United States Patent 9,303,079 (MODIFIED POLYNUCLEOTIDES FOR THE PRODUCTION OF CYTOPLASMIC AND CYTOSKELETAL PROTEINS) - sequence listing, part 13

SEQ ID NO: 23833 - DNA, 2346 bp, Artificial Sequence
  Description of Artificial Sequence: Synthetic coding sequence
atgggccagctgcgggactggttccccaacacccaggacctggccggtaacgatcaggaaaacatccgacacgctgataggaataattcggatgacaaccaccttgcctccgaggacacctccgcaaaacagtccgggaagccaggcatttacgaggacagagatcccttacgagtgtcaatatccagggaacagtcgttctttgggagcccccttgcccacgatccattcagttgccttcagctggttggacaggaaaatgtgtgtggtgatgactatgacgaagccgtgaaacttaaagaatcggttgtcgaaaatcatgctgtgctgagttatgcggtcgaagaggagcacgcctacctcggaccaaccgtgaaaccagacgataaggccaagacattatcctacgaacccctgagctccgccacggtgagtaccggtagcttactgtcttacgagaacaccgatctttctctgaccgatcccgaaagcttcagcgaacacatggacgactctaagcaggaaagcactacctctaaggaggaagaaacaaacataatctcctccatcgtcccttccacccaggatatctaccaaagacagaactcctcagatgttcacaaatcgctgcttccagctgtggatgagacaacatgcggccacacacatttccagcagatgatcgacaagtacatcaacgaggctaaccttatccctgaaaaaaccgacttgcaggagcttgaacatatttttcctaatctgcaccatcaacttttcaaacctttagagcctcaccctgactttgatctgagcagctcatccagcggcatatcaccagataacagggacttttatcaacggagtgacagctcaagtgagtcacactgtgccaccggtctctcaaagagcaccgtttatttcaccgccctcaggcgtacaagcatgcattcctccctcaacaccagccctaaccaacagcctgacactaatctcgcgcacgtgggggcacatagcttcgccaccgagaatatcattggcgggtctgagcagtgttttgaacagctgcaaccggagtactcatcgcaagaagagagtcagcacgctgatctgccaagcattttctccatcgaggccagggactccagccaaggcatgaagaaccagaattatccgtcagaagaacataccgaaatcttgcagaataaaaagaagattgtccatttccagctgtctatcggcaacctaagtagtgtatatagctcgagcgacgaggccaatgtgtttgaccagcttaacgtgcaacactcaactccatgtggatctaattctagcgaatgcagtacgaagcatcagcttgaatcccgcaaggaatcgatgggatttgaagaactaagtaagaggggcgttgtcactatgctgcagtcacaggggctgatcgaggacaataaaaatgagacctgccgggtgttggacatcaacccccaggtggaggagacagactctcggttgtgcgtgcgcacggtcgaaatgggaacttccatacaagccccttactccttaacaacacagaacgaaaagtacttcgaaaattctgccgaaactgatatccccaagatcacaaagaaactgtcccagctgggggaatccgagctgtttgctagcagcggctcgttctcacttcagagctccatccctgtttgggaaaccgaaaccggccacggcattatggaggaacccgaattaactctgatctcaacaaccgataccagcatagccgaaatggacttcgctaatctcaccctggaagagaaatctgaaaacgaggcaaaatgcttcttccaggtctcagaattcctgcccttggtgtccgcaaccgaagcctcagactatcctgctgtgagtgaactgagcatcgaaaagccccgcacagcgtctaccgagacacctaggaggcttacacccgtcccaggcagtttacaagaagcattcatcaagcgcaagaagtcttttatggagaggagccaccagaggcaaaaggagattaggaataagattcatgtgtctgagaactcccagatcaaaactgtaaaggaaaagccgtctatttcatcatcggtaagtcggttgaaaggagtaaataaggttagggcttccttcccagaagaccggaagaccactcaagcactgagacaccagagagggctccggctttacaatcagttagccgaagtcaagcagcaaaaagaggagaagactaagcaggaagcatacgcccagaaccgcgcgcgggctaaagaattccataagaagacacttgaaaagctgcgcgccaagaatacctgttag

SEQ ID NO: 23834 - DNA, 513 bp, Artificial Sequence
  Description of Artificial Sequence: Synthetic coding sequence
atgggcaagcggtacttctgcgactactgcgaccggagcttccaggacaatctccataaccggaaaaagcaccttaacggcctgcagcacctaaaagcgaagaaagtctggtacgacatgttccgagatgccgcggctatcctactggacgagcaaaataagcgcccttgtcgaaagttcctgctgactggccagtgcgatttcgggtcgaactgtcgcttctctcatatgagcgagcgggatctgcaggagctgagcatccaggtagaggaggagagacgggccagggagtggctgttggatgcccccgaactgcccgagggccacctagaggactggcttgaaaagcgagccaagcggctgtcctccgcaccctcaagccgagcggagcccattaggacgactgttttccagtaccccgttggctggccgccagtccaggaattgcctccgtcacttagggccccccctccgggcgggtggcctctccagccacgcgtgcagtggggttag

SEQ ID NO: 23835 - DNA, 1542 bp, Artificial Sequence
  Description of Artificial Sequence: Synthetic coding sequence
atggccagcgtgctgagccggcggctgggcaagcggagcctgctgggggctagagtgcttgggccatccgcaagcgaaggaccaagcgctgccccgccttctgaaccactgctagagggcgctgcgccacagccattcactaccagcgatgacacaccttgtcaagagcagcctaaggaagtgctgaaggctcccagcacctcagggctgcagcaggtcgcatttcagccggggcagaaagtctacgtgtggtacggggggcaggaatgcacaggcctggtagagcagcattcgtggatggagggtcaggtcacagtatggctgcttgagcaaaagttgcaagtatgttgtcgggtggaggaggtgtggctcgcagaattgcaaggcccttgcccccaggcgccccctctcgagccaggcgcccaggctctggcctatagacccgtgagcagaaatatcgatgtgcctaagcggaaaagcgacgccgtcgagatggatgagatgatggccgccatggtattaacatcactctcgtgtagcccagtggtgcagagcccacccggcaccgaggccaacttctcggcaagtcgtgctgcctgcgatccttggaaagagagcggagatatctctgacagcggctcgagcaccacgagcggccactggtctggctctagtggtgtgtctaccccttcaccaccgcacccacaggcttcccccaaatacctcggagacgcgttcgggtctccgcagacggaccacggattcgaaacggatcctgacccatttttgctcgacgaaccagcaccaagaaaacgaaagaactctgtgaaagtgatgtataaatgcctctggccaaattgtgggaaggtcttacggagcattgttggaattaaaaggcatgtgaaagcccttcacctcggggatacagttgacagtgaccaattcaagcgggaggaggatttctattacacagaggtccagctgaaagaagaatcagccgccgccgccgcagccgctgccgctggtacacccgtacctggcacacccacatcagaacctgctcctaccccaagcatgactggcctcccgctgtctgcactgcctcccccccttcacaaagcgcagtcaagtgggcccgaacaccccggaccagagtcaagcctgccctctggagcactctcaaaaagcgcaccggggtcgttttggcacattcaagctgatcatgcctaccaggctcttcccagcttccagattcctgtttcgcctcatatttatacttcagtgtcttgggctgcagcccctagcgcagcgtgttcattgtcacccgttaggtcccgatccctgtctttttcagaaccccagcagcccgctcccgctatgaagtcacacttgattgtcacatcacctcccagagcccagagtggtgccagaaaggcacgaggcgaagctaaaaagtgtaggaaagtctatggcattgagcacagagatcaatggtgtacagcctgccgctggaagaaagcatgccagcgtttcttagactag

SEQ ID NO: 23836 - DNA, 555 bp, Artificial Sequence
  Description of Artificial Sequence: Synthetic coding sequence
atgggcaacggcatgaacaagatcctgcccggcctgtacatcggcaatttcaaagacgcaagagatgcagaacagttaagcaagaataaagtgactcatatattaagcgtccatgactcagcacgccccatgctggaaggagtgaagtatttgtgtatcccagctgccgattctccttcgcagaatctgacacgccatttcaaagagtctattaaattcatccatgagtgtagactgcggggcgagagctgtttagtgcattgtctggctggggtgagtcggagcgtcaccctggtcattgcgtacattatgaccgttactgacttcggttgggaagacgcccttcacacggtcagggctgggaggtcttgtgcgaaccccaatgttggcttccagagacaattacaggaattcgagaagcacgaagttcatcagtataggcaatggctaaaagaggagtacggcgagtcccccctacaggatgcagaagaagccaaaaatattttagctgcaccaggtatcctgaagttctgggcatttctccgtcgcctctag

SEQ ID NO: 23837 - DNA, 642 bp, Artificial Sequence
  Description of Artificial Sequence: Synthetic coding sequence
atgctgcagctgcgggacagcgtggacagcgccggcaccagccccacagctgtcttggctgctggcgaggaagtcggagctggaggcggacctggaggaggaagaccaggagccgggactccattacgacagacgttatggccgttaagcatccatgatcctacccgaagagctcgagttaaagaatacttcgtgttcaggcccggatctattgagcaagctgttgaagagatacgcgtggttgttagacccgtcgaggatggggagattcagggtgtttggctgttaactgaacgtgaaggtttcgggattcgaatacaatgggataagcagtcgagaccttccttcataaacagatggaatccctggagcactaatgtcccgtacgctacattcactgagcatcctatggccggcgccgatgagaaaaccgcgagcttgtgtcagcttgagagcttcaaggcgctcctgattcaagccgtgaagaaggcccagaaggaatcccccctgccgggacaggctaacggcgtcttgatccttgaacggcccctgctgatcgaaacctacgtgggccttatgtccttcataaataatgaagcaaagctgggatattcgatgaccagagggaagattggcttttag

SEQ ID NO: 23838 - DNA, 888 bp, Artificial Sequence
  Description of Artificial Sequence: Synthetic coding sequence
atggagctgatccaggacaccagccggccccccctggagtacgtgaagggagtgcccttgatcaaatatttcgccgaggccctggggcccctgcagtcttttcaggcccgacccgacgacctacttataaacacttatccgaaatcgggcaccacatgggtctcccagatactagacatgatttatcaaggtggggaccttgagaagtgcaaccgcgcaccaatatacgtgcgggttccctttttggaagtcaacgatccaggagagccctccggacttgagacacttaaagatacccctcccccgaggctgattaaaagccatctgccccttgccctgttaccccaaacattgctagaccaaaaggttaaggtcgtttatgtggccaggaatcctaaagatgtggcagtgtcctactaccacttccatcgaatggaaaaggcccaccccgagccaggaacgtgggactcattcctggaaaagtttatggcaggagaagtgtcatacggatcctggtatcagcatgtacaggagtggtgggagttatcgaggacgcacccagtgctgtacctattctacgaggatatgaaggaaaaccccaagagagagatccagaagatactcgaattcgtgggtaggagtctgccagaggaaactatggattttatggtgcaacacacgtcatttaaagagatgaagaaaaaccctatgacaaattatacaacggtgccacaggagctgatggaccattccatttcccccttcatgcgcaaagggatggccggcgactggaagacgaccttcaccgtggcccaaaatgagagattcgatgcggactatgcagagaaaatggctggatgcagcctcagcttccgatctgaattatag

SEQ ID NO: 23839 - DNA, 3867 bp, Artificial Sequence
  Description of Artificial Sequence: Synthetic coding sequence
atgccccggaagggcacccagcccagcaccgcccggcggcgggaggaagggccccccccccctagccccgacggtgcatctagtgatgctgagccggagcccccatcagggagaactgagtcccccgcgactgcagcggaaacggcgtctgaggagctcgataacagatccctggaagaaatcttgaattctatcccaccccctccaccacctgcgatgaccaatgaggccggcgcaccacggctcatgattacccacatcgtcaatcaaaatttcaagagttacgcaggcgaaaaaatactcggaccatttcataagagattctcttgtattattggtcccaacgggagtggtaagtcaaacgtgattgatagcatgctattcgtgtttgggtatagggcgcaaaaaatccgttcgaagaagttatccgtgctcattcataattccgatgagcacaaagatatccaaagctgcaccgtcgaagtccacttccaaaaaatcatcgataaggagggagacgattatgaggtgatcccgaactccaatttctacgtcagccgaactgcgtgtcgtgacaacacgagtgtctaccatatcagtggcaagaagaagacattcaaggacgtcggtaacctgctgagatcccatggaattgatcttgatcataacaggtttctcattctccaaggcgaagtggagcagatcgcaatgatgaaaccaaagggacaaacagagcatgacgaggggatgctagaatacctggaagacattatcggttgtggcagactcaacgaacccataaaagttttgtgcagacgcgtggagatactcaatgagcaccgcggcgaaaagctgaaccgtgtaaaaatggtagaaaaagagaaggacgcacttgaaggtgaaaagaatatcgcaatagagtttctgacacttgaaaacgaaattttccgaaagaaaaaccacgtctgccagtattacatatatgagctgcagaaaaggattgccgaaatggagacacaaaaagagaaaattcatgaggataccaaggagatcaatgagaagtctaacatcctgtctaatgaaatgaaggccaagaacaaagatgtgaaagacaccgagaaaaagctaaacaaaataacgaaattcatcgaggagaacaaagagaaattcacgcagcttgatctcgaagacgtgcaagtgcgggaaaaactgaaacacgccacgagtaaggccaaaaaactggagaagcaacttcagaaggacaaggagaaagtagaagaatttaaaagcattccggccaagtctaacaacatcataaacgagaccacaacccggaataacgcactagagaaggagaaggagaaggaggagaaaaagctgaaagaggtgatggactccctcaagcaggagactcaaggactgcagaaggaaaaagagagcagagagaaagagctgatgggatttagcaagtctgtgaacgaggcaaggtccaagatggacgtggcgcagagcgagctagacatctacctgagccggcataatacggccgtttcccagctgacaaaggccaaagaggcactcattgcggcatccgaaacactgaaggaaagaaaggccgctatccgagacattgaggggaagctcccacagaccgaacaggaactcaaggaaaaggagaaggaattgcagaagctcactcaggaggaaaccaacttcaagtccttggtgcacgatctgttccagaaggtggaggaggctaaaagctctctggcaatgaaccgatcccggggaaaggtattggacgcaatcatccaagaaaagaaatctggaagaattcccggcatttatggccgactgggagacctcggcgccatcgacgagaaatatgacgtagcaatctcaagctgctgccacgcgcttgactatattgttgtcgactcaattgatattgcgcaggagtgtgtcaacttcttgaagagacagaacattggcgtggcaacctttattggtctggataaaatggctgtgtgggccaagaagatgactgaaatacaaacgcccgaaaacaccccgcgcctgttcgatctagttaaagttaaagatgagaagatccgacaagccttttactttgctctgagggacacgctggtcgccgacaatttggaccaggctacgcgcgtggcttatcaaaaagatcgtcgctggcgggtagtgaccctgcagggccagatcatcgagcagagcggaaccatgaccgggggaggatccaaggtgatgaaagggcggatgggtagctctctggttatcgaaatatctgaggaagaagtcaataaaatggaatcacaacttcagaacgattctaaaaaggccatgcagatccaagagcagaaggttcaattagaagagcgggtagttaagcttaggcacagtgagagggaaatgcggaacacgcttgaaaagtttactgcctccatccagaggctgattgagcaggaagagtatctgaacgttcaagtgaaagagctggaggcgaacgtcctggctacagcgcccgacaagaaaaaacagaagctgctcgaagagaacgtgagtgcctttaagaccgaatatgacgccgtcgccgaaaaagcaggcaaagtggaggctgaagtcaagcgtctacataacactatagtggaaatcaataatcacaaactgaaggctcagcaagataagctcgacaagatcaataagcaactcgacgagtgcgcctccgccataacaaaagcccaggtagcgatcaaaaccgcggaccggaatctgcaaaaggcccaggattccgtgctccgcacagaaaaggaaattaaggatactgagaaggaagtggatgatcttaccgctgagttgaagtcactagaagacaaggccgccgaggttgtcaaaaacactaatgcggcagaggaaagcctgcctgagatccaaaaggagcatcgtaacttgttgcaggaactcaaggttattcaggagaacgaacacgcccttcagaaggacgccttgtcaatcaagctgaaactcgagcagatagatggccacatcgctgagcacaactctaagatcaagtactggcacaaagagatcagtaagatatcactccaccccatcgaggataatcccatagaagagatttcggtgctctccccagaggacctcgaggcaattaagaacccagactccatcacaaaccagattgcactcttggaggcacgctgtcacgaaatgaagcccaatctgggtgccatagctgaatataagaaaaaagaggagctttatttacagcgagtcgcagaactggataagatcacgtacgagcgagactcctttaggcaggcctatgaggatctacgcaaacagcggctgaacgagttcatggcggggttttatataattaccaataagctgaaggaaaactaccagatgttgactctggggggggatgcggagctggaactcgtcgatagcttggacccattcagcgagggtattatgttctccgtgcgccctcccaaaaagtcctggaagaagatcttcaacttatccggaggcgaaaagaccctgagcagcctggcactggtatttgctctgcaccattataagcccacacctctgtacttcatggacgaaatcgacgccgccctagatttcaaaaatgtatcaatagtggctttttacatttatgaacaaacaaagaatgctcagttcatcataattagtctcaggaacaatatgttcgagatatcagaccgcctgattgggatctacaagacttacaatatcaccaagagcgtcgcagtgaaccccaaagagatcgcctccaaagggctgtgctag

SEQ ID NO: 23840 - DNA, 2856 bp, Artificial Sequence
  Description of Artificial Sequence: Synthetic coding sequence
atgctgggcagcatggcccggaagaagccccggaacaccagccggttaccactcgcactcaaccctctcaaatcaaaagacgttctggccgtccttgcagagaggaatgaggccatcgtgcctgtgggggcttgggtggaaccagcaagtcctggctccagcgagataccagcctacacttcagcgtacctaattgaagaggagctcaaggaacagcttcggaaaaaacaggaggccttaaagcatttccagaagcaagtgaagtatcgtgttaaccaacagattcggctccgtaagaagcagcagctacagaaatcttacgagagagcgcagaaggaaggctctatcgcgatgcaatctagcgccacccatttaacttcaaagagaacatccgtgtttccaaataaccttaacgtggctattgggtcctcacgcttgccacccagtctaatgcccggcgatggcatagaggacgaggaaaaccagaatgaactcttccagcaacaagcccaggccctgtctgaaaccatgaagcaggcccggcacaggctggcatcattcaaaacagtgatcaagaagaaaggcagcgttttcccggacgacggccgaaaatctttcttgaccagagaagaagtacttagcagaaagcccgcttcaactggcatcaacacaggcatcagaggggaattacctattaaggtgcatcaaggcctgctggcagcagtgccttatcagaattacatggagaatcaggaactcgattacgaagaacccgattacgaagaatcttctagcctcgtcacagatgagaagggcaaagaggatctgttcgggcggggccagcaggaccagcaagcaatacactctgaagacaaaaacaagccattctctcgagtgcagaaagtgaaatttaaaaaccctctttttgtgctaatggaggaagaagagcaaaaacaactgcacttcgagggcttgcaggacatactcccagaggcgcaggattactttttggaggctcagggcgatctgctggagacccagggggacctgacggggatccagagtgtgaagcccgacactcaagccgtggagatgaaagtgcaggttactgagcctgagggccaggcgattgaacctgaggggcagcccatcaagaccgaaacccagggaataatgcttaaggcccagtcgattgaactcgaggagggcagtatagttctaaaaacgcaggactttctcccaacgaaccaggcactcctcaccaagaaccaggatgttcttcttaaggaccactgcgtcttgccaaaggatcagtccatattactgaaatatcaggatcaggatttcctccctcgcgatcagcatgtgcttcacaaggatcaagatatcctgcccaagtaccaggaccagaacttccttcccaaagatcaaaatttcctcagcagggaccaacatgtgcttcctaaagatcaggacatcttacccaaataccaggaccaaaattttctgcccaaggaccagaatttcctttcacgcgaccaacatgtgctgcccaaggaccagaacatcctccccaaataccaaggtcaggacttcttgcctaaagaccaggacttcctgtctagggaccagcacgtcctgccaaaggactggaatattctgcctaagtgtcaggatcaagactttttgccacgcgatcagggtgttcttcctaaagatcagaacatactgcccatctgccaagaccaggatttccttccccgcgaccagggatacttgcctaaagatcagaatatactgccgatctgtcaggaccgtgatttccttccgcgggacctgcacgtgctttcaaatgatcaaaacatccttccgaaatgtcaagatcaggatttcctccccaagtaccaaaaagttcacttcaaagagccatattctgacatgacggatgaaaaaggacgcgaagacttcagtctggctgactaccagtgtttgccccccaagtcacaagaccaagatgatatcaagaaccaacagcctgcttccttcatgcgcgaagagcgagttcgcgaagagctccctctggattaccaccaatatgtggtgcccaaaattcaggatcaggatagcccgagggagcagaacaaacacataaagttgccatcatcctttgaaaagtgggaaatcgcacgcggaaatacccccggagttcccctggcatacgacaggtaccagtccggactcagtacggagttccaggccccattagcattccagagtgacgtggataaggaggaagacaaaaaggagagacagaagcaatacctcagacatcggcggttatttatggatattgaaagagaacaggtaaaagagcagcagcgccagaaagagcagaaaaagaagatcgaaaaaataaagaagaagcgcgaacaggaatgttacgccgcggaacaacggattctgcggatgaattttcacgaagatccatatagcggggagaaactgagcgagattctcgcgcagttacagctccaagagatcaaaggtacacgggaaaagcagcagagggagaaggaatacctgaggtacgttgaagctctaagggctcagatacaggaaaagatgcagctctataatattactctgccccccctgtgctgctgcggccccgacttttgggatgctcatcctgacacctgcgcaaataactgtatcttttacaagaatcaccgcgcatacaccagagcgttgcattctttcatcaattcctgtgacgtacccggagggaactccacactgcgcgttgccattcacaatttcgctagtgcacacagaaggaccttgaagaacctttag

SEQ ID NO: 23841 - DNA, 1248 bp, Artificial Sequence
  Description of Artificial Sequence: Synthetic coding sequence
atgagccccgaggtggccctgaaccggatcagccccatgctgagcccgtttatcagcagcgtggttcggaacgggaaggtgggacttgacgcaactaattgcctccgcataactgatctgaaatccggctgtaccagcttaacccctggcccaaactgcgatcgcttcaaactgcatatcccgtacgctggcgagacgttgaagtgggacattatctttaatgcacaatatcccgaactccccccagactttatattcggcgaggacgcggagtttctgcctgaccccagcgctttgcagaatcttgcctcctggaaccccagcaatcctgagtgcttgctcctcgtggtgaaggaacttgtacagcagtaccatcagttccaatgctcccggctcagggagagctcaagattgatgtttgaataccaaacacttttagaagaaccacaatatggtgagaatatggagatctatgctggaaaaaaaaacaattggaccggagaatttagcgcaaggtttctgctgaaactacctgttgacttttcaaacatccctacctacctgcttaaagacgtgaatgaggaccctggcgaggatgtggcgcttctctctgtgagcttcgaagatacggaagccacgcaggtgtatccaaagctctacttgtcgcctcgaatagagcatgcccttggcggctcatctgctttgcacattcctgctttcccaggaggtgggtgtcttattgattatgtgccccaggtttgccatctactgacaaataaagtgcaatacgtcatccagggttatcacaaacggcgggagtatatcgcagcatttctctctcacttcggcacgggggttgtggaatacgacgccgaggggttcaccaagctgaccttacttcttatgtggaaagatttctgcttcttggtacatatcgaccttccactcttcttccccagggatcaacccaccctcacattccaatcggtgtatcacttcaccaatagcggacagctatactcccaagcacaaaaaaactacccttactccccaagatgggatgggaacgagatggcgaaaagagccaaaggatgccaggggtcaagggacgcatgctcgccatgggagcaggtcttagcttttgccgtggcgaagacgggatgtaagctgctgcagccccaaagaaattggccctcttctcgggggccaccctggagggcatcggagggcgagaggaccgcgcagtag

SEQ ID NO: 23842 - DNA, 903 bp, Artificial Sequence
  Description of Artificial Sequence: Synthetic coding sequence
atgctgagcgccgtggcccggggctaccagggctggttccacccctgtgcccgcctgagtgttcgaatgagctctactggtattgatcggaaaggtgtgctggccaacagggttgcagtcgtcaccgggagcacgagtgggatcgggttcgcaatcgcccgcaggctggcacgtgatggtgcccatgtagtaatctcttcccgaaagcagcagaatgtggatagggctatggccaagctgcaaggcgagggcctgtcagtagcgggcattgtatgccacgtcgggaaggccgaggatcgcgaacagctcgttgctaaggcgttggaacactgtggtggagttgattttctagtctgctccgcgggagtcaatcccttggtgggaagtaccctgggcacatccgaacaaatctgggataaaatactaagcgtgaacgtgaagtctccagccctgctccttagccagctcttaccctatatggagaataggcgcggagccgtcatcctggtttcatccatcgccgcctacaatcccgtcgttgcactcggagtctacaacgtctcaaagacggctcttctcggcctgacccggacacttgcacttgagttagcgccaaaagatatccgtgtgaactgcgtggttcctgggatcatcaagactgatttcagcaaggtcgtcaggattggctttatggggatgtctctcagcgggaggacgagtcgaaacatcataagttgtcgcggcctgggaagtcagcgaaccgttcaggaaagctgccctagctgcgccttgcaaatgcccgccaccagtacaggcagaaccctgcgatggcaggccacacccctgggttccgagcgcagtggcggaggctgcgtcgcagtggtgcccggcccaggtgcttag

SEQ ID NO: 23843 - DNA, 1014 bp, Artificial Sequence
  Description of Artificial Sequence: Synthetic coding sequence
atgcggttcgacaccctgtgggagaacaagctgatgcagagccgggccgtggacggctttcactctgaagagcagcagttactgctacaggtccagcagcagcaccaaccccagcagcagcagcaccaccatcaccaccaccaccagcaggcccagccccaacagactgtcccccagcaggcacagacccagcaggtgttaattcccgcatctcagcaggctaccgccccacaggtaatcgtcccagacagcaaattaattcagcatatgaacgccagtaacatgtctgcagcagccactgcagctacattggcgttacctgccggggtaacaccagtgcagcaaattctgacaaatagcgggcagctcctccaggtggtgcgcgctgcgaatggcgcccagtacatcttccagccgcagcagtctgtcgtgctgcagcagcaggtgatcccgcaaatgcagccaggaggtgtccaagcgcccgtaatacaacaggtcctcgcaccgttacctggaggcatatcaccccagactggggtgattattcagccacagcagattctgtttaccggcaataaaacgcaggtgatcccaacaaccgtggccgccccgacccccgcacaagcacaaattacggccacaggacagcagcaacctcaggcccagcctgcccagactcaggcccctctcgtcctccaggtggacgggaccggtgacacatccagtgaggaggacgaagatgaagaggaagactatgacgatgatgaagaggaagataaagaaaaagacggagccgaggacggacaagtggaagaggaaccacttaatagtgaagacgacgtgagtgacgaggaagggcaggaactgtttgatactgaaaatgtggttgtatgccagtacgacaaaatacaccgaagtaagaacaagtggaaatttcatttaaaagacggaataatgaatctgaatgggagggactatatcttctctaaagcaattggggacgcagaatggtag

SEQ ID NO: 23844 - DNA, 282 bp, Artificial Sequence
  Description of Artificial Sequence: Synthetic coding sequence
atggcccagagcggcggcgaggcccggcccggccccaagaccgccgtgcagatccgcgttgcgattcaggaggccgaggacgtggatgagttggaagacgaagaggagggcgccgaaacccggggtgctggggatcctgcccggtatctaagcccaggatggggatcggccagcgaagaggagcccagccggggccaccggaatcgttcgtctgtgaatagcaggactatgttggctagtttcatcgtgtcctcagcgccaagcaccgcacctagtacatag

SEQ ID NO: 23845 - DNA, 255 bp, Artificial Sequence
  Description of Artificial Sequence: Synthetic coding sequence
atgaaggtgaagatcaagtgctggaacggcgtggccacctggctgtgggtagcaaatgacgaaaattgtggaatctgtcgcatggcatttaatggttgctgtcccgactgcaaggtgcccggggatgactgtcccctggtgtggggtcaatgctcgcattgttttcatatgcactgtatcttgaaatggctccacgctcagcaagtgcagcagcattgccctatgtgccggcaggagtggaagttcaaggaatag

SEQ ID NO: 23846 - DNA, 612 bp, Artificial Sequence
  Description of Artificial Sequence: Synthetic coding sequence
atggcccacgtgagcagcgagacccaggacgtgagccccaaggacgagcttacagcctccgaggcaagcacccggtcaccattgtgtgagcacacctttcccggcgattccgacctccggagtatgatcgaggagcacgccttccaggtactatcacagggcagtttactcgagagtccatcctacacggtgtgcgtgtccgagcccgataaggacgacgattttctgagtctgaactttcccagaaaactgtggaagattgttgaaagcgaccagttcaagagcatttcgtgggatgaaaatgggacctgcatcgttataaatgaggaacttttcaaaaaagagattttagagaccaaagctccgtaccgaatcttccaaacggacgcaatcaaaagcttcgtgcgacagctgaatctctatggtttcagcaaaatccagcagaatttccagcggagtgcattcctggctacattcttaagcgaagaaaaagaaagctctgtgctcagtaagatacgatttacaaagatgaaattgtccagaagcagtacatacgagaatcggtatctctgttgcaacctacatctgaaggacgagtccaattactcatag

SEQ ID NO: 23847 - DNA, 1794 bp, Artificial Sequence
  Description of Artificial Sequence: Synthetic coding sequence
atgcccagcccccagctgctggtgctgttcggcagccagaccggcacagcccaggatgtttcagagcggctcgggagggaggcaagaagaaggcgcttgggctgtagagtccaggccctcgactcctatcctgtcgtgaatttaataaacgaacccctcgtgatcttcgtatgtgctacaaccggccagggcgatccgccggataatatgaagaatttctggcggtttatattcaggaagaacttgcccagcacagccctttgtcagatggactttgcagtcctgggtcttggggattctagttacgcaaagtttaatttcgtcgcaaagaaactgcacagaaggctgctgcagctaggcggctctgcacttctccccgtgtgtttaggagatgatcaacacgagttgggtccagatgcggcagtcgacccgtggctccgtgacctatgggatcgtgtccttggcctttatccaccgcccccaggcttaaccgaaatccctcccggcgtacctctgccctccaaattcactctgttattcctgcaagaggctccttccactggatcagagggccagagggtggcgcatccagggtcacaggagccacctagcgagtcgaagcctttcttagcaccgatgatcagcaaccaacgtgtaactgggccatctcatttccaggacgtgcgtctcatagaatttgatatcctcgggagcggaatctccttcgctgccggcgacgtcgtcctcatccagccgagtaatagtgctgcccatgtgcaaagattttgccaggtcttaggactcgatcccgatcagctgtttatgttgcagcctagagaacccgatgttagctctcccaccaggctcccccagccatgctcaatgagacacctggtatctcactaccttgatatcgcctctgtcccgcggcggagcttctttgaactgctggcttgtctgtccctgcacgaactggaacgcgaaaagcttttggagtttagcagcgcccagggtcaagaggagctgttcgagtactgtaatagacctcgtaggactattctggaggttttgtgcgattttcctcacaccgccgcagcgatacctcccgattatctgctggacctcatccccgtgataagaccccgtgcattttccatcgcttcttctctgctaactcacccctctaggctacagatcttggtggccgtggtccagttccagacacgcctgaaggagccaaggcgcgggctgtgttccagttggctggccagtctggaccctgggcaagggcccgtacgagtgcctctgtgggtaaggccaggttccctcgcttttccagaaactcccgacactcccgtgatcatggtcggcccgggcaccggggtcgccccctttcgcgccgctattcaggagcgggtggctcaagggcaaaccggcaacttcctgtttttcggatgccggtggagggatcaggatttctactgggaggcagagtggcaagagctggaaaagagggactgtctgaccttgatccccgcttttagtcgcgagcaggagcaaaaggtctatgttcagcacagactccgggagttgggctcccttgtatgggagttacttgacagacaaggtgcctacttctatctggcaggaaacgcaaaaagcatgcctgctgacgtctctgaagcattaatgtccatctttcaggaggagggcggactgtgttctcctgatgccgctgcctacctcgcacgcctgcagcaaacaaggcgttttcagaccgaaacgtgggcgtag

SEQ ID NO: 23848 - DNA, 1860 bp, Artificial Sequence
  Description of Artificial Sequence: Synthetic coding sequence
atggacgaccagcaggccctgaacagcatcatgcaggacctggccgtattgcataaagcatcacggccagccctgtccctacaggaaacgagaaaagctaagtcctcatcccccaaaaagcagaatgacgttagagtgaagttcgagcatcggggggagaaaaggattttgcagtttcctcggcctgtgaagttggaagatctgaggtctaaagccaaaatcgcatttgggcaaagcatggaccttcactacacaaataatgaactggtgatccccctcacgactcaggacgatctggataaagccgttgaattgcttgataggtccatccacatgaaatccctgaaaatattgctggtcattaacggttcaacgcaagctactaatctggagcctctgccctcactcgaggacctggacaacacagtcttcggtgccgagcggaaaaagcgcctgagcatcattggcccaaccagtagagaccgcagtagtccccctcctggatacataccggacgaattacaccaggtggcccgaaatgggtcattcaccagcatcaactccgaaggcgagttcatccccgagtctatggatcagatgcttgaccccctttcactgtcatcacctgagaatagcggaagcggatcatgcccatctctggattctcctctagacggagaatcatacccgaaatcccggatgccaagggctcagtcatatcccgacaatcaccaggagtttagcgattacgacaaccctatattcgagaagttcggaaaaggcggcacttaccccagaaggtaccacgtcagctatcatcatcaggagtacaacgacggcagaaagacatttcctcgagcgcgccgcacacagggcacttctcttcgctcccctgtctcttttagccccaccgatcactcactaagcacatcctcgggctctagcatctttacgccagagtacgatgattctaggattaggagacgcggctcggatatcgataatccaacactgaccgtgatggatatatcccctcccagccggtcacctagagccccaaccaactggcgtctcggaaaactgctgggacagggagcattcggtcgagtgtatctttgttatgatgttgacacaggcagggagctggccgtgaagcaggtgcagtttgaccccgacagtccggaaacttctaaagaggtaaacgccctggaatgcgagatccaattacttaaaaaccttctacatgagagaatcgtccagtactacggttgtttacgggatccacaggagaagacactgtccatttttatggagtatatgcccggagggtccatcaaggatcagctgaaggcttatggcgcgctcaccgaaaatgtgacaagaaaatacacacggcaaatcctggaaggcgttcattatttgcattccaacatgatcgtgcatcgcgatattaagggcgctaatatcttgcgcgactcaactggtaacgtgaaactcggagattttggtgccagcaaaagactgcagactatttgcttgtccgggacggggatgaagtccgttacaggtacaccatactggatgagccccgaagtgattagtggagaaggctatggcagaaaggccgatatatggtccgttgcctgtactgtggtcgaaatgctcacagagaaaccaccttgggccgagttcgaggccatggctgccatttttaagatcgccacccaacccaccaaccctaaactccctccccatgtctccgattatacgcgtgattttctcaagcgcatttttgttgaggcaaaactgcgcccgtctgcagacgagctcctccgccacatgtttgtgcattaccactag

SEQ ID NO: 23849 - DNA, 828 bp, Artificial Sequence
  Description of Artificial Sequence: Synthetic coding sequence
atgagcaccatcggcagcttcgagggcttccaggccgtgagcctgaaacaggagggtgacgaccagccttcagagacagaccatttgtcgatggaggaggaagacccaatgcctcgccagatttccagacagtcctctgttactgagtccacactttacccaaacccctaccatcagccctacatcagcaggaagtattttgccacaaggccaggagccattgagaccgccatggaagatcttaagggtcacgtggcagagacctccggggaaaccattcagggcttttggctgctcaccaagattgaccattggaacaacgaaaaggagcggattctacttgtgactgacaagactctactaatttgcaagtatgatttcattatgctctcatgcgttcaactgcagcggatccctctctccgcagtgtatcgtatctgtcttgggaagtttacgtttcccgggatgtccctcgacaaaaggcagggcgagggtctgagaatctattggggttctccagaagaacagtcgctgctgtccagatggaatccgtggtccacagaagtgccctatgcaacgtttacggagcaccctatgaaatataccagcgagaaatttctggaaatatgcaaacttagcggatttatgtccaagctcgtgcctgctatacagaacgcccataagaattctacgggctcagggaggggcaagaaacttatggtgttaaccgagccaatcttgatagagacatatactggcctgatgtcctttatcggcaacaggaacaaattgggatatagccttgccaggggcagcatcgggttttag

SEQ ID NO: 23850 - DNA, 1629 bp, Artificial Sequence
  Description of Artificial Sequence: Synthetic coding sequence
atggccgccgccgccggcgccgccgccgcccccggcagccgggagcctcaggaccgcccagaatgcggagccggccaccccgggccccgctattaccggcaccctgagaggtggttgctgaggccagaagcctttctaggacctctgaggactagagccccctccgcagaagatagccagagggagaggcctgctgccagatcaggacctgcgatgtctcggcgggtggtgaggcagagcaaattccgccacgtatttggtcaggccgccaaagctgatcaggcctatgaagatatccgagtgagcaaagtgacatgggattcaagcttctgcgcagtcaatcccaagttcctagccattatcgtagaggcaggcggtggtggcgccttcatcgtcttgcccctggcaaagacagggcgggtcgataagaattatcctctggtgactggacatacagctccagtgctggacatagactggtgcccgcataatgacaacgttatcgcgagcgcctccgacgatactacaattatggtgtggcagatcccggactacacaccaatgcggaacattaccgagccgataattacactagagggccactcaaagcgcgtgggaattctttcatggcatccaaccgcccgcaatgtgttacttagcgcaggcggggacaacgttatcattatctggaacgtggggacaggagaggtacttctgtctctggatgacatgcatcccgacgtgatccattctgtttgttggaattcaaacggatctctcttggcaactacttgcaaagataaaacactccggattatagaccctcggaagggtcaggtggtggcagaacgttttgcagcacatgaagggatgcgtcctatgcgcgccgtattcacgcggcaaggacatatcttcaccaccgggtttacacgtatgagccagagggaactaggtctgtgggatccaaacaactttgaggaacccgtagcactgcaggaaatggacacatccaatggggttcttttacccttctatgatcctgacagctcaatcgtgtatttgtgtgggaagggcgacagcagcattcgttacttcgaaattactgacgagcctccctttgtccattatcttaacacgttcagctcaaaggaaccgcaaagaggtatgggtttcatgccgaagaggggtcttgatgtgagcaagtgcgagattgccagattctacaaactgcatgaacggaagtgtgagcccataattatgacggttcctagaaaaagcgatctgtttcaagacgacctgtatccagatacacccgggcccgagccagctcttgaggccgatgaatggttatcagggcaggatgcagaacctgtgcttatctctttgagagacgggtacgtgcctccaaagcaccgggagttgcgggttaccaagcggaacatcctcgacgtcagaccgccttcggggccccgtagatcccagtccgcctcagatgccccactgtctcagcatacactagaaacactgctggaggagatcaaagccctgcgggagagagtgcaggctcaggagcagcggattacagccctggaaaacatgctttgtgagctggtggacggtacagattag

SEQ ID NO: 23851 - DNA, 2550 bp, Artificial Sequence
  Description of Artificial Sequence: Synthetic coding sequence
atgagcgacacccggcggcgggtgaaggtgtacaccctgaacgaggacagacagtgggacgaccgggggacggggcacgtgagttcaacctacgtggaagagctcaaagggatgtccctgttagtgcgcgccgaatctgacggtagtctgctcctagaatcgaagatcaaccccaacacagcctatcagaaacaacaggacacgctgatcgtctggtctgaagctgagaactacgatctggccctgtcttttcaggagaaggctggttgcgatgagatatgggaaaagatatgccaggtgcaaggcaaggacccctcagtggaagtgacccaggacctgatcgatgaatctgaagaggagcgctttgaagagatgccagaaacctctcacctcatcgatctgcccacgtgtgaactgaacaaacttgaagagattgctgatcttgttacttcggtgttatccagccctatacggagagaaaaactggcattagcattggaaaatgagggttatataaaaaagctgctccagctgtttcaggcatgcgaaaacctcgagaacaccgagggactccaccatttgtatgagatcatccgcggcattctgttcctgaacaaagccaccctctttgaagtaatgtttagtgacgaatgcataatggacgttgtaggctgccttgagtacgatccagccttagcccagcccaaacgccaccgcgagtttctcactaagaccgccaaatttaaagaagtgattcccattactgatagtgaactgaggcagaagatccatcagacctacagggtccagtacatccaggatatcattctgcctactcctagtgtcttcgaagagaattttttaagcacgcttacttcctttattttcttcaacaaggttgagatcgttagcatgctgcaggaagacgaaaaatttctgtctgaagtgttcgctcagttgactgatgaggccaccgacgatgacaaacgacgggagttagtgaacttctttaaagagttttgcgcattttctcagaccctccagccccaaaacagagacgcgttctttaagacactcgctaagcttggaatcctcccagccctggaaatagttatgggcatggacgacctccaggtgcgatccgctgctaccgatattttttcctacctggtggagttctctccttctatggtgagggagttcgttatgcaggaggcacaacagtctgatgacgacattctgctcattaacgtcgtcattgagcagatgatctgtgacaccgatcccgaactcggcggggcggttcaactcatgggactgctgagaaccctgatcgacccagagaatatgctggctacaacaaataaaaccgaaaagtccgaattcctgaactttttttacaatcattgcatgcatgtgctcactgctcccctcctgaccaatacttccgaggataagtgtgaaaaggactttttcttgaagcactacagatacagctggtcgtttatatgtactccctcgcactcccactctcatagtactccctcctcatcaatttctcaggataatatcgtaggatcgaataaaaacaacaccatctgccccgacaactatcagaccgcccagctgttggctcttatactggaactcctaacattttgtgtggagcatcatacttaccacatcaagaattacattatgaataaggacctgctaagacgggtgctggtgctaatgaattcgaagcatacattcctcgcattgtgcgctctcagattcatgaggcgcatcattggactgaaggacgaattctacaacagatacatcaccaaaggtaacttgttcgaaccagtaataaacgcccttctggacaatgggactaggtacaatttgctaaattctgccgtgattgaactgttcgaattcattagagtggaggacatcaagtctctgaccgcccacatcgtcgaaaacttttacaaagctctggaatccattgaatatgtccagacctttaagggcctcaagacaaaatacgagcaagaaaaggatagacagaaccaaaaactgaatagcgtgccgtcaatccttaggtctaacaggttcaggcgagatgctaaggccctcgaagaggacgaggagatgtggtttaacgaggacgaggaagaggagggtaaagccgtggttgcccctgtggagaaaccaaaacctgaggatgattttcccgataactacgaaaagttcatggaaactaagaaagctaaagaaagcgaggacaaagaaaatttacctaagagaaccagcccagggggcttcaaattcactttctcccactccgcttctgcggccaatggaacgaatagtaaatcggttgtggcgcagatccctcctgccacaagcaacggctcctcgagtaagacaactaatctacccacgtctgtaactgctaccaagggttcactggtcgggttggtggattatcccgatgacgaggaagaggatgaggaggaagaaagttccccacggaaaaggccgagacttgggagctag

SEQ ID NO: 23852 - DNA, 669 bp, Artificial Sequence
  Description of Artificial Sequence: Synthetic coding sequence
atgggcgacatccccgccgtgggcctgagcagctggaaggccagcccagggaaggttacagaggcggttaaagaagctattgatgcgggctataggcacttcgattgcgcctatttctatcacaatgagcgcgaggttggggctggcatacgctgcaaaatcaaagagggagctgtccgacgcgaggatctgtttatcgcaacaaagttatggtgcacatgccacaaaaaatcactcgtagaaacagcctgtaggaagtcacttaaagccctgaagttaaattatctcgatttgtacctcattcattggcccatggggtttaaaccccctcaccccgaatggatcatgagttgttccgaactgtcgttctgcctgtcccaccctagagtccaggatctgccccttgatgagtctaacatggtgatacccagcgacactgactttctggatacctgggagattctcattcgcttccagatccagcgaaatgtgatcgtaattcctggatccattacaccctcacacatcaaggaaaatattcaggtgttcgacttcgaactaacccagcatgatatggataacatccttagcctcaacaggaacctccgcctggcgatgtttccaataacaaagaatcataaggactatccctttcacattgagtactag

SEQ ID NO: 23853 - DNA, 1080 bp, Artificial Sequence
  Description of Artificial Sequence: Synthetic coding sequence
atgcccaaccccagcagcaccagcagcccctaccccctgcccgaggaaatcagaaatctgctggcagatgtagagaccttcgtcgcggatattttgaagggtgagaatctatccaaaaaggcaaaggaaaagcgagaatcgctaatcaagaagattaaagacgtgaagtcaatctacttgcaggagtttcaagataagggggacgcggaagatggcgaggagtatgacgatccgtttgccgggcccccggacaccataagtcttgcctcagaaaggtacgataaggatgacgaagccccgagcgacggcgctcaatttcctccaattgcagcgcaggaccttccattcgtgctgaaggcaggctacttagaaaagcggaggaaagatcactcattccttggatttgaatggcagaaaagatggtgtgccctgtctaaaacagtcttttattactatgggagcgacaaagacaaacaacagaagggcgagttcgcaattgatggctacagtgtgcgtatgaataacaccctgcgcaaagacggcaaaaaagactgttgttttgagatcagtgcccctgacaagagaatataccagtttaccgcagcctcccccaaagatgcagaggagtgggttcagcaactgaaattcgtcttgcaggacatggaatccgatattattcccgaagattacgacgagcgcggagagctttacgacgatgtagatcatccactcccaatcagtaatcctttgacctctagtcagcctattgatgatgagatttacgaggaactccccgaagaagaggaagactctgcacccgtaaaggtggaagaacagcggaaaatgtctcaagatagtgttcatcacactagtggagataaaagtacggactacgccaatttctaccagggcctgtgggattgcactggtgcattttccgatgagctgagctttaagcggggtgatgtgatctacattctaagcaaggagtataacaggtatggctggtgggtgggggaaatgaagggtgcgatcggactcgtgcccaaagcctacataatggaaatgtacgatatatag

SEQ ID NO: 23854 - DNA, 1227 bp, Artificial Sequence
  Description of Artificial Sequence: Synthetic coding sequence
atgaagtgcgagcactgcacccggaaggagtgcagcaagaagaccaaaaccgacgatcaggaaaacgtgtcagcagacgcaccttctcccgcacaggagaacggagaaaaatgcgacactagtaagcataaggtgctcgttgtatccgtgtgtccgcagagcctgccttatttcgccgctaagttcaaccttagtgtgaccgacgcaagtcggcggctgtgcgggttcttgaaatccctgggggtccactatgtgtttgatacaaccatcgccgccgactttagtatcttagagagtcaaaaggaatttgtgcgtcgctaccggcagcatagcgaagaagaacggaccctccctatgttaactagcgcttgtcccggctgggtgaggtacgcagagagggttctgggaaggcctatcacagcacacctgtgtacagcaaagtctccacaacaggtgatgggaagcttggtgaaagattattttgctcgtcagcaaaacctatcccctgagaagattttccatgttatcgtggccccatgttatgacaagaaactcgaggctctgcaagagagtctgcctcctgcgcttcacggcagcagaggagcggactgtgttttgacaagcggggagatcgcccaaatcatggaacagggggatctcagcgtcagggacgcagccgtcgacactctttttggcgaccttaaagaggacaaggtgactcgacacgatggagcaagcagcgacggtcatctggcgcacatctttaggcacgccgctaaagaactatttaatgaggatgtcgaagaggtcacttaccgggccctgaggaacaaggacttccaggaggtgaccttggagaaaaatggagaggtggtcttacgcttcgctgctgcgtacgggtttcgcaacatccagaatatgatcctcaagctgaaaaagggcaaattccccttccatttcgtggaagtcctcgcctgcgccggcggttgcctgaacggacgtggccaggcccaaacacctgatggtcatgccgacaaggcattgctcaggcagatggagggaatttacgctgacatcccagtgcgcagacccgaatcctcagcgcacgtgcaagaattgtaccaggagtggctggaagggattaactctcccaaggccagggaggttctccataccacataccagagtcaggaacgtggaacccattcactggatataaagtggtag

SEQ ID NO: 23855 - DNA, 1104 bp, Artificial Sequence
  Description of Artificial Sequence: Synthetic coding sequence
atggccctgaacgtggcccccgtgcgggacaccaagtggctgaccctcgaggtgtgccgtcagttccagaggggcacctgcagcaggtcagacgaggagtgtaaattcgcccaccctcccaaaagctgccaagtcgagaatggcagagtaatagcgtgttttgactcattgaagggcaggtgtagtagggaaaattgtaaatacctgcatccccctacccacctgaaaacccagctggagattaatggacggaacaacctaatccaacagaagactgctgctgcgatgctcgcccaacaaatgcagttcatgttcccgggcacccccctccaccccgtcccaaccttcccggttgggccggccattggaaccaacacagccatttcgtttgctccctatctagcacctgtgacgcctggcgtgggacttgtgcctaccgaaattttgcccaccacaccggtcatcgttccagggtccccacctgtcacagtcccaggaagtactgccactcaaaaacttctgcggacagataagctcgaagtgtgtcgagagttccagcgcggcaactgtgcccggggcgaaacagactgtcggttcgcacacccagccgatagcaccatgatcgacacatcagacaacacagttaccgtttgtatggactacattaagggacgatgtatgagagagaaatgtaagtattttcatcccccagcacacttgcaggccaaaatcaaggcagcccagcaccaggcgaatcaggctgctgtcgccgcccaggccgccgctgctgccgccactgtcatggcatttcccccaggggctttgcaccccttgcccaagcgccaagccctagagaaaagcaatggaacctcggctgtctttaatccatctgttttacattaccagcaagctttgacatccgcccagttgcaacagcatgccgccttcatacccacaggttcagtgctatgtatgacgccagctacatctatagtgcctatgatgcatagcgctacgtccgccacagtgtcagccgctacgacccctgcaacttcagttccttttgcagccacagccacagcaaaccagattatcctcaaatag

SEQ ID NO: 23856 - DNA, 3909 bp, Artificial Sequence
  Description of Artificial Sequence: Synthetic coding sequence
atggccctgcggcccggcgccggcagcggcggcggcggcgccgccggggccggcgcaggttccgccggaggaggaggcttcatgttccctgtggctggcgggatacggccaccacaggctgggctgatgcccatgcagcagcagggatttcctatggtgtctgtcatgcagcctaacatgcagggcattatggggatgaactatagctcacagatgagccaaggcccaatagctatgcaggcaggaatccccatgggcccgatgcctgctgccgggatgccatatcttggtcaggctcctttcttagggatgagacctcctgggccccaatacacaccagatatgcaaaaacagtttgcagaggagcagcagaaacgtttcgagcaacaacaaaaactgcttgaggaggagagaaaaagaaggcagttcgaagaacagaagcagaaactgaggctgctcagctctgtgaaacctaagaccggagagaaatctagagatgatgctctcgaagctatcaagggcaaccttgacggtttcagcagggacgcaaaaatgcacccaactcctgcctcccatccgaagaagcccgggccctcgctggaggagaagtttctcgtgtcctgtgacatctctacctccggccaagagcagattaagctcaacaccagcgaggtcgggcacaaagctctgggaccggggtcatcaaagaagtacccctcattgatggcttctaacggggtggctgtcgacgggtgcgtgtccgggactacaacggctgaagcagagaataccagtgaccagaacttgagcatagaggaatccggggtgggggtctttccaagtcaggatcctgcgcagcctaggatgcccccatggatttataatgagtcactggtgcctgatgcatataaaaagattctggagaccacaatgactcccactggcattgataccgctaaactgtatccaatccttatgtccagtgggttgccccgcgagacccttggacagatttgggctttggcaaatcggacaacccccgggaaattgaccaaagaggagttgtacaccgtattggcaatgatagctgtcacccagaggggcgtgcctgccatgagcccggatgctttaaatcagttcccggcggcgccaattcccaccctgtccggcttttccatgaccctccccacaccagtgagccagcctacagtaatcccatcgggcccagctggcagtatgccactttccctcggacagccggttatgggcattaacttggtgggacctgtaggcggagcggccgcccaggccagtagcggttttattcccacataccctgcgaaccaggtcgtaaaacctgaggaagacgattttcaggatttccaggacgctagcaagagtggatcactcgacgacagttttagtgactttcaagagctccctgcctcaagcaagacctccaactcacagcacggaaacagtgcccctagcctgctgatgccacttcccggcactaaggcactgccgtcaatggacaagtatgctgtcttcaaagggatagccgctgacaagagtagtgaaaacacggtgcctcccggcgatcctggagacaagtacagcgcattcagagagttggagcagacggctgaaaataagccgttaggggagtcattcgctgaattcaggtccgctggtacagatgatggatttacagacttcaaaactgccgacagcgtctcaccccttgaacctcctaccaaggacaaaacatttcccccaagtttcccctcaggcacaatccagcagaaacagcagacacaggttaagaatccacttaacttggcagatttagatatgttttcaagtgtgaactgctcttccgagaagcccctgagtttttcagccgtgtttagcacaagcaagagtgtttccactccacagagcacagggagtgcggcaacaatgaccgccttagccgctaccaagacgtcttcactcgccgatgacttcggagagttctcattgttcggagagtactctggtctggcccccgtcggagagcaggatgacttcgccgattttatggccttctccaattccagcattagctctgaacagaagcctgatgacaagtatgacgccctgaaggaggaggccagtcccgtgcccctgactagcaacgtaggtagcaccgttaagggagggcagaatagcacggccgccagcaccaagtacgatgtcttcaggcaactgtcattggaggggtccggactgggggtggaggatctcaaagacaataccccatcaggaaaaagcgacgacgacttcgccgactttcatagtagtaaattctccagcatcaattcagataagagcttgggcgagaaggcggtggcgttccgtcataccaaggaggattccgcaagcgttaagtctttggatctaccctccattggagggagtagcgttggaaaagaggacagtgaagacgctctctcggtgcagttcgacatgaaactggccgacgtgggcggagacctcaagcatgtaatgtcagacagctcattggacctccccacagtctctgggcaacaccccccggccgccgacattgaggatttgaagtatgcggcatttggttcctactctagtaacttcgccgtgtccacacttacgagttatgactggtccgatagggatgacgccacccagggcaggaaactctcgccgtttgtgttaagcgctggcagtggctcacccagtgcaacctctattttacagaaaaaagaaacatcgtttggctctagtgaaaacattacaatgacctcgctcagcaaggtgacaaccttcgtctcagaagatgccttgcctgaaaccactttccccgctttagcttcattcaaggacacaataccgcagaccagcgaacagaaggagtacgagaatcgggattacaaagacttcaccaaacaggatctccccaccgccgaacggtctcaagaggccacctgtccttctccggcctcatccggagcttcgcaggaaacacctaacgagtgtagtgacgactttggagagttccagtctgagaagccgaagatctccaagttcgacttcttggtggctacaagtcagagcaaaatgaaaagctctgaggaaatgattaagtccgagttagccacttttgatctctctgtgcaaggctcccacaagagatcgttgtcactcggagataaggaaatttctagatcgtccccatcacccgcgctggaacagccttttagagatagaagcaatactttgaacgaaaaacctgcgttacccgtaatccgcgacaagtataaggacctgaccggagaggtagaggaaaacgaacggtacgcctacgagtggcaacggtgcctgggctcagccctgaatgtcattaagaaagctaacgacaccctcaatgggattagtagcagctctgtgtgcaccgaggtcatacaaagcgcccaaggaatggagtatctcttgggggtggttgaagtctaccgggtaacgaagagagtggaacttggcattaaagccaccgccgtgtgctcagagaagttacagcagctgctgaaggacatagacaaagtatggaataacctcatcggttttatgagtctcgccacccttactcccgatgaaaacagcttagacttcagcagctgcatgctccggcctggaattaaaaatgcacaggagcttgcttgcggcgtgtgtctacttaatgtcgactctagatcgagagcttttaattctgagacggacagcttcaagctggcatacggtggccaccagtatcacgctagttgtgcgaacttttggattaattgtgttgaacctaaaccacctggtctagtgctcccagatctgttatag

SEQ ID NO: 23857 - DNA, 1011 bp, Artificial Sequence
  Description of Artificial Sequence: Synthetic coding sequence
atggagagcgtgctgagcaagtacgaggaccagatcaccatcttcactgattacctcgaggagtatcccgatacagacgagctcgtgtggatcctaggtaaacagcacttgctgaagacagaaaaatctaagctgctgagtgatatctccgccagactctggtttacataccgtcggaagttctcccccattggggggactggtccttcctccgatgcagggtggggctgtatgcttcggtgcggtcagatgatgctagcacaggctctcatctgccgacacctggggagagattggtcctgggagaaacagaaagaacagccaaaggagtatcagcgaattttgcagtgtttcttggatagaaaggactgctgttacagtattcaccaaatggcccagatgggggtcggggaaggtaagtcaattggagaatggttcgggcctaatacagtggcccaggtgctgaaaaaattggctctctttgatgaatggaatagtctggctgtctacgtttcaatggacaacacagtcgtgattgaagacatcaaaaaaatgtgcagggttcttcctttatctgctgataccgctggggatcgtcctccagactcccttaccgccagcaatcagtcagacgagctgatcttcctcgacccacacacaacacagacatttgtcgatacagaggagaacggtactgtcaatgaccagaccttccattgtttacagtcgccacagcggatgaatatcttaaacttagatccctcggtagcattaggctttttctgtaaggaagagaaagacttcgataactggtgctccctcgtgcagaaggagatcctgaaagaaaatctgcggatgtttgagctagttcagaagcatccaagccactggccccccttcgtcccacccgccaagccggaagttactaccacaggcgctgagttcattgactccactgagcagctcgaagaatttgatctcgaagaggattttgagatcctgtcagtctag

SEQ ID NO: 23858 - DNA, 3018 bp, Artificial Sequence
  Description of Artificial Sequence: Synthetic coding sequence
atgctgcggaccgccggccgggacggcctgtgccggctgagcacctacctggaagagctagaggcagttgagctgaagaaatttaagctttatttgggaacagcaaccgagctgggcgaaggcaaaatcccctggggttccatggagaaggccggaccactggaaatggcacagttattaataacacattttggcccagaagaagcatggcgtttagcactgtccacattcgagcggatcaatagaaaagatctgtgggaaagagggcagagggaagacctggtgagagacactccacctgggggaccaagctctctcgggaaccagtcaacgtgcttgctggaggtgagtttggtgaccccacgaaaggacccacaggaaacatatcgggactatgtgcgaaggaaattcagattaatggaggatcggaacgctcgcctgggcgagtgcgtcaatcttagtcaccggtatacaagactccttcttgtgaaagaacactccaatcccatgcaggtgcaacagcagctcttggatacaggacgcggtcacgctagaactgttggccaccaggctagccccatcaaaatcgagacgctgttcgagcccgacgaagagcgaccagagccaccacgcacggtggttatgcaaggggcggctggcattggtaagtcaatgctagcgcataaagtgatgctcgactgggctgatgggaagctgttccaaggtcgctttgattatctgttctatatcaactgcagagaaatgaatcagtccgctacggaatgtagcatgcaagacctgattttcagttgttggcctgagcccagcgcacctctgcaggagctgattcgcgttcccgaacgccttctgttcattatcgacgggttcgacgagctcaaaccctcatttcacgatcctcagggcccatggtgtctttgctgggaggagaagcgtccgaccgaactcctgctcaatagtctaatccgcaagaaacttctccccgagctgagcctcctcatcacaacgaggccgaccgctttagagaaactacacaggctgctcgagcatccccggcacgtcgagatcctcggatttagcgaggccgaacggaaggagtacttctataaatactttcacaatgccgaacaggctggacaagtcttcaactacgtgagagacaacgagccactgttcacgatgtgttttgtgccgttggtgtgctgggtggtctgtacctgccttcaacagcagttggaggggggcggactcctgcgacaaacttcgcgtacaacaaccgcggtttatatgctctacctgctatcattaatgcaacctaagccgggtgctccgagacttcagcctccaccgaaccagcgcggactctgttcacttgcagctgatgggctgtggaatcaaaagatcttattcgaagagcaggacctgaggaagcatggcctcgacggagaggatgtctccgcttttcttaacatgaacatttttcaaaaggatattaattgcgaaaggtactacagtttcatccatttgtctttccaagagttcttcgccgctatgtactacatccttgacgagggcgagggaggggccggccctgatcaagacgtgaccaggctactgaccgaatacgcattttccgaaagatcattcctcgccctgacgtcacgctttctgttcgggctgctaaacgaggaaacccgcagtcacctggaaaaatccctatgctggaaggtgagcccccatatcaaaatggatctgctgcaatggattcagagtaaagcacaatccgatggttcgaccctgcagcagggctcactggaatttttctcctgtctttacgagatccaagaggaggagttcatccagcaggctctgagtcacttccaagtaatagttgtaagcaacatcgcctccaagatggaacatatggtttccagtttttgcctcaaaaggtgtcgttccgcgcaggttctacatctctacggggccacctactcagctgacggagaagacagagcccggtgtagcgcgggcgctcacactctactggtgcagctgcgtccagagcgtaccgtgttgctcgatgcatactctgagcatctcgccgcggctttatgcaccaatccgaatcttatcgagctctcactgtacaggaatgcgcttggatcccgcggtgtgaaacttctttgtcagggcctgaggcaccccaactgtaaacttcagaatttacgcctcaaacggtgtcggatatccagctccgcttgtgaagatctgagcgccgccctgattgccaataagaacttgactcgcatggatctgagcggaaatggtgtgggctttccgggaatgatgcttctgtgcgaggggctccggcacccacaatgtcggctgcagatgatacagcttaggaagtgtcagctagagagtggagcctgccaggagatggcctccgtccttgggaccaatccccacctcgtggagctcgatttgactggaaatgcactggaagatcttggtctcagactgctgtgtcaaggtctccggcacccggtctgtcgactgcgcacattgtggctcaagatctgccgactgactgccgccgcctgcgatgagctggcgtctaccctttctgttaaccagagtctgagagagttagacttaagtttgaacgagttgggcgacctgggggtgctgctgctttgtgaaggcttgaggcatcctacatgcaagcttcaaacccttagactgggaatctgtagactggggtcagcagcctgtgagggactgtcagtagtgctccaggccaaccacaatttaagggaactggacttatccttcaacgatctcggtgattggggcttgtggctcctcgctgaaggcctccaacatccagcctgtcgccttcagaagctgtggctgtttggcatggacctgaataagatgacacatagtcgcctggccgctctccgcgtgaccaagccatatctcgatattgggtgttag

SEQ ID NO: 23859 - DNA, 618 bp, Artificial Sequence
  Description of Artificial Sequence: Synthetic coding sequence
atggtgagcagctgctgcggcagcgtgtgcagcgaccagggctgcggacttgaaacctgctgtcggccatcgtgttgtcaaaccacatgttgccgcacgacatgctgtcggccctcatgctgcgtctcgtcatgttgccgtccccaatgctgccaaagtgtctgttgccagccgacgtgttgccggccctcttgttgcccatcttgctgtcagaccacctgctgccgaaccacttgctgcagaccctcatgttgcgtgtcatcttgttgcaggccacaatgctgccagagtgtgtgttgccagccaacttgttgtaggccatcgtgctcaatctcttcttgttgtaggccttcctgttgtgtttcgcgctgttgccgttcgcagtgttgtcagagcgtctgttgtcagcccacatgctgcagacctagctgttgtataagttcatgctgtagacccagctgttgcgaatcctcttgctgcaggccctgctgctgtcgaccctgttgttgtctgcggccagtctgcggtcgcgtgagctgtcataccacttgttatcgccctacctgcgtgattagcacatgccctcggccactttgctgcgcttcttcttgctgttag

SEQ ID NO: 23860 - DNA, 573 bp, Artificial Sequence
  Description of Artificial Sequence: Synthetic coding sequence
atgcagagctgcgagagcagcggcgacagcgccgacgaccccctgtccaggggactccgtcggcggggacagccaagggtggtggtcattggcgccgggctagccgggctggctgctgccaaagctctgctggagcagggatttactgacgtcaccgtgctggaggcaagttcacacataggaggcagggtccaaagcgtaaagctgggccacgccacctttgagctgggggcaacgtggatccatggcagtcacggcaaccccatctaccatcttgctgaggctaatggactgctggaagaaacaacagacggagagcggtccgtgggccggatatctctctactccaagaatggcgttgcatgttatctcacaaaccacggaaggcggattccaaaggatgttgtggaagagttctctgacctttacaatgaacctatgcaggtgctcttctccggcgaggcgactcacagaaaatactactccactactcatggggcactactatcgggacagcgagaagctgctcggttgatcgagatgtatcgagacctttttcagcagggaacctag

SEQ ID NO: 23861 - DNA, 3945 bp, Artificial Sequence
  Description of Artificial Sequence: Synthetic coding sequence
atggccctgcggcccggcgccggcagcggcggcggcggcgccgccggggccggtgccggttctgccgggggggggggtttcatgttccccgtggcgggagggattcgccccccccaagccggccttatgcccatgcagcagcaggggtttccgatggttagcgtgatgcagcctaacatgcagggaattatggggatgaactacagcagccagatgtctcagggacctatcgctatgcaggccgggattccaatgggccctatgccagccgccggtatgccatatctggggcaagcccccttcctggggatgcggccacccggacctcagtacacacctgacatgcaaaagcagtttgccgaggaacagcagaaacggtttgagcagcagcaaaagctactcgaagaagagcgcaagcgtagacagtttgaggagcagaagcagaagctgcggcttttgtcaagtgtaaagccgaaaactggggaaaaatcccgggatgatgctctagaggctatcaaaggcaatcttgatggtttctccagagacgctaagatgcatccaactccagcatcccatcccaaaaagccaggtccctctctggaggaaaaattcctggtgagctgtgacattagcacgagtggtcaggagcagattaaactgaatacttctgaggtaggtcacaaagccctcggaccaggttcatcgaaaaaatatccgagcctaatggctagtaacggagtcgccgtggatggttgcgtgagtggaaccactactgccgaggcagaaaatacttctgaccagaacctgtccatagaggagagtggcgttggagtgttccctagccaggatccagctcagcccagaatgccaccttggatatacaacgagtccctggttccagacgcctacaaaaaaattctggagaccactatgacccccaccgggatagacacagctaagttgtatccaattttaatgtcttctggactcccacgggagaccttgggtcagatctgggcccttgctaataggaccacaccaggtaagctgaccaaggaagagctttacacagtgctggccatgatcgccgttacccaacgcggcgtgccagcgatgtctcccgatgccttgaatcaattccccgctgcacctatacctactctgtccggtttctcaatgacactacctacccctgtgtcccaaccaaccgttatccccagcgggcccgccggcagcatgccactctcgttgggccagccagtcatgggaatcaacttggtaggcccggtgggaggcgcagccgcccaggcttcctccgggtttatcccaacgtatcccgccaatcaagttgtcaaacccgaagaggacgatttccaggattttcaagacgcctctaagtccgggtcattagacgatagtttttctgattttcaagaacttcccgctagcagcaagacgtccaactctcaacatggtaactctgccccctcccttttgatgccactccccgggaccaaagccctcccttccatggataagtacgccgtgttcaaaggcatcgctgctgataagagttccgaaaacactgtcccaccaggcgaccctggggataagtacagcgcattccgagagctggagcagaccgcagaaaacaaacctctcggggagagttttgcagagttccgatctgccggaacagatgatgggttcacagattttaaaaccgctgatagcgtgtcccctctagaaccacccaccaaagataaaaccttccctccatctttccctagcggcacgattcagcagaaacaacagacacaggtcaaaaatccactgaatctcgccgatttagatatgttctcttctgtaaactgttcatcagaaaagccgttatctttctccgccgtgttcagtacatctaagtccgtgtctactccccaatccactggcagtgccgccaccatgacagctctggccgctaccaaaacgagttcactggcagatgattttggagaattcagccttttcggcgaatacagcgggctggcaccggtaggagagcaagacgacttcgctgacttcatggccttcagcaattcttccatcagctccgagcagaagcctgacgacaagtatgatgcccttaaagaagaggcatctccagtgcccctgacatcgaacgttggaagcacggtaaaaggcggccaaaacagtacagccgcgtctaccaaatacgatgtgtttcgccagctgtcactggagggcagtggcttgggggttgaggacctcaaagataatactccctctggtaagagcgacgatgatttcgctgattttcactctagcaagttctcaagtattaacagcgacaaatcattaggagaaaaggccgtcgctttcagacacactaaagaagattcggcgtccgtgaagagcctggatttaccatcaattgggggaagctctgtgggcaaagaagatagcgaggatgctctgtctgtgcaattcgacatgaaactcgccgacgttggaggcgacttaaaacatgtgatgtccgacagcagcctggacctgccaaccgtgtccggccaacaccctccggccgcagatatagaggatctcaaatacgctgccttcggatcatacagctcaaacttcgccgttagcacactcacaagctacgactggtccgatagagacgatgccacgcaggggagaaagttaagcccctttgttctctctgccggatccggttcccctagtgctaccagcattttgcagaaaaaggagacgtcttttggcagcagcgaaaatattacgatgacctcgctctctaaggtgacaacttttgtctctgaggacgccctgcctgagactacctttcccgcgttggcctcattcaaggatactataccccagacctctgagcaaaaagagtacgagaaccgcgattacaaggactttacaaagcaggatctgcccaccgccgaacgcagccaggaggcgacatgccccagcccagcttcctcgggcgcgagccaggaaacccccaatgaatgttccgacgacttcggagagttccagagcgaaaaaccaaagatctcgaaattcgactttctcgtggctacctctcagtcaaagatgaagagcagcgaggaaatgatcaagtcagagcttgcgacatttgacctgtctgtccaaggcagtcacaagagatctttatcactcggggataaggaaatctctcgatccagtccttcccccgcactcgaacaacctttccgcgaccggagtaacacattaaacgaaaagccggccttacccgtgattagagacaagtataaggacctgacaggggaagtggaggagaatgagcgatacgcatacgaatggcaacgctgtctgggatcagcactgaatgtcattaaaaaggccaatgatactcttaatggaatctcatcatcttctgtgtgcacagaggtgatacagtccgcacagggtatggagtacctcctgggagtcgttgaggtgtatcgcgtaacgaagcgagtggaactaggtattaaagccaccgcagtctgtagcgaaaagctgcaacagctgctaaaggacatagataaggtttggaacaatctgatcggctttatgtctctcgcaactctgaccccggacgagaactccctcgacttttcttcttgtatgctgcgccccggaattaagaacgcgcaggaactggcctgcggcgtctgtttgctaaatgtagactcacgtagcagaaaggaggagaagcccgcagaggagcatccgaaaaaagcattcaatagcgaaacagactcttttaaactcgcatatgggggacaccagtatcatgcaagctgcgcgaatttctggatcaattgcgtggagcccaagcctcctggactggttttgccagatttattgtag

SEQ ID NO: 23862 - DNA, 531 bp, Artificial Sequence
  Description of Artificial Sequence: Synthetic coding sequence
atgagcgacgacgacagccgggccagcaccagcagcagcagcagcagcagttctaaccagcaaacggagaaagagaccaacacccctaagaagaaggagtcaaaggtttcaatgtctaagaattcaaagcttctctcaaccagcgccaaatccgccggtccaaaaggtgataatatatatgagtggaggtcgacaatattgggccctccaggctctgtatatgagggaggggtattttttctggatatcaccttcaccccagaatacccctttaaaccaccaaaggtaacttttcggacacgcatctatcattgtaacatcaactcacagggcgtaatatgtttagatatactcaaggataattggtccccagcactgacgattagtaaggttttgctgagtatctgttcccttctgaccgattgcaatcctgctgatccgctcgtcggatcaatagcaacccaatacatgacaaatcgcgcagagcatgaccgcatggcacgtcagtggaccaaacgatacgcaacatag

SEQ ID NO: 23863 - DNA, 7029 bp, Artificial Sequence
  Description of Artificial Sequence: Synthetic coding sequence
atggacggcgtgagcagcgaggccaacgaggagaacgacaacatcgagcggcccgttcggagacgccattcgtcgatcctgaaacccccgaggtccccattgcaagatctgagaggagggaacgagcgggttcaagaatccaatgccctcagaaacaaaaagaactcccggcgcgtctctttcgctgacacaattaaagtcttccagactgaatcgcatatgaaaattgttcgtaaatccgaaatggaaggctgctcggctatggtgccgagccagctgcaactcttgccccccggattcaagagattctcatgtctcagccttcccgaaaccgagaccggcgaaaatctactgcttatccagaacaaaaagctggaggacaactattgcgaaataaccggtatgaatacactcttatccgcacctatccacacgcagatgcaacagaaggagtttagtatcatagagcacacaagggagagaaagcacgctaacgatcagactgttatcttctctgacgagaaccagatggatttgacctcttctcataccgtgatgatcacgaaaggactgttagacaacccgatttctgaaaagagtactaagattgacaccacatctttcctcgccaacctgaaattacacaccgaagatagtaggatgaagaaggaggtgaattttagtgtggaccaaaacacttcctctgaaaacaaaattgacttcaacgattttattaagagactcaagacaggtaaatgttcggcatttcccgacgtgccagataaagagaactttgagataccgatctacagtaaagagcccaactccgcctcctccacacatcagatgcatgtgagtctgaaggaggatgaaaataactccaacatcactcgcttgttccgcgagaaggacgacggcatgaactttacgcaatgccataccgctaacatccagacactgattccgacaagctccgagactaattcacgcgagagcaaaggaaatgatataacgatctatgggaacgacttcatggatctgacattcaatcataccctccaaattttgccagctactggtaactttagcgaaatagagaatcagactcaaaatgcaatggacgtaacaaccggatatggaacgaaggctagcgggaataagaccgtgttcaagtcaaagcagaatactgcttttcaggatctgagcatcaactcggccgataaaattcacatcaccaggtcccacataatgggggctgagacgcatatcgtgagccagacctgcaaccaggacgctcggatcctagccatgacacccgagtccatctacagcaatcctagtatccaaggctgtaaaactgtgttctactcatcgtgcaatgatgctatggaaatgaccaaatgtctcagcaatatgcgtgaggaaaagaacctcctgaagcacgattctaattacgccaaaatgtactgtaaccctgacgcaatgtcctccctgacagagaaaaccatatacagcggtgaggagaacatggacattaccaagagccacacagtggcgattgacaatcaaattttcaagcaagatcagagcaacgtgcaaattgcagccgcaccaacacccgagaaggaaatgatgctccagaacctgatgacgaccagcgaggatggcaagatgaacgtgaactgtaacagcgtcccccacgtgtccaaagaacggattcagcaaagcctgtccaaccccctgtctatttccctcacagaccggaagaccgaattgctgtccggggagaacatggatctgaccgaatcacacaccagcaatttggggtcccaggtaccactggctgcctataacctggcgcccgagagcacgagtgagagccactcccagtccaaaagttcctcggacgagtgtgaggagatcacaaagtcccgcaacgagccttttcagcgatcggatattattgccaaaaattccttgacagacacatggaacaaggataaggactgggttctcaagattctgccctatttagacaaggacagcccccagtcagccgattgcaatcaggagatcgccaccagtcacaatatcgtatattgtgggggagtactggataaacagatcactaaccgaaatacagtcagctgggagcagagtctgttctccaccacaaaacctctgttcagtagtgggcaatttagcatgaagaaccatgatacggcaatttcatcccacacggtgaaatctgtgctagggcagaacagtaagctagccgaacctctgagaaaaagcctttcaaatcccacaccggactattgccacgataagatgattatttgcagtgaagaagagcaaaacatggatctgactaaaagtcacacggtcgtgatcgggtttggaccatccgagctgcaggaattaggaaaaactaaccttgaacacactaccgggcagttgactactatgaacaggcagattgcagttaaggttgaaaaatgcggtaaatcaccgatagagaagtctggcgttttgaagtcaaactgtatcatggatgtcctggaggatgaaagcgtccagaagccgaaattccctaaagaaaaacagaatgttaagatatgggggagaaagagtgtgggaggtcccaagatcgataagaccatcgtgtttagcgaagatgacaagaacgacatggacataactaagagctacaccatcgagattaatcacagacccctcttggagaagcgcgattgccacctggtgccgcttgccggtacttcagaaaccattctctatacttgtcgccaggacgacatggagataactagaagccacaccacagctcttgagtgtaaaaccgtgtctccagacgaaattacgacaaggcctatggacaagacagtggtattcgttgataaccacgttgagctggaaatgacagagtcgcatactgttttcatcgactatcaagaaaaagaacggacagaccgcccaaacttcgagctgtcccagcgtaagtccctgggaactcccacagtcatttgtactcccactgaggagtccgtgttctttccagggaacggcgagtcagatagacttgtggctaacgacagccagctgactccactcgaagagtggagcaataataggggtccggtggaggtggccgacaatatggagctgtccaagtctgctacatgtaaaaatatcaaggatgtgcagtcaccggggttcttgaacgaacccttgtcatctaaaagccaacggagaaaatcgttgaaactgaagaatgacaaaaccattgtgttcagtgaaaaccacaagaacgacatggatattactcagtcatgcatggttgagatagacaacgaaagtgctctggaagacaaggaggattttcatctcgctggcgcatcgaagaccatcctctattcttgtgggcaggatgacatggaaatcactcggtcccacactacagctctagaatgcaagactttactaccgaacgaaattgccataaggcccatggacaagacagtgctgtttactgacaattacagcgatctggaagtgaccgacagccacactgtattcatcgattgccaggcgactgagaagatactggaggagaaccccaagttcggcataggcaaaggcaagaacctgggtgtgagcttccccaaggacaactcttgcgtccaagagattgccgagaagcaagctttggctgttggcaacaaaattgtgctgcacactgagcagaaacagcagctctttgccgccacgaatagaacaaccaacgaaatcatcaagtttcatagcgccgctatggacgagaaggtgatcggcaaggtggttgaccaggcgtgcaccttagagaaagcccaggtggaatcctgccagctgaacaatagggatcgacgaaatgttgacttcacttcttctcacgcgactgctgtttgcggttcatcggataactactcatgcctgccaaacgttataagttgcacggataacttggaggggtccgccatgctcctgtgcgacaaagacgaggagaaggctaattattgtcctgttcaaaatgacttagcctacgcaaatgatttcgcttcggagtattatctggaatctgaggggcaacccctctccgcaccctgccctttgctcgaaaaagaggaggtgattcagactagcaccaaagggcaacttgactgcgttattactctgcataaagaccaggatctcatcaaagatccacggaacctgctggccaaccaaactctggtgtattcgcaagacttgggcgagatgaccaaattgaattccaaacgcgtgtccttcaaattgcccaaggaccagatgaaagtgtatgtggacgacatatatgtcatccctcaaccccatttcagcaccgaccagcccccgttgcctaagaaagggcagtcgagcattaacaaggaggaagtgatcttatcaaaggcagggaacaagagtttgaatatcatcgaaaattcatctgctcccatctgtgagaataagcccaaaattcttaatagtgaggaatggttcgccgccgcctgcaaaaaagaattaaaagaaaacatacagaccacgaattataacactgccctggattttcattcgaattccgacgtaactaaacaagttatccagacccatgtgaacgctggggaggcgcccgatccagtcattaccagtaacgtcccatgttttcattcgataaaaccgaatcttaataacctgaatggtaagactggagaattcctagcctttcagaccgtgcacctgcctcctttgccggaacagctgctcgagctgggcaataaagcacataacgacatgcacatagtccaggccactgagattcataacatcaatattatctcttccaacgccaaagactcgcgggacgaagagaataaaaaaagccacaacggagcagagaccacctctctgccccccaagaccgtgtttaaggacaaggtccgtaggtgctctttaggcatcttcctccctcgactgcctaataaaaggaactgtagtgtgacgggcatcgacgacctggagcagatccctgctgatacaactgatatcaatcacctggagacgcagcctgtctcctcaaaggatagtgggataggcagcgtagcaggcaagctcaacctgtctccttctcaatacataaacgaagaaaacctgcccgtctaccccgacgaaatcaactcctctgactctattaatatcgagaccgaggagaaggccctcatcgaaacctaccagaaagagattagcccttacgaaaacaaaatgggcaaaacatgcaacagccagaaacggacctgggtgcaggaagaagaggatatacataaggaaaagaagatcagaaagaatgaaataaagttttctgacaccactcaagaccgtgaaatcttcgaccaccatacagaggaggatattgacaaatccgccaatagcgtccttatcaagaacttgtctaggacaccttcctcctgtagctctagcctggacagtataaaagcggacgggacctcactggacttttcaacctacaggtcctcccaaatggaaagtcagttcttgagagacacaatctgcgaggagagtcttcgcgaaaaactgcaagatggacggattactatccgcgagttttttattctgctgcaggtccacatcctgattcaaaagcccaggcagtccaacttaccggggaactttacggttaatacaccaccaactcccgaggatctgatgctgtcccagtacgtatatagacccaaaattcagatataccgggaagactgcgaagccagacgtcagaagatcgaggaattgaagctgtccgcatctaaccaggataagctcctggtagatatcaataaaaacctgtgggagaaaatgcggcactgtagtgacaaagagctgaaagctttcggcatctacctaaataaaatcaagagttgctttacgaagatgaccaaggtcttcacgcaccagggaaaagtggccctgtacggcaaactggtacagtccgcccagaacgagagagagaagctacaaatcaagattgatgaaatggacaaaattctgaaaaagatagacaattgtctaacagagatggagaccgagaccaagaacctcgaagacgaggaaaagaataatccagtggaggaatgggatagcgaaatgcgcgccgcagagaaagaactggagcagctgaagactgaggaagaagagcttcagaggaacctgctggagctagaagttcaaaaggagcaaactctggcacagatcgactttatgcagaagcagcgaaatcgaacggaagaattgctagatcagctgtctctgagcgagtgggatgttgtggaatggtcggacgatcaggctgtgtttactttcgtgtacgacactatccagcttactattacgttcgaggagagcgtggttgggtttccatttcttgacaaacgataccgcaaaattgtcgacgttaactttcagagccttctggacgaggaccaggcccctccctcttccctgctcgtgcataaactgatcttccagtatgttgaagaaaaggagtcatggaaaaagacctgcaccactcaacaccagttacccaaaatgctggaggagtttagcttggtcgtacaccattgcagacttcttggcgaggagatcgaatacttgaaaaggtggggccctaactacaacctcatgaacatcgatatcaataacaacgagcttcgcctcctgttctcaagcagtgccgccttcgctaagttcgagattacactcttcctgagcgcgtattatcccagcgtgcccttaccatctacaatccagaaccacgtgggcaacactagccaggatgatatcgccaccattctctccaaagtacctctggaaaataactatttaaagaatgtcgttaaacagatttaccaggatctgtttcaagattgccatttttaccactag

SEQ ID NO: 23864 - DNA, 1638 bp, Artificial Sequence
  Description of Artificial Sequence: Synthetic coding sequence
atgagcagctgcgtgagcagccagcccagcagcaaccgggccgccccccaagatgaactcgggggtaggggcagttcatccagtgaaagccaaaagccctgtgaggctctcagagggctgtctagccttagcattcatcttggaatggaatccttcatcgttgtgaccgaatgcgagccgggatgtgcggtcgatctcggcttagctcgagatcggcccctggaggccgacggtcaagaggtgccccttgatacctccggatcgcaagcccgccctcacctgagcggacgcaagctgtccttacaggagaggtcgcaaggcggccttgcggccggggggtccctggatatgaacggacgctgcatctgcccttcactgccctattcacctgtgtcatcaccccagtctagtcctcgcctcccgcgtcggcctacggtggagtcacatcatgtcagcattaccgggatgcaagactgcgtgcagctaaatcagtatacattaaaagacgaaataggcaaaggcagctatggagtcgtgaaacttgcctataacgagaacgataacacctactatgcaatgaaggtcctctctaagaagaaactaatacgacaggccggattccccagaagacctcctcctcggggaactcggcccgcgcctgggggctgtatacaaccccgcggccctattgaacaggtgtatcaggagattgctatcctgaagaaattagatcatccaaatgtggtgaagttagtcgaggtcctcgatgaccctaatgaagaccatttgtatatggtttttgagctcgtgaatcaggggccagtgatggaggtccccactctcaagcccctaagtgaagaccaagcccgattttactttcaggacctgattaaggggatcgagtacctgcattaccagaagatcatacaccgagatattaaaccatccaacctcttggtaggggaggatgggcatatcaagattgctgatttcggcgtctctaacgagttcaaaggatcagatgctctactctccaacaccgtcgggacgcccgccttcatggctcctgagtctcttagcgagaccagaaagatcttctcaggaaaggccctcgatgtatgggccatgggggtcactttgtactgtttcgtgttcggacagtgtccctttatggatgaacggatcatgtgcttacattcaaagataaagtcccaggcgcttgaatttcctgaccagcccgacatcgcagaggatctcaaagatctgattactaggatgctggataaaaaccccgaatccagaatcgtagttcccgaaatcaagattctcgtaaaaacaatgatccgcaaacgctcctttggtaatccattcgaaggatccaggcgcgaagagcggtctctgtccgctcctggaaatttactgaccaagaaaccaaccagagaatgtgaaagtctctcagagctgaaggaagcccgtcagcgccggcagccgcctggtcatcggcccgcgcctcggggaggtggagggagtgctctggtgcgtggcagcccttgtgtggagagctgctgggcacccgcccccggaagcccagccagaatgcaccccctaagacccgaagaggctatggagcctgagtag

SEQ ID NO: 23865 - DNA, 333 bp, Artificial Sequence
  Description of Artificial Sequence: Synthetic coding sequence
atgcccaagcggagctgccccttcgccgacgtggcccccctgcagcttaaagtgcgcgtgtcacagcgggaactctctaggggggtgtgcgcagagagatactctcaggaagtttttgacccatctggcgttgcatccatcgcctgttcctcatgtgtcagagcagttgacggtaaggctgtctgtgggcaatgtgaaagagcactctgtgggcaatgcgtgcggacctgctggggctgcggatcagttgcctgtaccctgtgcggcctagtggactgcagtgatatgtacgaaaaagttctgtgcacatcatgcgcaatgttcgagacctag

SEQ ID NO: 23866 - DNA, 2253 bp, Artificial Sequence
  Description of Artificial Sequence: Synthetic coding sequence
atggaggacctgttcgagaccttccaggacgagatgggcttcagcaacatggaggacgatgggcccgaggaagaagagagagtggcagagcctcaagcaaacttcaacaccccacaagccctgagattcgaagaactgttggctaacctgctgaacgagcaacaccaaattgctaaggaactgtttgaacaactaaaaatgaagaagccttcagcaaagcagcaaaaggaagtggagaaggtaaagccacagtgtaaggaagtgcatcagacccttatactcgaccctgcgcagagaaagcggttgcagcaacagatgcagcaacacgtgcagcttctaacacaaattcacctccttgccacctgcaacccaaacctcaaccccgaggcgagcagcacgcgcatttgtctcaaagaactgggaacctttgcccagagctctatcgcattgcaccaccagtataaccctaagtttcagactttatttcagccttgcaacctcatgggggcaatgcagttgatcgaggattttagcacgcatgttagcatcgattgtagcccccataaaactgttaagaaaacggccaatgagtttccttgtcttccgaagcaagtggcatggatcctcgctacctcaaaggtattcatgtaccctgagctactgccagtatgttcactgaaggccaagaatccccaagacaagatactctttactaaagccgaagataatctattagctctcgggctgaagcatttcgaaggcaccgaatttctgaatcccctgatcagcaaatacctcctgacctgtaaaacagcgagacagctgaccgtgcggataaaaaacctgaatatgaacagagcgcctgacaatattattaagttttacaaaaaaaccaagcagctcccagtgttgggcaagtgctgcgaagaaatccagccccatcagtggaaacctcctattgagagagaggagcaccgtttgcctttctggctgaaggcttctttaccatcaatccaggaggagctgagacatatggctgacggcgcaagggaagtgggaaacatgaccggcacaactgaaatcaatagtgatcagggcctggagaaggacaactcagaactgggttcagaaacacgttacccactgctcctgcccaaaggagtcgtgctgaaattgaagccagtggccgatcgctttcctaagaaggcctggcgccaaaaacggtcgagcgttctcaagcctctcctgatacaaccttcacccagcctccagcccagctttaaccccggtaaaacccctgctcagtctacccactccgaagcacccccaagcaagatggtgctccggataccacacccaatacaacctgcaaccgttttgcagacggtcccaggcgtccccccccttggcgtgtctggaggcgagagctttgagtccccagccgcgttgccagcgatgccacctgaggcaaggacatctttccctctcagtgaatcccagaccctgttgtccagtgcgcctgtccccaaggtcatgatgccgtctccggctagctcaatgttccggaaaccctacgtccgccgtagaccttccaaaagaaggggggccagggcctttaggtgcatcaagcccgccccagtcattcaccctgccagcgttatctttaccgtacccgctactactgtcaagattgtgtcccttggtggcggttgtaatatgatccagccagtgaatgccgccgtggcacagagtccccagacgattcctatcgctaccttgctcgtgaatcctacgagctttccttgccctctgaaccagcccttggtcgcatcctctgtgagccccctgatagtctccggaaattccgtgaatctgcctatcccaagcaccccagaggacaaggcgcatatgaacgtggacattgcctgtgctgtagccgacggcgagaatgccttccaggggcttgagcctaagctggagcctcaggagctgtcccccctgagtgctacagtttttcctaaggttgaacattcacctggacctccccccgttgacaagcagtgccaggagggactctccgagaactccgcctatcgttggacggtggtgaaaacagaggaaggacgacaagctctggagcccctccctcaaggaattcaggaatcactgaataatagtagccccggggacctagaagaggtcgtaaagatggaacctgaagacgcaacagaggagatctccggatttttgtag

SEQ ID NO: 23867 - DNA, 2604 bp, Artificial Sequence
  Description of Artificial Sequence: Synthetic coding sequence
atgcaggccgaggccgccgactggttcagcagcatgcccttccagaagcacgtgtattatcctctggctagcggtccagaaggcccagatgtcgcagttgcagccgcagcagcgggggcagccagtatggcctgcgccccacccagcgctgcctcggggcccctgcctttctttcagttcaggcctagactggagtcagtcgactggagaagactgtctgctattgatgtggacaaggttgctggggcggtagacgtgctcactctacaagagaatatcatgaatatcacattctgcaaactcgaagacgagaagtgcccccattgccagtccggcgtggatcccgtgctactgaaacttatcaggcttgcgcagtttacgatagagtacctgctgcacagccaggagttcctgacctctcagctgcacactctggaggagaggctgagactttctcactgtgatggggaacagtccaagaagctgttgactaagcaggcaggggaaattaaaacactcaaagaagaatgtaaacgccgaaaaaaaatgatctctacacagcagcttatgatcgaagctaaagcaaattactaccaatgccatttctgcgataaagcgtttatgaaccaggccttcttgcaatcacacattcagcgcaggcacaccgaagaaaactctcacttcgagtaccagaaaaatgcccagattgagaagctcaggtcagaaatcgtagtgctgaaggaagaactccaactgaccaggtcagaactggaagccgctcatcatgctagtgccgtacgattttctaaggaatatgagatgcagaagaccaaagaggaagatttcctaaaactgtttgacagatggaaggaggaagaaaaagagaaactcgtcgacgagatggaaaaggtcaaggagatgttcatgaaggaatttaaggagctcacatcaaagaatagtgcccttgaataccaactgtcggagatccagaaaagcaatatgcagatcaagtctaatatcggtactctcaaggacgctcacgaatttaaggaggatcgtagtccgtatccgcaggatttccataatgtgatgcaacttcttgactcccaggaatccaaatggaccgcaagagtgcaggctatccaccaggagcacaagaaggaaaaaggcaggctgctgagtcatatagagaagctccggacctccatgattgatgacctcaatgcctctaatgtcttttacaagaaaagaattgaggaactgggccagaggctgcaagaacagaacgaactcataataactcagagacaacagatcaaggattttacctgcaaccctctcaattccatcagcgaacctaaaggaaacccgctggcatggcaggcatttgagtcccagccagccgcacctgctgtacccatgaatgccccagctctccacactctagaaacaaagtcttctctgccgatggtacatgagcaagctttcagctcacacattcttgaaccaatagaagagctctcagaagaggaaaaaggccgtgagaatgagcaaaaactgaataacaacaagatgcatctgcggaaggctctgaagtccaactcttccctgaccaaaggcctacgaacaatggtggaacagaaccttatggagaaactggaaactttgggtatcaatgccgatattcgtggaatttcttcagatcagctgcaccgcgtgctgaagagtgttgagtctgagcgtcataagcaagagcgcgaaattccgaactttcaccagatcagggagttcttagagcatcaagtgagctgcaagattgaagagaaggcactgctgagctccgaccaatgctcggtttcccaaatggataccctatcaacaggggaagtgcccaagatgattcagctcccgagcaaaaatagacagcttatacgacagaaagccgtcagtaccgaccgcacttcagtgcctaagatcaagaaaaatgttatggaggaccccttccccaggaaatcaagtacaattaccaccccaccgttcagcagcgaggaggagcaggaagacgatgatctgattcgggcatatgcttctcccggaccccttcccgtcccccctccccagaataagggtagctttggcaagaatacagttaagtccgacgccgacggtactgaaggttcagaaatcgaggataccgacgattcacccaagccagcaggagtcgccgtgaaaaccccaaccgaaaaggtcgaaaaaatgtttccccaccgcaagaatgtcaacaaacccgtggggggtacgaacgttcccgaaatgttcatcaagaaggaggagctccaggagctcaagtgtgcagacgtggaggacgaagactgggacatatcctcactggaagaggaaatatccctcggaaaaaaatccggcaaggagcaaaaggagcccccccccgcgaaaaatgagccgcacttcgcacacgtccttaatgcgtggggcgctttcaatccaaaaggcccaaaaggcgaggggctgcaagaaaacgaatcgagcacccttaaatcttctttagtgacagtgaccgactggtctgacaccagtgatgtttag

SEQ ID NO: 23868 - DNA, 1860 bp, Artificial Sequence
  Description of Artificial Sequence: Synthetic coding sequence
atgagcggcctggtgctgggccagcgggacgagcccgccggccacaggcttagccaggaggaaattttggggtcaacaagactcgtgtcacagggactagaagctctacggagtgaacatcaggcagtactgcagtcactatcccagactatcgaatgtctgcagcaaggaggccatgaagagggtctggtgcatgagaaagctagacagcttagaagatctatggaaaacattgaactcgggctgtccgaagcccaggtgatgctggcgctcgcttcacatctttcaactgtcgaatcagagaagcaaaagcttcgggctcaagtgagaaggctgtgccaagagaatcagtggctccgggatgagctggccggcactcagcagcggctacaacggagtgagcaggccgtggcccaacttgaggaagaaaagaaacacctggagtttttaggtcaactgcgccagtacgatgaggatggccacacctctgaggaaaaagagggggatgcaacaaaggatagcttagacgacctgtttcctaacgaagaggaagaagacccatcaaatggactgtccaggggccagggagctaccgccgcccagcaaggagggtacgagatacctgctcggcttaggaccctgcacaacttggtcattcagtacgctgcccagggccggtatgaggtggcagtcccgctgtgtaagcaggccttggaggatctggaaaggaccagcggacgcggacatccggatgtcgccaccatgctgaacattctggccctggtgtacagggaccagaacaagtataaagaagctgcgcatctcctaaatgatgctctgtctatccgtgaaagtaccttagggccagaccatcccgcagtcgccgctacactgaataacctggccgtgctgtacggcaaacgtgggaagtacaaggaggccgagcccctctgccagcgcgccctggaaattcgtgagaaggtgttaggcaccaaccaccccgacgtagcaaaacaactgaataatctcgctctgctttgccagaaccagggcaaatatgaggccgtggagcgatattatcagcgtgccttagccatttacgagggtcaactgggcccagacaaccccaatgtagctcgcacaaagaataatctggcttcctgttatctcaagcagggaaagtacgcagaggcagagaccttgtataaggagatacttacgcgcgctcacgtccaggagtttggctccgttgatgacgaccacaagccaatttggatgcacgctgaggagagggaagagatgtccaaaagtcgacatcatgaaggcgggaccccctatgccgaatacggtggctggtacaaagcatgtaaggtgagtagtcccaccgtgaacaccaccttacggaatctaggagctctctaccgaagacaaggcaagctcgaggctgcagaaacactcgaggagtgcgcattgcgaagtcgaaggcagggcacggaccccatttcgcagacgaaagtagcggagctcttgggtgagtctgatggtagacgaactagccaggaggggcctggcgattctgtcaagttcgagggaggtgaggatgctagtgttgctgtggagtggtctggagacggctccggaaccctgcagcgatccggcagcctgggtaagattagagatgtgttgcggcgttcctccgaactcttggtaagaaaactgcagggcacagagcctcgcccatcttcgtccaacatgaagcgggccgcctctctgaattatttaaatcaaccctcagccgcacccctgcaagtgtcaagaggtctgagcgcctcaactatggacttatcatctagttcctag

SEQ ID NO: 23869 - DNA, 1137 bp, Artificial Sequence
  Description of Artificial Sequence: Synthetic coding sequence
atgaaggagcagctgcccgacctgcacagccacttcagcgacctgaacttagaggcccacatgtatgcctcgcagtggtttcttaccttgttcaccgccaaatttccactttgcatggtgtttcatattatcgatctgttactgtgtgaaggcctcaatataatttttcacgtagctctcgccctcctgaaaaccagtaaagaggatctgctgcaggcggatttcgaaggcgctttgaaattcttccgtgtgcaactgcccaagagatatagagcagaagaaaatgcgagacggttaatggagcaggcctgtaacattaaggtcccaaccaaaaaacttaaaaagtatgagaaggagtatcagacaatgcgggaatcccaattacagcaagaagatccaatggaccgatataagagggagaaccgtcgactccaggaggcgtctatgcgcttggagcaggagaacgatgacctggcccatgagctcgtgacctccaagattgccttgaggaacgatttagaccaagccgaggataaggcggatgttctaaataaagaactgctgcttacaaagcaaagactagtcgaaacagaggaggagaagcgaaaacaggaagaagagaccgcacagctgaaagaggtgttcagaaagcaacttgaaaaggccgaatatgaaataaagaaaactactgccatcattgccgagtacaaacagatttgtagtcaactttctacgagattggaaaaacagcaagctgccagtaaagaagagctagaggtggtgaaagggaagatgatggcttgcaagcactgctctgacatcttttccaaggaaggtgctctaaagctggcagccacaggcagagaagaccagggaatcgagactgatgacgagaaggactccctgaaaaagcagttgcgggagatggaattggagctagcacaaacaaaattgcagctcgtggaggctaaatgtaaaattcaagaacttgaacaccagcggggcgctctcatgaatgaaatccaagcggccaagaacagttggttctcaaagacactcaatagtattaaaactgccacaggtacgcagcccctgcagccagcgccggtcactcaacctcccaaagagagcacttag

SEQ ID NO: 23870 - DNA, 2631 bp, Artificial Sequence
  Description of Artificial Sequence: Synthetic coding sequence
atgggcgacagcgacgacgagtacgaccggcggcggcgggacaagttcagaagggaacgctctgactatgatcggagtagggaacgagatgagcggcggcgaggggatgactggaatgatcgagaatgggaccggggtcgtgagaggaggtccaggggcgagtaccgtgattacgaccggaatcgtcgcgagcgtttttcaccgccgcggcacgagctaagcccgccgcagaagagaatgcggagggattgggatgagcattcctccgatccctatcattccggctacgaaatgccttacgcgggcggtggaggaggccccacatacggtccaccgcagccatggggccacccggacgtccacatcatgcagcaccacgtcctgcccatacaggctcgactgggatccattgctgagattgacttaggggtacccccccctgttatgaagacgtttaaggagtttttgctgagcctcgatgactcagttgatgagacggaggcagtgaagagatacaatgactataaactcgactttaggcgacagcaaatgcaagattttttcctcgcccacaaagatgaggaatggttccgtagtaagtaccatccggacgaagttgggaagcggaggcaagaggcccgtggtgcactgcagaaccggcttagagtattcctgtccctgatggagactggctggttcgataacctcctgttagatatcgacaaggctgacgcaattgtcaaaatgctggacgcagcggtgattaagatggaagggggaaccgaaaatgacttgcgtattctcgaacaggaggaggaggaagaacaggccggcaagcctggagaaccgtctaagaaggaagaggggcgagccggggctggtctgggcgacggagaacgtaaaaccaatgacaaggacgaaaagaaggaagacggcaaacaggccgagaatgactcgagtaacgatgacaagacaaagaaaagcgaaggcgacggagacaaagaagagaagaaagaagactcagaaaaggaagccaagaagtccagcaagaagagaaatcgaaaacactctggggacgacagcttcgatgagggttccgtgtccgaaagtgagagcgagagcgagagtggccaggctgaggaggaaaaagaagaagctgaggaagccctcaaggaaaaggaaaaacctaaggaggaggaatgggaaaaacccaaggacgccgcaggactggaatgtaaacctaggccattacacaaaacctgcagcctgttcatgaggaatatcgccccaaatatctcgagggcggaaataatcagtctgtgcaaaaggtatcctggatttatgagggtcgctttgagcgagcctcagccagagcgcagattttttcgaagaggatgggttacctttgacagatcggtcaatattaaagaaatttgctggaatcttcaaaacatacggttacgtgaatgtgagctgagtccaggcgtcaatcgcgaccttacccgtcgcgtcaggaacatcaatgggatcactcagcataaacagatcgtccggaatgacatcaagctcgcagccaagcttatacacaccctcgatgataggacacaactgtgggccagtgagccagggacaccccctcttcctacttccctgccatcccagaatccaatcctcaagaacattactgattacctaatcgaagaggtatcagcagaagaggaggagctgttaggcagcagtgggggggcgcccccagaggagccaccgaaagaggggaacccagcagagattaacgtagaacgggatgagaagctgatcaaggtgctggacaagttgctgctttacctgcgtatagttcactcgctcgattattataacacttgcgagtaccctaacgaggatgagatgccaaaccgatgtggaatcattcacgtgcgggggcctatgcctcccaatcgcatctcacacggggaagttctggagtggcagaagacttttgaggaaaagttgacccccctcctttccgtgcgcgagagcctgtccgaagaagaggcacagaaaatgggcaggaaggatccagagcaggaggtagaaaaatttgtcaccagcaacacgcaggagctgggtaaggacaagtggttatgtcccctgagcggaaagaagtttaaggggcctgagttcgtgaggaaacatattttcaacaaacatgcagaaaagatcgaggaggtgaagaaggaggtcgcatttttcaataacttcttaaccgacgccaaacggcctgcacttcccgagataaaaccagctcaacctcccggtcctgcccagatacttccgcccggtttgacccctggactcccttatccacatcagaccccccagggtctgatgccttacggtcagccccgtcctcctattctggggtatggagctggtgctgtgcgacctgctgtgccaactggggggccgccttaccctcatgctccctacggggcaggccgcggaaattatgatgcctttcgcggacagggcggataccccggcaagcctcggaacagaatggttaggggcgatcccagggccatcgtcgagtatagagacctggatgctccagacgatgttgattttttctag

SEQ ID NO: 23871 - DNA, 1491 bp, Artificial Sequence
  Description of Artificial Sequence: Synthetic coding sequence
atgaagctgggcaagaagcccatgtacaagcccgtggacccctactctaggatgcagagcacctataattacaacatgaggggcggcgcgtatcccccccgatacttctatccgtttccggtaccccctctcctgtaccaggtcgaactctccgttggcggccagcagttcaacggcaagggaaagacccgtcaagctgccaagcacgacgccgctgctaaagcattacgaattttgcaaaacgaacctctgcccgagcgactggaggtgaacggaagagaaagtgaggaggagaacctgaacaaatcagagatctcccaggtgttcgaaatcgccctgaagagaaatctgccagtcaacttcgaagtcgcgcgggaaagcggacccccccacatgaaaaacttcgtgaccaaggttagcgtcggcgagtttgtgggggaaggagagggcaaatcaaaaaaaattagcaaaaaaaatgccgcgattgccgttctggaagagctgaaaaaactgcccccgctcccagctgttgagagagtgaagcctcggatcaagaagaagacaaaaccaattgttaagccgcagacatcacctgagtacggtcaaggaattaacccgatttcacggttggctcaaatacagcaagctaaaaaagaaaaagaacctgaatacacccttctaacagagcgggggctccctcggaggagggaattcgttatgcaggtcaaggtgggaaaccatactgctgagggtacagggacgaacaagaaggtggctaagaggaatgccgccgaaaatatgttggaaatcttggggtttaaagtgccccaggcccaaccaaccaagccggccctgaagagtgaggagaagacccccattaaaaagcccggtgacggaaggaaggtgactttcttcgaaccaggatcaggggacgagaatgggacttccaataaggaggacgaattccgcatgccctatctctcacatcaacagctccctgcaggcatccttccaatggtgcccgaagtcgcccaggcagtgggcgtgtctcagggtcaccacaccaaagattttacaagagccgcccccaaccctgctaaagcgaccgttaccgctatgatcgccagagaactcctgtatgggggcacctcgcctaccgccgagaccattcttaagaataacatcagttctggccacgtgccccacggacctcttacacgccccagtgagcaactggactatctctcaagagtccagggatttcaggtggagtacaaagacttccctaagaacaataagaacgagttcgtgtccctgattaattgtagcagccaacctcccctgatctctcatgggattggaaaggatgtggagtcttgccacgatatggctgccctgaatatcctgaagctgctgtccgagcttgatcaacaatccaccgaaatgccacgcacggggaatggcccgatgtctgtatgtgggcgatgctag

SEQ ID NO: 23872 - DNA, 318 bp, Artificial Sequence
  Description of Artificial Sequence: Synthetic coding sequence
atggccctgcggtaccccatggccgtgggcctgaacaagggccacaaagtgacaaagaatgtcagtaaaccccggcactctcgcaggcgaggcagacttaccaaacacaccaagtttgtgagggatatgatccgcgaggtatgcggctttgcgccttacgagcgtagggctatggagctgctgaaagtttcgaaggacaaaagagccctgaagtttatcaagaagcgggtggggacacacattcgagctaaacgcaaaagagaagagctgagcaatgtcctcgccgctatgagaaaagccgccgctaagaaagattag

SEQ ID NO: 23873 - DNA, 3720 bp, Artificial Sequence
  Description of Artificial Sequence: Synthetic coding sequence
atggccaacgacagccccgccaagagcctggtggacatcgacctgtcctccctgagagaccctgcaggaatcttcgaacttgttgaagtggtgggaaacggcacctacggacaggtgtataaagggcgccatgtaaagacaggacagctggcggccataaaggtgatggacgttacagaagacgaggaagaggagatcaaactggaaattaacatgctgaaaaagtatagtcaccaccgcaacatcgccacctattatggagccttcataaaaaaaagtccaccgggccacgacgaccagctgtggctggtgatggagttctgcggcgcaggttctattaccgacctggtcaagaacaccaaagggaataccctgaaagaggactggatcgcctacatttccagggagatcctccgcgggctggcccacctccacattcaccatgtgatccatcgcgatattaagggacaaaacgtgcttcttaccgagaacgcagaggtgaagctggttgacttcggggtctctgctcagctggaccggactgtggggcgcagaaatacctttattggtaccccttattggatggcccccgaggtaattgcctgtgacgaaaacccagatgctacctacgactaccgttcggatctgtggagctgcggaattactgctatcgagatggcagaaggggccccaccactctgcgatatgcatcccatgagagccctgttcctcatcccccggaacccaccccccaggttgaaatccaagaagtggtccaagaagtttttctccttcatcgaaggctgtctcgtcaagaactatatgcagaggccatctactgagcagctactgaagcatcccttcatcagagatcagccaaacgagcggcaggtgaggatacagctgaaagaccatatcgatcgaaccagaaaaaaacgcggagagaaagacgaaactgagtatgagtactccgggagcgaagaagaggaggaggaagtgcccgagcaggaaggggaacccagtagcatagtcaatgtcccgggagagtccaccttaaggagagacttcctccgattgcagcaggagaacaaagaaaggagcgaagctctcaggagacagcagctgctgcaagaacaacagttgagggagcaggaagagtacaaacgacagcttctcgcggagagacagaaaaggattgagcagcagaaggaacaaagacgcagacttgaggaacagcagcgccgagagagagaggctcgaaggcagcaggagcgcgagcagcggagaagggagcaagaggaaaaacggaggctggaggaattagagcggcggcgcaaggaggaggaggagcggcgccgcgctgaggaggagaagcggagggtggagagagagcaggaatacattaggcgccaactcgaagaggagcaacgccacctcgaagttctgcagcagcagctactgcaggagcaggcaatgctgctggagtgccggtggagggaaatggaagaacaccgtcaggccgagcggctgcagagacaactgcaacaggagcaagcctacttacttagcctgcaacacgaccaccggcggccacatccccagcactcacagcagccaccaccacctcagcaggagaggtccaagccatcttttcacgctcccgagcctaaagctcattatgagccagctgatagggccagggaagtggaggacagatttcggaaaaccaaccactccagccccgaggctcagtcgaagcagactggaagagtgctcgagcctccagtcccctcccgatccgagtccttctccaatggtaactctgagagcgtgcacccagctctgcagagacccgcagagccccaggtccccgtccggaccacatcgcgaagccctgtgctgtctcggagagacagcccccttcagggttcagggcagcagaattcccaggctggccagcggaacagcactagcatcgagccacggcttctatgggagagggtagaaaaattggtgcctcgacccggctccggctcatcttccggctcttctaactctggttcccagcccggtagtcatcccggaagccaaagcgggtcaggagaaaggttccgggtacggtctagttccaaaagcgaaggttcccctagtcagcgcttggaaaatgctgttaagaaacccgaggacaaaaaagaagtgtttagaccacttaaacccgcggacttgacagccctggcaaaagagcttcgtgctgttgaggacgttcgcccacctcacaaggtgaccgactattcctccagtagcgaggaaagcggaacgacagacgaggaagatgacgacgtggaacaggagggggccgatgagtcgacttcaggaccagaagacacaagagctgcatcctccctaaacttaagtaacggcgaaacagagtcagtgaaaactatgatcgttcatgatgacgttgagtcagagcctgcaatgacacctagtaaagaagggacccttatcgtacggcagacacagagcgcaagtagcacgctgcagaagcacaagtctagctcatcatttacgcctttcatcgacccaaggctcctacaaatttctccttccagtggaactactgtaacttccgtcgtgggctttagctgcgacggtatgcgcccagaggcgattcggcaggatcccacaaggaaaggcagtgtggtaaatgtgaatccaaccaacacacgtccccaatcagacacaccagaaatcaggaaatacaagaagcgatttaacagtgagatcctctgtgcagcattatggggcgtgaacctcctcgtggggactgaatctggcctaatgttgttggaccgctccggtcagggtaaagtgtacccactgattaataggcgccggttccagcagatggacgtgttggagggactaaacgtgcttgttactatcagcggcaagaaagacaaactgcgggtgtactacttgtcttggcttaggaacaaaattttgcacaatgacccagaggttgagaagaagcaaggctggacgactgtgggtgacttggagggatgcgtgcattataaggtggtgaaatatgagagaattaagtttttagtgattgccttaaagagttctgtggaagtctatgcctgggcccctaagccctaccacaagtttatggcatttaagagcttcggggaactagttcacaagccgttgcttgtggatctgaccgtggaagaaggtcaaaggttaaaagtaatatacgggagctgcgctggctttcatgcggtcgatgtggactccggatctgtatatgacatctatctccccacccacatccagtgctctattaagccacacgccatcattatattgcctaacaccgacggtatggagctcctcgtttgttacgaggacgagggggtatacgtgaatacttacgggcgtataacgaaagatgttgtactccaatggggcgagatgccaaccagcgttgcttatatcaggagcaaccagaccatgggttggggtgaaaaagccattgaaattcgcagcgtcgaaactggtcacctggacggcgtattcatgcacaaacgagctcagagattgaagttcctgtgtgagcggaatgacaaggttttcttcgctagcgtgaggtccggcggcagctcacaggtttacttcatgacattagggcgaaccagcttactgtcatggtag

SEQ ID NO: 23874 - DNA, 2847 bp, Artificial Sequence
  Description of Artificial Sequence: Synthetic coding sequence
atgtacggcagcgcccggagcgtgggcaaggtggagcccagcagccagtccccaggccggtcaccgagactccctcgttctccccgacttggacatcgccgaacgaactccacagggggttctagcggatcctccgtgggcggcggcagtggcaagacccttagcatggaaaatattcaaagcctcaacgccgcatacgccacgtccgggcctatgtacttaagtgatcacgaaaatgtgggcagtgagacccccaaatccacaatgaccctggggcggtctggtggtagactaccgtacggggtgagaatgactgctatgggaagtagtcccaacatcgcctcttccggggtcgcatcggacaccattgcctttggagagcaccaccttccacccgtctcgatggcttcaaccgtgccccatagcctgagacaagctcgagacaacaccatcatggacctgcaaacccagctcaaggaagtcctacgagagaatgatctgctgcggaaagacgtggaagtgaaggagtcaaaacttagcagttcgatgaattccattaaaacattttggagccccgagttgaaaaaggagcgggccttgaggaaagatgaggcctccaaaattacaatctggaaagaacagtacagagtcgtgcaggaggagaatcagcacatgcagatgaccatccaggcattacaagatgaacttagaatccagagggatcttaatcaactgttccagcaggactcctcaagtcgcactggggagccctgtgtggctgaactaaccgaggagaacttccagcgtcttcacgctgagcatgagcgacaggcaaaggagctgttcctcctgcggaaaaccctggaggaaatggagctgaggatcgagacgcaaaagcagactttgaatgcacgggatgagtcaatcaaaaagttgctggaaatgctgcagagcaaagggctgtccgccaaagcaacagaagaagatcatgaaagaactcgcaggcttgctgaagctgagatgcacgtccatcacctagaaagcctgctggaacagaaagagaaggagaattccatgttgcgagaagaaatgcaccggagatttgagaacgcaccagattccgctaaaaccaaggcgttgcagacagttatcgaaatgaaggactctaagatttcctcaatggagagggggctcagggacttggaagaagagatccagatgctcaagtctaacggcgccctgagtaccgaagaacgagaagaggagatgaagcagatggaggtttacagaagccacagcaagtttatgaaaaacaaaatcgggcaggtcaaacaggagcttagcagaaaggatactgagctcttggccttgcagaccaagttggaaacactgacaaatcagttctcagactccaaacaacatattgaagtgctgaaggaatctctcaccgccaaagagcagagagccgccattcttcagacagaggtcgatgcactgcggctgcgcctcgaggagaaggaaactatgttaaacaaaaaaactaagcagattcaggacatggccgaggaaaaaggcactcaagcaggagagatccatgatttgaaagacatgttagacgtgaaggagcgcaaggtgaacgtgctgcagaagaagatagaaaacctgcaggagcagctgcgagataaagagaagcagatgtcttcccttaaagagcgcgtgaagagcctgcaggccgatactacaaatactgatactgccttgaccacccttgaggaagccctggctgaaaaagagaggaccatagagcgcctgaaggaacaacgggacagggatgagcgagagaagcaggaggagatcgataattataaaaaggacctgaaagatttaaaagagaaagtgtcccttctccagggggacttgtctgaaaaagaggcaagcctgctggatcttaaggagcatgcctcctcccttgcctcttctggattaaagaaagatagtcgactcaaaacactggaaatcgcacttgaacagaaaaaggaagagtgcctcaagatggaaagtcaacttaaaaaagctcatgaggccgccctcgaagccagagcaagtccggaaatgtccgatagaattcagcatctcgagcgcgaaatcacccggtataaggacgagtccagtaaagcccaggccgaggtcgatagactcctcgagattctgaaggaggttgagaatgagaaaaacgacaaggacaaaaagatcgccgagttggagagcctgacttcgagacaagttaaggatcagaacaaaaaggttgccaacctaaaacacaaagagcaagtggagaagaagaaatctgcccagatgctcgaggaggccagacgaagagaggataatcttaatgatagctcccagcagctacaggttgaggagctcctgatggcgatggagaaggtgaagcaagagttagaatctatgaaagcgaagttgagcagtacgcagcagtcactggccgagaaggaaacgcacctgaccaacttaagggctgaacgtcgcaagcatcttgaagaagtccttgaaatgaagcaggaagccctgctagctgccatttctgagaaggatgccaacattgcccttctggagctgagctccagtaaaaaaaagacacaagaggaagttgcagctttaaagcgcgagaaggacaggttagtgcaacagcttaagcagcagacacaaaatcggatgaagctgatggccgataattatgaagacgatcactttaaatccagtcactctaatcagactaaccacaaacctagtccggaccaggatgaggaagagggtatttgggcatag

SEQ ID NO: 23875 - DNA, 2733 bp, Artificial Sequence
  Description of Artificial Sequence: Synthetic coding sequence
atggccgccaccgtggagggccccgagctggaggccgccgccgccgccggtgacgccagtgaagacagcgatgctggcagcagggcactgcccttcctggggggtaatcgcttatcattggatttatacccaggcgggtgtcagcagctgcttcatctctgtgtgcagcaacccttgcagttgcttcaggtggaattcttgcgactttcaactcacgaggaccctcaattgctggaggcaacgttagcgcagttgccccagtctttgagttgcctgcgcagcctcgtgttaaagggtggtcagcggagggacacactgggtgcttgcttgagaggggcactcacaaacctgccagctgggctctccggcttggctcatttggcacacttagatctgtcttttaatagcctggaaacactgcctgcctgtgttttgcagatgcgcggactaggagccctccttctttcacacaattgtctttccgaactgcctgaggcgttgggggccctgcccgcacttacttttttgaccgtcacccataaccgactgcagacactgccaccagctctgggtgctctgagcaccctccagagactggatctttcccagaacttgctggatacactaccaccggaaatcggggggttgggcagtctgctcgagctgaacctggcctctaaccggctgcaatccttgcctgcctccctagcaggactccgcagtctgagacttcttgtcctgcacagtaacctcctggcatcagtccctgctgatttggctaggctcccactcctcacgcggcttgatctgcgcgataaccagttacgcgatctcccccctgaacttctggatgcaccattcgtcagactccaaggaaacccgctcggcgaggccagtcctgacgccccctcttcacctgtagcagctctgatcccagaaatgccccggctatttctgacctcggacctcgactcatttcccgtcacaccacagggctgtagcgtgacgctagcgtgcggggtacggcttcagtttccagcaggcgccactgctactccgattactattaggtacaggctactgctgccagagcccggcctcgttcctctgggcccccatgacgcattactgtcgcacgtcctggagctccagccccacggagttgcttttcaacaggatgttggactctggctgctcttcaccccaccccaggccaggagatgcagggaagtggtggttagaactaggaacgacaattcgtggggtgaccttgagacatacctggaagaggaagcgccccaacgactctgggctcactgccaggttcctcacttttcctggtttcttgtcgtctctaggcccgtatcgaacgcatgtcttgtccctccggagggcactctcctgtgctcgtccggccacccgggagtaaaagtgatcttccccccaggcgccacagaggaaccacgccgcgtgtctatgcaggtcgtgagaatggctggtagggagttgcaagcactgctgggcgaacccgaagccgctgtctcaccgcttctgtgtctgtcacaatcgggacccccctccttcctccagcccgtcacagtacaactcccattgccgtccggtatcacaggcttgtcccttgacagaagccggctgcacctgctatattgggccccacctgctgctacttgggatgatatcacggcacaggtggtgctcgaactgacccacctatatgcccgcttccaggttactcacttcagctggtactggctgtggtacactacaaaaaactgcgtgggtggcctcgcacggaaagcctgggaacgtctccgactgcatcgggtgaacctgatcgctctccaaagacggagggatccagagcaggtcctgctccagtgtttgccacgcaataaagttgatgccaccctgcggcgcctcctggagcgatatcgaggcccagaaccttccgataccgtagaaatgtttgaaggcgaggaatttttcgctgctttcgagcgtgggatcgacgtagacgctgaccgccccgactgcgtggagggaagaatttgcttcgttttctatagccatctgaagaacgtgaaagaggtatacgtcaccacaaccctggacagagaagctcaagccgtgagaggccaagtgtcgttttatcggggagcagtgcccgtcagagtccccgaagaggcagaagccgcgagacaaaggaagggtgcagacgccctatggatggccactcttcctatcaagctcccgcggttaaggggtagcgaagggccccggagaggcgccggactgagcctcgcaccattaaatctaggcgatgcagagaccggatttttaactcaatctaatctgctttcagtagccggccggctcggactggattggcccgccgttgccctgcacttaggcgtttcctatcgtgaagtccagagaatccggcacgaatttcgcgatgacctggatgaacagataagacacatgctgttctcatgggccgagaggcaggctggccaacctggggccgtgggcctgttggtgcaggccctggagcagtcggatcgacaggatgtcgccgaggaagtgcgcgcagtcctcgagttgggccggcgcaaatatcaggatagcatccgcaggatgggccttgccccaaaggaccccgccttgcccggaagttctgctcctcaaccacccgagcccgcccaggcctag

SEQ ID NO: 23876 - DNA, 2961 bp, Artificial Sequence
  Description of Artificial Sequence: Synthetic coding sequence
atgagccagtggacccccgagtacaacgagctgtacaccctgaaggtcgacatgaaaagcgaaatcccatctgatgccccaaagacccaggagtctctcaagggtatattgctccaccctgaaccaattggagcagccaagtcttttccggctggagtggaaatgatcaactcaaaggttgggaacgaatttagccatctgtgcgatgattcacagaagcaggaaaaggaaatgaacggaaaccagcaagagcaggaaaaatctcttgtcgtgcgcaaaaagcgaaaaagccagcaggctgggcccagctacgtgcaaaactgcgtcaaggagaaccaagggatcctgggccttaggcaacatctgggcactccctcggacgaagacaacgattctagtttctccgactgtctctcttccccctcatcatccctgcacttcggcgatagcgatactgttacaagcgacgaggacaaggaggtcagtgtgcgccatagtcagaccattctgaatgccaagagtcgcagccattctgcccgcagccataagtggccgaggacagaaaccgagtcagtatccggattactcatgaagcggccatgcttgcatggcagctctctgagaaggctgccgtgcaggaaacgcttcgtgaagaataatagttcccagagaacacagaagcaaaaggaaagaattttaatgcaaaggaaaaagcgggaggtgctggcaagacggaagtacgcccttcttcccagcagcagctccagtagcgagaacgacctgagctccgaatcttcgagctctagctcgactgaaggcgaggaagacttgttcgtcagtgctagcgagaatcatcaaaacaatccggccgtgccctccgggtccatagacgaggacgtggtcgttatcgaagccagttcaaccccgcaagtgactgctaatgaggagataaatgtcacgagtaccgactccgaggtggagattgtgacagtgggcgagtcatacagatccaggtccacacttggccacagtaggagccactggagccagggatccagttcccacgcctccagaccccaggaaccccggaacaggtctcggatttctactgtgatacagcctctgcggcagaacgcggcagaggtcgtggacctgacggtcgatgaggacgagcccactgtagtgcctacaacttctgctagaatggaaagccaagcaactagcgcttctattaacaattccaacccctctacctctgagcaggcgtctgacaccgctagcgctgttactagcagccagcccagtacagtgtcagaaacctccgcaacgttaacctctaactccacaaccggcacatctataggggacgatagtcggagaacaacttcatccgccgtgactgagaccggtcccccagcgatgcctcggttgccatcttgttgcccccagcactccccttgcggtggatcttcccaaaaccaccatgccctgggccaccctcacacgtcatgcttccaacaacacggacatcattttcagcaccatcaccatcaccatcatacccctcatccagccgttcccgtttctccttctttcagcgacccagcttgcccggtggaaagaccacctcaggtgcaagccccatgcggggccaacagctcctcaggaacctcttatcatgagcagcaggcactgccagttgacctgagcaattcaggcatacgctcccacggctctggctccttccatggtgcaagcgctttcgatccctgttgtcccgtctcttcaagtcgcgcagccattttcggccaccaggcggctgcagctgcaccttcgcagcccctgagtagcatcgatggctacggaagttcaatggttgcacaaccgcagccccaaccccctccacagccaagcctcagctcctgtcgtcactatatgcctcctccttacgcctccctgacacggcctttgcatcatcaggcctctgcctgcccgcacagccacggcaatccccccccccagacccagcctcctcctcaggtagactacgtcatcccacaccctgtgcacgctttccactcgcaaatctcatctcatgcaacaagccatccagtggctcccccacctccaacacatttagcttcaaccgctgccccaattcctcagcaccttcctccgactcaccaacccataagtcaccatatacctgccactgcacccccagcacaaagactgcaccctcacgaagtgatgcagagaatggaggtgcaacgtcggagaatgatgcagcaccccacacgggcacacgaacggcctcccccccatccgcaccggatgcaccccaattacgggcatggacaccacatccacgtgcctcagaccatgtcatcacacccgaggcaggccccagagaggtctgcctgggagttaggcatagaggccggggtcactgccgccacttataccccaggcgccctacaccctcatctggctcactatcatgccccacctagacttcatcacctgcagctgggagccttacctctaatggtgcccgatatggcgggttatcctcacataaggtatatctcttccggcctcgatgggacaagctttaggggcccattccgagggaactttgaagaactcatccatctcgaagaacggctgggaaatgtcaaccggggtgctagccaggggaccattgaaaggtgtacgtatccccataagtataagaagcggaagcttcattgcaagcaggatggtgaagaagggactgaagaagatacagaggaaaaatgcacgatatgcctctccattctggaagagggggaggacgtcagacggttgccgtgcatgcacctatttcatcaggtttgcgttgaccagtggctcataacaaacaagaaatgtcctatatgtcgagttgatatagaggcccagctaccgagtgagtcatag

SEQ ID NO: 23877 - DNA, 372 bp, Artificial Sequence
  Description of Artificial Sequence: Synthetic coding sequence
atggccaagatcaaggcccgggacctgcggggcaagaagaaggaggaactgctgaaacagctcgacgaccttaaggtggagctgagccagctgcgcgttgccaaagtgaccggtggagcggcctcaaaactcagtaaaattcgggtggttcgcaaaagtatcgcgcgcgtgctgacagttatcaatcagacccagaaggaaaatctcagaaagttttacaaaggtaagaagtacaagccgctggatctgcggcctaagaagaccagggccatgcgacggcgccttaacaaacatgaggagaatctcaagaccaagaagcaacagcgcaaggaacgcctctatccgcttaggaaatatgctgttaaggcctag

SEQ ID NO: 23878 - DNA, 1635 bp, Artificial Sequence
  Description of Artificial Sequence: Synthetic coding sequence
atgaagatcttctgcagccgggccaaccccaccaccggcagcgtggaatggcttgaggaagacgaacactacgactaccatcaggagatcgctcgttcatcctacgcagatatgttgcacgacaaggacaggaatgtgaagtactatcagggaattagagcagccgtgtcacgcgtgaaggacagaggccaaaaagcgctggtgcttgacatcggcactggcacggggctgttgagcatgatggccgtgaccgctggagccgatttctgctacgccatcgaagagaattgcgaagctgtgccccatagggcaacagtctacgcgcaattggtggagagtgggagaatgtggtcctggaacaagttgtttccaatacacgtgcaaacgtcactcggtgaacaagtgattgtaccgcccgtggacgtggaaagctgcccaggagcgcctagtgtgtgtgatatacagctgaatcaggtgagtcccgctgactttacagtgctgagcgacgtcctgcccatgttttccatcgatttttccaagcaggtgtcatcatccgccgcttgtcacagcaggaggttcgagccattgaccagcggacgtgctcaggttgtcctgtcatggtgggacatcgagatggaccccgaaggtaagatcaaatgtacaatggcacccttttgggcccacagtgaccccgaggaaatgcagtggagggatcattggatgcagtgtgtgtatttcctgccgcaggaggagcctgtagtgcagggtagcgccctttacctagtggctcatcatgacgactattgtgtctggtactctctccagagaacatcacccgagaagaacgaacgggtacgccagatgagaccagtgtgcgactgccaggcccatctcctatggaatcgccccaggttcggagagatcaatgaccaggaccgcactgacagatatgtccaggccctgcggaccgtgtcgctccttctgggagagccgttcttcacgaccagtttattgccttggcacaacctttatttctggtacgtgcggacagcagttgatcaacatctcggccccggtgcaatggtcatgccgcaggctgccagcctgcatgccgtcgtcgtcgagtttcgggatctatggaggatccgatctccctgcggcgactgcgagggtttcgacgtacacattatggacgacatgatcaaaagagcactcgattttcgtgaaagtagagaagccgagccgcacccattatgggagtatccatgcagatcgttatctgaaccctggcagattctgacattcgacttccaacagcctgttcctctacagcccctgtgcgccgagggcactgtggagctgaggagacctgggcaaagtcatgcggccgtgctgtggatggagtaccatctgacaccagagtgcactttgtcaacaggactgttggagcccgcagatccggagggcggatgttgttggaatccccactgcaagcaggctgtctacttctttagccctgcccctgatcctcgcgcgcttctcggaggacctcgcacagtctcctacgccgtcgaatttcaccctgataccggtgacatcatcatggaattccgacatgcagatactccggattag

SEQ ID NO: 23879 - DNA, 1131 bp, Artificial Sequence
  Description of Artificial Sequence: Synthetic coding sequence
atgcccctgcaggtgagcgactacagctggcagcagaccaagaccgcagttttcttgagcctgcccctcaaaggcgtgtgtgtaagagacacagacgtcttctgcaccgaaaactatctgaaggttaactttccgccgttcctttttgaagcatttctctatgcacccattgatgacgaaagctccaaggccaagataggcaatgatacgatcgttttcactctgtacaaaaaagaggcagcaatgtgggagacccttagtgttactggcgtggataaagaaatgatgcaaagaattagagagaagtctattctgcaggcacaggaaagagccaaggaagccaccgaggcaaaggcggctgctaagagggaagaccaaaaatacgcgttgagcgtgatgatgaagatagaggaggaagaacggaaaaaaatagaggatatgaaggagaacgaaagaatcaaggctaccaaagccttagaggcctggaaggagtatcaaaggaaagcagaggaacaaaagaaaatccagagagaagagaaactgtgtcagaaagagaagcaaattaaggaggaaaggaaaaagattaaatataaaagcctgacaaggaatctggcgagtagaaacttggcccccaaaggccggaacagcgagaacatcttcaccgaaaaactcaaagaggattcaatacctgcgccgcggtcagtcggtagcatcaagattaatttcacccccagagtgttccccaccgcattacgtgaatcgcaggtggccgaggaagaggagtggctgcacaagcaggctgaagccaggcgagccatgaatacagatattgccgaactctgtgacctaaaggaagaagagaaaaatcctgagtggctcaaggataagggtaataaactcttcgccacagaaaactacctggcagcgattaacgcctacaatctcgctattcggctcaacaacaaaatgcccttactgtatttgaacagggccgcctgccacctgaaactgaagaacctgcataaagcaatagaggattcttccaaggcttacaggattatgaaacggcacctccgcctgatccatcccactaagttgtataaactgatgttgaggcggtttggcatgtag

SEQ ID NO: 23880 - DNA, 4221 bp, Artificial Sequence
  Description of Artificial Sequence: Synthetic coding sequence
atgtggagcctgaccgccagcgagggcgagagcaccaccgcccactttttcctcggcgcaggcgacgaagggctgggaacaaggggtatcgggatgaggccggaagaatccgacagcgagctgctcgaagatgaggaggacgaagtccctcccgagcctcagattatagtgggtatatgtgccatgaccaaaaagtcaaaatccaagccaatgacccagattttggaacgtctgtgtaggtttgactatctgacagtggtgattcttggtgaggacgtgatcctgaatgagcctgtcgaaaattggccctcttgccactgcctgatctcatttcacagtaagggcttccctctggataaggcagtggcctattctaaattgagaaatcccttcctgatcaatgatctcgcaatgcagtactacatacaggacaggcgagaggtttaccgcattctccaggaggagggcattgatttacctaggtacgctgttctcaaccgggaccctgcccggccagaagaatgtaatctcatcgaaggagaggatcaggtggaagtcaatggcgctgtgttccctaagcccttcgtggagaaaccagtgtctgccgaggatcataatgtctacatttactatcccagcagtgccggaggcggcagccaacgactatttaggaagatcggttcaaggtcatctgtgtactcaccggagtcctcagttaggaagacaggttcctacatctatgaggaatttatgcccactgacgggaccgacgtgaaagtttacactgtcgggccagattacgcgcatgccgaggcccgcaagtcccccgccttggatggcaaagttgaaagggatagcgaggggaaggaaattagatatcccgtcatgctgacagctatggaaaaactcgttgcacgcaaggtgtgtgtcgcctttaagcagactgtatgcggatttgatctcctgcgagctaacggccacagctttgtgtgcgacgttaatggtttctcatttgtgaaaaatagtatgaagtattatgacgattgcgccaagatcctgggcaacaccatcatgagagagctcgcaccgcagttccaaatcccatggtcaattcccaccgaagccgaggatatccctattgtgccaactacaagtgggacaatgatggagctaagatgtgtcatcgcgataatccggcacggggaccgaacccctaagcagaagatgaagatggaggtgaagcaccccaggttcttcgctctcttcgagaaacacggcgggtataagaccggaaaactgaagttgaaacggcccgaacaactgcaggaggtgttggatatcaccaggctgctactggccgagctggagaaggagcctggaggagagatcgaagaaaaaaccggaaagcttgagcagctcaagtccgtgctcgaaatgtacgggcatttctccggaataaaccggaaggttcaattgacctactatcctcatggagttaaggctagcaacgaagggcaggatccacagcgagaaactcttgccccgtctttgctgctggtgctgaaatggggcggggagctgactcctgctggtagggtccaggccgaagaactaggccgggctttcaggtgtatgtacccaggcggccaaggcgactacgccggatttcccggctgtggcctgctgcggctccacagtaccttccggcacgatctcaagatctacgcgagcgacgaagggagggttcaaatgacagcggctgcctttgccaagggcttgctagccctggaaggcgaactcacgcctattctggtgcagatggtgaaatcagccaatatgaacggcttgttggattccgatggagactctttaagcagctgccagcacagagttaaagccagactgcaccacatactccagcaggatgccccctttggacccgaggattacgatcagttggccccaactcggagtacaagcctgctgaactccatgaccattatccagaaccctgtcaaagtatgtgatcaagtgttcgcattgatcgaaaacctgacccaccagatcagagagagaatgcaagatcctcgcagcgtcgacttgcagctttaccactccgaaactctggaactgatgttgcagagatggtcaaaacttgagagagatttccgccagaagtccggccgttacgacatctccaaaattccggacatctacgattgtgtcaagtacgacgtgcaacacaatgggtccctcggcctgcaaggcaccgcagaacttctgcgcctgtccaaggccctggccgacgtggtgatcccgcaggagtacggcatatcacgggaagaaaaattggagatagccgtcggcttttgtctccccctcctgcggaagattctactggatcttcagagaactcatgaagacgagtccgtaaataaactgcaccctctgtacagtagaggtgtcctgagccctggccggcacgtcaggactcggctatactttacttctgaatctcatgttcactctttgctcagtgtgttccgctatgggggtcttctggacgaaacgcaggacgcgcagtggcaacgagccctagactacctgtccgcaatatctgagcttaattacatgacgcagattgtgatcatgctctacgaggacaatacccaggacccgctgtcagaggagagattccacgtggaacttcacttctcgcccggggtcaaaggggttgaggaggaggggtctgcgcccgccgggtgcggattccgccctgcttctagcgaaaacgaggagatgaagacaaatcagggctcaatggagaacctctgtccgggaaaggcaagcgatgaacctgatcgggcactgcagacgagtccacagcccccagaaggacccggtttacccaggcgtagccccctgattaggaatagaaaagctggctcaatggaggtgctgagcgagactagtagctcacgtccaggtgggtataggctgttcagtagctccagaccgccgaccgagatgaaacagagtggactgggtttcgaagggtgttctatggtccccaccatataccctttagagacactccacaacgccctcagtttgaggcaggtttcagaatttctctctcgagtatgccaaagacatacagatgcccaggctcaggcttcagcggcactgttcgactcgatgcattcctcccaggcttctgataacccttttagcccgccccgcacactccatagtccccccctgcagctgcagcaacgctctgagaagcctccatggctggagacacgcttctgccatgtgggccaggcggggctcgagttgttgacctcatcagatctgcctgcctccgcctcacagtccgcaggaatcacaggggtgtcacacaggacacaaccagattcttccgggcccagttctaccgtgagtagcgccggcccatcaagccccacaacggtggacggaaacagccagttcggatttagcgatcagccctccctaaacagccatgttgctgaagaacaccaagggcttggtcttctacaagaaacgcctgggtcaggagcccaggaactgagcatcgagggtgagcaggagctgtttgaaccaaaccaaagtccccaggtgcccccgatggagacttcgcagccatacgaggaggttagtcagccttgccaggaagtccccgacatatcccagccgtgtcaggatatttcagaggctttgagtcagccttgccaaaaagtcccagacatttcacagcagtgccaggaaaaccacgacaacggcaaccacacatgccaggaggtcccacatatttctcagccctgccagaaatcctcccagctttgccaaaaagtgtcagaagaggtgtgtcagctgtgccttgaaaattccgaggaagtgagccagccctgccagggagtgtccgtagaagttggaaagctcgttcacaagttccacgtcggggttggttctttggttcaggagaccctagttgaggtgggatccccggcggaggagatccccgaagaggtcatccagccctatcaggaattctctgtggaagtgggcagactggctcaagaaacgtcagcaattaacctcctgagtcaagggatccctgagatcgacaagccaagccaggaattccctgaggagatcgaccttcaggcccaagaggttcccgaagaaataaactag

SEQ ID NO: 23881 - DNA, 1338 bp, Artificial Sequence
  Description of Artificial Sequence: Synthetic coding sequence
atggtgctggagggcaaccccgaggtgggcagcccccggaccagcgatttgcaacataggggcaacaaaggatcctgcgtactctcctctccaggtgaagatgcccagcccggcgaagagcctataaaatatggtgaactgatcgtactgggctataacggttgcctggcctcaggagacaagggccgccggagatctcgactggccctttctcggcggtctcacgctaacggcgtgaaacctgacgtaatgcatcacatatcaactcccttggtctccaaggcgctgtccaacagagggcagcactctatcagctacacactgtctcgtagtcactccgtcatcgtggagtatactcacgactccgatactgatatgtttcaaataggcagatcaacagagaacatgatagacttcgtagtcacagatacttccccaggcgggggcgccgccgaaggcccttccgcgcagagcacaatttccaggtatgcctgccggattctatgcgatcggcggccaccatacactgccaggatttacgctgccggttttgatgcctcgagcaatatttttctgggagagcgcgcagccaagtggcgaacacccgacggtcttatggatggtctaacaactaatggggtcttggtgatgcaccctgccggagggttttccgaggattccgccccgggcgtgtggcgggaaatatcagtctgcggcaacgtgtatacgcttcgagatagcaggtctgctcagcagcgggggaaactggttgagaacgagagtaacgtgttgcaagacggatccctgattgatctatgtggtgccacacttctctggcggacaccagctggcctgctgagagcgcctaccttaaaacaattggaagcacagcggcaagaggcaaatgctgctcgaccgcagtgcccggtcggtctttctacccttgccttcccaagtccagcacgaggaaggactgcccccgataagcaacagccatgggtatatgtgcgctgtggacatgttcatggttaccacggctggggatgccgccgcgaaagagggccccaagaacgggaatgcccactgtgccgattggtcggcccctacgtgcccctgtggctgggacaggaagccggcctgtgcctagaccccggaccccctagccatgccttcgccccgtgcggccatgtgtgctctgagaagacagcccgttattgggctcagactccgctcccccatggaactcatgcctttcacgcggcatgcccattctgtggggcgtggctaacaggagaacacggttgcgtgcgtctgattttccagggtccactagactag

SEQ ID NO: 23882 - DNA, 1950 bp, Artificial Sequence
  Description of Artificial Sequence: Synthetic coding sequence
atgggcaccgccctggtgtaccacgaggacatgaccgccacccggctgttgtgggacgaccctgagtgcgagatcgagaggcctgagaggctcaccgccgcactggatcggctccgccaaagaggcctggaacaacggtgcttgaggttaagtgcccgcgaggcctcagaagaagaactaggcctggtacatagcccagagtatgtgagtctggtgcgcgagacacaggtgctcgggaaggaggagctgcaggcacttagtggacagttcgatgcgatttattttcatccatctacattccattgcgcccgcttagctgctggcgccgggctgcagcttgtcgacgcagtcctcaccggtgctgtccagaatggcctggcattggtaaggccaccaggacatcacgggcagagagctgcggcaaacggtttttgtgttttcaacaatgtagcaattgccgccgcccacgccaagcaaaaacacggcctgcaccgcattcttgtggtggattgggacgtacatcacggacaggggatccagtacctctttgaggatgacccttccgtcctctatttcagctggcaccggtacgaacacggtcggttctggcccttcctccgggaatcagacgcagatgctgtagggcgaggacaggggcttggctttacagtaaaccttccatggaaccaggtggggatgggaaacgcagactacgtagcggcattccttcaccttctgttacccttagcgttcgagggccagatgcaggccactcctgagtgtttcgcccatttaacacagttgctgcaggtcctggccggcggaagagtttgtgctgttctggaaggtggctaccacctcgaaagtcttgcggagagcgtctgtatgactgtgcagacattgttgggggaccccgctccacccttgagcggaccaatggctccttgtcaatccgctctagaaagcatacaatccgctagagcagcgcaagctcctcattggaagtctctgcagcaacaagatgtgaccgcagtgcctatgtcgcctagtagccattcgcctgagggccgaccccctcctctgctgccgggaggccccgtgtgcaaagcggccgcctcagcacctagctcgctgctggatcagccctgtctctgcccggcaccttctgtccggacggccgtggctctgactactcctgacattactctggtgcttcctcctgacgtcatacaacaggaagccagtgctcttcgagaggaaactgaggcttgggctcggccacacgagtccctggcgagagaggaggccctgaccgcattaggcaaactgctctatctgctggatggtatgctggatgggcaggtgaactctggaatcgccgcgacaccagctagcgcagcggccgccaccttggatgtggcggttcgtcgcggcttgagccatggggctcagcgcttgttatgtgtggccctgggccagctcgaccgtcctccagaccttgcccacgacggacgctccctgtggctaaatattcgggggaaagaggcggctgctctctcaatgttccacgttagcacccctctgcctgtgatgaccgggggcttcctgtcttgcatccttggccttgtgcttcctttggcttacggattccagcccgatctggttctggtagcgctgggccctggtcacggcctgcaaggtcctcacgctgccctgttggctgccatgctgcgaggactggcaggtggcagagtattagcactgcttgaagagaactcaaccccccagttggctggaatccttgcgcgggttttaaacggggaggcacctccatctctcgggccctcttctgtggcatctcccgaagatgtgcaggctcttatgtatctccgtggacagctcgagccccaatggaaaatgctgcagtgtcacccgcacctagtggcctag

SEQ ID NO: 23883 - DNA, 795 bp, Artificial Sequence
  Description of Artificial Sequence: Synthetic coding sequence
atggccggcgagcagaagcccagcagcaacctgctggagcagttcattctacttgcaaaagggacttcagggagcgcccttactgctctgattagccaggttctggaagctccaggagtatatgtgttcggagaattactagaactcgctaacgtgcaggagctggcggagggggctaacgcggcctacctgcagcttcttaatctgtttgcttacggtacctacccagactatatcgcaaacaaagaatcattgccagaactgtcaacggcacagcagaataaactcaagcacttgactatagtttcattagcttcgcgaatgaaatgtataccatatagcgtgcttctcaaagatctggaaatgagaaaccttcgcgagttggaagacctgatcattgaagctgtttacacagatatcatacagggaaagcttgatcagagaaatcagctcttggaagtcgacttctgcatcggtagagacatccgcaagaaagatattaacaacatagtgaagaccctgcatgaatggtgcgacgggtgtgaggccgtgctgctggggatagagcagcaagtgcttcgtgccaatcaatataaggaaaatcacaatcggacccaacagcaagtagaggccgaggtgacgaatatcaagaagaccctgaaggccaccgcgtcctccagtgctcaggagatggagcagcaattggccgagagagagtgccccccccatgcggaacagcgtcaacctactaagaagatgtcaaaagtgaagggcctggtgtcctctaggcactag

SEQ ID NO: 23884 - DNA, 726 bp, Artificial Sequence
  Description of Artificial Sequence: Synthetic coding sequence
atgagcgccagcctgaactacaagagcttcagcaaggagcagcagaccatggacaatctggagaaacagctgatctgtcccatttgcttagagatgttcaccaaacccgtagtcatccttccctgtcagcacaacctgtgcagaaagtgcgcatcggatatcttccaggcttctaacccatacctgcctacgaggggtggtaccacaatggcttcaggcggaagattcaggtgcccatcttgtagacacgaagttgtgctcgaccggcacggggtgtacggtcttcagaggaacctcctcgtcgaaaatattattgacatctacaagcaggaatcgacccgtcccgagaagaaatccgatcagcccatgtgtgaagagcacgaagaagaaaggatcaacatttactgtttaaattgtgaagtgcctacctgttccttgtgcaaggtgttcggagcccacaaggactgtcaggttgcacctttaacccacgtttttcagagacagaaaagcgagctctccgacgggatagctatccttgttgggtcaaatgaccgagtacagggggtaatttcacagttggaggatacttgcaagactatcgaaatcggcttcgaggccccacccttacaaggccaggctgccgcgcccgcctccggaagcggagccgatagcgagcccgcccggcatattttttccttctcttggctgaattctttgaatgaatag

SEQ ID NO: 23885 - DNA, 3501 bp, Artificial Sequence
  Description of Artificial Sequence: Synthetic coding sequence
atggccaacgacagccccgccaagagcctggtggacatcgacctgtcctcacttcgcgacccggccggtatattcgagctcgtggaggtcgtgggtaacggtacttatggtcaggtctataaaggtaggcacgtgaagacggggcagctcgccgcaatcaaagtgatggacgttactgaggacgaagaggaggagattaagcttgagattaacatgctgaagaagtactcccaccacagaaacattgccacatactacggcgcgtttatcaaaaagtcaccaccaggtcatgatgaccagctatggctggttatggaattttgtggcgcaggtagcattaccgatctagttaagaacacaaagggcaacacacttaaagaggactggatcgcttacatttctcgggagattttaaggggtctcgcacacctgcatattcatcacgttatccaccgggacataaagggacagaacgtgctgttaacggagaatgccgaggtaaagctcgttgatttcggtgttagcgcccagcttgatcgcaccgtgggaaggcgaaacacttttattggcacaccatactggatggcaccggaggtgattgcttgtgatgagaaccctgatgccacatacgactatagaagcgacctatggagctgcggcattaccgccatcgagatggcggaaggagctccacccttatgtgacatgcatccaatgagggccctgtttctcattccacggaacccacctccccgtctgaagagcaagaagtggtccaagaagttcttcagctttattgaggggtgtcttgttaagaattatatgcaacggccttcgacagagcagcttctgaagcacccttttatccgtgatcagccaaacgagcggcaggttcggatccaattgaaggaccacattgaccggacacggaagaaacgcggcgagaaggacgagacggagtacgaatattccggctcagaggaggaagaggaagaggtgcccgagcaggagggcgagccaagcagtatagtgaacgtccccggcgaatcaaccctgaggagggattttttaagattgcagcaggagaacaaggaacgaagcgaagctctaaggaggcaacagttgttgcaggagcaacaattgagggaacaggaggagtacaagcggcaactgctggcagagaggcagaagcggatcgagcagcagaaggagcaacgtcggcggctagaggaacaacaaagaagagagagagaggctcggaggcagcaggagcgcgaacaacggaggagagaacaggaggagaaacgcaggttggaagagctcgaacgacggagaaaagaagaggaagaacgtagacgggctgaggaggagaaacgacgggtggaacgggagcaggagtacatcagaagacagctcgaggaagaacagcgtcacttggaggtcttgcagcagcaactattgcaggaacaggccatgctgctacacgaccaccgccgcccccacccacagcattcacagcagccgccccctcctcagcaggaacgatctaaaccgtcctttcacgcgccagaaccgaaggcccattatgaacctgctgatcgtgcccgggaagtgcctgttagaactacctcacgatcgcctgtgctctctagacgggacagccctttacaggggtccggtcagcagaactcgcaggcaggacaaaggaactctaccagttccatcgagccccgactgctttgggaaagggtggaaaagctcgtgccaagaccgggtagcggaagttcttctggcagtagcaactccggctcccagcccggctcccaccccggaagccagtccggcagcggcgaaaggtttagggtgaggtcctcaagcaagtctgagggctccccaagtcagagattagagaatgccgtgaaaaagccagaagataaaaaagaggtcttcaggccactgaagcctgccgttagaatagacctgaccgctctggcaaaagagctgcgcgctgtcgaagacgtgagacccccacataaggtgacagactattcatccagtagcgaagagtctggcactactgacgaggaggatgacgatgtggagcaggaaggcgccgatgaatccacttctgggccggaagatacaagagccgcttcctccctaaacctcagcaatggagagacagagtcagtaaagacaatgatagtccacgatgacgtcgaatcggagccagcaatgacacctagcaaagagggaactctgatcgtaaggcaaactcagtccgcctctagtaccctgcagaagcacaagtcgtctagctcctttacccccttcatcgacccacggcttttgcagatctcaccctcatctggcacaacggtgacctccgtggttggctttagctgcgacggaatgaggcccgaggcaatccgccaagatcctacgcggaaaggctctgtggtcaacgtaaatcccaccaatacgcgcccccaatcagacacacccgagattagaaagtacaagaagcgcttcaacagtgaaattctttgcgctgcactctggggtgttaacttgctggttggcactgagagcgggctgatgcttctcgatcggagtgggcagggcaaagtgtatcctctaatcaatcgccgcaggttccaacagatggacgtgctcgaaggcctaaatgtgcttgttaccatttctggaaaaaaagataagctgagggtgtactacctatcatggctcagaaataagattttacacaatgatcccgaggttgaaaagaagcagggctggaccaccgtaggcgacttagaaggctgtgtgcattacaaggtggtgaagtatgaaaggattaaattcctggtgatagcactgaagtcttcagttgaagtatacgcgtgggcccccaagccttatcacaagttcatggcattcaaaagttttggcgagctcgtacacaaaccactcttggttgacctgaccgtagaggaagggcagcgcctgaaagtgatctatggatcttgcgccggttttcatgcggtcgacgtggactccggttcggtatatgacatctacctacctactcacgtgcgcaaaaacccacacagcatgatccagtgtagcataaagccccatgcgatcatcatcctgccaaatactgacgggatggagctgctggtgtgttatgaggacgagggtgtttatgtgaatacctacgggcggatcacaaaggatgtggtgcttcaatggggggaaatgccaaccagtgtggcctacattagatccaaccagactatgggatggggcgagaaagccattgagatcagaagtgtcgagaccggccatctcgacggagtgtttatgcacaaaagggcacagcgcctgaaattcttatgtgagcggaacgataaagtcttctttgcctctgtccgcagtggggggtcttcacaggtctatttcatgaccctgggaagaaccagcctgctgagctggtag

SEQ ID NO: 23886 - DNA, 2466 bp, Artificial Sequence
  Description of Artificial Sequence: Synthetic coding sequence
atggtggcccccgtgctggagaccagccacgtgttctgctgccccaacagagtacgcggagtcctaaattggagcagtggaccaagagggcttctggcatttgggaccagctgttcagtggtgctgtacgacccattgaaacgcgttgttgtgactaacctaaacggccataccgctcgggtgaattgcattcagtggatttgcaaacaggatgggagccctagtacagaacttgtatccgggggctctgataaccaggtgatccactgggaaatagaggataatcagcttctgaaggccgtacatttacagggacatgaaggccccgtttatgccgtgcacgcggtttaccagcggagaacctccgacccagctctgtgcacactcatcgtgagtgccgctgctgactccgccgtgaggctatggtcaaagaagggtcctgaagtgacctggaaaacaggccaggtggaaagaggcagagcttggaaacctccggcttccttggcgctatgttctcggtcctgtgatagtatggtctcatgttatgcttccattctgtgtaaggccctctggaaggagaagctccacaccttttggcaccacaatcgaatctcctttcttccatccgcttttcgacccatccctattctggcctgcgggaatgacgactgccgcattcacatattcgcacaacaaaacgatcagtttcagaaagttctgagcctctgcgggcacgaagattggatccgcggggtggagtgggccgcatttggcagagacctgtttctagcctcgtgctctcaggattgcctgattaggatttggaagctctacattaagtcgacaagtttggaaacacaggatgacgacaatatcaggctcaaagagaatacattcacaatcgagaacgagagtgtgaaaattgccttcgctgtgacgctagaaaccgtgttggccggccacgagaattgggtaaacgcagtgcactggcaacccgtgttctacaaggacggcgtgttgcaacagcccgtccggctgctttccgcttcgatggacaaaaccatgatattatgggctcccgacgaagaatccggcgtgtggctggagcagagagagtggacccctgagatcgtcatctctggacacttcgacggagtgcaagacctcgtatgggatcccgagggcgaattcatcatcactgtaggaaccgatcaaactactaggttgttcgccccatggaaacgcaaggaccaaagccaagtgacgtggcatgaaatcgccaggccccaaatacacgggtacgacctcaagtgcctggccatgatcaaccgattccaatttgtctctggggcagacgagaaggtattacgcgtgttctccgcccccagaaactttgtggagaatttctgcgccatcaccgggcaaagcctgaaccacgtgctttgtaaccaggattccgatctgcccgagggtgcaaccgttcctgcccttggcctctccaacaaagctgtgtttcagggagacatcgcttcgcagccttccgatgaagaggagctcttaacttccacaggctttgaatatcagcaagtggcctttcagccttccatcttgacagaaccacctacagaggaccacctgctgcagaatacactgtggccagaggtccagaagctatatggccatgggtatgagattttttgtgtgacgtgtaacagtagcaagacccttctggccagtgcctgcaaggccgcgaagaaggaacacgccgccatcatcctttggaatacaactagttggaaacaggttcagaatctcgtttttcattcattaactgtcacccaaatggcattctctcctaacgagaaattcctgctcgccgtttccagagatcgaacttggtctctgtggaaaaaacaggataccattagcccagagtttgagcctgtatttagcctcttcgcctttacaaataaaatcacttctgtccactcacggatcatatggagttgcgactggtctcccgacagtaagtatttcttcacaggaagccgcgataaaaaggtggtcgtttggggggaatgcgattctaccgacgattgtattgagcacaacattggaccatgttcaagtgtgctggacgttgggggcgctgtgactgcagtgagcgtttgccctgtgttacatccctcacaaaggtatgtggtggccgtcggtctggaatgtggaaagatctgtctctacacgtggaagaagaccgaccaggtgcctgagatcaacgattggactcactgtgtggagactagtcagagccagtcccacactcttgccataagaaagctgtgttggaagaactgtagtggcaagaccgagcaaaaagaggccgagggcgccgaatggctgcactttgcatcttgtggggaggatcacacggttaagatacaccgggtgaacaaatgcgctctttag

SEQ ID NO: 23887 - DNA, 969 bp, Artificial Sequence
  Description of Artificial Sequence: Synthetic coding sequence
atggtgagcgtgatcaacaccgtggacaccagccacgaggacatgattcatgacgcacagatggattattacggcaccagactcgctacctgttcaagcgacaggtctgtaaagatttttgatgttcgtaatggtgggcagattttgatcgccgacctgcgcgggcatgaagggcccgtgtggcaggtggcgtgggcccatccaatgtacggcaacatcctggccagttgctcttatgaccgcaaagtcattatatggcgcgaagaaaacggtacctgggagaagtcccatgagcatgctgggcacgactcgtccgtgaactctgtctgttgggctccacatgactatggtttaatcctagcatgcggatcctcggacggcgccatttctctcctcacctacactggggaagggcagtgggaagttaaaaaaattaataacgcacacacaatcggctgtaatgctgttagttgggcaccagcagtcgttccgggatcccttattgaccacccctccggacagaaacccaattacataaagaggttcgcgagtgggggctgtgacaacctgataaagctttggaaggaagaggaagacggacagtggaaagaggagcagaaactggaagcccactcagattgggtgcgcgatgtggcctgggcgcctagcattggcttgccaacctccaccattgcctcctgttctcaggatgggcgagtattcatctggacatgcgacgatgcttcctcaaatacatggtcgcccaaactgcttcataagtttaacgacgtggtgtggcacgttagttggagcatcactgcaaacattctggccgttagcgggggcgacaacaaggtgactctatggaaggagtcagtggatgggcagtgggtatgcatctctgacgtgaacaagggccaggggagtgtgtcggcgagtgtcacagaaggccaacagaacgagcaatag

SEQ ID NO: 23888 - DNA, 1347 bp, Artificial Sequence
  Description of Artificial Sequence: Synthetic coding sequence
atgagcagccggaagctgagcggccccaagggccggcggctgagcatacatgttgtcacctggaacgtagcatcagccgcccctccgctggacctgtccgatctattacaactcaacaaccggaatctgaatctggacatatatgtaatcggtttgcaggagctgaacagcgggattatctctctcctttcagatgcggcctttaatgactcctggtctagttttcttatggacgtcctgtcgcccttgagcttcatcaaggtgtcccatgtccgaatgcagggcatcttactgctggtcttcgctaagtaccaacaccttccctacatccagatcttgagcacaaagagcaccccgaccggactattcggatattgggggaataaggggggggtgaatatatgcttaaaactgtatggctactacgtgtcaatcatcaactgccacctccctccacacatttccaataattatcagcgcctggagcattttgatagaattctggagatgcagaattgtgagggtagagacataccgaacatcctggatcacgacctgatcatctggttcggagacatgaattttcgcatcgaggactttggcctccatttcgtccgggagagtatcaagaaccggtgttatggaggtctctgggagaaagaccaactgtcaattgcaaagaaacacgatccattgttaagagagtttcaagaaggacggttactgttccctccaacatacaaattcgatcggaactcgaacgattacgatacctcagagaagaaacggaagcctgcctggacagacagaatcttatggagactgaaaaggcaaccatgcgccgggccagatacccccattccccccgcatcccactttagcctgagcttgaggggctatagttcacatatgacatacgggatctcagaccacaagcccgtgtctggtacatttgaccttgagttgaagccgctggtgtcagcccccctgatcgtactgatgcctgaagacttgtggaccgttgagaatgacatgatggtctcttattcttccacaagtgactttccatcctccccctgggattggattgggttgtataaagtgggactgagggacgtgaacgactatgtgagctatgcttgggtgggcgactccaaggtgtcctgctccgacaatttaaatcaggtttatattgacatctccaatattcccaccaccgaggatgaattcctgctgtgctactactccaatagcttgcgctcagtggtggggatctctcggcccttccagatccctcccggcagcttgcgggaagaccctttgggcgaggctcagccccagatctag

SEQ ID NO: 23889 - DNA, 1641 bp, Artificial Sequence
  Description of Artificial Sequence: Synthetic coding sequence
atgggcgcctacctgagccagcccaacaccgtgaagtgcagcggcgacggcgtcggcgctccacgactgccactgccgtacgggttctcagccatgcaaggatggagagtgtccatggaggatgcccacaactgtattcctgagctggactccgagacggccatgtttagtgtctacgatggccatggcggcgaagaggtggccctttattgcgccaagtatcttcctgacattatcaaggatcagaaggcatataaagagggtaaacttcagaaggccctggaggacgcttttttggccatcgatgccaagctgacaaccgaagaagtcatcaaggaactggcacaaattgccgggaggcccactgaggacgaggacgaaaaggagaaagtggctgacgaagatgacgtggacaatgaagaggccgcccttctgcatgaggaagcaaccatgacgatcgaagaattgctgaccaggtatggacagaattgccacaaagggccgccccactccaaaagtggcggaggaaccggcgaggagcctggttcccagggactgaatggcgaggccggcccagaggactccaccagggagacaccatctcaggagaatggacccactgcaaaggcgtatacaggtttcagcagcaacagcgagagaggcacagaagccggccaggttggcgaaccaggtatccccactggtgaggcaggaccctcctgctcttcggcctcagataagctacctagagtggccaagtcaaaattcttcgaagattctgaagacgaaagcgacgaggctgaagaggaggaggaggattccgaagagtgcagtgaggaagaagacgggtactccagcgaggaagccgaaaatgaggaggacgaggatgacactgaagaagccgaagaagacgatgaggaagaggaggaggagatgatggtgcctggcatggagggaaaggaggagcctggcagtgactctgggactactgctgtggtcgcgctcatcaggggcaagcagctgatcgtagctaacgcaggagacagtaggtgcgtcgtgtctgaggcaggcaaggccctggacatgtcatacgatcataaaccagaagacgaggtagaactggccagaattaagaatgctggcgggaaggtgacaatggatgggcgagtgaacggcgggcttaacctgtcccgagccataggtgaccacttttataaaaggaataaaaacctcccacctgaggagcagatgatttccgcactcccagatattaaagtgttaacccttactgatgaccatgagttcatggtaatcgcttgtgatggcatttggaatgtgatgtcaagccaggaggttgttgacttcattcaatctaaaatctcccagcgagatgaaaatggggagctcaggcttctgtccagcatcgttgaggagttattggatcaatgtttggcacctgatacttccggggacgggacaggctgtgacaatatgacctgcattatcatatgtttcaagccacgcaacaccgcggagctgcagccagaatcagggaagaggaaattggaggaggtcttatctactgagggggccgaagagaatggcaattcggacaaaaaaaagaaagccaaaagagactag

SEQ ID NO: 23890 - DNA, 3840 bp, Artificial Sequence
  Description of Artificial Sequence: Synthetic coding sequence
atgctgcaggccctgcagctgcggaccggcttcttctgcttccgggtgttggttgccttgagtccatgcgccctgcacgattccggtcggcttaccacaggctcattcaacgttgtcagagatgaggaagaagaaatcaagctggaaattaatatgttgaagaagtattctcatcaccggaacattgcaacctactatggtgcgtttattaagaaaagcccaccaggtcacgatgatcagttgtggctggtaatggaattctgtggtgcaggcagcataaccgatctggtgaaaaatactaaggggaacaccctgaaggaggactggatagcctatatatctcgagagatcctgcgtggtttagcccacctccacatccaccatgtgatccacagggacatcaaggggcagaacgtcctgctcaccgagaacgctgaggtgaagctagttgacttcggtgtgtcagcccaattggaccggactgtcggacggcggaataccttcattggtactccctactggatggcaccagaagtcatcgcctgcgatgaaaaccccgacgccacatatgactacaggtctgatctgtggtcctgcggtataaccgcaatagagatggccgagggggcccctcctctgtgcgatatgcacccaatgcgagctctattccttattccaagaaacccccccccaagactcaagtctaagaaatggtccaagaagttcttttccttcatcgaagggtgcctggtgaaaaattatatgcagagaccttcaactgaacagttactgaaacacccttttatccgcgatcagccaaacgagcgccaggtccggattcaactcaaagatcacatcgaccgtacacggaagaagcgaggcgagaaggacgagaccgaatacgagtattccggatcggaagaggaggaagaagaggtgccagaacaggagggagagccctccagcattgtgaatgttccaggcgaatcaacgttgcgcagagacttccttcgcctccaacaagaaaacaaagaacgaagtgaagctttacgcagacagcagctgctccaggaacagcagttgagagaacaggaggagtataagcgccaactgttggctgaaagacagaaacgcatagaacagcagaaagagcaacgtcggcgactggaagaacaacagaggcgggagcgggaagctcgacgccaacaagagagggagcagaggagacgggagcaagaggagaagcgccgccttgaagaacttgagcgccgtaggaaggaagaggaggagcgccggagagcagaggaggaaaaaaggcgggtggagcgggagcaggaatacatacggcgtcagcttgaggaggagcaacggcatctggaggtcctacagcaacagctgttgcaggaacaggccatgctgcttcacgaccacagaaggccacatccccagcactcccagcaaccacccccccctcagcaggagagatctaagccttccttccatgccccagaacctaaagcccactatgagcccgctgatagggcacgggaagtccagtggtcccacctggcctcattgaagaacaatgtcagccccgtgtcccggtcacactcctttagcgatccctcaccaaaattcgcgcaccaccatttaaggtctcaggatccttgccctccgtctagatcagaggtgctctctcaaagttcagactcgaaaagcgaggcacccgaccccactcagaaggcatggtctagaagcgacagcgacgaagtgccaccgcgcgtccccgtgcgaacaaccagccgaagtcctgtcctgagtcgacgtgactcgcctctgcagggtagcggacagcagaactcccaagccggccagagaaatagcacatctagtatagaaccacggctgttatgggaaagagtcgagaagctcgtaccaaggcccgggtccgggtctagctctggctcatctaatagtgggagccagccaggatctcaccctggctcccagtcgggttctggagagaggtttcgtgtgcggagttcttctaagagcgaggggtcaccttcccaacgactggaaaacgctgtgaaaaaacccgaagacaagaaagaagtttttcggccactgaagccggccgtcaggattgaccttacagcactggccaaggagcttagggcagtggaggacgtaaggcctccacacaaggtgacagattattcttctagctcagaagagtctggaaccacggacgaagaggatgatgatgtggaacaggaaggggccgacgagtcgaccagcggcccagaagatactagggcagctagcagtctcaacctgtccaacggagaaacagagagcgtgaaaacaatgatcgttcacgacgatgtagaatctgagcccgcaatgaccccctctaaggaggggacccttattgtacggcagtctaccgtggatcagaagagagcatctcaccatgaatcgaatggtttcgcaggaagaatccacttacttccagatctgctacagcaaagtcatagtagctcaaccagctcaacatcctcaagccccagtagctctcagcctacgcccactatgtcgcctcagaccccacaggacaaactgactgcaaatgagacccagtctgccagcagtactctgcagaaacacaagagcagcagctctttcaccccattcatcgaccctagactgcttcagatatctccctcaagcggcaccaccgtgacatcggtggtcggcttctcctgcgacggaatgcgccctgaggctattaggcaggatcctactaggaaaggatcggtcgtcaacgtcaacccaacaaataccaggcctcagtctgacacaccagagattcgaaagtataaaaaacgatttaacagcgagatcctttgtgctgccctctggggggtgaacctcctcgtcgggaccgagtcggggctcatgctgttagacaggagtgggcagggcaaggtgtacccgcttattaacagaaggagatttcagcagatggacgtgctcgaagggttaaacgtgctcgtgacaattagcgggaaaaaggataagcttcgggtgtactatctcagctggctgagaaacaaaatcctccacaatgaccccgaagttgaaaaaaaacagggctggaccacagtaggcgatctggagggatgcgtacactacaaggtcgtcaaatacgagcggatcaagttcctcgtgattgctctcaaatcctcagtggaggtgtatgcctgggctcccaagccttaccacaaatttatggcctttaagtccttcggtgaactggtccataagcctctgctggtggatctcaccgtagaggagggacagagactgaaagttatatacggttcttgcgccggattccatgcagtggacgtagacagtggcagtgtgtacgacatttacttgcctactcacatccaatgctcaatcaagccccacgccatcattatcctgcccaacacagatggcatggagcttctcgtgtgctacgaggacgagggggtttacgttaacacttatgggaggatcactaaagatgtggtgctgcagtggggcgagatgcctacatctgtcgcgtatatcagatcaaaccagactatgggatggggagaaaaggcaattgagattcgctcggttgaaaccgggcatctggacggcgtcttcatgcacaagcgcgcccagcggttgaaattcctctgcgagcgcaacgacaaagtcttctttgctagcgtgcgctcgggcggatcaagtcaggtctactttatgacgttggggaggactagcctgctatcatggtag

SEQ ID NO: 23891 - DNA, 1989 bp, Artificial Sequence
  Description of Artificial Sequence: Synthetic coding sequence
atggccagctgccccgacagcgacaacagctgggtgctggccggcagtgagtcattgccagtcgagacactggggcccgcaagcagaatggatcccgagtctgaaagagcactgcaggcccctcattccccctcaaaaacggatggtaaagaactggctggcacgatggacggcgaagggaccctgttccagacggagtctccccagtccggatccattcttaccgaagaaactgaagtcaagggcaccctcgagggggacgtgtgtggggtggagcctccgggtcctggagataccgttgtgcagggcgacctgcaagaaacaacagtggtcactgggcttggaccagatactcaggacttagaggggcagagcccaccccagtccttgccgagcacccccaaggctgcatggatacgtgaggaggggcggtgctcaagcagcgacgacgatactgatgtggatatggaaggactacggcggcggcgtgggagagaggctgggccaccacaacccatggtccctcttgccgttgagaatcaggccggaggcgaaggagccggcggcgagctgggaattagcctgaacatgtgcctcctgggagctcttgttctattaggcttaggtgtgctgctcttcagcggtggactctctgaatctgagaccggccccatggaggaagtggagcgccaggtgctgccggatcccgaggtattggaggctgttggcgaccggcaggacggcttgcgggagcagctccaggctccagtccccccagattccgttccatctctccagaatatgggactcctactcgataagctggctaaggagaaccaggatatccggcttctccaggcgcaactacaggcccagaaggaggaactacagtccctgatgcatcagcccaaagggctagaggaggagaacgcccaacttcggggggcactgcaacaaggagaggcgttccaaagggcgctggagtccgaactgcagcagctgcgggcacgtttgcagggcttagaggcagattgtgtaaggggccctgatggagtgtgcctgagtggtggcaggggaccacagggggacaaggccatcagagaacaggggccccgggagcaggaacccgagttgagtttcctcaagcagaaggagcagctagaggcagaagctcaggctctcaggcaggaattagaacgccaacgtaggctcctgggctcagtgcaacaagacctcgagcgtagcctgcaagacgccagccgcggagatccggcccatgctggattggccgaactcggccatagactcgcccagaagctccaaggccttgagaattggggccaagacccgggggtgtcagctaacgccagtaaggcatggcatcagaagagccatttccagaactcgagggaatggagtggtaaggaaaagtggtgggacggccagagggaccgaaaggcagaacattggaagcacaaaaaagaggaatccggtagagagagaaagaagaattggggcgggcaggaggatcgcgaacccgctggtcggtggaaggaaggacggccccgggtggaagagagcggctcgaagaaagagggaaagagacagggtcccaaggagccaccacgcaaatccggatccttccattccagcggggagaagcagaagcagccccggtggagagagggcaccaaggagttgccgctaagccccgctttttttggcgaggacggtattttcagacacgaccgtctgcgcttccgcgattttgtcgatgcactggaggacagtctggaagaggtggcagtacagcagaccggcgatgatgacgaggtggacgacttcgaggactttatcttctcgcacttttttggagataaggcactgaagaagcggagtggaaagaaggacaaacactcacagtcacctcgggctgcaggcccccgagagggacactctcactcgcaccatcaccatcatcggggctag

SEQ ID NO: 23892 - DNA, 2403 bp, Artificial Sequence
  Description of Artificial Sequence: Synthetic coding sequence
atggtggcccccgtgctggagaccagccacgtgttctgctgccccaatagggtgcgcggcgtcctgaactggagttcaggacctagggggctgctggcttttggcacttcatgcagtgtagtactctatgatccacttaagcgtgtggtcgtgacaaatttgaatggccacacagcgagagttaactgcatacaatggatctgcaaacaggacggttccccttccacagaactggtgagcggcggatccgacaatcaagtgatccattgggagatcgaagacaatcagctgctgaaggccgtgcatcttcagggacacgagggaccagtgtacgccgtgcacgcagtgtaccaacgcaggacatctgaccccgcgctttgtacgctgatcgtatcagccgctgccgatagtgccgttcgactgtggagtaaaaaggggccggaagtcccgatcctagcttgcggtaacgacgattgccgaatccacatattcgcacagcagaatgatcagtttcagaaagtgcttagcttgtgcggtcacgaagattggatacgcggcgtggagtgggctgcattcggccgcgacctcttcctggccagctgctcacaggactgtctcatcagaatctggaagctgtatataaagtccactagcttggaaacccaagacgacgataatatccggctgaaggaaaacacctttacaatcgagaacgaatctgtgaagatagccttcgcagttactttggagactgtgctggcgggccacgaaaactgggtgaacgcagttcactggcagcccgtcttctataaggatggcgtgctacaacagcctgtgcgtctcctatccgccagcatggacaaaacaatgattctatgggcacctgatgaggagtccggtgtatggttggagcaagtccgcgtcggcgaggtggggggtaacacactcggattctatgattgtcagttcaacgaggacggctcgatgattattgcccacgcttttcatggcgcacttcacctttggaaacagaacacagtgaacccacgcgagtggacccccgagatcgtgattagtgggcattttgatggtgttcaggaccttgtctgggaccccgagggcgaattcatcattactgtcgggaccgaccagacgacaagactgttcgcaccctggaaacgtaaggatcagtcccaagtgacctggcatgagatcgcccgtcctcaaattcatggctacgacttgaagtgcctcgccatgatcaaccgatttcaatttgttagcggggcggatgagaaagtgctgagggtgttttccgccccacgtaacttcgtcgagaacttttgtgccatcacgggtcaatccctgaaccacgtcctgtgcaaccaggatagcgacctgcccgagggagctactgtcccggcactcggacttagtaacaaagccgtgttccaaggcgatatcgccagtcagccatccgacgaggaggagctacttacctctaccggttttgaataccagcaagtggccttccagcccagcatccttaccgaaccaccgaccgaggatcacctgctgcagaacactctgtggcctgaggtgcaaaagctgtatgggcacggctatgagatcttttgtgtgacgtgcaatagttctaagacattgctagcgtctgcctgtaaggccgccaaaaaggagcatgccgctataatcctatggaacactacttcatggaagcaggtccaaaacctggtcttccatagcctcaccgtgactcagatggccttttcgcctaacgagaagttcctgctggcagtttctcgggaccgcacctggtcactgtggaagaagcaggatacaatctctcccgaattcgaaccagtgttctcattatttgctttcaccaacaaaatcaccagcgtccactcaagaataatttggtcgtgcgactggagtcccgattccaaatactttttcactggctcccgggacaaaaaagtggtcgtttggggagagtgtgattccacagacgactgtattgagcataatattggcccttgttcatccgtgctggacgtgggcggcgccgtcaccgctgtatcagtgtgcccggtgctccacccgtcccagagatacgtcgtggccgtgggcttagaatgtgggaagatttgcctgtacacttggaaaaagactgatcaggtgccggagatcaatgactggacccactgcgtggagacctcccagtcccaaagccacacactggccatcagaaagctttgctggaagaattgtagcggaaaaactgaacagaaggaggcagaaggggccgagtggcttcactttgcgtcctgcggggaagaccacaccgtgaaaattcaccgcgtgaataagtgcgccctctag

SEQ ID NO: 23893 - DNA, 561 bp, Artificial Sequence
  Description of Artificial Sequence: Synthetic coding sequence
atggccggcgagaacttcgccacccccttccacggccacgtgggccggggtgccttttcagatgtgtacgagcctgcagaagacaccttcttgttgttaaacgccctcgaagccgccgctgctgagcttgccggggtggagatctgtcttgaggtcggaagcgggagtggagttgtttccgctttccttgcatccatgatcgggccgcaggctctttatatgtgcaccgacatcaatccagaggcggcagcctgcactttggaaacagcacgttgcaacaaggtgcatatccagcccgtgatcacagacctggtggggtcccatggcattgaagccgcttgggccggtggtaagaacggtagagaggtcatggaccggttttttcctttggtccctgacctcctttcgccgaagggtcttttctacttagtgacaatcaaagagaataatccggaagagatcttgaagatcatgaaaacaaaaggtctccagggtaccacggctctgagccgtcaagccggccaagagacgctctcagtgctgaagttcaccaaatcatag

SEQ ID NO: 23894 - DNA, 2352 bp, Artificial Sequence
  Description of Artificial Sequence: Synthetic coding sequence
atggccaagtacaacaccggcggcaaccccaccgaggacgtgagcgtcaatagccgtcctttcagagttactggacccaacagctcttctggaattcaggccaggaagaatttattcaacaaccagggaaatgcttcaccacctgcaggtcctagcaatgtaccaaagtttggtagtcctaagccccccgtcgccgttaagccgtctagtgaggagaaacccgacaaagagcctaagccaccttttttgaagcccacaggagctggccagcgttttgggacacccgcttccctgaccacccgggacccggaagctaaagtaggatttttaaagcctgtgggaccaaagcctattaacctccctaaagaggattctaagccaaccttcccttggccccctggaaacaagccatcattacatagcgtcaatcaagatcacgaccttaagcctctggggcccaaatctggacctacgcctcctacgagtgagaacgagcagaaacaggcattcccgaaactgactggcgtgaaaggcaagttcatgagtgcttcccaagatctggagccgaaacccctcttccccaaacccgccttcgggcagaagcctccactgagcactgagaacagtcacgaggatgagtcccctatgaagaacgtgagcagtagcaaaggctccccagcccctctgggagttcgatcaaaatccggtccactgaaacccgccagagaagatagtgagaataaggatcacgcgggagaaatcagttcccttcctttccccggagtcgtgctgaaaccagcggcctccagagggggcccaggactgtccaagaacggagaagagaaaaaagaagatcggaagattgacgccgctaaaaatacgttccagtctaagatcaaccaagaggaactagcctcagggacaccccccgctcggtttcctaaagctccatctaagctcaccgtaggaggcccatggggacaatcccaggaaaaggagaaaggcgataagaattccgccaccccaaaacagaagcctctccctccgctgtttacccttggaccccccccgccaaagcccaatcgccctccaaatgtcgatctgacaaaatttcataagaccagctctggtaactctactagcaaaggtcaaacatcatactctactacgagtttgcccccacccccaccaagccatccggcatcccaacctcctctccctgccagtcatccgtcccagccaccagtgccttccctgccaccgcggaatattaagccccccttcgatctgaaatcacctgtgaatgaagataaccaagatggtgttacacatagtgatggcgccggaaatctggatgaagagcaggactctgaaggtgaaacctacgaggatatagaggcgagcaaggagcgtgaaaagaagcgcgagaaagaagagaaaaagcgccttgaactggagaagaaggaacagaaggagaaggagaagaaggaacaggagattaagaagaagttcaagttaaccggccccatccaggtgatacacctagccaaggcctgctgtgatgtcaagggaggcaagaacgagctctcctttaagcagggcgagcagatcgagatcattcgcatcactgacaaccccgagggcaagtggctgggaagaacagcgagaggaagctatggttacatcaagaccacagccgtggagatagactatgactcattaaagctgaagaaggatagcttgggggccccttcccggcccattgaggacgatcaagaggtgtatgacgatgtggctgagcaggacgacatctcctcacatagtcagagcggtagcgggggcatcttcccacccccccctgatgatgatatctatgacgggattgaggaggaggatgccgacgatggtttccctgccccacctaagcagctggacatgggggatgaggtatatgacgatgtggatacctccgacttccctgtcagttcggcagagatgtcccagggaacaaacgtgggtaaggccaagactgaggagaaagacttgaaaaagttgaagaaacaggaaaaggaagaaaaagattttaggaagaagtttaagtacgacggagagatcagagtactgtacagcacgaaggtgaccacttccatcacctccaagaaatggggaacccgagatctgcaagtcaagcccggcgagtccctggaggttattcagactactgatgacacaaaggtgctctgccgaaacgaggagggaaagtatgggtacgtgcttagatcctatcttgccgacaatgatggcgaaatttatgacgatatcgcggacggatgtatctatgacaatgattag

SEQ ID NO: 23895 - DNA, 1722 bp, Artificial Sequence
  Description of Artificial Sequence: Synthetic coding sequence
atgatccccccccaggaggccagcgcccggcggcgggagatcgaggacaagctgaagcaggaggaggagaccctgtcctttatccgggattcactggaaaaatccgaccagctgactaaaaacatggtgtccatcctctccagctttgagtctagactgatgaaactggaaaatagcattatccctgtgcataagcagacggagaatctgcaaaggctccaggagaatgtcgagaaaacactgagttgtctcgaccacgtcatttcatactatcatgtgatctctggagacgacgatttggaggcccaagaagacgtcaccctggagcatctccccgagagcgtacttcaagacgtgatccggatcagtcgatggttagtggagtacggacgaaaccaggacttcatgaacgtgtattaccagattcgttcttcacagttagatagatccattaagggcttgaaagagcattttcacaagagctcctccagcagtggcgtgccgtattcacctgccataccaaacaagaggaaagacacaccgaccaagaagcccgtcaaaagacccggcagagatgacatgctggacgttgagacagatgcttatatccactgcgtctcggcgttcgtgaaattggcacagtccgaataccagctcctggccgatatcattccagaacaccaccagaagaagacttttgattcgctgatccaggatgcgctggatggtctcatgctggagggggaaaatatagtctccgccgctcgcaaagccatagtgcggcacgatttttcgaccgtgctgacagttttccccatcctgagacacctcaaacagactaagcctgagttcgaccaggtgctacaggggaccgccgcctctacaaagaacaagctccctggtcttatcaccagtatggagactattggcgccaaggccctagaggatttcgcagacaacattaaaaacgatcccgacaaagagtacaacatgcctaaggacggcactgtgcacgagcttacaagtaacgccatactctttctgcagcagctcttggactttcaagagacagccggcgccatgttagcgtctcaggaaacttcttcgtccgctacttcctactcatcggaatttagtaaaagacttctttcgacatacatctgtaaagtgttaggaaacctccagctgaacctgctgagcaagagcaaagtctacgaggaccccgcactttccgctatctttcttcataacaactataattatatattgaaaagtttggagaaaagtgaactgatccagctggtcgctgtcacacagaaaacggcggagagaagttacagggaacacatcgagcagcagattcagacatatcagagaagttggttgaaagtcaccgactacatcgctgaaaaaaacctacctgtgttccaacccggtgtaaaactgcgggataaagaaagacaaattatcaaggagagattcaaaggattcaatgatggattagaagagctctgcaagatacagaaggcctgggcaattcctgacaccgaacagagggataggattaggcaagcacagaagactattgtgaaggagacttatggcgcattcttgcagaagttcgggagtgtgcctttcaccaaaaacccagaaaagtacatcaagtatggggtggagcaggtcggggatatgatcgaccgactgttcgataccagcgcctag

SEQ ID NO: 23896 - DNA, 2475 bp, Artificial Sequence
  Description of Artificial Sequence: Synthetic coding sequence
atgatgcagaacgtgcacctggcccccgagaccgacgaggacgacctttactccggctacaacgactacaatcccatttatgacatcgaggagctggagaatgacgccgccttccagcaggccgtgagaacttcccacggcaggagaccccccatcacggctaaaattagctctacggcagtgacgaggccgattgcaacggggtacggcagcaagacctccttagcatctagcattggtcggcccatgacgggggccattcaagatggcgtgacgcggcctatgaccgccgtccgagccgccggcttcacaaaagcagctctgcgaggaagtgcatttgaccccctttcccagtccaggggcccagcgtctccactggaggcgaagaagaaagactccccggaagagaagataaagcagctggagaaggaggtgaacgagttggttgaggagtcttgcatcgccaattcttgtggggatcttaagctcgcactggagaaggcaaaagacgccggtagaaaggagagagtactcgtcagacagagggagcaggtcactacacctgagaatataaacctggacttgacgtacagtgtgctctttaaccttgcctcgcaatacagtgtgaacgagatgtatgccgaggcccttaacacttaccaggtgattgttaagaacaaaatgttcagtaatgcaggcatcctgaaaatgaatatgggtaatatctacctgaagcaacggaattattctaaggcgatcaagttttaccgcatggcgctggaccaggtgccctccgtcaacaagcagatgcgtatcaaaatcatgcagaatatcggtgtaacattcatccaggccgggcagtactcggatgccatcaattcatacgagcacattatgtccatggctccaaatctgaaagccggttacaaccttaccatttgttatttcgccatcggggatcgagagaaaatgaagaaggccttccagaagcttatcaccgtgcctcttgagatcgacgaagacaagtacatctccccatcagacgatcctcacacaaacctagttactgaggccatcaagaatgaccatctcagacagatggagcgagagagaaaggccatggccgaaaagtacatcatgactagcgcgaaattgattgctcctgtaatcgaaaccagctttgccgccggatacgattggtgtgttgaggtagttaaagcatcccagtacgtagaactcgctaacgatttagaaatcaataaggccgtgacatacctgcggcaaaaggactataatcaggcagtcgaaattctgaaagtgttggagaaaaaagatagccgggtgaagtccgcagccgcaacaaacctgtccgctctgtactacatgggtaaggattttgctcaagcgtcctcctatgcagacatcgctgtgaattcggaccgatataatccagccgccctcacaaataagggcaataccgtgtttgctaatggtgattacgaaaaagcagctgagttctataaggaggcactccggaacgattctagctgtacagaggcgttgtataacattggacttacctacgaaaagctgaacagactggatgaagctctggactgtttcctgaagctccacgcgattcttcgcaactcagccgaagtgctgtatcagattgctaacatttacgaactgatggagaaccctagtcaggcaattgaatggctcatgcaggtggtctctgtcattccaacagacccacaggtgctgagtaagttgggggaactgtatgacagagaaggggacaaatcccaggccttccagtattattatgagtcatatagatatttcccatgcaatatcgaggtaattgaatggttgggtgcatactacattgatacccaattctgggagaaggccattcagtattttgagcgagcaagtcttatccagcccacccaagttaaatggcaactgatggtcgcatcatgctttcgcagatcaggaaactaccagaaagcacttgatacatacaaggatactcaccgtaagtttcccgaaaacgtcgaatgtctgcggttcctagtacggctctgcactgacctaggactcaaggatgcccaggagtatgcccggaagctcaaaaggctggagaagatgaaagaaatcagagaacagcgcataaagtccggaagggatggatccggaggctcacgagggaagcgggaaggatctgcatctggcgattctggtcagaattatagtgcgtcatccaagggcgaacgcttgtccgcaaggctgcgagcccttcccggcacaaacgagccttacgagtcatcgagcaataaagagattgacgcctcttatgttgaccctcttgggccccaaatcgagagacccaagaccgcagcgaagaaacggatcgacgaagatgacttcgctgatgaggaattgggggacgacctgctccccgagtag

SEQ ID NO: 23897 - DNA, 2850 bp, Artificial Sequence
  Description of Artificial Sequence: Synthetic coding sequence
atgctgcggaccgccggccgggacggcctgtgccggctgagcacctacctggaagaattggaggcagttgagctgaaaaaatttaagctgtacctgggcaccgccactgaattgggtgaggggaagataccttgggggagtatggagaaagccggccccctggagatggcccagctccttatcactcacttcgggccggaggaggcttggaggttggctctgagcaccttcgagagaattaatcgcaaggacctgtgggaaaggggtcagagagaagatctcgtcagagataccccgccgggcggaccctctagcttggggaaccagtcaacatgcctgctcgaagttagcttagtgacaccaaggaaggatccgcaggagacttatcgcgattacgtgcgccgaaagtttagactcatggaggacaggaatgcccgtttgggcgaatgcgtgaatctgagccaccgctacacaaggctcctcctagtgaaggaacactcaaaccctatgcaggtccagcagcagctgctcgacaccggacgggggcacgcacgcaccgtgggacaccaagccagtcccataaaaattgagaccctgttcgagccagacgaagaaagaccagagcctccaagaacagtggtcatgcagggcgctgcaggcattggcaagagcatgcttgcacacaaagtcatgctggactgggccgacggcaaactcttccagggccggtttgattatttattctacattaactgtcgggaaatgaaccagtcagcaacagagtgctcgatgcaggacctcatcttctcctgctggccagagccttccgcacctttacaggagctgatacgcgtgccagagagattgctttttatcattgatggcttcgacgaattgaagccgtcatttcacgatccccaaggcccctggtgtctgtgctgggaggagaaaaggccaacagaattgctgctgaatagcttaatcagaaagaaactcctgccagagctttcactcctcattaccactcgccccaccgcccttgagaagttacacaggttgcttgagcacccaagacacgtagaaattctgggtttcagtgaagctgagcggaaagagtatttttacaaatattttcataatgctgagcaggccggccaggtattcaattacgtgcgcgacaacgaacctctgtttacaatgtgtttcgtgcctcttgtgtgctgggtagtctgcacatgcctgcagcagcagcttgaaggcggcggattgttacgtcagacaagcagaactactacagccgtttatatgctgtatctgctatctctcatgcagccaaaacccggtgcaccccgcctgcagcctcctccgaaccaacggggcctctgcagccttgctgcagatggcctatggaatcagaagatactgtttgaagaacaggatctaaggaaacatggactggatggcgaggatgtatccgctttcttaaatatgaatatcttccaaaaggacataaattgtgagcgatactactcatttatacatctcagctttcaagagtttttcgccgcaatgtactatatccttgacgagggagagggcggcgctgggccagatcaagacgtgacaaggctgctgaccgagtatgccttcagtgagcgttcttttctcgccctcacctcgcggttcctgtttgggttgctaaatgaggagaccaggtcgcaccttgaaaagtcactttgctggaaggtgtcacctcatataaaaatggatctgctccagtggatacaatctaaagctcagagtgatggaagcactcttcaacaaggttccctggagttcttttcatgcttatacgagatccaggaagaggagttcatccagcaggctctgtcacattttcaggtgatcgtggtttccaacattgcatctaaaatggaacacatggtgtcgagcttctgcctgaagcggtgtcgatctgcgcaagtgctgcatttgtacggagctacatattcggctgacggagaagaccgcgcccgctgcagcgcaggcgcccacacactactggtgcagttgcccgaacgcaccgtcttactcgacgcatactcagagcatctggctgcggcgctttgcacaaatccgaatctgatcgaacttagtctctaccgcaatgctttgggtagccgcggcgtgaaactgctttgtcagggcttgcgccaccccaactgtaagctgcagaacttacggctgaagcggtgtaggatatccagtagcgcttgcgaggacctaagcgctgcactgatcgctaacaagaatctaacacggatggacctctccggcaatggtgtcggtttccctgggatgatgctcctgtgtgaaggcttgcgccatccccagtgtcgcctccagatgattcagttgagaaaatgccaactggaaagtggtgcgtgtcaggagatggcatcagtgctaggcaccaacccccacctggtcgaacttgatctgacagggaatgccttagaagatctgggcctccgtctgttatgccaggggctgagacatcctgtatgccgactgagaacattatggttacaattagatagttgtgggcttactgccaaggcttgtgagaacttgtactttaccctggggatcaatcagactctgactgatttgtacctcacaaataatgctcttggagatacgggcgtaaggctgctgtgtaaacggctgtcacacccaggttgtaagctccgtgtcttgtggctgtttggcatggatctgaacaaaatgacccattccagattggcggcgctgcgggtgacaaagccttaccttgacattggatgttag

SEQ ID NO: 23898 - DNA, 5796 bp, Artificial Sequence
  Description of Artificial Sequence: Synthetic coding sequence
atggccgcccggagcgcccccagctgccacctgcggctggagtgggtctatggatacagggggcaccagtgccggaataatctgtattacactgctgccaaagagattgtttattttgtcgccggagtgggagtggtgtatagccccagagagcatagacaaaaattttatcgaggtcacagcgatgacattatttctcttgcgctacatcccgagagagtgctggtcgccacagggcaggtgggaaaagagccctatatatgcatttgggattcctacaccgtacagaccatctctgtcttaaaagacgtgcacacccacggcatagcctgtctggcgtttgatctcgacgggcagcggctcgtctctgtgggcctggattccaagaatgctgtgtgcgtttgggattggaagcgcgggaaaatgctgtctatggcccccgggcatactgacagaatcttcgacatctcctgggatctgtaccaacctaacaaactggttagttgcggcgtgaaacacatcaagttctggtcactgtgtggaaatgcactgaccccaaagcgaggggtgttcggcaagacaggggatctgcagaccatactatgtctggcctgcgctagagacgagctgacttactctggagctctcaatggcgacatttacgtctggaaaggcattaatttgattaggaccattcaaggagcacacgcagctgggatcttctctatgaatgcttgcgaggaaggctttgctacaggtggacgcgacggatgtattcggttatgggatctgacattcaaacccatcacagttatcgatctccgggagaccgaccaggggtacaaaggactgtctgttcggtcagtgtgttggagaggcgatcacatacttgtagggacgcaggatagcgaaattttcgagatagttgtgcaggagcggaacaaaccttttttaattatgcagggacactgcgaaggagaactttgggcactggccgtgcaccctacaaagcctctcgcagtcactggctccgatgatcgcagtgtacgcatatggtccctggtagatcatgccctgattgccaggtgcaatatggaggagcctataaggtgtgctgctgtgaacgccgacgggatacacttagcgctcggcatgaaagatggtagcttcaccgtgctcagggttcgcgacatgacagaagtggtgcatataaaagaccggaaagaggccatccacgaacttaagtattcccctgacggaacctacctggcagtgggctgtaacgactcttccgttgacatctacggtgtcgcccaacgatataagaaggttggtgaatgccttggatctttgtcattcataactcatttggattggagctctgattctcgctacctgcagacgaacgatggcaatggaaagagattgttctaccggatgcccgggggaaaggaggttacatccacagaagagatcaagggcgtccattgggcgagctggacctgtgtgtctggcctcgaagtgaacggcatatggccaaagtatagcgatattaacgacattaacagtgtggacgggaattatattggtcaggtcctcgtcaccgcagatgattatggcattataaagctgtttcgatatccatgtctaaggaaaggggcaaagttcagaaagtacattgggcactccgcccacgttaccaatgtaagatggtcccacgactatcaatgggtcattagcattgggggcgctgatcactctgtctttcagtggaagttcattccagaaagaaagttgaaggatgctgtccacatagccccccaagagtcactggccgattctcacagtgatgagtctgatagtgacctaagtgacgtccctgaactggactccgaaatcgaacaggagacacagctgacatatcgacggcaggtctataaggaggatctgccgcagctcaaagaacaatgcaaggagaaacagaagagcgctacaagcaaaaggcgcgaacgggccccggggaattcaatacggctgcattttgttcatggctaccgaggatacgactgccgcagcaatctgttttacacccaaatcggggagatcgtatatcatgtagccgcagtgggagtgatctacaatcgccagcagaacacacaacggttctacctgggtcatgatgacgacattctttgcttgactatccacccactcaaagactatgtggctacggggcaggtgggtcgagacccatccatccacatttgggataccgagaccattaagcctctctccatactgaaggggcatcatcagtacggcgtatccgccgtggacttcagtgccgacgggaagcgcctggccagcgtagggattgacgatagccataccgtcgttctatgggactggaaaaaaggcgagaagttgtcaatcgcgaggggtagcaaggacaagatatttgtcgtcaagatgaatccctatgtaccagataagctgattactgcaggtatcaaacacatgaaattctggcgaaaggctggcgacgtgtgtatttggcgtgacatattcttggtcaagactgttaaagcccacgacggccccgtgttcagcatgcacgctctcgagaaggggttcgtgaccggaggcaaggacgggatcgtagctctctgggatgacagttttgaacgctgcctgaaaacctacgcaatcaaaagagctgccttagcaccaggaagcaaaggattactgttggaagacaatccatcgatccgcgccatcagcctgggccacgggcatattttggtgggcacaaagaatggcgaaattctcgaagtggataaatctgggcctattactctgctcgtccagggccacatggagggggaagtctggggccttgcgacgcacccctaccttcccatttgcgcaactgtgagcgacgataaaactctcagaatttgggacctgagtcccagtcattgcatgttagctgtgcgcaagctgaaaaaaggtggtagatgttgttgctttagcccagatggcaaggcactggctgttggcctgaacgacggaagcttcctcatggcgaacgccgatacgttggaggatctggttagctttcaccatagaaaggatatgatcagtgacattagattcagtcctggctcagggaagtacctggccgtggcctctcacgactctttcattgacatctataacgttatgtcctcaaagcgcgtgggtatctgcaaaggcgccacaagttatattacacatatcgactgggatataagggggaaactcctccaagtcaatacgggcgcgaaggaacaactgttctttgaagctccacgcgggaagaaacagactattccttccgtggaggtggagaaaattgcctgggcatcctggactagtgtattgggactgtgctgcgaaggcatctggccggtgattggggaggtgaccgatgtgaccgcttcgtgtctcaccagcgacaagatggtcctggccactggagatgatctgggcttcgtcaagctgttccgctaccccactaagggcaaatttggaaagttcaaaagatacgtggctcacagcacgcacgtgacaaatgtgaggtggacttacgacgattccatgctagttacattggggggcacagacatgagtttaatggtgtggactaacgaaatggagggatacagggaaaagcgcccatgcgactcagaggagagcgatattgattccgaagaagacggcggttacgattccgatgtgactagggagaatgaaatctcctacactataagagccctttctaccaatattcggccgatgctgggaattaaacctcatctccagcagaaagagccctcaatcgacgagcgacctcctgtctctcgggcccctcctcaacccgaaaaactgcagaccaacaacgtcggtaagaaaaagaggcccatcgaagatctggtgcttgaactgatttttggctatagagggcgcgactgccggaacaatgtacattatctgaatgatggagatgacatcatttatcatacggctagcgtcggtattctccataacgtggccaccgggtctcaaagcttctatcaggagcacaatgacgatatcctctgcctcaccgtgaatcagcatccgaaatttatcaacatcgtcgcaactgggcaggttgtgctgagctgctccctgctgacgactgcgccaagcatccacatttgggacgcaatgaataaacagacgctctccattctccggtgctatcactccaagggagtttgttcagtgagctttagcgcaaccgggaaacttcttttaagcgtgggtcttgaccctgagcacacaattacgatctggcgctggcaggagggggcaaagatcgcctcaagggctgggcataaccagcggatctttgtggcggaattccgccctgactctgatacacaattcgttagtgtaggcgtgaaacatgtgaaattctggaccttggctgggcgggctctcttgagtaaaaaagggctgctctcaacactcgaggacgccagaatgcagactatgctggcaatcgccttcggcgccaataacttaacctttactgggaccatttcaggtgacgtttgcgtatggaaggatcatatcctgtgtcgcattgtggcccgcgcccataacggtcccgtattcgctatgtatactactttacgagatggactgatcgtgactggaggaaaggagcggccaagcaaagaagggggagctgtcaagttgtgggaccaagaactccggcgttgccgcgccttccgtctggagaccggtcaggctactgattgcgtcaggtctgtctgtcgggggaagggcaagattcttgtggggacccgcaatgccgagataattgaagtgggcgaaaaaaatgcagcttgtaatatcctcgtaaatggacacgttgatggccctatctggggcctcgctacccatccctctcgtgacttttttctcagcgctgctgaagacggcactgtgagattatgggatatcgccgacaaaaaaatgctgaacaaagtgaacttggggcacgccgctcgaaccgtgtgttatagtcccgagggcgatatggtcgccataggcatgaagaatggagaatttataatactattggtttcctctctcaagatttggggaaaaaagagagatagacgctgcgcaatccacgacatccggtttagtcccgattccagatatctcgcagtaggtagcagcgagaacagcgtggatttttacgaccttaccctgggccccactctcaatagaatctcatactgtaaggatatcccgagcttcgtgatccagatggacttcagcgccgactctagttatctgcaggttagttcaggatgctacaagagacacgtttacgaagtgccgagtggaaaacacttgatggatcatgcagcaatagatcgaatcacttgggccacctggactagtatcctcggcgacgaggttcttggaatttggtctcgccacgccgagaaggcggatgtgaactgtgcatgcgtcagtcatagtgggatctccctcgtcaccggggacgacttcggtatggtcaaactctttgacttcccctgcccagagaagttcgctaagcataagagatttctgggccacagccctcatgtgacaaatatcaggttcacttccggagatcgccatgtagtttcagcgggcggagacgattgctcgctcttcgtgtggaaatgtgtgcacacaccacactag

SEQ ID NO: 23899 - DNA, 429 bp, Artificial Sequence
  Description of Artificial Sequence: Synthetic coding sequence
atgagcatcagcagcgacgaggtgaacttcctggtgtaccggtacttgcaggagtctggcttctcgcattccgccttcacttttggtattgagtctcacatcagtcagagtaacatcaatggcgccttagtcccaccagcagctcttatctcaattatccagaaaggcctgcagtacgtggaagccgaggtgtcgatcaacgaagatgggacactgtttgacggcagacctatcgaatccctgtccctgatcgatgccgtgatgcccgatgtggtgcagactaggcagcaggcatatcgggataaattggcgcagcaacaggcagccgctgcagccgctgccgcagcagccgctagccagcagggctcagcgaagaacggggaaaacaccgccaatggagaagaaaacggtgcacatacgatcgcctag

SEQ ID NO: 23900 - DNA, 1704 bp, Artificial Sequence
  Description of Artificial Sequence: Synthetic coding sequence
atggagttcttcaccatgcccccccggacctggttcatgcggcagctacagcgcatgtggttccttaggccgagcatggctatcatggtgtttcgtatgatagaggagcgccccactcacgctattaccgtcagagtgtcataccttgaaatttacaacgagagcctgttcgacttactgtccactttaccctacgtggggccttctgtcacacccatgactatcgtcgagaaccctcagggagtcttcattaaggggctaagtgtgcatttgacgtctcaggaggaagacgccttttcattactgttcgagggtgaaaccaatcggatcatcgcctctcataccatgaataaaaactcaagccggtcacattgtattttcactatatatcttgaggcccactcacgtactctatccgaggagaaatacatcacgtccaagataaacctggtggatctcgctggatctgagaggctcggcaaatctggaagcgagggacaggttcttaaagaagcgacgtatatcaacaagtccctgtcctttctggagcaggccattattgcactgggagaccagaaacgggaccatatacccttccggcagtgcaagctcacccacgcccttaaggacagccttggcgggaactgtaatatggtcctggttactaatatctacggcgaggcagcgcagctggaggagactctgtcctccctgaggttcgcctcccgaatgaaattagtcacgactgagcccgccatcaatgaaaagtatgatgcggagcgaatggtcaagaacctcgagaaagagctggccctgctgaaacaagagttagcaatacacgatagccttacgaaccgaacattcgtcacgtatgaccccatggatgaaattcagattgctgaaatcaacagtcaggtccggcggtacctcgaggggaccctggacgagatcgatatcattagcttacgccaaataaaggaggtatttaaccagtttcgggtggtgctctcacaacaagagcaggaagtcgagtctaccctgagacggaagtatacattaatcgatagaaacgactttgcagctattagtgccatccaaaaggctggactcgtggacgtcgacggacacttggtaggcgagcctgaggggcagaattttggtttaggagtggcgccctttagtaccaaacccggcaaaaaggctaagtcgaaaaaaaccttcaaggagcccctgaggcccgacaccccgccgtccaaacccgtggcttttgaggagttcaagaacgagcaaggttccgagatcaatcggatattcaaagagaacaagtctattctgaacgaaaggcggaaacgcgctagtgaaacaacccagcatatcaatgcaattaagcgggagatagacgttaccaaggaggcattaaacttccaaaagagtctgagagagaaacagggcaagtatgagaacaaaggactcatgattattgacgaggaggaattcctgttgatacttaagttgaaagacctgaagaagcaatatcgatccgagtatcaggatctgagggacctgcgcgcagagattcagtattgtcagcaccttgtggaccagtgcaggcaccggctgctgatgggtgcaaccgttggtaagaatcttacgtcaggtacaatgtctccactttcttccctccgaacatgcaggtggcactag

SEQ ID NO: 23901 - DNA, 1428 bp, Artificial Sequence
  Description of Artificial Sequence: Synthetic coding sequence
atggccgagggcagcgtgatgttcagcgacgtgagcatcgacttctcacaggaagagtgggactgtcttgaccctgtccagagggatctgtatcgagatgtgatgcttgagaattacggcaatttagtctcgatgggactatatacccccaagccacaagttataagcttgcttgaacaggggaaagagccctggatggtcggacgcgaactaacgcggggactgtgcagcgatctcgagtctatgtgcgagaccaagctcctatccctgaaaaaggaggtatacgaaatagaactttgtcagcgtgaaattatgggtctcacgaagcatgggctggagtactcctccttcggggatgtccttgagtataggagtcacctggccaagcagctgggttacccaaatggccacttctcccaagagatcttcaccccagaatatatgccaactttcatacagcagacattcctcaccctgcaccagattataaacaacgaagatcgaccgtacgaatgcaagaagtgcgggaaagctttctcccagaactctcaattcattcagcaccagagaatacacattggtgaaaaatcttatgaatgcaaagagtgcggtaagtttttctcctgtggctcccacgtaaccagacacctcaagatacatacaggcgaaaagccgtttgagtgtaaggaatgcggcaaagccttctcgtgcagttcctatctttcacagcatcagaggattcatactggaaaaaagccttatgaatgtaaagagtgcggtaaagccttctcctactgctccaatctgatcgatcaccaaaggatacacacaggcgaaaaaccctacgagtgtaaagtgtgcggcaaggcattcaccaagagctcacagttgttccagcacgctagaatccatacgggggagaaaccatatgagtgcaaggagtgtggtaaggctttcacccaatcctccaagctggtacagcaccagcggatccacacaggggagaagccgtatgaatgcaaagaatgcggtaaagctttctcttcaggaagcgccctcacgaatcaccagcgcattcatacaggggaaaagccatacgattgtaaggagtgcggcaaagccttcacccagagttctcaactccggcagcaccaacgcatccacgccggcgaaaagccattcgaatgtcttgagtgtggcaaagcatttacccaaaatagccagctattccagcatcagcgaatacacacagacgagaaaccatacgagtgtaatgagtgcgggaaagcgttcaataagtgctcgaatctgacgcgtcacctgcggatacacacaggcgaaaaaccttacaattgcaaagagtgcggcaaagcattctccagcggctcagacctcatccggcatcaggggatccatacaaacaaatag

SEQ ID NO: 23902 - DNA, 462 bp, Artificial Sequence
  Description of Artificial Sequence: Synthetic coding sequence
atggcccggaacaccctgagcagccggttccggcgggtggacatcgatgaattcgatgaaaataaattcgtggatgagcaggaggaagctgctgcagcagctgcagagccaggcccagatccgtccgaggtggatggcctgctgaggcaaggggatatgcttagagcattccacgccgccctgcgtaatagccccgttaacaccaagaaccaggcagtgaaggaaagagctcagggggtcgtgctgaaggtgttgaccaatttcaaatcatccgagatagagcaagccgtccagagcctcgacaggaacggcgttgacctgctgatgaagtacatatacaaaggatttgaaaagcccactgagaacagctccgctgtgttgcttcagtggcatgagaaggcacttgcagtgggggggctaggatccattatacgagtcctgaccgctagaaagacagtttag

SEQ ID NO: 23903 - DNA, 2616 bp, Artificial Sequence
  Description of Artificial Sequence: Synthetic coding sequence
atgggcgagggcggcctgccccccgccttccagctgctgctgcgggcctgcgatcagggggacaccgaaaccgcccgccggcttctcgagcctggtgccgcagaacctgctgaaagaggcgccgaacctgaggcgggggccgagcccgctggggctgaagtggccggacctggcgccgcagccgctggggcggtcggagcaccagttcctgttgattgctccgatgaggccggcaatactgcactccaatttgcggcagctggtgggcatgaaccgctggttagattcctgctgcgacgaggcgccagtgtcaattcgcgcaatcattatggttggagtgccttgatgcaagcggctaggtttggacatgtctctgtagcgcatctgctcctggatcatggtgctgatgtcaatgcccaaaaccgtcttggagctagcgtgttgaccgtggcgtcccgcggtggccatctgggggttgtgaaactgctgctggaagcaggggccttcgtggaccaccaccatccctcgggcgaacagctgggtctgggaggctcacgcgatgaacctctcgacattaccgccctgatggctgcaattcaacatggacatgaggccgtagtgcggctactgatggagtggggagccgatccgaatcatgctgcccgcacagtgggctggtcccctctcatgctggccgcattgactggtagactcggggtggctcagcagctggtggagaagggtgccaaccccgaccatctgtcagtgctggagaagactgcctttgaggtggcccttgactgcaagcaccgtgacttggtggattacctagatcccttgaccaccgtgcgtcccaagaccgacgaggaaaaacgacggccagacatctttcacgcactcaagatgggtaacttccaactcgtgaaggagattgccgacgaagacccttcccacgtgaacctcgttaacggtgatggggcgacacccctcatgctggccgcggtcaccggccagttggctttagtgcagctgctggtagaacgacacgccgacgtcgacaagcaggactcagtgcacgggtggacagccctcatgcaagcaacttatcatggtaacaaagaaattgtcaaatacctactgaatcaaggagctgatgtgaccctccgagccaagaacggatatactgcctttgacctagtgatgctgctgaatgaccctgatacagaactcgtgcggttgttggcatcagtatgcatgcaggtgaacaaggacaaaggtcgtccttcccatcaaccacctctgccccacagcaaggtgcgacaaccgtggtccatcccggtcctacctgatgacaagggtgggttgaagagctggtggaaccgcatgtctaatcggtttcgtaaactcaaactgatgcagacacttcctcggggactctcttctaatcagcccttaccctttagtgacgagccagaacccgccttagactctacaatgcgggccgcaccacaggataaaacctcacggagcgctctgccagacgcagcccccgtgaccaaggacaatggcccaggcagtaccaggggggaaaaggaggacaccctactgacaacgatgctgagaaacggcgctccgctcacacgtctcccgagtgacaagctcaaggcggtgatccctcctttcttgcctccaagctcctttgagctgtggagctccgaccgctcccgaaccagacacaacggtaaggctgatcctatgaagaccgctcttcctcagcgagctagccggggacacccagtcggaggcggcggaaccgacaccacgcccgtgaggcctgtgaagtttccttcccttccgagatcccctgccagctctgccaactcaggcaatttcaaccactcgcctcactcatctgggggctcttcaggggtcggcgtgtctcgacacggcggggaactacttaacaggtctgggggttccattgataatgtcctgtcccagatcgcagcccaacggaaaaaagctgccggcctgctggaacaaaagcctagtcataggtccagccccgtcgggcctgcacccggcagctccccctccgagctcccagcttctcccgctggcgggtcagccccggttggcaagaagttagagaccagtaagcgcccccccagcggcaccagcacaacttcaaaatcaacaagcccaactctcactccatcaccgtcaccgaagggccacactgccgaatcttcagtgtcttctagcagcagtcatagacagtccaagtcttcaggaggttcatcaagcgggactattactgatgaggatgaactgaccggaatcttgaagaagctctcccttgagaagtatcagcccatcttcgaggagcaggaagtagatatggaagcctttcttaccctgacagacggggatctgaaggaacttggaatcaaaaccgatggaagccgccagcagattttagccgctatcagcgaactcaatgccggaaagggcagggaacggcaaatcctgcaagagacaatacacaactttcacagtagctttgagagctccgcgagtaacaccagggcgcccggaaacagcccatgcgcctag

SEQ ID NO: 23904 - DNA, 1359 bp, Artificial Sequence
  Description of Artificial Sequence: Synthetic coding sequence
atgagcgccagcctgaactacaagagcttcagcaaggagcagcagaccatggacaacctcgagaaacagctgatctgtccaatctgcctggagatgttcacaaaacctgtcgtgattcttccgtgccagcacaacctctgtcgcaaatgcgcctcagatatctttcaggcctccaatccatacctgcctactaggggcggcacgacaatggcctcaggaggccgcttccggtgtcccagctgcaggcatgaggtcgttctggaccggcatggcgtctatggactccagcgaaacttactggttgagaatataattgatatctacaagcaggaaagtactagacccgaaaagaagagtgatcagccaatgtgtgaggaacacgaggaggagcggattaacatatattgcctcaactgtgaggtgcctacctgtagcttgtgtaaagtcttcggcgcacataaggactgccaggtggcccctttgactcacgtttttcagcgccaaaagagtgagctatccgatgggattgcaatattagtgggctccaatgaccgcgttcaaggcgtgatttcccagctggaggacacatgcaaaacaatcgaagagtgctgtcgcaagcagaaacaggagctgtgtgagaaattcgactacttatacgggatattagaggaacgaaaaaatgaaatgactcaggtgatcacacgcacccaggaagagaagctggagcacgtacgggctctgattaagaagtatagcgaccatttggagaatgttagcaagcttgtggaatccggtatccagttcatggacgaacccgagatggctgtctttttgcagaacgccaaaacattactgaagaagatcagcgaagcttctaaggcctttcagatggaaaagattgagcatggatacgaaaacatgaatcatttcacagttaacctcaacagagaagagaaaattattcgggagattgacttttaccgcgaggatgaggacgaagaggaagaagaggggggggagggcgagaaggagggggagggagaagtcggcggagaggctgtggaggtggaagaggtcgagaacgtccagactgaatttccaggcgaggatgagaatccagagaaagcttcggagctgtcacaagtggaactccaggcagcaccgggcgctctccctgtgtcctctcccgagcccccccctgcactccctcctgccgccgatgccccagtgactcaaatcggctttgaggcacctcctttgcaggggcaggccgcagcgccagctagcggaagtggtgccgactctgagcctgccagacatatcttttccttttcttggctgaattctctcaacgaatag

SEQ ID NO: 23905 - DNA, 492 bp, Artificial Sequence
  Description of Artificial Sequence: Synthetic coding sequence
atgcccagcatcaagctgcagagcagcgacggcgagatcttcgaggttgatgtagagattgccaaacaatctgtgacaatcaaaaccatgttagaggacctgggaatggacgacgagggcgatgatgatccggtgccattacccaacgtcaacgccgcaatcctcaagaaggtcattcaatggtgtactcaccacaaggatgatccgcccccacctgaggatgacgaaaacaaggagaagcgtactgatgatattcctgtctgggatcaagagttcctgaaggttgatcagggcacgttgttcgagctgattctggcggcaaattatttggatatcaagggcctgcttgacgtgacatgcaaaacagtagcgaatatgataaaagggaaaacccccgaagaaatacgaaagacatttaacatcaaaaacgactttacggaagaggaggaggctcaagtgagaaaagaaaaccagtggtgcgaggaaaaatag

SEQ ID NO: 23906 - DNA, 1200 bp, Artificial Sequence
  Description of Artificial Sequence: Synthetic coding sequence
atggccgcccccagccccagcggcggcggcggcagcggcggcggctctgggtcgggaactccagggcccgtgggttcacccgccccagggcaccccgctgtgtcaagcatgcagggaaagaggaaagctctaaaactcaattttgctaacccaccattcaagagtactgctcgtttcacccttaaccccaatcccacgggagtgcaaaatccgcacattgagagactacgcacccacagcatcgagagcagcggcaagctgaagatcagccccgaacagcattgggactttaccgccgaagacctgaaggatcttggcgaaattgggaggggggcgtacggttcagtcaacaagatggtacacaagccgagcggacagattatggccgtgaagaggatccgctccacagtggacgaaaaagagcaaaagcaactcctgatggatttagatgtggtgatgaggtccagcgactgcccttacatcgttcagttctatggagcactcttccgcgaaggggattgctggatctgcatggagcttatgagcacaagcttcgacaaattttacaaatacgtctattccgtgctggacgatgttatccctgaagagattctcggcaaaatcacacttgccacagtcaaggcactgaaccatcttaaggagaacctgaagatcattcacagagacatcaagccaagcaatatcctgcttgatagatctggaaacatcaaactctgcgatttcggaattagcggccaactggtcgattcgatcgctaaaactcgcgatgcagggtgtcgaccctacatggccccagagaggatcgacccctccgcctcgcggcaggggtatgatgtgcgcagtgacgtctggagtttggggatcaccctgtatgagttggccacaggcagattcccgtatccaaagtggaacagcgtttttgaccagctcacccaggttgtaaagggggatccaccccagctctccaattctgaggagagagaatttagcccgtctttcattaattttgttaatttgtgtctgaccaaggatgaaagcaaaagaccgaaatacaaggagctgctgaaacaccccttcatccttatgtatgaagagcgcgcagtggaggtcgcctgttatgtttgcaagatactagatcagatgccagccaccccctcttctcccatgtacgtggactag

SEQ ID NO: 23907 - DNA, 1122 bp, Artificial Sequence
  Description of Artificial Sequence: Synthetic coding sequence
atggcccaggagagccccaagaacagcgccgccgagatccccgtgacaagtaacggggaggtggacgactctagggaacacagttttaaccgggaccttaagcattcacttccttcaggcctcggactgagtgagacacaaattaccagtcatggatttgataacactaaagagggggtcatcgaggctggtgcttttcagggtagtccggctccgccgctaccatctgtgatgagtccttcccgagtagctgcttcccgactggcacaacagggtagtgatctgatcgtcccagctggaggccagagaacacagacaaaatccgggcccgtgattctggcagacgagataaaaaaccccgcaatggagaagctagagttagtgcggaagtggtctctgaatacttacaagtgtaccaggcagattatcagtgagaagctgggcaggggatccagaactgttgatttggaactcgaagcccaaatcgatatccttagggataataagaagaagtatgaaaacatcttaaaactggcccagacgctgagcacacaactgttccagatggtgcacacccagcggcagttgggagatgccttcgccgacctgtcactgaaaagtttggagctgcatgaagaattcgggtacaacgctgatactcagaagctccttgctaaaaacggcgaaacccttctcggagccattaatttcttcattgcatcagtgaacacgctggtgaataagacaatagaagacacccttatgactgttaaacaatacgaatccgccagaattgagtatgatgcttatcgcactgacctggaagagcttaacttggggccacgtgacgccaatactcttccgaaaattgagcagtcacagcacctatttcaggcacataaggagaagtatgacaagatgcggaatgacgtgtctgtcaagctgaagtttcttgaggagaacaaagtaaaagtgctgcataatcagctcgtgctgtttcacaacgccatcgccgcctattttgccggcaatcagaaacagcttgaacagacattaaagcagttccatatcaagctcaaaacaccaggtgtggacgccccatcatggctggaggaacagtag

SEQ ID NO: 23908 - DNA, 654 bp, Artificial Sequence
  Description of Artificial Sequence: Synthetic coding sequence
atgtacagcctgaaccaggagatcaaggccttcagccggaacaaccttcgcaagcagtgcactagggtcactacactaacaggtaagaaaatcatcgaaacgtggaaagatgccaggattcatgtcgtcgaggaagtggaaccttcctctggcggggggtgtggctatgtgcaggatttgagcagcgatttgcaggttggcgtgattaaaccatggctgctgcttggctcacaggatgctgcccacgatctcgacacactaaagaagaacaaggtgactcacattctgaacgtggcgtatggggtcgagaacgcctttctaagcgattttacatacaagagtattagtatcctggatcttcccgagactaacatattgagctactttccggagtgctttgagttcattgaagaggctaagagaaaagacggagtcgtgctggtgcactgcaacgctggcgtttccagagcagccgcaatcgtcatcggctttctgatgaactctgagcaaacctcatttaccagtgccttttctctcgtgaagaacgctcggccgagtatctgccccaattctggttttatggaacagctccgcacttatcaggaaggcaaggagtccaataaatgtgaccgtatccaggaaaactcttcatag

SEQ ID NO: 23909 - DNA, 2679 bp, Artificial Sequence
  Description of Artificial Sequence: Synthetic coding sequence
atgctgcggaccgccggccgggacggcctgtgccggctgagcacctatcttgaggagctggaggcggttgaactcaagaagtttaagctctacctcgggaccgctacagagctgggcgagggcaaaatcccatggggtagcatggagaaggcaggaccgctggagatggcacaattgcttattacacattttggaccggaagaggcctggcgactcgcccttagcacattcgagcgcatcaaccggaaagacctgtgggaacgcggacaacgggaagacttggtgagagatacgccccccggcggcccgagcagcctggggaatcaatctacatgtttgctcgaggtgtctctagtgacccctcgaaaggaccctcaggagacgtaccgggactatgtgagaaggaaattcagactgatggaagaccgtaacgcaaggttgggggagtgcgtcaatctgtcccaccgatataccaggttactgcttgtcaaggagcattccaatcctatgcaggtgcagcaacagttacttgatactggcaggggccacgcgcggaccgttggccatcaggcgagtccgattaagatagagacactattcgagcctgacgaagagcggccggagcccccccgcacagtcgtgatgcagggcgctgctggtatcggaaagtccatgctggcgcataaagttatgttggactgggcagatggcaagcttttccagggccgattcgactacttgttttatattaattgcagagagatgaatcagtctgccacagagtgctctatgcaggacctgatttttagctgctggcctgagccatctgcacccctgcaggaactgatccgcgtcccagagcgcctcttgtttataatcgacggattcgacgaactgaagccatctttccacgatccacaggggccgtggtgtctgtgttgggaggagaagaggccaacagagctcctcctcaattcactaatacgcaagaaacttctgcctgagctgagcctgctcattaccacccgccccaccgctttggaaaagttgcaccgtctgctggagcaccctaggcacgtcgagatcctcggattctccgaagccgagagaaaagagtacttttacaaatatttccataacgccgagcaggcgggacaggtgttcaactacgtcagggacaacgagccactgttcacaatgtgttttgttcccctcgtctgttgggttgtgtgtacatgtctgcagcaacagctggaaggaggcgggctgctccgacagacgagtaggaccacgacggccgtctatatgctgtatctactgagcctgatgcagccaaaacccggggcgccacgccttcagcctccacccaatcagcgggggctgtgctccctcgccgccgatggactgtggaatcagaagattctctttgaggaacaggacctgcgcaaacacgggcttgatggagaagacgtgtccgcctttcttaatatgaacatattccagaaagacatcaactgcgagcgatattactctttcatccatctgtcttttcaggagttctttgcagcaatgtactatatcctagatgaaggggaaggcggtgctgggccagaccaagacgtcacgaggttattgactgaatatgccttcagcgaaagatcttttctagcgttgactagtagatttctctttggattattgaacgaagaaactcgaagccacctggaaaaaagcttgtgttggaaggtttctccacacataaaaatggatttgttgcagtggatacagtcaaaggcccagtctgacgggtctacactgcagcaaggttcactcgagttcttttcttgcctctatgagatccaggaagaggagtttatacagcaggccctcagtcacttccaggtcattgtcgtaagcaacatcgcttcaaaaatggagcacatggttagctccttctgcctcaaacgctgtcgctcagctcaggtgttacatctctacggggcaacatacagcgccgacggggaggacagggcacgttgttctgccggagctcacactctccttgtgcagttgcccgaaagaaccgtccttctggacgcgtacagcgaacaccttgccgccgctctctgcactaacccaaatctcatcgagctgagcctttatagaaatgctctggggagcagaggagtcaaactcctttgtcaggggctgcgccatcccaattgcaagctacagaatcttaggcttaagagatgccgtatttctagctcagcatgtgaagatctttccgccgccctcatcgccaacaaaaacttaacccgtatggacctgtccgggaatggagtgggtttcccaggcatgatgctcctatgcgaaggattgcgccacccacagtgtagacttcagatgatccagcttcgcaagtgccagttggagtccggagcatgtcaggagatggcaagtgttctcggcactaatcctcatcttgtcgaactggacctaaccgggaatgcacttgaagatcttggactgagattactatgccagggcctcagacaccctgtgtgcagactacgcaccctctgctggatgctgtttgggatggatctgaacaagatgacacactccaggctcgccgctctcagggttaccaagccatacctggacatcggttgctag

SEQ ID NO: 23910 - DNA, 945 bp, Artificial Sequence
  Description of Artificial Sequence: Synthetic coding sequence
atgcagaccttcctgaagggcaagcgggtgggctactggctgagcgaaaaaaagattaagaagctcaacttccaagcgtttgccgaactctgccgaaaacggggtatggaagtagttcagcttaacctaagtaggccgattgaggagcagggccccctggatgtgattatacataaattgacggacgtgattctagaggccgatcaaaatgacagtcagagcctggaactggttcaccgcttccaggagtatattgatgcccaccccgagacgattgtgttggacccgcttcccgcgatacgcacactgcttgacagaagcaaaagctacgaattaatcaggaagattgaggcgtatatggaggacgacagaatttgcagtcccccttttatggaacttacttcgctctgtggtgatgatacgatgagactcctggagaagaacggcctgacttttccctttatttgcaagacacgcgttgcccacggtaccaatagccacgagatggccatcgtattcaaccaggaggggcttaatgctatacaacccccatgtgtggtccagaattttataaaccataatgctgtgctctacaaggtcttcgtggtcggggaatcgtacacagtggtgcagcgcccttccctcaagaacttcagcgcaggaactagcgatcgcgagtcaatcttttttaattcacataatgtttctaaacccgaatctagctcagttctcaccgagcttgacaagattgaaggcgtgttcgagagacccagcgatgaggtgatccgcgaactctctcgtgccctaagacaggctctgggagttagccttttcggcattgatataattattaataaccagacaggacaacatgctgtcattgacattaatgctttcccaggggactgccaagtgtgttttattgaggggtggaagaccgactag

SEQ ID NO: 23911 - DNA, 630 bp, Artificial Sequence
  Description of Artificial Sequence: Synthetic coding sequence
atgcccgtggccgtgatggccgagagcgccttcagcttcaagaagctgctggaccagtgcgagaaccaagagctcgaagcgcccggcggcatagccaccccgcctgtttacggccagctgcttgcgctttacctgttacacaacgatatgaataatgcccggtatctctggaagcgaataccccccgctatcaagagtgcaaatagcgagctggggggtatatggagcgtaggccagaggatctggcaacgggactttccaggtatttatacgactatcaatgcacaccagtggtcagaaaccgtgcagcccatcatggaagcattacgggacgccacacgacgcagggctttcgccctggtcagccaggcctacacaagtataattgccgacgacttcgccgcgtttgtagggctcccggtggaggaggctgtgaaaggcatactggagcagggctggcaagctgattccactacccgcatggtgctaccacgaaaacctgttgctggcgccctcgacgttagtttcaataaatttattccactgagcgagccagctcccgtcccccccatacccaatgagcaacagcttgctagattaactgattatgtggctttcctggagaactag

SEQ ID NO: 23912 - DNA, 4935 bp, Artificial Sequence
  Description of Artificial Sequence: Synthetic coding sequence
atgttctggtgcggcacctgcttcgtgaccaacaacatgaagggctccgaagtgtccctggaaaaaaagaaaaagattaagatgcccgtgaaaagactccgagaagtggtctcccagaatcatggtgatcacttggttctgctcaaggacgagctgccttgcgtgcctccggcactcagtgcaaacaagaggctgcccgttggcacagggacttccctgaacggcacttcaagagggagctccgacctgacgtccgcacgaaattgttaccagccactattggagaacccaatggtgtccgagtccgatttttctaaggacgtggctgttcaagtgctgccacttgacaagatcgaagagaataacaaacagaaggcgaacgacatcttcattagtcagtacacgatgggtcagaaggatgcactgcggaccgtgcttaagcagaatgtgtcactctgcctcacagggtggtctgaccactctggggtgattaccacacactgctccctatatttactcaggctgatgcgcagcagccacttgtcactgccctcatcttgggactacagagcccagagcatgccggttttcaaagaagtgaaagtgcatctcttggaagacgccggcattgagaaagacgctgtcacccaggaaacccggatcagtccatccggcatagactcggccaccactgtggctgccgccacagccgctgcgatcgctacagctgcacctttgattaaggtgcagtcagacctagaggcaaaagtgaacagcgttacagaactgttgagtaagctgcaagaaacagacaaacacctccaaagagtgaccgagcaacaaacttctatacaaagaaaacaggaaaagttacactgccacgatcacgaaaaacagatgaacgtttttatggagcagcacatccgccacctggaaaagctgcagcaacagcaaatcgatattcagacacacttcatctctgccgctctgaagacgtcgtcgttccagcctgtctctatgcccagcagccgcgccgtggaaaaatactcagtgaaacccgagcaccctaatctgggatcatgtaaccccagcctgtataacacgtttgcttctaaacaggccccactcaaagaagttgaagacactagctttgataagcagaaatctcctctcgagactccggcccccagacgcttcgccccggttcccgtgtctcgggatgatgagctgtctaagcgggaaaatctgttggaggagaaagagaatatggaggtaagctgtcaccggggaaatgtgcgcctcctagagcagattctgaacaacaacgatagtctgactaggaaatcggaatcaagcaataccactagtctgaccaggagcaagattggctggaccccggaaaaaacaaatcggttcccctcgtgtgaagagttggaaacaaccaaggttacgatgcagaagtccgatgacgtgcttcatgatttgggacagaaggagaaggagacaaactcaatggtccagcctaaggaatccctttccatgctcaaactcccagatctccctcagaactcagtgaagctgcagaccacaaataccaccaggtccgtgctcaaagacgccgaaaaaatcctcaggggcgtccaaaacaacaagaaggttctcgaagagaacctggaggctatcattcgcgccaaagacggggcagcaatgtattctctgataaatgccctgtccacgaaccgcgagatgtctgagaagatacgaataagaaagactgtcgacgaatggatcaagactatctccgcagaaattcaagatgaattgtcacggactgactacgagcagaaacgatttgaccagaagaatcaaagaacaaagaaagggcagaacatgactaaagatatacggacaaacactcaggacaaaacagttaacaagagcgttattccgcggaaacacagtcagaagcagatagaagagcacttccggaacctccctatgcgagggatgcccgcgagctcattgcaaaaggaacgcaaagaaggactcctgaaggccaccaccgtgattcaggacgaagattatatgctgcaagtgtacggtaaacccgtctatcagggacaccgatccactctcaaaaaagggccatatctcaggtttaactctccctctcccaagagcagaccgcagcgaccaaaggttatcgagcgcgttaaaggaacaaaagtgaagtctatccgcacacagactgatttctatgctaccaagcctaagaagatggattccaagatgaaacacagcgttccagtccttccccacggggaccaacagtacctgttctctccatcaagggagatgccaacattctccggcacgctggaaggccacctgattcccatggcaatcctgttgggtcagactcagtcaaactcagatacaatgcctcccgcaggtgtgatcgtgagcaagccgcaccctgtcacagttacaacatcgatcccccccagcagcaggaaggtggaaactggagtcaagaagcccaacattgctattgtggaaatgaagtccgaaaaaaaggatcccccccagctcaccgttcaagttctcccttctgtggatatcgacagcatctctaactcctccgccgatgtgctgtctccgctgtcatctcccaaagaggctagtctgccccccgtacagacttggatcaagacccccgaaattatgaaggtggatgaggaggaggtaaagttccctgggacaaatttcgatgaaataatagatgtcattcaggaggaggagaagtgtgatgagatcccggattccgaacccattctcgagttcaacaggtccgtcaaagccgactccacaaagtataacggcccaccctttcccccggtggcatctactttccagcctaccgcagatatcctggacaaggtcatcgagcgtaaagaaaccctggaaaattcattaattcaatgggtggagcaagagatcatgtccagaatcatctcgggactgtttccagtgcagcagcaaatcgctccctctattagcgtaagcgtgtcagaaacctctgagcccctgactagtgacatagtggaaggtacctcctctggcgcgttgcagctgttcgtggacgctggtgtacctgtgaattccaacgttattaaacatttcgtgaacgaagccttagccgaaactatcgcggtgatgttaggagacagggaggctaagaaacaaggcccagttgcaacaggcgtgtctggggatgctagcaccaatgagacctatctgcccgctagagtgtgtacccccctcccgacgccccagcccacaccaccatgtagtccgtcttcccctgctaaggaatgcgtgctcgtcaagactccagattcttccccttgcgatagtgatcacgatatggccttcccagtgaaggagatctgtgccgaaaagggggacgatatgccagctattatgctggtaaatacacctacggtcacccccacaaccacaccacccccagccgctgccgtgttcaccccgacattgagcgacatcagcatagacaaactgaaagtttccagcccggaactgcccaaaccatggggtgacggagacctgccactcgaggaagaaaatcccaacagtcctcaggaggagctgcacccaagagcaattgtgatgtccgtggctaaggatgaagagccagagagtatggacttcccagcacagccccccccgcccgagcctgtcccattcatgcccttccctgccggtaccaaagctccttccccttcccaaatgcccgggtccgattctagtactttagagagtactttgagtgtgaccgtgaccgagaccgaaaccctcgataagcctatttcagaaggcgagatcctgttttcttgcgggcagaagctggcccccaaaattctggaggacattggactgtacctcacgaatctgaatgatagtctatctagtaccctccacgacgccgttgaaatggaggacgatcctccttccgagggtcaggtcattcggatgtctcataagaagttccacgccgacgctattctctcttttgctaaacagaaccaggagagcgccgtgagtcagcaagccgtctaccacagtgaagatctggaaaacagcgttggcgaattatctgaaggtcaacgcccccagctcactgctgcggctgagaatatactcatgggacacagcctctatatgcaaccccccgtcacaaacactcagtccctggaccaacaatgcgatccaaaacccttgagccgacaattcgacaccgtgtcaggctcaatctacgaggattcttgcgcttctcatggacccatgtctctgggagaattagagttggaaccaaactctaaactggtcttgcctaccacattactgaccgctcaggaaaacgacgttaacctgcccgttgcggcagaagacttttctcaatatcaactgaagcagaaccaggatgttaaacaggtggaacacaagccctctcagagttatcttcgagttcgcaacaagtctgacattgcgcccagccaacagcaggtctctcctggagatatggacaggactcagatcgagctaaacccgtaccttacctgtgtgttttccggacttggcgtacatgtgaagaaagtcagctgcataggaaagctggggctctggaggttcgtaatacagattatcagcagtcccagatgggagagctccgccaccctgcggtttacagatgctccgtgccaagacgtttcggatgcagctgtctccgagccccgcggactgctgagtgtgagcgaaagccagcacaacgccggaggtcacggggtttttgggggaaggtatcttctgaacggcaagcgtcaacccgcgcagtgtttgtgtcattggttttag

SEQ ID NO: 23913 - DNA, 3138 bp, Artificial Sequence
  Description of Artificial Sequence: Synthetic coding sequence
atgctgaccgtgcaggtgaagaccagcagcgccatcgagctgcccgactcactggcgttcttatggataatcccaatgtggtactgcgaggggaaggaacttgagaattctccagatattcatattgtccaggccggcaatctgcacagtctcactatcgcggaagcgtttgaggaagatactgggagatatagttgcttcgcttccaacatttacgggaccgatagtaccagcgcagagatctacatcgagggcgtctcaagttccgacagtgagggcgaccccaataaagaggaaatgaatcgaatacaaaagcccaacgaagtgtcaagcccacccaccacctcagctgtcattcctcctgcggtgccccaggcgcagcacctagttgctcagcctcgcgttgctacaatccagcagtgtcagtcccccacaaactatttacaaggtctcgacggaaagccaattatagccgctccagtttttactaagatgttacaaaacctttctgcctctgaagggcagctggtggtgttcgagtgccgagttaagggcgcacccagccctaaagtcgaatggtatagagagggcactctgatcgaggactcccccgattttcggatcctgcagaaaaaaccaaggagcatggccgaaccagaggaaatttgcactctggtgattgccgaggtgttcgcagaagatagtggctgcttcacctgtaccgcttccaacaagtatgggaccgttagctccatcgcccagctgcatgtgcgaggcaacgaggatctgtctaacaacggctccctccattcagcgaattccaccacaaatctggccgccattgagccgcagccaagcccaccgcactccgaacccccatccgtggagcaacctcccaaacccaaacttgagggagttctggtcaaccacaacgagccccgctcctcctcccgaatcggcctgcgcgtccacttcaatctccctgaggacgacaaaggatcggaggcctcatccgaggccggggtggtgacaacccgccagactaggccagatagcttccaggagcggtttaacgggcaggctactaagactcccgaacctagctcccccgtaaaagagccgccgcctgtactggctaaaccaaagctagattctacgcagctgcagcagctgcacaatcaggtgctgttagagcagcaccagttacaaaaccccccaccttcaagtcctaaggagtttcccttctcgatgacggtgttgaactctaatgcgcccccagctgtaacaacctcttcaaagcaggtgaaagcgccttcttctcagacattcagcttggcccggcccaaatatttttttccctcaacaaatacaaccgctgcaaccgtcgcgccatccagctccccggtcttcaccctgagctcaactcctcagactatccagaggaccgtgtccaaggagtcactgctggttagccaccctagtgtccagactaaatctcccggcggcctgagcattcaaaatgaacccctcccaccgggccctactgagcccactccgcctccttttactttcagtatcccatctggtaaccagttccagccccggtgtgtcagccccatccctgtctcacccacctcacgaatccagaacccggtggcatttctctctagcgtgctcccttcactgcctgcaatcccccccaccaatgcgatgggactcccacggtctgccccttccatgccttcacagggcttagctaagaaaaacaccaagagtccacagcctgtgaatgatgacaacatacgggagacaaagaacgctgtaattcgcgatctgggaaagaagataactttctccgatgtccggcccaatcagcaagaatataagatctcgagttttgagcagcgcctgatgaacgaaatcgagtttcggcttgaacggactccagtagatgaaagcgacgatgagatccagcacgatgaaatacctactgggaagtgcattgctcccatctttgataaacgcctgaagcatttccgcgtcacggagggcagcccagtaaccttcacgtgcaagatcgttggcatcccagtgcctaaggtgtactggtttaaggacgggaagcagatctcaaagaggaacgagcactgtaaaatgcggagagagggcgacggcacatgttcactacatattgagtctactacttccgacgatgatggcaattacaccattatggctgccaacccgcagggacgcatttcctgctctggccatttaatggttcagtccttgcccattagatcacggcttacgagcgccggccagtcccatcgcggaaggagccgagtccaggaacgggacaaagagcccttgcaggagcgctttttccgccctcattttttgcaggccccgggtgacatggtggcccacgaagggcggttatgccgcctggactgtaaggtttccgggctgccacctcctgagcttacctggttgcttaacggacagccggtcttgccagatgcctcccataaaatgctcgtgcgtgaaactggagtccactccttactaatcgaccccctgacccagcgggacgctggcacctacaaatgcattgcgacaaacaaaacgggacagaatagcttttcactggagctctctgtggtcgcaaaggaggttaaaaaggccccagtgattctggaaaaactccaaaattgcggcgttccggaaggtcacccggtgcggttagaatgcagggttattggcatgccaccacctgtgttttattggaaaaaggacaatgagaccatcccctgtaccagggagaggatatctatgcaccaggacacaactggttacgcttgcctcctgattcagccagccaagaaaagcgatgccggttggtacacactctcagctaagaacgaggccggcattgtgtcttgcactgcgagacttgacatctacgctcagtggcaccaccagatcccgcctcccatgagtgtcaggccatctggctcgaggtacggcagtctcaccagcaagggcctggacatattttctgcttttagcagtatggagagtacaatggtatattcctgctcctcccggagtgtagtggaatctgatgagctttag

SEQ ID NO: 23914 - DNA, 951 bp, Artificial Sequence
  Description of Artificial Sequence: Synthetic coding sequence
atgacccccagcgagggcgcccgggccggcaccggccgggagctggagatgctggactccctgctagccctcggcgggctagtgctgttacgcgacagcgtcgagtgggaggggcggagtctgctgaaggctctggtcaagaagtcggcgctttgtggggagcaggtgcatattcttggttgtgaggttagtgaggaagaattcagagaaggattcgactctgatatcaataacaggctggtatatcacgacttttttcgagatccattaaactggagcaagaccgaggaggcttttcccggcggacccctgggcgcattgagagcgatgtgtaagcggacggaccccgttcccgtgaccattgctctggacagtctgtcgtggctgttgctgcggcttccttgcaccaccctttgtcaagtacttcacgccgtgtcacaccaagactcctgccccggtgacagttcaagcgtcggtaaggtgagcgtgctgggactgctccatgaagaactccacggccctgggcccgtgggggccctctcctccctggctcagacagaagtgaccctgggggggacgatggggcaggcctctgcacacatactctgccgcaggcctcggcagcggcccaccgaccagactcagtggtttagtattctacctgacttctcattggatcttcaagagggccccagcgtggaaagtcaaccctatagcgatccccatatcccacctgtagatcctacaacccatctgactttcaatttgcacctgagcaagaaagaaagagaggctagggatagccttatattgccatttcagttctcatcagagaaacagcaggccctgctcagacctcgccccgggcaggccacaagccacattttttacgagcctgatgcgtatgatgacctggaccaggaagatccagacgacgatcttgatatttag

SEQ ID NO: 23915 - DNA, 1473 bp, Artificial Sequence
  Description of Artificial Sequence: Synthetic coding sequence
atgaacggcgccctggaccacagcgaccagcccgaccccgacgccattaagatgtttgtcggtcagataccacgtagttggagtgaaaaagaacttaaggaactgtttgagccctacggagcagtctatcaaataaatgtactgagagaccgctcgcaaaaccctccacagtctaaaggttgctgtttcgtcacattttacactaggaaggcagcgctcgaagcccagaacgcccttcataacatcaagaccctgcctgggatgcaccacccgatccaaatgaaaccagcagactccgagaagtcaaacgcggttgaagatcggaaactattcattggcatggtgagcaagaaatgcaatgaaaacgatattcgggtcatgttctctcccttcggacagattgaggagtgtcgaatattaagaggccccgacggtctctcacgggggtgcgccttcgtaacattttctactagagcgatggcacagaacgccatcaaggctatgcatcagtctcaaactatggagggctgttcctctccaatcgttgtcaagttcgccgatactcagaaagacaaagagcaaaggcggctacagcaacaacttgcacaacaaatgcaacaactgaataccgctacctggggtaatctgacagggctggggggcctgaccccccaatacctcgcactactgcagcaggcaacgtcttcaagcaacctgggggccttctcaggcatccaacagatggctggaatgaatgctttgcaacttcagaatctagctaccctcgccgcagctgccgccgcggcccaaacatctgccacctctaccaacgcaaaccccctgtcgaccactagcagcgccctgggagccctgaccagccctgtggctgctagtacccctaactctacggccggcgccgccatgaacagccttacttcactcgggactctgcagggcctggctggagccaccgtggggcttaataacattaatgccttggccgtggcacagatgttgagcgggatggcagccctaaacgggggactgggcgccaccggcttgacgaatggtacagcaggaacaatggatgcgctgacacaggcatacagcggaatacaacagtacgccgcagccgccctgccaacattgtactctcagagccttctccagcagcaatccgcggccggttctcaaaaggagggccccgagggcgcgaatctattcatctaccatctcccacaagagttcggcgaccaggacattctgcagatgttcatgccctttgggaacgtgattagcgccaaagttttcatcgataagcagactaacctctccaaatgttttggattcgtctcgtatgacaatcccgtcagcgctcaggcggctattcaggccatgaacggtttccagatcggaatgaagcggctgaaggttcagcttaaaaggagcaagaatgacagtaaaccatattag

SEQ ID NO: 23916 - DNA, 1428 bp, Artificial Sequence
  Description of Artificial Sequence: Synthetic coding sequence
atggaggccctgctggagggcatccagaaccggggccacggcggcggcttccttacctcttgcgaggctgaactacaggagctgatgaaacagatcgatattatggtagcacataagaagtctgaatgggaaggtagaactcacgccctagagacctgcttgaagatcagggaacaggaattaaagtccttgaggagtcaattggacgtcacgcataaagaggtggggatgttgcaccagcaggtagaggaacacgaaaaaatcaagcaagagatgacaatggaatataagcaagaactgaagaagctgcacgaagagctgtgtatcctaaagcgctcttatgagaagctgcagaaaaaacagatgagggaatttagagggaataccaagaaccaccgcgaggacagatccgaaatcgaacgtctaaccgccaaaatcgaggagttccggcagaagtccctcgactgggaaaagcaaaggctgatctaccaacaacaagtgagttccctggaagctcaacgaaaagcactggccgagcagtccgagataattcaggcgcagctggtgaatcggaaacagaaactggagagtgtggagttatcctcccaatctgagatacagcatctgtcctccaaattggagcgtgctaacgatacaatttgcgcaaatgagttagagatcgaaagattaaccatgagggtcaacgatctggttggcacctcaatgactgtactgcaggaacagcagcagaaggaggaaaagctgcgagagtctgagaagctgcttgaggctctgcaagaggagaagagagaattgaaggcagccctccagtcacaggaaaatctgattcacgaagctaggatccagaaagagaagttacaggagaaagtaaaagctaccaatacacagcacgccgtggaggcaatctccttggaaagtgtgagcgcaacctgcaagcagctgtcccaggaacttatggaaaaatatgaggagctcaaacgcatggaagcccataacaatgagtacaaagctgagatcaagaagttgaaagagcaaatcctacagggagagcaaagctactctagtgcccttgaaggaatgaagatggaaatcagccatttgacccaggagttgcaccagcgggatattaccatcgctagcaccaaagggtcatcctctgatatggagaaacgattgcgcgcagagatgcaaaaggccgaagacaaagccgtagagcacaaggagatcctggaccagctcgagtctctgaagctggaaaatcgccatctatcggaaatggtcatgaaactcgaactaggtctccatgagcggtggggtttcaccatgctgtctagcttggtcctgaatttcggaatccaggccattcggcagccacagcgccccaaggtgctggagttgcaggtttag

SEQ ID NO: 23917 - DNA, 2340 bp, Artificial Sequence
  Description of Artificial Sequence: Synthetic coding sequence
atgcggatcgaggagcggaagagccagcacctgaccggcctgaccgatgagaaggtcaaggcgtatttatctctgcacccccaggtgctggacgagtttgtatccgaatccgtgtctgccgagaccgtggaaaagtggttgaaacggaagaataacaagtctgaggatgagtccgcccccaaagaagtctctcgctatcaggacactaatatgcaaggggtcgtgtacgagcttaattcatatatcgaacagaggcttgacaccggcggcgataaccagctgcttctgtacgagctttccagcatcatcaagatcgcgacaaaagcagatggctttgctttatactttttaggggagtgcaataactcattgtgcatttttacaccccccggtataaaggagggcaaacctaggctgattccagcaggaccgattacccaggggaccacagtgtctgcatacgtcgcgaaatccagaaaaacgctgctcgtcgaggatattctcggcgacgaaagattcccccgcggcacagggttagagtctggcacgagaattcagtctgtgctgtgcctccccatagtgacggccattggagacctcatcggaatcctggagctataccgccattggggcaaagaagccttttgtctatctcaccaggaggtggccaccgctaaccttgcctgggcgagtgtggccatccaccaggttcaggtttgtaggggactggctaagcagaccgagttgaacgacttcttgttggacgtttcaaaaacttacttcgacaacatcgtggctatagactcattgctggagcatatcatgatttacgccaaaaacctggttaatgcagacagatgcgccctctttcaggtagaccataagaataaagagctctattccgatctgttcgatatcggtgaagaaaaggagggcaagcccgtcttcaagaaaacaaaggaaatccggttcagcattgaaaagggcattgccggccaggttgctcggaccggcgaagtgctcaacattcccgacgcatacgcagatcctcgctttaaccgagaggtggatttgtatactggctacaccacgaggaacatcctgtgcatgcctatcgtttcccggggatcagtgatcggagtcgttcaaatggttaataaaatatcaggatctgctttctcgaaaacagatgagaataactttaaaatgttcgccgttttttgtgctttagccttgcattgcgctaacatgtaccacaggattcgccactccgagtgcatctatagagtaacaatggaaaaactttcttaccacagcatctgtacctccgaagaatggcagggcctgatgcagtttactttgcccgtgcggttgtgtaaggaaatcgaactgttccatttcgatatcggtcccttcgaaaacatgtggcctggaatcttcgtttacatggtacatcggtcttgcggcacaagctgtttcgagcttgagaaactgtgtaggttcattatgagcgtgaaaaagaactacaggcgggtaccctaccataattggaagcacgcagtcaccgtagcccactgtatgtatgctattttacagaacaatcacactctttttaccgacctcgaacgcaaggggctgctcatcgcatgtctttgccatgacttggaccataggggattcagtaattcgtatctacagaagttcgatcacccactggccgctctgtacagtacttccactatggagcagcaccacttttctcaaactgtgtccatactgcaactggaaggccataacatattcagcacactatcatcaagcgaatatgagcaggtgttggaaatcatccggaaggctattatcgcaacggatttggcactgtactttggcaatagaaaacagctggaggagatgtatcagacaggatctctaaacctaaacaatcaaagccacagagatagggttattggcctgatgatgacagcttgtgatttgtgcagcgtgactaaactctggccggtcactaagttgaccgcaaacgacatttatgccgaattctgggcagagggcgatgagatgaagaaattaggcatccagcccatacctatgatggatcgggataagaaagatgaggtgccgcaaggccagttgggcttttacaatgcagttgctataccttgttatacgacgctgactcaaatcctacctcctacagagccactattgaaggcctgcagagataacctgagccagtgggagaaagtcatccgaggggaggagacagccacctggatctcctcaccttctgttgctcagaaggccgcagccagcgaggactag

SEQ ID NO: 23918 - DNA, 2112 bp, Artificial Sequence
  Description of Artificial Sequence: Synthetic coding sequence
atggccgccgccaccggcgaccccggcctgagcaagctgcagttcgccccattcagctccgccctggatgtgggattttggcatgaacttacgcagaagaaactaaacgaatatcggttggatgaggcccccaaggacatcaaggggtattattacaatggagattccgcgggattacccgcacgactgacactggaattttccgcttttgacatgtctgcccctacacccgcgcggtgttgccccgctatcggcacactgtacaacactaacaccctggagtcctttaagacagccgacaaaaagctgttactcgagcaggcagccaatgagatttgggagtcaatcaagagtggaactgccctggagaaccccgtgctactgaacaagttcctgctgttgacctttgcagatctaaagaaataccacttttattattggttttgttaccccgcgctctgccttccagagagcctgccactgatccagggcccagttggcttggatcagcgcttctccttgaaacaaattgaagcccttgagtgcgcttatgataatctgtgtcagacagaaggggttaccgccttgccgtattttcttattaagtacgatgagaacatggtgctagtgtccctactgaaacactactcagactttttccaggggcagaggaccaagattaccatcggggtttatgacccatgcaatctggctcagtacccagggtggccactaaggaatttcctagtgctggcggcgcataggtggtcctcctcatttcagtcagttgaagtggtgtgttttagggatagaaccatgcagggggcccgagacgtggcacacagcattatctttgaagtcaagctgcctgaaatggctttttcacccgattgccctaaggccgttggatgggaaaagaaccagaagggcggcatgggcccacggatggtaaacctgagtgagtgtatggaccctaaaagattagccgagagttccgtagacctaaatctgaaactgatgtgttggcgtctggttcccactctggacctggataaggtggtgtccgtcaagtgtctcctcctgggagccggcacgttagggtgcaacgtggcccgcaccctcatgggatggggagtgagacacataacctttgtcgacaatgcgaaaatcagttacagcaacccagtaagacagccactttacgaattcgaagactgcctgggagggggcaagcctaaagctctcgctgcggcagaccggctgcagaagattttccccggcgttaacgccagaggattcaacatgagtataccgatgccaggtcatccggtgaatttcagcagcgtcacgctcgaacaggccaggagagacgtggagcagctggagcagcttattgagtcccacgacgtcgtatttctcttgatggatacccgggaatcaaggtggctgccagccgtgatcgctgccagcaagcgcaaacttgttattaatgctgccctgggtttcgacacctttgtggtgatgcgccacgggctcaagaaacccaaacagcagggggccggagacctctgccctaaccaccccgtcgcctccgcagacctacttggcagttccttgtttgccaatataccaggatacaaacttggatgctacttttgtaacgatgtggtagctccgggggactccacaagggacagaaccttagatcagcaatgtacagtgtcaagacccggccttgcagtgatcgccggtgcactggcagtcgagctaatggtgtctgtgcttcagcacccagaaggagggtacgccatagcttcctcctccgatgatcgaatgaatgaaccccctacttcactgggactcgtgcctcaccagattaggggcttcctctcccggtttgataacgtgctgccggtcagtttggccttcgacaagtgtacggcttgtagttctaaggtgctcgaccagtatgaaagggaagggtttaatttccttgcaaaggttttcaattcttctcacagctttctggaggacttaactggcttgacattgctccatcaggaaacgcaggctgctgaaatttgggacatgagcgatgacgagaccatctag

SEQ ID NO: 23919 - DNA, 3246 bp, Artificial Sequence
  Description of Artificial Sequence: Synthetic coding sequence
atggagagcgccggcctggagcagctgctgcgggagctgctgctgcctgataccgaaagaattaggcgggccacagaacagcttcagatcgtgcttagagcccccgctgctctgcctgcactgtgcgacctgctcgcttccgccgccgacccacagatacggcaatttgcggcggtgcttactcgtcgccgcctaaataccaggtggcgtcggctagccgccgagcaacgggaaagtctcaaatctttaatcttgacagcgcttcagcgagagaccgaacactgcgtgagcctgagcctggcacagttgagcgccacgatttttaggaaagagggcctcgaagcatggccccagctgctgcaactcctgcagcattccactcatagtccccattccccggagagggaaatgggccttttattgctatccgttgtcgtgacaagtagaccggaggctttccagccccatcatagagaactgctgcgcctgttgaacgaaactctcggtgaggtgggctcccccgggttactgttctattcgcttaggacgctcaccactatggccccctacctgtcaaccgaggatgtaccgttagcaagaatgctggtacctaaactgattatggcaatgcagacgttgattcctattgacgaagcgaaagcctgcgaggcactggaggctctggacgagctgctggaaagcgaagtgcctgttattacaccctacctgagcgaggtgctgactttctgtctggaagttgctcggaacgtcgcgcttggcaacgctattcgtataaggattctctgctgtctgacattcctcgtgaaagtaaagagcaaggccctgttgaagaatcgcctgctgccacctctgctacacactttatttcccattgttgcagcggagcccccaccaggccaactggatccagaggatcaggactctgaggaggaggaactggaaatagagcttatgggcgagacacctaagcactttgccgtgcaggtagtggacatgctagctctacatttgccacccgaaaagctgtgtcctcaactaatgccaatgctcgaggaagcgctgagatctgagtctccataccagcgcaaggcagggctcctcgtactggctgtgctgagcgatggcgctggagatcatatccgccagagattacttccccccttattacagattgtgtgtaagggactcgaagatccttcgcaggtggttagaaacgccgccctttttgctctagggcagttttctgagaatttgcagccacatatatcctcttatagtcgagaagtcatgcctctgctgcttgcctacctcaaaagtgtgccattaggccatacacaccacttggccaaagcttgctacgctctggagaactttgtagagaaccttggccctaaggtacagccctacctgcccgagctgatggagtgtatgctgcagttgctgcggaatccttctagtccgcgcgctaaagaactcgcggtgtcagcgctcggcgccatcgccaccgcggcccaagcatctctgctgccttactttccagccatcatggagcatctccgcgaattcttactgacggggcgtgaagacctgcagccggtccagatccagtctctggaaacacttggggtgttggcccgagccgtgggagaacccatgcgtcccctggcagaggagtgctgccagctggggctcgggctgtgcgatcaggtggacgatccggatctccggcgctgcacctactcactgttcgcagctctgagtgggcttatgggggagggattagccccccatctggagcaaatcacaaccttgatgctgttgtccctgcgctccaccgaggggattgtgcctcagtatgatgggagcagctcatttctcctgttcgacgacgaaagcgacggcgaagaagaagaggagctgatggacgaggatgtggaagaagaggacgatagcgagatctctggatattctgtagagaacgccttcttcgatgaaaaggaggatacctgcgcagcggtaggagagatttccgttaacacatcagtggcattcctgccttatatggagagcgtcttcgaggaggtatttaaactgttggaatgcccccatctcaacgtcagaaaggctgcgcacgaggccttggggcaattctgttgtgctctccacaaggcatgccagtcgtgtccttcagagccaaataccgctgcgctacaggccgctctggcgagagtcgtgccctcctacatgcaggccgtgaacagagagagggagcgacaggtagttatggcagttctcgaagccttaactggcgtgctgcgctcttgcggaactctcactttgaagccacctggaagactggccgagctatgcggcgtactgaaagctgttctgcagcgaaagacagcttgtcaggatacagacgaagaagaggaggaagaagacgacgaccaggccgaatatgacgctatgctgctggaacatgccggagaagcaatcccagccctcgctgctgccgccgggggagacagctttgctcccttcttcgcgggtttcctccctctgttagtatgcaagactaagcagggatgcactgttgccgaaaagagcttcgccgtgggcacactggccgagaccattcagggattgggggcggcctccgctcagtttgttagcagattgttgcccgtgctgctgagtacagcccaggaggccgaccccgaagtgcggagcaatgccatcttcgggatgggagtcttggcagagcacggtggtcatcctgcccaagagcacttcccgaaactgctgggcctgttattccctctgctggcccgggaacgccatgatcgggtcagagacaatatctgcggcgcccttgctaggctgctgatggcctctccaacaagaaagcctgagcctcaggtcctggccgctttgctacatgccctgcctctgaaagaagacctggaggagtgggttaccatcggacgcctgttttcctttctttaccagtccagtccagaccaggtgatagacgtagctccagaactgctccgcatttgctctctgatactggccgacaacaagatcccccctgacacaaaagcagcactgctgctgctattaaccttcctggccaagcagcacactgattcattccaagctgctcttgggtctctgcctgtagataaggcacaggaactacaggctgtccttggtttgagctag

SEQ ID NO: 23920 - DNA, 7224 bp, Artificial Sequence
  Description of Artificial Sequence: Synthetic coding sequence
atggtgggcgagcggcacgccggcgacctgatggtgcccctgggcccaagactccaggcctaccccgaggaactgatcaggcaaaggcccgggcacgatggtcaccccgagtacctgatcagatggtccgtcctcaaatgcggagaggttggcaaagtgggggtggaggagggaaaggccgagcacatacttatgtggctaagcgcaccagaggtttacgcaaactgccccgggctcttgggagaacgggccctgagcaaaggactgcagcacgagcccgcaggtgtgtctgggtcgtttccacgtgatccgggtggcctagatgaggtggcgatgggcgagatggaggcagatgtccaggctctcgttcggagagccgcgaggcagctggcagagagcggaaccccttcactcaccgcagcagtcctccacacaatacatgtcttatcagcatacgcgagcattgggccactgacaggggtgtttagagaaactggcgccctggatctgctaatgcacatgctttgtaaccctgaaccccagatccggaggtctgcagggaaaatgctgcaggcccttgcagctcatgacgctggctctagagctcatgtgcttctctctctcagtcaacaagacggcatcgagcagcatatggatttcgattcaagatacaccctcctggagctgtttgcggagacaacctcctccgaagaacactgtatggccttcgaggggatccatctgccccagattccaggtaagctccttttctcactggtgaagcgctacctctgtgtgacatccttgttggatcaattgaacagttctcctgaacttggagcaggcgaccagtcttccccatgtgccacccgcgagaagtctagagggcagcgcgaactcgagttttccatggccgttggtaacctgatcagcgaactggttcgcagcatgggctgggctcgaaatctgagtgagcagggaatgagtccgccgaggccaacacggtctatcttccagccatatatttctggtcccagcctgctgttgcccactatcgtaaccacgccaagacggcagggatgggtattcagacagcggagtgagttctcttcaagaagcgggtacggggagtatgtgcaacagacactgcagccagggatgcgggtgaggatgctggacgattatgaggaaattagtgccggggacgagggcgagttccggcagtctaataacgggatcccccctgtccagacattaggagaaaaagccctgggggagatctccgtgtcagtggagatggcagagtcactgctgcaggtgttaagctcccgcttcgaggggtcgaccctgaatgatttgctaaattcccagatctataccaagtacggactcctatcaaacgaaccttcttccagtagtacttcacgcaaccatagctgtacccccgatccagaggaggagtccaagtcggaggccagctttagcgaggaggagacagaaagtcttaaagccaaggccgaagcaccaaagaccgaggccgagcccaccaagactcgaaccgagacaccgatggcccagagcgatagccagctatttaaccaattgctcgtaactgagggaatgacattacccactgagatgaaagaagccgccagcgagatggcaagagccctccgaggccctggtccgagatcatctttggaccaacacgtggccgccgtggtagctacggttcagatcagttctctcgacacaaaccttcaactgtccggcctatccgctttaagtcaagccgtagaggaggttactgaacgggatcatcctctcgtgaggccagaccggtcactgcgcgagaagctcgtaaagatgctggtggaattactcactaatcaggtaggcgaaaagatggtggtggtgcaggcgctccgcctgttatacctcctgatgaccaaacatgagtggaggccgctgttcgcccgagaaggcggaatttatgccgtccttgtgtgcatgcaggagtacaaaacctccgtgctcgtgcagcaggccggacttgctgccctcaaaatgctcgccgtggcgagttccagcgagatcccgacctttgtgaccggccgagatagcatccactctctgttcgacgctcagatgactagggagatattcgcaagcattgactccgccactaggccaggctctgagtctctgttattgaccgtgcccgccgcggtgattctgatgctcaacaccgaaggctgcagctcagccgctcggaacggccttctgctcctgaatttgctgctgtgtaatcaccacacactgggcgaccagattatcactcaggagctcagggatactctgttcagacattcaggcattgctccccgtaccgaacctatgcctacaactagaacaatcctcatgatgctgcttaatcggtattccgagcctcctggtagtcccgagagagccgctcttgagactccaataattcaaggacaggacgggagcccagagctactgattcgctccctcgtgggcggacctagcgctgaactgcttctggaccttgagcgggttttgtgtcgggaggggtcacccggcggcgccgtacgacctctgctaaagcggctccagcaggaaacccaaccgttcctgctgctgctgagaacacttgacgccccaggccccaacaaaactctgctgctctctgtcttgcgggtgatcacccgtcttctcgattttcccgaagcaatggtacttccttggcacgaagtccttgagccctgcctgaattgtttgtctggcccaagttccgactcagaaattgtgcaagagctcacttgttttctgcaccgtctggcctctatgcacaaagattacgctgtagtgctgtgctgcctaggtgcaaaggaaatcctgtccaaagttcttgataagcacagcgcccaactgctgttggggtgtgaactgagggatttggtgaccgagtgtgaaaagtatgctcagttatactccaacctgacgagctctatcctggcagggtgcattcagatggtgctcggtcagatagaggaccatagacgaactcatcagccaataaatattccattcttcgatgtcttcctgcgccatttgtgtcagggaagcagcgtagaagtcaaagaagataaatgctgggagaaagtggaggtctcaagtaacccccaccgcgccagtaagcttaccgatcacaacccaaagacatattgggaaagcaatggttccacaggctcccactatatcacactgcacatgcacagaggggtgctggttaggcaattaaccctcctcgtggcatcagaagactctagctacatgcctgcaagggtggtggtcttcggaggagacagcactagttgcatcggaacggagcttaataccgtaaatgtgatgccatcagcctctcgggtaattctgttagagaacctgaaccgattctggcctattattcagattaggatcaagcggtgtcagcagggaggaattgataccagagttcgcggcgtggaggtactgggccctaaaccaaccttctggcccctcttccgggaacagttgtgcagacgcacctgtctcttttatacaattagggctcaggcctggtccagggatatagccgaggaccaccgtcgtttgttgcagttgtgccccagacttaacagggtactgcggcacgaacaaaatttcgccgaccggtttctgcccgatgatgaggccgcccaagccttgggaaagacctgttgggaggccctcgtcagccctttagtgcagaatataaccagccccgacgcggagggcgttagtgctctgggttggctgctggaccaatatcttgagcaaagggaaacaagtcgaaacccactgtcccgcgccgcctccttcgcttcacgagttcgccggctttgtcacctgctcgttcacgtggaaccgcctccaggacccagccctgaacccagtaccagacctttttcaaagaactccaagggtcgggacaggagccccgccccatcacctgtactgccatccagtagccttcggaacatcacacagtgctggctatccgtggttcaggagcaggtctcccgtttcctggccgctgcctggcgggcgcctgatttcgttccccgctactgtaagctatacgagcatctgcagagggcagggagcgagctctttgggccaagagctgcattcatgctggctcttcggagtgggtttagcggagcattgttacagcaatcctttctgactgccgcccacatgtcagaacagtttgcccgctacattgatcagcagattcaaggcggtcttatcggtggtgcaccaggggttgagatgcttggacagctgcagcggcatctggaacccatcatggtattaagcggtctggagttggccacaaccttcgaacatttctatcagcattatatggcggaccgactgttgagcttcggctcctcgtggcttgaaggtgccgtcttggaacagatcggcttgtgcttccccaatagactgccccagctgatgctccaatccctgtcaactagcgaagaattgcaaagacagtttcacctttttcagctgcagagattggataaactgttccttgagcaggaagacgaggaggagaagcgcctagaagaggaagaggaggaagaggaggaggaggaggcagaaaaggaactgtttattgaagaccctagccccgcaatctcgatcctggtcctctctccaagatgttggccagtctctcctctctgttacctgtaccatccccgtaaatgcttgccaaccgaattttgtgacgccttagaccggttctcatctttttactcccagtcccagaatcaccctgtgctggatatgggaccccatcgaaggctgcagtggacctggctggggagagccgaattgcagtttgggaaacagatcttgcacgtttccacagtccagatgtggctcctcctaaagtttaatcagaccgaagaagtgtccgtagaaacgctcctgaaggactccgacctctcccctgaattgcttctccaggcgttggtaccgttgactagtggcaacgggccactcaccctgcacgagggccaggatttccctcacgggggtgtactgaggttgcacgagcctgggccacagcgaagcggcgaggccctgtggttgatcccgccccaggcttacctgaacgtggaaaaggacgaaggaagaaccctggagcagaaaaggaatctgctctcttgcctcctcgtgcggatccttaaggctcacggggaaaaagggttgcacattgatcaactggtctgtctcgttttagaagcgtggcaaaaaggacctaaccctcctggaacactcggacatactgttgcaggcggtgtcgcctgtactagcactgatgttctttcctgtattctgcatcttctggggcagggatatgttaaacgcagggatgatcgacctcagatcctgatgtacgctgcaccggagcccatgggtccctgcaggggacaagccgacgtgcctttctgcggatctcaaagcgaaacatcaaagccttcaccagaagcggtggctaccctagctagcctgcagttgcccgctggcaggacaatgtcccctcaggaagttgagggccttatgaagcaaaccgtaagacaggtgcaggagactctcaacctggagcctgacgtagcccagcacctgctggctcacagtcattggggagccgaacaactgttgcaaagctatagcgaggaccccgaacctcttctgctcgctgcagggttatgcgtccaccaggctcaggcagttcctgttaggcctgatcattgccctgtatgcgtgtccccgctgggttgcgacgacgatctgccctctctatgctgcatgcattattgttgtaaaagttgctggaacgaatatctgactacccgcatcgagcagaatctggttctcaattgtacctgccccattgccgactgccctgcccagccaaccggagcctttatccgcgcaattgtatcctcacctgaagtcatcagcaaatatgaaaaagctctgctacgcggttacgtggagtcctgctccaacctcacctggtgcaccaatccccaggggtgcgataggatcctttgccgacaggggcttggatgtggcacaacctgtagcaaatgcggctgggctagctgcttcaattgctcattcccggaggctcactatccagcctcttgcggtcacatgtcacagtgggtcgacgacggtggctactatgacggtatgagcgttgaggcacagagtaagcatctcgccaagttgatctcaaagagatgtccctcgtgccaagcccccatcgagaaaaatgaaggctgcttgcacatgacctgtgccaagtgcaaccatggattctgttggagatgcctcaagagctggaaaccgaatcataaggactactataactgcagtgccatggtgtctaaggctgcaaggcaagaaaaaagatttcaagattataacgagcggtgtacattccaccaccaagcaagagagtttgccgtgaatctgcgcaaccgagtttccgcaatacatgaggtcccgcccccgcgttctttcacctttctcaatgacgcctgtcaggggctggaacaagcccgaaaagtactggcatacgcgtgtgtgtactccttttactctcaggacgcagagtatatggacgtggtagaacagcagacagaaaacctggaattacacacaaacgctctccagatcttgctggaggagaccctcctacgttgccgggatctcgcatcttctctgcgacttctcagagccgattgcctgagcaccggcatggaactcctgcggagaatccaggaaagactgttagctatcctgcagcactccgcacaggatttcagggtcggtttgcagtccccttctgtcgaagcctgggaagccaaaggccccaacatgcccggtagtcagcctcaggctagctcaggtccggaagccgaggaagaggaggaagacgacgaggatgacgtgccagagtggcagcaggacgaattcgacgaggaactagacaacgactctttttcctatgatgaaagcgaaaatttggatcaggaaaccttctttttcggggatgaagaagaagatgaagacgaagcctacgactag

SEQ ID NO: 23921 - DNA, 672 bp, Artificial Sequence
  Description of Artificial Sequence: Synthetic coding sequence
atggaggacgtgaagctggagttccccagcctgccccagtgcaaggaggacgccgaggagtggacttatcccatgagaagggaaatgcaggagatcctgccaggcttgtttctgggcccctatagttcagccatgaagagtaagttaccagtactgcagaagcacgggataacacatattatttgcatccgacagaacatcgaggccaattttattaagccgaactttcagcaactgttcaggtacctggtactcgacattgctgataatcccgtcgagaatataatccggttcttccctatgactaaggaattcatcgacgggtccctccagatgggcgggaaggtcctcgtgcacgggaacgcgggaatttcacgtagtgctgcctttgtgatcgcctacattatggagacatttggcatgaagtatcgcgatgcattcgcctatgtgcaggagcggagattctgtatcaaccctaatgctggatttgtccatcagctgcaggaatatgaggccatttacctggctaaacttacaatccaaatgatgtcccctttgcagattgagaggtccctcagcgtccacagtggaaccaccggtagcctcaagcgtacgcacgaggaagaagacgacttcggtaccatgcaggtggcgacagcccaaaatgggtag

SEQ ID NO: 23922 - DNA, 1689 bp, Artificial Sequence
  Description of Artificial Sequence: Synthetic coding sequence
atggacgacaagggcgaccccagcaacgaggaggcccccaaggccatcaaaccgacatctaaggaattcaggaagacgtggggctttcggcgcaccactatcgccaagagagagggcgccggagatgccgaggcagacccgctggaacctccaccacctcagcagcaattgggactaagcctgcgccggtcgggccggcagccaaagcgtacggaacgcgtggagcagtttcttaccatcgcaagacgtcgcgggaggcgatctatgcccgtgtcacttgaagatagcggggagcccacttcatgccccgccacggacgccgagacagcctccgagggctccgttgaatcagcttctgagactagatcaggtcctcagtcggctagcactgctgtgaaagagagacctgcttcttcagagaaggttaaaggaggcgacgaccacgacgatacatcagacagtgactcagatggcctaaccctgaaggaactgcagaatcgccttagacgaaagcgggagcaggaaccaactgagcgccctctcaaaggcattcagagcaggctgcgtaaaaagcggagagaagaagggcccgccgagacggtggggtcagaggccagtgatacagtagagggggttctcccttctaagcaggagcctgaaaacgatcagggcgtcgtttcccaggcaggcaaggacgacagggaaagtaagctggagggtaaggcggcacaagacatcaaggatgaggagccgggtgacctgggcagacccaagcctgagtgcgagggctacgatccaaatgccctgtactgcatttgcagacagccgcacaacaaccgcttcatgatttgctgcgacaggtgtgaggaatggtttcacggcgactgcgtgggcatctcagaggcgcgggggaggttactggagcggaatggggaggactacatctgtccaaattgcactattttgcaggtccaagacgagacacatagtgaaaccgccgaccagcaggaagccaaatggaggcccggcgacgctgacggaacagattgtactagcatcggaaccatcgagcagaaatcctcagaggatcagggcatcaagggccggattgaaaaagcggccaacccctctggtaaaaaaaaactaaagatctttcagccagtcatcgaggctcctggtgcatctaaatgtatcggccctggttgttgtcatgtcgcacagcctgacagtgtctactgcagcaatgattgtatccttaaacatgcggcggcaacgatgaagttcctctcaagcggcaaggagcagaagcctaaacccaaggagaagatgaaaatgaaacctgagaagccgtcgctgccgaaatgtggtgcacaggccggcataaagatcagttccgtgcacaaacgaccagcccctgagaagaaagaaaccaccgttaagaaagctgtcgtggttcccgccagatctgaagcactcggtaaggaggcagcctgtgagagttctacgccttcatgggcatccgatcacaattacaacgcggtaaagccggagaaaacagctgccccttcaccgtccctactgtacaaatgtatgtaccacctgggtgtgggattactggaccctagtagaagcttttggatcgccataccatgggcatgccccggactaggtgtagcagccttgtgctag

SEQ ID NO: 23923 - DNA, 360 bp, Artificial Sequence
  Description of Artificial Sequence: Synthetic coding sequence
atgatcctgcagcagcccctgcagcggggcccccagggcggcgcccagagactgccgcgggctgctttgggtgtgacctggggactggatgcacgtgaacctctgcgtaagcagtttctctccgaggaaaacatggccacacacttctcacaactgtcactacataacgaccatccgtattgcagtcctcccatgacgttttcccccgctcttcctcctcttcgatccccgtgtagtgagttgctcctctggaggtaccccggcagcctgatccctgaggcactgcggctgctgagattgggagacacccccagtccaccgtaccctgccacacccgctggtgacatcatggaactgtag

SEQ ID NO: 23924 - DNA, 1794 bp, Artificial Sequence
  Description of Artificial Sequence: Synthetic coding sequence
atggtgcccgaggagcggcgggtgggcctgagcagcgacgagacctcgagtgactcgctgaagtcctggcactctatttgcgtgcttgatagtaaagagcagcctctcgcttgtcaacagaagcaacgccagttcgttaaacctgtgacagaaagcgagcaaccaaccgttctcgagttgctcctggcagagctgagaacacttttctccgcagtgcttcaggactccagtccggctgcttggcgatacctgcacgcggtgctggggttgctgccaccctatagagagctattagtgggccacctagacctgttgccttttctagagcagctttattgctgggcaccgtgggttcagactcatctccaccttgacttgctgggagccatagtgcaagcttttccgcctgatagcagtctgctggacagcgctagtcacgcagactgctgtccccagaagcgacgactgcatcacagacccccctgccccgcttgcccctttgtgcaagcccagtggtccagacagcaggtaaaagaggagctggccacatggttacggcccctgactctgcccgaactgcagcgttgcttgggcatagtgggagctcaagtggctctggaggaggccgtgtggttagacggactctctcttctgccacttgccttagctgccgacattcctgtgagatacgagagtagtgacacggacaacgcagaggtcgagcccgtcggccgcaaggagacaaggagccagctagattatgaggtccctagagagaaggcttttcagaaatctagcacagggttctccccggagacctcttttttagatagccaggtgatgaccgctcttaaaatggaaaggtatctcaaaaagatccacttcctgtacttgaatgtggccccttctagatattttcggccgtacagccttatggtagtgcctcctgacaaggtcaatcccgagcactatattttttctcccttcgggatcttgcacgtgcaccctgtggaaggctctgaaactatgactctcggaacctggcatcaccactgcgtgttgtggcagcagcttcagtttataccgttctttaaatactgcctgctgaggaaatcattcacatgctggaaaaagaacgtgcgactgcaagggctccaccgtcttcagaaatttttagagaatcaccttctgctcgctgtcccccattttggtgccggactcctgcacatttcgcgcctcctgcaggaattacacagcgtctcatggctgccccaagagctggataggtgctacgagctgttggaccttcaaaccgccctggccgaggaaaagcacaaggcactgcggctgcttcaccggtgtctcaatctctgcacttcgatacttcgcctggtgcatgaggacacatatcacatgcagcagtgtctgcaggagagggtccagaactgtgatcggatccgcactggccaggggtctatctatctgcaaagagtgcagcacaagcaattagagcagaagctgaaacaagccgaagcttggtggcttcagctcggcaagttcgctcgcctggttgattacatgatctgccagtcgctgatcagcgttctcgaagagcaaattacaagctttgtggccaatattctgcaggcaccccgtcaaaaacctttcctgtctagccagctagtttttgatgatcacggccagcttagccatgttccctgcgtggagaacatgatacagacacttactgggggcctgcaatctgtgaaaacgtctgctcttcaagtcttctag

SEQ ID NO: 23925 - DNA, 591 bp, Artificial Sequence
  Description of Artificial Sequence: Synthetic coding sequence
atggaggacctgttcgagaccttccaggacgagatgggcttcagcaacatggaagatgacggcccagaagaggaggaacgagtcgcagaacctcaggctaactttaacacacctcaggccctccgttttgaggaattacttgcgaatctgttaaatgaacaacaccagatcgctaaagagttgttcgagcagctgaagatgaagaagccttcagccaagcagcaaaaggaggtggagaaagtaaagccacagtgcaaagaggtacaccagacgttgatccttgaccccgcacaacgcaaacggctgcagcagcagatgcagcagcacgtgcagcttcttacccagattcacctacttgccacgtgcaaccctaacctaaatcccgaggcttctagcacgaggatttgcttgaaggagcttggtacttttgcccagagctccatagctcttcatcaccaatataaccctaaattccaaacactatttcagccctgcaacctgatgggagcaatgcagctgatcgaggacttcagcacacacgtgagcattgattgttccccacataaaactgtcaagaaaactgtgtgctag

SEQ ID NO: 23926 - DNA, 888 bp, Artificial Sequence
  Description of Artificial Sequence: Synthetic coding sequence
atggagctgatccaggacaccagccggccccccctggagtacgtgaagggggtgcccctaatcaaatacttcgccgaggccttgggcccattacaatcattccaagcgaggccggacgacttactgatcaacacttaccccaaatccggtaccacttgggtgtcacagatattggacatgatctaccaaggcggcgaccttgaaaaatgtaatcgagcgcccatctatgttagggtcccttttcttgaagtaaacgacccgggagagccatccggactcgaaacccttaaggacacaccaccaccaaggttaatcaaatcacatctacctttggccctccttcctcagacacttctggatcagaaggttaaggtcgtttacgtagcacgtaacccgaaagatgtggccgtatcatattaccatttccataggatggaaaaagctcatcccgaaccgggaacatgggactcctttctggaaaagttcatggctggagaagtgagctatgggtcttggtaccagcacgtccaggaatggtgggaactttcgaggacgcatccagttctgtaccttttctacgaagacatgaaagaaaatccaaaaagagagatccagaagatcctagagttcgttggcaggagtctccctgaagagacgatggactttatggtgcagcacacttcgtttaaagagatgaagaagaaccctatgaccaattatacgacggttccgcaggagctcatggaccattctatctccccatttatgagaaaaggcatggcgggcgattggaaaaccaccttcacagttgcccagaacgagcgcttcgatgcagactatgctgagaagatggccgggtgttcactgagttttcgcagcgaactgtag

SEQ ID NO: 23927 - DNA, 915 bp, Artificial Sequence
  Description of Artificial Sequence: Synthetic coding sequence
atgaagcgggcccaccccgagtacagcagcagcgacagcgagctggatgaaacaatcgaagttgagaaggaatcagctgatgagaatgggaatctcagttctgcgcttgggtccatgagccccacaacctcttcccagatcctcgcaaggaagaggagacgaggaatcatcgaaaagaggcgcagggaccggatcaacaacagcctctcagaacttcgcagactcgtcccttcagcattcgaaaaacagggctccgccaaactggagaaggctgagatacttcagatgacagttgaccatctgaagatgttgcataccgccggcgggaaaggatatttcgatgcccatgcgctggcaatggattaccggagtttgggcttcagggagtgtctggctgaagttgctcgctacctgtctatcatcgaaggcctcgatgcatctgatcccttgagagtccggttagtttcccacctcaacaattacgcttctcagagggaagccgcttccggggctcacgcagggctgggacatattccttggggaaccgtgttcggccaccacccacatattgcccatccgctgttactgccccagaacggccatggcaatgccgggaccacggcatcccctacggaacctcaccaccagggccgcctgggctctgcccacccagaagcccccgcactcagagctccaccatcagggtcattaggaccagtccttccagtcgttacctcagctagcaagttaagccccccccttctctcaagtgtggcatctctaagtgctttccctttttcgtttggatcattccacttactgagccctaacgccttgtcaccaagcgctcctacacaggcagcaaacctcggaaaaccctaccgcccatggggcacagagattggagcattttag

SEQ ID NO: 23928 - DNA, 2529 bp, Artificial Sequence
  Description of Artificial Sequence: Synthetic coding sequence
atgtgcggcagcgagcggatcctgcaggccggcaacatcctggagatccgtgtcggccaggcaggcgcccggcgggtcgccaccatgactagccccgtcttagtggatatccgggaggaggtcacctgccctatttgtttggagctgttaactgagcctctttccattgattgtgggcacagcttttgccaggcctgcattacccccaacggaagggaaagtgtcattggtcaggaaggggagagatcctgtcccgtgtgtcaaacttcttaccaaccgggcaacctgcgacctaaccggcacctggccaatatcgttcggagattacgcgaagtggtgttaggccctgggaaacagctgaaggccgtgctgtgcgccgaccatggggaaaagctgcagcttttttgtcaggaggatgggaaagttatctgctggctgtgtgaaaggtcacaggagcaccgggggcatcacacatttttagtggaggaggtggctcaggaataccaagagaaattccaggagtctctgaaaaaactgaagaatgaggagcaggaggccgaaaaactgacagctttcatacgcgaaaagaaaaccagctggaagaaccagatggaacctgagcggtgccgcattcaaactgagttcaaccagctccgaaatatcttagaccgcgtcgaacagagagaattgaagaaactggagcaggaggagaaaaagggacttcgaatcatagaggaggccgaaaacgatctggtacaccagacacagtccctacgggaattgatttccgatctggagcgcagatgtcaaggctccaccatggaattgctgcaggatgtttccgacgttaccgagcgttccgagttctggacacttcgaaagccagaggccctccctacaaagttaagaagcatgtttcgtgcccctgacctaaaacggatgcttagagtatgtcgggagcttaccgacgttcaatcctactgggcaatccaggggagcctcactagacgggaacgtcgagcttccggtgtgcgcacaagacgctctcagggtagctcagccatggcctctaagattctgctgaatgtccaagaagaggtgacttgccccatttgcctcgagttgctgaccgaaccattatccctggattgtggccattccctttgcagggcatgcatcactgttagtaacaaagaggctgtcacaagtatgggcgggaagagttcttgcccagtctgcggaatcagctattctttcgaacacttgcaggccaatcagcacctggcaaacatagtggaaagattgaaggaagtgaagctttcacccgacaacggaaagaaacgagacctgtgtgaccaccatggtgagaaactcctcctcttttgcaaggaggaccggaaagttatttgttggttatgtgaacggtcgcaagagcacagaggccatcacacagtgctaaccgaagaggtgtttaaggaatgtcaagaaaaactgcaggccgtccttaagcgtttaaaaaaggaagaggaagaggcagagaagctggaagccgatattagagaggagaaaacctcctggaaatatcaagtgcaaacagagcgtcagcgcatacagaccgaattcgaccaactgcgtagcatcctcaataacgaggagcagcgtgagctgcagcgcctggaggaagaagagaagaagaccttggacaaatttgcggaggcggaggacgaactggtccagcagaaacaactggtcagggagctcattagcgatgtggaatgccgaagccagtggtcgaccatggaactgctgcaagacatgtccggaataatgaagtggagcgaaatttggaggttgaagaaacccaaaatggtgagtaagaagcttaagaccgtattccacgctcctgacctgagtcgcatgctccagatgttccgggagttgactgcggtacgctgttactgggtcgacgtgacgctgaacagcgttaacttaaatttaaacctcgtgctatcagaggaccaacgacaggtcatttccgtgccaatctggccatttcaatgttataactatggagtcttaggttcacagtacttctccagcggaaagcattactgggaagtcgatgtcagcaagaaaactgcatggattctcggagtttattgccgcacttattcccgccacatgaaatatgtcgtcagacgttgcgcaaaccgacagaacttgtacacgaaatacaggccgttattcggctactgggtgattgggctgcagaataagtgcaagtacggtgtgtttgaggagagtctgtcatctgatccggaggtcctcacgctgtcgatggccgtgccgccctgtcgggtcggcgttttcctcgattacgaagctggtatagtgtcattctttaatgtgacatctcacgggtctcttatttataagttttccaaatgttgcttttcacagccagtctatccttactttaatccctggaactgtcccgctccaatgaccctctgccccccctcctcctag

SEQ ID NO: 23929 - DNA, 1497 bp, Artificial Sequence
  Description of Artificial Sequence: Synthetic coding sequence
atgaacggcgccctggaccacagcgaccagcccgaccccgacgccatcaagatgttcgtgggccaaattcctcgcagctggtccgagaaagagctgaaagaactgttcgaaccttatggtgccgtataccagatcaatgtcctacgggatcggagccagaatcccccccagagcaagggatgctgttttgtgacgttttacacccgcaaagctgccctcgaggcacagaacgcgctgcacaatattaaaaccctgcctggcatgcaccaccctatccagatgaagccagcggactcagagaaatctaatgctgtggaagatagaaagctgttcatcggcatggtgagtaagaaatgcaacgaaaacgatataagggtgatgttctctcccttcggacagatcgaggagtgccggattctccgtgggcctgacggattgtcacggggatgtgcctttgtaacattctcaaccagagccatggctcagaacgctattaaagcaatgcatcagtctcaaacaatggagggctgcagcagccccatcgtagtaaaattcgcagatactcagaaagacaaagaacagagaaggctacagcagcagctcgcacagcaaatgcaacagttgaacacggcaacctggggcaacctgacggggcttggtgggctgaccccacaatacctcgcactcctccagcaggctacatctagctccaatctgggagcattctccggaattcaacagatggccgggatgaacgctcttcagctacagaacctagcgacactcgcggccgccgctgccgctgcacagacgagtgcgacctcgacgaatgctaacccactgtctaccacctcgagcgcactcggggcactcactagcccagtggccgccagtacccctaattccaccgccggcgcggccatgaactccttgacatcgttaggaacattgcaaggcctggccggcgccacagtcggtctcaacaacattaatgctctggccgctccgaggagcaagagactgctgctgccaaaagacaataatggtatggccgcattgaatggaggtctaggtgctacaggcctcacgaatgggacggccgggacaatggatgccctgacccaagcctactccggcatccagcagtacgccgcagctgcgcttcccactctctattcacaaagcctgctccaacagcaatccgcggccggaagccagaaggaaggccccgagggcgcgaacttattcatatatcatctgccacaagagtttggagatcaggatattctgcagatgttcatgcccttcggaaatgtcatttcagccaaagtctttattgataaacaaacaaacctcagcaaatgcttcgggtttgtttcctatgataatccagtgtcagcgcaggcagcgatacaggctatgaacggatttcaaatagggatgaagcggttaaaggtgcagctcaagcgctcaaagaacgactctaagccttattag

SEQ ID NO: 23930 - DNA, 2580 bp, Artificial Sequence
  Description of Artificial Sequence: Synthetic coding sequence
atgctggaggtgctggaggagatctggagcgtgcgggcccggcgggctcatcgaccatgccccggaccaagtctcgcagatgacacagacgccaatagcaacggatcctcagggaacgagtctaacggtcatgagtcgcggggcgccagtcagaggtcttcccattcttcaagttctggcaacgggaaagactctgccttattagaaactaccgagtcctccaaatcaacaaacagccagtcgccctctcccccgtcctcatctatcgcctacagcctgctttccgcctcttcagaacaggacaatccctctacaagcgggtgctccagcgagcagtctgctagagcgcggacacagaaagagctgatgaccgcccttagagaactgaagctgcgtctgcccccagaaagacgtggcaaaggcagatccggcacactggccaccctacaatacgctctggcctgcgtaaagcaagtccaagctaatcaagagtattatcagcagtggtctcttgaagaaggggagccatgttcaatggacatgtccacctatactctcgaagaactggagcatataacatccgagtacacactccagaaccaggacacatttagtgttgctgtctcattcttgactgggcggattgtgtacattagtgagcaggccgccgtcttgctcagatgcaaacgggatgtgttcagaggcactagatttagcgaactactcgcacctcaagatgtcggagtgttctatggtagtaccgctccctctcgtctgcctacttgggggactggagcctccgcaggcagtgggttgcgcgatttcactcaggaaaagagcgtgttttgtcgaattcgggggggccctgacagagatccagggccacgttatcagccattccgcctgacaccctacgtcactaagattagggtttccgatggagcgccagcacagccctgttgcctgcttattgccgaacgcatacactccggctacgaggcaccccgcattcccccagataagagaattttcactacgaggcatactcctagctgtctcttccaggacgtggacgaaagagctgctccacttctcggttacctgccacaggacttacttggtgctcctgtccttttatttctgcatcctgaagacaggcccctgatgttagcaatacataagaaaatcctgcagcttgcaggccaaccattcgaccactctcctatcagattctgcgcgagaaatggagagtacgtcacaatggataccagctgggccggatttgtccatccatggagcaggaaagtggcttttgtgctagggaggcataaggtacgaactgcccccctcaatgaggatgtgttcacaccccctgctccctctccagcaccaagccttgacactgacatccaggaactctccgaacagatacaccgccttttgctgcaacccgtgcactccccatcccccacaggtttgtgcggagtgggcgcggtaacaagcccaggtccactgcattcccctggttcatcctccgactctaacggaggagatgcggaggggcccgggcccccggcccccgtgactttccagcaaatttgcaaggacgtccatttggtcaagcaccaaggacagcaactgttcatcgagtccagagctcgcccacagagtagacctcgcctcccagctaccggcactttcaaagctaaagcgctgccgtgtcagtcccctgaccctgaactcgaagcgggcagcgcaccggtgcaggccccactggccctggtgccagaagaagctgaaagaaaggaagcctcttcctgttcatatcagcagatcaactgcctcgactccatcctcaggtaccttgagagttgtaaccttccaagcactactaaacgaaagtgcgcctcctcctctagttacactacttcttcagcctcggacgatgatcgccagcgcacaggccctgtaagcgtaggtaccaagaaggatccaccaagcgccgccctttcaggggagggagctaccccccgcaaggagcctgtggtcggcgggaccctgagtcccctcgccttggcaaataaagcagagagcgtggtgagtgtgacctctcaatgttcattcagctcaacgattgttcatgttggagacaagaagccccccgaaagcgacattataatgatggaggatctgcccggcttggccccggggcccgcaccatcaccagcccccagccccaccgtggcccccgacccagcaccagacgcctataggccagtgggcctcaccaaagcagtgctttcgctccacactcagaaagaggagcaggcgttcctgagccggtttcgtgacctgggtcgccttagagggctggatagctccagcaccgccccaagcgccctgggagaaaggggctcacatctgggaccgcctggcgcctgcccactcccctccttaggcctcgactgctggggagttggtcttaaaggcggggtttccgctccaggcacgcaggccggagtggcttccaccacaaggccctgtcttggtaccggtcccagtttagcctccccacattag

SEQ ID NO: 23931 - DNA, 1266 bp, Artificial Sequence
  Description of Artificial Sequence: Synthetic coding sequence
atggccagcagcagcgtgccccccgccaccgtgagcgccgccaccgcaggaccaggacctgggtttggtttcgcgtccaaaaccaaaaagaaacactttgtccagcagaaggttaaggtattcagggcggcggatccacttgtaggggtttttctttggggcgtggctcatagcatcaatgagctctctcaggtgccaccaccggtgatgctgcttcccgatgattttaaggctagttcaaagataaaggtgaataatcatttgtttcaccgggagaatttaccttcccatttcaagtttaaggagtattgccctcaggtctttcgtaatctgagggacagatttgggatcgatgatcaggattatctagtttctctgacccgaaatcctcccagcgaatccgagggatcggacggacgctttctgattagctacgacaggactctggtcatcaaggaagtgagcagtgaggatatagctgacatgcacagtaacctctccaattaccaccagtatattgttaaatgtcatggaaacacactcctcccccaattcctggggatgtaccgcgtgtcagtggacaatgaggatagttacatgctggttatgcggaacatgttctcccaccggctgccagtgcacagaaaatatgacttgaagggatcgctggtctcgcgcgaagctagcgacaaagagaaggtcaaggagctcccaaccttgaaggacatggactttcttaacaaaaaccaaaaggtctacattggcgaagaggagaaaaaaatctttctagagaagctgaagcgggatgtcgaattcctcgtgcaacttaagatcatggattactcattgcttctggggatccacgacattataaggggatccgagcctgaagaggaggcgcctgtgagagaagatgaatctgaggtggacggcgattgctccttgacaggcccccccgccctcgtgggcagttacggaacatctcctgagggtattgggggctacatccactcccataggcctctcgggcccggggagtttgagagcttcatcgacgtctatgcaataaggtctgcagaaggagctcctcagaaggaggtgtattttatgggtctcatcgacatcctgacccagtacgacgccaaaaagaaggctgcccacgcggccaagactgtgaaacacggagcgggcgccgagatttcaaccgtccaccccgaacagtacgcaaagcggttcctcgattttatcacaaacatatttgcctag

SEQ ID NO: 23932 - DNA, 2031 bp, Artificial Sequence
  Description of Artificial Sequence: Synthetic coding sequence
atggccgccgccaccggcgaccccggcctgagcaagctgcagttcgctccctttagctccgccctcgacgtgggtttctggcacgagttgacccagaagaagctcaatgagtacaggctggacgaagcacctaaggacattaagggttactactataacggggatagcgccggcctgcctgcccgcctgactttggagttcagcgccttcgacatgagcgctcctacccctgctcgctgctgccctgccataggaactctctacaacaccaataccctggagagctttaagactgcagacaaaaagctgctgctggaacaggccgctaatgagatctgggaatctataaagagcggcacagcgctcgaaaatcccgttctactgaataagtttcttctcctgacctttgccgatttgaagaagtatcacttctactactggttctgttacccagccctgtgccttcccgaatcactgcccctgattcaggggcccgtagggctggatcagcgcttttcgcttaaacagattgaggccctggaatgtgcctacgacaacctgtgccagacagagggcgttactgcgcttccttatttcctgatcaaatacgacgagaacatggtattagttagtctgctgaaacactactctgacttctttcagggccagcgaactaagattaccatcggcgtgtatgacccctgcaacttagcccagtaccctggctggccactaagaaattttctggtgctagccgcccacaggtggtccagctcattccagagtgtggaggtggtgtgttttcgcgaccgaactatgcagggtgcacgagatgtggcccacagcatcatctttgaagtgaaactacccgagatggcattttctcctgactgccctaaggcagtcggatgggagaagaaccagaaggggggcatgggtccacgcatggttaaccttagcgaatgtatggacccaaagcgcctcgccgagtcctctgtagatttgaacctcaagctcatgtgctggagactggttcccacgcttgacctggacaaagttgtgagcgtgaagtgccttctcctcggcgcaggaaccctgggatgtaacgttgcccgcaccctcatgggctggggagtacggcacatcactttcgtggacaacgcgaagatcagttacagtaaccccgtcaggcagccactctatgagttcgaggattgcctgggaggagggaagcctaaagccctagcggctgcagacagacttcagaaaatattcccaggagtgaacgcaaggggatttaacatgtcgataccaatgcctgggcatcccgtgaatttttcctctgtcactttagagcaggcaagaagggatgtcgaacagctggaacagctcatcgaatcgcacgacgtcgtgttcttgctcatggacacgagagagtctcgctggcttcctgcggtaatagccgcaagcaagcggaagctcgtgatcaacgccgctcttggcttcgatacttttgtggtcatgcgtcatggcctgaagaaacccaaacagcagggggcgggtgacctgtgtcctaaccatccagtggcatctgctgatctgctgggctccagcctctttgcaaacattccaggatataaattgggctgttacttttgtaatgacgttgtggcacctggcgattctacccgcgacaggaccctcgatcaacagtgcacagtgagtcgacctggccttgcggtgattgccggtgctttagcagtggaactaatggtcagcgttttgcagcatcctgagggaggttacgccattgctagtagcagcgatgatagaatgaatgaaccaccaaccagcctcggattggtgccccatcaggtcctcgatcagtatgaacgcgaggggttcaatttccttgcaaaagtttttaactcctctcactcctttcttgaggatctcaccggactgaccctgctccaccaggaaactcaggccgctgaaatttgggacatgtctgacgacgaaacaatttag

SEQ ID NO: 23933 - DNA, 1329 bp, Artificial Sequence
  Description of Artificial Sequence: Synthetic coding sequence
atggccagcgacggcgccagcgccctgcccggccccgacatgagcatgaagccatcagctgcaccaagccctagcccggcgctgccattcctgccccctacttcagacccgcctgaccatcctcctcgcgagccccccccgcaacccatcatgccttccgtgttctccccagacaatcccctgatgctgtccgcttttccctcctccctgctggttaccggggatggtggtccctgtttgtcaggtgctggcgccgggaaagtaattgtgaaagttaaaaccgagggagggtccgctgagccatctcaaacgcagaactttattctcacccagactgccttgaactccactgctccgggtaccccgtgtggggggctagaaggtcccgccccgccctttgtgacagcttccaatgtgaaaacaatccttccatcaaaagccgtgggcgtaagtcaggaaggcccaccaggtttgccaccccaacctccccctcctgtggcccagcttgtgccaatcgtacctctggagaaagcctggcctggccctcacggcactacaggtgagggaggtcccgttgccaccctcagcaagccaagtcttggggacaggtcaaaaatatctaaagacgtgtacgagaacttcagacagtggcaacgctacaaggcgctggcgaggagacatctttcacagtccccagataccgaggcagtgaaggagtatgtggacattatggagtggctggtgggcacgcacctggccacgggcgagagcgatggaaaacaggaagaggaggggcagcagcaagaagaggagggaatgtatcctgatcccggactcctttcatacattaatgagctctgcagccagaaggtgttcgtcagtaaggtggaggctgtcatacatcctcagtttttggccgaccttttgtcccccgagaaacagcgcgaccccttagcactgatcgaagaacttgaacaggaggaagggttgactctggcccaactcgtgcaaaaaaggctcatggccttagaagaagaggaggatgctgaggccccaccttccttctctggagctcaactagattcttccccttcgggcagtgtggaagatgaggacggcgatggccgcctgcgcccatcccccggccttcagggggcaggcggggccgcctgtctaggcaaagtgagtagtagtggcaagcgtgcaagggaggtccatggggggcaggagcaggcgttggatagtcctcggggcatgcacagagatggaaataccctgccctctcctagttcttgggatctgccgaccaacggagagtctcaatgttag

SEQ ID NO: 23934 - DNA, 666 bp, Artificial Sequence
  Description of Artificial Sequence: Synthetic coding sequence
atgcaggtgcaggacgacggcgtgaacctgatccccttcgccaagtgttctagagttgtatccaggtcaccaccccctagactaccctcgcagagtttaaggccaatgccccaacgctatggggacgtgttctggaagaacttaaatcagcgacctacacctacttggctagaggaacagcatatcccaccaatgctgctccctcctccagagatgttgtggaggaggaagaagagacgcccgtgtcttgaggggatgcagcagcaggggttgggcggcgtcccagcccgggtgagggcggtaacataccaccttgaggatctgcgccgccgacagagtattataaacgagctgaagaaggctcaatggggttcaagtggcgcggcctcagaacctgtcgtccttggagaagaggggtgcggatttccgtctacaaacgaatatcccgaccttgaggaagagcgggccacgtacccccaagaggaggacagatttctgactcctggacgggctcagttgttatggtctccatggtcccccctcgatcaggaggaggcttgtgcctccaggcagctgcattccttggcctcattttccaccgtcaccgccaggaggaatccactccacaatccttgggggatggaactggccgcaagtgaggagtag

SEQ ID NO: 23935 - DNA, 480 bp, Artificial Sequence
  Description of Artificial Sequence: Synthetic coding sequence
atgcagcgggtgggcaacaccttcagcaacgagagccgggtggcctcgcggtgtccatccgtcggcctagctgagcgcaacagagtggcaactatgcccgtccggctgctcagggactcccccgctgcccaggaggataacgatcacgcccgcgatggattccaaatgaagctggacgcgcatggctttgcacccgaggaattggtcgtccaggtcgatggacaatggctgatggttactgggcagcagcaactcgacgtccgggaccctgagagggtgtcctaccgcatgagccagaaagtgcataggaaaatgctgccttccaatctatcgcctactgctatgacttgctgcctgacaccctctgggcagttatgggtgaggggccagtgcgtggccctggctctgcccgaagcccagactggaccgtctcctagattgggctccctcggcagcaaggcaagtaacctgacaagatag

SEQ ID NO: 23936 - DNA, 1782 bp, Artificial Sequence
  Description of Artificial Sequence: Synthetic coding sequence
atggagaagctgagcgccctgcaggagcagaagggcgagctgcggaaacggctgtcctataccacccataagctagaaaagctggagactgaattcgacagcaccaggcactatctggagattgagcttcggcgggctcaggaagagctcgaaaaggtgacggagaagttacgacggatccagtcaaactacatggcccttcaaaggattaaccaggaacttgaggataaactgtacaggatgggacaacactacgaagaagagaaacgggcactgagccacgaaattgtagcccttaactcccacctcctggaggcaaaagtgacaatcgacaaactgtctgaggataatgagctgtaccgaaaagattgcaacttagctgctcagctcctgcaatgtagtcagacgtacggtagagtgcataaggtgtccgagctacctagcgactttcaggaacgggtttctctgcacatggaaaagcacgggtgttctctccccagccctctctgtcatcccgcctatgctgattccgtgccaacatgcgtgatcgccaaggtgttggaaaagccggaccccgcttctctgtcctcaagactctctgatgcctcagccagggacctggccttttgtgacggcgtcgagaagcctggacctcgacccccctacaaaggggatatctactgtagcgataccgccttatactgtcccgaggagcgcagacgggatcgtagaccatccgtcgatgctccagtcacagacgtggggtttctccgcgctcagaattctacagacagtgcggctgaggaagaagaggaggcagaggcagccgcattccccgccggtttccagcacgaagccttcccttcttatgccgggtctctaccaacaagctcttcctactcatccttttccgcaacttctgaggagaaggaacatgcccaggctagcacattgacagcttcacagcaagccatttatctgaacagccgcgacgagctgtttgaccgcaaacccccggccacaacgtacgaggggtcaccaagatttgccaaagccaccgccgcagtcgcggcccctctcgaggcggaagtggcgcccggctttggcaggaccatgtccccctatccagccgaaactttccgcttccccgctagccccggaccacagcaggcacttatgcctccaaacctatggtctctgcgagccaagccgggcactgcacggcttccaggagaggatatgcgggggcagtggagacccctgtctgtggaggacattggggcctatagctaccctgtcagtgccgctggcagagcaagcccatgttccttcagcgagagatattatggcggcgcgggcgggtcaccaggtaagaaggctgacgggagagctagccccctttatgcaagctacaaggcggacagtttctctgaaggggatgatctgtcccaaggtcaccttgccgaaccgtgctttctccgagccggcggagatctgtcactctctcccgggaggagcgcagatcccttacccggctatgctcccagtgaaggcggtgatggtgatagattgggcgtccagttatgcggcaccgccagttctcccgaacccgaacagggcagccgcgacagtttagagccatccagtatggaagcctctcccgaaatgcacccagcagcccgactctccccccagcaagcctttccacggaccgggggaagcgggctgtccagaaaggatagtcttaccaaagcccagctctatggcaccctgctcaactag

SEQ ID NO: 23937 - DNA, 2610 bp, Artificial Sequence
  Description of Artificial Sequence: Synthetic coding sequence
atgggcaaccgggagatggaggagctgatccccctggtgaaccggctgcaggatgccttcagcgccctcggacaaagctgtctcctggaattaccccaaatcgccgtcgtgggcggccaatccgcggggaagtcttccgttctggaaaattttgtcggccgcgattttttgccacgtggttctggaatcgtcacacgtaggcccctggtgctgcaactggtaacttctaaggcggaatacgccgagtttctgcattgcaagggtaagaagtttacggatttcgacgaagtgcggctggagattgaggcggagactgatcgagtgacaggcatgaataaaggaatctcctccattcccattaacttgagggtgtacagccctcatgtgctgaacctaactctgattgaccttccaggaatcacaaaggtccctgtgggcgaccagccgcccgatattgaatatcaaatcagggaaatgattatgcagtttatcacaagggagaattgccttatcttggcagttactcccgccaacactgatctggcaaatagcgatgcccttaagttggccaaggaggtggacccccaaggactaaggacaataggcgtgattactaagttggatttaatggatgagggcaccgatgcacgggacgtgctggagaacaaactcctgccactgagaagggggtatgtgggagtagtgaataggtctcagaaagacatcgacggcaagaaggatatcaaggctgcgatgctggctgagagaaagttcttcctgtcccaccccgcatataggcatatcgccgatcgcatgggcacgccccacctccagaaggtgcttaaccagcagctcacaaatcatatccgtgacacgcttcccaatttcagaaataaacttcagggccagctgctttccatcgaacatgaagtagaagcatacaaaaattttaagccagaggatccaactagaaagacaaaggctctcctgcaaatggtgcagcagttcgcagtagacttcgagaagaggattgagggatccggagaccaagtggatacactggaactgagcggaggcgctaaaatcaatcgtattttccacgaaaggttcccttttgaaatcgtgaagatggagttcaatgagaaggagctgagacgcgagattagctacgccattaaaaacatacacgggattcgaactggcctcttcaccccagatatggcctttgaagctatcgtcaagaagcagatcgtaaagcttaaaggcccttctctgaaaagtgtcgatctggtgatccaggagctgatcaacacggtcaaaaagtgtactaagaaattggcgaatttcccaaggttgtgcgaggagactgagaggattgtcgctaatcatattcgcgagcgcgaaggcaagaccaaggatcaggtactgttgctgatcgatatccaagtttcctatattaacacgaatcacgaggacttcatcggatttgcgaatgctcagcaaagatcctcccaggttcacaaaaagacgactgtggggaatcagggtaccaacctgcctccttcacgccagattgtaatacggaagggctggctaacgattagcaacattggcatcatgaaaggtggctcgaagggctattggttcgtcctgacagccgagagtttatcgtggtacaaggacgatgaagagaaggaaaagaagtacatgctacctcttgataacctgaaagtcagggacgtcgagaagtcctttatgtcaagtaagcacatctttgctctctttaatacagagcagcgcaacgtgtacaaagattatcgattcctggaactcgcatgcgatagtcaggaagacgtggacagctggaaggcaagccttctccgggccggagtataccctgacaaaagcgttgccgagaacgacgagaacgggcaggctgaaaacttcagcatggaccctcagctggagcgacaggtggagaccatacgcaacctggtcgacagttatatgtctattataaataagtgcattcgggacctgattccaaaaaccatcatgcatctcatgattaacaatgtgaaggacttcatcaacagcgagctgctggctcagctatactccagcgaggaccaaaatacccttatggaggaaagcgctgagcaggcccagagacgtgacgagatgctgaggatgtatcaggcactgaaagaagcacttgggattataggagacatatcaaccgcaaccgtaagtacccccgcccctccccccgttgacgactcttggatacagcactcaagacggtcaccacccccaagcccaacaacacagcgcagaccgacgctctcggccccactggccagacccaccagcggtaggggacccgcccccgccataccttctccgggaccccacagtggcgcccctccagtgcctttcagacctgggcctttgccgccatttccatcatccagtgatagcttcggcgcaccaccacaggtacctagtcgtcctacaagagccccaccttccgtgcctagcaggaggcctccacctagtcccacccggcccactatcattaggccacttgagagctccctcctggattag

SEQ ID NO: 23938 - DNA, 1896 bp, Artificial Sequence
  Description of Artificial Sequence: Synthetic coding sequence
atgaacagcagcgacgaggagaagcagctgcagctgatcaccagcctcaaagaacaggctattggcgagtatgaggatttacgcgcagagaatcagaagaccaaagaaaaatgcgataagatcagacaagaacgcgatgaggccgttaagaagttggaggagttccagaagataagtcacatggtcattgaggaagtcaattttatgcagaaccatttagaaatcgaaaagacctgtcgagagtcagccgaggccctggctactaagctgaataaggagaacaagaccttaaagagaataagcatgctatatatggcaaaactcggaccagatgttataaccgaggaaattaatattgacgacgaggatagtaccaccgacaccgatggcgctgcggagacttgtgtatctgtgcaatgtcagaaacagatcaaggagctgagagatcagatcgtttccgtgcaggaggagaagaagatcctagctatcgagctggaaaatcttaaaagtaagctggtggaagtcatcgaagaagtgaacaaggtgaagcaggagaagacagtactgaattcagaggtgctcgaacagagaaaagtccttgagaaatgtaatagggtgtccatgctggcggtcgaagagtacgaagaaatgcaggttaacttagaactcgaaaaggacctcaggaaaaaggccgagtcattcgcccaggaaatgtttatcgaacaaaacaagctcaagaggcaatcccacctcctgctgcaatcctcgattcctgatcagcaactcctgaaagccctcgacgaaaacgcaaaactgactcagcagctggaagaagaaagaatccaacatcaacagaaggtcaaagagctagaagagcaactcgaaaacgaaactttgcataaagaaatccacaatttaaagcaacagttggagttactggaggaggacaaaaaggaactggaactcaagtaccagaactctgaagaaaaggcccggaaccttaagcactcagttgacgagctacagaaacgcgtaaatcagtctgagaactctgtaccaccgccgcccccacctccacctcccttgcccccccctccccctaacccgatcagatcgcttatgtctatgattagaaagcgctctcatccatctggatcaggcgcaaagaaagaaaaggctacacaacctgagacaacagaagaggtgaccgatcttaaaaggcaggcggtcgaggagatgatggaccggataaagaagggagtccatctgcgtcctgtcaaccagacagcacgcccgaaaacgaagccggaaagttcaaaggggtgtgaatctgcggttgatgagctcaagggcattctaggtacacttaataaatctacatcttccagatccttgaagagtttggatccggaaaattccgaaacagagttggaacgcatcctgcggagaaggaaggtcacagccgaggcagattcctcttctcccacggggatcctagcgacgtcggaatctaagtccatgcccgttctcggctccgtatcttctgttacaaagacagccctgaacaagaagacactagaggccgagttcaattcaccgtcccctccaaccccagagcccggagagggcccaaggaagctcgagggctgcacctcgagcaaggttactttccaacctccctcctccataggatgccggaagaagtacatcgatggggagaagcaagccgagcccgtcgtggtgctggatcctgtcagtacacacgaacctcagacgaaggaccaggttgccgagaaagatccaacccagcacaaggaagatgaaggcgaaatacaacctgaaaataaggaagactccatcgagaacgtccgcgaaacagatagttctaactgctag

SEQ ID NO: 23939 - DNA, 1701 bp, Artificial Sequence
  Description of Artificial Sequence: Synthetic coding sequence
atggacctgcaccgggccgccttcaagatggagaacagcagctacctccctaatcccctcgcatcacctgccttgatggtgcttgcaagtactgccgaagccagccgtgacgcctccattccttgtcagcagcccaggcctttcggcgtgcccgtttctgtggacaaagatgtgcacattccctttaccaacgggtcgtacacctttgcatccatgtaccatcgccagggaggagtgcccgggacattcgccaatcgcgattttccgccatccctgttgcacctacacccccagtttgcaccccccaacctagattgtacaccaatttctatgctgaaccattccggcgtgggcgctttccgtccatttgcctctactgaagatagagagagctaccagtcggccttcacgcccgccaagaggcttaaaaattgccacgacaccgagtcgccccacctgcgcttttccgatgcagatggaaaagagtatgatttcggaactcagctccccagttcctcccctggcagcttgaaagttgatgataccggtaaaaagatcttcgcagtcagcggtcttatctctgaccgagaagcatccagttccccagaagatcgtaacgacagatgtaaaaagaaggctgcagccctgttcgattcgcaggcccccatatgtccaatttgccaggttttattacgcccctcagaactgcaggaacacatggagcaagagctcgaacagctggctcagctcccatcgtccaaaaactcgctgctgaaggacgcaatggctccagggacaccaaaaagcttgctcctcagcgcgtccatcaaaagagaaggtgagagcccaaccgccagtcctcactctagtgcgaccgacgacctgcatcatagtgaccggtatcagaccttcctcagagttagagccaatcgacagactcggctaaacgctagaattgggaaaatgaagagaagaaagcaggatgagggtcagagggagggcagttgcatggccgaagacgacgctgtggacatcgagcatgaaaataataatagattcgaggagtatgaatggtgtgggcagaagcggatccgtgctacaacgttgctggaaggtgggttcagaggcagtggtttcatcatgtgcagcgggaaggagaatcccgacagcgacgctgaccttgacgtggacggcgacgacactctggagtacggaaaaccccagtataccgaagccgacgtcattccctgcaccggagaagagcccggcgaggctaaggagagggaggcacttcgtggagccgtattgaacggcgggcctccaagcactcgtatcacgcccgagttttccaagtgggcttcagacgagatgccatcaaccagtaatggcgagtcatcgaagcaggaagctatgcagaagacttgtaaaaatagcgatatcgagaaaattaccgaggactcagccgtgaccactttcgaggccctgaaggcccgcgtgcgcgagttggagagacaactgtcaaggggagacaggtacaagtgcttaatatgtatggactcatactccatgccgctcacctcaattcagtgctggcacgtgcactgcgaagagtgttggctcaggacactgggggcgaagaagctttgccctcagtgtaacaccattacagctcccggtgacctcaggcggatttatttgtag

SEQ ID NO: 23940 - DNA, 1071 bp, Artificial Sequence
  Description of Artificial Sequence: Synthetic coding sequence
atgctgagcgccatcaccaacgtggtgcagaacaccggcaagagcgtgttgaccggcggactggacgcgctggagtttattggaaaaaaaacaatgaatgttctggcagaatccgatccaggtttcaaaagaaccaagacgcttatggagaggactgttagtttatcccagatgctgcgagaagctaaggaaaaggagaaacagcggttggcccagcagctgacaatggagaggaccgcccattacggcatgctgttcgatgagtaccaggggctttcccatctggaggctctcgagatccttagtaatgagtccgagtcgaaggtgcaatcattcctcgccagtttggatggggaaaaacttgagctcctgaaaaacgatttgatttctattaaggatattttcgcggctaaagagctggaaaacgaggagaatcaggaggaacagggcctagaagagaaaggcgaggaatttgcccggatgttaaccgaattactgttcgaacttcacgttgccgcgacacccgacaagctgaataaagccatgaagcgcgcccatgactgggtggaagaggaccagacggtcgtgtctgtggatgttgccaaagtttcagaggaggaaactaagaaggaggagaaggaggaaaagagccaggatccgcaagaagataagaaggaggagaaaaaaactaaaaccattgaagaggtttacatgtcaagcattgaatctttagcggaggtcactgccaggtgcatagaacagttacacaaggtggccgaactcattctgcacggacaggaggaggagaagccggcccaggatcaggccaaagttttgattaaacttaccacagctatgtgcaatgaagtagcgagcctgagcaagaagttcaccaactcactcaccacagtgggctcgaacaagaaagctgaagttcttaatcccatgatcagtagcgtgttgttagaaggatgtaattctaccacgtacatacaggacgccttccaattactgctgcctgtcttgcaggtatcacatattcaaacaagctgcttgaaggcccagccctag

SEQ ID NO: 23941 - DNA, 519 bp, Artificial Sequence
  Description of Artificial Sequence: Synthetic coding sequence
atgagctacaactgctgcagcggcaacttcagcagccggagctgcggtggctacctgcattaccctgcatcgagttgcggtttctcttaccccagcaatcaggtctactcaacggacttgtgctccccttctacatgtcagctgggcagtagcctgtacaggggttgccagcagacatgctgggaaccaaccagctgtcagaccagctacgtggagagcagtccatgtcagacctcttgttatcgccctcggacatctcttctctgcagcccctgccaaaccacatattccggctctctgggctttggaagcagtagctgtcgcagtctcggctatgggagcagatcgtgctatagcgttggatgtggctcttccgggttccgatcgttgggctacggtgggtgcggttttcctagcttggggtacggagtcggattctgccgccccacctatctggcctcacgcagctgccagtcaagctgctaccgacccacatgcgggagtggcttttactactag

SEQ ID NO: 23942 - DNA, 2253 bp, Artificial Sequence
  Description of Artificial Sequence: Synthetic coding sequence
atggaggacctgttcgagaccttccaggacgagatgggcttcagcaacatggaagacgacggcccagaggaagaagagagggtagctgagccacaggctaattttaacaccccgcaggccctcaggtttgaggagttactggcaaaccttttaaatgagcagcaccaaattgctaaggagttatttgaacagctgaagatgaagaagccctccgccaaacagcaaaaagaagtcgagaaggtgaaaccacaatgtaaggaggtccaccagacactcatccttgaccccgcacagcggaaacgcctgcagcagcagatgcaacagcacgtccagttgcttacccagatccacttgctagctacctgtaatcctaacctgaatcctgaggcctcctctactcgcatctgtctgaaagagttagggactttcgctcaaagctccatcgcattacaccaccagtataatcctaagtttcagaccctgtttcaaccttgtaatctgatgggcgcgatgcagctaatcgaggactttagcactcacgtgtctatcgactgcagtcctcacaaaacagtcaagaagactgccaatgaatttccttgtctgcccaaacaggttgcgtggattttggcaacatcaaaagtgtttatgtaccctgagctcttgcctgtgtgctcattgaaagcaaagaatccccaagacaagatcctcttcacaaaggccgaagacaatctgctggccttaggtttgaagcatttcgaaggcacagaatttcttaatcccctgatcagcaagtacctgctcacgtgtaagacagccaggcagctgacagttcgaatcaagaatctaaatatgaatcgggcccccgacaacatcattaagttttacaagaaaactaagcagttaccggtgctgggaaagtgttgtgaagaaattcagccgcaccaatggaagcctccaattgagcgggaggaacatcggttgcccttttggctaaaggcctcccttccttccattcaagaagaactgagacatatggccgatggcgcgcgggaagttgggaatatgactgggactacagagatcaactccgaccagggcctggaaaaggataatagtgagctgggcagtgaaacccgttatcccttattgttgcccaagggagtcgtgctcaaactgaagccggtcgcagatcgattcccgaaaaaggcatggcggcagaaacgaagcagtgttctcaagcccttactcatccagccaagcccctccttgcaacccagctttaatcccgggaagactcccgctcagtccacgcatagtgaagcccccccgagcaagatggtgcttcgtattccgcaccctattcagcccgccaccgtcctacagacagtgccaggcgtgccccctctaggcgtttcggggggggagagctttgagtccccagctgctctccccgccatgccccccgaggcccgtacaagctttcctctaagcgagtctcagacccttctttcttcagctcctgtccccaaggttatgatgccttctcctgccagcagtatgttcaggaagccctatgttaggcgccgacccagcaagagaagaggggctcgtgcgttcaggtgtattaagcctgcccccgtcattcacccagcctctgtcatatttaccgtgccagctactactgtgaagattgtatcccttgggggtggatgtaacatgatccaacctgtcaacgccgccgtagcacaaagccctcaaacaatccctatcgccacactgttagtgaaccctacgtcatttccctgcccattgaaccaaccgctcgttgcaagttcagtgtcccctttaatagtgagcggaaactctgtgaacctgcctatcccttccacaccagaagacaaagctcatatgaatgttgacattgcatgcgccgtggccgatggggaaaatgccttccagggcctggagccgaagttggagcctcaggaactgtcaccgctttctgctaccgtgttcccaaaggtcgagcatagcccaggaccccccccagtcgacaagcagtgccaggagggactcagcgaaaacagcgcttaccgatggacggtcgttaagacagaagagggaaggcaggccctggagcctctgcctcaaggcattcaggagagcctcaacaactcgagccctggtgaccttgaggaggtcgtaaaaatggaacctgaggatgccactgaagagattagcggcttcctatag

SEQ ID NO: 23943 - DNA, 888 bp, Artificial Sequence
  Description of Artificial Sequence: Synthetic coding sequence
atggagctgatccaggacaccagccggccccccctggagtacgtgaaaggagttccccttattaagtatttcgccgaagcccttggacctctccagtcctttcaagcacgaccagacgaccttctgatcaatacttacccgaagagcggcactacctgggtttcccagattttggatatgatttatcagggcggtgatctggagaaatgtaaccgcgccccgatttatgtaagggtgcctttcctcgaggtgaacgaccccggcgagccttctgggctcgaaacactcaaggataccccaccaccccgattgataaaatcccatttgccacttgctctacttccgcaaactcttcttgatcagaaagtcaaggtggtgtatgtggctcgcaatcctaaagacgtggctgtcagctattaccactttcaccgcatggagaaggcacaccctgagcccgggacatgggatagttttctggaaaaatttatggcgggtgaggtgagctatggtagttggtatcagcacgtccaggagtggtgggaactaagtcgaacccatcctgttctttatctcttttacgaggacatgaaagagaaccccaagcgagagatccagaaaattctcgagtttgtggggcgcagtctgcctgaagaaactatggattttatggtccaacacacctccttcaaagaaatgaagaagaatccaatgacaaactatacaacagtcccccaagagctaatggaccactcaatcagccccttcatgagaaagggaatggccggtgactggaaaacgaccttcaccgtggcacaaaacgagcggtttgatgcagactacgcagagaaaatggcgggctgctctctgtcttttaggtcagaactgtag

SEQ ID NO: 23944 - DNA, 1476 bp, Artificial Sequence
  Description of Artificial Sequence: Synthetic coding sequence
atggacaccaagggctgcaccaccaccaacagccccagcaccccctgccagaattgcagtagaatcacgaacgtgtctacaatttccagcaacaatggttgccaccctgggggactcactgtcaacaactgccaacctgccggacacgttctgcgcatcccctgggaccagggttgccagcctactccgaggttttgtcgaaaacccatttaccttatgaataactttaatgccaggttcagcctagatgactgtagttggtacggggaggggatcaactccaacgaaaaggagactatgcaaattctaaacgagagactggctaattatcttcagaaggtgcggatgttggagcgcgaaaacgctgagctggagtccaaaattcaggaggagtccaataaagaacttcccgtgttatgcccagactatttgtcctactacactacaatcgaggaactccagcagaaaatcctatgtaccaaggccgagaattcgcgacttgtgtctcagatcgacaacacaaaacttaccgccgacgatctgcgggccaagtatgaggctgaggtaagcctgcgccagctggtcgaaagtgatgccaatggattgaaacagatcctgaacgtgctgaccctggggaaggccgaccttgaggcacaggtccagtccctgaaggaggaactgctgtgtctaaaaaataatcataaagaagagattaattctctccaatgtcagctgggggagcgtctggatatcgaggttacagcagctccttctgctgatctcaatcaagtgctgcaagagatgaggtgtcaatacgaacccattatggagacaaacaggaaggacgtggagcagtggttcaatacacagattgaagagttgaaccagcaagtggtcacctcgagtcagcaacagcagtgttgtcagaaagagatcattgagctgcgaagatccgtaaacaccctcgaagtagagctgcaggcccagcatcgtatgcgtgactcgcaagaatgcatcctcacagaaaccgaagctcggtacacagccctgctgacccagatccagtctctgattgataacttagaggcgcagctagctgaaatccgctgtgcgctggagcgccagaaccaagagtatgagatccttctggacgttaagagccgcctggagtgcgaaatcaccacgtaccgatcactacttgagtctagtgatggcaagaggccttgctatcctagggcaactaaatgtgagccttcaccatggacatcttgtaaatccggggccatcgaaagtacagcccccgcttgtacctctagttccccctgtagcctcaaagagcattgcagtgcatgcggacccttgtcccgtatcctcgtcaagatctgcacgatcacgaaggagatcaaggacggcaaggtaatttcatcctacgagcatgtccagccatgctttattattcggcccgcaaaggtctag

SEQ ID NO: 23945 - DNA, 1287 bp, Artificial Sequence
  Description of Artificial Sequence: Synthetic coding sequence
atgaagcggggcggccgggacagcgaccggaacagcagcgaggaggggacagctgagaaatccaagaagttgcgaacaacaaatgagcactcacagacctgtgactgggggaacttgcttcaagatattattctccaggtgtttaagtatttgccactactggaccgggcccatgcttcgcaagtgtgccggaactggaatcaggtctttcatatgccagatctgtggcgatgctttgagtttgagcttaaccagcctgcaacttcttatctgaaagcgacccacccagagctgattaagcagatcatcaagcggcactccaatcacctgcagtacgtttcctttaaggtggacagctctaaggagtccgctgaggcggcttgcgacatcttatcacagctggtcaattgtagtcttaagaccctgggcctgatcagcactgctagacccagtttcatggaccttccgaagtcacattttatctccgctctgactgtagtcttcgtcaattctaaaagcctgtcgagcctcaaaattgatgacacccctgtggatgatccatcccttaaggttctcgttgctaacaatagcgacactcttaagctgctgaaaatgagctcatgccctcatgtgagtccagcgggaatcctgtgcgtggccgaccagtgccacggactgagggagctcgctctgaactaccacctcttgtccgatgaactcctcctggccctttcctccgaaaagcacgtgagactcgaacacctgagaatagatgtcgtctccgagaatcccggccaaacacattttcacacgattcagaaatcctcctgggatgcctttattcggcattcacctaaggtcaacctggtgatgtattttttcctctacgaagaggagtttgaccctttttttcgttatgaaatcccagctacacatctgtactttggccggtctgtttccaaagacgttctgggccgggtaggaatgacgtgtcctcggttagtagaactcgtcgtgtgcgccaacggacttcgcccgctggacgaggaactgatcaggatagcagagagatgtaaaaacctgtcagcaatcggactcggggaatgcgaggtgagctgttccgcctttgtggagtttgtaaaaatgtgcggagggaggctctcccagctgtctatcatggaagaagtgcttataccagatcagaagtattccctcgaacagattcattgggaggtgagcaagcatctgggtagagtttggtttcccgacatgatgcccacgtggtag

SEQ ID NO: 23946 - DNA, 3603 bp, Artificial Sequence
  Description of Artificial Sequence: Synthetic coding sequence
atgaacaccgacagcggcggctgcgcccggaagcgggccgccatgtcggttacccttacttcggttaaaagagtgcagtcctcccctaacctgctcgcggctggtcgtgacagtcagagtcctgacagcgcttggcggtcctataatgacggtaaccaggagaccctgaatggcgatgcgacatattccagtttagctgcaaaagggtttcggagcgtgcggcccaatttacaggacaagagatcccccactcagagtcagattacagtgaatggcaactccggcggtgctgtgtctcctatgagctactatcagcggcccttctcacccagcgcctacagcctacctgcttctcttaacagctccattgtcatgcagcatgggacctctcttgattccactgacacgtatccacaacatgctcaatctctagacgggactacttccagttctattccactttaccggtcctctgaagaagaaaagcgcgtgacagtgatcaaagccccacactaccccggcatcggccccgtggacgagtctggtattcccaccgcaattcgcacaacggtcgaccgccctaaagactggtataagaccatgttcaaacagatccacatggtacataaacccgatgacgataccgatatgtataacacgccctacacttataacgccggcctatataaccccccgtactcagctcagtcccaccctgcagcaaagacacagacatatcggccgctgtccaagtcccatagtgataacagcccaaacgcttttaaggacgcttccagtccagttcctcccccccacgtcccccctcccgtgcccccgttgaggcctcgcgacaggagcagtactgaaaagcatgactgggatcctcccgatagaaaggtggacaccaggaaatttcggtccgagccaagatctatcttcgaatacgagcccggcaagtcctctatactacagcacgagagacctgcgagcctctatcagagctctattgacaggagtctggaacggccgatgtcttcagccagtatggccagcgactttagaaaacgcaggaagagcgagcctgccgtcggccctcctcgaggtctaggcgatcagtctgcctctcggacctcacccgggcgcgtcgacctacccggaagcagtacaacactcaccaagtcattcacctcctcctcacctagtagtccctctagggccaaagggggggacgattcaaagatttgccccagcctttgtagctacagtggcctgaatggcaatccctccagcgagttggattactgcagtacttatcgacaacatcttgacgtgccccgggatagccctcgcgcaatatccttcaaaaacggctggcagatggcgaggcagaacgccgagatttggtcttccacagaggaaacagtttcccccaagattaagtcccgctcatgtgacgatttgctgaacgacgattgcgatagttttcctgatccaaaggtgaagagcgagtccatgggctctcttctctgcgaagaagatagcaaagaatcatgccccatggcatggggaagcccctacgtcccagaggtgcgatcgaatggcaggtcacggatccggcataggtcagcaagaaacgctccgggatttctgaagatgtataaaaagatgcataggattaataggaaagacctgatgaattctgaggtcatatgtagtgtgaagagcagaattctacagtacgagtctgagcaacagcacaaagatctcttaagggcctggtcgcagtgttcaacagaagaggttccacgagatatggtgccaacccggatcagcgagtttgaaaaactgattcagaagagcaaatccatgccgaatctgggagacgacatgctctcccccgtgacccttgaacctccccagaatggtctctgcccgaagcgtcggttttcaatcgaatatctgctggaagaagaaaatcagtctggacctcccgctcgcgggcgccgaggttgccaaagtaatgccctggtgcccattcacatcgaggtcaccagtgatgagcagccgcgcgcacacgttgagttctcagactctgatcaagacggggttgtgtccgatcactccgactatatacatctagagggttctagcttctgttctgagtctgactttgaccatttttcttttacgtcatctgagtcattctacggttcgtcgcatcaccaccaccaccaccaccaccatcaccaccggcacctgatatcctcgtgtaagggccgctgtccagccagttacactcgatttacaactatgctgaagcacgaacgcgcccggcacgagaatactgaggaacccaggcgccaggaaatggatccagggctcagcaagctggcatttctggtatctcccgtaccatttcgcaggaaaaagaactcagcaccaaagaagcagacagagaaagcgaagtgtaaggctagtgtctttgaggcgcttgattcagctctcaaagatatttgtgaccagatcaaggccgagaaaaagagaggctccttgcccgataacagtattctgcaccgcctcatctcggagctgcttcccgatgtgccagaaagaaattcaagtttaagggcgctgagacgatcacctctccaccagcccctgcacccccttccgcctgacggtgccatacactgcccgccctatcagaatgactgcgggaggatgccaaggtctgccagttttcaagatgtggataccgcaaattccagttgtcaccatcaggataggggaggtgctctgcaagacagagagtcccctaggtcttactcgtcaaccctgacggacatgggcagaagcgccccccgtgagcgaagaggcacccccgaaaaggaaaagctgcctgctaaggctgtgtatgatttcaaagcccagacatcgaaggagctaagctttaaaaagggagacacagtgtacatcctgcgcaagatagatcaaaattggtatgaaggcgaacatcacggccgggtcggcattttcccaatttcctatgtggagaagcttacgccccccgagaaggcccagccagctaggccaccgcccccggcgcaaccgggagagattggggaggcaatagccaagtacaattttaacgctgacaccaatgtggaattatctctgcgcaagggcgacagggtgatcttgttaaagcgtgtcgatcaaaattggtacgagggcaaaattccgggcaccaacaggcagggcatctttcctgtaagttacgtggaggtcgttaaaaagaatacaaaaggagctgaagattacccagacccccctattccacacagttattcctcagataggattcattcattgtcctccaataagccccagcgcccggttttcactcacgagaatatacaaggcggaggagaaccattccaagctttgtacaactatacacccagaaacgaggacgagctggagttgcgcgagtcagacgtcatcgacgtaatggaaaaatgcgacgacggttggtttgtgggcacttctcgcagaacaaaattcttcggaactttccccggaaactacgtcaaaagactgtag

SEQ ID NO: 23947 - DNA, 1470 bp, Artificial Sequence
  Description of Artificial Sequence: Synthetic coding sequence
atggaggacagcgccagcgccagcctgagcagcgccgccgccaccggtactagtacttcgaccccagctgccccaactgctaggaagcagctggataaagaacaggtgagaaaggccgttgatgctctccttactcattgtaaatcccgcaaaaacaattacggacttctgctgaatgaaaatgaatcactgttcctcatggtagtactatggaagattccaagcaaagaattgcgcgtgcgcctgactcttccgcactcaattagaagtgattcagaggatatatgcctgtttaccaaagacgaacctaattcaacacccgagaagactgaacagttctaccgcaagctcctcaacaagcacgggatcaagaccgtgtcacagattatttctctgcaaaccctaaaaaaggaatataaaagctacgaggcgaagctgaggctactctcctcttttgacttctttctgacagacgcccgaatccgaagactgttgccatcactcataggtcgccatttttaccagaggaagaaggtgcccgtcagtgtcaatctgctgtcgaagaacctgtcacgagagattaatgactgcattggcgggaccgttctgaacatcagcaaaagcggcagctgctccgcaattaggatcgggcacgttggaatgcaaattgagcatattattgaaaatatcgtggccgtgactaaaggtctcagcgagaagcttccagaatgggaatccgtcaaattgctattcgttaagaccgagaagagtgcagcactgccaattttctcttcttttgtatcgaattgggacgaagccactaaacgttccctgctcaacaagaaaaagaaagaagcaagaagaaaaagacgcgagcggaacttcgagaaacaaaaggagcggaagaaaaaacggcaacaggccaggaaaaccgcttctgtgctctctaaggatgacgtggctccagaatcgggcgacacaacagtgaaaaaaccagagagcaagaaggagcagacacccgaacatggaaaaaaaaagagaggtagaggcaaagctcaggtgaaagctaccaacgagtcagaggacgaaattccccaactggtgcccattgggaagaagacccctgcaaatgaaaaagtggagatccagaagcacgccacgggaaagaagtcaccagccaaaagtcccaaccctagtaccccaaggggcaaaaagcgaaaggcactgcccgccagtgagacccctaaggccgcagaatcagagacgcctggaaagtcccctgaaaaaaagccgaaaatcaaggaagaggctgtgaaggagaaatcaccaagcctgggaaaaaaagatgcccggcaaactcctaaaaaaccagaagccaagttcttcactacgccttcaaagtctgtgaggaaagctagtcacacaccaaaaaaatggcccaagaagccaaaagttcctcagagcacgtag

SEQ ID NO: 23948 - DNA, 3171 bp, Artificial Sequence
  Description of Artificial Sequence: Synthetic coding sequence
atggccggcgccctgcggcggggccgggccctgggcagccggccctccggcccgacagtgtcgtcacgccggagcccacaatgccctgtcgcacaggagggactgggggcacgttccaggccacgagttgccccccgaagcctggcccgctgtggcccttcctcacgcctgatggggtggaaaccttccgaagcccggggccaatcccagagctttcaggcctcaggtctccaaccgcggagcctgaaggccgcacggagagctaccggcagacctgatcgatcacgtgcagccccccctaacatggaccccgacccccaggctggggtccaggttggaatgcgagttgtgcgaggcgtggattggaaatggggtcagcaggatggtggtgagggaggagtggggaccgtcgtggagcttgggagacacggatccccatctacacctgaccgcacggtcgtagtgcagtgggatcagggcacccggaccaactaccgtgcaggctaccagggagcccacgatcttctgctgtatgacaacgctcagattggggtgagacaccctaatatcatctgtgattgctgcaagaaacatggcctgcgcggcatgaggtggaaatgtcgggtgtgcctggattacgacttgtgcactcagtgctacatgcacaacaagcacgagctggcccacgcatttgatcgttacgaaactgcccactctagaccagtgaccttgagtcctcgacagggcctgccacgcattccactacgggggatctttcagggggctaaggtcgtccgcgggcctgactgggaatggggcagccaggatggcggcgaaggaaaaccaggccgggttgtcgacattcgtggctgggacgtcgagacgggtcgatctgtggcatctgtgacatgggcagacggaactacaaatgtgtatagagttggtcacaaaggtaaggttgacttgaaatgtgtgggtgaggccgccggcggcttttactacaaagaccacctgcctcgcctggggaagcccgccgagctacagcggcgcgtgtcagccgactcccagccatttcaacacggagataaggtaaaatgtctgttggataccgacgtccttcgggagatgcaagaggggcacggcggatggaatccccgtatggcagaatttattggtcagacgggcacagtacatcggatcaccgacagaggggacgtcagggtccagttcaatcatgagaccaggtggacatttcaccccggagcccttacaaaacaccacagtttctgggtgggggatgtggtgcgagtaatcggagacctcgacaccgtgaagaggctccaagctggacacggcgaatggacagatgacatggccccagccctgggccgtgttggaaaagtggtgaaggtcttcggtgatggtaatttacgggtagcagtggctggccagaggtggactttttcacctagctgccttgtcgcctaccggccggaagaggatgccaaccttgacgtcgctgaaagggccagagagaacaaaagctccctcagcgtcgctttggacaaattaagagcacagaagtctgatccagagcacccaggtcgcctcgtcgtcgaggtggcactcggaaacgcagcccgcgcactggatttgctccgcagaagaccggagcaggtcgataccaagaatcaaggtcgaaccgcactccaggtcgctgcttatcttggccaggtcgagctaatcagactcctcctccaggcccgcgccggagtggaccttcccgacgatgagggaaataccgccctgcactacgcagctctggggaaccagccagaagctactagagtactgctgtcagccggctgtcgtgccgacgctatcaactcaactcaatcgaccgctttacacgtggctgtgcagcggggttttctcgaggtggtgagagccctctgcgaacgcggctgtgatgtgaacctcccagatgctcactccgacacccctttgcactctgctatatcagctggcaccggcgcctcgggcatcgtggaggtgcttaccgaagtcccaaatatcgacgtgacggccaccaacagccaggggttcactctgctccatcacgcgagtttgaaaggccatgcactggccgtcagaaaaattctggcaagagcgaggcagctagtcgatgccaagaaggaggacggatttacagccctccacctggctgctctcaataaccacagagaagtagcacagattctgatcagagaaggacgatgtgatgtgaatgtgcgaaaccggaagctgcagtcccctctccatctcgccgtccagcaggctcatgttgggctggttcctcttcttgtcgacgccgggtgcagcgtgaacgcagaggatgaggagggagatacggctctgcatgttgcccttcagagacatcagctgctccctctggttgcagatggagctggcggggacccagggccgctgcaactgctttcgcgtctccaggccagcggtctgccggggtctgcagaacttactgtgggagctgctgtagcttgttttttagctcttgagggagccgacgtgtcctacaccaatcaccgggggcgttcccccttggatctggcagctgaaggacgcgttctgaaggcgttacaaggctgcgcccagagattccgagagaggcaggcaggggggggcgccgcaccagggccccgacaaacccttggtaccccgaataccgtgacaaatctccacgttggtgccgcccccggccctgaagcggccgagtgtttggtgtgtagcgagctggctctcttggtcctcttttccccttgtcagcaccgcactgtgtgcgaggagtgcgcgcgtcgcatgaagaagtgcattagatgccaagtcgttgtgagtaagaagctgcgaccagacggctccgaagtggcgtctgctgcgcctgcacctggaccaccgcggcagttggtggaagaactccagagccggtaccggcagatggaggagcgcataacctgtccgatttgtatagattcgcatatcaggttggtatttcagtgtgggcacggcgcctgcgcaccctgtggctccgcactgtctgcatgccctatctgtaggcagccgatccgagatagaatacagatatttgtgtag

SEQ ID NO: 23949 - DNA, 858 bp, Artificial Sequence
  Description of Artificial Sequence: Synthetic coding sequence
atgagcgaggccggcgaggagcagcccatggagaccaccggcgccaccgaaaatggccacgaagccgtaccagagggcgaaagccccgcgggagctggaaccggtgctgccgcaggagctgggggcgccacagctgctcctccctcggggaaccaaaacggcgcagagggggatcagataaacgcctcaaaaaacgaggaagacgctggcaaaatgttcgtcgggggtctgagctgggacacatccaaaaaagacctaaaggactatttcacgaagtttggcgaagtggtggactgtacgatcaagatggacccaaatacgggacgcagccgcgggttcggatttattctgtttaaggatgcagcatccgtcgagaaagtgttagaccagaaggagcatcgcctggacggccgggtcatcgacccaaagaaagccatggcaatgaagaaggatcctgtgaaaaagatctttgtgggcggactcaacccagaggctactgaagagaagatcagagaatatttcggcgaattcggagagatagaggcgattgagttgcccatggatcctaagctcaacaaacgaagaggtttcgtgtttattacatttaaggaagaggagcctgtaaagaaagtgctcgagaagaagttccacactgtgtcaggatctaagtgcgaaatcaaagtcgctcagcccaaggaggtctaccagcagcaacaatacggctccggtgggaggggaaatcggaataggggtaatcggggatccggcgggggtggaggaggtggtggccaggggtcaacaaattacggcaaatcgcagcgcagaggcggccaccagaacaattataaaccctactag

SEQ ID NO: 23950 - DNA, 1212 bp, Artificial Sequence
  Description of Artificial Sequence: Synthetic coding sequence
atgagcggcagcgacggcggcctggaggaggagcccgagctgagcatcaccctgacactgcggatgcttatgcatgggaaagaggtagggagtatcattggcaaaaaaggggaaaccgttaagcgaattcgagaacagtccagcgctcggataactattagcgaggggagctgtccagagcgaattactactatcaccggatccactgccgccgtcttccacgctgtgtccatgatcgcctttaaattagatgaagacttgtgtgctgctcctgcaaatgggggaaatgtgtctaggccccctgtgactctccggctagtgattccagcctcccaatgtggatctttgatcggcaaagccggaaccaagataaaagaaatacgtgaaacgacgggcgcccaggtccaagtggctggcgacctgctgccgaacagcacggagcgggcggtcaccgtatctggcgtgcctgacgctattatcttgtgtgtcaggcaaatttgcgcagttatcctcgagtcgcctcctaagggcgccacaatcccgtaccatccgtcgttaagcttaggtaccgttctgttatccgcgaatcagggcttttcagtacaaggccaatatggcgcagttacccccgccgaagtaacgaagctccaacagctgagttctcatgcagtcccctttgccaccccttctgtggtgcctggcctcgatcccggcacccagacatcctctcaggagttcctcgtacctaacgacttgataggatgtgtcattggacgccaaggttcaaaaattagcgaaataaggcagatgagtggtgcccatattaagatcgggaatcaggcagaaggggctggagagagacatgtcacgatcactgggtcccctgtgagcatcgccctcgctcagtatcttataactgcttgtctggagacagccaagtctacctctgggggaacaccttcctccgctcctgcagacctccccgctccgttcagtccaccactaacagccctcccgacagcgccacccggactgcttggcactccatatgccatcagtctgagtaactttatcggcctcaagccgatgccttttctagccctcccccccgcttcccctggacctccacctggactggctgcctataccgccaaaatggccgcagctaatggaagcaaaaaggcggaacggcagaagtttagtccctattag

SEQ ID NO: 23951 - DNA, 1347 bp, Artificial Sequence
  Description of Artificial Sequence: Synthetic coding sequence
atggccaccgacagctgggccctggccgtggacgagcaggaggccgccgcagagtcactgtcaaacctgcatcttaaagaggagaaaatcaagcccgacaccaatggagcggttgtcaagacaaatgccaacgcagagaaaactgatgaggaggaaaaagaggatcgcgccgcccagtcactcctgaataagttgattcgtagtaatctcgtggacaacactaatcaggtggaagtactccaacgcgaccctaatagcccactgtatagcgtgaaatcgtttgaggagctgcggctgccacagaacctgatcgcgcagagccagagcggcacaggcaagaccgctgctttcgtgctggccatgctgagccaggtggagcccgcgaacaagtacccacagtgcctgtgtctttcccccacttatgagttagccctgcagaccggcaaggttattgagcagatgggcaagttttacccggagctgaagctggcgtatgctgtcaggggaaacaaacttgagcgcggccagaaaatctcggaacaaatcgtaattggcacacctggaaccgtgcttgactggtgctcaaagcttaagtttattgatcctaagaaaataaaggtatttgtgctggacgaagccgatgttatgatcgctacccaggggcaccaggaccagagtatccggattcagcgaatgctaccacggaattgccagatgctactgttctctgccacattcgaagattctgtctggaaattcgcacaaaaggtggtgcctgaccccaacgtgatcaagctgaaaagggaggaggagactctggatactatcaaacaatactatgtcttatgctcttctagggatgaaaaatttcaggccctctgcaatctgtacggtgccatcactattgcccaggcaatgattttctgtcataccaggaaaaccgcctcctggctggcagcagaactgtccaaagaaggacatcaagtagctctgttgtccggagagatgatggtggaacagagggccgcagttattgaacgatttagagagggcaaggagaaagtgctggtaacaactaatgtctgtgcaaggggcatagatgttgaacaggtctcggtagtcatcaatttcgaccttcccgtcgacaaggacggtaaccccgataatgagacctacctgcaccggatcggcagaaccggacggtttgggaagcgggggctggccgtaaatatggtggattccaagcactcaatgaatattctgaaccgcattcaagagcattttaacaagaagattgagaggctagatactgacgatctcgatgaaatcgaaaaaattgccaactag

SEQ ID NO: 23952 - DNA, 1248 bp, Artificial Sequence
  Description of Artificial Sequence: Synthetic coding sequence
atgatgctgggccccgagggcggcgagggcttcgtggtgaagctgagggggttaccatggtcgtgcagtgttgaggacgtacagaacttcttgtctgactgtacaatccatgatggggcagcaggcgtccactttatttatactcgcgaaggacgccagtccggagaagcctttgtggaactcggatccgaggatgatgtgaagatggcacttaagaaggatcgcgaatcgatgggccataggtatatcgaggtcttcaagagtcaccggactgagatggactgggtactgaaacatagcggccctaatagcgccgattcagcaaatgatgggtttgtgcgattgagaggcctgccttttggctgtacgaaggaggaaattgtgcagttttttagtggtcttgagatcgtgccaaacggcatcacactgcccgtggacccagaagggaaaatcacaggcgaggctttcgtacagttcgccagccaggagctggcagaaaaagcacttggcaaacacaaggagcggatagggcataggtatattgaagttttcaagtcctctcaggaggaggtccgcagctatagcgatcctccattaaagtttatgagcgtacagaggcctgggccatatgaccgccccggtaccgcgagaagatatattggtattgtgaagcaggctggcttagaacgcatgagacccggggcgtactccactggctacggagggtacgaagagtatagcggcctcagcgatggttatgggttcaccaccgacctctttggaagggacttgtcatattgcctctcagggatgtacgatcacaggtatggggacagtgagttcaccgtgcagtcaaccacaggccactgtgtgcatatgcgcggcctcccctacaaggcaactgaaaatgatatttacaatttttttagccctctcaaccctgtgcgcgtccacatcgagattggacctgacgggcgagtgacaggcgaggcagacgtagaattcgcaacacacgaggaagccgtggccgctatgagcaaagatcgagctaatatgcaacaccgctacatagagctgtttttgaatagcactacaggagcgtctaatggagcttactcctctcaggtgatgcagggaatgggtgtgtctgcagcccaggcgacttactctgggttggaatcccagagcgtgagtggatgctacggagccggatattccggtcaaaattccatgggcggctacgattag

SEQ ID NO: 23953 - DNA, 1026 bp, Artificial Sequence
  Description of Artificial Sequence: Synthetic coding sequence
atggcccaggagagccccaagaacagcgccgccgagatccccgtgacaagcaatggagaggttgatgattcaagggaacattcttttaaccgcgatctcaaacatagtctcccgtccgggctgggattatctgagactcaaataacttcccatggattcgataatacaaaggagggggtcatcgaggccggagcctttcagggcgggcagaggacccagacgaaatccggtcccgtgattcttgcggacgagattaaaaatccggccatggagaaactggagctggttagaaaatggtctcttaacacctataaatgcacgagacagataatttcggagaaattaggcaggggatccagaaccgtagatcttgaactggaagcccagatcgatatcctgcgcgacaataagaaaaagtacgaaaatatcctgaaattggcccagacgctatccacacaactgtttcagatggtacatacccaaaggcaactgggagacgctttcgccgatcttagtttaaaatccctagaactccacgaggaatttggatataacgccgacacgcagaaactgctcgccaaaaatggcgaaactctcttaggtgcaatcaatttcttcattgccagcgttaatacacttgtaaacaaaaccatagaagatacactgatgaccgttaaacagtacgagtcagctcgcattgagtacgacgcctatcgcactgatctcgaggaactcaacctcggtcccagagacgcaaatacgttgccaaaaatagagcagagccagcatctgttccaagcacacaaggaaaagtacgataaaatgcgaaacgatgtgagcgtcaaactcaaattcctcgaggagaacaaagtgaaggtccttcacaaccagctggtcttatttcacaatgccatcgccgcctattttgctggcaaccagaagcagctggagcagactctgaagcagttccatattaaactcaagactccaggagtggatgctccatcctggctcgaagagcagtag

SEQ ID NO: 23954 - DNA, 1572 bp, Artificial Sequence
  Description of Artificial Sequence: Synthetic coding sequence
atggccaacgtgggcctgcagttccaggccagcgccggcgacagcgatccccagtctcggcccctgctgctgctcggtcagttacaccacctacatcgtgtgccttggtctcatgtccgcggtaagctccagccacgagtcacagaagagctgtggcaggctgctttgagcactttgaaccctaaccccaccgacagctgccctctctacctcaattacgcgaccgtggccgccctgccctgtagggtctctagacataacagccctagtgccgcacactttattacccgcctcgtcagaacctgcctaccaccaggcgcacatcgctgtatagtaatggtgtgtgagcagcccgaggtgttcgcaagtgcctgcgctctggcccgggcctttccattattcacacacaggtctggggccagtaggcgactggagaaaaagactgtgactgtggagttctttctggttgggcaagataatggaccagtggaagtgtcgacgcttcagtgcctggctaacgctaccgacggagtcagattagccgccaggatcgtcgatacgccctgcaacgaaatgaacactgacaccttcctggaagagataaataaagtgggcaaggaacttgggattattcctactatcattcgcgatgaggagctgaagactcgcggattcggcggaatctatggagtcgggaaggctgctctccatccccccgctctggctgtgctgtcacacacacccgatggcgccacacagactatcgcctgggtgggaaagggaatcgtctacgatacaggcggtctatcaatcaaaggtaaaaccaccatgcccggaatgaaacgggactgcggaggcgccgccgcagtgctgggcgcttttcgtgccgcgataaaacaggggtttaaggacaatttgcatgctgtcttctgcctagcagaaaactccgtcggaccgaacgcaacgcgtccggatgacattcacctgctctattcaggaaaaaccgtggagattaataacacagacgctgaggggcggttggttctcgcagacggtgtgtcatatgcgtgcaaggacctgggcgcggatatcattctcgacatggcaactctgacaggtgcgcagggaatcgccaccggaaagtatcacgctgcagtgttaaccaacagcgccgagtgggaagcagcctgcgtcaaggcggggagaaagtgcggggatcttgttcaccccctggtttattgcccagagctacatttctccgagtttacttcggcagtcgccgatatgaaaaattccgtggccgaccgcgacaatagtccctcctcatgcgccggcctttttatcgccagccacatcggctttgactggccaggggtatgggttcacctggatatcgccgcgcctgtacatgctggagagcgggcaacgggttttggagtagctctgttgctcgctctgtttggtagggccagcgaggacccgttgctgaacctcgtgtctccccttgggtgtgaagtggatgttgaagagggggatctaggaagagattctaagcggcggaggttagtgtag

SEQ ID NO: 23955 - DNA, 1371 bp, Artificial Sequence
  Description of Artificial Sequence: Synthetic coding sequence
atggccgacggcggcagcgagcgggccgacggccggatcgtgaagatggaggtggactacagtgcaaccgtggatcagcgtctgccagaatgcgcaaagctggccaaggaaggcaggcttcaggaggttatcgaaaccctgctatcccttgagaagcagacaagaacagcgtcagacatggtgtcaacaagcagaattctagttgccgtggttaaaatgtgctacgaggctaaggaatgggatctgcttaacgaaaacatcatgctactgagcaagagacggagtcagcttaagcaggctgtggctaaaatggtgcagcaatgctgcacttatgtagaggaaattaccgacctgccaattaagttaaggctgattgacactctgcgcatggtgacagaaggcaagatctatgttgagattgagagggcaagactgacaaaaacacttgcgactataaaggaacagaacggtgatgtcaaagaggcagcatccattcttcaggagctccaggtcgagacatacggcagcatggaaaagaaggaacgggttgagtttatcctggagcagatgcgtttatgcttggccgtgaaggactatatccgcacacagattattagcaaaaaaatcaacacaaaattctttcaagaggagaatacagaaaagcttaagcttaagtactataacctgatgatccagctggaccagcatgaggggagctatctctccatctgcaagcattacagggccatctacgataccccatgtatccaggcggagagcgagaagtggcagcaggcgctgaagagcgtggtcctttatgttatcctggctccatttgacaatgagcagagcgatctcgttcatcggatttccggcgacaaaaagttagaagagattcccaaatataaggatttgctgaaactattcaccacaatggaactgatgcggtggtccactttggtggaggactacggaatggaactgagaaaaggatccctggaatcccccgcaaccgacgtgtttggtagcacagaggaaggggaaaaaagatggaaggatctgaagaaccgcgtcgtggaacataatattagaattatggctaagtactacacgaggatcaccatgaaacggatggctcagctactcgacttgtcagtggatgaatctgaggcctttctcagtaacttagtggtgaacaagacaatcttcgccaaggtagataggttagctggtatcatcaattttcaacggcccaaagacccgaacaacctactcaatgactggtctcaaaagttaaattccctgatgagcctggtcaataagactacacacctgatcgccaaagaggagatgatccataacctgcagtag

SEQ ID NO: 23956 - DNA, 1011 bp, Artificial Sequence
  Description of Artificial Sequence: Synthetic coding sequence
atgaagatcgacatccacagccacatcctgcccaaggagtggcccgaccttaagaaaaggttcggctacggaggatgggtgcagctgcaacaccacagtaaaggcgaggccaagctcctcaaggacgggaaggtgttccgggtggtcagggagaactgttgggatcccgaagtgcgcatacgcgaaatggaccaaaagggcgtgacagtgcaggctctcagtaccgttcccgtgatgtttagctactgggccaagccagaggacactcttaatttgtgccagctgcttaataacgatctagcttctacagtcgtatcctaccctaggaggtttgttggcctcggcactttgcctatgcaagcccctgaactcgcggtcaaggagatggagcggtgcgtgaaggaactcgggttccctggcgtccaaattggtacccacgtgaacgaatgggacctgaacgcgcaagaactgtttcctgtgtacgctgctgctgagagactgaagtgctccttgttcgttcatccttgggatatgcagatggatgggcgcatggcaaaatattggctcccttggttagtaggcatgcccgcggaaaccacaatagccatctgttctatgatcatgggaggggtgttcgagaagtttcccaaactgaaggtctgtttcgcacatggcgggggggccttcccattcacagtcgggaggattagccatggattcagtatgcggccagacttatgcgctcaggataaccccatgaaccctaaaaaatatctagggagcttctacacggacgccttggtccacgaccccttgagccttaagctgctgacagacgtgattggcaaagacaaggtcattctcggaacggattaccccttccccctgggagaactggagcccgggaaacttatcgaaagcatggaggagtttgacgaagagactaaaaacaagctcaaggcgggaaacgctctcgcctttcttggcctcgaacgcaaacagtttgagtag

SEQ ID NO: 23957 - DNA, 1617 bp, Artificial Sequence
  Description of Artificial Sequence: Synthetic coding sequence
atggagctgagctaccagaccctgaagttcacccaccaggcccgggaggcatgcgagatgcgcaccgaagcacgccgtaagaatctacttatcctaattagtcattatctgacccaggagggatacattgacactgccaatgcccttgagcaagagaccaaactcggtctcagacggttcgaggtctgcgacaacattgatctcgagaccattctgatggaatacgagagctactatttcgtaaagtttcagaagtacccaaagatagttaagaagtcctctgacaccgctgagaacaacttgccgcagcggagccgggggaaaacccgcaggatgatgaatgattcctgtcagaacctccctaagataaaccaacaacgacctcgaagtaaaacgactgccggcaaaacgggcgataccaagagcctcaataaagagcacccaaatcaggaggtagtagataacacgaggctggaaagcgctaacttcggcctccatataagtagaatcagaaaggacagtggcgaggaaaacgcccaccccagacgcggccagatcattgattttcaggggctgttaaccgacgcaatcaagggcgctacttcagagctcgctctgaacacctttgaccacaatccagacccctcggagagacttttgaagccgctgagcgcctttataggaatgaactccgaaatgcgagagctggccgctgttgtgtcgcgggatatataccttcataaccctaatatcaagtggaatgatattattggattggacgcagccaagcaactggtcaaagaagccgtcgtgtacccaatcagataccctcagctgtttacaggaattctttctccctggaaaggactcttgctgtatgggcctcccggaactggaaagaccctcctggctaaggctgttgcgactgagtgcaagacgacgtttttcaacatctcggcatccaccattgttagcaaatggagaggagattccgagaagctggtgagggttctcttcgagctcgccagataccacgcacctagcacgatctttttagacgaacttgaatccgtcatgagccagagagggactgcttcgggaggagaacacgagggcagcctgaggatgaaaaccgaactattggtgcagatggatggccttgcacgttcagaggacctggtctttgtcctggccgcctcaaatcttccctgggaactagactgcgccatgctgaggcggctggaaaagcgcattctcgtggacctgcctagccgggaggcgaggcaggcaatgatatatcactggcttccccccgtttccaagtccagggccctcgagctgcacaccgagctggaatattccgtgctctctcaggagactgaggggtattctgggagcgacatcaaactcgtatgcagagaggcagccatgcgacccgtccgaaagatcttcgatgccctagaaaaccaccagagtgagtctagtgacctgcccagaatacaactagacatcgttaccactgcggatttcctagacgtgttgacacatactaagccctccgctaaaaacctggcacagcgttactccgattggcaacgagaatttgaatccgtctag

SEQ ID NO: 23958 - DNA, 507 bp, Artificial Sequence
  Description of Artificial Sequence: Synthetic coding sequence
atggccgagggcagccggatcccccaggcccgggccctgctgcagcaatgcttgcacgccaggctacagatccgccctgccgacggagacgtggccgcccagtgggtggaggtacagcgtgggctggtcatatatgtgtgcttcttcaagggtgcagacaaggaattgcttcctaaaatggtcaacacactgttgaatgtgaaactgagcgaaacggagaatggcaagcacgtcagtatcctagacctgccaggcaatattttaatcatcccacaggcaacattgggtggccgactcaaggggagaaatatgcagtaccactccaatagtggcaaagaggaagggttcgaactgtattctcaattcgtgactctgtgcgagaaagaggtggctgccaattctaagtgcgcggaagcccgcgtcgtcgtagaacacggcacttatggaaataggcaggtgctgaaattggacactaatggccccttcactcatcttatcgaattctag

SEQ ID NO: 23959 - DNA, 1764 bp, Artificial Sequence
  Description of Artificial Sequence: Synthetic coding sequence
atggccagcgaggacatcgccaagctggccgagaccctggccaagacccaggtggccggcggtcagttgagctttaaaggaaaatctttgaagctcaataccgcagaggatgccaaggatgtgatcaaagaaatcgaggattttgacagcctggaggccttgcgtttggagggcaacaccgtgggggtcgaagcagcgcgagtgatagcgaaggcgctcgagaagaaatctgagttgaagagatgtcattggtccgacatgtttactggcagactgcgaactgagattccccccgcactgatttcactgggggaaggacttattactgccggcgcccagctcgttgaactggatctgagcgataatgcattcggtcccgacggcgtccagggatttgaagccctgttgaagagctccgcatgtttcaccctccaggagctgaagcttaacaattgtgggatgggcatcgggggcgggaaaatcctggccgcagccctcacagagtgccaccgaaaaagttctgctcaagggaagccattagctctgaaagtctttgtcgcaggcaggaaccggttggagaacgacggcgccacagccctggctgaggcattccgagttattgggacacttgaggaggtacacatgccgcagaacggtatcaaccatcccgggatcaccgccctggcccaggcattcgcagttaatcccctactgcgcgtcattaacctgaacgacaatacgttcacagagaagggcgccgtggccatggctgaaaccttgaagacactgcggcaagtagaagtcatcaacttcggcgactgtctagtgcgatccaagggagcagttgcaatcgcagacgctatccggggcggcctgccgaagctgaaggagttgaatctttctttctgtgagatcaagcgcgacgctgctttggccgtggctgaagccatggcagacaaggcagagttggagaaactggatttaaacggaaatactctgggcgaggaaggatgcgaacagctacaggaggtcctggagggattcaatatggcaaaggtgctcgctagtctatctgacgatgaagatgaggaagaagaagaggaaggagaggaagaggaggaagaagcggaggaggaagaagaggaggatgaggaagaagaggaggaggaggaggaggaagaggaagaagagccacagcagcgaggacaaggtgagaaaagcgctacaccgtcgcggaaaattctcgatccaaacaccggtgaacccgctccagtcctcagttcccctccaccagccgatgttagcacattcctggcctttcctagtcctgagaagttgctccggttgggtcctaaatcatcagtcctgattgcccagcagacagatacatctgatccagaaaaagttgtgtccgcgtttctcaaggttagctccgttttcaaggatgaggctacagtgcgaatggcagtccaagacgcggtagatgccctgatgcagaaggccttcaattcatctagctttaacagcaacacgttcctgacccgcctgctagtgcatatgggacttttgaaaagtgaggataaggttaaggccattgctaacctgtatggccctttaatggctttaaaccacatggtgcaacaggactattttccaaaggctctggcaccccttctgctggcttttgtgaccaagcccaactctgcactcgaatcctgttctttcgctagacatagtcttctgcagactctttataaggtgtag

SEQ ID NO: 23960 - DNA, 2529 bp, Artificial Sequence
  Description of Artificial Sequence: Synthetic coding sequence
atggacatcagcaagggcctgcccggcatgcagggcggcctgcacatctggatatcagagaatcgcaagatggttcctgtaccagaaggtgcatacgggaacttcttcgaagagcattgctacgtcattctacacgtgccccagtcacctaaagcgacccagggggcctcaagcgatttgcactactgggtcggaaaacaggcgggggcagaagcacagggcgctgccgaagcctttcagcaacgattacaggacgaactgggcggacagacggtgctgcaccgggaagcccagggacacgaaagtgattgtttctgctcatatttccgtccagggattatatacaggaagggggggctggcatcggatctgaagcacgttgagactaatttattcaacatccagcggttgctgcatattaaaggccgcaagcacgtcagtgctacggaggttgagctctcatggaactcctttaataagggagacatttttttacttgatctggggaagatgatgattcagtggaacggacccaagacttcaatcagtgaaaaagccagagggctagccttaacttattctctccgagaccgcgaaagaggcggcggacgggcccagatcggcgtggttgacgacgaggccaaggcacccgatctgatgcagatcatggaggcagtactcggccgtcgggtcggctcgctccgcgcagctactcccagtaaggatattaatcagctgcaaaaagccaatgtacgcctctatcacgtctacgagaaggggaaggatctgctgcaggaggaggacttttacattctcgatcagggaggattcaagatttacgtatggcagggacgtatgtcttccctacaggagcggaaggcagcttttagccgcgcagtagggtttattcaggccaaaggatatccaacttacactaatgtggaagttgtcaatgacggcgcggagtcagccgcttttaagcagctctttcggacctggagcgagaaacgccgccgaaaccagaagcttggaggcagggacaaatccatacatgtgaagttggacgtcggcaagttacatacccaacctaaactcgccgctcaactccgaatggtggacgacggatccggcaaagtagaagtttggtgcatccaggatctccatcgccagcccgtggacccaaaacgtcatgggcaactgtgcgctgggaactgctatctcgtgctgtacacctatcagcggctggggcgggttcagtatattctgtacctctggcagggacaccaggccactgccgatgagatagaagcactaaattcaaatgcggaagagcttgacgtaatgtacggcggggttcttgtgcaggagcacgtcactatgggtagtgaaccaccacacttcctcgccatcttccagggccagctggtgatctttcaggaaagggccggacatcatggtaagggccagagcgccagcaccacaaggctcttccaggtgcaaggtactgactcacacaatactaggaccatggaggtcccagcacgcgccagcagtcttaattcttcagacatcttcctcctcgtcacagcttctgtgtgttacctgtggtttggaaaggggtgtaacggggatcaacgagaaatggcacgcgtggtggtaaccgtaatatcaagaaaaaatgaggaaaccgttcttgagggacaggaacccccacatttctgggaagctttgggaggccgggccccttatccatccaacaagcgcctgccggaagaggtcccctcatttcagccacgactcttcgagtgcagctcccatatgggttgtctcgtgctcgccgaggtcggctttttctctcaggaggatctggacaaatatgacatcatgctgctggatacctggcaggagattttcttatggttgggggaagcagcctccgagtggaaggaggcagttgcatggggtcaggagtacttgaagacacaccctgctgggcgtagccccgccacacctatcgtcctggtcaaacagggacatgaaccaccaacgtttataggctggttcttcacctgggacccatataagtggacttcccacccatcccataaagaagtcgtcgacggctccccagcagctgccagcaccatttccgaaataaccgccgaagttaacaatttgagactaagcaggtggcctggaaacggaagagcaggggccgtcgcccttcaggctttaaaaggatctcaggattcgagcgagaatgatctggtgagatcacctaaaagcgcaggcagccgtacctcttcgtctgtaagcagtacttccgcaaccatcaatggcggattgcggagagaacagctaatgcatcaggccgtcgaagacctgcccgagggagttgatcccgctaggcgcgagttctacctctctgactccgatttccaggatatatttgggaagtctaaggaagaattttactcaatggccacatggcggcagagacaggaaaagaaacagttgggatttttctag

SEQ ID NO: 23961 - DNA, 1620 bp, Artificial Sequence
  Description of Artificial Sequence: Synthetic coding sequence
atggacgccatggccagccccggcaaggacaactaccggatgaagtcttataagaataaagcattaaatccacaggaaatgcgaaggagacgcgaggaggaagggatccagctgcggaaacagaagagagaagagcagttgtttaagcggaggaacgtttacctgccaaggaatgacgaatcaatgctggaatcccccatccaggacccggatattagttcaactgtacctatccccgaggaagaggtggtgaccactgatatggtacaaatgatcttttcaaacaacgctgatcagcaactgactgcaacccaaaagtttagaaaattgctgtcaaaagaaccaaatcctcctatcgatcaggtgatacaaaagcccggcgtcgtacagcggttcgtgaagtttctggaacggaacgaaaattgcaccctgcagttcgaagctgcttgggctctgaccaatatagcctccggtactttcctgcacacaaaagtcgttatcgagaccggagcggttcctattttcatcaagttgctaaattcagaacacgaagacgtccaggagcaggccgtttgggccttgggaaacatcgccggggacaacgccgagtgtagggacttcgtgttaaattgcgagattcttcctcctctgctggagctactgactaactccaatcgcctaactacgaccagaaacgctgtgtgggccctctccaacctatgtcgcgggaaaaatcccccgccgaacttctcaaaagtctccccatgtctgaatgtactcagccgcctgctgtttagttccgaccctgatgtgcttgcagatgtctgttgggccctgtcctacctatcggacggtcccaacgacaagattcaagccgtgattgacagcggcgtgtgtaggcggcttgtggagctcttgatgcataatgattacaaagtcgtaagccctgccctgcgggccgttggcaatatcgtgacaggagatgacattcagacgcaggtcatactaaactgcagcgcactgccctgccttctgcacctgctctcctctcccaaggagtctatacggaaggaggcctgttggacggtgtctaatatcactgccggcaacagagcccaaattcaagctgtgattgacgctaacatctttcccgtgttgattgagattctgcaaaaggctgaatttcggacgcgaaaagaagctgcctgggctataaccaatgctacatcagggggcacccctgagcagatcaggtacctggtagctcttgggtgcataaaacccttgtgcgacctgctgacagtcatggatagcaaaatcgtgcaggtagctttgaatggcctcgagaacattttaagactcggagagcaggaatctaagcagaatggcattggcataaatccatattgcgccctcatcgaagaagcttacggattggacaaaatcgagtttctccagtcccacgaaaatcaggaaatataccagaaagcctttgatctgatcgagcattactttggcgttgaagaagatgacccaagcatcgtgccccaggtggacgagaatcagcagcagtttatctttcagcaacaggaagccccaatggacggattccagttgtag

SEQ ID NO: 23962 - DNA, 3735 bp, Artificial Sequence
  Description of Artificial Sequence: Synthetic coding sequence
atgctgatcaaggagtaccacatcctgctgcccatgagcctggacgaataccaggtggcccagctatacatgattcaaaaaaagtcaagagaggagagtagcggcgagggatctggcgtggaaattctggcaaacaggccttacaccgatggccctggcggaagcggccagtacacccataaagtgtatcacgtgggaagtcatatccccggttggttccgagccctactgcctaaggcggcactgcaggtagaagaagagagctggaatgcctacccctacacacggaccagatatacatgccccttcgtggaaaagttttccattgaaattgagacctactacctccccgacggaggccagcagccaaacgtgtttaacctgagcggagctgaacgccgacagcggatccttgataccatcgacattgtacgtgacgctgtggctccgggagagtataaagccgaagaggacccccggctttaccattccgtcaagaccggaaggggaccactgagcgacgactgggctcgcaccgccgcccaaaccgggccactcatgtgcgcctacaaactatgcaaagtggagtttcgttactggggcatgcaggccaagatcgaacagtttatacacgacgtgggcttaagaagagtaatgctgagggcacatcggcaggcctggtgttggcaggacgaatggacggagctttcaatggccgacatcagagctctcgaagaagaaaccgcgcgaatgcttgcacagcgaatggcaaaatgcaacacaggctcggaaggatctgaggcacagccacctggcaagcccagtacagaggctcggtctgccgcaagcaatacaggtacccccgacggccccgaagctccccctggtcctgatgcctcccccgatgccagctttggaaagcagtggtcatcctcctcgcggtcttcctacagttctcagcacggaggagcagtaagccctcagtcactttcagaatggcggatgcagaatattgcccgggactccgagaattccagcgaagaggagttctttgatgcccatgaaggcttctccgacagcgaagaggtctttcccaaggagatgaccaagtggaacagcaacgatttcatagacgcattcgcatctcccgtcgaggccgaaggcacacctgagccgggggccgaggccgccaaagggatcgaagatggagctcaagcccctcgcgattcagagggcctggacggtgccggagaactcggggccgaagcatgcgctgtccatgcccttttcctgatcctgcattcagggaacattctcgatagtggacctggcgatgctaactcgaagcaggctgatgtgcagaccttaagttctgccttcgaagcggtcacaaggatccacttcccagaggcactgggccacgtggcattaaggctcgtgccttgcccaccaatctgtgccgccgcctacgccctggtgtccaacctaagtccctactcccacgacggagactctctcagccgatctcaggaccacattccactggccgcgctgcctctgctcgcaaccagcagctcgcgttaccagggcgcagtggcaactgtgatcgcacgaaccaatcaggcttatagcgctttcctgagatcccccgaaggtgccgggttttgtggccaggtcgccttaatcggagacggcgtaggcggaatcctgggatttgacgccctctgccatagtgccaacgctggtaccggctcgcggggctcctccaggcggggctcgatgaacaatgagctcttgagccctgaattcggacccgttcgcgacccgctggccgatggggttgaagggctggggcgcgggtctcccgagccctctgccttgccaccccagagaatcccatcggacatggctagtccggaacccgagggatctcagaatagtctacaggcggcacccgctactacatcctcatgggaacctcggcgggcgagtaccgccttttgtccccccgccgcgagcagtgaggccccagatgggccctcctccactgccaggctagactttaaggtaagcggtttttttcttttcggtagcccgctaggtctggtgctcgcactgcgtaagactgtgatgcctgctctcgaagccgcacagatgcggcccgcatgtgagcaaatttacaatttatttcatgcagctgatccatgtgcatcacgcctcgagcccctgttggcccccaaatttcaggccattgcaccattgacggttcctcgataccagaaattcccacttggagacggctcatccctcctcctcgctgatacactgcagacccactccagcctgtttttggaggaactagaaatgctcgttccgagcacccccacaagtacctccggagctttttggaaggggagtgaactggctaccgacccacctgcacagccagcggcccccagtactacctcagaggttgtgaaaattctcgaacgatggtggggaacgaagcggattgactattctttatattgccctgaggcactgacggccttccctacggtgactctgcctcaccttttccacgcctcctactgggagtctgcggatgtggtggccttcattctgcggcaagtgatcgaaaaagagcggcctcaactggccgaatgtgaagaaccctccatctactctcccgcctttccccgggaaaagtggcagcgaaagagaacacaggtgaaaattcgtaacgtgacctccaaccatagagcatccgacaccgttgtctgcgaagggcgcccacaagtgctgtccggtcggttcatgtatgggcccttagatgtagtcaccctgacaggcgagaaagttgatgtgtacattatgactcagcctctgtctggcaagtggattcacttcggaacagaagtcaccaactcatcaggtaggctgacctttcccgtcccacctgaaagggcacttgggattggggtgtaccctgtgcgaatggttgtccggggcgatcatacctacgctgagtgttgtctcaccgtggtggctcgcgggaccgaggcagtagtcttttcaattgacggtagcttcacggcctctgttagtataatgggaagcgatccaaaagtgcgtgctggcgcagttgatgttgtgagacactggcaggattcagggtatttaatcgtgtacgttactggacgccccgacatgcaaaagcatagggttgtagcctggctttcacaacataattttccgcacggagtggtgagcttctgtgatggcctcacgcacgatccgctccggcagaaggcaatgtttctccagtcgctcgttcaggaggtggaacttaatatagtggcgggatatggctcaccaaaggatgtggccgtttatgccgctctcggactcagtccttcacagacgtacattgtgggacgcgctgtgcgcaaactgcaggcgcagtgtcaattcctgtccgacggctatgttgctcacctggggcagctggaagcggggtctcattcacacgctagctctggaccaccacgggcagcgttgggtaaaagcagctatggcgtggcagctcctgttgatttcttgcgtaagcagtcccaattattgaggtccaggggcccttctcaggccgagcgcgagggtcccggaactcctcccaccactctggcgcgggggaaagcccgttcgattagtcttaagctggatagtgaggaatag

SEQ ID NO: 23963 - DNA, 882 bp, Artificial Sequence
  Description of Artificial Sequence: Synthetic coding sequence
atgaccgaggacagccagcggaacttccggagcgtgtactacgagaaggtgggattcagaggagtcgaagagaagaaatctcttgaaatcctcctgaaggacgatcgcttagataccgaaaagctgtgtacttttagccagcgctttcctctgccttcaatgtaccgggctctggtttggaaggttctgctcgggatcctacctccacaccacgaatcacacgctaaggtcatgatgtacagaaaagagcagtacttagatgtgctgcacgcactcaaagtggtccggttcgttagtgacgcaacacctcaagccgaggtctacctcaggatgtatcagttggagagcggaaaattgccacgctctccttcctttcctttggagcctgacgacgaagtgtttctggctattgccaaagccatggaagagatggtggaggactctgtcgactgctactggataactcggcgatttgtcaaccaactgaatacgaagtaccgggatagtctcccccaactgcctaaagcatttgagcagtatctgaatctggaagatggcaggctcctgacacacctgcggatgtgctctgccgcccctaagctaccttatgatctgtggttcaagcgttgctttgccggatgcctgcccgagtcaagcttgcagagagtgtgggataaggtggtttccgggagctgcaagatattggtatttgttgcggtggagatactattaacatttaagataaaggtcatggctctaaattcggccgagaaaattaccaagtttctcgagaatattccccaggactcgtctgatgcaatagtgagcaaggccatcgacctgtggcacaagcactgtgggaccccagtccacagctcgtag

SEQ ID NO: 23964 - DNA, 249 bp, Artificial Sequence
  Description of Artificial Sequence: Synthetic coding sequence
atgagcgagggcgagagccagaccgtgctgagcagcggcagcgaccccaaggttgagtcaagctcatcagcacctgggctgacatctgtaagccctcccgtgacctcaaccacaagcgctgcctcccctgaggaggaggaggaaagtgaggatgagtccgagattctggaggagtcaccctgtggcagatggcagaagcggcgggaagaggtgaatcagcgcaacgtaccaggaatcgacagtgcctag

SEQ ID NO: 23965 - DNA, 5058 bp, Artificial Sequence
  Description of Artificial Sequence: Synthetic coding sequence
atgagcctgcccttctaccagcggtgccaccagcactacgacctgtcctaccggaataaggatgtgcgctccaccgtgagtcactatcagcgagaaaaaaaacgatctgccgtctacactcagggaagcactgcttactcgtcacgctcttcagctgctcataggcgagagtctgaggcctttcggcgcgccagtgcgtcaagtagccagcagcaggcttctcagcacgctctgtcgtcagaggtgtcaaggaaggccgcctcagcttatgactacggttccagccacggactgactgacagctcactcttactcgatgactacagcagtaagctctccccgaaacccaagcgcgcaaagcacagcctcttgtccggcgaagaaaaggagaacctaccctctgactatatggtgcctattttctcgggacggcagaagcacgtcagtgggatcaccgacacagaagaagagcgcatcaaagaagctgcggcctatatcgctcagcggaatctcctggccagcgaggaggggattaccacctctaagcagtcaacagcttcaaagcagactacggcttcaaaacagtcgactgctagtaaacagtctaccgccagcaaacagagcaccgccagtcggcagtcaactgcttcccgacagtccgtcgtttcaaaacaagctactagcgccctccaacaggaagagacttctgagaagaagagcaggaaagtagttatcagagaaaaagcagagcggctctcccttagaaagactttggaggaaacagaaacgtatcatgccaagctcaatgaagatcacctcttacacgcaccggagtttattatcaaacctagaagtcacaccgtgtgggagaaagagaatgtgaagttgcactgttcaattgctggatggcctgaaccgcgcgtcacttggtataaaaaccaggtgccaattaatgtacatgccaaccccgggaagtatataattgagtctagatacgggatgcacactctcgaaatcaatggctgtgacttcgaagacaccgcacagtaccgagcctcagctatgaacgtcaagggagaactctctgcctatgccagcgtggtggtaaaaagatataaaggtgaatttgacgagacccgcttccatgccggggcgtctaccatgccactgtcattcggagtgactccttacggctacgcaagtaggtttgagatacacttcgacgataaatttgacgtgtcttttggcagggagggtgaaacaatgagtctggggtgtagggttgtcattacgcccgagatcaaacatttccagcctgaaatccagtggtacagaaatggagtaccgctcagccctagtaaatgggttcagacactgtggtctggtgagcgagctaccctgaccttctcccatctaaataaagaagacgaggggctgtacaccatccgtgtacgcatgggtgagtattatgaacagtattcggcatacgtttttgtgcgggacgctgacgccgaaatcgagggcgctcctgccgcacctcttgatgtgaagtgcttagaagctaataaagattacataatcatatcttggaaacagcctgccgttgatggggggagccccatacttgggtacttcattgacaagtgcgaagttgggaccgacagttggagtcagtgcaacgatacaccagtaaaatttgcacggtttcctgtgactggccttatcgaaggacggtcctacatcttccgagtccgggcagtgaacaaaatggggatcggttttccatctcgtgtgagtgagccagtggctgccttggaccctgccgagaaagcccgcttgaaatccagaccgtccgccccatggactgggcagattatagtcactgaggaagaacccagcgagggaatagtcccaggacctccgaccgatctgtctgtcacagaggccacacgatcttacgtcgtactaagctggaagcctccaggacagcggggccacgaggggataatgtattttgtagaaaagtgtgaagccgggaccgagaactggcaacgggtgaatacagaattgccggtgaaaagtccccgattcgccctttttgatcttgctgagggtaaatcctattgctttagggttaggtgctccaatagcgcgggagtcggtgaaccaagcgaagcgaccgaggtaacggtggtcggggataaactggacattcccaaggctccgggaaaaatcatcccttctagaaataccgacacgtcagtggtcgtgtcctgggaagagtccaaggacgccaaggagctcgtcgggtattacattgaagccagtgtggctggttcaggtaaatgggagccctgcaataacaatcctgtgaaaggctcccgcttcacctgccacgggcttgtgacggggcagtcatacatattccgcgtccgcgccgtgaatgcagccggtctgagcgagtactcgcaagactctgaggccatcgaggtcaaggccgctatagggggcggagtctcacctgatgtgtgcccagctctgagcgatgagccaggaggcctcaccgcatcccgcgggcgagtacacgaagcatcacctccaacttttcagaaggatgccctgctgggatccaagcctaataagccctccctgcctagttcatcccagaatcttggccagacggaagtgagcaaggtctcagaaactgtgcaggaagagctcacccctcccccccaaaaagctgccccgcaaggaaagtccaaaagtgatccacttaagaagaaaaccgaccgggcccctccctcccccccttgcgatattacatgccttgagtccttcagagactctatggtgcttggatggaaacagccggataaaattggaggcgctgaaatcactggttactatgtgaattaccgggaggtgatcgatggagttcctggtaaatggagggaggccaacgttaaggccgtgagcgaggaggcctataagatctcgaatctgaaagagaatatggtgtatcagttccaggttgccgctatgaatatggctggcctgggagcccccagcgcggtcagcgagtgctttaagtgcgaggagtggaccattgccgttccaggtccaccgcatagtttaaaatgttctgaggtgcgcaaagattcactagtcttacagtggaagcctccagtgcatagcggtagaacgccggtcaccggctattttgtggacctaaaggaggccaaagcgaaggaggaccaatggagggggctgaatgaggctgccatcaagaatgtatacctcaaggtaagagggttaaaggagggcgtgtcctatgttttccgggtacgggcaatcaaccaagctggcgtgggcaagccctctgacctggccggtcctgtggtggctgagaccaggccaggaacgaaagaggtggtggtgaatgttgacgacgacggcgtgatctctcttaattttgaatgtgacaaaatgacccctaagtcagaattcagctggtccaaggattatgtctctaccgaagatagcccgaggctggaggtggagagcaaagggaacaagacaaaaatgacgttcaaggacctggggatggacgacctcggcatctactcctgtgacgtgacagataccgacggaatcgcatccagttaccttattgacgaagaagagttgaaaagactcctggccctgtcccatgagcacaagtttcctacagtacctgtcaagagcgaactggctgttgaaatactcgagaaagggcaggtgcggttctggatgcaggcagaaaaactgagcgggaatgccaaagttaactatatttttaatgagaaggagatatttgaaggacctaaatacaagatgcacattgaccggaataccggcataattgaaatgtttatggaaaagcttcaggatgaagacgaagggacttacacctttcagctccaggatggcaaggctacaaaccattcgaccgtagtacttgtgggggacgtgtttaaaaagttacagaaagaggccgagttccagagacaggagtggatccgaaaacaggggcctcactttgtggagtatctgagttgggaggtcaccggagagtgcaacgtcctgttaaaatgcaaggttgccaatattaaaaaggaaactcacatcgtatggtataaggacgagcgcgaaatcagcgtggatgagaagcacgactttaaagacggaatctgtacgctcctcatcaccgagttctctaagaaggatgcgggcatttacgaggtgatactcaaggatgatcggggaaaggataaatctcggcttaaactggtggacgaagcattcaaggaacttatgatggaagtctgtaagaagattgccctgagcgctactgatctcaagattcaatcaaccgccgagggcattcagctctactcatttgtgacctattatgttgaagacttgaaggtgaactggagtcataatggctctgccatacggtactccgaccgcgtcaagaccggggtgacaggagagcagatatggctccagattaacgagcccacccctaacgataagggcaaatacgtcatggagctgtttgacggcaaaactggccaccaaaaaaccgttgatctgtcaggacaggcctatgatgaggcgtacgccgagttccagagactgaagcaagctgctatcgcagaaaaaaatcgggcccgggtcctgggtgggctccctgacgtggtcaccattcaggaagggaaggctttaaacttgacatgtaatgtctggggcgaccccccccccgaagtgagctggctgaaaaacgagaaagctttggcttcagacgaccactgtaatctgaaattcgaagccggcaggacagcatactttaccattaacggtgtgtcaactgcagattccgggaaatatggtctggtcgtgaaaaataaatatggtagcgagaccagcgatttcaccgtgtctgtctttatcccagaagaagaggccagaatggccgcactggagagtcttaagggggggaaaaaggccaagtag

SEQ ID NO: 23966 - DNA, 5877 bp, Artificial Sequence
  Description of Artificial Sequence: Synthetic coding sequence
atggccgaccggaccgccccccggtgccagctgcggctggagtgggtttatggctacagaggacaccagtgccgaaacaatctgtactacaccgccggtaaggaggtcgtgtacttcgtagccggcgtcggcgtagtgtacaacacaagagagcatagtcaaaagttttttttaggccataatgatgacataatctctctcgccctccatccagataagacgctcgtggccacgggacaggtcgggaaagagccgtatatttgcatctgggacagttacaacgtacagacagtctccttgcttaaagatgtccatacgcatggggtcgcctgtctagctttcgactccgatgggcagaggttggcttcggtaggactggatgcaaaaaacaccgtgtgtatctgggattggcggaagggcaaacttttagcctcagctaccgggcatagcgacaggattttcgatattagctgggacccctatcagcccaaccgtgtggtgtcctgcggggttaaacacataaagttttggactttgtgtgggaacgctctaaccgcgaagcgcggaattttcggtaagactggcgacctacaaactatactatgcttggcctgcgctaaagaggatataacatactcgggcgctcttaatggcgacatttatgtttggaaaggcctcaatttagtgcgcaccatccagggagcccactcagccggcatcttttcgatgtacgcctgtgaggaaggctttgctaccggcgggagggatggatgcatccggctgtgggatacagatttcaagcctattaccaagattgatttgcgggagacagaacagggttataagggcctgtccatccgatcggtgtgctggaaggccgatagactcctagctggtacacaggactctgagatcttcgaagtcatagtgagagagcgggataagcctatgcttatcctccaggggcattgtgaaggtgaactctgggcacttgccctccatcccaagaaaccactggcagtgaccgggtccgacgacaggtcagtgcgcttgtggtctctagctgatcacgcactgatagccagatgtaacatggaagaggctgttaggagcgtggcattctcacctgacggaagtcagctggccctggggatgaaggacgggtcttttatagtactcagagtgcgggacatgactgaggtagtacacattaaggatcgcaaggaggtcatccatgagatgaagttctcaccagatggtagctacctcgcagttgggtcaaacgatggacccgtggacgtttatgcagtcgcccagaggtacaaaaagatcggagagtgttccaaatccctttctttcataactcatatcgactggtcccttgacagtaaatatctgcagaccaacgacggggccggggagaggctgttttataggatgccttcagggaagcccctaacatccaaggaggagatcaaggggataccgtgggccagctggacatgcgtgaaaggtcctgaagtcagcgggatctggcctaagtacaccgaggtgactgacatcaacagcgtggacgccaactacaattcgtctgtcctggtttctggggacgattttggactagtgaagctgttcaagttcccctgccttaagcgcggagctaagttccggaaatacgtgggtcacagtgctcacgtgacgaatgtgcgctggtctcatgactttcagtgggttctatctactggaggtgctgaccacagtgtcttccaatggcgattcatccccgagggcgtctctaacggaatgttggaaaccgcgccccaagaaggaggcgccgattcctacagcgaggagtcagactccgacttgtccgacgtgcccgagttggattctgacattgagcaggaagcacagattaattatgaccgccaggtgtataaggaggatctaccccagctgaagcagcagtcaaaggagaaaaatcacgcagtcccctttctcaaaagggagaaggcccccgaagatagcctgaagctccagttcattcacgggtatagaggctatgactgcagaaataatctgttttacacacaggcaggagaggttgtgtaccacatcgccgcagtggccgtggtctacaaccggcagcagcatagccagcgactgtacctggggcacgatgacgatatcctttccctgacaattcaccctgtgaaggactatgttgccacaggtcaggtgggaagagatgccgcaatccatgtgtgggacactcagaccctaaaatgcctgtcccttctgaaagggcagcaccaaagaggcgtttgcgcactggacttttccgcagacggaaaatgcctggttagcgtgggacttgacgactttcacagtatagtcttttgggactggaagaagggtgaaaaaatcgccactaccagaggccataaggataaaatctttgtggtgaagtgcaatcctcatcacgtggacaaactggtaacagtgggtatcaagcatatcaaattctggcagcaggccggaggaggctttacctccaaaagaggcacttttggctctgttggaaagctggaaacgatgatgtgcgtgagttacgggaggatggaggatttggtgttctctggggcagccacgggggacatatttatctggaaagacatcttactgctgaagacagtcaaagctcacgacgggcccgtattcgccatgtacgcactggacaagggctttgtaaccggaggtaaagatggcatcgtagagctctgggatgacatgtttgagagatgccttaagacttatgcgatcaagaggagtgccttgagcacttccagcaaagggctgctgctagaagataatccttctatccgagcgattacgctgggccacggccacattctggttgggacaaagaatggagaaatcctcgagatagacaagtccggcccaatgaccttgctggtgcaaggacacatggagggggaagtttggggcctggcggctcacccactcctcccaatatgcgcaacagttagtgacgataaaacactccgcatctgggagttaagtgctcagcatagaatgctagctgttcggaagctgaagaaagggggtcggtgttgcgcctttagtcctgacgggaaagcattggctgtgggcctcaacgacggttcctttctcgtcgtgaacgcagacacagtggaggatatggtgagttttcaccatcgcaaagaaatgatctcagatatcaagttttcgaaggataccggaaagtatcttgcagtggcatctcatgacaatttcgttgatatatataacgttctgacaagcaagagagtgggcatttgcaaaggagccagcagctatatcacacacatcgactgggactcaagaggtaagctgttacaagtgaattcgggggctcgcgagcagcttttctttgaggcgcctcgtggcaaacgccacattataaggccgagtgagatcgagaagattgagtgggacacctggacctgcgtccttggcccgacatgtgaaggtatctggcctgcacactccgacattaccgacgttaatgccgcctccctgacaaaggattgctccctacttgcgacaggcgatgacttcgggttcgtgaagctcttcagttaccctgttaaaggacaacatgcgaggttcaagaagtacgtggggcattcagctcacgtgactaatgtgcgctggctccataatgacagcgtgctgctaaccgtggggggggccgacaccgccctgatgatttggaccagggagttcgtcggaacacaggaaagtaaattggtagacagtgaggaatcagacactgacgtggaggaggacggaggatacgactccgatgttgccagggagaaagcgatcgactatactaccaagatttacgccgtgagtatccgggagatggaaggtactaaacctcaccagcagctgaaagaggttagtgtggaggagaggccaccagtctctagagcggctccacaaccagagaagcttcagaagaacaatatcacaaagaaaaaaaaactggtggaggagctggctttagaccatgtcttcggctatagaggatttgactgcaggaataacttgcattatttgaacgatggagccgatatcatcttccacactgctgccgctggcatcgtgcaaaatctttcaacaggatctcagtccttctatctcgaacacacagatgatattttatgcctaactgtgaaccagcatccaaagtatcggaacgtggttgccacatcacaaatcggcacaacgccgtctattcatatttgggatgctatgacaaaacacacgctgtctatgctgaggtgtttccattccaagggtgtgaattacattaatttctccgcgaccgggaaattattagtgtcagtgggagttgatcccgagcacactataactgtgtggagatggcaggagggggccaaagtggcaagccggggaggacatctcgagcgcatcttcgtggtcgagttcaggcctgatagcgacacacagtttgttagcgttggagtgaaacatatgaaattttggacgctcgccgggagcgcactactgtacaagaaaggcgtgatcgggtcactcggggctgcgaagatgcagacaatgctgagcgtagctttcggagctaacaacctgacctttactggcgccataaatggcgatgtgtacgtctggaaggatcacttcttaatccggcttgttgctaaggcacataccggtcctgtgttcactatgtacacaacattaagggacggcctcatagtaacaggtggaaaggagcgcccaaccaaggagggaggagccgtcaagctgtgggatcaggaaatgaagcgatgtcgggcctttcagttagagaccggccagctcgtggagtgtgttagaagtgtatgccgaggcaaagggaaaatactggtaggtaccaaggatggagaaataatcgaggtgggagaaaaaaatgctgcctcaaatatcctcatagatggccacatggaaggcgagatctggggcttggccactcatcccagtaaagacctgttcattagtgcttccaacgatggtaccgcccgcatttgggatctggctgacaaaaagctgcttaataaggtgtctctcgggcacgccgcccggtgtgccgcctatagccccgacggtgaaatggtcgccatcggaatgaagaacggagaatttgtgattttactggtgaactctcttaaagtgtggggtaaaaagcgggaccgcaaatcagccatacaagacattagaatatctcccgataatcggttcctggcagttgggtccagtgaacatacagtggacttctatgacctgactcaggggaccaatttgaatcgcattggctattgcaaggacatcccaagtttcgtcatccaaatggacttttctgccgacggcaaatatattcaggtttcaacaggcgcgtataagcgccaggtacacgaagtccctctggggaaacaggtaaccgaggccgtcgtcattgagaagattacctgggcatcatggacctcggtgctcggtgacgaggtaattggcatctggcctcgaaatgccgacaaggctgatgtgaactgtgcgtgtgtgacacatgccgggctcaacatagtaaccggtgacgatttcggccttgtaaagctgttcgattttccttgtactgagaaatttgcaaagcataagcggtacttcgggcactccgcgcacgtgaccaatatccggttttcctacgatgataaatatgtcgtgtcaactggcggagatgattgtagtgtgttcgtctggagatgcctgtag

SEQ ID NO: 23967 - DNA, 630 bp, Artificial Sequence
  Description of Artificial Sequence: Synthetic coding sequence
atgaaccccagcatgaagcagaagcaggaggagatcaaggagaacataaagaacagcagcgtgcctagaaggacacttaaaatgattcaacctagcgcctcaggttcactcgtggggcgtgagaatgagttgtcagcaggcctttccaaacggaaacatcgcaatgatcatcttaccagcactacttcgtcccccggtgtgatagtaccagagtcaagcgaaaacaaaaacctagggggagtcacccaagaatcattcgaccttatgattaaagaaaacccttcttcccaatattggaaagaagtggcggagaagcgccggaaggcactgtatgaggctcttaaagaaaacgaaaaacttcacaaggaaatcgaacagaaggacaacgagatcgcacgtctgaaaaaggaaaataaggagctggccgaggtcgcggaacatgtccagtacatggcggaactcattgaaaggctgaatggcgagcccctggataatttcgagtcacttgacaatcaagaattcgactccgaggaagagacagtcgaggatagtttagtcgaagattctgaaattggtacctgcgcggaggggacagtatccagctccacggacgctaagccctgtatttag

SEQ ID NO: 23968 - DNA, 1635 bp, Artificial Sequence
  Description of Artificial Sequence: Synthetic coding sequence
atgaacaccagcatcccctaccagcagaacccctacaacccccgggggagttctaacgttatacagtgttaccggtgtggagacacttgtaagggagaagttgtccgcgtgcataacaatcattttcacattcgctgtttcacttgtcaagtctgtggctgcggactggctcagtcagggtttttctttaaaaaccaggaatacatctgcacccaggactatcaacagctgtatggaactagatgtgacagttgtcgtgattttataaccggagaggttatcagcgctctcggtcgtacatatcacccgaagtgttttgtgtgtagcctgtgccgaaaaccatttcccataggagacaaggtgacattttctggcaaagagtgcgtttgtcaaacctgttcccagtcaatggccagcagtaaaccaattaagatcagaggcccctcacattgcgcaggttgcaaagaggaaatcaaacacggtcagtcattactcgcactggacaaacaatggcatgtctcttgttttaagtgccaaacctgttctgtgatcttaactggagaatacatcagtaaggatggagtgccatattgtgagagcgattatcatgcacagtttgggattaagtgtgagacctgcgataggtacatttcaggccgcgtcctggaagccggtgggaaacattatcaccccacatgtgcccggtgtgtcaggtgccaccagatgttcaccgaaggggaagagatgtatctcacaggctccgaagtttggcacccaatctgcaaacaagctgcccgcgcagaaaaaaagctgaaacaccgtagaacctctgaaacatccatcagtcctcccggctcatccatcggtagcccaaatagggtgatttgtgacatttacgaaaacctggacctgcgacagaggagggcctcgagtccgggatacatcgattccccaacctattcccgtcaaggtatgtcacccacatttagccggagtccccatcactactataggtccggagacctcagtaccgcaacaaagagtaaaactagtgaagatatttcccagacctctaagtattcgccaatttacagccctgacccctactacgccagcgagtcagaatactggacctatcatggcagtcccaaagttcccagagctcggcgattctcctccggcggtgaggaggatgattttgatcggagtatgcacaaactgcagtccggcataggccggctaattctgaaagaggagatgaaggctagaagttctagctacgccgatccatggaccccacctagatcttcaactagctcaagggaagcactccacaccgccggctatgagatgtcactgaacggctcaccaaggtcacactatcttgcggattcagacccactgatctctaaaagcgcttctctacctgcttataggcggaacggactgcatcggactccctcggccgatctgttccattacgactctatgaacgcagtcaactggggaatgagggagtataaaatatacccctacgaacttctactcgtgacgactcgaggaaggaatcgacttccaaaggatgtggataggactaggctcgagggaaacttttggaagagcgggtgtctctag

SEQ ID NO: 23969 - DNA, 840 bp, Artificial Sequence
  Description of Artificial Sequence: Synthetic coding sequence
atgacccccagcgagggcgcccgggccggcaccggccgggagctggaaatgttagattctctgttagctttaggcggcctcgtgttattgcgcgacagcgtggagtgggaggggcggtctcttctcaaggccctggtgaaaaagtctgccctgtgtggcgagcaggtccacatcctggggtgtgaagttagcgaggaagagtttagggaaggcttcgatagcgacatcaataacagactggtgtaccacgacttctttagggatcctctgaattggtcaaagaccgaagaagctttccccggcgggcccctaggcgccttacgggccatgtgtaagagaacagatccagttccagtaaccatcgccctggatagcctgtcgtggctgctccttcggctgccatgcacaaccctgtgccaggtactacacgcagtgtctcaccaggactcttgcccaggcgactcttcgtcagtgggcaaggtgagtgtgctcgggctcctgcacgaagagctccacgggcctgggcccgtgggcgctttaagttcgctcgctcaaacggaggtgaccctggggggcaccatgggccaggcttccgctcatatattgtgcaggaggccccgccaaagaccgacagaccagacccaatggttcagcatactgcctgattttagccttgacctgcaggagggcccttcagtcgagtcccagccctattcggacccacatattccccccgtttcaaagaacgcaaaggcccggacgaggaaatgtagtctggtgtccggacatggccgggaaaataaaagctgtcgggggtgggggtgggggcagggtttttag

SEQ ID NO: 23970 - DNA, 405 bp, Artificial Sequence
  Description of Artificial Sequence: Synthetic coding sequence
atgagcgagaacgccgcccccggcctgtgcggcgagctgctgctgcaacgcggcacaaccaaagtggccaccggcctcgttctgaaccgcgatcaacggctcgcctgggctgagaattctatcgacttcatctctcgcgaactctgcgcccactcgatcaggaagctccaggcccatgttttacttataaaggctgtgcacgggtactttgacagccggcaaaactatagtgaaaaagagagcctcagtttcatgatcgataccatgaagtcgaccttgaaagagcaattccagttcgtggaagttcccggaaaccattgcgtgcatatgtctgaacctcagcacgtggctagcatcatcagctcctttcttcagtgtactcacatgctgcctgcccagctgtag

SEQ ID NO: 23971 - DNA, 1350 bp, Artificial Sequence
  Description of Artificial Sequence: Synthetic coding sequence
atgatgctgggcaccgagggcggcgagggcttcgtggtgaaggtgcggggcctcccctggtcttgtagtgctgacgaagtccagagattcttctccgattgcaagatccagaatggggctcagggcatcaggttcatctatacccgggaaggccggccctccggcgaagccttcgtggagctggagtcagaggacgaggtgaagctggcgttgaagaaggaccgggagaccatgggacaccgctatgtagaggtgttcaagtcgaataatgtcgagatggactgggttctgaaacacacggggcctaactcccccgacacggctaacgatggatttgtgcgccttcggggccttcctttcggatgtagcaaagaagaaattgtccagttcttttcaggcttagaaatcgtacccaacggcattaccctgcccgtggattttcaaggccggtccacaggagaggcgttcgttcagtttgcctcgcaagaaatcgctgaaaaagcccttaagaaacataaggagaggatcggtcatcggtacatcgagatctttaagtctagtagagctgaggtccggacccactacgatccccccagaaagctgatggctatgcaacggcccggcccttatgatcgacctggagccgggcgcgggtataacagcattggtcggggcgcgggattcgagcgcatgcggaggggggcctacggtggggggtatggcggatacgacgactataatggatataatgatgggtacggattcgggagcgaccgattcggtagagacctgaattactgtttcagcggcatgagtgaccacagatatggcgatggcggctcgacttttcaatcaaccaccgggcactgcgtgcacatgcgtggcctcccatacagggcaaccgaaaacgatatctataatttcttcagtccattgaatcccgtgagagtccacatcgagatcggccccgatgggagagtcacaggcgaagccgacgtagagttcgcaacgcatgaggacgccgttgctgctatgagtaaggataaggctaatatgcagcacagatacgtcgagctattcctcaactcgaccgcaggcgcatccggcggtgcctacgagcataggtacgtggaactgttcctgaattccacagcaggggcttcaggaggagcttatggctcacagatgatgggggggatgggacttagcaaccagtcgtcatacggcgggcccgcaagtcagcaacttagtggggggtacgggggaggttatggtggccagagctcaatgagcggctatgatcaggtgttgcaggaaaattccagcgacttccagtcaaacatcgcatag

SEQ ID NO: 23972 - DNA, 4077 bp, Artificial Sequence
  Description of Artificial Sequence: Synthetic coding sequence
atgggcaaccagctggccggcatcgcccccagccagatcctgagcgtagagagctacttcagcgacattcacgactttgagtacgacaaatcccttggttctaccagattcttcaaagtcgcccgcgcaaaacatcgagagggcttggtcgtggtgaaagtctttgctatacaggaccctacattgcccttgacctcgtataaacaagaactcgaagagctgaagattcgcctcaactccgcccagaactgtctcccttttcagaaggcaagtgagaaagcttctgagaaagcggcaatgttgttccggcaatacgttcgagacaacctctatgataggatcagcactagacctttcttgaataatattgagaaacgttggatcgcgttccagatattgacagccgttgatcaagcacataaatctggcgtgcggcacggcgatatcaaaactgagaatgtgatggttacttcctggaactgggtgctcctcaccgacttcgccagtttcaagccgacttatctccccgaagacaaccctgctgactttaattactttttcgacacttcaagaaggcgcacatgttacattgccccagagaggttcgttgatggaggcatgttcgcgactgagctggaatatatgagggatccaagcacgccattggtggacctcaactctaatcaacggacaaggggggagcttaagagagccatggacatcttctctgcgggctgcgtgattgctgaattgttcaccgagggggtaccactctttgatctctcacagctgctggcgtatcgtaacggccatttcttccctgagcaggtcctcaacaagattgaggaccacagcataagagagctcgtaacacagatgattcatagagagcccgacaagagactggaggcagaagactacctgaaacagcaaagaggaaacgcctttcctgaaattttttacacttttctacaaccctatatggcacaatttgcaaaggaaacattcctgtctgctgatgagagaatcctcgtgatcaggaaagacctgggaaacattattcacaatctgtgtggacatgatcttcccgaaaaagcggaaggagagcccaaagagaacggcctagtgatactggtgagcgtcataactagctgcctccaaaccctgaaatattgcgattcaaagctggcagctctcgagctcatcctccatctagccccgagactatccgtggaaattcttctggatagaatcaccccttatctgcttcacttcagcaacgatagtgttcctcgtgtgcgggcagaggctttgcgaaccctgacaaaggtgctggccctggtgaaagaagtgccacgcaatgatatcaacatctatcctgagtacatccttcccggcatcgcacacctggcacaggacgacgctaccatagtacgcttagcctatgcggagaacattgctttgctagctgagaccgccctgcgctttctggaattggtccagcttaaaaatttaaacatggagaatgatcccaacaatgaggaaattgacgaagtgacccatccaaacggtaactacgataccgagctgcaagctctccatgaaatggtacagcagaaggtcgtgactctgctgagcgatccagaaaacatcgttaagcagacattgatggagaacggaatcacgagattgtgcgtgttttttggcagacaaaaggccaatgatgtgttattgagtcatatgatcaccttcctgaatgacaagaatgattggcacctgcggggagctttttttgatagtattgtgggggtcgcagcttacgtcggctggcagtcgagctcaatcctgaaaccattactgcagcaaggcctctccgatgctgaggaattcgtgatcgtgaaggccctttacgctttaacttgcatgtgtcagctcggactgcttcagaagccacacgtttatgaattcgcctcggacatcgccccgttcctttgccaccccaatttgtggattcgatatggagctgttggcttcattactgtagtcgcccggcaaattagcaccgcggatgtctattgtaagctcatgccttatcttgatccttatatcacgcagccaattatccagattgagcgaaagcttgtgctcttatcagtattaaaggagccggttagtcgctcaatattcgattatgcccttcggagcaaagatattacctctttgttccgacacctccacatgcgccagaaaaaacgaaatggaagtctgcctgattgcccccctccagaggaccccgctatcgctcagttgctcaaaaaactgttgagtcaaggcatgaccgaagaggaagaggataagctcctagccctgaaagacttcatgatgaagagcaacaaggccaaggccaatattgtggaccagtcccatttacatgactcgtcgcagaagggcgtcatcgacctggcagcacttgggattactgggcggcaggtggatctggtcaagaccaaacaagaacccgacgataaaagagcgaggaagcacgtaaaacaggattcgaacgtcaatgaggagtggaagagcatgttcgggagtctggatccacctaacatgccccaagcactgcctaaaggatcagaccaggaagtcattcagaccggaaagcccccaaggtctgaaagctccgcggggatttgtgtgcccctgagcacttctagtcaggtgcctgaggtgaccactgtacaaaataaaaaaccggtcattccagtcctgtcttctacaatcctcccttccacgtatcagatccgaattactacgtgcaagacagaactgcagcagctgatacaacagaagcgcgagcagtgtaacgcagaaagaatcgccaaacaaatgatggaaaatgccgaatgggagtctaaaccccccccaccaggttggaggccaaagggactccttgtggctcacttgcacgaacacaagtccgctgtgaatagaattcgagttagcgatgagcactcactgttcgcaacctgctccaatgacgggacagtgaaaatctggaactctcagaagatggagggcaagaccaccactactcgatcaatcctgacatacagtcgcatcgggggtagggtcaagacactgacattttgccaaggctcacactaccttgcaattgcctcagataacggagcagtgcaactcctcggcattgaagcaagtaagctaccaaagagcccaaagatccatccactgcaatcacgcatactagaccagaaggaagacggatgtgttgtcgatatgcaccatttcaattccggcgcccagagcgtgcttgcttatgcaactgtgaacggcagcctggttggatgggatttgcgctcctcctccaatgcctggacactcaagcatgatctcaaatccggtctgatcactagttttgccgtggacatccaccagtgttggctctgtatcggtacttcaagcggtacaatggcctgttgggacatgaggtttcagctgcccatatcatcacattgccacccgagcagagcccgaatacggaggctgagcatgcatcccctgtatcagagttgggttatagcagctgttcaggggaacaacgaggtgagcatgtgggacatggaaaccggtgaccgtcgttttaccctctgggcctcctcggccccccccttgtcggagctgcagccctcccctcactctgtgcatggtatttattgttcgccagctgatggcaatccaattctcctgacagcaggtagtgatatgaagattcgattttgggatcttgcatatcccgagcggagctatgtcgtcgccggctcgaccagctcgccatctgtgagttactaccggaagatcatcgaggggacggaggtggtgcaggaaattcaaaacaagcaaaaggtgggccccagcgacgacacaccgaggagggggcctgagtctctgcctgtggggcatcacgatatcattaccgacgtcgctacttttcaaactacccagggatttattgtgaccgcatctagagatgggatcgttaaagtctggaaatag

SEQ ID NO: 23973 - DNA, 993 bp, Artificial Sequence
  Description of Artificial Sequence: Synthetic coding sequence
atgcccgtggtgaccaccgacgccgagagcgagaccggcatccccaaatccctgtcgaatgagcctccctcggagactatggaagagattgagcacacttgcccacagcctcggctgactctcacagcccctgctccattcgccgacgagaccaattgtcagtgccaggcccctcacgagaagctcacaattgcacaggcccgcttaggaacccccgctgaccggcccgttcgcgtgtatgcagatggaatatttgatcttttccatagcgggcatgccagggctttaatgcaggccaaaacactatttcccaactcctatttgctagtgggggtatgctctgacgatctcacacataagttcaagggtttcacggttatgaatgaagccgaacgctacgaagccctgagacactgccgctacgtggacgaggtgatcagagatgctccttggaccctcactccggagttcttggaaaagcacaaaattgactttgttgcacatgatgacattccttattcttctgccgggtctgacgatgtgtataagcacataaaagaggcaggaatgtttgttcccactcagcgaacggagggcatcagcacaagtgatatcatcactagaattgtgagagactatgatgtgtacgcaagacgaaaccttcagcgcggatataccgcaaaagagctcaacgtgagctttattaacgaaaagagatacagatttcaaaaccaagttgataaaatgaaagagaaggtgaaaaatgtggaggaaaggtccaaggaattcgttaaccgggtcgaggaaaagagccacgacctgattcagaaatgggaggaaaagtcaagagaattcataggaaactttctggaactatttggcccggacggcgcatggaagcagatgtttcaggagaggtcgtctcggatgctgcaggcgctgtcccccaaacagtcaccactcaagtcctgggcaagatgtcgcgatttttag

SEQ ID NO: 23974 - DNA, 2025 bp, Artificial Sequence
  Description of Artificial Sequence: Synthetic coding sequence
atgcagaccagcagcagccggagcgtgcacctgagcgagtggcagaaaaactacttcgctatcacctccgggatctgtactggccctaaagccgacgcataccgggcgcagatactgagaattcagtacgcttgggcgaattcagagatatctcaggtctgcgccactaagctgtttaaaaagtatgccgagaaatacagcgcaataattgatagcgataacgtggagtcaggattaaacaactacgctgaaaacattctgactttagccgggagtcagcagacagactctgacaaatggcagtcgggcctgtctatcaacaatgttttcaagatgagtagtgtgcagaagatgatgcaggcggggaaaaagtttaaggattcactcctggagcctgctctggcatcggtagtcattcacaaggaggcaaccgtgtttgacctgccaaaattctcagtttgcggcagcagccaagagtcggatagcctccccaattccgcccacgaccgcgatagaacccaagatttcccggaaagtaacagactgaaattgctgcagaatgctcagccacctatggtgacgaatactgcgcgtacttgtccaacattctcagccccggtgggtgagagcgccactgctaaatttcatgtaacaccactcttcggcaacgtgaagaaagagaaccattcatccgcgaaggaaaacattggcctgaacgtgttcttgagtaatcagtcttgctttcctgccgcctgtgagaatccccagcgcaaatcattctatggatccggtacaatcgatgctctgagcaaccctatcctcaataaagcctgcagcaagactgaagataatggaccaaaagaagactcctctttgcccactttcaagacagccaaggagcagctttgggttgaccaacaaaaaaaataccaccagcctcagagagcgtccggttcctcctatgggggtgtgaagaagtccctgggagcatctcggtctcgaggaatactgggaaagttcgtaccaccaatcccgaagcaggacggtggcgagcagaatggaggaatgcagtgtaaaccgtacggtgctggcccgaccgagcctgcacacccagtggacgaaagactcaaaaatctggaacccaaaatgatagagctgatcatgaatgagataatggatcatggcccccccgttaactgggaagatattgcaggggtcgagttcgccaaagcaactattaaggaaattgtggtctggcctatgcttcggcccgacatattcacaggattacgtggccctcccaagggaattcttctattcggtcccccgggtacaggaaaaaccttgatcggcaaatgcattgccagtcagtccggggcaaccttcttttccatatctgccagctctctaacgtctaaatgggttggcgaaggggaaaaaatggtcagggcgctttttgccgtagctcgctgtcaacaacccgccgtcattttcattgacgagatagactctctgcttagccaacgcggcgatggcgaacatgagtccagccgcagaatcaagacagagtttttggtgcagctagacggagcaaccacttcgagtgaagaccggatactggtagtgggagcaacgaacaggccgcaggagattgatgaagcggctcgacggagactggtgaagcgcctttatatccctctgccagaagcctctgcccggaagcagatcgttattaaccttatgagcaaagaacagtgctgtctcagtgaagaggagatcgaacagatagtccaacagtccgacgcctttagcggggccgacatgactcagctttgtcgggaagcatctctcgggccaatccgaagcctgcagaccgcggatatcgctacaattacacctgaccaggtgagaccgatagcatacatagatttcgaaaatgcctttaggactgttaggccttccgtcagccctaaggacctggagctgtatgagaactggaataaaacctttgggtgcgggaagtag

SEQ ID NO: 23975 - DNA, 1143 bp, Artificial Sequence
  Description of Artificial Sequence: Synthetic coding sequence
atgctgcggcggaagcccagcaacgccagcgagaaggagcccacccaaaaaaaaaaactctcccttcaacgatcaagctcgttcaaggattttgcgaaatccaaaccctcaagtcctgtggtttctgaaaaggagtttaaccttgacgacaatattccagaggatgattcaggcgtacctacccccgaagacgccggcaaatcggggaagaagctgggcaagaaatggcgggccgtgatttcaaggaccatgaataggaaaatgggtaaaatgatggtgaaagcattatctgaggagatggcagataccctggaagaggggtcagcgagtccaacaagtcccgactactctctcgacagtcctgggcccgagaaaatggccttagccttctccgagcaggaggaacacgaactgcccgtgctgagtaggcaggccagcaccggctccgaactttgcagcccatcccccggtagcggttcctttggagaggaaccccctgctcctcagtataccgggccattttgtggcagggccagagttcacactgattttacgcccagcccgtacgatcatgactctctgaaattgcagaaaggggacgtaatacagatcatagaaaagccgcccgttggcacctggctcgggctgctgaacggcaaagttgggagctttaagttcatttatgtcgacgtgctccccgaagaggcggtggggcatgctcgcccctcccggaggcaatcaaaggggaagcgcccaaagcccaagactctgcacgaattgctggaacgtatcgggctggaggaacatacttccactttactgctcaatggctaccagactctggaagatttcaaagagctgcgggagactcacctgaatgaattaaatatcatggatcctcagcacagggcgaaactactgactgctgctgagctgctgctggactacgatacaggctcagaggaagcggaagagggggccgaatcctctcaggaacccgtcgcccacacagtgtccgagccaaaggtcgacatccctcgggatagtggatgttttgagggcagcgagtctggccgcgatgacgccgagctggccggtaccgaggagcagcttcagggtttaagcctggcaggcgccccctag

SEQ ID NO: 23976 - DNA, 1692 bp, Artificial Sequence
  Description of Artificial Sequence: Synthetic coding sequence
atgaaccccctgttcggccccaacctgttcctgctgcagcaggagcagcaaggccttgctggtccccttggcgactccctggggggtgaccatttcgccggaggaggtgacctcccacctgctcctctctcccctgccgggcccgccgcttactcaccacctgggccaggacccgcgccacctgccgccatggcattacgcaacgatctcggcagcaacatcaacgtgctgaagacactgaatctgcgttttcggtgtttcctcgcgaaagtgcacgagctcgaacggcggaacagattactcgaaaagcaacttcaacaagctctcgaggagggcaagcagggcagacgaggacttggccgaagggaccaggccgtgcaaaccggtttcgtgtctcccatccggcctttgggtttacagctcggggccagacctgccgctgtatgctccccgagtgcccgagtcctcggaagtccggcaagatcgccagccgggccgcttgcccctagcgccgcttccctatcctcaagtagtacttccacttccacgacttattccagctctgcacggtttatgcccggcactatctggagctttagtcatgcacgccggcttgggcccggactcgaacctaccctcgtacagggccccgggctttcctgggtgcaccctgatggtgtgggcgttcagatagacacgattactcctgaaattcgtgcattatacaacgtgttggctaaagtgaagcgggaaagggatgaatataagcgaagatgggaggaagaatacacagtgcgcatccagctgcaggatagagtgaatgaactgcaggaagaagctcaggaggcagacgcctgccaagaggagctggccctgaaagttgagcaacttaaggccgagctggtcgtctttaaagggctcatgagtaacaacctgagcgaactcgataccaagatccaggaaaaagcaatgaaggtcgatatggacatctgtaggcggatcgacatcaccgctaagctgtgcgatgtcgcccaacagcgaaactgcgaagacatgattcagatgtttcagaaaaagcttgtcccgagtatgggaggccggaagagggaacggaaggctgccgtcgaagaggacacgagcctgtccgaatccgagggccctaggcaacccgatggggacgaggaggagagcactgccctttccattaacgaagagatgcagaggatgctgaatcagctcagagaatatgattttgaagacgactgtgacagcctgacttgggaggagactgaagaaacactgcttctttgggaggacttctctggctatgcgatggccgccgccgaggctcagggtgagcagcaagaagactcattagagaaggtcattaaagatactgagagtctctttaagacaagagaaaaggaatatcaggagacaattgaccaaattgagctcgagctagcaaccgccaaaaatgatatgaaccgacatctgcacgaatatatggaaatgtgctcaatgaagaggggacttgatgtccagatggaaacctgtcggagactcattacacaatctggagataggaaatcccccgctttcacagcagttccactctcagacccacctccccccccatctgaagccgaggattcggacagggatgtgagcagcgacagctcgatgaggtag

SEQ ID NO: 23977 - DNA, 1893 bp, Artificial Sequence
  Description of Artificial Sequence: Synthetic coding sequence
atgctgttcctggccatcccccagagcatcgacgaggagaccgaggtgtggtcagaccacattatttttccgcgtattcccaggggtcccgttcagcagcctctggaagatcggatcttcactccagcagtgtctgccgtttattcaacagtgacccaggttgctcgacagcctggaacccccaccccctctccttattctgctcacgaaatcaacaaaggacaccctaatttggccgccaccccacctggccatgctagttcccctggactttctcagaccccttaccccagcggtcaaaacgccggacctaccacactagtttacccccagactccgcagacaatgaactcacagccccagacgagaagcccctttgctgcggggccccgccctccccaccatcagtttttccaacgcccccaaatacaacctcctcgagctaccatccccaactcctccccaagcattaggcctggggctcagacccctacagctgtctatcaggcaaaccagcacatcatgatggtgaaccacctgcccatgccatatccagtaccccagggaccccaatattgcatcccccagtatcgacactctggacctccctatgtggggccccctcagcagtatcccgttcagccacccgggccgggtcctttttatccgggaccaggcccaggcgacttccctaacgcgtatggaactcccttttaccctagccagcctgtctatcagtctgctccgatcattgtccccacacagcagcagccgccacccgcgaagcgggaaaagaagaccatccgcatacgtgatcctaaccagggagggaaagacatcactgaagagataatgagtgggggaggtagtcgtaaccccacacctccaatcgggcgtcctacatctacccctacccctcctcaacaattaccctcccaggtacccgaacacagccctgtcgtgtatggtacggttgaaagcgcccacctggctgcgagtacccccgtgacagcggcctcagaccaaaaacaggaggaaaagccaaaacctgatccagtgctgaagagtccctcgccggttcttaggctggtgctctctggggagaagaaagaacaggaaggccagactagcgaaacaaccgctatcgtgagcatcgccgagcttccactgccaccaagccccacgactgtctcctctgtcgctaggagcacaatcgcagcaccgacaagctccgctctgtcttctcagcccatctttacgacggccattgatgacaggtgtgagctgtctagcccccgagaggataccatccccatccctagtctaacgtcatgcactgagacctccgacccgttgccaaccaatgagaatgacgatgacatctgcaaaaagccatgcagtgtcgcccctaacgatattcccctggtctcatctaccaatcttatcaatgaaataaacggcgtgtccgaaaagctgtcagcgacagagtctatcgtagaaattgtgaagcaagaggtgttacctttaacgcttgaactggaaatactggaaaatccgcccgaggagatgaagctcgagtgtattcccgccccaatcactcccagcaccgtgccaagttttcctcctacgcctccgaccccacccgcatctccgccacacacgccagtgatcgttcccgcagccgcaaccactgtctcctctcccagtgcagctataaccgtccagagggtcttggaggaagatgagagcattaggacatgcctttcggaggatgcaaaggagattcagaacaaaattgaggtggaagccgatggccagaccgaggagattctagactcccagaacctgaactcacgtcgaagcccggttccggagacaagcaatgagtgctag

SEQ ID NO: 23978 - DNA, 414 bp, Artificial Sequence
  Description of Artificial Sequence: Synthetic coding sequence
atgatcctgcccaccaaggccatggccacccaggagctgaccgtgaagcgcaaactcagtggcaatactctgcaggtccaggcatcaagccctgtagccttaggagtcagaatccctaccgtcgctctccacatgatggagctgtttgataccacggtcgagcagctttactcaattttcaccgtgaaagagctgacaaataaaaagatcatcatgaaatggcgttgcggaaactggccggaagaacattacgctatggtggccctcaatttcgtacctacactcggccagaccgaactgcaactcaaggagttcctgtccatctgtaaagaggagaacatgaaattctgctggcagaagcagcactttgaagagatcaaggggagcctgcagttaacaccattgaatggttag

SEQ ID NO: 23979 - DNA, 1248 bp, Artificial Sequence
  Description of Artificial Sequence: Synthetic coding sequence
atgatgctgggccccgagggcggcgagggcttcgtggtgaagctgagggggctgccatggtcgtgcagcgtggaggatgtgcaaaattttctcagcgactgtacaatccatgatggcgctgcaggcgtgcacttcatctacacgcgtgagggtagacaaagtggagaagctttcgtcgagttagggtccgaagatgacgtgaaaatggccttaaagaaggatagagaaagcatgggccataggtacatcgaagtttttaagagccaccgaacagaaatggactgggtcctcaaacatagtggaccaaactctgcagactcggctaatgacgggttcgtccggctgcgcgggttgccattcggctgcaccaaggaagaaatcgtccagttcttttctggcctggagattgtaccgaatggcatcacccttcctgtcgatccagaagggaaaattacgggtgaggcctttgtccaattcgccagccaggagttagccgaaaaggccctcggcaagcacaaagagcggattgggcatagatacatcgaagtgttcaaatcgtcccaggaggaagtccgttcctatagtgaccctcccttgaagtttatgtccgtacagcggccgggaccatacgacaggcctggcacggcccggagatatattgggattgtcaaacaagccggtctggagaggatgagacctggggcctactcaacaggctacggtggctatgaggagtacagcgggctatccgatggatacgggttcaccacagacttgtttgggcgcgacttaagctattgcctcagcggcatgtatgatcaccggtacggcgattcggaatttactgtacaatcgactacaggacactgtgtacatatgcgcggactcccgtacaaggcaacagaaaatgatatctacaattttttctctcccctcaatccagtgcgcgtgcatatagaaattgggccagacggccgtgttaccggggaagcggacgttgaatttgccacgcatgaggaagccgtggctgcgatgagtaaagaccgcgcaaatatgcagcacaggtacattgagctttttctgaattccaccactggtgcctctaacggggcctacagctcccaagttatgcaagggatgggtgtttctgctgcacaagcaacctactcaggcctggagtcacagagcgtgtcaggttgctacggggccgggtacagcgggcagaactccatggggggctatgattag

SEQ ID NO: 23980 - DNA, 1464 bp, Artificial Sequence
  Description of Artificial Sequence: Synthetic coding sequence
atgagcagccccctggccagcctgagcaagacccggaaggtgcccctgccctccgagccaatgaaccccggccggcgcggaattagaatctacggagacgtacccgcctctcacgactctgaactgatggcttttatgactaggaagctctgggatttagagcagcaggttaaagcccaaaccgacgaaatcttgtcgaaagatcagaaaatcgccgccttagaggacctggtccagacactacgcccacatcctgccgaggctacactccagcgccaggaggagctcgaaactatgtgtgtacagctccaaagacaggtccgcgagatggagcgtttcctgtcagattacgggttacagtgggtcggagagcccatggaccaggaagattccgagtctaaaaccgtctctgaacatggcgagagagactggatgactgctaagaaattctggaaacccggagattctctagctccacccgaggtggatttcgatagactactcgcctctcttcaggatctgagcgaactggtggttgaaggcgacacccaggttactccagtgcccgggggagctagacttagaacacttgagcccattcctctgaaactgtatcggaacggcattatgatgtttgatggaccttttcaacctttctacgatccatctacacagcgctgcttgcgggatatcctagacggattctttccaagtgagctgcagcggctgtatcctaacggcgtgccgtttaaggtctcagatctcagaaaccaggtatacctggaagatggacttgacccattccccggcgaagggcgcgttgtgggccgacaactgatgcataaagcccttgacagagtcgaggaacatcctggaagtcggatgacagctgagaaattcctgaaccgcctgcccaagttcgtgatcagacagggggaggtaatagatattagaggcccaatacgagatacactgcagaactgctgcccactgcctgcccgcatccaggagatcgttgtggagacaccaaccctggccgccgaaagggaacgtagtcaggagagtcctaacactcccgccccccctctctcaatgttacgcatcaagtcggaaaacggggagcaggcgtttctcctgatgatgcaaccagacaatactattggggacgttcgcgccctgctcgctcaggccagagtgatggacgcatccgcttttgagattttttccacctttcctccaacactctaccaggacgacacactgactctccaggcagccgggctcgtaccaaaggctgcgctgttgctccgcgcccgccgagcacctaagagttcactcaaattctcaccagggccttgtccaggcccggggccagggccctccccaggcccaggccccggaccttcgccaggcccaggacccggcccttcaccttgtcctgggccttctccatccccgcaatag

SEQ ID NO: 23981 - DNA, 1467 bp, Artificial Sequence
  Description of Artificial Sequence: Synthetic coding sequence
atgagcgccttctgcctgggcctggtgggccgggccagcgcccccgccgaaccagatagcgcctgctgtatggagctgcccgccgcagctggagacgctgtaaggtctcccgcggctgccgcagctttgatcttccctgggggatcaggcgaactggagttggcacttgaagaggagctggctcttctggctgctggtgagcggccttcggaccccggagaacacccccaagccgaattactttcggtgatccgacagaaggagaaggaccttgtgttagcagcccggctcggcaaggcgttgttggaacgaaatcaggacatgtcccgacagtacgagcagatgcataaggaattaaccgacaagcttgaacacttggagcaggagaagcacgagctgcgccgtaggtttgagaacagagaaggggaatgggagggcagggtgtctgagcttgaatccgacgtcaagcagctgcaagacgaattagagcggcagcagattcacctgcgagaggcagatcgtgaaaagtccagggccgttcaggaactttcagaacagaatcagcgcctgctggaccagttatccagggccagtgaggtggagagacaattgagtatgcaggtgcatgccctcagagaagactttagagaaaagaactcatccacaaatcagcacattatccgacttgaaagcctccaagcagaaattaaaatgctatcagataggaagcgcgagctggagcatcgactgtcggccactttagaagaaaacgatctcctccagggaacagtggaggagctgcaagaccgcgtgctgattctggagcggcaagggcatgataaagatctgcagctccaccagtctcagctggagctccaggaggtgcgcctgtcctgcagacagctgcaggtgaaggtggaagaactgaccgaggagaggagtctgcagtcttctgcagcgactagcacttctctgctttcggagattgagcagtctatggaagcagaggagttggagcaggaacgggagcagctgagactgcagctttgggaggcttattgccaggtgagatatttgtgttcccacctaagaggcaatgattcagccgactcggccgtgtcgaccgatagctccatggacgagtcctccgaaaccagctctgctaaggatgtgcctgcagggagcctgagaacggccttaaatgaactgaaaaggctgatccagagcatcgtagacgggatggaaccaaccggctcacgtcgcctcgatgatgactcgctggaggaacagattcgacagacatcggaagattctagagccctgagggaactcatggagggagaacgaggtcgtctaccagaggcctcccgctgctgcctccccgcttgtagccagccaatccaatctcccagtctgccacacgtcggcaaggcacagcagggttgcgcagccaggatgtacctctag

SEQ ID NO: 23982 - DNA, 1428 bp, Artificial Sequence
  Description of Artificial Sequence: Synthetic coding sequence
atgacccggggcaccggcggcaccgcccagcggggccggagcggccccgactcccagggactgctggattcttccctcatggcctccgggacggcatcccggtccgaggacgaagagtctttggctggacagaaacgcgcatcatcccaggcactaggcactatccctaagaggagatcctcaagccgatttattaagcgaaagaagtttgacgatgaactggtggagagctctctggcaaagagtagcacaagagctaagggagccagtggggtggagccggggagatgcagcggaagcgagccaagctcgagcgagaagaagaaggtctccaaagccccttccacccctgtcccccccagtcccgcaccggcgccaggattaaccaaaagggttaagaagtcgaaacagcccctgcaggtcaccaaggacctaggaagatggaagcccgccgatgacctactgctcattaatgcagtcctgcagacgaacgacctcaccagcgtgcacttgggggtcaagttctcttgtcggtttacgctgcgtgaggtgcaggagaggtggtacgcactgctgtatgatcccgtgatcagcaaacttgcttgccaggccatgcgtcagctccaccccgaggccattgctgctattcagtccaaggcccttttttccaaggccgaagaacaactgctgagtaaagtcggctcaacgagtcagccaacactggagacattccaggacctgttgcatcgccaccctgatgcattctatctggcccgcacagcgaaggctctccaggctcactggcaactgatgaaacagtactacctgctggaggaccaaactgtccagcctttacctaaaggagaccaggtactcaactttagcgacgcggaggatctgatcgacgatagcaagctgaaggatatgagggatgaagttttggagcatgaactcatggttgctgatcggcgtcagaagcgcgaaattcgccaactggagcaagagctgcataagtggcaggtactcgttgattctatcacaggcatgagcagccccgactttgacaaccagactttggccgtactccgtgggaggatggtaaggtatctgatgcgaagtagggagataacattaggccgagccactaaggacaatcagattgatgtggatctttctctagaggggcccgcgtggaaaatctctaggaaacagggggtgataaagctgaagaataacggcgattttttcatcgccaacgaaggccgaagacccatttacatcgatggtcgacctgttttgtgcggttctaagtggcggctgagcaataacagcgtggtcgaaattgctagtctcagatttgtgttccttattaaccaagatttaatcgccttgataagggccgaggccgcaaagatcaccccccagtag

SEQ ID NO: 23983 - DNA, 1311 bp, Artificial Sequence
  Description of Artificial Sequence: Synthetic coding sequence
atggccgacggcggcagcgagcgggccgacggccggatcgtgaagatggaagtggattattctgcaacagtggatcagaggctgcccgagtgtgctaagctagctaaagcttcggacatggtgtccacgtcccgcattttggtggctgtcgttaagatgtgttacgaggcgaaggagtgggacctgctcaacgaaaacatcatgctgctttccaagagacggtctcaacttaagcaggcggtggctaagatggtgcagcaatgctgcacttacgtggaagagatcacggatctacctataaagttgagactgatagatacccttcgcatggtgaccgagggaaaaatttacgtagagatagaacgagcacggctgaccaagaccttggctacgatcaaagagcaaaacggcgatgtcaaggaagccgcctccattcttcaggaactgcaggtcgagacatacggctccatggaaaaaaaggagcgcgtggaatttattctcgagcaaatgcggctgtgtcttgccgttaaagattacatcaggacgcagattatctcaaagaagattaatacaaaattttttcaggaggaaaacacagaaaagctaaagctcaaatactacaacctgatgatccaactggaccagcacgagggctcctacctgagcatctgcaagcactatagagctatctatgatacaccatgtatccaggccgagtctgagaaatggcagcaagccctcaagtcggtcgtgctctatgtgatactagcaccttttgataatgaacagtccgacctcgtgcacagaatcagcggggataagaaactagaagagattccaaaatacaaggatctcctgaagctctttactacgatggagcttatgcggtggagtacacttgtggaggactacggaatggagctgcgtaaagggagcttggaaagtcctgcaaccgacgtttttgggagcacagaggaaggagagaagcgctggaaggacttgaagaatcgagtggtggagcacaatattcggattatggcaaagtactatacccgcattactatgaagcgaatggcccagttactggacttatcggttgacgagtctgaggcctttctgagcaacttggtggtgaacaagacaatatttgcaaaagtggatcgcttggctggaatcataaacttccagcggcccaaggatccaaacaatctgctgaacgactggtcgcaaaaattaaatagccttatgagcctcgtgaataaaactacacaccttattgccaaagaagaaatgatccataacctccagtag

SEQ ID NO: 23984 - DNA, 1974 bp, Artificial Sequence
  Description of Artificial Sequence: Synthetic coding sequence
atggacgaccccgactgcgacagcacctgggaggaggacgaggaggatgctgaagatgccgaagacgaggactgtgaagatggtgaagctgctggcgccagagacgctgatgccggcgatgaagacgaggaatcagaggaacctcgcgctgctaggccaagcagctttcagtccagaatgaccggtagccgtaattggagggctaccagggacatgtgcagataccgccataattatcccgatctggttgagagagattgtaatggagatacccccaatctgtccttttatcggaatgagatccgttttttgcccaacggatgtttcatcgaagatattttgcagaactggaccgacaactatgatctgttggaagacaatcactcctacatccagtggttgtttcccttgagggagcctggcgtgaattggcatgccaagccgcttacgcttcgcgaggttgaagtgttcaagagctctcaggagatccaagaacgcctcgtgcgagcctatgaactcatgcttgggttctatggcattcgactcgaagatcgtgggactgggactgttgggcgtgcccagaattaccagaaacgctttcagaacttgaattggagatcacataataatctgcggataacacgaatcctaaagagcctgggtgagctggggctggaacacttccaggccccactggtaaggtttttcctggaagaaacactggtccgaagggaactaccaggggtgaggcagagcgcactggattacttcatgttcgctgtacgctgccgacaccagcggcggcaattggtccattttgcgtgggaacacttccggccccgatgcaagtttgtatggggtccccaggataagctgagaaggtttaaaccttcctccttgccccaccccttggaaggttcccggaaggttgaggaggaaggctcccctggggaccccgatcacgaagcaagtacacaaggccgaacctgtgggccggagcattccaaggggggggggagagtggacgaaggcccccagccgaggtcagtcgagcctcaagatgctggacctctcgaacgaagccagggcgatgaggccggaggccacggtgaggatcggcctgaaccactctcaccaaaagagtcaaaaaaacggaagttagagctgagtcgcagggagcagccgcctactgagcctgggccacagtccgcctcagaggtggaaaaaatcgccctgaacctagaaggatgtgcattgtcccaagggagcctgaggacgggcacccaggaggtagggggtcaggatcccggagaagctgtgcaaccctgtaggcagcctctgggcgcgcgggtcgcagacaaagtgcggaaacgtaggaaagtcgacgagggtgctggcgactctgccgcagtggcttccggcggcgcccagaccctcgccctggctggcagccccgctccctcaggccaccctaaggctggccactccgaaaatggggtggaagaggataccgaaggcagaacgggccccaaagagggcaccccagggtcaccttccgagacacccgggcccagcccagcggggcctgcaggggatgagcctgctgagagtcctagcgagactcccggaccaaggccagccgggcctgccggcgatgaaccggccgaatcgccaagtgagacaccaggaccttctcccgcaggcccgactcgggacgaacccgctgaatctcctagtgagacaccaggccctcgaccagccggtcccgcaggggacgagccggctgagtcaccctctgagacgcccggaccccgcccagctggaccagcgggagacgaaccagccgagtcgcctagtgagactccgggtccgagcccagccggccctactagggacgaacccgcaaaggctggcgaagctgcagaactccaggacgccgaggtcgaaagctcagccaagagcggcaagccatag

SEQ ID NO: 23985 - DNA, 615 bp, Artificial Sequence
  Description of Artificial Sequence: Synthetic coding sequence
atggaccccaaggaccggaagaagatccagttcagcgtgcccgcccctccgtcgcaattagaccccagacaggtcgagatgattcgcaggagaagaccgacgcccgcaatgctgtttaggctctccgagcactctagcccagaagaagaagcatcaccacaccagagggcgtcgggtgagggccatcatctgaaatccaaacggcccaatccttgtgcttatacccctccgagcctgaaggctgtccagcgcatagcagagagccacttacagagtatctctaacctgaatgagaaccaggccagtgaggaagaggatgagctaggagaactgcgcgaactcggctaccctcgagaagaagacgaggaagaggaggaagatgatgaagaggaagaggaagaagaagacagccaggccgaggtgctgaaagttataaggcagtcagcaggtcaaaagaccacttgcgggcaaggcctcgagggaccttgggagaggccaccaccactcgatgaatccgagagggacggggggagcgaggatcaggtagaggacccggctctgtccgaacccggtgaggagccccagaggccttctccctctgaacccggcacatag

SEQ ID NO: 23986 - DNA, 3042 bp, Artificial Sequence
  Description of Artificial Sequence: Synthetic coding sequence
atgggctggaagcccagcgaggcccggggccagagccagagcttccaggccagcggattgcagccccgcagtctgaaagctgcccgccgcgccactgggaggccagataggtcacgagcagcccgacctactatggacccatcagctcacagaagcagggcagctcctccaaatatggatcccgatcctcaagctggcgtccaggtgggaatgagagtcgtgaggggtgtggactggaaatggggacagcaggacggcggggaaggaggagtgggaacagtagtcgagctgggacgccacggcagccctagtactcctgaccgtacagttgtggtgcagtgggaccaaggcaccagaaccaactacagagctggataccagggggcccatgacttactgctctatgacaatgcccagatcggagtgcgccatccgaatatcatctgcgactgctgcaaaaaacacggcttgagaggaatgcggtggaagtgtcgtgtgtgcttggactacgatttatgtacgcaatgctacatgcacaataagcacgagttggcacatgcttttgatagatatgaaacagctcactccagacctgtgacccttagtccgcggcagggactgccacgaatcccgctgagaggaattttccagggagcgaaagtcgtgcgcggtcctgattgggagtggggtagccaggacggtggagagggaaaaccaggtagggtggtggacatcagaggttgggatgtggagaccggaagatccgtggcttcggttacatgggcagatggcacaactaatgtgtaccgcgtgggccacaaaggcaaagttgacctgaaatgcgtaggcgaggcggctggtggcttttactacaaagaccatctgcctaggttaggcaaaccagccgagctgcagcgccgggtcagcgccgactcgcaaccctttcagcacggagacaaggtgaagtgtttactcgacacagatgttctcagagaaatgcaggagggtcacggagggtggaacccccgcatggccgaatttattggccagaccggaactgtccatagaatcactgacagaggtgacgtacgcgtgcagtttaatcatgagaccagatggacgtttcaccccggcgcacttacgaaacaccacagtttctgggtgggcgacgtggtgcgggtgattggcgatcttgataccgtgaaacggttacaggcaggtcatggcgagtggaccgacgatatggcaccagctcttggaagggtgggaaaagtagtcaaagtgttcggcgacggcaacctgcgcgtggcagttgcagggcagcgctggaccttctcacccagctgtcttgtcgcatataggcccgaggaagatgccaatctggacgtggccgagcgcgctcgggagaacaagagctctttaagcgtggccttggacaaattacgggcacaaaagtccgaccctgagcatcccggcaggctagtggtcgaagtggcccttgggaatgccgctagagcccttgacttgctgcggcgccgtccagagcaggtggacacaaagaatcaggggcggacggctctgcaggttgcggcatatctcggccaggtagagcttataagactgctgttacaggcccgggcaggggttgatctgcccgacgacgaaggaaacacggccctgcactatgctgctttgggcaatcagccagaggccacaagagtccttctgtctgccggctgtagggccgatgctataaactcaacacagtccacggctctccatgtggctgttcagcgtggtttcctggaggtcgtgcgcgccctatgcgaaagaggctgtgacgtgaaccttcccgatgcccacagtgacactccccttcacagtgctatttccgccggtaccggcgcatctggaatcgtggaagtgttgacagaagtccccaacatcgacgttaccgccacaaattcacaggggttcacactcctgcatcacgcaagtttgaaagggcacgcactggccgtgaggaagatactggcccgggcgagacaactggtggatgctaagaaagaggacggctttacagcccttcatctggccgcactcaacaaccaccgggaggtggcacaaatcctgatacgtgaaggaagatgtgatgttaatgtgaggaaccgcaagctacaatcaccgctccatctagcagtccagcaggcgcatgttgggctcgttccactgctggtggacgctggctgtagcgtgaacgctgaagatgaagagggcgatactgctctgcacgtagctctgcaaagacatcagctgcttcctctggtggctgacggagcaggcggcgaccctggaccgctgcagctgctcagtaggctgcaagccagtggcctgccagggtcagcagagctcacggtgggcgcagccgtggcctgttttctggcgctcgagggagccgacgtcagctacaccaaccataggggccgcagccctttggacctggcagctgaaggaagagtgctgaaagccctgcaagggtgcgcacaaagatttcgcgagcggcaggccgggggcggagctgccccaggaccacggcagaccctcggaactcctaacacggtgactaatttgcatgtgggcgccgcacctggccctgaagcagcagagtgtctggtctgctccgagttagcattgctggtgctgtttagcccgtgccagcaccggactgtttgtgaagaatgcgctcgacgaatgaagaagtgcatacggtgccaggtggtcgtgagcaagaaattacggcctgatggctccgaggtggcctctgctgcgcctgctcctggccctccgcgacagctggtcgaggagcttcagagccgctaccgccagatggaggagaggatcacctgtcctatatgcatcgatagtcatatccgtttggtgtttcaatgtggccatggagcctgtgctccctgtggctccgccctgtcagcttgcccaatatgccggcagccgattcgggatagaatccagatcttcgtttag

SEQ ID NO: 23987 - DNA, 2055 bp, Artificial Sequence
  Description of Artificial Sequence: Synthetic coding sequence
atgatccccccccaggaggccagcgcccggcggcgggagatcgaggacaaattgaaacaagaggaggagaccttatcctttatccgcgatagcctagagaagtctgaccagctgaccaaaaacatggtgtcaattctgagtagcttcgagtcacgtctgatgaaactggaaaacagcattattcccgtgcacaaacagaccgaaaatttacaacgcctgcaagaaaatgtcgaaaagacccttagttgccttgaccatgtgatttcatattaccatgtcgcatccgacacggagaaaattatacgggaaggcccaactgggcggttggaagagtacttgggctcgatggccaagatccagaaggccgtagaatatttccaggataactctccggattcccctgagctaaataaggtgaagctactctttgagcgggggaaagaggcactggagagcgagttccgctcattgatgacccgccattctaaggtggtttcacctgtgctcatactggacctcatctctggggatgacgatcttgaggctcaggaggatgtcaccctcgaacatttaccagagtctgtgttacaggacgttattcggattagccgctggctggtagagtatggccgaaatcaagactttatgaatgtctactatcagattagaagcagccaactggacagatcaatcaaaggccttaaggagcatttccataaaagttccagcagcagcggcgtgccatatagccctgctattcccaacaaaagaaaagacacgcccacaaagaagccagtcaaaaggccaggcactattagaaaggcacaaaacttgcttaagcagtacagccagcacggcttagacggcaaaaaagggggctctaatctgattcccctagagggcagagatgatatgttagacgtggaaaccgacgcctacatccactgcgtgtcagcctttgttaagctcgctcagtccgagtatcagctcctcgccgatatcattcccgagcatcaccagaagaaaaccttcgacagcctgattcaggacgcgctggatggcctaatgctggagggagagaacatcgtgtcggcggcccgtaaagcgatcgttaggcacgatttctccacagtgctgacagtattccctatccttcggcatctgaagcagaccaagcccgagtttgatcaagtactgcaggggacagctgcttccacgaaaaataagctcccaggactgattacaagtatggagaccattggagccaaggcccttgaagacttcgcagacaatatcaaaaatgatcccgacaaggagtacaatatgcctaaggacggaacagtccacgagcttactagcaatgctatcctgttcttgcagcaacttttggattttcaggaaaccgccggggcaatgttagcatctcaggagacgtcgagttctgctacctcttactccagcgaattttccaaaagactcctttcaacgtatatttgtaaggtcctgggcaacctacagctcaacctgttatccaagtcaaaggtatacgaggatccagctctttccgcaatctttctgcacaataactataattacatactcaagtccttagagaaatccgaattaattcagctcgtggcagtcacacagaagacagccgaacggtcctaccgcgagcatatcgaacaacagattcagacttatcagcggtcatggttaaaggtcacggactatattgctgaaaagaatctgccagtgtttcaacccggagtgaagttacgagataaggaacgtcagattattaaggagagattcaaaggatttaacgacgggctcgaggagctgtgtaaaatccagaaagcgtgggccattccagacactgaacagcgtgataggattagacaggctcagaagaccattgtaaaagaaacgtatggagcctttctgcaaaaatttggctctgtgccctttactaagaatccagagaaatatatcaagtacggcgttgaacaggtgggcgatatgatcgaccggctgttcgatacaagtgcttag

SEQ ID NO: 23988 - DNA, 3576 bp, Artificial Sequence
  Description of Artificial Sequence: Synthetic coding sequence
atgcccgtgcaggccgcccagtggaccgagttcctgagctgccccatctgctacaatgagtttgacgaaaacgtgcataaaccgatctcactcgggtgcagccacacagtgtgcaagacatgccttaataaattacaccgaaaggcttgtcccttcgatcagacggccattaataccgatattgacgtcctcccagtaaacttcgctctgctacagctggtgggggcacaagtgcccgaccaccagagtatcaaactgtcaaacctgggggaaaacaaacactatgaggtggccaagaagtgcgttgaggacctggccctctatctgaagccgctgagtggcgggaagggcgtcgcctcactcaaccagtcagccctgtcaaggcctatgcagaggaagttggtcactctggtaaactgtcagttggtcgaagaggagggcagggttagagcgatgagagcagcacgaagtctcggggaaagaacagtcacagagttgattctgcagcaccagaacccacaacagttgagcgccaatctttgggcagcggtgcgagctcgcgggtgtcaattcctggggccggccatgcaggaggaagcactcaaattggtcctgttggctctggaggatggttcagctttatccagaaaagttctcgtgttatttgttgtgcaacggttagaacctcggtttcctcaggcttctaaaacatccatcggccatgtggtgcagttgctctaccgtgcctcatgttttaaggtgaccaagagggatgaggactcctctctgatgcagctgaaggaggaattccgatcctacgaagcacttcggcgggaacatgacgcgcagatcgtccatattgcaatggaagcaggactgagaatctctcccgaacagtggtcgtctctgctttatggtgacctggcccacaagagccatatgcaaagcattattgacaagcttcaaagcccggagtcttttgcaaagagtgtgcaagaactcacaatcgtgctgcagcggactggcgacccagcaaacctgaaccggttacggccacacttagaactattggccaacatagatccaaatcccgatgctgtgagcccaacttgggagcagcttgaaaacgccatggtggccgtgaaaacagttgttcatggcctggtcgatttcatccagaattacagtcgcaaaggacacgaaacaccacaaccacagcctaatagcaaatataagaccagcatgtgccgcgatctacggcaacaagggggctgcccaagagggaccaactgcacattcgcccattctcaagaggaactggagaaatatcgcctaaggaataagaaaataaacgcaaccgtcaggactttcccgctgctcaacaaggttggggtcaataacaccgtgacgaccaccgctgggaacgtgataagcgttattggaagcacagagactacagggaagattgtccccagtaccaatggtatctctaatgctgagaattcagttagccaactgatttcccggagtaccgattccacacttcgggcacttgaaaccgtcaagaaagtaggcaaggtcggggctaatggccagaacgctgctggaccatctgcggattctgtcaccgagaataaaatcggctctccccccaagacccctgtatccaacgtggctgcaacctccgctggtccatcaaatgtgggcaccgaactgaattctgtgcctcagaagagtagtccatttctgacaagagtgccagtgtaccctcctcactccgagaatatccaatatttccaggacccacgtacacagatcccatttgaagtgccacagtacccgcagaccggctactacccccccccgccaacagtgcctgcaggagtcgcaccgtgcgtaccgcgttttgttcgaagcaataatgtgccggagtcttcactgcccccagctagtatgccctacgctgaccactattctacgttttctccaagagatagaatgaacagcagcccctaccaaccaccccctcctcagccatacggacctgtgcctccagtcccaagcggcatgtacgcacctgtgtacgactcacgccgcatttggagaccccccatgtaccaacgggacgacataatacggtcaaactcgctgccccccatggatgtcatgcatagctctgtctatcaaacctccctgcgagaaaggtataactcgttagatggctactattcagtcgcctgccaacctccgtccgagccaagaactacggttccgctgccgcgcgaaccatgcgggcacctcaaaacatcatgcgaggaacaaatcaggagaaagcccgatcaatgggcccagtatcacactcagaaggctcctctcgtctctagcaccctgcctgtagcgacccagtctcctacacctccctctcccctgttctctgttgactttcgggccgacttttctgaatccgtgagtggtacaaagttcgaggaggatcacctgagccattactccccatggtcttgcggtacgatcggaagctgcatcaacgctatagactcagaaccaaaagatgtgatagccaactcaaatgccgtacttatggatctcgactcaggggatgttaagcgacgcgttcacttgtttgaaacccagcgccggacaaaggaagaggacccgatcattccgttctccgacgggccaattatcagcaagtggggagccatatctcgaagttctcgcacaggataccacaccaccgacccagtgcaggctacagcctctcaggggtctgccaccaagcctatcagcgtaagcgactacgttccatacgtaaacgccgtggactcccgctggtcctcctacggcaacgaggccacatcctctgcccactacgtggagagggacaggtttatagtgactgacctcagtggacacagaaagcactctagtactggggatcttctctcgctcgagctccagcaggccaagtctaacagcctgttgttgcagagagaagctaatgccctggcaatgcagcaaaaatggaacagtctcgacgagggccgacacctgacgctgaacctgctgtcgaaggaaatcgagttaaggaatggtgagttacagtcggattacacggaagatgcaacagacacaaagcctgaccgagatatcgagctggagttgagcgcacttgatacggatgaacctgacggccaaagcgagcctatagaggagatcctcgacatccagttgggaatctcttctcaaaacgatcagctgctgaacgggatggccgtggagaacggtcacccagtccagcaacaccaaaaggagcctccgaagcaaaagaagcagtctctgggagaggaccatgtgatattggaagaacagaaaactatcctgcccgtgacttcttgtttctctcagccactacctgtgtccatctccaatgcctcatgcctccccatcaccacttccgtgtccgctggcaatttgatccttaagactcatgttatgtccgaggacaaaaatgatttcttgaagccagtagcaaacggtaagatggttaactcttag

SEQ ID NO: 23989 - DNA, 2100 bp, Artificial Sequence
  Description of Artificial Sequence: Synthetic coding sequence
atgtgcggcatcttcgcctacctgaactaccacgtgccccggaccagaagggagattttggaaacattgattaaaggtctgcagaggctggaatataggggatacgatagcgctggtgtggggtttgatggcggcaacgacaaggactgggaagccaacgcttgtaaaattcagcttattaagaagaaggggaaggtgaaagctctggacgaagaggtgcacaagcagcaggatatggacctggatatcgaatttgatgtgcacctcggcatcgcccacactcggtgggctacacatggcgagcctagccctgtgaactcacatccgcaacggagcgataaaaacaacgagtttatcgtgatccacaatgggataattacaaattacaaagacttgaaaaaatttctcgagtctaagggctacgactttgaaagtgagaccgatacagagaccatcgcaaaactagtgaagtatatgtatgacaacagggagagccaggatacctcctttactactctggtagagagagtcatccagcagctggaaggagccttcgcattggtcttcaagtctgtgcactttcctggacaggccgtcggcaccaggcggggatcacccctcttaattggcgtacgcagtgaacataaactatctactgatcatattcccattctctataggaccgcacgtacgcagatagggtctaagtttacacgctgggggtctcagggggagcgtgggaaagataagaaaggaagttgcaacttgtcgcgtgttgattcaaccacatgccttttccctgtggaagagaaggcagtggagtattacttcgcttctgatgcgtccgccgtgatcgaacacaccaatagggtcatattcctcgaagatgacgatgtagctgctgtggtcgatggtaggctctcgatccatagaatcaagagaaccgccggtgaccaccctggccgagcagtccagacattacagatggaactccaacagattatgaaaggtaatttttcatcctttatgcaaaaggaaatatttgaacagcctgaaagcgtggttaatactatgcgtgggagggtcaactttgacgactatactgttaacctcggtgggctaaaagatcatatcaaagagattcagcgttgtagaagattgatactaatcgcttgtggtacctcttaccacgcaggcgttgcaaccagacaggtactagaagagctcactgaattgcctgttatggtcgaacttgcttcagatttccttgacaggaacacacctgtgttcagagacgacgtgtgtttcttcctgtcacagtcaggcgagactgccgatacattgatgggcttgcgctattgtaaagaaagaggagccctgactgtgggaattacgaatacggtcggatctagcatttctagagaaacggattgtggtgtacacattaacgcaggccccgaaattggagtggcgagcaccaaggcatacacctcccagtttgttagtttggttatgtttgcgctgatgatgtgtgacgaccgtatttccatgcaggagcgtagaaaggagattatgcttgggctgaaacgtctgcccgaccttattaaagaggtattgagcatggatgacgagatacagaaactggcaacagagctctaccatcaaaagagtgtcctcatcatgggtcgagggtaccattacgctacatgcttagagggtgctctgaaaataaaggaaatcacttatatgcactcagaaggtatcctggccggtgagctgaaacatggacccctggctctggtcgataaactcatgcctgtaatcatgatcatcatgagggatcatacgtacgctaaatgccagaacgccctccagcaggttgtcgcaaggcagggtaggcctgtagtcatctgcgacaaggaagacaccgagaccatcaaaaacactaaaaggactatcaaagtcccccattcagtggattgcctgcagggcatcctctccgtgatccctctgcagctcttagcctttcatctggcggtgctgcggggatatgacgtagatttcccaaggaacctcgccaagagtgtgacagtggagtag

SEQ ID NO: 23990 - DNA, 2067 bp, Artificial Sequence
  Description of Artificial Sequence: Synthetic coding sequence
atgagcgtgaacagcgagaagagcagcagcagcgagcggcccgagccccagcagaaagccccgctggtccctcctcctccgccgccccctcctcccccgcccccccctcttccagacccaacacccccagagcccgaggaagagattctggggagcgatgatgaggaacaggaggaccctgcggactactgcaaaggaggttatcaccccgtcaagatcggggaccttttcaatggccgctatcatgtgataagaaagctgggttggggccattttagcacagtttggttatgctgggatatgcaggggaagcgcttcgtggccatgaaagtcgtcaagtccgctcagcactacaccgaaacagcattggatgagatcaagctgctgaaatgtgtgagagagagtgatccaagtgatcctaataaggatatggtggtgcagctgattgatgattttaagattagtggaatgaatggaattcacgtctgtatggttttcgaagtcctcgggcaccacctgctgaaatggatcatcaaatccaactatcaaggcctgcccgtccgatgcgtaaagagtatcatacggcaggtactccagggtctcgattacctccatagtaaatgtaaaattattcacactgatattaagcccgagaacatcttaatgtgcgtcgatgacgcctacgtccgacgtatggccgctgaggcgacagagtggcaaaaagcaggggcacctcctccctcgggcagcgctgtgagcacagcaccacaacagaagcctatcgggaaaatttcaaaaaacaaaaagaagaagctgaagaagaaacagaagcgccaggcggagttattagagaaacggttacaggaaattgaggagctggagcgagaggccgaacgcaaaatcatcgaggaaaacatcaccagcgccgccccatctaatgaccaggacggggaatactgcccggaagtgaagcttaagacaacgggcctcgaggaagccgcagaggcagagactgcaaaagacaacggggaagcggaggatcaagaggagaaagaagatgctgagaaagaaaacattgagaaggacgaggacgacgtcgaccaggaactcgctaacatagacccaacttggatagaaagcccaaaaacaaatgggcatatcgagaatggcccgttttccctggagcagcagctcgatgacgaggatgatgatgaggaggactgtccaaatcccgaggagtataatctagatgaaccaaacgccgagtctgactacacttacagttcatcttatgaacaatttaacggtgaactccccaatggccgacacaagatccccgagtcccagttcccagagttttcaaccagcctgttctcgggctcactggagcccgtcgcttgtggctcagtgctctctgaaggatcccctctgacagagcaagaggaatcttcgccctctcatgatcgcagccgcaccgtgagtgccagctccaccggcgaccttcctaaagccaagaccagagctgcagatctgctcgtaaaccctctcgatccacggaacgcggataagatccgtgtgaaaatagccgatctgggtaacgcttgttgggtgcacaagcacttcactgaagatatacagacgcgccagtacaggtctatcgaggtcttgattggcgccggctacagcacacccgccgatatttggtctacggcctgtatggccttcgaactggcaactggggactatctttttgaaccccattctggcgaagactattcgcgagatgaggaccacatagcacatatcatcgagcttctggggtcaatacccaggcactttgcactgagtggcaaatattcaagagagttctttaatcgccgcggagagctccgtcatattaccaaactgaagccatggtctctctttgatgttctcgtggagaagtatggatggccacacgaagacgccgcccagtttacagacttcctgattccgatgctcgagatggtgcccgagaagcgggcgagcgccggagaatgtcttaggcatccttggctcaacagttag

SEQ ID NO: 23991 - DNA, 1308 bp, Artificial Sequence
  Description of Artificial Sequence: Synthetic coding sequence
atgagcggctaccagcggcggcccggcgccacccccctgagccgggcccgatctctcgctattcccgacgcaccggcgttttacgagagacggagctgtttacctcagttgaattgcgaacggccccacgggcgtgacctggacagtcctttcttcggcattcggccggctttcatgtgctacgtgccatctccggtgctcgcaagtgtgggagacacagattttggatacggcaaaggcaaatgtagtaaacagtcaccctcgggtgcccacggtacacactttggggacgacaggtttgaagatttggaagaggcgaatcctttctcattccgggagtttttaaaaaccaaaaacctgggcctgagcaaagaggatcctgcctccaggatctacgcaaaggaggcaagtcggcatagcctgggtctggaccacaatagtcccccaagccagactggcggatacggtcttgaatatcaacagccttttttcgaggaccccacgggggctggggacctgctcgatgaggaagaggacgaggacaccggatggagcggggcctatcttccttctgctatcgaacaaacccacccggagagggtccccgccggcacatctccatgttctacatatctgtctttctttagcaccccatccgaactggctggcccagaaagcctcccctcatgggctctgagtgataccgacagccgagtcagtcctgcgtcccccgccggcagtccaagcgctgatttcgctgttcatggcgagtctctgggagatcggcatttgcgcactttgcagattagctatgacgcactgaaggacgaaaacagtaagttgcggagaaagctgaacgaggttcagtccttcagtgaggcccagacggagatggttagaactttggaaaggaagttggaggctaaaatgatcaaagaggagagtgattaccatgacctggagtcagtggtgcagcaggttgaacagaacctggagctgatgaccaaacgcgcggtgaaagccgagaatcacgttgttaagttaaagcaagagatttccctgttgcaagcacaagtatccaatttccagagagaaaacgaagccctgaggtgcgggcagggtgcaagcctcactgtagtcaagcagaatgctgacgttgcacttcagaatcttagagtggtgatgaattccgcacaggcaagtataaaacagctagtcagcggcgcagagacgctgaatttggtagccgagattctcaagtccatcgatcggatttcagaagtgaaggatgaagaagaagacagttag

SEQ ID NO: 23992 - DNA, 591 bp, Artificial Sequence
  Description of Artificial Sequence: Synthetic coding sequence
atgaaggtgaagatcaagtgctggaacggcgtggccacctggctgtgggtggccaatgatgaaaactgtggaatctgtcgaatggctttcaatgggtgttgcccagactgcccgcttcatggagaaagcatctcacgttgtctggggtggtgtccccaacccgtgcccgttctcgggggccgtgctcatccgcaggtccccataaatactgcgtcacctactcctggccagcacactggtagcctgatgtctagggaggagagctccagatcgcccgacccgactccccctgccctggatcaggaaacttcttcattgctgagatgcacatccccttggtgcctggaccattcttgtgacctttttggcattaccgaccaagtcagtgctgacggcccgcgggcttgcaggcagggtgcccggcgccgtctgcctgccggggtcgggccggttctcccgctcctaccacatgctctgcatccacaggtagccgccaggaccgcaggtgccgcggccctaccacacgtgcctcccggcatggaagtgcagggagttaggccagacttggctttggccggaggcgcaagttag

SEQ ID NO: 23993 - DNA, 5127 bp, Artificial Sequence
  Description of Artificial Sequence: Synthetic coding sequence
atggccgccatcggccggggccggagcctgaagaacctgcgggtgcgcggccggaacgactcaggtgaagagaatgtaccactcgaccttacaagagaacctagtgataatttacgggagatcctgcaaaacgtggctaggttgcagggggttagtaacatgaggaaattaggacatctcaacaattttacaaaattgctttgtgacatcggccattccgaagagaagctgggttttcattacgaggatatcatcatctgcctccgccttgctctgctgaatgaagccaaggaagtgcgcgctgcgggtctgcgcgccctccgctacctgatccaggattcatctattctccagaaggttctcaaactgaaggtagactaccttatcgcacgctgcatcgatatccagcaatctaacgaagtggaaagaacacaagctctgagacttgtgcgcaagatgattactgtgaacgctagtttgtttccctcttctgttacaaacagtttaatcgcagtcgggaatgatggcctgcaggaacgggatcgcatggtgcgggcgtgcatcgccatcatctgcgaacttgccctgcagaacccagaagttgtggcactgagaggcggtctgaacactatactgaagaatgtgattgactgtcagttatctcggatcaacgaggcgctgatcactaccatcttgcatctcctgaatcatccaaagacgagacagtacgtgagggccgatgtcgaactggagcgaattcttgccccctacaccgattttcattatcggcatagtcctgacactgcagaaggacagcttaaggaggaccgggaggccaggttcctcgcgagtaaaatggggattatcgctacctttaggtcatgggcgggcataatcaatctgtgtaagccgggtaacagcggaatccagagcctgatcggagtgctgtgtatccccaatatggagatccgccgggggttgctggaagtcttatacgatatcttccggctacccctgcctgtggtgaccgaggaatttatcgaagcactgctgtcagtcgatcccggaagattccaagactcatggcgattgtcagacggattcgtagctgcggaagctaagactatcctgccacacagagctagatcaagacctgatcttatggacaattacctggcattgatcctgagtgccttcatcagaaacggactgctcgagggcctggtcgaagtgattaccaatagtgacgaccacatatctgtgcgggcaactatcctgcttggggagctccttcacatggcaaatactattctgcctcattcacatagccatcacttgcactgcctcccaaccttgatgaatatggccgcatcctttgatatacccaaagagaaacggctgagggcatccgccgctttgaactgccttaagcgctttcacgaaatgaaaaagcgcggccccaaaccatacagccttcatctcgatcacattattcagaaggctatcgccacgcaccagaaacgcgaccagtacttacgcgttcagaaggatatatttatattgaaggatactgaggaagcattgttaattaacttacgggacagccaagtgttgcaacataaggaaaatctcgagtggaattggaaccttataggcaccatcctgaagtggcccaacgtcaatctgcggaattacaaggatgagcaactccacaggttcgttagacggctactgtatttctacaaaccttcctccaagctgtatgcaaacttggacctcgactttgccaaagccaaacagctcacagtagtggggtgccagtttaccgagtttctactggaaagcgaggaagacggccagggctacttggaggacttggtcaaggacatcgttcaatggctgaacgccagctccggcatgaagcctgagagaagcctacagaacaatggactgcttaccacgctgtcacaacattactttctgtttattggtaccctgtcatgccatcctcacggtgtgaaaatgttggagaagtgctctgtattccagtgtctgcttaatctgtgcagcctgaagaaccaagatcatctcctgaagctgacagtttcgagtctggattatagtcgggatgggttggccagggttattctctctaaaatactgactgccgccaccgatgcttgcagactatacgccaccaaacacctacgggtcctgctgagggctaatgtcgaattcttcaataattgggggattgagctcctcgttacccaactccacgacaagaacaaaactatctcgtcggaggcccttgatatcctcgacgaggcttgcgaagacaaagcaaacctccatgccttaatccagatgaaaccagccctgtcacaccttggcgacaaaggtcttctgctgctgctgcgcttcttgtccatcccgaagggcttctcttatttgaacgagcgtggctacgtggccaagcagctggaaaagtggcatcgagagtacaactctaagtacgtggacctcatcgaggagcagctcaatgaggccctgactacctaccgaaagccagtggatggcgacaactacgttagaagatcaaatcagcgacttcagcggccacacgtgtatctgccaatacatttgtacggccagctggtgcatcacaaaactgggtgccatctgctggaagtccagaacattatcaccgagctctgcaggaatgtccggacgccagacctggacaagtgggaagaaatcaagaaactcaaagcatctctgtgggccctcggtaatattgggagctcgaattggggacttaaccttctgcaggaagagaatgtaatcccggacatccttaagctggcaaagcagtgtgaagttcttagtattcgggggacctgcgtctatgttcttgggctaatcgctaaaacaaaacaagggtgcgacattctcaaatgtcataactgggatgctgtacggcacagtaggaagcatctctggcccgttgttcctgacgatgtcgaacagctctgcaacgaactgtcctccattccttccactctaagtttgaactccgagtcaacatcttcccggcacaacagcgaatccgagtccgttccatcaagcatgtttattcttgaggacgataggtttggcagctcgtcaacgtcaacctttttcctggatatcaacgaagatacagagccgacattttacgataggagtgggccaatcaaggacaagaacagttttccattttttgctagcagcaaattggtaaaaaatagaatcctaaattctctaactctgcccaataaaaaacaccggagttcaagtgaccccaagggaggtaagctgtccagcgagtccaaaacctccaatcggagaatccggacactaactgagcccagcgtggacttcaaccacagcgatgattttacccctatctctaccgtccaaaaaactctgcagctcgagacaagctttatgggaaataaacacatcgaggacaccggtagtaccccaagcataggagagaacgacctgaaattcacaaagaatttcggaaccgagaaccatcgggagaatacttctcgcgaacggctcgttgtcgagtcatccacgagctcccacatgaaaatccgcagtcagagtttcaacacagacacgactacatctggtatttccagcatgtcttccagcccctcaagggagacagttggggtggacgctacaaccatggataccgactgcggatctatgtctacggtcgtgagcacgaagactataaaaacatcccattacttaacccctcagtcgaaccacctctcactgtccaagagcaatagcgttagtctagtcccccctggctcttctcatacactacccaggcgcgcacagagtctgaaagctccgtctattgccaccatcaaaagcctcgctgattgtaacttctcttacaccagcagcagggacgcctttggatatgcaactctgaagaggttgcagcagcagagaatgcacccatctctctcacactcggaggccctggccagcccggccaaggatgtgctgttcaccgatacgattaccatgaaggcaaattcttttgagtccaggctgacaccgtcccgatttatgaaggccctctcatatgcctcactcgataaggaagacctgctctcacctatcaatcagaacacactgcaaagatccagtagcgtccgaagcatggtgtcttctgcaacttacggtggaagcgacgactacatcgggctggccctgcccgtagatatcaacgacatcttccaggtcaaggatattccttacttccaaaccaagaacatccctccgcacgacgaccgaggcgctagagccttcgcccacgacgccggtggcctgcccagtgggacaggagggctggtaaagaattcttttcacctgctgcggcagcagatgtctctgaccgagattatgaacagtatacattccgatgcatccctatttctcgaaagcactgaggacaccggactccaggaacatacggatgataactgcctgtactgtgtgtgcatcgagattttaggcttccagccttctaatcaactgtcagccatatgttcacattctgacttccaggatatcccatactcagattggtgtgagcaaacgatccacaacccactggaagtggtgccctcgaagtttagcggaattagtggatgctcagatggggtttcccaagaggggagcgcgtcaagtaccaagtccactgagctcctgctgggagtaaaaactataccggacgacactcccatgtgccgtattctcttaaggaaagaggtgctacgcttagtcatcaatctgagctccagcgtttctaccaagtgccacgagacaggactactgacaataaaggagaaatacccccaaacatttgacgacatatgtctgtatagcgaggtctctcacctgctcagccactgtacttttaggcttccatgcaggcggtttattcaagagctgttccaggatgttcagttcctgcaaatgcatgaggaagccgaggccgtgctcgcgacaccgccaaagcagccaatcgtcgataccagtgctgagtcctag

SEQ ID NO: 23994 - DNA, 3867 bp, Artificial Sequence
  Description of Artificial Sequence: Synthetic coding sequence
atgccccggaagggcacccagcccagcaccgcccggcggcgggaggaaggacctccaccaccaagtcctgacggggctagctccgacgcagagccagagccgcccagcggcagaacagaatctcccgctacagccgctgaaaccgcttcagaagaactggataatcgcagtcttgaggagatcctgaacagcatacctcctcccccaccacctgctatgaccaacgaagccggagctccacggttaatgattacacatatcgtcaaccagaattttaagtcatacgcaggtgagaaaatcttaggaccttttcacaaaagattttcctgcattattggaccgaacggaagcgggaaatctaacgtgatagactcaatgctttttgtgttcgggtaccgtgcgcagaagatcagaagcaaaaaactcagtgtcctgatacacaacagtgacgagcataaggatatacaatcctgtaccgtggaggtccactttcagaaaatcattgacaaggagggtgatgattacgaggtgattcccaactccaacttttacgttagccggacagcctgcagggataatacttctgtttatcatattagcggcaagaagaaaaccttcaaggacgtcggtaacctgctccgttctcacggtattgatctcgaccacaaccgctttcttattttacagggggaggtcgagcagattgcgatgatgaaaccaaagggacagactgagcacgacgagggaatgctggaatacctcgaggatatcattggatgcggtcgccttaacgagcccatcaaggtactctgtaggcgcgtggaaatcctgaacgagcatcggggcgaaaagcttaatcgcgttaagatggtggagaaggagaaggatgccttggagggcgagaaaaacattgctatcgagtttcttacccttgaaaacgaaattttccggaagaaaaaccacgtctgtcagtactacatctacgagctacagaaaagaatagctgagatggagacgcagaaagagaaaattcatgaggacacaaaggaaattaatgagaaatctaacatcctgagcaacgagatgaaggcgaaaaataaagatgttaaggacacggaaaaaaagcttaataagatcaccaagtttatcgaggagaataaggagaaattcactcagcttgacttggaggatgttcaagtgcgcgagaagctgaagcacgcgacatctaaagcaaagaagcttgaaaaacagctccagaaggataaggaaaaagtggaagagttcaagtctatccccgccaaaagcaataatattattaatgagacgacgacccgcaataatgcgctggagaaggagaaagagaaggaggagaagaaattaaaggaagtaatggatagcctcaagcaggagactcagggactgcagaaggagaaagagtcccgggagaaagaactgatggggttttccaaatctgtgaatgaagcacgatccaagatggacgtggctcagtccgaactcgacatttaccttagccggcacaacaccgctgtctctcaactcacgaaggcaaaagaagctcttattgcagccagtgagacccttaaggagcgaaaggctgctatccgggacattgaaggtaaactgccacagaccgagcaggaacttaaggagaaggagaaagaattgcagaagcttacgcaggaggagacaaatttcaagtcgttagtgcatgacttgttccaaaaggtcgaagaggcaaaaagctctctcgccatgaatagaagccgtggcaaagttctagatgcaattatacaagagaagaagtccggccggattccagggatttatgggcggcttggcgaccttggcgcaatagacgaaaaatatgatgtggcgatctcttcgtgttgccacgcccttgattatatcgtggtggattccattgacatagctcaagaatgtgtgaactttctcaaacgtcagaacatcggtgtggccacttttatcggcctggataagatggcagtctgggccaagaaaatgaccgagattcagacccctgagaacacacccaggttattcgatctggtgaaagtcaaggacgagaagatccggcaagccttttacttcgcactccgcgacacgctggttgctgacaacttggaccaggctacaagagtcgcttaccaaaaagacaggcgttggcgggtcgtaacattgcagggtcaaataattgaacagtctggaacaatgaccggcggcggcagtaaagtgatgaaggggcgaatgggatcctcgctggttatagaaatctccgaggaggaagttaataagatggaaagccaactccaaaatgacagtaaaaaagcaatgcagatccaggaacagaaggtgcagctggaggagcgggttgtgaagctgcggcattcagaaagagagatgcgaaacactctggagaaattcaccgcaagcattcagagactcattgagcaagaggagtatctcaatgtgcaggtaaaggaactggaagcgaacgtactcgctacagcacctgacaagaaaaagcagaagctgctagaggaaaatgtgtccgccttcaaaactgagtacgacgcagttgcagagaaggccggcaaggtggaagctgaagtcaagagacttcacaacaccattgttgaaatcaataaccataagttaaaggcccagcaggacaagctcgataagataaataaacagttggacgagtgcgcctctgcaatcacaaaggcccaggtcgctatcaaaaccgctgataggaatctgcaaaaggctcaggattccgtgcttaggacagaaaaagaaatcaaagacactgagaaggaggttgatgatctaaccgctgagctcaagtcgctggaggataaagccgccgaagtggtcaagaacactaacgcagctgaggagagccttccagagatccagaaggaacatcgcaatctcttacaagaactgaaagtgattcaggagaacgaacacgccttgcagaaggacgccttgagtattaaactcaagctagaacagatcgacggacacattgctgaacataattccaaaatcaagtactggcacaaagagataagcaagatcagcctgcatccgattgaagataatcctatagaggagatttccgttctgtcgccggaggacctggaggcgataaaaaatcctgattccattaccaatcagattgcgctgctcgaagccaggtgccacgagatgaagcccaacctgggggctatcgcagaatacaagaaaaaggaggaactgtatttacaacgcgtggccgaacttgataaaatcacatatgaacgcgactccttcagacaagcctatgaggatctccggaagcagcggctgaacgaatttatggctggcttttacatcataactaataaactgaaggagaactaccagatgttaacgctcggaggggatgccgagcttgaactggtcgattctctggatccattctccgaaggaataatgttttctgttagacctccaaagaaatcatggaagaaaatctttaacctgagtggaggcgagaagactctctccagcctagccctggtgtttgcactccaccattacaagcctacgcctctttactttatggacgaaatcgacgccgcccttgatttcaagaacgttagcatcgtggccttttacatatatgagcagactaagaatgctcaattcattataatatccctgcgaaacaacatgttcgagatctccgacaggctcataggtatttataaaacatacaatattacaaaatccgtcgccgtcaaccccaaagaaatcgcctccaagggcttgtgttag

SEQ ID NO: 23995 - DNA, 2829 bp, Artificial Sequence
  Description of Artificial Sequence: Synthetic coding sequence
atgaccggcagcaacagccacatcaccatcctgaccctgaaggtgctgccccatttcgagagccttggcaagcaagaaaagatcccaaacaagatgagcgccttccgcaaccactgccctcacttggatagtgtgggtgaaataacaaaagaagatctgatacagaagagcctgggtacctgtcaagactgtaaggtccaggggcctaacttatgggcatgcctggaaaatcggtgctcatatgtgggctgcggggaaagccaagttgaccattccaccattcattctcaggagacaaaacattacttgacagtgaacctgacaactctgagagtgtggtgctacgcttgcagtaaggaggtgttcctagataggaagctgggaacgcaaccaagtcttcctcacgtgcgccagccccaccaaattcaggaaaatagcgtccaagatttcaagatcccatccaacactaccctaaagactccactggtggcagtattcgacgatttagacatagaagctgacgaagaagacgaactgagagcgaggggccttacaggcctgaagaacattggcaatacctgctacatgaacgccgcattgcaggccctatctaactgtccccccttaacccagttcttcctggactgtgggggtcttgcccggaccgataagaagccagccatttgcaaatcttacctaaaactcatgacagagttgtggcataaaagccgccccggtagcgtagtgccaacgacactgttccaaggaatcaagaccgtgaatccaactttccggggctacagccagcaagacgcccaggagttcctgaggtgccttatggacctgctccatgaggaactgaaggagcaggtgatggaagtggaagaggatccccaaacgataacaaccgaagagaccatggaagaggacaagtcccagtcagatgttgattttcaatcctgtgaaagttgtagtaatagtgacagagccgagaacgaaaacggttctaggtgctttagtgaagataataacgaaactacaatgctcattcaggacgacgagaacaattcggaaatgtccaaggactggcaaaaggaaaaaatgtgcaataagattaataaagtcaactctgagggcgaattcgacaaggatagagacagcattagtgaaaccgtggatctgaataaccaggaaacagtgaaggtgcagatccattctcgagccagcgagtacatcaccgatgtccacagcaatgatctgtcgacaccgcaaatcctacccagcaacgagggagtgaaccccaggttatcagcatccccccccaagtcaggcaacctctggcctgggctggcccccccgcacaagaaggcccagtcagcaagccccaagcgcaagaagcagcataaaaagtaccgcagtgtgataagcgatatcttcgatgggacaatcattagcagcgtgcagtgcctaacttgtgatcgtgtttccgttactctggaaacctttcaggatctaagcctccccatccccggaaaggaggacctggcaaagctccattcgtcttctcaccccacctccatcgtgaaagctggttcatgtggagaggcttacgctccacaaggctggattgcgttttttatggagtacgtaaaacgtttcgtggtgagctgcgtgcctagttggttctggggcccagtcgtcacactgcaggattgcttagccgctttcttcgcaagggacgaattaaaaggtgacaacatgtacagttgtgagaagtgcaagaagctgcgcaatggggtcaagttttgtaaggtgcagaattttccggaaattctttgtatccaccttaagcggttcaggcacgagttgatgttttccacaaagatttccactcacgtcagcttccctctggaggggctcgacctgcaacctttccttgcgaaggatagtcctgcacagattgttacttacgatctgttatctgtgatttgtcatcacggtactgcgtcttccggtcactacatagcgtactgtcgtaacaatttaaataacctgtggtatgagttcgatgatcaaagtgtgaccgaggtgagtgaatctacagtacagaacgccgaggcctacgtgctgttttatcgcaagagcagcgaagaggcccagaaggagcggcgccggatcagcaatttactgaacattatggaacctagcctgctccagttttacatctccaggcaatggctgaacaaatttaaaacctttgccgagcctgggcccatctcaaacaatgattttttatgtattcacggaggcgtcccaccacggaaagctggatatatcgaagacctggtcctgatgcttccccaaaacatttgggataacctctactcaaggtacggggggggaccggccgttaaccacttgtatatatgtcacacatgccagatagaggctgaaaagattgaaaagaggcgcaagactgaactggaaatcttcattcggctgaaccgagccttccagaaagaggacagccctgccacattctactgtattagcatgcaatggttcagagagtgggaatccttcgttaaggggaaagatggcgatcctccaggacccatcgacaatactaagattgctgttacgaagtgcggaaacgtgatgcttcgacagggtgccgactcaggacagatttccgaagaaacatggaatttccttcagtcaatctacggggggggaccagaggtgatactgcggcctccagtggtgcatgtcgaccccgacattttgcaggcagaggagaagattgaagtggaaacgaggagtctctag

SEQ ID NO: 23996 - DNA, 2106 bp, Artificial Sequence
  Description of Artificial Sequence: Synthetic coding sequence
atgatgaagcggcagctgcaccggatgcggcagctggcccagaccgggtcccttggtcgtacccctgagactgcagagtttctgggagaggatctgttacaagtcgagcagcggttggagccagccaagcgggccgctcacaacattcacaagcgcctccaggcttgcttgcaggggcagtctggagctgacatggacaagagagtgaagaaactgcccctaatggcactcagtaccacaatggcagagagtttcaaggaactggatcctgacagttcaatgggcaaggccctggagatgagttgtgcaatccagaatcagctcgcacgtattcttgccgagttcgagatgactctggaacgagacgtcctccaacctcttagccggctcagcgaggaagagctgccggcgatcctcaaacataagaagagcctacagaaactcgtttctgattggaacaccctgaaatccagattgtcccaggccaccaagaacagcggaagctcgcagggactgggcgggagcccaggcagtcattcacacacgactatggcaaacaaagttgagacgttgaaagaggaagaggaggaactcaagagaaaagtcgagcagtgtcgagatgagtacctagcagatctgtaccattttgtgacaaaagaagatagttacgccaactatttcattaggttgctagagattcaggcagactaccaccgacggagtctgtcatcccttgatacagcgttagctgaacttcgggagaaccatggtcaggccgaccactccccaagcatgaccgcaacccacttcccccgtgtgtatggcgtcagcctggccacacatctgcaggaactaggaagggagatcgccttacccatagaggcctgtgtgatgatgctgctgagcgaagggatgaaggaagagggacttttccgcctggccgcaggggcatcagtgctcaaacgcttgaaacaaaccatggcttcagatccacacagccttgaagagttctgctctgatccccacgccgttgctggcgcactgaagagctacttacgcgaacttcctgagcctctgatgacctttgatttatatgacgattggatgcgtgccgcctccctcaaggaacccggggcacgactgcaggcgctacaagaagtctgcagcaggttacccccggagaacctcagtaatttgaggtatctaatgaagttcttggccaggcttgcggaagaacaagaagttaataagatgactcccagcaacatcgccattgttctcgggcccaatctgctatggcctcccgaaaaagagggagatcaggcccagttagacgccgcgtccgtctcaagtatacaggtagtgggcgtggttgaagccctgattcaaagtgcagatacactttttcctggtgatattaacttcaatgtgtcaggactgtttagcgccgtcacactacaagatactgttagcgaccgtctggcttccgaggaattgccctccactgccgtgcccacacccgcgaccactcccgccccagcgccagctcccgcccctgcccccgccccagctctggcttctgcagccaccaaagaaagaaccgaaagcgaggtgcctcccaggccagcgagcccgaaggtaactagatcacctccagagacagctgccccggtagaggacatggcaaggagaaccaagaggccagctcctgccagaccaacaatgcccccaccgcaagtgagcggatctcggtcctcaccacccgctccaccgctacctcccggcagtggaagccccggaacccctcaggctctgccaaggcggctcgtgggctcctctttgagagcccctacggtgcctcctcctttaccaccaacacccccacagcccgctcgcaggcagagccgccgcagccccgcctctcctagtccagcctcacccgggcctgcttctcctagtccagtcagcctgtctaatcccgcacaggtggacctgggagccgccaccgccgaagggggggctcctgaggccatttccggcgtgcctacccctcctgccattccacctcaacctcggcctcgaagcctggctagtgaaaccaactag

SEQ ID NO: 23997 - DNA, 1818 bp, Artificial Sequence
  Description of Artificial Sequence: Synthetic coding sequence
atggaggtgcgggccagcctgcagaagatcgtgagcaacggcgacgaacagctggagaaggccatggaagaaatcttaagggactcagaaaagcgcccgtcatccctgctggtggattgtcagtcttctagcgaaatttcagatcattccttcggagatataccagcttctcagactaataagcctagccttcagctgattctcgatcctagtaatacagaaatttccaccccacggcctagctcacctggaggactgccggaagaagattccgtgcttttcaacaaactgacttatcttggatgcatgaaggtctcctctccgcgcaacgaagtggaagccctccgtgccatggctactatgaaatcatcatcccagtacccctttccggtaactctgtacgtccccaacgtaccagagggatccgtcagaattattgaccagtctagcaatgtcgaaatcgcaagtttcccaatctacaaagtgctgttttgtgcccgcggccacgacggcaccactgagtctaattgttttgcgtttacagagtcaagccacgggagtgaagagttccagatccacgtgtttagttgtgaaattaaggaagcagtctcacgtatcctttattctttttgcacggccttcaagcggagtagcagacaggtttctgatgtgaaagactcagtcattcctactcctgactcagacgtattcacattcagtgtgtctcttgaagtgaaagaggacgatggcaaagggaacttcagccctgttcctaaagacagagataagttctacttcaagctgaagcagggcatagaaaagaaagtggttatcaccgttcagcagctctcaaacaaggagctcgcaatcgagcgttgcttcggaatgctcctgagccccggtagaaatgtgaaaaatagcgatatgcatctgttggatatggagagcatggggaaatcttatgacgggcgagcttatgtcatcaccggcatgtggaatccaaatgctccagtgttccttgcgctgaacgaggaaacccccaaagacaaacaggtctatatgacagtggctgtcgacatggtggtgacggaagtggtggaaccggtaagattcttgctggaaactgtggtgagagtgtatcccgccaatgagcgcttctggtattttagccgtaagacctttactgaaaccttcttcatgagactgaagcagtctgagggaaaaggccacactaatgctggagacgcaatctacgaggttgtgtccctccaaagagagagtgacaaagaggaacctgttacaccaaccagcgggggtggacctatgtccccccaggatgatgaggctgaggaggaatcagacaatgaattatcttcagggaccggagatgtgtctaaagactgtcccgagaaaatactctacagttggggggagctgcttggcaaatggcactccaatttgggagcccggcctaaggggctatctactctcgtgaaatctggtgtgcccgaggccctgcgcgcagaggtgtggcaactcctggccggatgccacgacaatcaggccatgctggaccggtatagaatcctgattactaaacaacagatgaagttcagcctgactcctaggcaaacaatacatctggttaaatatgaagggtccatgaaagtgtctatgaccccctgcaatcaactgcagttcgatattaggctggatgtacttattacttacactttttgcttctcctcttttcctgaaccggaattatataaatacgtactgaaacatcagttaatcaagcggcttaacgcgtgctag

SEQ ID NO: 23998 - DNA, 3120 bp, Artificial Sequence
  Description of Artificial Sequence: Synthetic coding sequence
atggccgtgcagctggtgcccgacagcgccctgggcctgctgatgatgaccgaaggacgacgatgccaggtgcatcttcttgatgacagaaaactcgaactgttggtgcagccaaaactcctggccaaagaactcctggatttggtggcatctcattttaatcttaaggaaaaagaatatttcggtatcgcctttacagacgagacaggccatctgaactggctccagttggataggcgggtcctggaacatgatttccccaagaaatctgggcctgtggttctatacttttgtgtcaggttttacatcgaatcaatcagttatctgaaggataacgcgacaatagagctgtttttcctcaatgcgaaatcttgcatctacaaagagctgatagatgtggatagtgaagtggtgtttgaactggcctcttacatccttcaggaggcaaagggggatttcagctctaacgaagtggtgcggtccgacctgaagaaactcccagctctgcctacccaggcactcaaggagcatccgtccctagcctactgcgaggatagggtaatcgagcactataagaagctcaatggccagacccgaggacaagccattgtgaattatatgtcaatcgtcgaatccctgccgacctacggggtgcactattatgctgtgaaagacaagcagggaattccatggtggctaggcctgtcttataaagggatctttcaatatgactaccatgataaagttaaaccacgcaagatatttcagtggcggcaactggagaatctgtattttcgggaaaaaaagttttctgtggaggtgcatgatccgagacgagcctcagtaacccgccgcacttttggtcactcggggattgccgttcacacttggtacgcttgtcccgctctgataaagagcatttgggccatggcaatctcccagcaccagttctatctggatcgcaagcagtccaaatctaagatccacgccgcccgatccctaagtgaaattgctatagatctgactgaaaccggtactctgaaaacaagcaagctcgctaatatgggctcaaaggggaaaatcataagcggttcatccggcagcctacttagttctggatcccaggagtccgatagctcacagtccgctaaaaaggacatgttagcagcattgaaatcccgacaggaagccttagaggagactttaaggcagcgcctggaagagcttaagaagctctgcctccgagaggccgagcttacgggaaaactgcctgtggagtatcctttagaccccggagaggagccacccattgtccgccgacggattgggactgcctttaagctggacgaacaaaaaattctccccaaaggagaagaggctgagctggagagactggagagggaattcgcaatccagtctcagatcactgaggccgctcggagactggcttctgaccccaacgtgtccaagaaactgaagaagcagagaaagacgagctacctgaatgctcttaagaaactacaggagatcgagaatgccataaacgaaaaccggatcaaaagcggcaagaaacctactcagcgcgcctccctcataatcgatgatggaaacattgcatctgaagacagttctctgtccgatgcccttgtccttgaagacgaagacagccaggtaacgagcacgatctctccactacattcccctcacaaaggtcttccaccacggccgccatctcacaaccgtcctccaccccctcagtcccttgaggggcttcggcagatgcactaccacaggaacgactacgataagagccctataaaacccaagatgtggagcgagtcgtctctagacgagccttatgaaaaagtcaaaaaacgatctagccactctcattcatccagccataagcggtttcctagtaccgggagttgtgccgaggctggcggcggctccaatagcctccagaattctcctattagaggtctgccacactggaatagtcagagctctatgcctagcacccctgatctcagagtgcgcagccctcactacgttcattcaacgaggagcgtcgacatcagtcccacacgcctccacagcctggccctccattttcggcaccggtcctcctctttagagtcccagggaaagctgctgggctctgagaatgataccggcagtcccgacttttacaccccccggacccgtagtagtaatgggtccgatcccatggacgactgtagctcttgcaccagccactcctcctccgagcattattatccagctcagatgaatgccaactacagcaccctggcagaagactcaccttccaaagccaggcagcggcaacgtcaacggcagcgcgccgccggcgctttggggagtgcttcgtccggctccatgcccaacctggccgcccgaggtggggctgggggtgcaggcggtgcgggagggggggtttatctgcactcacagagccaacctagctcacagtacaggattaaggagtacccactgtacattgaaggcggcgccacacccgtggtcgttagaagcctggaaagcgaccaggaaggccactacagcgtgaaagcacagttcaaaacgagcaattcttacaccgctggaggactcttcaaggaatcctggaggggaggtggcggcgacgaaggagacacgggacgactgacgccaagcagatctcaaattttgcggacacctagtctcggtcgggaaggagcgcacgacaaaggcgctggaagagccgcagtgtcagatgagctgcgccagtggtaccagaggtctacagcgagccataaggagcatagccgcctatcccatacaagcagcacctccagtgacagcgggagccaatacagtacatcaagccagtccactttcgtcgcccattctagggtcacccggatgccacagatgtgcaaggctacttcagcagcattgccacagagccaacggagtagcactccatcctctgagatcggcgctacgcccccgagctcacctcaccacatcctgacatggcagactggcgaggccaccgaaaattcccccatcttggacggctcggagtctccacctcatcagagcacagacgagtag

SEQ ID NO: 23999 - DNA, 3228 bp, Artificial Sequence
  Description of Artificial Sequence: Synthetic coding sequence
atggtggtggaggtggacagcatgcccgccgccagcagcgtgaagaaacctttcgggctgagatctaaaatgggaaaatggtgctgtagatgtttcccatgttgcagggagagcggtaagagcaacgtgggcacttccggcgaccacgacgactccgctatgaagaccctccgctcaaaaatgggtaaatggtgtcgccattgtttcccgtgttgtcggggctcagggaaatccaatgtgggcgcctcaggcgaccacgatgacagcgccatgaaaacgcttcgaaataagatgggaaaatggtgctgtcattgcttcccctgctgtcggggctcctctaagtccaaggtcggagcatggggggattatgatgactctgcctttatggaaccgagatatcatgtcaggggtgaggatctcgataaactgcatagagcagcttggtggggtaaggtgcctcgtaaagacctgatcgtgatgctgcgagacactgatgtaaataagcaggataagcaaaagcgaactgcccttcatctggcttctgctaacggaaattctgaggtcgtgaaattactactggacaggagatgccagctcaatgttttggataataaaaaacggacggcgctcattaaagccgtccagtgccaggaggatgagtgcgctctaatgctcttggagcacggaacggacccaaacattcccgatgaatatggaaacactactctgcactacgcaatttataacgaggataaactcatggcgaaggctctgctgctttatggggctgacatcgaatcgaagaataagcatggactgacaccacttctgctgggcgtgcatgagcaaaaacagcaggttgtcaaatttctgatcaagaagaaggcaaatctcaacgccctggacaggtatgggcgaacagccttgatacttgctgtttgctgcggtagtgcttctatcgtgtcattactgcttgagcagaatattgacgtctccagccaggatctttccggccagacagcaagggaatatgcagtctctagccaccatcacgtgatatgccaattacttagcgactacaaggagaagcagatgttaaagatatcatctgaaaacagcaaccccgagcaagacctcaagttgacctccgaggaagaatcacagcgattcaaagggagcgagaactcacaacctgaaaaaatgtctcaggaacccgagatcaacaaagacggagacagagaggtagaggaggagatgaagaagcatgaatcaaacaatgttggcctgctggaaaacctgacaaacggagtgactgcgggcaacggcgacaatggtctgatccctcagcgtaaaagccgtacccctgaaaaccagcagtttcctgacaacgagtccgaggagtatcacagaatctgcgaactgcttagcgattataaagagaaacagatgcctaagtattcttccgagaactccaaccccgagcaggacctaaagctgacctccgaagaagaatcacaacgcctcaagggcagtgaaaatggccagccagagaaaagatcacaggagcccgagatcaacaaagatggagatcgagaactggaaaattttatggctatcgaagagatgaaaaagcaccggagcacacacgtggggtttcccgagaatcttaccaatggcgcaactgccggcaacggtgatgacggactgattcccccacgcaaatccagaactcctgaatcacagcagtttcctgacacagagaatgaggagtatcactccgacgagcagaatgacacccagaaacagttttgtgaagaacagaacactggcatcctgcacgacgagatactgatccacgaggaaaagcaaatagaagtggtggaaaaaatgaacagcgaacttagcctgagttgcaagaaggagaaagacatcctgcatgaaaacagcacgcttcgggaggaaatcgccatgttgagactggagttggatacaatgaagcaccagtcacagctccgagaaaaaaaatatcttgaggacattgaatccgtgaaaaagagaaacgataatctgttaaaggcgcttcagctcaacgagctgacaatggatgatgacaccgccgtcttggtgatcgacaatggtagcggtatgtgtaaggctggattcgccggcgatgacgccccaagagccgtgttcccttccatcgtggggaggcctcgacagcaaggtatgatgggcggcatgcatcaaaaggaaagctatgtcggaaaagaggcccagtctaagcggggcatcctcaccctgaagtaccctatggagcatggaatcatcaccaactgggacgacatggagaagatttggcatcacacattctacaatgaactgcgggtcgcgcctgaagagcaccccgtgctgctcaccgaggcgaccctaaaccccaaggctaatagagaaaaaatgacacaaattatgttcgagacgtttaatacccctgcaatgtacgtggcgatccaggccgtccttagcctgtatacgtccggccggaccaccggaatagtcatggacagcggggacggcgtgacccatactgtgcccatctatgagggcaacgcattgccccatgctactctccggttggatctggcaggtcgcgaactgcccgactacttgatgaaaattttaactgagcatggatatagattcactacaatggcagagagagaaattgtgcgcgacatcaaggagaaactctgctacgtggccctggattttgaacaagagatggcgaccgtagcttcatcttcttccctggaaaagtcctatgagctgccagacggacaggtgattaccataggtaatgaacggttcaggtgtccagaagcgctcttccagccctgtttccttggaatggagtcctgcgggattcatgaaacaacctttaacagcatcatgaagtcagacgtagacatccgcaaagacttatatacaaataccgtcctctctggaggcaccacaatgtaccccggaatggcacacaggatgcagaaggagatcgcggcgctggcccccagcatgatgaagatccggattatcgcccccccaaaaagaaagtacagtgtctgggtgggcgggagcattctggcctcactgtcaacgtttcaacagatgtggatcagcaagcaagaatatgacgagtcaggtccctctatagtgcatcgaaagtgcttgtag

SEQ ID NO: 24000 - DNA, 1752 bp, Artificial Sequence
  Description of Artificial Sequence: Synthetic coding sequence
atgctgagcgagagcaaggagggcgaggagaaggaggaggtgaccatggacacatccgagaacagacccgagaacgatgtgcccgaacccccaatgcctatagccgatcaggtgagcaacgatgaccggcccgagggaagcgtggaagatgaggagaaaaaagaatctagcctcccaaagtcgtttaaacgtaagatctctgtcgtgagcgccaccaagggtgtgcccgccggtaactccgacacagagggcgggcagcccgggcgtaagcgccggtggggagcatcaaccgccaccactcagaagaagcccagcatatctattaccaccgagtctctcaagtcactgatcccagacatcaaacccctagcaggtcaggaagccgtggtggatcttcacgccgacgactcccgcatcagtgaggatgaaaccgagcgaaacggagacgacgggacccatgacaagggcctcaagatctgtcggacggttacccaggtcgtgccagccgaaggccaagagaatggacaacgggaggaggaggaggaagaaaaggagcctgaagcagagcctcccgtgcctcctcaggtgtccgtggaggtagccctgcctccccctgccgagcacgaagtaaagaaagtaaccctgggcgacacgctcactagacgctccatttcccagcagaaatctggggttagtatcacaatcgatgatcctgtcaggaccgcacaagtgccatctccccctcgtggcaaaatttccaacatcgtacacatttcaaacttggtgcgtcccttcaccctgggccaactgaaggaacttctgggcagaacaggaaccctagttgaggaggcattctggatagacaaaatcaaaagtcactgctttgtgacgtactccaccgttgaggaagctgtggccactcggaccgcactgcacggggtaaagtggccacagagcaatccaaaattcctctgtgcagattatgctgagcaagacgagctagattatcacaggggcctgttggtcgaccggccatcagaaacaaaaacagaagagcagggcatacccaggccactccaccctccacccccacctcctgtgcagccccctcaacacccccgggccgaacagcgcgaacaggagagagcagtcagggaacaatgggccgagagagagagagaaatggagaggcgggaacgaacaaggagtgagagagaatgggatcgtgataaggtcagagagggccccagatcacgttctcgtagccgtgaccggagaagaaaggagcgagccaagagcaaggagaaaaaatccgagaagaaggaaaaagcacaggaagaaccaccagccaagttgttggatgatctttttagaaagacaaaggctgctccatgtatctattggctgccattgaccgattcacaaatcgtgcagaaagaggctgagagggctgagcgtgccaaagaaagggagaagaggagaaaggagcaggaggaagaggagcagaaagagagggagaaggaggccgaaagagaaaggaataggcaactggagagggagaagagacgggaacactctcgcgagagggaccgggagcgcgagagagagcgggagcgcgaccggggagacagggacagggatcgggagagggatagagagagaggcagggaacgcgacagacgcgataccaagcgccactcccgctcgcgaagcaggagcactcctgtgcgcgatcggggaggacgccggtag

SEQ ID NO: 24001 - DNA, 963 bp, Artificial Sequence
  Description of Artificial Sequence: Synthetic coding sequence
atgagcaagagcgccagccccaaggagcccgagcagctgcggaagctgttcataggtggactgagtttcgagacgacagacgagtcactgcgttcccattttgagcaatggggcaccttgaccgactgcgtggtaatgagggacccaaacacaaagcgtagcaggggctttgggtttgtgacatatgcaacagtggaggaggtcgacgccgccatgaatactaccccgcataaagtggatggacgcgtggttgaacccaagcgggcggtgtctcgggaggactcacaacgcccaggggcccaccttaccgtgaaaaaaattttcgtcggcggaattaaggaagataccgaagagcatcatttacgtgactattttgagcagtacggtaaaatagaagtgattgagattatgaccgatagaggctctggtaagaaacgaggtttcgcgttcgtgacgttcgacgaccacgactctgtggataagatcgtcattcaaaagtaccataccgtaaaggggcacaactgcgaggtgcggaaagcactgcctaaacaggaaatggccagcgccagctcttctcaaagaggccgaagaggatcagggaattttgggggcggccggggtgatggattcggcggtaacgacaatttcggtcgcgggggtaacttcagcgggcggggtggctttggtgggtcctgtggtggcggaggctacggcggttcaggcgatggctacaatggcttcggtaatgacgggtctaatttcgggggaggtggctcctacaacgatttcggtaattacaacaatcagtctagtaattttggacccatgaagggaggaaatttcggaggcagatcctccggaccttacggaggaggtgggcagtattttgcaaaaccccagaaccagggcggatatggtgtcagctctagctcctcttcttatggctctggacgaaggttttag

SEQ ID NO: 24002 - DNA, 3294 bp, Artificial Sequence
  Description of Artificial Sequence: Synthetic coding sequence
atggccgccgccgccgccgagcagcagcagttctacctgctgctgggaaatttattaagtcccgataacgtggtccggaaacaggcagaagagacctatgagaacatacccgggcagagcaaaattacgtttctgcttcaggccatacgcaatacaaccgcggcagaagaggcaaggcaaatggcagctgtacttttaagacgcctgctgtcatcggccttcgatgaggtctatcccgccctgccttctgacgtccagactgcgatcaagtcagagctactgatgataatacaaatggagacccagtcttcaatgagaaaaaaagtgtgtgatattgctgcagagttagcccgcaatctcattgatgaggacgggaacaatcagtggcctgaagggctgaaattcctcttcgattcagtctcctcccagaacgttgggcttcgggaggccgcactgcatatattttggaattttcccggcatatttggtaaccagcagcagcattacttggatgtcatcaaaagaatgcttgtgcaatgtatgcaggaccaggaacaccccagtatcaggactctctccgcgcgggcaacggcagctttcattcttgccaacgaacacaacgtcgcgctgtttaagcactttgctgaccttctcccgggtttcctccaagcagttaacgactcatgctaccaaaacgacgactctgtcctaaagtcactcgttgagatcgctgatacagttccaaagtacctccgccctcacttggaggcgacccttcaattatcactgaaactgtgcggggacacctcactcaataatatgcagcgacagctggcactggaagttattgtaactctcagtgagacagcagctgctatgttacgcaagcacacgaacatcgtcgctcaaactatcccccagatgttggccatgatggtagacctggaagaggatgaagactgggctaacgctgacgaactcgaggacgatgacttcgattctaacgcagtggcaggggaatccgcactggatcggatggcttgtggcctgggcggaaagctcgttcttcccatgatcaaggaacatattatgcagatgttgcaaaatccagactggaagtaccggcacgccggacttatggcgctaagcgccattggtgaaggatgccaccaacaaatggagggcattctaaatgagatcgtgaatttcgtgctactgttcctccaggatccccatccaagagtgcggtatgctgcatgcaatgcagtgggccagatggctactgacttcgccccaggtttccaaaagaagttccacgagaaagtgatagctgcattgcttcaaaccatggaagatcaggggaaccaacgggtacaggctcacgctgcggcagctttaataaacttcacggaagattgcccaaaatccttactgattccctacttagataatctggtgaagcacctccacagcattatggtccttaaactccaagaactgattcaaaaagggactaagctagtgcttgagcaggttgtgacgtccattgcctctgtggctgacacagctgaggagaagttcgtgccttattacgacctgtttatgcctagcctaaagcatatcgtggaaaacgcggtgcagaaagaactccggctattgcgcggcaaaaccatcgaatgcatatcacttatcggtctcgcggtcggtaaagaaaaatttatgcaagatgcctctgacgtcatgcagctgctcctcaagacccagactgattttaacgacatggaggatgacgacccccaaataagttatatgatatccgcctgggctcggatgtgcaagattctgggaaaggaattccagcagtacctgccagtcgtgatgggaccactgatgaaaactgcctccattaagccagaggtggctctgttggacacccaagacatggaaaatatgagtgatgacgacgggtgggaatttgtgaacctcggggaccagcagtccttcggcatcaaaaccgcaggcctcgaggagaaatccaccgcttgccagatgctggtctgttatgctaaggagttgaaagagggatttgtggaatacaccgagcaggtagtaaaactaatggtacccctcctcaagttttactttcacgacggcgttagggtggccgccgccgagtctatgcccctcctgttggagtgtgcccgggtgcgaggacctgagtacctcacccaaatgtggcactttatgtgcgacgcactcattaaggcaatcgggacagagcccgacagcgatgtcctgtctgaaatcatgcacagtttcgcaaaatgcatcgaagtaatgggggacgggtgtctgaacaacgaacatttcgaagaactgggcggcatattaaaggccaagctcgaggaacactttaagaaccaggagctgaggcaggtgaagcgccaagacgaggattacgatgagcaggtcgaggagagcctgcaggacgaagacgacaatgacgtgtacattctgacgaaggttagtgacatcctacactccatattctcttcttacaaagagaaagtgctcccctggtttgagcaacttttaccattgatcgttaacttgatctgccctcatcgcccctggccagaccgtcaatgggggctgtgtatcttcgacgacgtgattgaacattgcagccctgcatcctttaagtacgccgagtacttcctaagaccgatgctacagtacgtgtgtgacaattcccccgaagtgaggcaagccgctgcctatggcctgggggtgatggcacaatacgggggagataactacaggccattttgcacagaagctctacctcttctggtgagggtgatccaaagcgccgacagtaagactaaggaaaacgtaaatgcaacggagaactgtattagcgctgtaggtaaaattatgaagtttaagcccgattgcgtgaacgtcgaggaagtactgccacattggcttagctggctgcctttacacgaggacaaggaggaagccgtccagacattcaactatctctgcgatctaatcgagtcgaaccacccaattgtgctgggacccaacaacacaaatcttcccaagattttctctatcatcgcagagggagagatgcatgaggcgattaagcacgaggacccttgcgccaaaagactggctaatgtagtgaggcaggtacagacgtctggcgggctgtggacggagtgtatcgcccagctttctccagagcagcaggccgcgattcaggagctattgaacagtgcatag

SEQ ID NO: 24003 - DNA, 2715 bp, Artificial Sequence
  Description of Artificial Sequence: Synthetic coding sequence
atgttccccgccctggagacccacctgaagcagaccatccccgacccctatgaggactttatgtacaggcacctccaatactatggctattttaaggcccagcgaggttccttgcctaactcagcgacccaccagcatgttcgaaaaaacaatccccagtgtctcctcaacggctcattgggggaaaaagatgacctaattcctgatacactacaaaaggagaagctgctgtggcccatttctctgagtagcgcggtacatcggcagatcgaggccatcaatcgcgacttccactcctgccttggctggatgcaatggcggggactatccagtctgcaaccaccgccgccacggtttaaagattccccggcctcagcgttcagggtggccggtatcacggattctcacatgctatcacttccacacctcaggagccgtcagcttctgtatgatgagttagacgaggtgaatcctcggctgcgggagccacaggagctgtttagcatcctctcaactaagcgtcccctccaggccccacgttggcctattgagtgtgaagttatcaaagagaacatccatcatattgagtgggcaccccctcagcctgagtatttctaccaaccaaaaggaaatgaaaaagtgcccgaaatcgtaggggagaaaaaagggaccgtggtttatcagctcgactcagtacccatcgaagggagctatttcacatcttctagagtggggggaaaacggggaatcgtcaaggagctggctgttacacttcaaggacctgaggacaacacactcctctttgaatcccgctttgaatctggcaatctccagaaggccgtgagggtggatacctatgaatacgaattgaccctcaggactgatttatacactaacaagcacacccagtggttctactttcgcgttcagaatacgcggaaggatgcgacgtacaggttcacaattgttaatcttttaaagcccaagagcctgtacaccgtaggcatgaaacctctcctttattctcagcttgacgccaacacaaggaacattggctggcgtagggaaggtaacgagatcaaatactacaagaataacaccgacgacggccagcagccattttactgcctcacctggacaatccagtttccatatgatcaggacacttgctttttcgcacacttttatccctatacttatactgatctacagtgctacctgcttagcgtggccaacaatcccatacagtctcagttttgcaagctgcagacgctgtgccggagcctggccgggaacaccgtttatctgctgaccataacgaacccatcacagacaccacaggaggccgccgcaaagaaggccgtggtgctttccgctcgagtgcaccctggggagagtaacggaagttgggtcatgaagggcttcctggactttatcctgagcaatagtcccgatgcacagctgttaagagacatatttgtctttaaggtcctgccaatgctaaatcccgatggcgtcattgtgggaaactatcggtgtagcctggctggcagggacctgaacagacactataaaacgattttgaaggaatcattcccttgcatctggtacactaggaatatgatcaagcgcttgttggaggaaagggaagtgctcctctattgtgatttccacgggcattccagaaagaataatattttcttgtatggttgcaacaacaacaatagaaagtactggcttcatgagagagtgtttcccctcatgctgtgcaagaacgctcctgacaagttttccttccactcttgcaactttaaagtacagaaatgcaaggagggtactgggagagtcgtcatgtggcgcatggggattcttaactcatacaccatggaatctactttcggcggctctacattagggaataaacgggacacgcattttaccattgaggacctgaaatcactgggttaccatgtgtgcgacacactacttgatttctgtgacccggaccagatgaaatttacgcaatgtctggctgagctgaaggagcttctgcggcaggaaatccataaaaagtttcatgaattgggccaagacgttgatctggagggtagctggagtgacatttctctgtcggacatcgagagcagaaattcgacctctggttccgactctagcttatccgacggactcccagtgcatttggcaaatatagcagacgagctgacacagaaaaagaagatgttcaaaaaaaagaagaagaagagtctgcagacacggaagcagcgcaatgagcagtatcaaaagaagaaccttatgcaaaaattgaaattgaccgaagatacctccgagaaagccggattcgcctccaccctgcagaaacagcccacgtttttcaaaaactcagaaaattctagcttcctcccaatgaaaaatgaaaatcctcgactgaacgagactaatctgaaccgacgcgacaaagatacaccccttgaccccagcatggccacgctgattctgcctaaaaataaaggtaggatgcagaataaaaaacccggtttcaccgtgtcctgttctcccaaacggaccatcaacagttcacaggagcccgcaccggggatgaagcccaattggccccgctccagatatcctgcgaccaagcggggatgcgccgcaatggcagcttacccctctctccacatctacacgtacccttag

SEQ ID NO: 24004 - DNA, 789 bp, Artificial Sequence
  Description of Artificial Sequence: Synthetic coding sequence
atggccctgagcctgggctggaaggcccaccggaaccactgcggcctgctgcttcaggcgttgcgctcgagcggcctccttttattcccttgcggccaatgcccttggcgtggggctggatctttcttggatcccgagatcaaagcctttttggaggagaacacagaggtgacatcaagcggctccctcacccccgagattcagctgagattgctaactccaagatgtaagttttggtgggagagagctgacctgtggccccactccgatccttattgggccatctattggccaggagggcaggctctctctcgctaccttctggacaatcctgatgtcgtgcgcggaaagtctgtcctggatctgggctcaggctgtggtgcaacagccattgctgctaagatgtccggggctagtcgtattttagctaatgacattgatccaattgctgggatggcaattacactcaattgcgaattgaaccggttgaacccattcccaattctgatccaaaacattcttaacctagaacaggataaatgggacttggtggttctgggtgacatgttttatgacgaggacctcgcagatagcctgcaccaatggctgaaaaaatgtttctggacgtacagaacaagggttctgattggggacccagggcgccctcagttttcagggcatagtattcagcatcatttgcacaaggttgtagagtattcactactggagtctacccgacaagaaaactcagggctgacaacgtctactgtatggggtttccagccatag

SEQ ID NO: 24005 - DNA, 2619 bp, Artificial Sequence
  Description of Artificial Sequence: Synthetic coding sequence
atgaactaccccggccggggcagcccccggagccccgagcacaacggaagaggtggggggggaggagcctgggaactgggatcagatgctcggcccgctttcggtggaggcgtctgttgttttgaacacctacctgggggcgaccctgacgacggagacgttccactggctttgctgaggggagaaccgggcctgcatcttgcccctggcactgacgatcacaatcaccacctggctttagacccatgcctatctgacgaaaactatgatttttcttccgctgagtctggaagctctctgaggtactattcagagggggaatctgggggcggaggctcatcacttagtcttcatcctccgcagcagcctcctttggtccctaccaatagtgggggaggcggcgcaactggggggtcccctggcgaaagaaagaggaccagattgggaggcccagccgcccggcacaggtatgaagttgtcactgaacttggcccggaagaagtacgctggttctataaggaggacaaaaaaacctggaagcccttcatcggatatgattccctgcgcatcgagttagcattccgcacattgttgcagaccacaggcgcaaggcctcagggaggcgatcgagatggggaccacgtatgcagtcctacaggcccggcgagttctagtggagaggatgatgatgaggacagggcttgcgggttctgtcagtccacgactggacatgagcccgaaatggtggagctggtgaatattgaaccagtctgtgtaagagggggcctttatgaagtcgacgtgactcagggtgagtgttatcccgtatattggaaccaggctgacaagattccagtcatgcgaggtcagtggtttatcgacggtacctggcagccgctcgaggaggaggagagcaacctcattgaacaggaacatttaaactgttttcgggggcaacagatgcaggaaaactttgacatcgaagtctccaaaagcatagacggcaaagacgccgtacactccttcaaactgagcagaaatcacgtcgattggcactccgtggatgaagtctatctgtactcggacgcaaccacgtctaaaattgccaggactgtgactcagaagttggggttttccaaagcatcaagttccggaacacgcctacataggggttacgttgaggaggctaccttggaagacaaaccctcccagactacgcacattgtcttcgtagttcacggcattggccagaagatggatcaggggcggatcataaagaacacagcaatgatgcgagaagccgcccgcaagatcgaggaaaggcacttctcaaaccatgccacccatgtggagtttctccctgtcgagtggcgtagcaaactcacacttgacggcgataccgtcgattctataacaccagataaagtgaggggcctgcgtgacatgctgaactcctcagctatggatattatgtactacacctcccctctgtatcgggacgagttggtgaaagggctgcaacaggagctcaacaggctgtactctctcttttgctctaggaatcccgattttgaggaaaagggtggcaaagtgtcaatagtgtcccattccttgggttgcgtgatcacgtatgacatcatgaccggttggaatcctgtcaggctgtacgaacagttactgcagaaggaggaggagctgcccgacgagagatggatgagttacgaagagagacatctgctggatgaattgtatataaccaagcgtcggctgaaggagatagaggaacgccttcacgggctgaaggctagcagtatgactcagactccagccttgaaattcaaggtcgaaaatttcttctgcatgggaagcccactggcagttttcctggccctgcggggcatcagaccaggcaataccggatcacaggatcatatcctgcctagagaaatttgtaacagattgttgaacatcttccaccctactgatcccgttgcctacagattagaacccttgattcttaagcactacagtaacatcagtccggtccagattcattggtacaataccagcaaccccctgccctacgaacacatgaaacctagctttctgaatcctgcgaaagagcctacctccgtgtcagaaaacgaaggcatttccacgatcccttctccagtgaccagcccggtactgtctagaaggcattacggcgaatccatcactaacattgggaaagccagcattctgggcgccgccagcataggaaaaggtttgggagggatgctgttctcaaggttcgggagatcatctacaacacagtcatctgaaacgagtaaagattctatggaggacgagaagaaaccagtagcttcgccctcagccactacggtcggtacacaaaccttaccccactccagttccggcttccttgacagtgctcttgaattggatcaccggatcgattttgaacttcgcgagggcttggtggagagcaggtactggtctgccgtaactagtcatactgcttactggtccagccttgacgtggccctgttcctgcttacctttatgtataagcacgagcacgacgacgatgccaagccgaacctggaccccatctag

SEQ ID NO: 24006 - DNA, 1461 bp, Artificial Sequence
  Description of Artificial Sequence: Synthetic coding sequence
atggtgagccacaccttccacatgcggaccgaggagagcgacgcctcgcaggaaggcgatgaccttcctaaaagctcagcaaatacaagtcatcccaagcaggacgatagtcctaagtcaagtgaggagactatccagcctaaagaaggcgacatccctaaagctcctgaggaaaccatccagtccaagaaggaggatctcccgaagtccagcgagaaggcaattcagcccaaggagtccaacattcccaaatctagcgccaagcccatccagcccaaactcgggaacatcccaaaggcttccgtcaagccttctcaacccaaagaaggggacattccaaaggctcctgaggagactatccagagtaagaaggaagatctgcccaaatcttccgaggaagcaatccaacctaaggaaggggacattcccaagagttcagccaagcccatccagcccaagttgggaaatattgctaagacgtctgtgaagcctagccagccaaaggagagtgatatacccaagtctccagaggagacaatccagcctaaggaaggcgatatcccaaagtctagcgctaaaccgatacagccgaaactcggaaatatacccaaggcgtccgtgaagccctcacagcccaaggagggcgatatcagcaagtcccctgaggaagcaatccagcctaaggagggggaccttcctaagagtttggaagaggccatccagccgaaggagggggatatccccaagagccccgaagaggcaatccaaccaaaggagggagatattcccaagtcgctggaggaggcgattcagcctaaggaaggggacattccaaagtctcctgaagagacaatccagcctaaaaagggcgatatccctaaatccccagaggaggccatccagcctaaagagggtgatatcccgaagagtccaaaacaggctatccagccgaaagagggggatatccccaaatctctggaggaggctatccctcctaaggaaattgacatccctaaatcgccggaagagaccatccagcccaaggaagacgacagcccaaaaagcctcgaagaggcgacaccatcaaaagagggcgacatcctgaagccagaggaggagactatggagtttcccgagggcgataaggtaaaggtcattctgagcaaagaggacttcgaggcaagccttaaagaggctggagagaggttggtcgccgtggatttcagcgctacttggtgcgggccctgtaggaccatcaggcccttctttcacgctctgtccgtgaaacatgaggatgttgtcttcctggaggttgacgctgataactgcgaggaagtcgtgagggagtgtgccatcatgtgtgtgcccacattccagttttacaagaaagaggaaaaggtggacgagttatgtggggccctgaaagagaaactggaggccgttatcgcagaactgaagtag

SEQ ID NO: 24007 - DNA, 1005 bp, Artificial Sequence
  Description of Artificial Sequence: Synthetic coding sequence
atggccgccagcggcagcggcatggcccagaagacctgggagctggccaacaacatgcaggaagcgcaatccattgatgagatttacaagtatgacaagaagcagcagcaggagatcctagccgctaagccgtggacaaaagaccatcactactttaaatattgcaaaatctcagcccttgcccttcttaaaatggtaatgcacgccagatctggaggaaatctcgaggtcatgggcctgatgttggggaaagtcgacggagagaccatgattatcatggattcctttgcgctgcctgtggaggggactgagacacgcgtcaacgcccaggctgcagcttatgaatatatggcggcctacatagagaacgctaaacaggtgggtcgactggaaaacgctattggctggtatcattcccatcccggatatggttgctggctgagtggaatcgatgtgagtacacagatgctcaatcagcagttccaggagccattcgtggccgttgttatagatcctaccaggacaatcagcgcaggaaaagtcaatctgggtgcgttccgcacctaccccaaaggttacaaacccccggatgagggtccgtctgaatatcaaacgatccccctcaacaagattgaagactttggtgttcactgtaaacagtattacgccctggaggtgagttatttcaaatcttctctggacagaaagctcctcgagctcctatggaataagtactgggtcaacacactgtccagttcttcgctcttgaccaacgctgattacaccacaggtcaggtgttcgacctatcagagaaactcgaacagtcggaagcccagctggggcgcgggagttttatgctgggcctggagacgcatgaccggaagtctgaagataaactggccaaggctacaagggactcgtgcaagaccacaattgaggctatccatggcttgatgagccaggtaatcaaagataaactgttcaatcagatcaacatcagttag

SEQ ID NO: 24008 - DNA, 1350 bp, Artificial Sequence
  Description of Artificial Sequence: Synthetic coding sequence
atggtgatggagaagcccagccccctgctggtgggccgggagttcgtgcggcaatattatacactcttaaacaaggctcccgaatacctgcaccggttctatggtcggaattcttcgtacgtccatggaggcgtcgatgcctcaggcaagccccaggaggccgtctatgggcaaaacgatatccatcacaaggtactgtcccttaacttctcagagtgccatacgaagattcgccatgtggacgcgcatgctacactgtcggatggtgtggtggtgcaggtgatgggattgttaagtaattcaggccagcccgaacgcaaattcatgcagacatttgtgcttgcgccagaaggctcagtgcctaacaagttctacgtgcacaacgacatgtttaggtacgaggatgaggtattcggcgactcagaacctgagctcgacgaggagtctgaggacgaagtggaagaggagcaggaagaaagacaaccgtcccccgagccggtgcaagagaacgccaacagcggatactatgaggctcaccccgtgacaaatggaattgaggagccactcgaggaatcatctcatgagcccgaacctgagcctgagtcggaaacgaaaaccgaagagctgaagccacaggtggaagagaagaatttggaagaactggaggagaagtctaccacccctcccccagccgaacccgtgtcccttccgcaggagcccccgaagccccgtgtcgaggccaagcctgaggtacagagccagccaccaagggtgagggaacaacgcccccgcgaacgccccgggtttcctccacgaggcccccggcccgggcgtggagatatggagcaaaacgattcggataataggagaatcatacgctaccctgattcccatcagctctttgtcggaaacttacctcatgatattgacgagaacgaacttaaagaattttttatgagtttcgggaatgtcgtcgaattacgaatcaacaccaaaggagtcggcggaaagttaccgaattttggcttcgtagttttcgatgactcagagcccgtgcaacgcatcctcatcgccaaaccgatcatgtttcgcggcgaggtccgactgaacgtcgaggagaaaaagactagagcagccagggaacgcgagacaaggggtggtggcgacgatcggcgggacatccggcgcaacgaccgcggacccgggggcccccggggtatcgtcggcggtggaatgatgcgagacagagatggaagggggcctcctccccgcggaggaatggctcagaagcttggatcaggccgcggaacgggacaaatggaaggacggttcactggccagcggcgttag

SEQ ID NO: 24009 - DNA, 333 bp, Artificial Sequence
  Description of Artificial Sequence: Synthetic coding sequence
atggaggagatccccgcccaggaggccgccggcagcccccgggtgcagttccagagcctcgagactcagagcgagtgcttgagtccagagccgcagtttgtgcaggataccgacatggagcagggactgactggagggattcttttgagactccccactaccaggattcactctgttaatagctgcccggcattgtcacacactcaggcctctgcattttcaggagagaccctcgcggtgttaaccgctggcatttccaagcgctggcctaagtataggctcccgatcgatatcgccagaccatgttcagagacaccgttcccccgtctgtag

SEQ ID NO: 24010 - DNA, 822 bp, Artificial Sequence
  Description of Artificial Sequence: Synthetic coding sequence
atgggccagaaggtgaccggcggcatcaagaccgtggacatgcgggatcccacataccggcccttgaagcaggaactgcagggcctggactactgtaagcctacgagactggacctgcttctcgacatgcccccggtgagctatgacgttcagctgttgcactcgtggaataataacgaccggtctcttaatgtgttcgtgaaagaggatgataagttaattttccataggcaccctgtagcacaaagcacagacgctatacgtgggaaagtaggctatacacgtggactgcacgtgtggcagatcacttgggcaatgaggcagagaggtacgcatgcagtcgttggagtcgcgactgctgacgcacctctgcactcagtggggtacactactctggtgggtaataatcatgaatcctggggatgggatttgggtagaaaccgcctctatcacgacggcaagaaccagccaagtaaaacctatccagcgtttttagaacccgacgaaacattcatcgtgcccgattcctttctagtggccttagacatggacgacggaactctgagctttatcgttgatggccagtacatgggggtagcctttagggggctgaaagggaaaaagctgtatcccgtggttagcgccgtgtggggccactgcgaaattagaatgcggtacctgaatgggctggatcctgagcctctgccactgatggatctctgtcggagatctgtgcggttggccctcggacgggaacgcctgggcgaaattcacactctcccacttcctgctagtctgaaggcttacttgctctaccaatag

SEQ ID NO: 24011 - DNA, 2916 bp, Artificial Sequence
  Description of Artificial Sequence: Synthetic coding sequence
ctgagccggcgggtgccctgcgtgcggcggggctgccggcccccccttccccctctccccggctctcaaagtcgggcttggagccgcgatagggaggccccgctggaccccggccgacccgcgcagagcggacgcagaccaaccagccgatctgtgtcgcatgcttgcagttggaatggcggaagcctggacccactagaggggaccccagctctcttgcgctctgccgagcgtctgatgaggaaagttaaaaaattgcggctggacaaagagaatacggggtcttggcgctcatttagcctgaatagcgagggcgccgagcggatggccacaactggtacccctactgcggaccgcggcgacgctgcagcaacagatgaccccgccgcaagattccaagtccagaagcactcctgggacggtcttaggtctatcatccatgggtcacggaaatattccggtttgattgtgaataaggcccctcatgatttccagttcgttcagaagacggacgagagtggacctcactcgcaccgcctctattatctgggtatgccctacggatccagagagaactccctgctttacagtgagatccctaagaaggtgcggaaggaggccctgctcctgctctcctggaaacagatgctggaccattttcaggctactccccatcatggggtgtatagccgcgaggaagaactattacgagagcggaaaaggctaggggtattcggaattacaagctatgatttccacagtgaaagcggcttatttctcttccaggcctcaaacagtcttttccattgccgcgatggtggtaagaatggattcatggtgagcccaatgaaaccccttgagatcaaaacgcagtgctctggacctcgcatggatcctaagatctgcccagctgatcctgcctttttcagctttatcaacaattcggacttgtgggtggctaatatcgagaccggcgaagagcggaggctgacattctgtcaccaaggcttaagcaatgttctggatgaccccaagagcgctggcgtggcaacatttgtgattcaggaggaatttgacaggttcaccggctattggtggtgtccaacagcctcgtgggaaggcagcgagggactgaaaacattgagaatcctgtacgaggaagtggatgagagcgaggtggaggtgattcacgtcccttccccagctctcgaggagcggaaaaccgactcttatagatacccccggaccggttccaaaaatccaaagattgccctcaaacttgctgagttccagacagactcccagggcaagattgtctcaacccaggagaaagaactggttcaacctttcagctccctgttcccaaaggtggagtacattgccagggcaggatggacaagggacggcaagtacgcctgggcgatgttcctggatagaccccagcagtggctccagttggtgctgttacccccggcgctctttattccctccaccgaaaacgaggagcagaggcttgctagtgctcgcgccgtgcccaggaatgttcaaccctacgtagtttatgaggaggtgaccaacgtttggataaatgttcacgatattttttatcccttcccccaaagcgagggtgaggatgaactgtgttttctgagggctaacgaatgtaagactggcttttgtcatttgtataaggtgaccgccgtgctaaagtcacagggctacgactggtcagagccgtttagtccgggagaggatgagttcaagtgcccgataaaagaggaaatcgccctgaccagcggcgagtgggaggtcctggccaggcacgggtcaaaaatttgggtgaacgaggagaccaagttagtctactttcagggcaccaaagacactcctctggagcaccacctgtacgtcgtaagttacgaagccgctggggagattgtaaggctcactactccgggtttctcccatagctgttccatgtctcaaaattttgatatgtttgtatctcactattcttccgtgtctacacctccttgcgttcacgtctacaaactatccggacccgatgacgaccccctacataagcagcctcgcttctgggcaagcatgatggaggctgctagctgcccaccggattatgtgcctccagaaatattccactttcacacgcggtcagatgtaaggctctatggcatgatttataagcctcatgccctacagccgggcaagaaacatcctacagtcctgttcgtctacggaggcccccaggtgcagttggtgaataacagctttaaaggcattaagtacctgagactgaacacattagccagtctcggatacgctgtggtagtgatcgacggccgtgggtcctgccagcgcggactcagattcgagggcgcccttaagaaccagatgggccaggtggagattgaagatcaggttgaagggctgcagttcgtggcagaaaagtatggttttatcgacttgagcagggtggctatccacggttggtcatacggaggtttcctcagtctgatgggtctcatccacaagcctcaggttttcaaagttgcgatcgccggcgctcctgttaccgtgtggatggcctatgacacaggctacacagaacgctatatggatgtgccagagaataaccagcacgggtacgaggccggatccgtcgctctccacgtcgagaaactgcccaacgaaccaaatcggctgttaatccttcacggatttctagacgaaaatgtccacttctttcatacaaactttttggtatcgcagctgattagagcgggcaagccctatcaactgcagatttacccaaacgagcggcattctatccgatgtccagaaagtggcgagcactacgaggttaccttactccactttcttcaagagtatctctag

SEQ ID NO: 24012 - DNA, 2592 bp, Artificial Sequence
  Description of Artificial Sequence: Synthetic coding sequence
atgggcaaccgggagatggaggagctgatccccctggtgaaccggttacaggatgccttctccgcactcgggcagagttgcctcttggagttgcctcaaatagcagttgtgggcggccagagtgccgggaagagctcagttctagaaaactttgtaggtagggattttttgccccggggttcgggaattgtgacacggaggcctcttgtcctgcaactggtgacttccaaggcggagtacgcagaattcttacattgcaaaggtaaaaaattcacggactttgatgaggtgagactggagatcgaggccgagacagacagagtaactggcatgaacaaaggtatctccagcatccctattaacctacgggtgtactcgccccacgttctgaacctgacactgattgacctgccagggatcactaaggtacccgttggagaccagccccccgatattgagtatcagattcgcgagatgatcatgcagttcattacacgggaaaattgccttatcctggcagtgactcctgctaacaccgacttggctaacagcgatgcactaaagctcgctaaagaagtggatcctcaaggcctacgaacaattggggtcatcactaaactcgatctgatggacgagggtacagatgccagagacgtgctggagaataaattattgcctctaaggagaggttatgtgggggtggtaaataggtcacagaaggacatcgatgggaaaaaggacataaaggccgccatgcttgcagaacggaaattttttcttagtcaccctgcttaccgacacattgccgataggatggggaccccccacctgcaaaaggtgctgaatcaacagctgacaaaccatattcgagacactttgccaaactttcgtaacaaactgcagggccaacttctatcgatagagcatgaggtcgaagcttacaagaatttcaaacccgaggacccaacacgaaagaccaaggcccttctccagatggtgcagcaattcgccgtcgactttgagaagcgaattgaggggagcggggaccaggtcgatactctcgagcttagtggcggagctaaaattaacagaatcttccacgagcgctttccattcgaaatcgtgaagatggagtttaacgaaaaggagctccggcgggagataagctatgccattaaaaacatccacggcataagaaccgggcttttcactcccgacatggccttcgaagcaatcgtcaaaaagcagatcgtgaagctcaaagggccatctctgaagtctgtcgatctggtgatccaagaactgatcaatactgtcaaaaagtgcactaagaaactcgccaatttcccgcgcctgtgtgaagagactgagcgaattgtcgccaatcacatcagagagagagaaggaaagacgaaggatcaggtcttactgctaatcgacatccaggtcagttacataaacacaaatcatgaggactttattggttttgcaaacgctcagcagcgcagctcacaggttcacaagaaaaccacggtggggaaccaggttattcgtaaagggtggctgaccatttctaatatcggcattatgaagggcggtagcaaaggatattggttcgtccttactgccgagagcctcagctggtataaggacgacgaagaaaaggaaaagaaatacatgctgcctctggataatctcaaagtccgcgacgtcgaaaaatcttttatgagtagtaaacacatctttgcgctgttcaacacagaacaaagaaatgtgtacaaagattacagattcctagaattagcgtgtgactcccaagaggatgtggattcctggaaagctagtttgctccgagccggcgtctacccagacaagtctgtgggaaataacaaggccgagaatgatgaaaacggacaggccgagaacttcagcatggacccccagttggaaaggcaggtggaaaccatccggaaccttgtggactcttacatgagtataatcaacaagtgcatacgggatttaatccccaagaccatcatgcacttaatgattaacaacgtgaaggattttatcaactctgaattattagctcagctgtatagcagtgaagatcagaacaccttgatggaggagtccgcagaacaagcacagaggagggacgagatgctcagaatgtatcaggccctgaaagaggccctcggcataatcggcgacatatccaccgcaaccgtgagcactccggctccgcctccagtcgacgatagttggatccagcactcccggcgaagtccccctccatcccccacaacccagaggcgcccaactttgagtgcccctcttgccagacctacctcaggccgcggaccggcccccgccattccttctcctggccctcatagtggggccccaccagttccgttccggcccgggcccctgccccctttcccctcaagctctgacagctttggcgctcctccccaggttccctctcggccgactcgggccccaccatcagtgcctagtcgccgccctcccccgtcaccgactcgcccaaccatcatcaggcccctcgaatcaagcctgctggattag

SEQ ID NO: 24013 - DNA, 1263 bp, Artificial Sequence
  Description of Artificial Sequence: Synthetic coding sequence
atgctgaaggccgtgatcctgatcggcggcccccagaagggcaccaggttccgtcccctgtccttcgaagtgcccaaaccgctgttcccagtggccggagttcccatgattcagcatcacatcgaagcttgcgcgcaagtcccaggaatgcaagaaattctgttgatagggttctatcagccagacgaacccttaacccagtttcttgaagccgcccagcaagaatttaatctgccggtccgctacctacaagaattcgccccactaggaaccgggggtggactgtatcactttcgtgaccagattctggccggaagtcccgaggccttctttgttcttaatgccgatgtgtgtagcgattttcccttgagcgccatgctggaggctcacagacggcagaggcacccctttctgctgctcggcactactgctaaccgaacccagtcgctcaattatggctgcatcgtggagaacccccaaactcacgaggtgttgcactacgtggaaaaaccatctacattcatttccgacatcatcaactgtgggatctacctgttcagtcccgaggcattaaaacccttgagagacgtgttccaacgtaatcagcaggacgggcagttggaggatagtcctgggctgtggccgggggctgggaccattagactcgaacaagacgtgttctctgctctcgccgggcaggggcagatatacgtgcatctaacagacggtatttggtcccagattaagtccgccgggagcgcactctacgcctcccgtttatatttgagcagatatcaggacacccacccagaacgcttagctaagcacacccctggcgggccttggattagaggcaacgtgtatatccaccctaccgccaaagtcgccccgtcggccgtattgggccctaacgtgtccattgggaagggcgtgaccgttggcgagggcgtgcggttgagagagtcaatcgttttgcacggtgctacactgcaggagcacacctgtgtgttgcactcgatcgtgggatggggctctaccgtcggccggtgggcacgtgtggaggggacaccatctgaccctaatcccaatgaccccagggctaggatggattctgagagcttattcaaggatggcaagcttcttcctgctataacaatcctgggttgtcgcgtccggatccccgcggaggtgctgattctgaattctatcgttctacctcacaaggagctgagcaggagctttaccaaccaaattatcctgtag

SEQ ID NO: 24014 - DNA, 2481 bp, Artificial Sequence
  Description of Artificial Sequence: Synthetic coding sequence
atggtggcccccgtgctggagaccagccacgtgttctgctgccccaatcgcgtgcgaggtgttctcaactggagcagcggcccccgaggactgttggccttcgggacctcctgcagtgttgtcctctatgatcctctgaaacgcgtggtggtcacaaatctgaacggccataccgcccgagtgaattgcattcagtggatctgcaagcaggatggatctcctagtaccgagctagtgtccgggggatcggataaccaggtgatccactgggagatcgaagataatcaattgctaaaggcggttcatctgcagggccacgaaggccctgtatacgctgtccatgccgtataccagagacgaacctcagacccagcactgtgcactctgatcgttagcgctgccgcagattcagccgtccggttatggagtaaaaaggggcctgaggtgatgtgtctacagaccctcaactttgggaatggttttgccctggctctgtgtctgagttttctccctaacacagacgtaccaatactggcctgcggcaacgacgactgtcgaatccatatcttcgcacagcaaaacgatcagttccaaaaggtcttatcactgtgtggccacgaggactggatccgcggtgtggagtgggcagcgttcggtcgggacctgtttctggcttcctgctcccaggactgcctgatcagaatttggaagctgtacattaaaagcacttctttggaaacacaggacgatgataatattcggctgaaagagaacactttcactatagaaaacgagtcagtcaaaatcgcattcgccgtcactctggaaaccgtgcttgctggacatgaaaattgggttaatgctgtccactggcagccagtcttctacaaggatggagttttacagcagccggtgagactactctctgcctctatggataagaccatgatcctatgggcccccgacgaggaatcaggtgtgtggctcgagcaagtgcgcgtgggcgaagtcggaggcaataccctgggcttttacgattgtcagttcaacgaggacggctctatgatcattgcccacgcatttcatggggcactccatttatggaagcagaacacagtgaatccaagagagtggacccctgagattgtgatctccggccactttgatggcgttcaggatctcgtttgggaccccgagggggagttcatcattactgttggaacagatcagacgactcggctgtttgctccatggaagagaaaagatcagtcccaggttacctggcatgagatagctagacctcagattcacggttacgacttgaagtgtctcgcgatgataaaccgattccagttcgtttccggcgccgatgagaaagtcttgcgcgtgttttcagccccacggaattttgttgagaacttttgtgccatcacagggcagtctctgaatcatgttctatgtaaccaggattccgacctccccgaaggagccacagttccggcactggggttgtcgaacaaagccgtgtttcagggagatattgcgtcgcagcccagtgacgaggaggaattgctgacaagtactggatttgagtaccagcaggtcgcatttcagccttccatcttgaccgaacctccaacggaagaccatctactacagaacaccttgtggccagaagtgcagaagctgtacggccacgggtatgagatcttctgcgtgacctgcaattcttcaaaaactctcctagctagtgcctgcaaggctgccaagaaggagcacgctgccatcattctatggaataccactagctggaagcaggtccagaatttggtgttccacagtctgaccgtgacccagatggcattttctcctaacgagaaatttttacttgccgtgagtagagataggacatggagcctctggaaaaaacaggacaccatctccccagagttcgagcccgtgttcagtctgtttgcctttacaaataaaatcactagcgtgcattccagaatcatctggtcctgtgactggagcccggacagcaaatatttctttactggttcaagagacaaaaaggtggtagtgtggggagaatgcgattccacggacgactgtattgagcataatatcggaccctgtagcagcgtcttggatgtcggcggcgctgtcacggcggtgagcgtctgtcctgtgctccacccgagccagcggtacgtggtcgcggtgggacttgagtgcggcaaaatctgtctctacacctggaaaaagaccgaccaggtgcctgagatcaacgactggactcactgcgttgagacaagtcagtctcagagccacactctggctatccggaaactgtgctggaagaactgtagtggcaaaacagaacagaaagaggctgaaggtgccgagtggcttcatttcgcttcctgcggcgaggaccacacagttaagattcatagggtgaacaaatgcgctctctag

SEQ ID NO: 24015 - DNA, 1152 bp, Artificial Sequence
  Description of Artificial Sequence: Synthetic coding sequence
atggaccggacctgcgaggagcggcccgccgaggacggcagcgacgaagaagacccagactccatggaagcccctacccgcatccgggatactccagaagacatcgtgttggaggctcccgcaagcggactcgccttccacccagccagagacttgctcgcagcgggggatgtcgacggagacgtgttcgttttctcgtactcctgccaggaaggtgaaactaaagagctgtggtccagcggccaccatctaaaggcttgcagggccgtagctttttcagaggatggacagaagctgattactgtgtcaaaagataaggccatccatgtgctggacgtggagcagggtcagctagagagacgagtgagtaaggctcacggggctcctatcaattctctcctgttggtcgacgagaatgtactcgccaccggggatgatactggaggaatctgtctgtgggaccagcgaaaagaaggacctctgatggacatgcgccagcacgaggaatatattgctgacatggccctggatcccgctaaaaaattgctcctgaccgcctcgggagacggttgtttggggattttcaatatcaaacgcagacggtttgagcttctgagcgagcctcagagcggagatctgactagcgtgacgttaatgaaatggggaaagaaggtcgcttgcggcagcagcgaagggactatctatctgtttaactggaatggctttggggccacatccgaccgtttcgccctcagggcagagtccattgactgtatggttccagttaccgagagtctcctttgcacaggctcaactgacggagtgattcgcgcagtgaatatcctccctaatagagtggtggggtccgtgggccagcacaccggtgagccagtcgaggagctggctctgtctcattgcgggaggttcctcgcaagctccggccacgatcaacgcctgaaattttgggacatggcccagcttagagccgtggtcgtggatgactacagacgcagaaagaaaaaaggcggccctcttcgagcactgtcctcaaagacttggtctacagacgatttttttgccggcctgagagaggagggagaggactctatggctcaggaggagaaggaagagacgggtgacgattccgattag

SEQ ID NO: 24016 - DNA, 999 bp, Artificial Sequence
  Description of Artificial Sequence: Synthetic coding sequence
atgagcgaggccggcgaggagcagcccatggagaccaccggcgccaccgaaaatggacacgaggctgtccccgaaggggagagtcccgccggcgcgggtacaggggcagccgccggagcagggggagcgaccgccgcccctccttcagggaatcagaatggtgccgagggtgatcagatcaatgcaagtaagaatgaggaggacgcgggtaagatgtttgtcggtggcctctcatgggacacatccaaaaaagatttgaaggactacttcactaagttcggggaggtcgtcgactgtaccattaaaatggaccctaatactggacgtagtcgcggtttcggctttattctctttaaagatgcggcttctgtagaaaaagtcctagaccagaaggagcatcgactggacggtcgcgtgattgaccctaagaaagccatggctatgaaaaaggacccggttaaaaagatcttcgtgggagggttaaacccggaggccactgaggaaaagatccgcgaatattttggtgaattcggtgagatagaggccattgagctgcccatggatcctaagctgaataaacgcagggggtttgtcttcatcacctttaaagaggaagagccggtgaagaaagtgttagagaaaaagtttcacacagtttccggcagtaaatgcgaaatcaaggtggcccagcccaaggaagtgtaccagcagcagcagtatgggagtggcggcagaggcaatagaaatcgaggcaatagaggctctggagggggagggggtgggggtgggcagtcccagagctggaaccagggctacgggaactactggaatcagggctacggctaccagcagggatacggtccagggtatggggggtacgactactcaccctacggctattacggttatggacctgggtatgactattctcagggtagtacaaattatgggaagagccagaggaggggcggtcaccaaaacaattataaaccctattag

SEQ ID NO: 24017 - DNA, 2745 bp, Artificial Sequence
  Description of Artificial Sequence: Synthetic coding sequence
atgggcgacagccgggacctgtgcccccacctggacagcatcggcgaggtgacaaaagaggatctgctgttaaagtccaaaggtacttgccagagttgtggggtcacggggccaaatctgtgggcatgtttgcaagtggcgtgcccctacgtaggatgcggcgaaagtttcgccgaccattctaccattcatgcgcaagccaagaagcacaatctcaccgtgaatctgaccactttccgactctggtgttatgcatgcgaaaaagaggtgtttttggaacagaggctggcggcacccttactggggtcttcgagcaaattttcagagcaggatagcccccctccgtcacaccctttgaaagccgtgcccatcgccgtcgcagatgaaggagagtccgagtctgaagacgacgatctaaaacccagaggcctgaccggaatgaagaacctggggaactcatgctacatgaacgccgcgctgcaggcactgtccaactgtccccctttaactcagtttttccttgaatgcgggggattggtgcggacagacaagaaacctgctttgtgtaagagttatcaaaagctcgtgtccgaggtgtggcataaaaaacggccttcctacgttgtgccgacaagcctctcacacggcatcaaactcgtcaatcctatgtttaggggatatgcacaacaggacacacaggagtttcttcggtgcctcatggaccagctccatgaggaactaaaagagcctgtcgtcgcaaccgtcgcgttgaccgaggccagggatagcgactcttctgatacagacgaaaaacgcgaaggcgaccggagtccttctgaagacgaattcttatcttgtgatagctcctccgacagaggtgaaggggatggacagggcagaggcggaggtagttctcaggccgagacggagttactgattccagacgaggccggcagagcgatctccgagaaagagcggatgaaggaccgcaagttttcctggggacagcagcggaccaactcggaacaggtggatgaagatgctgatgtcgacaccgcgatggccgctttggatgaccagccagccgaagcccaaccgcctagtccccgatccagcagcccgtgccggacacctgagcctgacaatgatgcacatctgaggtcatccagccggccttgttcgcctgtccatcaccacgagggacatgccaaactgtcttcatctccgcctcgtgccagcccagtaaggatggcccctagctacgtgttaaaaaaagcacaggtcctgtctgccggatctaggagaaggaaagaacagaggtatagatctgttattagcgacatctttgacggatcaatactgtcactggtacagtgtttgacttgcgaccgggtctcaacaaccgtggaaacttttcaggacttgagtttaccaatccccggaaaagaggatcttgccaaattacatagcgccatttatcaaaatgtgcccgcaaagcctggcgcttgcggggacagttacgccgcgcagggatggctggcctttattgttgagtatattagacggttcgtcgtgagctgcacaccgagttggttctggggacctgtcgtcaccctggaggactgtctggcagcatttttcgctgccgatgagcttaagggagacaacatgtattcatgcgagagatgcaagaagctgaggaacggggtcaaatattgtaaagtgctcagactgccggagatcctgtgtatacatctcaaacggtttagacacgaggtcatgtacagcttcaagattaattcccatgtctcattcccactggaggggctggacctgcgacccttcctcgctaaagagtgcaccagccagatcactacatacgatctgctgtcagttatttgccaccacggtaccgcgggcagcggtcactacattgcctattgtcagaacgtgataaacggccagtggtatgaatttgacgatcagtacgtcaccgaggtgcatgagactgtggttcaaaacgcagaaggttacgtgttattctataggaagtcttcagaggaagccatgcgggagcgccagcaagtcgtgtccttagcagccatgcgcgaaccctccttgcttagattctatgtgtcccgcgagtggctcaacaagttcaacaccttcgccgaacccggaccaattactaaccagacctttttgtgcagccatggtggaattcccccccacaaatatcactacatcgacgacctggtggtgattctgccgcagaacgtgtgggagcacctgtataacaggtttggaggcggccctgccgttaaccacctgtacgtgtgcagcatttgccaggtcgaaattgaagccttggcaaagcgccgaagaatcgaaatagacacctttatcaagctgaataaggcctttcaggccgaagagtcaccgggtgttatctattgcatttcgatgcagtggttcagggagtgggaggccttcgtaaaaggtaaagacaacgaacctccgggccccatagacaacagtagaatcgcacaagtgaagggctccggccatgtacagttaaagcagggagccgattacggccagatctcagaggagacatggacttacttgaactctctttacggcgggggacctgagattgccatcagacagtctgttgctcagcctctggggcccgaaaacttacatggcgagcaaaagattgaagcagagactcgcgcagtctag

SEQ ID NO: 24018 - DNA, 2772 bp, Artificial Sequence
  Description of Artificial Sequence: Synthetic coding sequence
atggccgccagcaccggctacgtgcggctgtggggcgccgcccggtgttgggtgcttcgtcgaccaatgctggcggctgcgggcggccgtgtcccgaccgcagcgggagcttggctattgcgaggacagcgcacatgcgacgcttctcccccttgggccctctggggccgcggcccagctatcggcgggagcgctggtgctggagagggcccagtgatcaccgcacttacacccatgacaattccggacgtgtttccacacttaccgctgatcgctataacccggaaccctgtgttccccagatttatcaagataattgaagtaaagaacaagaaactggttgaattgttacgccggaaggtccggctcgcgcaaccctacgtgggcgtgtttctcaaacgcgatgactcgaacgaatcagatgtagtagagtctctggatgagatctaccacaccggtactttcgcccaaatccatgagatgcaggacctcggcgacaagttgcgaatgatcgtgatgggtcatcgccgagttcatatctcacgacaactggaagtggagcctgaagagccggaggcagaaaataagcacaagccaagaaggaagagtaagcgcggaaagaaggaggccgaggacgagctttctgctcgccatccagctgaattagccatggagcccacccctgagctcccagccgaggtgcttatggtcgaggtagaaaacgtcgtgcatgaggacttccaggtgacagaagaggtcaaggctctgactgccgagatcgtcaaaaccatccgcgatatcatagccctgaaccctctgtacagagaatctgtgctccagatgatgcaagccggccagcgcgttgtggacaatcctatctacctttccgacatgggcgcggctcttaccggcgctgagtcccacgagttacaggacgtattggaggagactaacatccctaaacgcctctataaagccctgagtctgctcaagaaagagttcgagcttagtaaacttcaacagagactaggtagggaggtggaggagaaaattaagcagacccatcggaaatacttactgcaagagcagctcaagatcatcaaaaaggagctcggcctggagaaggacgataaggatgctatcgaggaaaagtttcgtgaacggctgaaagaactggtcgttccaaagcatgtgatggatgtggtggatgaggagctgagcaagcttggattgctggacaaccactcatccgagtttaacgtaacccggaactacctggactggctaactagtataccctggggtaagtatagtaacgagaacttggacctggccagagcccaggcagttctggaagaggaccattacggcatggaggacgtaaagaaaagaatcttagagtttatcgcggtgtctcagctgcgggggtcaactcagggcaaaatcctatgcttctacggtccccccggcgtaggcaagacctcgatcgccaggagcattgcgcgtgccctgaatcgtgaatacttcaggttttcagtaggagggatgactgacgtggcagagataaaggggcaccgacgcacctacgttggtgccatgcctgggaaaattatccagtgccttaagaagaccaagactgagaatccactgattttgatcgacgaggtcgacaaaatcgggaggggctaccagggtgacccctcttctgctctccttgaactgctggaccctgagcagaatgccaatttcctcgaccattacctggacgtgcctgtggacctgagcaaggtcttgttcatttgcacggccaatgtgactgataccatccccgagcctctaagggatcgaatggaaatgatcaacgtttctggttatgtggcccaggaaaaactggccatagccgaaaggtacctggtgcctcaagcccgggctctgtgtggcctggacgagagcaaagccaagctctcctccgacgtgctgaccctgcttatcaagcaatactgccgagagagtggggttcggaatctgcagaaacaggtcgagaaggtactgcggaaaagcgcgtacaagatagtgtcgggtgaggccgagagcgttgaagtaactccagaaaacctccaggattttgtgggcaagcccgtatttactgttgagcgcatgtatgacgttactcctccaggcgtggtcatgggactggcttggacagccatgggagggtctacattattcgtcgagacaagcctgcgaaggccccaggataaggatgccaagggcgacaaagacggtagtctcgaagttactggacagctcggtgaggtgatgaaggaatctgcaaggatcgcctatacctttgcccgcgcattcctcatgcagcacgctccggccaatgattaccttgtcacttcgcacatccacctgcatgttccagagggtgcgactcccaaggatggaccttctgccggatgtacgattgttactgcattgctaagccttgcaatgggccgaccagtaaggcagaacctggctatgacaggtgaggtttccctgaccggaaagatcctccccgtcggagggattaaagagaagaccatagctgctaaaagggcaggcgtcacgtgcattgtcctcccagcagagaataaaaaggacttttacgatctggctgctttcattacggaaggacttgaggtccactttgtcgaacattaccgggaaattttcgacatcgccttcccggatgagcaggcagaggccctggctgttgaaaggtag

SEQ ID NO: 24019 - DNA, 681 bp, Artificial Sequence
  Description of Artificial Sequence: Synthetic coding sequence
atgggccccctgccccggaccgtggagctgttctacgacgtgctgtcaccctatagttggctcggttttgaaatcctgtgtagatatcagaatatctggaatataaatctccagcttcggccctccctaattaccggcataatgaaggacagtggcaacaagccacccggcctcttaccacggaaggggctttacatggctaacgatttgaagcttctgcgtcatcacctgcagattccgattcattttcccaaggactttttatccgtgatgctcgagaaaggctccctcagcgccatgcgattcctgactgccgtcaatttggagcaccctgagatgctggagaaggccagccgagagctttggatgcgtgtctggagtcggaatgaggacataactgagccccagtctatcctggccgccgccgagaaggctggcatgtctgccgaacaggcacaaggcctgttagaaaagatagctacaccaaaagtgaagaatcagctgaaggagacaacagaggccgcctgcaggtacggcgcgttcggcctccctatcactgtggcccatgtggacggacagacccatatgctgtttggatctgacaggatggaactcctggctcacctgctgggagagaaatggatgggccccatcccgccagctgttaatgctagactctag

SEQ ID NO: 24020 - DNA, 2055 bp, Artificial Sequence
  Description of Artificial Sequence: Synthetic coding sequence
atggaggccaaccacagcgagcagctgagcgccgagcggcagagcacaccgccaggagacagctctagtctgccgtctcacaatggactggagaaagaggatggacaagactccccaactcctgttcagcctcccgagaaggaagccagcgtgcatccagacatctcagaggaactaaataggcagctggaggacattattaacacttacggtagcgctgcctcaaccgcagggaaggaaggcagcgccagagccagcgaacaacccgagaacgccgagagcccagataacgaggatggtgattgcgaggaaactacagaagaggcgggacgggagcctgtggcctctggtgaacctcccactgtcaaggaacctgttagcaacaaggaacagaagctcgagaagaagattctaaaggggttagggaaggaagcaaacctcctgatgcagaatctgaacaagcttcagacaccagaggagaaatttgacttcctgtttaaaaagtatgcagagctgttggacgaacacaggaccgagcagaagaagcttaagctcctgcagaagaagcaggttcagatccagaaagagaaggaccagttgcagggtgagcactccagggccattctggcacgatccaagctggagagcctctgccgcgagctacaacgccacaataaaaccctgaaggaagaagccctgcagagagctagagaagaagaagaaaaacgtaaggagattacgtctcacttccagtctacactcaccgacattcaaggccaaatcgagcagcagtccgaacggaatatgaagctctgccaagagaacacagagttagccgagaagcttaagtctattatcgaccagtacgaattgagagaagaacatctggacaagatcttcaagcacagggaactacagcagaaactcgtggacgccaaactcgaacaggcgcaagagatgatgaaggaagcggaagagcgacacaagagagagaaggaatacctgctcaaccaggctgccgaatggaaactgcaagctaaagtacttaaggaacaggaaaccgtgctgcaagctcaattgaccttgtattccgggaggtttgaagagtttcaatcaaccctcacaaagagcaatgaggtattcgccacctttaagcaggagatggacaagactaccaagaagatgaagaagcttgagaaggatactgcgacatggaaggctcgatttgagaactgcaataaagctttactcgacatgattgaggaaaaggcactaagggctaaagaatatgagtgctttgtcatgaaaattggccgcctggagaatctgtgtcgcgctctccaggaggaaagaaatgagctgcacaagaagatccgcgacgccgagatcagcgaaaaagacgaccaatcccagcacaacagcgacgaggagcctgagagcaacgtgagcgtcgatcaagaaatagacgcagaagaagtgaatagtgtgcagactgctgttaagaatctggccacagcttttatgataatacaccatccagagtctacgccacatcagagtaaagaaacccagccggaaatcggcagctcccaggaaagtgccgatgcagccctcaaggagcctgaacaacctccactcatcccctctcgagattcagagtcccctcttccacctttgaccccacaagccgaagctgagggtggaagcgacgcagagccccctagcaaggcctccaattcccctgccggccttggtgcagaaacccagtgcgaggggctgcccgtaggagcgcaggccgatcaagccagttggaaacccgaagccgaggcctcaggccaagccccccaggctcctaccgaagcctctctccagaaaatggaggcagacgttccagctccagcctgtgcagccgaagagcatgtggccgcaatggtgcccgcgtgtgaaccaagccgccaacccccccgagcagcagccgaagaactgcctgttggcgcctccgcgggccctcagcccaggaatgtcgccgacactaacctagagggcgtggattag

SEQ ID NO: 24021 - DNA, 1461 bp, Artificial Sequence
  Description of Artificial Sequence: Synthetic coding sequence
atgaacggcaccctggaccaccccgaccagcccgacctggacgccatcaaaatgtttgttggccaggtgcccagaacatggtcagaaaaggacttgcgggaattgttcgagcaatatggggcagtctatgagattaacgtcttgcgagaccggtcccagaacccacctcagtccaaggggtgctgtttcgtgactttctacacgcggaaggctgctctcgaggctcagaacgcgttgcataatatgaaagtgctgcccggaatgcaccatcccattcagatgaaaccagctgactccgagaaaaacaatgcggtggaggaccggaaactcttcataggtatgatctccaagaagtgcaccgaaaacgatattcgagtcatgtttagttctttcggccagatcgaagagtgtcggatactgcgcgggcccgacggactctcaaggggttgtgctttcgtgacgttcaccactagagcaatggctcagacagcgatcaaagcaatgcaccaggcccagacaatggaaggctgtagtagccccatggtggtcaagtttgctgatacacagaaggacaaagagcagaaacgcatggcccagcaacttcagcaacagatgcagcagatcagcgcagcatccgtctggggtaatctagctggacttaatacactgggaccccagtacttagccctttatctgcagttgcttcagcagacagcatcctctggaaatttgaataccctcagctcgctccaccccatgggtggtttgaatgccatgcaactgcagaatttggctgctctcgctgctgcggccagtgccgcccaaaacaccccctccggtacaaacgcccttaccacctcttcttctccattgtcagtgctcacctcgtctggctcatctcccagttcatcgagctccaacagtgtaaatcccattgccagcctgggagctctacagactttagccggcgctactgccggcttgaatgtgggaagtttggcgggaatggccgcccttaatggagggctggggtccagcggactctctaacgggaccggctccacaatggaggccctcacccaggcctatagtggaatacagcagtacgccgcagccgctctgcccactctctataatcagaaccttctgacacagcaatcgatcggtgcagctggatcacaaaaggaaggtcccgaaggagccaaccttttcatttaccacttaccacaggagtttggggaccaagatttgctgcagatgtttatgccgtttggtaatgtggtgagtgccaaagtctttattgataagcagactaatttgagtaaatgtttcggcttcgtgtcttatgataaccctgtctccgctcaggctgcaatccagagtatgaatggctttcagataggaatgaaaaggcttaaagtccagctaaaaagatctaagaatgacagcaagccgtactag

SEQ ID NO: 24022 - DNA, 7812 bp, Artificial Sequence
  Description of Artificial Sequence: Synthetic coding sequence
atggagaaggccaccgtgcccgtggccgccgccaccgccgccgagggcgaaggcagtcctcccgccgtggctgccgtagcaggacctcccgccgctgccgaggtgggtgggggagtggggggatcatcccgggcgcgcagtgcatcgagtcctaggggcatggtccgggtgtgtgatttactcctcaagaagaaaccaccccagcaacagcaccacaaagccaaaaggaatcggacatgcaggcctcctagctcaagcgagtcatcttccgacagtgacaattcaggcggagggggaggtggcggaggcggggggggcggaggaggcggaaccagctcaaataatagcgaagaagaagaagatgatgacgatgaggaggaagaggtgagcgaagttgagagcttcatcctcgatcaggatgatctggaaaatcctatgcttgagactgcctcgaaactgttgctgtccggtacagccgatggagcagatttgcgcaccgtggacccggaaacccaagcaaggcttgaagcactcctggaggcagctgggattgggaagctcagcacagcagatggtaaagccttcgccgaccccgaggtcttgcgccgcttgaccagtagtgtgtcttgcgcgctcgatgaagcagccgccgccctgacacgcatgagagccgagagtactgctaatgccggccaatccgacaacaggtctctggccgaggcttgcagcgagggagacgttaacgcagtgcgcaagcttctgattgaggggcgctccgtgaatgagcatacagaagaaggagagtccctgttatgtctggcatgttccgccggatactatgaactggcacaggtgctgctcgcaatgcatgctaacgtagaagacaggggcatcaaaggggatattaccccactgatggccgccgccaatggggggcacgtaaagatcgtgaagttgttattggcccacaaagccgatgtaaatgcccagagttccaccggtaacactgccttgacttacgcgtgcgccggcggctacgtggacgttgtgaaagtgcttcttgaaagtggtgctagtatcgaagaccacaatgagaatggccatacccctctgatggaggccgggtccgccggacacgtagaggtcgccagactgttactcgagaatggggccggtattaatactcattccaacgagtttaaggaaagcgctctgaccttggcatgttataagggacatctggagatggttcgatttctccttgaagcaggcgcagatcaggagcataagacagatgaaatgcacacagctctgatggaagcatgtatggatggccacgtcgaagtcgctcggctgctgctggatagtggcgctcaggtgaatatgcccgccgactcattcgaatcccctcttactctggcagcttgcggaggacatgtggagctggccgccttgctgattgagcgcggggcttctttagaggaggtgaatgacgagggatatacccctttgatggaggccgctcgcgaggggcacgaggagatggtagctctattgctgggacagggtgcgaacattaatgcccagacagaagagacccaggagaccgccctgacactcgcctgctgcggtggtttcctcgaggtcgccgacttcctcatcaaagcaggagccgacattgaattgggttgctcaacaccgctgatggaagcggctcaagagggtcacttggagcttgtcaaatacctgctagccgccggcgccaacgtgcatgccaccacggcaaccggtgatactgccttaacctacgcctgcgaaaacggacacactgatgtggccgacgtgttgctgcaggcaggcgctgatctcgagcacgagagtgagggcggtcggactcccttgatgaaagctgccagggccggccatgtgtgcaccgtgcagtttctcatttccaagggtgctaatgtgaataggaccactgccaataatgaccatacagtcctgtctctggcctgcgctggtggtcacttggcagttgtggaacttctgttggctcacggggccgatcccacacataggctgaaggatggatccactatgctgatcgaagctgccaaaggcggacatacatcagtagtatgttacctgctcgattaccctaacaacctcctgagtgcaccccccccagatgtgacgcagctgacacctccatcacatgacctgaatagagcaccccgagttcccgtacaggcccttccgatggtggtgcctccacaggagcccgataagccccctgctaacgtagcaacaacgttaccaatccgcaataaggccgcctcgaagcagaagtcaagctctcacctccctgccaatagtcaggacgtgcagggctatattactaatcagtctcccgagtccatcgtcgaggaggctcagggcaaattgactgagcttgaacagaggataaaagaagcaatagagaagaacgctcagctgcagtctttagagctggctcacgcagaccaactgacgaaagagaaaattgaagaacttaataaaacccgagaagaacaaatccagaagaagcagaagattcttgaagagctgcagaaagtggaaagggagctgcagctcaagactcagcaacagctaaaaaagcaatatttagaggttaaagcacagagaatacaattgcaacagcagcagcaacagtcttgtcagcacttgggactgttaacacctgttggggtgggagaacagctctctgagggggattacgccagattgcagcaggtcgatcctgtcctgctcaaggacgaaccgcagcagacggccgcccagatgggtttcgctcccatacagccactggccatgccacaggcactgcctttggctgcaggccccctgcctcctgggtccatcgccaatctgacggaattacagggagtcatcgttggacagccagttttgggccaggcccagctggctggccttgggcagggtattctgactgaaacccaacagggattgatggtagcttcacccgcccaaactctgaacgatacattagatgacatcatggcagctgtgtccggaagagcgagcgcgatgagcaacacaccaacacattctattgcagcaagcatctctcagcctcagacccccacccctagcccaattattagcccatccgccatgttgcctatttatccagctatcgacatcgacgctcaaaccgaaagcaatcatgatactgccttgacattagcttgcgctggcggacacgaagagttggtccagaccttgctggagcgaggcgcctccatcgaacaccgcgacaagaagggattcacacctctgatcctggccgccacagcagggcacgtgggcgtggtggagatcttgctggacaatggtgctgacatcgaggctcagagcgagagaaccaaagatacacccctatcactagcttgcagtgggggcaggcaggaggtagttgagttgctgctcgcacggggggcaaacaaggagcaccgaaacgttagtgattatacgcccctgtctctggctgcctcgggagggtatgtgaacatcattaagattcttctcaacgccggggcagaaattaacagccggaccggttccaaactgggaatctcacctctcatgctcgcagccatgaatggccacaccgccgctgtgaaactactcctcgatatgggctcggacatcaacgcccagatagagactaatagaaataccgcactcactcttgcatgcttccagggtaggacagaagtggtttctctgctcctggataggaaggctaatgttgagcaccgtgcaaaaacaggactgacccctcttatggaggccgccagcggaggttacgccgaggtggggcgcgttcttcttgataagggagcggatgttaatgcaccccctgttccttctagcagagacactgcactgacaatagccgccgacaaggggcactacaagttctgtgaactcctcatcgggcgcggcgcacacattgacgtgcgcaataagaaaggtaacacacccctttggttagccgctaacggaggccatctggacgtagtgcagctcttagtgcaagccggggccgatgtggacgcagcagacaacagaaagattactccgctgatggctgccttccggaaaggccacgtcaaggtcgtgagatacttggttaaggaggttaatcagtttccttcggattccgagtgtatgcggtacatagccactataactgataaagagatgttgaagaaatgccacctttgtatggagagtattgtacaggccaaagaccgtcaggctgcagaagctaacaagaatgcgtctatcctgctcgaggaactggacctcgagaagctgagggaagagtcaaggaggttggcattagctgcaaaaagagaaaaacgaaaggagaaacgcagaaaaaaaaaggaagaacagcgaaggaaattggaggagattgaagctaagaataaagagaattttgaattacaagctgcccaggaaaaggaaaagttaaaagtcgaggacgaacccgaggtcctaacagaacccccaagcgccaccacaaccaccactatagggatttccgctacctggaccactttggccggatcacacggaaagcggaataacacaattaccaccacctcatccaaaagaaaaaacagaaaaaataagattacccctgagaatgtccagatcattttcgacgatccactcccaatttcttacagccagcccgaaaaggtgaacggcgaatccaagtcttcctcaacttctgagtcaggggattccgacaatatgcggatttcatcctgcagcgacgagagtagcaattcaaacagctcccggaagtccgataaccattctccggccgtggtcacaacaacagtgagttccaagaaacagccctcagtgctggtgacttttcccaaagaagagcggaagtcggtaagcgggaaagccagcattaaattgtcagagactatttcggagggcacatctaactccctgtctacctgtaccaagagcgggccttccccactgtcatcccccaatgggaagctaacggtcgcatcccctaagcgcggccagaagcgcgaagaggggtggaaggaagtagtacgtcggagtaaaaaggttagcgtcccttctacggtcatctccagggttataggccggggtggttgtaatatcaatgccatccgagaatttactggggcacatatcgatatagacaagcagaaagataaaaccggcgaccgcatcatcacaatccgcggcgggaccgagagcacccggcaagccacccagctgatcaatgccctgataaaagatcctgacaaagagatcgacgagctgattcccaagaataggctgaagtcctcttccgcaaactccaagatcggtagcagtgcacctaccaccaccgctgctaataccagtctgatgggcatcaagatgactacagtagccttgtcctccactagtcagacagccactgccctgaccgtgccagccataagtagcgcctccacacacaagacaattaagaacccagtgaataacgtgcggcccggcttcccggtatccctaccgctggcctaccccccaccccagttcgcccatgcactcttggcagcccagacgtttcagcagatcagacctccacggctccctatgacccacttcggcggtacctttccccccgcccagagcacctggggacccttccccgtgagaccactgtccccggccagggccaccaatagtcctaagccacacatggtgccaagacactctaatcagaattcatctggctcccaggtgaactcagcaggctcacttactagcagtcccaccacgacgacctcatcttccgcatcgaccgtgcctgggacttcaaccaatggatctccaagtagtccctctgtccgtagacagctgttcgtcacagtggtgaagacctctaatgcaaccactactactgtcacaactaccgcatctaataacaacactgctccaaccaatgctacttaccccatgccaactgccaaagaacactaccctgtgtctagccctagctcgccttcaccccctgcccaaccgggtggggtttcccggaacagcccccttgactgcggaagcgcttctcccaacaaggttgcgtcaagctccgaacaggaggccggctcgcctcccgtcgtggagaccacaaatacaaggcccccgaatagctcttcttcttcaggaagcagcagcgcccattcaaaccaacagcagcctccaggatctgtttcgcaggagccaaggcctccattgcagcagagccaagtgccccctcccgaggtacgcatgaccgtgccaccccttgcgacttcatccgcacctgtcgcagtgccttctacagcccccgtcacctacccaatgccccaaaccccgatgggctgccctcaaccaacaccgaaaatggaaaccccagccataagacccccccctcatggcacaactgcacctcataaaaactcagcatccgttcaaaatagttctgtggcagtactatcagtaaatcacatcaagcggccccattcagtgcccagctccgttcagctccctagcaccttgtctacccagtccgcctgtcagaacagcgtgcatcccgccaataaaccaatcgctcccaactttagcgctcccctcccttttggtccctttagtacactgttcgagaactcgccgacctccgcccatgccttctgggggggctcggttgtaagctctcaaagtacccccgaatctatgcttagtggaaaatcatcataccttcctaactcggaccccttacaccaatccgacacttcgaaggccccaggttttaggccaccattgcaaagacctgccccctccccgtctggtatcgtcaacatggactctccctacggtagcgtaaccccctcaagtactcacctgggtaatttcgcttctaatatttcaggtgggcagatgtatggacccggagctccattgggcggtgccccagccgccgccaattttaatcgacagcatttcagcccattgtccctcctgacaccatgctcatccgctagcaacgactcgtccgctcaatcagtcagcagcggggttagagctccatcccctgctccttcttccgtgcccctgggaagcgagaaacccagcaatgtttcccaggaccgcaaagtgcctgtccctatcgggaccgagcggtctgctcgtattcgacaaaccggtaccagtgccccctcggtaatcggttctaatctgtcaacctcggttgggcacagcggaatatggagctttgaaggtataggaggtaaccaagacaaggtcgattggtgcaacccagggatgggcaaccccatgatccatcgtcccatgtcagatccaggtgtgttcagccaacaccaagctatggagagagatagcaccggaatcgtgaccccctcgggtacattccatcagcacgttccagccggctatatggattttcctaaagtggggggaatgcccttctccgtgtacgggaacgctatgatcccacccgttgcccccatcccggatggggctgggggcccaatctttaacggaccccacgcagctgacccttcctggaactcgctgataaagatggtcagttcatccactgaaaataacggcccccaaacagtatggacaggaccttgggctccacatatgaattcagtccacatgaatcagctcggttag

SEQ ID NO: 24023 - DNA, 3075 bp, Artificial Sequence
  Description of Artificial Sequence: Synthetic coding sequence
atgaccgagggccggcggtgccaggtgcacctgctggacgaccggaaactcgagttattggtgcagcctaagcttcttgctaaggagctgcttgatctggtggcgagtcatttcaatttgaaggagaaagagtacttcggaatcgccttcaccgacgaaactgggcacctcaactggctgcagctggatagaagagtgttggagcacgactttccaaagaagagtggcccagtagtgctttacttctgcgtaaggttctacattgagtctatttcttacttgaaggacaatgcgaccatcgaactcttcttcctgaacgcaaagtcatgtatttacaaagagctaatcgacgtagacagcgaggtcgtgttcgaattagcctcatatatacttcaagaagcaaagggcgacttctcttctaacgaagttgtgcgatctgacttgaagaagcttcctgctctccctacacaggctctgaaagagcacccgtccctcgcatactgtgaagatcgtgttatagagcactacaagaagctcaacggacagacacgtggtcaagctatagtgaactatatgtccattgtcgagagtctgccgacctacggcgttcactactatgcggtgaaagacaaacaagggattccgtggtggctgggactgtcatacaaggggatcttccagtacgactaccatgacaaggtgaagcccagaaagatcttccagtggagacagctggaaaacttgtatttccgggaaaagaaattcagtgtcgaggtgcacgacccccgaagagcctcagtcacgaggcgcacattcggtcactcgggtattgctgttcatacctggtatgcctgtccagccttgataaaatcaatctgggctatggcgatctctcaacatcagttttacctggatcgaaagcagtcaaagagcaaaatccacgccgctaggtcactctccgagatagcaatcgatctcaccgaaacgggaacgctgaaaacttctaagctggctaacatggggtccaagggaaagattatcagcggctcttccggaagtctgcttagtagcggctcccaggagagcgattcctcacagtcagcaaaaaaggatatgctggcagcattaaagagccggcaagaggcgctggaggaaacattgaggcaaaggcttgaggagcttaaaaaactgtgcctgcgcgaggccgaacttaccggaaaattaccagtggagtatcccctggatcccggcgaagagccacccatcgtcaggcggcggatcggaaccgcttttaagttggatgaacagaaaattctgcctaagggggaagaggcggaacttgagagactggaacgcgaatttgccattcagagccagataacagaggccgccaggaggctcgccagcgacccgaacgtgtccaagaagctgaaaaagcagcggaagacctcctacctcaacgcactgaagaaattacaagaaatcgaaaacgcaattaatgagaacaggattaaaagtggtaaaaaacctactcaaagggcctcactgatcatcgacgacggaaacatcgcatccgaggatagtagcttaagcgacgcattggtccttgaggatgaagatagccaggtaacttccactatctctcccctccactctccccacaaggggctgccgccacgacccccatcccacaatcgcccccctcctccacaaagtctggaggggctgagacagatgcactaccaccgtaacgactacgacaagagccctattaagccgaagatgtggagcgaatcatccctggatgagccctatgagaaggtaaagaagcgctcatctcacagccactcgtctagccacaagagattcccatcaactggctcgtgtgccgaggcaggtgggggctcaaacagcttacagaattctccaatccgggggctgccccattggaattctcagagcagtatgccatcaactcctgacctgagagtgaggagcccacactacgttcattcaactcgatcagtggacatttcacccacccggttacactctctggctctgcattttcggcaccgtagcagttcactggagtcccaggggaagttgttggggtcagaaaacgacaccggatcccccgacttttacacaccacgcacaaggagctctaacgggagtgatcctatggatgactgcagtagctgcacatcgcactcgagtagcgagcattactaccctgcacagatgaacgcgaattatagtactctagctgaggattctcctagtaaagctaggcagcgacaacgacaacgccaacgggctgccggcgctctcgggtccgccagcagtggctcaatgcccaacctggccgcccgaggaggcgctgggggcgcgggaggagccggcggcggcgtatacctgcattcacagtctcagcccagtagccagtatcggatcaaagaataccctctgtacatcgaaggaggcgcgacaccggtcgtggttcgaagccttgagtcagatcaggaagggcactatagcgtcaaggcacagtttaaaacctcaaactcctatacagcaggcggcttatttaaagagagctggagaggcggtgggggcgacgagggtgacacaggaagactaactccaagccggtcccaaattctgcgcacccccagcctgggtcgcgaaggagcacatgacaagggggcaggccgggctgccgtgtcagacgagcttaggcagtggtaccaaaggagcacagcctcccacaaagagcactccaggctgtcgcacaccagtagtacaagctcagactcaggatcccagtactccacctcttcacagagcacgttcgttgcacactcacgagtgactcgcatgcctcagatgtgtaaggctacttctgccgcgctgcctcagtcacagagatcttcaacaccctctagtgagattggcgcgacacctccgtcttcgcctcaccacattctgacctggcagactggcgaggccaccgaaaacagcccaattttagatggtagcgagtccccaccccatcagtccacagatgagtag

SEQ ID NO: 24024 - DNA, 864 bp, Artificial Sequence
  Description of Artificial Sequence: Synthetic coding sequence
atgagccaggcctggtggcacaccagcgtgagccccgccacccaggaggccaaagctggtggccttttgcagcccagaagacaacgtctgtggctcaaacgttgccgcatctccagcagcgcctgcgaagatttgtctgcagcattaatcgccaataagaatcttacacgaatggatctttcgggtaacggagtgggttttcccgggatgatgctgttatgtgaaggattgaggcacccacagtgtcgcttgcagatgattcagttaagaaaatgccagttggagagcggagcctgtcaggagatggcatcagtcctggggacaaacccacatttagtggaactcgacttgaccggcaatgctttggaggacctgggccttagactgctctgccagggattaaggcatcccgtctgtcgcttgaggactctatggttgaagatctgccgactcactgccgcagcctgtgacgagctagcctctaccctgagcgtaaaccagtccctcagagaactggacctctctctgaatgagctgggcgatcttggagtgctgcttttgtgtgaaggcctgcggcatccaacttgcaaactccagaccctccgcttagactcttgcggcctgaccgcaaaagcatgtgagaatctttatttcaccctgggcattaaccaaacacttactgacctctacctgactaataacgccctcggcgatactggtgtgcgactcctgtgtaaacgcctgtcacatccaggatgcaaactgcgcgtgctgtggcttttcggaatggatttaaataagatgacccattcacgccttgcggctttgcgcgtcacaaagccatacctcgacatcggttgttag

SEQ ID NO: 24025 - DNA, 615 bp, Artificial Sequence
  Description of Artificial Sequence: Synthetic coding sequence
atggccggctacctgagcgagagcgacttcgtgatggtggaggagggtttttctactcgcgatctactgaaagaactcactttaggagcaagccaggcaaccacagacgaagtggcggctttttttgtcgcagatttaggggctatagtgcggaaacacttctgctttctcaagtgtcttcctcgtgtcaggcctttttatgccgtcaagtgcaacagcagccccggagtcctgaaggtcctcgcacaactcggattagggttctcatgtgccaacaagatcgccagcgtcatcaatagcgccctggatctgtattttccggaaggttgcggagtggacattttcgccgaactaggcaggtactatgtgacctcagcttttacggtcgccgtctccatcatcgccaagaaagaagtgctcctggaccaacctggccgggaggaagagaacgggtccacgtccaagactattgtgtaccacctggacgagggcgtatacggcattttcaacagcgtactttttgacaatatctgtcccaccccgatcctacagaagagcaagaaccattcgccgtgttatatgagcctagagagcattcactttatcgccgtgtag

SEQ ID NO: 24026 - DNA, 519 bp, Artificial Sequence
  Description of Artificial Sequence: Synthetic coding sequence
atgatgaagctgaagagcaaccagacccggacctacgacggcgacggatataagaagcgcgccgcatgcctgtgcttccgctccgagtctgaggaggaagtcctgttggtgtcctccagtcggcaccccgatcgatggattgtccctggagggggcatggagcctgaggaagagccgagtgttgccgctgtgcgggaggtctgcgaggaggccggcgtgaaaggaacccttggccgattggtgggaatcttcgagaaccaggagcggaagcaccgtacctacgtgtacgtcctcatcgttaccgaagtcttggaagattgggaggattctgtgaacatcggcagaaaaagggaatggtttaagatcgaggacgctattaaggtcctgcagtatcacaagcccgtgcaggcatcttatttcgagacactgcgacaagggtattccgccaacaacggcacgccggttgtcgctaccacatatagcgtctctgcccagtccagcatgtctgggatccggtag

SEQ ID NO: 24027 - DNA, 4284 bp, Artificial Sequence
  Description of Artificial Sequence: Synthetic coding sequence
atgagcatgctgaagcccagcggcctgaaggcccccaccaagatccttaagccgggcagcacagctttgaaaacgccaacagccgttgtggctcctgtggaaaagactatctcctctgagaaggccagtagtactccatcctccgaaacacaggaagagttcgtcgatgacttccgggtgggcgaaagggtctgggtgaatgggaataagcccggctttatccagttcctcggggagacacaattcgcccccggtcagtgggccggtattgttctcgatgagcccatcggtaaaaacgatggcagcgtcgcaggggtcagatactttcagtgtgagccgctcaagggcatcttcacacggccctcaaagttgacacggaaggtccaggctgaggatgaagccaacggactccaaactaccccagctagccgcgcgacatcccccctatgtactagtactgcctccatggttagctcctcaccatccaccccatctaatataccacaaaaaccatcccaaccagccgccaaagagcctagtgccacccccccaatcagtaacctgaccaaaacagccagcgaatcaatcagcaacctaagcgaggcagggtcaatcaagaagggggagcgtgaactgaagataggggacagagtgctagtgggtggaaccaaggctggtgtggtgcggtttctgggcgaaacagattttgcaaaaggtgaatggtgcggggttgaactcgacgagcctttgggaaaaaacgatggagccgtggcaggaacaagatatttccagtgtcagcctaagtacgggctcttcgctcctgtacacaaggtaacaaaaatcggcttcccaagtacaacccctgccaaggcaaaggccaatgctgtccgaagggttatggctaccacttctgctagcctaaagcgaagtccaagtgccagtagcctttccagtatgtcctcagtggcatcatcggtgagctccaggccaagtcgaacagggctcttaaccgaaacctctagcagatacgctcgcaaaatctccgggacaactgcactccaggaggccctcaaagaaaagcagcagcatattgagcagctccttgccgagagagacctcgagagggcagaggtggccaaagctactagccatgtaggtgagattgagcaagaacttgctctggccagagacggacatgatcagcacgtgttagaattggaagctaaaatggaccagctgcgaacaatggttgaagccgcagacagagaaaaagtggaactgctcaatcagctggaggaagaaaaaaggaaagtcgaggacctccagtttcgtgtggaggaggagtctataactaaaggcgacctggaaactcaaactaaactggagcacgctcggattaaggagctagagcaatcattattgttcgaaaaaaccaaagctgataaactgcagcgggagctggaggacactagagtggccaccgtgtctgaaaagtcgcgcattatggagcttgagaaggatctcgctctccgggtgcaggaggtcgccgaattgcggcggaggctggaaagcaataaacccgctggagacgtagatatgagcctgtccctcctgcaagaaatctcttcattgcaggaaaaattggaagtgacccgtacagatcatcagcgggaaatcactagtcttaaagagcacttcggggcccgggaagaaactcatcagaaggaaattaaagctctgtacaccgccaccgagaagcttagcaaggaaaatgaatccctgaaaagtaagctcgagcacgccaacaaggagaactcagacgtgatagccctctggaagtccaaattagaaactgccatcgcaagccaccagcaggctatggaggagctgaaggtgagtttctctaaggggctgggcacagaaaccgcagagttcgctgaattaaagacacagattgaaaagatgcgactggattaccagcatgagatagaaaacctacagaatcaacaggatagcgaacgggccgcgcacgcaaaggagatggaagctctgcgcgctaagttaatgaaagttataaaggaaaaagaaaacagcttagaggctatacggtccaagttggacaaagccgaggatcagcatttggttgagatggaagacacactgaataaacttcaggaggcggagatcaaagtgaaggaactagaggtcctgcaggcaaagtgcaatgagcagaccaaagttattgataattttacaagccagctgaaagccaccgaggagaaattactggatctggatgcactgcgaaaagcctcgtccgaaggaaagagcgagatgaagaaactgcgccagcaactggaagctgccgagaaacaaataaaacatctggaaattgagaaaaatgcggaatcatcaaaagcttcttccatcactagggagcttcagggccgcgagctgaagttgacaaacctccaggaaaatctttctgaggtctctcaggtaaaagaaaccttggaaaaagagctgcagatcctaaaagagaagtttgcagaggcctccgaagaggctgtgtcagtgcagcggagtatgcaggaaacagtaaacaaactacatcaaaaggaggagcaatttaatatgttatcaagcgatctcgaaaaacttagagagaacttggctgacatggaggccaaattccgcgagaaggacgagagggaggagcaacttattaaggcaaaagaaaagctcgagaacgatattgcagagattatgaaaatgtcaggggacaattcctcccagctaacgaaaatgaatgacgagctgcggctcaaggagcgcgacgtggaagaactgcagctgaaactcacaaaggcaaacgagaatgcgtcattccttcagaaatctattgaggacatgacagtgaaggctgagcagagtcaacaagaggctgctaagaagcacgaagaagagaagaaagagctcgaaagaaaactgtccgacctggagaaaaaaatggaaacttcacacaatcagtgccaggaattgaaggcacgttacgaacgcgcaacttccgagacaaagactaagcacgaggagatactgcaaaacctgcagaaaactttgctggatactgaagacaagctgaagggtgcccgtgaggaaaatagcggcctccttcaggaactggaagagcttaggaagcaggccgacaaagcaaaggccgcacagacagccgaagacgcaatgcagatcatggaacagatgactaaggaaaagaccgaaactctggcaagtctagaagatacaaaacagacgaacgctaaactgcagaatgagctggacactttgaaggagaacaatctgaaaaatgtagaagaacttaacaaatcaaaggagctcttaaccgtcgagaatcagaagatggaggagttccgcaaagaaatcgagacccttaagcaggccgccgcccagaagtcacagcagctgtcggccctccaggaggagaatgtgaagcttgcagaggaactcggacggtctcgggatgaagttacatcgcaccaaaagcttgaggaggaacggtcagttctgaataaccagcttctggaaatgaagaaacgggaatctaagttcattaaggacgccgacgaggagaaggcttccttacaaaaaagcatcagcataacctcagccttattgacggagaaggatgccgagctggaaaagcttcggaacgaagtgaccgtccttaggggcgagaatgcttcggctaaaagccttcattccgtggtacaaacacttgagtccgacaaggttaagctagaactgaaagttaagaatctggagctgcagttaaaggaaaataagagacaattgagttcctccagcggtaataccgacactcaagctgatgaagatgagcgagcccaagagagtcaaattgacttcctgaacagcgtcatcgtggacctacagcgaaaaaaccaggatttgaagatgaaagtcgagatgatgagcgaagccgccctgaatggtaatggggatgatttaaataactacgattccgacgatcaggagaagcagtccaaaaagaagccaagactcttctgcgacatctgtgactgtttcgatcttcacgatacggaagactgcccaacccaggcgcagatgtccgaagaccccccccactcgactcaccatggatctaggggtgaggagcggccttattgtgaaatttgcgagatgttcggtcactgggcgacaaattgcaatgatgatgagactttctag

SEQ ID NO: 24028 - DNA, 1179 bp, Artificial Sequence
  Description of Artificial Sequence: Synthetic coding sequence
atgggcgacagctgccccgccgtgaccttccggagccagaaggagaacagagccgggttacaggaaaaactgaggtatctgcagcaacagttgcaggacgagacaccacgccgccaggaggctgaattacaggagccagaggaaaagcaggaacctgaagagaagcaggaacctgaggagaaacagaagcccgaagcggggctgtcctggaacagtctgggccccgccgctaccagccaggggtgtccagggccgcccgggagccctgataaacctagtaggccccacggactcgtgcccgcgggatggggcatgggcccacgggctggcgagggtccttatgtttcagaacaagagcttcagaaattgtttacaggaatagaagagctgagacgagaagtgtctagcttgacagccaggtggcaccaagaagagggagccgtacaagaggcattgcgcctcctgggggggcttggtggtcgggtggacgggtttctcggacagtgggagcgggcccagagggaacaggcccagaccgcccgcgacttacaagagctgcgaggccgggccgatgaactgtgtaccatggtcgaacggagtgctgtaagtgttgcgtcactgaggtccgagctcgaggggctgggacccctgaaacctatactggaggaatttggacggcagtttcagaacagtaggaggggtcctgatcttagtatgaatttggacaggtcacaccaagggaattgcgcgaggtgcgcctctcaggggtcacagctaagtaccgagtccctgcagcagcttctggatcgggcgctaacttccctggtggacgaggtgaaacagagaggtttgactcccgcctgcccctcatgtcagcgtttgcataaaaaaatcctggagctggaacgtcaggcactagcaaagcatgttcgggcggaggcgctctctagtacattaaggttagcacaggatgaggcactgcgtgcgaagaatttgctgctcaccgataagatgaagcctgaggagaagatggccacactcgaccacctgcacctgaaaatgtgcagtctgcacgaccacctgagcaacctacctctggagggttccactggcaccatgggaggcggctcttccgctggaacccctcctaaacagggcggatcagctcccgagcagtag

SEQ ID NO: 24029 - DNA, 1692 bp, Artificial Sequence
  Description of Artificial Sequence: Synthetic coding sequence
atgagcgacgacgccggcgacaccctggccaccggcgacaaggccgaagtgacagaaatgcccaattcagattcccttccagaagatgctgaagtccactgtgatagcgctgctgtcagtcatgaaccaaccccagcagaccctcgcggtgaaggacatgaaaatgccgcagtccagggtgccggagctgcggctataggtcctcccgtgcagccccaggatgccaacgccctggagcctccactgaacggagacgtgaccgaggacacactggccgagtgcatcgattctgtctcgctagaagccgagccgcgatcagagatcccgcttcaggaacaaaattacctggctgttgattctcccccaagcgggggagggtgggctggttggggatcctggggcaaatctttgctgagctccgcaagcgccacggtgggtcatgggctgaccgcagtaaaagagaaagccggcgctaccttgaggattcacggcgtcaacagcggaagctctgaaggggcccagccgaacaccgagaacggggtgccagagattaccgatgccgctacagatcagggccctgccgaatcccccccaacttccccctcctcagcaagcagagggatgctttcagccataaccaacgtagtgcaaaatactgggaaatctgtgctcactggggggctagatgctttggaatttatcggcaaaaaaactatgaatgtcctcgcagaatctgacccaggttttaagaggacaaaaacacttatggagcgcacagtttctctgagtcagatgctgcgagaagctaaagagaaagagaaacagagactggcccagcagttaaccatggaaagaactgcccactacggcatgttgtttgacgaatatcaggggctgtcacatcttgaggcgcttgagattctgtccaacgaatccgagagcaaggtccaatcatttctcgcctctctggatggagagaagctggaactcctgaagaacgatctgatttcgattaaggatatctttgctgccaaagagttggagaacgaggaaaaccaggaagaacagggactggaggagaagggagaggagttcgcacgaatgctgacagagctgctgtttgaattacacgtcgcagccacacccgataagttgaacaaagccatgaagagggctcacgattgggtcgaagaggaccagacagtggtgagcgtcgacgtggcaaaggtgtccgaagaggagacgaaaaaggaagagaaggaggaaaagagccaggacccacaggaggacaagaaagaggagaaaaagaccaagacaatcgaagaagtttacatgtcgtcaatcgagagcctggccgaagttactgcccggtgcatcgaacagctgcacaaggtcgccgagctgatcctccacggtcaggaagaggagaaaccggcacaagatcaagccaaggtactgataaaactgacaaccgcaatgtgtaatgaggtcgccagtctcagcaaaaaattcacaaattctctgaccaccgtggggagcaacaaaaaggcagaagtcctgaatcctatgatctcaagtgtgctgctggagggatgcaactctacgacatacatacaggatgctttccagctgctgctacctgtgttgcaagtctctcatattcagacttcatgtctgaaggctcaaccctag

SEQ ID NO: 24030 - DNA, 1257 bp, Artificial Sequence
  Description of Artificial Sequence: Synthetic coding sequence
atgttcagccccgaccaggagaaccaccccagcaaggcccccgtgaagtacggagaactgatcgtgctggggtataatggtagcttacccaacggagatcggggcagaagaaagtccagattcgccctcttcaaacgacctaaagcaaacggtgtgaagccctctactgtccacattgcgtgcaccccccaggcggccaaggctatatcaaataaggatcagcatagcatcagttacactctttctcgggcacagactgtggtggtggaatacacacacgacagcaataccgacatgtttcagatcggtcgcagcactgagtccccaatcgatttcgtggtgaccgatactgttccaggctcacagtctaatagcgacactcagagcgtccaaagcacaatctctcgttttgcttgccgaatcatatgtgaaagaaatccccctttcaccgcccgtatttatgctgccggcttcgacagtagtaaaaatattttcctcggggagaaggccgctaaatggaagacatcagacgggcagatggacggactgaccacaaacggagtcttggtgatgcatccaaggaacggtttcacggaggatagtaaaccagggatctggcgggagatcagtgtttgcggtaatgtgttttccttgagggaaactcggtccgcacaacagcgcggaaagatggtcgaaattgaaacaaaccaacttcaggacggctcgctgattgatctgtgcggtgctacactactttggaggacagctgagggtctgagtcatactcccacagtgaagcatctggaggccctgcgacaggaaattaatgctgccaggcctcagtgtccagtgggatttaatacactcgcatttcctagcatgaaaaggaaggacgtggtggatgaaaagcagccttgggtgtatcttaattgtggccatgtccacggctaccacaactgggggaacaaagaggagagagatgggaaggatcgagaatgccccatgtgtcggagcgtggggccatacgtgcctctttggttgggctgcgaggccggcttttatgtcgacgccggtcctcccactcacgcctttagcccttgcggtcatgtctgttcggaaaaaacaacggcatactggtctcaaattccgctgccacacggcacgcatacctttcatgcagcctgtcctttttgtgcccatcaactggccggtgagcagggatacatacggcttatctttcagggcccgttagattag

SEQ ID NO: 24031 - DNA, 3963 bp, Artificial Sequence
  Description of Artificial Sequence: Synthetic coding sequence
atgcaggacgacagcatcgaggccagcaccagcatcagccagctgctgcgtgaaagctacctggctgagacgaggcatcgagggaacaatgaaaggtccagagccgaaccttcttctaacccatgtcatttcgggtccccctctggcgccgcagaaggggggggaggccaggacgatctgccagacttgtctgcgttcttgagtcaggaagagctggatgaatcagtaaatctggccaggctggccatcaactatgacccattagaaaaagccgacgagacccaggccagaaaaagactgagccccgaccaaatgaaacacagtccaaacctttcctttgagccgaatttctgtcaggacaacccccgatcaccaacatcatccaaggagtctccacaggaagccaaaaggcctcagtactgctcagagactcagagcaagaaggtgttcttgaacaaggcagccgactttatcgaggagttgagtagtctgttcaaatcccacagctccaagaggatccgccctcgggcctgtaagaatcacaagtcgaagttggaatctcagaataaagtgatgcaagagaactcctcttccttttcggatctgagcgaacgtagagagcggagttctgtgcctattccaatccctgcggacacgcgggacaatgaagtgaaccacgcgctcgaacagcaggaagcaaagagacgagaggcggagcaagccgcaagcgaggcggctgggggtgacacaacccccgggtccagtccatcaagtttgtattacgaggaaccactggggcaacccccgaggtttacccagaagctgaggagtcgggaggttcctgagggaacacgtgtacagctggactgtatcgtggtgggcatccctccaccccaggttcgctggtactgtgaagggaaggaactggagaactcgcctgacattcatatagtacaggcaggtaacttgcacagtctcactatagcggaagcctttgaagaggacaccggcaggtacagttgtttcgcgtccaacatttatgggacggactccacgagcgcggaaatatacattgagggagtttcctcatctgactctgaaggagatcccaataaagaggagatgaacaggatccagaagcctaatgaagtgtcatcgccacctactaccagcgcagtgatacccccagcagtgccacaggcccagcacctggtggcccagcctagggtcgcgacaatacagcagtgtcaatcccctacaaactatctccaagggttggatggaaagcctattatcgctgcgcccgtcttcaccaagatgttgcagaaccttagtgcttccgaagggcaactcgtagtttttgagtgtagggtgaagggtgctcccagcccaaaggtcgaatggtatcgcgagggaaccctgatcgaagactccccagatttcaggattttgcagaagaagcctcgttccatggctgagcctgaggagatttgcactttggtaatcgctgaagtgtttgcagaggacagcgggtgcttcacctgtaccgcctcgaacaaatacggcacggtttcatctattgcccagctgcacgtgcgcgggaatgaggatctctccaataacggatctctccactctgcaaactccaccactaatctcgccgccatcgagccccaaccaagtcccccacattctgaaccaccttccgtggagcagcccccaaagcccaaactggagggtgtcttggtgaatcataacgagccgaggagctctagtcggatcggactgagggtacacttcaacctccccgaggacgataagggttcagaagcctcgtccgaagctggagttgtgaccacccgccagacccgccccgactcatttcaggagcgcttcaacggccaggcaaccaagaccccggaaccgtcctcccccgtaaaagaaccaccccctgttctggccaaacccaaactggatagcacacaattacagcagctacataaccaggtgctcctcgaacagcaccagttacagaatccacccccctccagtcccaaggaattccctttttctatgaccgtgctgaattccaatgctccccctgcagtgacgacttccagtaagcaggtgaaagctccttcctcacaaacctttagcctggcgcgcccgaagtattttttcccctccactaatactacggctgcaaccgtcgccccttcctccagtcccgtatttacactatcttccaccccgcagacaattcagaggactgtaagtaaggagagcctactcgtgtcccatccctcagttcaaaccaagtcccctgggggactgagcattcagaatgagcccttgccccccggaccaaccgagccaacacctccgccttttaccttctcaatcccctctggtaaccagttccagccacgctgcgtgagccccatacccgtgagcccaactagccgtattcagaaccctgttgcatttttgtcctccgtcctgccgtcactgcccgctattccacccacaaatgccatggggttgcccagatccgccccctcgatgccttcgcaaggtttggcaaaaaaaaatacgaagtcccctcaacctgttaacgatgataacatacgcgagaccaagaacgccgtgatccgtgatctgggcaagaagatcacgttcagcgacgtccgtcctaaccaacaagaatataaaatcagtagttttgaacagcgtcttatgaatgagattgagtttagattggagcgcactcctgtggatgaatccgacgatgagatccagcatgatgagattcccaccgggaaatgtatcgcccctattttcgataagcgcctgaaacactttcgcgtgacggagggatcacctgtgacctttacttgtaagatagtgggcatccccgtgcccaaagtctactggttcaaagacgggaagcaaatctcgaagcgaaacgagcactgcaagatgcgccgcgaaggcgatggaacctgcagcttacacatcgaatccaccacctctgacgatgacggaaactataccatcatggctgccaatccgcagggtcggatttcatgcagcggccacttgatggtgcaatctctgcctattaggagcagactcacctcagccggccagtcacacaggggccgctctcgcgtgcaagagcgcgacaaggagccgctccaggaacgatttttccgcccacatttcctgcaggcccccggcgacatggtcgctcatgaaggacggctgtgccgcctggactgcaaggtgtctgggcttccaccaccagagctgacctggcttttaaacggacagcctgtcctgccagatgcatcacacaaaatgttagtgcgcgagacaggagtgcactctctgctgatcgatcctctgacacaaagggatgccggtacctataagtgtatcgccaccaacaagaccggacagaacagcttcagtctagaactctcagtcgtcgccaaggaggtcaaaaaggcacccgtgatcttggagaagctccagaactgtggcgtgcccgagggccatcctgtgcggctggagtgtcgtgtgattggcatgcctccgcccgtcttctattggaaaaaagataacgaaaccatcccctgtacccgggaaagaatcagtatgcaccaggatacaaccgggtatgcctgcttgctcattcaacccgccaaaaagagcgatgccgggtggtacactctgtcagcaaagaatgaagctggaattgtcagctgcaccgctcgactggatatttatgcccagtggcaccaccagatccccccacctatgtcagtacgacctagtggtagccggtatggtagtctcactagtaagggcctcgacatattctccgcctttagctcaatggaaagtaccatggtatatagctgtagttcccgaagcgtagtagagagcgatgagctttag

SEQ ID NO: 24032 - DNA, 4206 bp, Artificial Sequence
  Description of Artificial Sequence: Synthetic coding sequence
atggccagctgcgccagcatcgacatcgaggacgccacccagcacctgcgagacattctcaagctggatagaccagccggcggccccagtgctgaatctcctaggccaagctccgcatacaatggcgacttgaatgggctgctggtgcctgacccgctctgctccggggattcgacatctgcaaataagaccggcctgagaaccatgccccctatcaatctgcaggaaaaacaggtcatttgtctttcgggggacgattcatcaacctgtattggcatcctagcaaaagaggtggagattgtggcatcgagcgacagttcaatcagtagcaaagctcgcggatctaataaggtaaagattcagcccgttgctaagtacgattgggaacagaagtactactatggcaacttgatcgccgtaagtaatagctttttggcctatgccatcagagccgccaataacggcagtgcaatggtcagggtcatcagcgtatcaacatcggagcgcactctcctgaaaggtttcaccggctccgtggcagatctagctttcgctcacctgaacagcccacagttggcgtgcctggacgaggcagggaacttattcgtgtggcgtctggccctggtaaatgggaagatccaggaggagatcctggttcacatccggcagccggaaggtacacctctcaatcacttccggcgcatcatatggtgcccctttattcccgaggagtccgaggactgttgcgaggagtccagcccaactgtggcgctgcttcacgaagaccgggcagaggtctgggacctggacatgctacgctcctctcatagtacatggccagtggacgtctcacaaatcaaacagggctttattgtggtgaaagggcattccacctgcctgtcggagggagccctctcaccagatggtactgtgctggccacggcttcgcacgatggctacgtgaaattttggcagatctacattgaggggcaagatgaacccagatgcctacacgagtggaaaccccacgatggcagaccactttcatgtctgctgttttgcgacaatcataaaaagcaagaccctgacgtaccgttttggcgcttcttaattaccggagccgatcagaacagggaactgaagatgtggtgcacagtgtcttggacttgcttacagaccattagatttagtccggacattttctcaagtgtgtcggtcccccctagccttaaagtctgtctcgacctgagtgcagagtacctaattctatctgatgtccaacgcaaggtcctgtacgtgatggaattactgcagaaccaggaagaagggcacgcctgtttttcaagtatatcggaattcctcctaactcacccagttctgtcctttgggatccaggtggtaagtaggtgccgcctccgccataccgaggttctgcctgcagaggaagagaatgattcactaggggccgacgggactcacggcgcgggtgcaatggagtctgccgcgggcgtgctgatcaagcttttctgcgtccacacaaaggccctccaggatgtgcagatccgttttcagccccaattgaatccagacgtggtggcccccctgcctactcacacagctcatgaagattttacctttggggagagccgaccggaattagggtccgagggacttggttcagccgcccatggtagccaacctgacctcagacgaatagtggaattacccgctcccgccgacttcctttctctgtcgtccgagaccaaaccaaaattgatgactccggacgcgttcatgacgcccagcgccagtctgcagcagataactgcatcgccaagctcctctagttctggctcgagttcatcttctagcagttcaagtagctctctgacggcagtgagcgccatgtcctctacgtcagctgttgatccttctcttaccagacctccagaggagctgacactatcccctaaactacagctggacggctctttgactatgagctcatccggaagcctgcaggcgtctcctcgaggcttgctgcccgggctcctgccggctcccgctgataagctcactcctaagggtcccgggcaagtgcccactgctacatcggccctgagcttggagctccaggaggtcgagccactggggttaccacaggcttctccatctcggacgagatctcccgacgtaatcagttctgcctccaccgccctatcccaagatatccccgagattgctagcgaagctctttcgcggggattcggctctagtgcacccgagggtttagaaccagactcgatggcttcggccgcaagtgcccttcaccttttgtcccccaggccaaggccaggaccggagctcggaccccagcttggcctggacggaggccctggcgacggagaccgtcataacacaccatccctgctggaggcggcactcacccaggaagccagtacccctgactcacaggtgtggccaactgcaccagacatcactagggaaacttgctcaaccctggctgagtcacctcgaaatggcctgcaagaaaaacacaagagcttggctttccataggcctccttatcaccttctacagcagcgcgatagccaggacgcgtcagcagagcaaagtgatcacgatgatgaggtagcttctctcgccagcgcatccggtgggtttggtaccaaagttcctgcacccaggctgccagcaaaggattggaagactaaggggtcccccagaacctcacccaagctcaagcgcaagagtaagaaggacgatggcgatgccgccatgggaagcaggctgactgaacatcaggtggctgagccccccgaagactggcccgcacttatctggcagcagcagcgcgagctcgctgagctgcgccacagccaggaagaattgctccaacggctctgcacacaactggaaggacttcaaagtactgtgaccgggcatgtcgagcgtgccctggagacccgccatgaacaagagcagcgacgcctcgagcgggccctggccgaaggacaacaaaggggggggcagctccaggaacagctcacacagcaactgagtcaggctctttcgtccgctgtggccggaagattggagcgcagcatccgggacgaaataaagaagactgtgccgccttgtgtgagccggtctctggagccgatggctggccagttgtccaatagcgttgccaccaagttgaccgccgtagaagggtccatgaaagaaaacatcagtaagctgttaaaaagcaagaacctgacagatgctattgcaagagccgcagccgacacgctgcaagggcccatgcaggccgcctaccgggaggcctttcagagcgtggtccttccagcgttcgagaaatcctgtcaggcaatgtttcagcagatcaacgatagtttccgcttaggaacacaggagtacctgcagcagctggagtcacacatgaaatcccggaaggccagggagcaggaagctagagagcccgtgctggcccagttgcggggcctcgtgagcacactgcaatctgcaaccgagcagatggcggccaccgtggcaggatctgtgcgtgcagaggtacagcaccagctgcatgtggcagtcgggtccctgcaggagtccatattagcacaggttcagagaattgtgaaaggtgaagtatctgtggccctcaaagagcaacaagcagcagtgaccagctccattatgcaggctatgcgatcagccgccggaacccccgtacccagcgcccacctggactgccaggctcagcaggcacacattcttcagctgttacaacaaggccatctcaaccaggcatttcagcaggccctcacagcggcagacctaaatcttgtactgtatgtgtgcgagacggtggacccggctcaggtatttggccagccgccatgcccactgagccagccagtgctcctgtccctcatccagcagctggcctctgatcttggaactcggaccgacctgaagttgtcctaccttgaggaggcagtgatgcacctcgaccactctgacccaataacccgcgaccacatgggcagtgtgatggctcaggtcaggcaaaagttatttcagttcctgcaggccgagccccacaattcactcggtaaagcagcaaggcgtctgtctttaatgcttcacgggttggtaactccctcactcccctag

SEQ ID NO: 24033 - DNA, 576 bp, Artificial Sequence
  Description of Artificial Sequence: Synthetic coding sequence
atgagcagcggcgccgacggcggcggcggcgccgccgtggccgccaggtctgacaaaggcagtcctggagaagacggcttcgtacccagtgccctgggcacacgagaacactgggacgcagtttatgaacgggaactgcagacattccgcgagtatggcgataccggagagatctggtttggcgaggaatccatgaataggctgatcaggtggatgcaaaagcataagattccactggatgcctctgtgcttgacatcggcaccggaaatggcgtgttccttgtcgagttggcgaaattcgggttctccaacatcactggaatcgattactcacctagtgcgatacaactgagcggtagcatcatcgagaaggaaggactctccaacatcaaacttaaggttgaggactttctgaacttgagtacccagctgtccggcttccacatttgtattgacaaaggaactttcgacgcaatatcccttaaccccgacaatgctattgaaaaacggaaacagtacgtcaaatcactgtcccgtgtgctgaaggtcaagggattctttaacaatgtgatgtag

SEQ ID NO: 24034 - DNA, 2622 bp, Artificial Sequence
  Description of Artificial Sequence: Synthetic coding sequence
atgggcaaccgggagatggaggagctgatccccctggtgaaccggttgcaggacgctttctctgccttgggacagagttgtctccttgagttaccgcagatcgctgttgtgggcggacagtccgctgggaagtccagcgttttggaaaatttcgtggggagggattttcttccacggggttctggaatcgtcacacgccgccccctcgtgctgcagctggtgacctcaaaggccgagtatgccgagttcctgcactgtaagggaaaaaagtttacagatttcgacgaagttcgcctcgaaatagaggctgagacagatcgggtcacaggcatgaacaagggaataagttcaatcccaataaatttacgcgtgtatagtccccacgtgctaaacctgacattgattgacctccctggaattactaaggtcccagtgggcgatcagccccccgatatagagtatcaaatccgcgaaatgatcatgcagtttattactagggagaactgcctgatactagctgtcacccccgcaaacaccgatctggccaactccgatgcgttgaaactagccaaggaagttgatccccaaggactacgtacaatcggcgtgatcacgaaactcgatctcatggatgaggggactgacgccagggatgtattggaaaataaactcctgcccctgcggagaggctatgttggtgtggtaaacaggtcgcagaaagacatcgacggaaaaaaggacatcaaagctgccatgctcgctgagagaaaattcttcctaagccacccagcataccggcacatcgccgatcggatggggacccctcacctgcagaaggtgctaaatcagcagttgactaatcatatccgcgataccttacccaatttcagaaataaactccagggtcagcttttgtccattgagcatgaggtcgaggcttacaagaactttaagcccgaagatcctacgagaaagactaaggcccttctgcagatggtgcagcaatttgcagtggactttgagaagagaatcgaggggtcgggagatcaggtcgacacgttggagctgtctggcggggcaaaaattaatagaattttccatgaaaggtttccctttgagatcgtgaagatggagttcaatgagaaagaactgagaagagaaatctcttatgctattaaaaatatccatggcattcggacaggcttatttacgcctgacatggccttcgaagccatagtcaagaagcaaatagttaaactaaaaggaccaagcctaaaaagcgtcgacttggtgatacaggagctcatcaatacggtcaaaaaatgtactaagaagttagccaattttcctcggttgtgcgaggagactgagcggatcgtcgcaaaccacatcagggagagagaaggtaaaaccaaagaccaggtgctgctgctgatcgacatacaggtgtcatacatcaacaccaaccatgaggattttatcggattcgccaacgctcagcagcgcagctctcaggtgcacaagaagaccaccgttggcaaccaaggaaccaacctgcctcctagtcgacagatcgtgatcaggaaaggttggttaacaatctctaacatcggaatcatgaagggcggaagtaagggatattggtttgtcctgactgccgagtccttgagttggtataaagatgacgaggagaaagagaagaaatacatgctgccactggataatctgaaggtacgggatgtcgaaaagtcctttatgtccagtaagcacatcttcgcattgttcaacacagaacagcgaaacgtgtataaggactataggttcctggaactggcctgtgactcacaggaagacgtggactcctggaaagcatccctactgagggctggtgtgtaccccgataagagcgtgatgaataaaaaggccgagaacgacgaaaacgggcaggctgaaaatttcagcatggaccctcaactggagcggcaggtggaaacaattcggaatctggttgactcctacatgtctatcatcaacaagtgcattcgcgatctcattcccaaaacgatcatgcaccttatgatcaacaacgttaaagattttatcaattcagagctcttggcgcagctgtattcttccgaggatcagaacactttgatggaggaatcagcagagcaggctcagaggagggatgaaatgctcagaatgtaccaagccctgaaagaagcactcgggatcataggggacatctctaccgcaaccgtttcaacgccagcacctcctcctgtggacgacagttggattcagcatagccgccgatctccacccccctcaccaacgacccagaggcggccgaccctcagcgcacccttggcaaggccgaccagtgggagagggcctgcccctgcaattccgtcaccaggtccccattctggagccccacccgtgcccttccggccagggcctctgcccccgttcccctcgtcctcagactccttcggcgccccaccgcaggtaccgtcccgacctacgcgagcccctccgtccgtcccttcccgccgcccacctcctagtcctacgcggcccaccataatccgaccactcgagtcatccctgctggactag

SEQ ID NO: 24035 - DNA, 3111 bp, Artificial Sequence
  Description of Artificial Sequence: Synthetic coding sequence
atgcggaagcaggaggtgcggaccggccgggaggccggccagggccatggaaccggaagccccgctgaacaggtgaaggcgcttatggatctgctggccgggaaaggttcccagggctcccaggccccacaagccttggatcggactcccgacgcgccgctcggaccatgttcaaacgattcgagaatccaaaggcacaggaaggctttgctctcgaaggtcggcggcgggcccgagcttgggggaccctggcatcgcctcgccagtctgctgctggtggagggtttgacagacctgcagttgcgagagcacgactttacccaggtggaagctacccgcgggggcggccatcctgctcggacagtggccctcgaccgcctgttcctgccactgagcagagtgtccgttcctcctcgcgtcagcataactattggggtggctgggatggggaagaccactctcgtcagacattttgtgaggttgtgggcccacggccaggtcggcaaggacttttcgctcgtgttgccgcttaccttcagggatttaaatacccatgagaagctttgcgctgatcggctcatctgctccgtattccctcatgtgggagaaccatcactggccgtggccgtccccgcaagagccctcttgattctcgacggactggacgagtgtcgtaccccgctcgatttctctaacaccgtagcctgcaccgaccctaagaaggagattccggtcgatcacctaatcaccaacatcatacgcggaaatctgtttccggaggtttcaatctggattactagccgaccttccgcctcaggccagattccaggagggctggtggatcggatgaccgaaatccggggattcaatgaagaggagattaaggtttgcctggagcaaatgtttcctgaagaccaagccttactcggctggatgctcagtcaggtacaggcagaccgagcactgtatttgatgtgtacagtcccagccttctgcagattgactgggatggccttgggccacctatggcgttccaggactggaccacaggacgctgaactgtggcccccccgaacattgtgtgagctgtacagctggtacttccgtatggctctgtctggggagggacaggagaagggtaaagcctccccaaggatcgagcaggtggctcatgggggccggaagatggtggggactctgggaaggctggcttttcatggtttgctgaagaagaagtatgttttctacgagcaggacatgaaggcttttggtgtggatcttgcccttctgcagggggctccgtgttcctgtttcctccagcgggaggagacactggcctcttccgttgcgtattgcttcactcacctgtcattacaagaatttgtggcggcagcatattattacggcgcttcccgaagagctattttcgatctgtttaccgaatctggcgtgtcatggccccgtttgggatttttgacacactttcggtcagccgctcaacgagcaatgcaagcggaggacgggcgcctggatgtctttctccgattcctttctggcttgctctctccacgggttaacgccttacttgccggctctctgttggcccagggcgagcaccaggcttacagaacacaggtggccgagctgctgcagggctgccttagacctgatgcggcggtctgcgcccgagctatcaatgtcctccattgtctccatgagctccaacatactgagcttgccagatctgtggaggaggctatggagtctggtgccctggctagacttaccggtccagcacacagagccgcactggcatatcttctacaggtctctgacgcctgcgcccaggaggccaatttgtctctgtctttgagccaaggcgtgctgcaaagtttgctaccacagctgctgtactgcagaaagctgcggctggatactaaccagtttcaggatccagtgatggaattactgggaagcgttctgagtgggaaggattgcagaatccagaagatctcgctggccgagaaccaaatcagcaacaagggtgcgaaagctctagcccgatccctgctcgtaaaccgatctttgactagcctggacttgcgtggaaactccatcggaccacagggagctaaggcgctcgctgacgcgctgaagatcaaccgtactctcacttccctgtcactccaaggcaatacagttcgggatgatggcgcgagatcaatggcggaggccctggctagtaatagaactctcagtatgttacacttgcagaaaaatagcattggccctatgggggctcaacgaatggctgacttgaaacagaaccgtagcctgaaagaattgatgtttagcagcaacagcattggggacggtggcgccaaagcattggctgaggcccttaaggtgaaccagggcctggagtcactggacctacaatcaaactccatctcagacgcaggggtggccgctctgatgggcgctctgtgtactaatcagacgctcctctctctgtccctccgcgaaaattcaatcagtcctgagggggcccaggcaatcgctcacgcactgtgcgccaatagtaccctcaaaaatctcgatcttcagtggaattttattcaagcaggtgccgcgcaggctttgggacaggccctgcaactaaaccggagtctgactagcctggacctccaagaaaacgccattggcgatgacggggcatgcgcagtggctagagctctgaaagtgaacacggcgctcactgcactttacctacaggttgcttccatcggcgcttccggcgcccaggtccttggtgaggcattggccgttaatagaacactggaaatcttggatctgagggggaacgccatcggcgtggccggtgctaaagcactggcaaacgctttgaaggtgaatagctcgctacggcggctgaacttgcaagagaattctctgggcatggacggggcgatctgtatagcaaccgcgctgtcgggcaaccatcgcctgcagcacattaatctacagggcaaccatatcggggacagcggggcccggatgatctcggaggctatcaagaccaacgctccgacctgcaccgtggagatgtag

SEQ ID NO: 24036 - DNA, 2784 bp, Artificial Sequence
  Description of Artificial Sequence: Synthetic coding sequence
atgttctggaagttcgacctgaacaccaccagccacgtggacaagcttctggacaaagaacacgtgacactgcaagaactcatggatgaggacgacatcctccaggagtgtaaggcacagaaccagaaactgctcgatttcctatgccggcagcagtgtatggaagaactcgtctctctcatcacccaagacccgcccttggatatggaggagaaggtgagatttaagtatcctaacacagcatgtgagctcttgacttgcgacgtgccccagatctccgatcgtttgggaggtgacgagtcactcctgtcccttttgtatgattttttggaccacgagcctcctcttaatccccttctggcgtcgttcttcagtaaaaccattggcaatctcatagctaggaaaactgaacaggtaataacgttcttgaaaaagaaagataaatttatctccctcgtgctcaaacatatcgggacttcggcgctgatggatctgctgctccggcttgtgtcatgcgtggaacctgctgggctgcgtcaagacgtgctgcattggctcaacgaagaaaaggttatccagcgtctggtcgagttgattcacccatctcaggacgaggaccgtcagtctaacgcttctcagacactgtgtgatatcgtcagactcggccgtgaccaggggagtcagctacaagaggcgttggaacccgatccgctgctgaccgctctggaatcccaagactgcgttgagcaactgctgaaaaatatgtttgatggtgatagaactgaaagctgtttagtgtccggcactcaggtcctgctgaccttgctagagactcgtagagtgggtacagaggggctggtggattctttttctcagggactggaacggtcctacgccgtctctagctctgtgcttcatggtattgagcctcgcctgaaagattttcaccagctgctgttaaatcctcccaagaagaaggccatcttgactacaattggcgtgctcgaggagcctcttggcaatgctcgcctgcacggggctcgcctgatggccgcgctgctgcacaccaacacacctagcataaaccaagagctatgccgattgaatactatggatctcctgttggatctcttcttcaaatacacctggaacaatttcctgcactttcaggttgagttgtgcatcgccgcgatcctgagccacgccgctcgtgaggaacgcaccgaggcctcaggatccgaaagtcgggtggagcctccccatgagaatgggaacaggtccctcgaaacgccgcagcccgcggcatcgttgcctgataatactatggttacacatctgttccagaaatgctgtctggtgcagcgcattctggaggcgtgggaggccaatgatcacacgcaggctgcgggggggatgcgccgtgggaacatgggccatctgacacgtattgcaaacgccgttgtacagaatctggagcgaggtcccgtccagacccatatttcagaggttatccgcggactgcccgccgattgccgcgggcgctgggaatcttttgtcgaagaaactctgacagaaacgaataggcgaaacaccgtcgatctggcattcagcgattaccagatccaacagatgacagccaactttgtggatcagttcggcttcaacgacgaggaatttgccgaccaggacgacaacattaacgcccctttcgaccgcatcgctgaaattaatttcaacatcgacgccgacgaggactccccaagtgccgccctctttgaggcctgctgcagcgaccgaatacagcccttcgatgacgacgaggacgaggatatttgggaggacagcgacacacggtgcgcagcacgggtaatggctagacctcgcttcggcgcgccccatgcctctgaaagctgcagcaaaaatggaccagaacggggaggccaggacgggaaagcttcattagaggcacatcgtgatgcccctggcgcaggtgcacccccggcccccgggaagaaggaagccccccctgtggaaggcgactctgaggctggcgcaatgtggaccgctgtgttcgacgaacctgctaacagcacccctacagctccaggcgtcgtccgtgacgtcggttccagtgtatgggcagctggtactagtgccccagaggagaaaggatgggcaaagttcacagattttcaaccgttctgttgcagtgagtctggaccacgctgtagttccccagtggacacggagtgcagccacgccgaaggaagccgaagccaggggccagagaaagcattcagtcctgcaagcccttgcgcttggaacgtgtgtgtgacacgtaaggcaccgctcctggctagtgattcctcatccagtggaggtagtcactccgaggacggcgaccaaaaagcagcctccgctatggatgcggtgagtcgaggcccaggtcgagaggcacctccgttgcccaccgtggccagaaccgaagaagccgtgggtagggtcggctgtgccgattctaggcttttgtcccccgcttgccccgcacctaaggaagttacggccgcccctgctgttgctgtccctcctgaagcgaccgtagccattaccacagcactgagtaaggcgggacctgccatccccacacctgcagtatccagcgctctggcagtggctgtgcctttaggcccaatcatggctgtcactgctgcacccgcaatggtggctaccctcgggaccgtgaccaaagacggacagatgcccagacaaaaggagctgccttag

SEQ ID NO: 24037 - DNA, 2220 bp, Artificial Sequence
  Description of Artificial Sequence: Synthetic coding sequence
atgggcttcagcaacatggaggacgacggccccgaggaggaggagagggtggccgagccccaggctaactttaacacaccccaagccctgagattcgaggaactgctagcgaacttgctcaacgagcaacatcagatcgccaaggaattatttgagcagctgaaaatgaagaagccaagcgcaaagcagcagaaggaggtcgagaaggtcaaaccccagtgcaaggaggtgcaccagaccctgatccttgaccctgctcaacgcaaacggctgcagcaacagatgcagcaacacgtccagctgttgacacagatccaccttttagcaacctgcaacccaaatctgaacccagaggcaagctctacacggatctgcctgaaagaactgggtaccttcgcccagagctcaatagcgctgcaccaccagtacaaccccaaattccagacattgttccagccttgtaatctcatgggcgcgatgcagctgattgaggattttagcacacacgtgagcattgattgtagccctcataagactgtcaaaaagactgcaaacgagttcccttgcctgcccaaacaggtcgcctggatcctggccaccagcaaagtttttatgtaccccgagttgctgcccgtttgttctctgaaggcaaagaatcctcaggacaagatcctctttaccaaggcggaggataacttactcgccctgggcttaaagcattttgagggaacggaattcctgaacccactcataagtaagtatctgctgacctgtaagaccgccaggcagctcacggtgaggattaaaaatctaaacatgaatagggcgccagacaacattattaagttctacaagaagaccaaacagctcccggtgcttggaaagtgttgcgaagaaatccagccccaccaatggaagcctccaattgaacgggaggagcaccggctgcctttttggctgaaagcttcgctgccctccattcaggaagagttaaggcacatggccgatggcgctcgggaagttggaaacatgaccggaacaacggagatcaattctgaccaaggtttagagaaagataacagcgagcttggttctgaaacaaggtacccactcctactccctaaaggcgtcgtactcaagctcaaaccagtggcggaccgtttccccaagaaggcgtggcgacagaaacggtcctctgtcctgaaacccctgctaattcagccttctccttctcttcagccatccttcaaccctggcaaaaccccagcgcagagtactcattcagaggccccgccaagcaaaatggtcctccggatcccgcatcctatccagcctgcaactgttttacagacagtccctggggtcccgcctctgggcgtcagtgggggtgagtctttcgagagccccgctgccctgcccgccatgccacctgaggcccgcacttccttccctctcagcgagtctcagaccctcctctctagcgccccagtccccaaggttatgatgccctctcccgcgtctagtatgttccgtaagccctacgtgagaaggcgtcctagcaagcggcggggtgcacgagctttccgttgcatcaaaccagctcctgtgatccacccggctagtgtgatcttcacggtgccagccacaacagtcaaaatcgttagcctaggtggtggttgtaacatgatacaaccagttaacgctgcggtcgcccagtcgccccagacgattccaatcgcaaccctgctggtgaaccccactagttttccttgtccactgaatcagcccctggtggcctcaagcgttagcccactgattgtcagtggtaattccgtcaatctccctatcccctcgacaccggaagacaaagcccatatgaatgtagatattgcctgcgccgtggccgatggagaaaacgcattccaggggctggaacccaaacttgaaccacaggaactatctccactgtcagccactgtttttccgaaagtcgaacactcacccgggcctccacctgtggataaacagtgccaggaaggcctttctgaaaacagcgcctaccggtggacggtcgtgaagactgaagaagggcgccaggccctggagcctttgccccaggggatccaagaatctctcaacaactcttctcccggtgacctcgaggaagtggtgaagatggagccggaagatgctaccgaggaaatttccggattcctctag

SEQ ID NO: 24038 - DNA, 1911 bp, Artificial Sequence
  Description of Artificial Sequence: Synthetic coding sequence
atggagaaggccgtgaacgacggcagccacagcgaggagctgttctgccacctgaaaactatttcagaaaaagaagacctgcccagatgtacgagtgaatctcacctctcctgccttaaacaggacatactcaatgagaagactgaattggaagccacactcaaagaagcagaactcgtaacacatagtgttgaactcctgctacctttgttcaaggacactatagaaaaaattaactttgagaatgccaatctgtctgccctcaacctgaagatttcggagcaaaaagagatcctgatcaaagagcttgacacgtttaagtcagtcaaacttgccctggagcatctccttcgcaagagggattacaagcagaccggtgataacctgtcatcgatgctgcttgagaatctgaccgacaatgaaagcgaaaacacaaatttaaaaaagaaagtgttcgagaaggaagcccatatacaagagctgtcctgtctatttcaatctgagaaggcaaataccttaaaagcaaataggttttcccaatcagtgaaggtcgtgcacgaacgactccagatccagattcacaagcgggaagcagagaacgacaaactcaaagagtacgtgaagtcacttgagaccaaaatcgccaagtggaatcttcaaagcaggatgaacaagaatgaggcaattgtgatgaaagaggcttcacgccaaaaaactgtggcactgaaaaaagcatcaaaagtgtacaaacagagactagatcatttcaccggagctattgaaaagttgactagtcagataagagatcaggaagcgaagctgtccgaaactatttccgcgagtaacgcttggaaatctcactacgagaagattgtcatcgagaagactgaactagaggtgcaaatcgaaacaatgaaaaagcagatcatcaacctcctggaggacctcaagaagatggaagaccacggaaagaactcatgtgaggagattctgcgaaaagtccactctatcgagtacgagaacgagaccctgaaccttgagaatactaagctcaaactcaggttcccctgtagaattacagagtcaaaaaacatgaacatcctcatagtgcttgatatgctctgctacattagtagtgagaagacaactttagctgccctaaaggacgaagtggttagcgtggagaatgaactgagtgagctccaggaggttgagaaaaagcagaaaactctaatagagatgtataaaacccaggtccagaaacttcaggaggctgccgaaatcgtgaagtcgaggtgcgaaaacctgcttcataagaacaatcagattaccaaaacaaaaaacaaaaacgtggagaaaatgaggggacagatggagagtcacctcaaggaacttgagcgcgtctgtgacagccttacagccgctgagagaagattgcatgagtgccaggagtctcttcagtgctgtaaagggaagtgtgctgatcaggagcatactattagagaactccaggggcaggtcgatggcaatcacaacttattaactaagctgagtctggaggaggagaactgcttaattcagctcaaatgtgagaacctccagcagaaactcgagcagatggatgccgaaaataaagagctcgaaaaaaagcttgcaaaccaggaggagtgtctgaagcatagcaacctcaagttcaaggaaaaatcagctgaatatacagccttagcgcgtcaactggaggccgccctcgaagagggtagacagaaggtggccgaggaaattgagaagatgtcctcacgcgaaagcgccctgcagattaaaatactggatttagagacagagcttagaaagaaaaacgaggagcagaaccaactcgtttgtaagatgaacagtgatcctgaaacaccctag

SEQ ID NO: 24039 - DNA, 873 bp, Artificial Sequence
  Description of Artificial Sequence: Synthetic coding sequence
atggccgccgtggagaagcggcggcaggccgtgcccccccccgccgggttcaccgacagtggtcggcagtccgtgagccgcgctgccggcgctgctgaaagtgaggaagattttctcagacaggtgggtgtgacggaaatgttgagggccgcactactgaaggtcctggaggctaggccggaggagcccatcgcattcctcgcccactattttgaaaatatgggcctgcgttcacccgtgaatggaggagccggggagccgccaggccagctgttgctgcagcaacagagactggggcgagcattgtggcatctacgcctcgcccatcactctcaacgcgctgcattcaacaataatgtgtccgtggcgtacgagtgtctgagtgctggtgggaggcggaaacggcctggccttgacggcagaacatactccgagctactgcgccgaatctgcagggatgggcaggccccggaggaagtggtggctccactcctccgaaaggttcagtgccgggatcatgaagccgtacccctgagtgtgttccgcgcggggacactcacctgcttcgtgcttttagagttcgttgctcgagctggggcgctttttcagctgctggaggattccgccgccgctgtcgccgaccggagagtcggacaggctgtgctggacacactggaaggcgcattgcaggcctcggatgcagccgccccagctcgattcttggaagccggaagtcgacttggtcccgattcccttgcccttgctctggacagggctgtgggtgggcgccggccaagtgcgcccatgacccgggaggaatttcttgagagagctgcggcgctatttatcgccaaagttaaaccagtggggtag

SEQ ID NO: 24040 - DNA, 1221 bp, Artificial Sequence
  Description of Artificial Sequence: Synthetic coding sequence
atggccgacagccagctgttctgcgtggccgaggagcggagcggccactgcgcagttgtcgatgggaatttcctttacgtgtggggggggtacgtttccatcgaggacaacgaggtatacctgcctaacgatgagatatggacttacgatattgactctggcctctggagaatgcatctcatggagggggagctgcctgcgtctatgtccggcagctgtggtgcgtgcataaacggcaagctgtatatattcgggggctatgacgataaaggctattcaaaccgtctgtattttgtcaacctccgaacaagagatgagacatatatctgggaaaaaatcacagacttcgaagggcagccgccaaccccacgtgacaagctctcgtgttgggtctacaaggacagactgatttacttcggaggttatgggtgtcggagacactcagagctgcaggactgcttcgacgtccatgatgcatcctgggaagaacagattttctggggttggcacaatgacgtccacatatttgacactaagacccagacctggttccagcccgaaatcaaggggggagtgcctcctcagcccagggctgcccatacatgcgcagtgctagggaataaaggttacatcttcgggggcagagtgctgcagacacgcatgaacgacctccattatctgaacctagatacctggacatggagcggccgcattaccattaacggcgaaagcccaaagcaccggagttggcataccctcacccccattgccgacgataaactgtttctgtgtggcggtttgtccgctgacaacatccctctgtccgatgggtggatacataacgttaccacaaactgttggaaacagttgacacatcttccaaagactagaccgagactctggcacactgcctgcctgggcaaggaaaacgagattatggtgtttggggggtcaaaagatgacctcctcgccctagacaccgggcactgtaatgacttgcttatatttcagacccagccctactctctgttgaggtcatgccttgactgcatcggcaagaactctattatgttggagagccagatctctcttctgcctcctaagctgcttcagcaggtgttgaagaagatcactttctgggctgccgccaatcacagagaggaacagcgggttcagaaggaggaaacagagaataagtatcaatggatcagcagtaactag

SEQ ID NO: 24041 - DNA, 1113 bp, Artificial Sequence
  Description of Artificial Sequence: Synthetic coding sequence
atggtgcagcccttcaccaccatccccttccccccccccccccagaacggaatccccactgaatacggggtccctcacacccaagactatgccggtcaaactggcgagcacaaccttaccctttacggatctacgcaggcgcatggggaacagtcttctaactcaccttcaacacaaaacgggagcctaacaacagagggcggcgcacagaccgacggtcagcagtcccagacccaatcgagcgagaatagcgagtctaagagcacacctaaaaggttgcatgtgtctaatattccattccggtttcgggatccagatctgcgtcagatgttcggacagttcggtaagattttggacgtcgaaatcatatttaatgaaaggggaagcaaaggatttggcttcgtcacattcgaaaactctgcagacgctgatcgagctcgcgagaaattgcacggaacagtcgtggaaggtcgtaagatagaagtcaacaacgccactgcccgtgtaatgactaataagaagatggtgaccccatacgccaatgggtggaagctgagcccagttgtgggtgcagtgtatggacctgaactgtatgctgccagctctttccaagccgacgtctcccttggaaacgatgccgccgtccctctctctgggcgtggtggcatcaacacatacatcccgttgataatccctggcttcccttacccgaccgctgccaccactgcagcagcctttcgcggggctcacctcaggggaaggggcagaactgtgtatggagctgtgagagcagtcccaccaaccgctatacccgcctaccctggcgtggtctatcaagacggtttctatggggcggacctgtatatcgaaagtgcgaactgtttccgctcaaatagagtcgacatgcagccaacagatatgcactctctcctgttgcagccccaacccccactgctgcagcctctccagccattgaccgtgacggtcatggctggctgtacgcagcctactcctacaatgccccttcccctgccactggcgatggagttggccctgtggcgcgtttatacagaagtcgccactgccgaccttcctccaaccgaagttacatag

SEQ ID NO: 24042 - DNA, 534 bp, Artificial Sequence
  Description of Artificial Sequence: Synthetic coding sequence
atgagcgaggacagcgagaaggaggactacagcgaccggaccatctcagatgaggatgagtcagacgaggatatgttcatgaagtttgtgtcagaggacctgcatcgctgtgctcttctcactgcggatagtttcggtgacccattctttcctagaacaacccagattctgctggagtaccagctggggcggtgggtgccccgactgagggagccacgagacctgtacggagtgtcctctagcggccccctgtcccccacccgctggccgtaccactgcgaggtgatcgacgaaaaggtgcaacatatagacggcgtcagttgctggagcgagtcccaccaggcaggggctcaatggtgcgacttggggagcctgcagcccccgcccccacgctttaaacgcttcgcatgtttcagcctgctgagctccagggactaccgccgggtcccaccccgcagcgcgaactttgtgtttcttgtggagacagggttccatcacgtgggacaggatgggcttcggttactgacctcctag

SEQ ID NO: 24043 - DNA, 1827 bp, Artificial Sequence
  Description of Artificial Sequence: Synthetic coding sequence
atgagcgacaagagcgacctgaaggccgagctggagcggaagaagcaacggctggcccagatccgcgaggagaaaaagcgaaaggaagaggagcgcaaaaaaaaggaggctgatatgcagcagaagaaggaacccgttcaagatgacagtgatttagatcggaagaggagagaaactgaagcgctactgcagtctatcggaatttctcccgagccccccctggtgcccacacccatgtcaccatctagtaagtcagtgtcgacgccgagcgaggcaggcagccaggactcaggcgacctagggccacttaccagacgccgcttacacaagctgggtgtgagcaaagtgacccaggtggatttcctccctagggaggttgtcagctactccaaggaaacccagacccccctggccacccaccagtcagaagaagacgaggaggacgaggagatggtggaatctaaggtgggacaagattccgagttagagaaccaggataagaagcaggaggtgaaggaggcccctcccagagaactgacagaagaggagaagcagcagattctccactcggaagagtttcttatcttctttgatagaacaataagggtcatcgaacgggctctagctgaggactccgacatatttttcgactactctggccgtgagcttgaggagaaagatggcgacgttcaggccggagccaacctgtcgttcaaccgccagttctatgatgagcactggtctaaacaccgagtggtgacgtgtatggactggtccttgcagtaccccgagctgatggtggccagttataacaacaatgaggatgccccacacgaaccagacggcgtggcactcgtgtggaacatgaaattcaagaaaactacacctgagtatgtcttccactgtcagagttcagtcatgagcgtgtgcttcgcgagattccacccaaacctggtagtgggggggacctatagtgggcaaattgtgctctgggataaccggtcccaccgtagaacaccagttcagagaacccccctgtcagcagctgctcacactcacccggtgtactgcgtcaacgtggtgggaacccagaatgcgcacaatctgattacggtttcaaccgatggcaagatgtgctcctggtctctggacatgttaagcacacctcaagaatctatggaattggtgtacaataagagcaagcctgtcgccgtgaccggtatggctttccctacaggtgacgtgaataatttcgtcgtgggtagtgaagaggggacggtctatactgcatgcagacacggcagcaaggctggtatcggtgaggtttttgagggccatcagggtcccgtaaccggaattaactgtcatatggctgttgggccgatagacttttctcatttatttgtgacctcctctttcgactggacagtaaagctatggacgaccaagcataataagccgctgtatagtttcgaagacaacgccgattacgtctacgacgtaatgtggtcgccagtccaccctgcactgttcgcgtgcgtggatggaatgggccggcttgatctctggaaccttaataacgacaccgaggttcctaccgcaagcgttgccatcgaaggggcttccgcgctgaacagggtgagatgggcccaggccgggaaggaggtagccgtcggagactccgagggtcgcatttgggtttatgatgttggggaactagccgtgccacacaacgacgaatggactcgctttgctaggacacttgttgagatccgcgctaacagagctgacagcgaggaggaaggtacagtggagctcagtgcctag

SEQ ID NO: 24044 - DNA, 627 bp, Artificial Sequence
  Description of Artificial Sequence: Synthetic coding sequence
atggagggcgccgccgcccccgtggccggcgaccggcccgacctgggactgggtgcacccggcagcccaagggaagccgtggccggtgcgaccgctgccctcgaacccagaaagcctcatggcgtgaagagacaccaccacaagcacaacctgaaacaccgctacgaactccaggagacccttggcaaaggtacctacggaaaagtcaagcgcgctactgagaggtttagcggaagggtggtggccataaaatcaatccggaaagacaaaatcaaggacgagcaggacatggtccacatcagacgagaaatcgagattatgtcaagtttgaaccaccctcacatcatcagcatatatgaagtgtttgaaaacaaagacaaaatcgtgatcattatggagtatgccagtaaaggagagctgtacgactatatcagtgagcgcaggcgcctctccgaaagggaaaccagacacttctttagacagatcgtctctgcagtgcattactgtcacaagaacggcgtagtgcatagggatctaaagctaaaacgcccatcacgagaaaaccaggtgaccacactacctcagtctgcagttagcctgagatcatgctggacggtaatgatgtag

SEQ ID NO: 24045 - DNA, 990 bp, Artificial Sequence
  Description of Artificial Sequence: Synthetic coding sequence
atggaggtggccgagcccagcagccccaccgaggaggaggaggaggaggaggagcactccgcagaaccgcgcccccgtacacgatccaaccctgaaggggcggaagatcgcgccgtgggcgcccaagcttccgtaggtagtcggtctgaaggtgagggcgaagcagcctcggcagacgatgggtcgctcaataccagtggcgctggcccaaaaagttggcaggtgccacctccggccccagaagtccagatacgcactccccgcgtaaattgccctgagaaggtcatcatttgcttggacctaagcgaagagatgagccttccaaaactggagtctttcaacggctccaaaactaacgccctcaatgtttcccagaaaatgatcgagatgtttgtgcgtaccaagcacaagatcgacaaaagtcatgagtttgccttggttgtcgtcaacgacgatactgcatggctttctggcctcacatctgacccaagggaactgtgctcctgcttatatgatttagagacggctagttgcagcaccttcaatctggagggactgttctccttaatacagcagaagactgagctcccagtgacagaaaacgtccagaccattccgcccccttacgtggtacggacaattttggtctactcccgcccgccctgccaaccacagtttagcctgaccgaacccatgaaaaaaatgtttcagtgtccatactttttcttcgatgttgtctacattcataatggtacagaggaaaaggaggaggaaatgagttggaaggatatgttcgctttcatggggtcgctggacactaagggcacatcatacaaatatgaggttgcccttgctgggcctgctcttgaattgcacaactgtatggccaaattgctggcccaccctctgcaaagaccctgtcagtcacatgcctcgtatagcttacttgaggaagaggacgaggccatcgaggttgaagctactgtttag

SEQ ID NO: 24046 - DNA, 885 bp, Artificial Sequence
  Description of Artificial Sequence: Synthetic coding sequence
atgagccagcccgccggcggccggcggaagccccggaccctgggcccccccgtgtgcagtatccgcccattcaagtcttctgagcagtatctggaggcgatgaaggaggatctggccgaatggctgcgagatctctacggtttggatattgatgccgcaaactttctccaagtcctggagactgggctggtgctttgccagcatgcaaacgtggtgacagacgctgccttagcctttttagccgaggccccggctcaggcccaaaagatcccaatgcctagggttggcgtcagctgcaatggcgccgcacaaccgggcacctttcaggcaagagacaacgtcagcaatttcatacaatggtgccgtaaagaaatgggtatacaggaggtgctgatgtttgaaacagaggacctggtactgcgcaaaaacgtgaaaaacgttgtcttatgtttacttgagctcggacgccgggcatggcgtttcggcgttgctgcccccacactcgttcaactcgaggaggaaatcgaggaagaagtacgaagagagctggcactcccccccctgcctcagcctggaccggatggagccgagccttgtgaacctctgcatgtgccctcagccgtgctccatggccagtccgtttacgtgttcctcggaccagcccgtcagcctcccaaagaccggctcctgagggccgttctggggtccaagggcggcgaagcctcccgggtggatggagccagcgttggggaggaagaggaggagggcaaagaagaaaaagaaccggccgctcctcttgagtcctccccacagcctcctgagggtctccagcctcactggctgaatcaggcacctttgccgccagaggaagaaagctgggtttag

SEQ ID NO: 24047 - DNA, 1554 bp, Artificial Sequence
  Description of Artificial Sequence: Synthetic coding sequence
atggagaccgacctgaacagccaggaccggaaggacctggacaagtttattaagttctttgctctgaagaccgtgcaggtgattgttcaggccagactgggcgagaagatctgtaccagaagcagctccagtcccacaggcagcgactggttcaatctcgccatcaaggacatccccgaagttacgcacgaggccaaaaaagccctggctggtcaattgccggccgtggggcgaagcatgtgtgtggaaatcagcctgaaaacctccgagggtgattccatggaactggagatctggtgccttgagatgaatgaaaagtgcgacaaggagattaaagtatcatatactgtgtacaatcggctgtccctattgctgaaaagtctgctggctatcacacgagtgacgccggcttacagactgtctcgcaagcaaggccacgagtacgttattctatatcggatttatttcggagaagtacagctgtctggcctaggagagggctttcagaccgtccgcgtgggcacagtggggacccccgtgggcactatcaccctgtcatgcgcatatcgtatcaacttggcctttatgtctactcggcagttcgaacgaaccccccccatcatgggcattatcatcgaccacttcgtggaccgcccatacccatcatcatcccctatgcacccttgtaattacaggacagctggcgaggacactggagtcatctacccaagtgtagaggattcccaggaggtgtgcaccacaagcttctcgacgtcccccccatctcagctgtctagctctaggctgtcctaccagcccgccgccctaggggtcggcagcgctgacctggcctaccccgtggtctttgccgcaggccttaacgcaacccatccacaccagctgatggtcccaggcaaagagggcggcgtgcctttggcccctaatcagccggttcacggcacccaggctgaccaggagcgtctcgctacatgtactcccagcgaccgcacacattgtgcagcgactccttcaagctccgaggacactgagaccgtgtcaaattcatctgaaggccgcgcgtcaccccacgacgtccttgagacaattttcgtcaggaaagtaggggctttcgttaataaacctattaaccaggtcacactgactagccttgatatacccttcgccatgtttgctcccaaaaacttggagttggaggatacagatccaatggtcaacccacccgacagcccagagaccgagtcacccttgcaggggtcactccattccgatggcagtagtggcggcagcagcgggaatacacacgatgatttcgttatgatagatttcaaaccggccttttccaaggatgatattctcccgatggatctagggactttttaccgcgaatttcaaaaccccccccagctgagctctctgagcattgacatcggagcgcagagtatggcggaagacctcgactcccttcctgaaaagcttgccgtgcatgagaaaaacgtccgggagtttgacgcgtttgtggagacgctgcagtag

SEQ ID NO: 24048 - DNA, 951 bp, Artificial Sequence
  Description of Artificial Sequence: Synthetic coding sequence
atggccaccttcgtggagctgagcaccaaggccaagatgcccatcgtaggactgggcacatggaaatcaccactgggaaaggtgaaagaggcagtgaaagttgcaattgacgcgggttatcggcatatcgattgtgcctatgtttaccagaatgagcatgaggtgggtgaagcaatccaggagaagatacaggagaaagctgtgaagagggaggatctctttatcgtctcaaaactatggcccacgttcttcgaacgtccacttgtccgtaaggcgtttgagaaaacattgaaggatctgaagttgagctacctggacgtgtacctcatccactggccccaggggttcaagtcaggcgatgatctgttccctaaggatgacaaaggcaacgcaatcggtgggaaagccactttcctggacgcatgggaagccatggaggaactggtagatgagggactggtaaaagcactgggcgtgtctaactttagtcatttccaaattgagaagttgctcaataaacccggcctgaagtacaaaccagtcactaatcaggtcgagtgccatccatatctgactcaagagaagctcatccaatactgtcactctaaggggatcactgtgacagcctactcccctttggggagcccggacagaccgtgggcgaagcctgaggacccaagtctgctggaagacccaaaaataaaagaaatcgccgccaagcataagaagaccgctgcacaggtcctgattagatttcacatacagaggaacgtgattgttattcccaagtcagtgacccccgcacgtattgtcgaaaatatacaggtcttcgactttaagctgagcgatgaggaaatggcaacaattctgtctttcaaccgcaattggcgggcatgtaatgtgcttcagtcatctcacctggaggattaccctttcaatgccgagtattag

SEQ ID NO: 24049 - DNA, 8274 bp, Artificial Sequence
  Description of Artificial Sequence: Synthetic coding sequence
gagcccaaggtggtgttcgccaaggagcagcccgtgcaccgggaggtacaggctcaagccggagcctccactaccctgagttgtgaggtagcccaggcccaaaccgaggtcatgtggtacaaagacgggaaaaagctctcgttttcaagtaaagtgagaatggaggcagtcggatgtacacgtcgcctggtcgtgcagcaggctggccaggctgttgctggggaatactcttgcgaggctggctcacaacggctgtcgttccacctccacgtggcggaacccaaggcggtcttcgctaaagaacagcctgctcacagagaggtacaggctgaagcgggcgctagtgccactctgtcttgtgaagtagcccaggcgcagacagaggtcacttggtacaaagacggaaagaaactgagcagttcactcaaggtccacgtcgaggcggcgggatgtacgcgacgcctggtggtccagcaggctggacaggccgacacaggggagtatagctgcgaggccggcgggcagcagttgagcttccgcctgcaagtcgccgagccaaaagccgtctttgcaaaggagcagcccgcaagccgcgaggtccaggccgaagctggaacatctgctacgctgtcttgtgaggtggcccaggctcagacagaggtgacatggtataaggacggtaaaaagctgtcttcaagttcaaaagtgaggatggaggcagtgggttgcacacgccggttagtggtgcaggaagccgggcaggctgatgccggggagtattcctgcaaagcaggcgatcagcggttatcatttcatttacacgtcgctgaacccaaggtggtttttgccaaggagcagcctgcacatagggaagtgcaggccgaagctggggcatcagcaactctttcttgtgaggtggctcaagcccaaaccgaggttacgtggtataaggatggaaaaaaattgtctagctcttctaaagtccgcgtagaggccgtgggatgcactagacggctggtggtccagcaggcaggtcaagctgaagccggggaatattcttgtgaggccggtggacagcaactgagcttccgactgcaggtggctgagccaaaagcagtgttcgccaaggagcaggtggtctttgctaaggaccagccagtccatcgcgaagttcaggcagaggccggaacttcaacaatgctgagttgcgaagtggcccaggcccagaccgaggtcatgtggtataaggacgggaagaaattgagttctagcagcaagatgcgggtcgaagcagtgggctgcacccgcagactagtggtgcaggaagctggccaggctgacgccggggaatattcctgcgaggcaggaggccagcgtctcagtttccatcttcacgtcgctgaaccgaaggtggtgtttgctaaggagcagcctgcctgccgggaggtacaagccgaagccggtgcgtccgccacccttagctgtgaggtggcccagggccagatggaagtgacctggtataaggacggcaagaagctcagtagcagctccaaagtgcatatggaagcatcaggctacactcgaaggctcgtggtccagcaggccgggcaagcagatgcaggtgaatatagctgtgaagctggaggccagaggcttagtttccgcttacacgtggcagagctcgaaccccagatttcagaaagaccttgtcgccgggaacccctagtggtcaaggaacatgaggatatcatcttaaccgccacactggccacccctagcgccgccaccgtcacgtggctgaaagatggcgtcgagatcaggcggtcgaaaagacacgagaccgccagccaaggggatacacacacgttaacagtgcacggagcccaagtgttggatagcgcaatctactcctgcagggtgggagcggagggccaagatttccctgtgcaagtggaagaggtcgctgctaagttctgcagactcctggagcctgtgtgtggcgaattaggtggaaccgtgaccctggcctgtgaactctcccccgcctgtgcagaggtggtctggcgatgtggcaatacccagttacgggtgggaaagcgtttccagatggtagccgaaggtccagtgcgctctttgacagtgttaggacttcgagccgaagacgccggtgagtacgtctgcgagagccgcgacgaccacacttctgcacaactcacagtgagcgtgccgagggtggtgaagtttatgtctggactatccacagttgtagccgaagaaggcggtgaagctaccttccagtgcgtggtctcgccctcagatgtcgcagtggtatggtttcgcgatggcgcgcttctccagccaagtgaaaaatttgcaatcagccagtcgggtgcatcacatagccttaccatcagcgacctagtgttggaggatgctggacagattacagtggaagcagagggcgcgtcatccagtgctgctctgagagtgcgggaggccccagttctcttcaaaaagaaattagagccacagaccgtggaggaacgatcaagtgtaactctagaggtggaacttactaggccctggcctgagctgagatggacacggaatgctacggccctggcgccggggaagaatgttgagattcatgctgaaggagcaaggcatcgattggttttgcacaacgttggatttgccgatcgtggcttttttggatgcgagacacccgacgacaaaactcaagcaaagcttaccgttgaaatgaggcaggtgaggttagtgcgcggactccaggccgtggaggcaagagagcagggcacagccactatggaagtccagctgtcgcatgccgacgttgatggctcttggactagagacggtctgagatttcaacagggtccaacgtgccacctcgcggtgagagggccaatgcacaccctgactttgagcgggctcaggcccgaggacagtggactcatggtattcaaggctgagggagttcataccagcgcccgcttagtggtaactgaactaccagtcagcttttctcggccccttcaggacgttgtaaccacggagaaggaaaaggtcactctggagtgtgagctaagccgccctaatgtcgatgtgaggtggcttaaggacggggtggagctccgcgctggaaaaaccatggcaatcgccgcacagggagcctgtcgcagtctgaccatttatagatgtgaattcgccgatcagggagtatatgtgtgcgatgcccatgatgcccaatcctcagcctccgttaaggtccagggacgaacttatacactcatttacagacgggtgctggctgaagacgccggggaaatacaatttgtcgctgagaacgccgaaagtagagctcagttgagggttaaggaactgcctgttacgctcgtcagacctctcagggacaagatagccatggagaaacataggggtgtgctggagtgccaggtgagccgtgccagtgcccaagtcaggtggtttaaggggtctcaagagttacaaccaggccccaagtacgaactcgtgagtgatggactgtatcgcaagctgatcatatctgacgtgcacgcagaggatgaggatacctacacctgtgacgccggagacgtgaaaacaagtgctcagtttttcgtcgaagaacagagtatcacaattgtgagggggctgcaggatgtaaccgtcatggagccggctcctgcgtggtttgaatgcgaaacgagtatcccgagcgttcgaccccccaagtggctcctgggcaagaccgtgctgcaggcaggcggtaatgttggactggagcaagagggaacagtccaccgactgatgctgcgtaggacctgctccacaatgaccggtcctgtgcactttacagtgggtaaatcgcgctcctcagccaggctggttgtgtcggacataccagtggttctcaccagaccactcgagcccaagacaggtagagaactgcagagcgtggtgctgtcctgtgacttccgacccgcccccaaggccgtgcagtggtataaggatgacacccccctcagcccatccgagaagttcaagatgagtctggagggtcagatggcagaactgcgcatcctgagactgatgcccgctgatgccggagtgtacaggtgccaggctggcagtgcgcactcatcaactgaggtgacggtcgaggcccgggaggtaacagtgacaggccctctccaggacgccgaggctaccgaggaagggtgggcatctttcagttgtgagctttctcatgaggacgaggaagtggagtggtctctgaatggcatgcctctgtataatgactctttccatgaaatttctcacaaagggcgacgccacacactcgttcttaaaagtatccagcgtgctgatgccggtattgtgagggcttcatctctgaaggtgagtacttcagctcgtctggaggtgagagtgaagccagtagtcttccttaaggctttggacgacctgtcagccgaagaaagagggaccctggccctccagtgcgaggtcagtgatcctgaagctcacgtggtatggcggaaagacggtgtgcagcttgggccctccgataagtacgattttttacatacagcaggaactcgcgggctcgtggtgcacgacgttagtccagaggacgccggactttatacgtgtcatgtgggcagcgaagagactagagcgcgcgtaagggtacacgacttgcatgtcggaatcacaaagaggctgaagaccatggaagtgttggagggcgaatcctgttccttcgagtgtgtgctcagtcacgagagtgcctctgatccagccatgtggaccgtcggtggtaaaacagtcggctccagctctcgttttcaggctactcgtcagggacgaaaatacatccttgtggttagggaggccgcgccatcggatgccggggaggtagtcttcagcgtgcgcgggctgacatcgaaggcctccctgatcgtgcgggaaagacctgccgctatcattaagcccctggaggaccagtgggtcgccccgggagaagatgtggagctccgctgtgaactaagcagagccggaactcccgtacattggctcaaggaccgaaaggcaatcaggaagtctcagaaatacgatgtggtatgtgaaggtaccatggccatgctggtgatcagaggcgcgagtttgaaggatgccggggaatatacctgtgaggtcgaggcctccaagtcaacagccagcctgcacgtggaggaaaaggccaactgcttcaccgaggagctgacaaatttgcaagtggaggaaaaaggcactgcagtttttacgtgcaagacggagcaccctgcggcaacagtgacttggcggaaaggactgttagagctaagagccagcgggaagcaccagccctcacaagagggactcactctgagactcaccatttctgctctggaaaaggccgacagtgatacgtatacctgcgatatcggccaggcacagtcacgcgctcagttgctggtccagggccggagagttcatattattgaggatctggaggacgtcgatgtccaggaggggtctagcgccacgttccggtgcagaatcagccccgcaaactatgaaccggtccactggttcctagataaaaccccattgcacgctaacgagctgaacgagatcgatgctcaaccggggggataccacgtcttaaccctgcggcagcttgccctgaaggatagtggaaccatctacttcgaggccggggaccagagggccagcgctgctcttcgagtaaccgaaaaacccagtgtcttctctcgcgagcttactgatgccactatcactgaaggcgaagacttaaccctggtgtgcgagacaagcacctgcgacatcccagtctgctggaccaaagatgggaagactcttcgcgggagtgccaggtgccagttatcccacgaggggcacagagcccagctcctgattaccggagctaccctgcaagattctggacggtataagtgcgaggctggcggcgcctgctccagcagcatagttagagttcacgccagacccgtgcggtttcaggaggctctgaaggacttagaagtcttggaaggaggcgcagcaactctgcgctgtgtcctatcaagtgtggctgcccctgtcaaatggtgctatgggaacaacgtgcttaggcccggtgataaatactcattgaggcaggagggcgccatgctggagctggtggttcgtaatttgcgcccgcaggattcaggtcgttacagttgctcttttggcgatcagactacctctgcaaccctgaccgttaccgcactgccagcgcagtttatcggcaagctgcggaacaaagaggctaccgaaggggcaacagccaccttaaggtgcgaactgtccaaggctgcaccggttgagtggcgaaaggggagtgaaactctccgggacggcgaccgctactgtcttaggcaggatggtgccatgtgcgaactgcagatacgggggctggctatggtggacgccgcggaatattcatgtgtgtgcggggaagagcgcacaagcgcctccctgacaatacggccgatgcccgcacattttattggaagattaaggcaccaggagagcatcgaaggggctactgccaccctgaggtgcgaattaagtaaagctgctccggtggagtggagaaaaggcagagagtctttacgagacggcgaccggcactctctgagacaggacggggccgtgtgcgagctccaaatctgtggccttgctgtcgccgatgctggggagtatagctgtgtttgtggggaagagcgaacaagtgcaactttgaccgtgaaggccctgcctgcaaagttcactgagggccttaggaatgaagaggccgtggaaggagccacagctatgctgtggtgcgaactgagcaaagtcgcccctgtagagtggcgtaagggaccagagaatctccgcgatggagatcggtatatcttaaggcaggagggtactagatgtgaattgcaaatctgcgggctcgccatggccgacgcgggagagtacctgtgcgtgtgtggccaggagagaacttccgccacattgacgattcgagcccttcccgctaggtttatcgaggatgtcaaaaaccaggaggcacgtgaaggggcgactgccgtgttacagtgcgagctgaattcggcagcgccagtcgaatggcgtaagggctctgagaccctccgggacggagataggtactcactcaggcaggacggcaccaaatgcgagttacagatcaggggtttggcaatggccgataccggggaatactcttgtgtctgcggacaggagcgaacatcagctatgttgaccgtgagagctcttcctattaagttcactgaaggtttgaggaatgaggaagctacagagggagctaccgcggtattacgatgcgagttgtccaaaatggcgccggttgagtggtggaaaggtcatgagacgttgagggatggtgatcgccatagcctccggcaggacggagcacgttgcgagttacaaatcagagggcttgtcgccgaggacgcgggcgagtatctctgtatgtgcgggaaggaacggacgtcagctatgttaacagtgcgagctatgccctctaaattcattgagggattgaggaatgaagaggctaccgagggggatacagccaccctctggtgtgagctatcgaaggcagcacctgtagagtggaggaagggccatgaaacgttgcgggatggggaccggcacagcttgaggcaggatggaagtagatgtgagctgcagatccgaggactcgcggtcgtggatgccggcgaatatagctgcgtgtgtggccaggagcgaactagcgctactttgacggtgagagctttacctgcacgtttcatagaggatgttaaaaaccaggaagcgcgggaaggagcgactgccgtgctccagtgcgagctgagcaaggcggcacctgtggagtggcgaaaaggcagcgaaacactccgcgggggtgataggtattctcttagacaagacggcacaagatgcgagctccaaatccatgggctgtccgtcgctgacaccggagagtacagctgcgtctgcggccaggaaagaacatccgcaacattgaccgttagggccttgccagcccggcactcccggagcgaagatcagggtggccttaggagaggccactcctataccgctgtctag

SEQ ID NO: 24050 - DNA, 1449 bp, Artificial Sequence
  Description of Artificial Sequence: Synthetic coding sequence
atggtgatggagaagcccagccccctgctggtgggccgggagttcgtgaggcaatattatactttgctgaacaaagctcctgagtatctacatcggttctatggcagaaatagcagctatgtgcatggcggagtggacgctagcggcaaaccgcaggaggctgtttacggtcagaacgacatccaccacaaagtgctgtcattaaattttagcgaatgccataccaaaatacgtcatgtggatgctcatgccaccttgtcagacggagtggttgtccaagtgatgggccttctgtctaattccgggcagccggaacgcaagtttatgcagaccttcgtgctggcccctgagggcagcgttcccaataaattctatgtgcacaatgacatgtttcggtacgaggatgaagtgtttggggattcggagccagaattagatgaagagtctgaagatgaagtggaggaggagcaggaagagcgacagccatctcctgagcctgttcaggaaaatgctaatagtggatattatgaagcccacccggtaacaaatggaatcgaggagcccctggaggagtccagccacgagcctgagccagagcctgagtccgagaccaaaaccgaggagctgaaaccgcaggtagaggagaaaaacctggaggagctggaagaaaagtccactacccccccacctgccgagcctgtctcactgcctcaagagccaccaaaagcctttagttgggcctccgtcacctctaaaaaccttcccccctctggtactgtgtcatcctctggcattcctcctcatgtgaaggcccctgtctcccaaccccgggtggaggccaaacctgaagtacagagtcagcctcctcgagtgcgcgagcaaaggcctagagagagacctggattccccccaaggggacctagacccggccggggcgatatggagcagaatgacagcgacaaccggcggataattaggtaccctgacagtcaccaactgtttgttggaaacttgccccatgatatcgacgagaacgagctgaaagaattttttatgagttttggcaatgtggttgagttgagaatcaacaccaaaggagtgggtggaaaattgccgaactttggatttgtcgtgttcgatgactctgagcctgtacagcgaatcctcatcgcgaagcccattatgtttagaggggaggttcgcctgaacgtagaagagaaaaaaacccgcgctgcaagggagcgagagactaggggtggtggggacgacaggcgcgacatccggcgaaatgataggggtcctgggggcccaagggggatcgtgggcggcggtatgatgcgggatagggatggtcgcggccctcccccccgaggcggcatggcccaaaagctgggctccggccggggcacagggcagatggaaggtagatttacaggacagaggaggtag

SEQ ID NO: 24051 - DNA, 807 bp, Artificial Sequence
  Description of Artificial Sequence: Synthetic coding sequence
atgagcggccggaagcggagcttcaccttcggcgcctacggcggcgtggataaaagctttacatccaggcgcagcgtgtggaggagcgatgggcagaatcaacatttccctcaagctctcgatctatcgagagttaatcttgtcccatcctatacaccttcactctacccaaaaaataccgacctgtttgagatgattgagaaaatgcaggggtccagaatggacgagcaaaggtgctcgtttcccccaccccttaaaaccgaagaggattatattccctacccttcagttcatgaggtcttgggaagggagggaccttttccgctgatactgctccctcagttcgggggatattggatcgaaggcacaaaccacgaaattaccagcatacccgaaacggaacccctgcagagtccgacaactaaagtgaagctcgaatgcaatcctaccgcccgtatctatagaaaacactttctgggtaaggagcatttcaactattattcacttgacgctgccttgggccacctcgtcttttcacttaaatacgacgtaatcggcgaccaggaacatctgcgcctgttgctgcggactaagtgtaggacctaccacgacgtgatccctataagttgcctgaccgaattcccaaatgtagttcagatggcaaagctggtatgcgaagatgtgaacgtggacagattttatcccgtcctatatcctaaggcctctcgactaatcgtgacctttgacgaacacgttatatccaataattttaagttcggcgtgatctaccagaagctaggccaatag

SEQ ID NO: 24052 - DNA, 606 bp, Artificial Sequence
  Description of Artificial Sequence: Synthetic coding sequence
atgtacaccctgctgagcggcctgtacaagtacatgttccagaaggatgaatattgcatcctcatcttgggcttggacaacgccgggaagacaacattcctagaacagtcgaagacccggtttaataaaaattataaaggcatgtccctgtccaagatcactaccacagtgggtctaaatataggcaccgtggacgtgggaaaagctcgcctgatgttctgggatctgggtgggcaagaggaactgcagtctttgtgggacaagtattacgctgagtgccatggagttatttatgtcattgactccaccgatgaggaaagattagctgagagtaagcaggcctttgaaaaggtagtgacttctgaggctttgtgcggcgtccctgtcctggtcttggcgaacaaacaggacgtcgagacttgcttgtcgattcctgatattaaaacagctttctccgattgtacaagcaagattgggagaagagactgtctgacacaggcgtgctctgcactcaccggcaaaggggtcagggaaggcattgaatggatggtgaagtgcgtagttcggaatgtacatcggccgccacggcaacgtgacatcacctag

SEQ ID NO: 24053 - DNA, 1707 bp, Artificial Sequence
  Description of Artificial Sequence: Synthetic coding sequence
atgggcctgctgaccttccgggacgtggccatcgagttcagcctggaggaatggcaatgtctggacaccgctcagcgtaatctgtataaaaatgtgatactggaaaactaccgtaatcttgtcttcctcggcatagctgtctccaaacaggacctgataacgtgcttggagcaggagaaggaaccactgaccgtcaagcggcacgagatggtgaatgagccacctgtaatgtgttcacatttcgcacaggaattttggcccgaacagaacattaaagactccttcgagaaggttacactgcgccggtacgagaaatgcggcaacgacaatttccagctaaaagggtgcaaaagcgtggatgaatgtaaactgcataaaggaggttataatggactcaaccagtgcctaccaacgatgcagtcaaaaatgttccaatgcgataaatatgtgaaagtatttaataagtttagtcactccgataggcacaagatcaaacacatggaaaataagcctttcaaatgtaaagagtgcggacgcagcttctgtatgcttagccacctcactcgccatgagcggaactacaccaaggtgaatttctgcaagtgtgaggagtgcgagaaggccgttaaccagtcatctaaactcactaagcacaagcggatctacacatgcgagaagctctacaagtgccaggaatgtgacaggacctttaaccaatttagcaacctgactgagtataagaaggactacgccagggaaaaaccctacaagtgcgaagagtgcggtaaagccttcaatcagagcagccacttaactacacataagatcatccacaccggcgaaaagccttacaagtgtgaagagtgcggcaaggcctttaatcaattttcaaacttgacgactcacaagaaaatccataccggggagcagccatatatatgtgaggaatgtggaaaggccttcacccagtctagtacactgacaacacacaagcggatccacacaggggagaaaccatataagtgtgaagagtgcggcaaggctttcaatcggagctccaagctgacagagcataagaatatacacacgggagaacagccctacaagtgcgaggaatgtggcaaagccttcaacagaagcagcaacttgacagaacataggaagatacataccgaggagaaaccttataaatgtaaagagtgcggcaaagcgttcaagcatagcagtgccttgaccacacataaacggatccacacaggagaaaagccttacaaatgtgaggagtgcggtaaggcgttcaacagatcttccaagctaacagagcacaaaaaactccacaccggcaagaagccctacaagtgtgaagagtgcggtaaagctttcatacagtcaagtaagctgacggagcacaagaaaattcactccggggagatcccctacaagtgtgaggagtgcggcaaggcattcaagcattcttcaagtcttaccacccacaaaaggatacataccggggaaaaaccttacaagtgtgaggaatgcggcaaagctttctcccgaagttcaaagctgacagaacacaaaatcatacacacgggagaaaagccctataagtgtgagcgctgtgataaagcatttaatcagtccgccaatttgaccaagcacaaaaagattcacacaggcgagaaactgcagaattggaacgtgtag

SEQ ID NO: 24054 - DNA, 1383 bp, Artificial Sequence
  Description of Artificial Sequence: Synthetic coding sequence
atggacagcgagctgatgcacagcatcgtgggcagctaccacaagccacccgagagagttttcgtgcccagctttacccagaacgaaccttcacagaattgccaccctgcaaacttagaggttaccagcccaaagattctgcactcacctaactctcaagcactgatactagctctcaaaactttgcaggaaaagatccataggcttgagcttgagcgaacccaagccgaagacaatcttaatatcctgtctcgagaggccgctcagtataaaaaagccttggaaaacgagacgaatgaaaggaacctagctcaccaagaactgattaaacagaagaaggatatctccatccagttgagtagtgctcagagtagatgtacattgcttgaaaaacagctggaatatactaaaaggatggtgctgaatgtggagcgggaaaaaaatatgatcctggaacagcaggcccaactgcaaagggagaaagaacaggaccagatgaagctctacgcaaaactggaaaagttggacgtgctggagaaagagtgttttaggttaaccaccacacaaaaaacagctgaggataagatcaaacatctggaggagaaactcaaggaggaagagcatcagagaaagctgttccaggacaaagctagcgagttgcagactggcctcgaaatctctaagattatcatgagctctgtaagcaacctgaaacatagcaaggagaagaagaaaagtagcaagaagacaaagtgcatcaaacggcgtcccccctggcagatttgtagtaaattcggcgcgttaccatttgttgctgagaagatgcgccagcacagagaccctcacatattacaaaaacctttcaatgtgacagagacccggtgcctccccaaacctagtcggactaccagctggtgcaaggccatcccccctgacagcgaaaagagtataagcatatgtgataaccttagtgaacttctcatggctatgcaagacgagctagaccaaatgagcatggaacaccaggagcttttgaaacagatgaaggagacggaaagccactcggtgtgcgacgacatcgagtgcgagcttgaatgtcttctgaagaaaatggagataaaaggggaacagatctccaaacttaagaagcatcaggacagtgtctgcaagctgcaacagaaggtacagaactctaaaatgagtgaggcctcaggcatccaacaagaggactcatatcccaaaggatctaagaacatcaagaacagtccgaggaagtgtctgactgatacaaacttgttccagaagaatagtagcttccacccaatacgagtccataatttgcagatgaagttacgaagggacgatatcatgtgggaacagtag

SEQ ID NO: 24055 - DNA, 1833 bp, Artificial Sequence
  Description of Artificial Sequence: Synthetic coding sequence
atgagccagaccagcctgaagcagaagaagaacgagcccggcatgaggagttcaaaagaaagtctggaagctgaaaaaaggaaggagtcagataaaacaggggtgcgtttgagtaatcagatgcggcgggcggtgaaccctaaccacagcctgcgatgctgtccattccagggccactctagctgccgcaggtgcttgtgcgctgctgagggaactgccctgggcccatgccacactatccgaatctatatccacatgtgcctgctctgggagcagggtcagcagatcacgatgatgagggggtcccaggagtcctctcttcgcaagaccgatagtcgtgggtatctcgtgaggagtcagtggtccagaatcagccgcagcccctcaactaaggctcccagcatcgacgaaccccgtagccggaacactagcgccaagctgcctagttcctcaaccagttctcgcacccctagcacaagtccaagcctgcacgattccagtccccctccactgtcaggccaaccctcactccaaccccccgcttctccccagctgccccgaagcctggattcccggcccccaactccgcctgaacctgatcctgggagtaggcggagtacaaaaatgcaagaaaaccccgaggcctgggcccagggaatagtgagagagatccgacagacccgtgactcgcagccactggagtactctcgaacttcaccaaccgaatggaagtcctcatcacagcgcagagggatttatccagctagcacccagctggatcgtaattccctgagtgaacagcagcagcaacagcgggaggatgaggacgattacgaagctgcctactgggcaagtatgagaagtttctacgagaaaaacccttcctgcagcagaccttggccgcctaaacccaaaaacgcaattacaatagcattaagcagttgtgctctctttaatatggtggatggaagaaagatctatgaacaggagggcctcgagaaatatatggagtaccagctcaccaatgaaaacgtcatcttgacccccggacctgccttccggtttgtgaaggctctgcagtatgtgaatgctcgcctgcgggatctgtaccccgacgagcaggatctgtttgacatcgtgcttatgacaaataaccatgcacaggttggggtccgactgataaacagtgtgaatcactacgggctgctgatcgatcggttctgcctcacagggggtaaggatcctattgggtacttgaaggcttacctgactaacctgtatattgcagcggacagtgaaaaagtccaagaggcaatccaagagggcattgcatctgccacaatgttcgacggagccaaagatatggcatactgtgatacacagctgagggtcgcctttgatggggatgcagtgttattctccgacgagtcggagcattttaccaaagagcacgggttagacaaattcttccagtatgacaccctttgcgaaagtaaaccgctggctcaggggccgctcaagggcttcctggaagatctgggccggctacagaagaagttctatgctaagaacgagcggctgttgtgcccaattagaacatatttggtcacagcgaggtcagctgccagctctggagcacgggtcttgaagaccctgcgacgttggggactggagatcgatgaagcgctgtttctcgcgggagcacctaaatcccccatcttggtcaaaatccggcctcatatctttttcgacgaccacatgttccatattgaaggtgcccaacgtctcggaagcatagccgcctacggtttcaacaaaaaattttccagctag

SEQ ID NO: 24056 - DNA, 456 bp, Artificial Sequence
  Description of Artificial Sequence: Synthetic coding sequence
atgagcaagaacaccgtgagcagcgcccggttccggaaggtggacgtcgatgagtatgacgagaacaaattcgtcgacgaggaagatggtggggatggtcaggctgggcccgatgagggcgaagtggactcctgcctgcgccaggggaacatgaccgcagcactgcaggcagccctaaaaaatccaccaattaatacaaaaagtcaagctgtgaaagatcgcgccggaagtatcgtgctgaaggtgcttatcagcttcaaagcaaatgacattgagaaggccgtccagtcactggacaagaacggcgtggatctcctcatgaaatatatctataagggcttcgagagcccgtccgacaatagtagcgcaatgctgctccagtggcacgagaaggccctggcggcaggtggcgttgggagcatagtgcgggtcctgacggcgagaaagaccgtctag

SEQ ID NO: 24057 - DNA, 3522 bp, Artificial Sequence
  Description of Artificial Sequence: Synthetic coding sequence
atggtgaccgtgggcaccaacatcctgcccagccggcccgccgcctcagcaaataccgcccgggaagacgcggccctgttcagcaggcgtattcccccgagacacaaaaacggagccgcccagccgggcgccgcacccggccctggggctcctggcgccaacatgggcaacgctcactcaaaaagtggggacaggcactcagcgttgcctggccggcccgaactgtccttctacggtagctttccgagaaagtggagtgagaacgtgtttcttgacaatgaactcttgaccagcaaaatactcagtgtcttacgccctcagagtgaacgtggctttcgggccggggatctgcgctacccaacacatttcctctcaaccaattctgtgctcgccagcgtgactgcttccctcaaggaacaccctcggggcaccttactgtcagatgggagcccagcgctgtcccgcaacgtgggcatgacagtttctcagaaagggggaccccaacccacaccaagccctgcagggccgggcacccagctcggacctatcactggggagatggatgaggcagactccgccttcctgaaattcaagcagacagcagacgactcactctcactgacctcccccaataccgaaagcatctttgtggaggacccttacactgcttcgttgaggagcgaaattgaaagcgatggccatgagttcgaggcagaaagctggtccctagctgtggatgccgcctacgccaagaagcagaagcgcgaggtagtgaagaggcaggatgtactgtatgagctgatgcaaaccgaggtgcaccacgtgcgcaccctaaagatcatgctgaaagtctactcgagagccctgcaagaggagctgcagttctcttctaaggcaattggcaggctgtttccgtgcgccgacgacttactggagacccactctcattttctggccaggctgaaagaaagaaggcaggaaagcctcgaggagggcagcgatcggaattacgtaatccagaaaatcggggatctgctggtacagcagttctcgggagagaacggcgagagaatgaaggagaagtatggcgttttctgcagtgggcacaacgaggcggtaagtcactacaagctactccttcagcaaaataaaaaattccagaatctgatcaaaaagattggaaatttctctattgtccgcaggctcggcgtccaggaatgtatcctgctggtgacacaaagaatcaccaagtatcccgtgctagtggagcggattatccagaacaccgaggccgggaccgaggactatgaagatcttacccaggcactgaaccttataaaggacataatctcacaggtggacgcaaaggtatctgagtgtgagaaaggccaacgactgagggaaatcgcaggtaagatggacctcaaatcttctagtaagttaaaaaacggactgactttccgcaaagaggatatgctccagcgtcaactgcatctggagggcatgctctgctggaaaaccacatctggcaggttgaaggacattcttgctatcctgcttaccgatgtactattgctgcttcaagaaaaagaccagaagtatgtgtttgcctctgttgactccaagccacctgtcatttcccttcagaaactgatcgtacgtgaggtagctaacgaagaaaaagcaatgttcctgatctccgcatctttacaaggccccgagatgtacgagatctacacttcttccaaagaggacaggaacgcttggatggcccacattcagagagctgttgaaagctgtcctgacgaggaagagggccctttctcactaccggaggaggagaggaaggtagtcgaagcaagggccaccagactccgagatttccaggaacgcttgtccatgaaggatcagctcattgcccaaagcctgttggagaagcagcagatatatttggagatggccgaaatgggcgggctcgaggacctcccccagccaagggggctgttcaggggaggggacccctctgaaactctacagggtgagttgatactgaagtcagccatgtccgagattgaaggtatccagagtctgatctgtcgccagttagggagcgccaacggtcaggccgaagatggtggatcaagtacagggcctccccgtagagcagaaactttcgccggatacgattgcacaaacagccccactaagaatggatcctttaaaaaaaaggtcagctcaacagaccctaggcccagagactggagaggaccaccaaactcacctgacctaaaactctccgactccgacatcccagggtcgagtgaagagtctcctcaggtcgtggaggctccaggtactgagagtgaccctagattgcctacggtgctggagagcgaactggttcagaggatccagactcttagccagctgcttctgaacctgcaagccgtcattgcacatcaagactcctacgttgaaactcagcgcgctgccatacaagaaagggaaaaacagttccgcttacagtctactaggggcaacctgctcctagaacaggagcgccaaaggaacttcgaaaaacaaagggaggagagagcggctcttgagaagctccaatctcagctgcgccatgaacaacagcgctgggagagagagcggcagtggcaacatcaggaactggagagagccggcgcacgacttcaagaacgagaaggcgaggcacgacagctgcgtgagcggctcgagcaggaacgagcagagttagagagacagcgacaagcctatcagcatgacctggagcgtttaagggaggctcaaagggctgttgagcgagagcgggaacggttagaattgcttcgtcgcttaaaaaaacaaaacaccgctcctggagcactgccgcctgatactttagctgaggctcagccaccctctcatcccccttctttcaatggggaaggcctagagggaccccgcgtgagcatgctcccttctggggtaggccccgagtatgcagagaggcccgaagtcgctcgaagagactcagctcccaccgaaaacagactggctaaatctgatgtcccaatacagttgctgtccgcgaccaatcagtttcagagacaggctgctgtgcagcaacaaatccccactaagttagccgccagcactaaagggggaaaagataagggaggcaaaagcaggggcagtcagaggtgggagtcctcagcatctttcgatcttaagcagcagctgctgctgaataagcttatgggtaaggacgagtctacaagccggaaccgccgcagcttgtcaccaatcctaccaggtcgccacagtcctgcaccgccaccggatccgggctttcccgcccccagccccccgcccgccgactcaccttccgagggcttctcactcaaggccggaggaactgccctcctcccagggcccccggctccgtctcctctccccgcaactccattgtctgcgaaggaggacgcctccaaagaagacgtgatattcttctag

SEQ ID NO: 24058 - DNA, 1674 bp, Artificial Sequence
  Description of Artificial Sequence: Synthetic coding sequence
atggacagcaccgtgcccagcgccctggagctgccccagcggctggccctgaatcctcgggagtcacctcgctcccccgaagaggaggagcctcatttgctgtccagccttgccgctgtccagactctcgcctcagtcataagaccttgttatggtccacacggaaggcaaaagttcctcgtcaccatgaagggagagactgtttgtacaggctgcgccactgccatcctgagagcactcgaactggaacacccagccgcgtggcttcttagagaggcgggccagacacaggcagaaaactccggcgacggtacagcctttgtggtgctcttaaccgaagcattgctggagcaagctgaacagcttttgaaggctggcctcccaagaccccagctccgcgaggcatacgcgacagcaaccgcagaggttctcgcgactttgccttcattagcaatccagagcttgggcccacttgaagacccctcgtgggcactgcatagtgtcatgaacacacacaccctctcaccaatggatcacctaaccaagctcgtggcacatgcatgctgggctatcaaggagctggatggctcattcaaacccgaacgcgtgggtgtttgtgccctgccgggcgggacactggaagactcctgtctgcttcccggcttggccatttcaggaaaactatgtgggcagatggctacagtcctctccggagctcgagtggcactcttcgcttgtccattcggaccagcacaccccaatgccccagcgacagcacgactgtcttcacctgcagacctggcgcagttttctaaagggtcagatcagctgctagagaaacaggtgggccagctggcagctgctggcattaatgttgcagttgtcctgggagaggtcgatgaggaaacattgactctggcagacaagtacggaatagtcgttatacaggcccgcagttggatggaaattatctacctgagcgaggtcctcgacacaccacttctgcctcgtctgctccctccgcagcgccccggaaaatgccagagggtttacaggcaggagcttggagatggcttggcagttgtgtttgagtgggagtgtacaggtacaccagctctgacggtggtcctcagaggcgccacaacccaagggcttcgcagcgcagaacaggccgtgtaccacggaattgacgcttatttccagctgtgtcaggacccccgcctgattcctggagcaggcgccacagagatggcccttgcaaagatgttaagtgataaagggtcccgcttagagggcccctctggacccgcgttcttggcgtttgcttgggccctgaaatatctgccaaaaacactggctgaaaatgccggactcgccgtctcggacgtcatggccgagatgagtggagtccaccaaggagggaacctactcatgggagtgggaactgagggaatcattaatgtagcccaagagggggtgtgggatacactgattgtgaaggcccagggcttccgggcggttgccgaagtggtcctccaactcgttaccgtcgacgagattgtcgtcgctaaaaagagccccacccatcaagaaatctggaatccagattctaaaaagaccaagaaacacccgcccccagtggaaaccaagaagattcttgggctcaataattag

SEQ ID NO: 24059 - DNA, 939 bp, Artificial Sequence
  Description of Artificial Sequence: Synthetic coding sequence
atgacccggagcctgttcaagggcaacttctggagcgccgacatcctttccacaattggttatgacaatatcatacagcacctgaataacggcaggaagaactgtaaagagttcgaagatttcctgaaagaacgcgcagcaatcgaggaacgttacggcaaagatctgctgaacctgagtagaaaaaagccatgtggccagtccgaaatcaacacactgaaacgcgcgctggaagtgttcaagcagcaggtcgacaatgtcgcacaatgtcacattcagctagctcagagcctgcgggaagaggctcggaaaatggaggaattccgggagaaacagaagctccagagaaagaagacagagttgataatggatgccattcataaacagaagtcacttcaattcaagaaaacaatggatgcaaagaagaattatgagcagaagtgtcgggataaagacgaagccgagcaggccgtaagtcggtctgccaacctggttaatccaaagcagcaagagaagttgttcgtaaagctggcgacctctaaaactgctgtggaggactccgacaaggcttacatgctccatatcggaacccttgacaaggtgcgagaggagtggcagtctgagcacatcaaggcatgtgaagctttcgaggcgcaggagtgtgaacggataaacttctttaggaacgcactctggctgcacgtcaaccagcttagccagcagtgtgtgacgtctgatgagcacccttcctgtatgcgaatatctaccccaccaagacgtatgcaaagccagcaggagcgtcttcagggcctcacctggcagggggaggacccttcacagttcctcaaggcgcatcagatgattcccatcacactgtggctaatgactacagtctgcagtatttccaagatcaacgagactagggccttcagtggctag

SEQ ID NO: 24060 - DNA, 3693 bp, Artificial Sequence
  Description of Artificial Sequence: Synthetic coding sequence
atgccccggaagggcacccagcccagcaccgcccggcggcgggaggagggccccccaccgccctctcccgacggggcgagctcggatgccgagcctgagccaccctccggcagaaccgaaagtccggcaacagccgctgagaccgcttctgaagagctggacaatagatctttggaagaaatcctgaacagcatcccgcctcccccccctcccgctatgacaaacgaggctggagccccccgtcttatgattacacacatagtaaatcagaattttaaaagctacgccggcgagaagattcttgggccttttcacaagagattctcttgcatcatcggcccaaacgggtcaggcaagagcaacgtgatcgactcaatgcttttcgttttcggataccgagcccagaagatcagatctaagaagctcagcgtgcttattcataattccgatgagcacaaggacatacagtcctgcactgtcgaggtacattttcaaaagattattgataaggagggggacgattacgaggtaatccctaattcaaacttttatgtgagcaggacagcttgcagggataacacgagcgtataccacatctctggcaaaaaaaagacgttcaaggacgttggcaatttactcagaagccacggaatcgacctggaccacaacagattcttaattctccagggagaggtagagcagatcgccatgatgaagccgaagggccagaccgaacacgacgaaggaatgcttgagtatctggaagatataatcggatgcgggaggctaaatgaacccattaaggtgttgtgcagaagagtggaaattttaaacgagcacaggggagagaagctgaaccgcgttaaaatggtggagaaagagaaagacgcactagagggcgaaaaaaatattgcaatagagtttctcactctggaaaacgagattttcagaaaaaagaaccacgtctgccagtactacatatatgagcttcaaaaacggatagcagagatggaaacgcaaaaagaaaagatacatgaggatacaaaagaaatcaacgagaagtcaaacattctgtctaacgaaatgaaagctaaaaataaagatgttaaagacaccgagaagaagttgaacaagataaccaaatttattgaggagaataaagagaagttcactcagttagacctagaagatgttcaagtgagagagaaactcaagcacgcaacctcaaaagccaagaagttggaaaaacagctgcagaaagataaagaaaaggtcgaagagtttaaatccattccagctaagagcaacaacataattaatgaaaccactacaaggaataatgccctcgagaaggagaaggaaaaggaggagaagaagctcaaggaagtaatggatagtctgaaacaggaaacgcagggactccagaaggagaaggagagccgggagaaagaactgatgggttttagtaagtccgtcaacgaagccaggtcaaagatggacgttgctcagtccgagttggacatttatctgagtcgtcataataccgctgtgagccaactgaccaaggccaaagaggcgttgatagctgcgtctgaaactttgaaggaaagaaaagctgctatacgtgatatagagggaaaactcccccaaaccgaacaggagcttaaggagaaggaaaaggaactccaaaagctaacgcaggaagagaccaactttaagtccctagtgcacgatctcttccagaaagttgaggaggcgaaaagctccctcgccatgaatcgatcaaggggcaaggttctggacgcgatcatccaggaaaagaaaagtggcagaattcctggcatttacggtaggttaggagatttaggggcgatcgacgaaaaatatgatgtagccatcagctcttgttgtcatgctctcgactatatcgtcgttgacagcatcgatattgcgcaggagtgtgtcaatttcctgaagaggcagaacatcggagttgccacttttatcggactagacaagatggctgtctgggcaaaaaagatgacggagatccagacccctgagaatacaccgagattattcgaccttgtgaaagtgaaggatgagaagatcagacaggccttttatttcgccctgcgagatacactcgtggctgataatctggatcaagccactcgagttgcctaccagaaagatcgccgctggcgggtcgtgactctccagggacagattatagagcaaagtggaaccatgaccggcggaggatctaaagtgatgaaagggaggatgggctcatccctcgtgatcgagatcagcgaagaggaggtgaacaaaatggagtcgcagctgcaaaatgatagcaagaaagcaatgcagattcaagagcaaaaagtacagctggaagaaagagtagttaagctgcggcatagcgagcgggaaatgcggaacaccctcgagaaatttacagcttcgatccagcggctcattgagcaagaggaatatctcaacgtgcaggtgaaggagttggaggcgaatgtcctggctactgcccccgacaaaaagaagcaaaaactgctggaggaaaatgtgagcgcttttaagaccgagtatgatgcggttgcagagaaggccggtaaagtggaggcggaagtaaaaagattgcataataccatagttgagatcaataatcataagctcaaggcgcaacaggataagttagataagattaataaacagctggatgaatgcgcgtcagccataacaaaggcccaggtcgccattaaaactgctgatcggaatttgcagaaggctcaggatagcgtgctccgaacggagaaggagataaaggacaccgagaaggaggtggatgacttaaccgcagagctcaaaagcttggaggataaggcagcagaagtggtaaagaacacaaacgccgcggaaataagtaaaatatcgctccatccaatcgaggacaatccaatcgaggagatatcagtactttctccagaagatctggaggctatcaagaacccagatagcatcacaaatcagattgctctgctggaagcgcggtgtcatgaaatgaaacctaacttaggtgctatcgctgagtataaaaaaaaagaagagctttaccttcagcgcgtggccgaattggataagattacttatgagcgtgacagctttaggcaagcttacgaagaccttcgaaaacagcgactcaatgagttcatggctgggttctacataataactaataagctgaaggagaattaccaaatgctaaccctgggaggagatgccgaacttgagctggtggacagcctcgatcccttctctgaaggaataatgttctctgtccgccctcccaagaaatcatggaagaaaatcttcaacctttctgggggcgaaaagactctcagttctctagctctagtcttcgctttacatcattacaagccaacaccactctacttcatggatgagatcgacgcggcactggattttaagaacgtctcgattgttgctttctatatatacgagcaaacaaaaaatgcacagtttatcattatctcattgagaaacaacatgttcgaaatctctgaccggttgattggtatttacaagacctacaacataacaaagtctgtggccgtcaaccctaaggaaatcgcaagcaaggggctgtgctag

SEQ ID NO: 24061 - DNA, 2661 bp, Artificial Sequence
  Description of Artificial Sequence: Synthetic coding sequence
atggagctgcggtgcggcggcctgctgttcagcagccggttcgactcgggcaacctagctcatgtcgaaaaggtggagtccctctcatctgatggtgagggggttggcgggggggcatctgccctcacctcaggaatcgcgtcttcccctgattatgagtttaatgtttggacccgccccgactgcgcggaaaccgagttcgaaaacgggaacaggtcatggttttatttttctgttaggggcgggatgccaggaaagctgattaaaatcaacattatgaacatgaacaagcagtctaaactctactcacaggggatggcgcccttcgtgcgaaccctcccaacgcgcccaaggtgggaacggattcgtgatcgccccactttcgagatgactgagacgcaatttgtgctcagcttcgtacatcggttcgtagagggaagaggcgcaacgacattcttcgctttttgctacccgttcagctacagtgattgccaggagttactcaaccagctcgaccagcgcttcccggagaatcatcccacacactccagcccattggacacgatatattaccacagagaactactgtgttattctcttgatgggttgagggtcgatttgttgactattacatcctgccatggcctaagagaggaccgcgagcctagacttgaacagctcttccccgacaccagtacgcctaggccatttaggttcgctggaaaacgaatcttctttctgtcatctagagtgcacccgggagagacacccagcagctttgtcttcaacggtttcctggatttcattctgagacctgacgacccacgggcccagacactaagacgcttgtttgttttcaaattgatccctatgctaaaccctgacggcgtcgtgagagggcactatcgtaccgacagcaggggtgtcaatctgaaccgccaatacttaaagccggacgctgtcctacaccctgcaatctatggggctaaggcagtgctgctgtatcatcacgttcatagcaggctgaattcccagtcaagcagtgagcatcagccgtccagttgtctgccacccgacgctccggtctctgaccttgagaaagctaataacctgcaaaatgaggctcagtgtggccactctgctgaccgacacaatgccgaagcttggaagcaaacagagccggccgaacagaagcttaactctgtgtggattatgccccagcagtccgccggcttggaagagtccgctcctgacactattccacctaaggagtccggggtagcttattatgtcgatctgcatggtcatgcatctaagagggggtgctttatgtacggaaactcttttagtgatgaaagcacccaggttgaaaatatgttatacccaaagctaatcagtttaaatagtgcccactttgactttcaagggtgtaactttagcgaaaagaacatgtatgcacgcgatcggagagatggccagtccaaggaagggtccggccgagtcgcgatctacaaagcttccgggattatccattcttatactttggagtgcaactataatacaggccgatccgtgaattccattccagcagcatgccatgacaacgggagggctagccctcctcccccgcctgctttccctagccgttacactgtggagctgtttgagcaggttggtcgtgctatggcaatagctgcgttagatatggccgaatgtaacccctggccccgaattgtcctgagtgagcacagctctttaactaacctccgcgcttggatgttaaagcatgtgaggaattctcgtggactgagcagcaccctaaacgtgggagtaaataagaagcgtgggttgcggacaccaccaaaatcacacaacggactgcctgtatcgtgttctgagaacaccctcagtcgggcaagatctttttcaaccgggacaagtgccggcggttcatctagcagccagcagaacagcccccaaatgaaaaacagcccttcttttcctttccacggaagcaggcctgccgggttacctggcctgggtagtagcacccagaaagtaacacacagagtcctgggtcccgtcagggagcctcgatcccaggacagaagacgtcagcagcagcctcttaaccatcggcccgctggttccctggccccttcccccgctccaacctcctcaggacctgcaagtagtcataaactgggtagctgtctgttgcctgattcttttaatatccccggtagctcatgttctttactttccagcggagacaagccagaggccgttatggtgatcggcaaaggccttttggggaccggagcaaggatgccatgcattaagaccagactacaagcaaggcctagactgggacgcggctccccacccacgcggcgcggaatgaaagggtcgtccggaccgacgtccccgaccccacgcacgagagagtcatcagagctggagctcggatcttgcagtgcaacccccggtctcccccaggcccgcccccctcggccccgttcggcccccgccttttctccaatatcttgttccctgtctgatagtccttcttggaattgctactccagggggcccctgggacagcccgaagtgtgttttgttcccaaaagccctcctttgacagtctcccctcgagtttag

SEQ ID NO: 24062 - DNA, 4221 bp, Artificial Sequence
  Description of Artificial Sequence: Synthetic coding sequence
atgtggagcctgaccgccagcgagggcgagagcaccaccgcccacttcttcttaggcgcgggagacgaagggctgggtacacgggggatcgggatgaggccagaagagagtgatagcgagctcctggaagatgaagaggatgaggttcctccggaaccccaaatcattgtcggtatctgtgccatgaccaaaaaaagtaagtctaagccgatgacacaaatactggaaaggctgtgcagatttgattatctcaccgtagtgatactcggtgaagatgtgattctgaatgagccagttgaaaactggccctcttgtcattgccttattagcttccatagcaaagggtttccactggacaaagctgtggcttattcgaaactgcggaacccgttcctgatcaacgacctggcaatgcaatattatatacaggacagacgcgaagtgtacaggattttacaggaagagggaatcgacctgccacgttatgcagtcttaaatagagatcctgcccggccagaggaatgcaacttgatcgaaggcgaagaccaggttgaagtgaatggtgctgtgtttcccaagccttttgtggagaaacccgtcagtgctgaggatcataacgtatatatttattatccttcatctgcaggtggtggaagtcagaggctcttcagaaagatcggcagcagaagctcagtgtattccccagagtctagtgttcggaagacgggctcctacatctacgaggagttcatgcccaccgatggcacagacgtcaaagtgtatacagtgggcccagactatgcccacgctgaggcaaggaagtcccctgcgctggacgggaaggtggagcgtgactccgagggtaaggaaatcagatatcctgtaatgttgacggcgatggagaaactggtggcacggaaagtgtgcgtggctttcaagcagaccgtctgcggctttgacttgttgagagccaatggccacagttttgtctgtgatgttaatggattcagctttgtgaagaattcaatgaaatattacgacgattgtgctaagatcctcggaaacactatcatgcgcgaattggctcctcagttccagataccttggagcattcccaccgaagctgaggacatcccaatcgtaccaactacatctggcaccatgatggagctccggtgcgtgatcgctatcattcggcacggcgatcgaaccccaaagcagaaaatgaagatggaagtcaagcacccgcggttctttgctctgttcgagaaacatggcggctacaagactggcaagctgaagttgaaaaggccagagcagttacaggaggtgctcgacataactcgacttttgctcgcagagctggagaaggaacctggtggtgagattgaagaaaagaccggtaaacttgaacagctgaagagcgtcctggagatgtatggacatttcagcggcatcaaccgcaaggtacagctgacatattacccacacggagtgaaggcaagcaatgagggccaagacccgcaacgcgaaacactcgcacctagcctcctgctagtgctaaagtggggaggcgaactcactcccgctggtcgcgttcaggcagaggaactggggcgcgcctttagatgcatgtatccgggaggccagggcgattatgccggcttccccggttgtggcctacttagattacacagcacatttcgacacgacttaaaaatctacgcctctgatgagggccgtgtgcagatgacagcagcggctttcgctaagggactcttggcgcttgagggcgagctgaccccgatactggtccagatggtcaagagcgcaaacatgaacgggttgctggactccgatggcgattctctctcctcttgccagcaccgcgttaaggcgcgtctgcatcatatcctgcagcaagacgcaccttttggccccgaggactatgatcagcttgctcctacaagatctacctctctccttaatagcatgactatcattcagaaccctgttaaggtgtgtgaccaagtgtttgcactcatagaaaatcttacgcaccagatcagagaacggatgcaggatccacggagcgtggatctgcaactgtatcacagtgaaactctggagttgatgttacaaaggtggagcaaactggaacgcgactttcggcagaaatcaggccgatacgatattagcaagatccctgacatatatgactgcgtaaaatatgacgtccagcataatggatctctgggacttcagggcaccgccgaactgctccgcctgtcaaaagctctcgccgatgttgtaattccgcaggaatatggcatctctcgagaggaaaagctagaaatcgccgttggcttttgcctgcccttattgaggaaaattctgctggacttgcagaggacacacgaggacgagtcagtgaataagctgcatcccctgtattctagaggagttttgagtcccggcaggcacgttcgcactcgcctatacttcaccagtgagagtcacgtacactctctgctcagtgttttccgctatggaggtctgctggatgagacacaggacgcgcagtggcaaagggctcttgattacctgtctgctatttcagagcttaattacatgacacagatcgtaataatgttatatgaagacaatactcaggaccctttgagtgaggaaagattccacgttgagctgcactttagcccaggggtcaagggtgttgaggaggagggttccgcccctgctggctgtgggttccgccctgccagtagcgagaacgaggaaatgaaaaccaatcagggaagtatggagaacctgtgtccaggcaaagctagtgatgaacctgatcgagcactccagacatctccacagccgcctgagggccctggtcttccgcgacggtcccctttgatccgtaataggaaggccgggtctatggaggtcttgtctgagacttcgtcgtctcggcccggagggtatagattattctcttcttcacggccacctacggagatgaagcaaagtggcctcggattcgaaggctgcagcatggtaccaacgatatatccgcttgagactttgcacaacgcactgtccctaagacaagtctccgaattcctgagtcgggtgtgtcagcgacatactgatgcccaggcacaggcctccgccgccctgttcgacagcatgcacagctctcaggctagtgataatccattttcccctcctcgcaccctgcactctcccccactgcagctgcagcagcggagcgaaaaacccccatggctggaaactcgattttgccatgtaggtcaagcagggctcgagctgctcacgagttctgacctgccagctagcgcctcacaaagtgcaggaattaccggggtttcccataggactcagccggatagcagtgggccaagttccacggtaagctccgccgggcctagcagcccgactacagtggatgggaacagtcaattcggattttctgatcaacccagcctcaactctcacgtggcagaggagcaccaggggcttggactgctgcaggaaacgcccggatctggggcccaagagttgtccatcgaaggagagcaggagctcttcgaaccaaatcaaagccctcaggtgccccccatggaaacctcccagccatacgaggaggtctcgcaaccttgccaagaggtgcctgatatttcacagccttgccaggacatctccgaggcattatctcaaccgtgtcagaaagtcccagatataagccaacaatgtcaggagaatcacgacaatgggaaccacacatgccaagaggtcccccatatatcacaaccatgtcagaaatcctcacaactctgtcaaaaagtcagcgaagaggtgtgccagctatgtctggaaaattctgaagaggtgtcacagccgtgccagggcgtgtccgttgaagtgggcaagctggtgcacaagtttcatgttggagtgggctccctggtgcaggagactctggtagaagtggggtcgccagccgaagaaatacctgaggaagttattcagccctaccaggagttttcagtggaggtgggccgcctggcccaagagacaagtgctattaacctgctgagccaggggatcccagaaatagacaagccgtcgcaggaatttcccgaggaaatcgacctccaagcccaggaagtgcccgaagagataaactag

SEQ ID NO: 24063 - DNA, 1308 bp, Artificial Sequence
  Description of Artificial Sequence: Synthetic coding sequence
atgggcgacctggagctgctgctgcccggcgaggccgaggtgctggtgcgggggctccgctcttttcccctccgcgagatgggcagtgagggctggaatcagcagcacgaaaatctcgaaaagctgaatatgcaggccatcctggacgcgactgtaagtcagggagaaccgattcaggagctgctggtgacgcacgggaaagtaccaaccctggtagaagaacttatcgcagtcgagatgtggaaacaaaaggtgtttcctgtgttttgcagagtcgaggatttcaagccgcagaacaccttccctatttatatggtagtgcaccatgaagcctctatcattaatttgcttgagacagtattttttcataaggaagtgtgtgaatctgccgaagatactgtactggatctggttgactactgccatagaaaattgactttgctggtcgcccagtccgggtgtggaggcccacctgagggtgaaggctcacaagactctaaccccatgcaggagctccagaagcaggccgaactcatggaatttgaaattgctctcaaagcactgtccgtactgagatatattaccgattgcgtggacagacagtggagtgtttcacaacctccccaattggcccatctgaagcgcatacagagactccacccggtttgttggtttctatctcctggcaagctgcagcagttcgagggatctagatggcacacagtggctcccagcgaacagcagaagctgagcaagctagatggacaagtttggatcgcgctgtacaatttactgctcagccccgaagctcaagcccgctattgcctgacgagcttcgccaaaggcaggttgctgaagttgcgcgcatttctaaccgatactttacttgatcaacttccaaacttggcccatttgcagtcatttctcgcccatctcacactgactgagacccaacccccaaaaaaagacctggtcctagagcaaatacctgagatttgggaacggctagagcgtgaaaacagggggaaatggcaggcaatagctaagcatcaactacagcacgtgttctcccctagcgagcaggatctgcgcttgcaggccagacgatgggctgagacctaccgcctggatgtgctggaggcagttgcgccagaacgcccccggtgtgcatactgctccgcagaggcatccaagcggtgtagccgatgtcagaatgagtggtattgttgtagggagtgccaggttaagcactgggaaaaacacgggaagacttgcgtgttggccgctcagggggacagagccaaatag

SEQ ID NO: 24064 - DNA, 1377 bp, Artificial Sequence
  Description of Artificial Sequence: Synthetic coding sequence
atgaacgaggccatggccaccgacagcccccggcggcccagccggtgcaccgggggcgtggtcgtacgcccacaggccgtgaccgagcaaagctatatggaatctgttgtcaccttcctgcaggatgttgttcctcaggtttattgttgtggcgacaatatccagtcatacaccgccacagtcatttcagcagccaaaacactgaagagcgggttaaccatggtcgggaaagttgtcacacagctaaccggaactctgcctagcggtgttacagaggatgatgtcgccatccactcaaactctcgtcgctctcctctggtgcctggtatcattacagtcattgacacagaaactgtgggtgaagggcaagtgctggtgtctgaggactcagacagcgatggtatcgtcgctcattttcctgctcacgaaaagccagtgtgttgcatggcctttaatactagcggtatgctgctggtgacgacggacactctcgggcacgacttccacgtgttccagattctaacccatccttggagctctagccagtgcgctgtccatcacctgtacacgctgcaccggggggaaaccgaggctaaggttcaggacatctgtttctcgcacgactgtcgctgggtggtggtgagcaccctgcggggtacctcacacgtgttcccgattaacccgtatggcggccaaccctgtgtcaggacacatatgagtccaagggttgtgaatagaatgagcaggtttcagaaaagcgccgggttagaagagatagagcaggagctcactagcaagcagggaggacggtgctcacccgtcccgggcctatcgtcctcaccttcaggctctccccttcatggcaaattgaactcacaggactcatacaacaacttcaccaataacaatccaggaaatccacgcctctcgccccttccatccctcatggtggtaatgccactagcccagattaagcagcctatgaccttaggcaccattactaagaggacgggtaaagtgaagccacctccccagatttcgcctagcaagagtatgggaggggagttttgtgttgccgcaatctttggtacaagccgtagctggtttgcaaataacgccggcctgaagcgagaaaaggatcagtctaagcaggtcgtagtagagtccctgtatatcatctcctgttacggaactcttgtcgaacatatgatggaaccacagccactgaacgggatgaactgtagtcatcgcctgatgcagactaccctctgctcctccctgcagatgcagtactctatcattagttcttgtctactggcatggtttcctctagaagttctgggccctctgctggatatggggctgacgacggtctag

SEQ ID NO: 24065 - DNA, 309 bp, Artificial Sequence
  Description of Artificial Sequence: Synthetic coding sequence
atgcgggccagcccctgcatcagccagcccgccgccagctggcacccccggccctccgccctccggccaactgctggatcgggtccggatacaagaactcccggcacggtggaagatggctcagccccatgcccggcattcagatctcctgccgtgagcccctgtggagaagagccttgttgcttccagatctcaccggctgaagaaactctggaattaggacgtcttgtgtcacccggatgccacaaatccagtgcccctcaggaacggcggctggatccaagggccaggtgcgttgtccatatctag

SEQ ID NO: 24066 - DNA, 4227 bp, Artificial Sequence
  Description of Artificial Sequence: Synthetic coding sequence
atgtggagcctgaccgccagcgagggcgagagcaccaccgcccactttttcctgggcgcaggggatgagggtctgggcacccggggcattgggatgaggccggaggagtcggacagcgagcttctggaggacgaagaggatgaggtccctccagaaccccagatcatcgtgggaatttgtgccatgacaaagaagagtaagagcaagcccatgacccagatattagaacggctgtgtaggttcgattacctcactgtggtgattctcggggaggacgttatactgaacgaacccgtagaaaattggccatcttgccactgtctgattagctttcatagcaaggggttcccactagataaggctgttgcgtattctaagcttagaaaccccttcctcatcaatgacttagctatgcagtactacatacaagataggcgggaggtttacaggattctgcaagaagaaggcatcgatctaccccgttacgctgtgctcaatagagacccagccaggccggaggagtgcaaccttattgagggagaagatcaggtcgaggtaaatggcgccgtatttcctaagccgtttgtggaaaagcctgtgtccgcagaggatcacaatgtgtacatctattatccatcatcagctgggggaggatctcagcgcctttttagaaagattggttctaggtcaagcgtgtactctccagaaagctctgtgcgcaagactggatcctatatatatgaggaattcatgcctacagacggcactgatgtgaaagtctatactgttggcccagattatgcgcatgccgaggcaagaaagagtcctgcccttgacggcaaggtcgagagagattcagaggggaaggaaatccgttatccggtcatgctgacagccatggagaagcttgtcgcgcgcaaagtttgcgtggcatttaaacagaccgtttgtggcttcgatctcctgcgggccaacggacattctttcgtgtgcgacgtgaacgggttcagtttcgtcaagaatagcatgaaatattacgatgactgcgcaaagatattgggcaataccatcatgagggagctggccccacaattccagataccctggtccatcccgaccgaagctgaggacatcccaatcgtaccaacaacctccggcaccatgatggagctccggtgcgtgattgcaattataaggcatggcgaccggacacccaagcagaaaatgaaaatggaagtcaagcacccaaggttcttcgctttatttgagaagcacggggggtacaagaccggtaagctgaagttgaaaaggccagagcagttacaggaggttctggatattacacggctgctgctggccgaactcgagaaggagccaggtggcgagatcgaagagaagacgggtaaattggaacagttgaaatctgtgctcgaaatgtacgggcatttttctggaattaatcgcaaagtgcagctaacttattatccacatggcgtgaaggctagtaatgaaggccaagacccacagcgggagactctggcccccagcctgctcttggtgctgaaatggggaggcgaactgactccagccggtagagtccaggccgaggaactgggacgtgcgttcagatgcatgtatccaggtggccagggggactacgcagggtttcctggttgcggacttctacgattgcactctaccttccggcacgatctgaaaatatacgcctctgacgaggggcgggtacaaatgacggctgcagcatttgctaagggtctgctcgccttagaaggagagctaacaccaatcctggtccaaatggtcaaaagtgcaaatatgaatggactcctcgactcagacggtgactccctgtcatcttgtcagcatagagtcaaggcaagactccaccacatcctgcagcaggacgcccccttcgggccggaggactacgaccagctcgcccccacaaggtctacatccttgttaaattctatgactattatccagaatcctgtaaaagtatgcgaccaagtgtttgcactcatcgagaacctgactcaccagatcagagagcgcatgcaagatccaaggtcagtagacctgcaactctaccattcagaaactttagagctgatgcttcaacggtggtccaaattggaacgggactttcgacaaaagtccggccgatatgacatcagtaagattcccgacatctatgactgcgtcaaatatgatgtacaacataatggctccttaggtcttcagggcacggctgaactgcttagactgagtaaagcattagcagatgttgtcatcccgcaagaatacggaataagcagggaagagaaattggagattgccgtgggcttctgtcttccactcctcagaaaaattctgctggatctgcaacgcactcacgaagatgaaagcgtcaataagctgcacccgctttatagcaggggcgttcttagccctgggcggcatgttcggacacgcctgtactttacgagcgaaagtcacgtgcacagccttcttagtgttttccgatacgggggcctcctggacgaaacccaggacgcacagtggcagcgtgccctggactaccttagtgccatctctgaactgaactacatgacccagatcgtgatcatgttatatgaagacaacacccaggatccactgtctgaggagcgcttccacgtagaactgcacttttccccaggcgtgaaaggcgtcgaggaggagggaagtgcaccagctggttgtggttttcgtccagccagcagcgaaaatgaggagatgaagactaaccaaggctccatggaaaatctatgcccaggcaaggcatcagatgagcccgaccgagcccttcagacaagccctcagccacctgagggacccggactaccgcgtaggagtcctttgattcgaaatcgcaaggccggaagcatggaggttctctcagagacatcttcctctcggcccggcgggtacaggctgttttcatcctctcgacccccaactgagatgaagcaaagtggcctgggatcacagtgcaccggcttattctcaactaccgtccttggaggcagctccagtgccccgaatctgcaagattatgcaaggtctcacggcaagaagctcccccccgcttccctaaaacaccgcgacggtttcgaggggtgttccatggtgccaactatatacccgctggagacgctgcataatgccttaagccttaggcaagtgtccgagttcctgtctcgcgtttgtcagcgccatacagacgcccaagcacaagcctccgccgctttattcgattccatgcactcatcccaggcatctgacaatcctttctcaccccctcgaactctgcattccccacccctccaactgcagcagcggagtgaaaaaccgccttggtactcttccggacccagctccactgtaagcagcgctggtccctcaagccccaccacagtggacggaaacagccagttcgggttctccgaccagcctagtctgaacagccacgtcgcagaagagcaccaaggccttggcctgctgcaggagactccggggagcggtgctcaggaactgagcatcgagggtgagcaggaactgtttgagcccaaccaatccccccaggtccccccgatggagacgtcccagccctacgaggaggtgtctcaaccctgccaggaggttccagacataagccagccctgtcaggacattagcgaggcacttagtcagccctgtcagaaggtgcctgatatatcacagcagtgtcaggagaatcacgacaacggcaatcacacatgccaagaggtcccccacatctctcaaccctgtcaaaaatcttcccagctctgtcaaaaggtaagtgaggaggtgtgtcagttatgcctggagaatagcgaggaggttagccagccttgccagggtgtttctgtggaggttggaaaactcgtgcacaaatttcacgtaggcgtaggatccttggtacaggaaaccttagtggaagtcggcagcccagccgaggagattcccgaggaggttatccaaccataccaggaatttagtgtcgaggtgggaaggctcgcccaggagacgtcagctataaatctactatcacagggaatccctgaaattgataagccttcacaggaattccccgaggagatcgatctgcaggcccaggaggtcccggaggagataaactag

SEQ ID NO: 24067 - DNA, 2994 bp, Artificial Sequence
  Description of Artificial Sequence: Synthetic coding sequence
cggcccccccccgccggcccccaggcccccgagggcgcccgggccggatcccgacccgtacagctcttggctttgctgagctcctggtgtgaggagctcggcagactgttactgctgcgacaccagaaaagcaggcagtccgatccccctggtaagctgccgatgcagccacccttgagtagcatgagttctatgaaacctacactgtctcattccgatggatcgtttccgtatgatagcgtgccctggcagcaaaataccaatcagccccccgggtcactatcagtggtgactaccgtttggggggtcacgaatacatcacagtcacaggtacttggaaaccctatggccaatgccaataacccgatgaaccccggaggcaatcctatggcttcaggcatgacaacctccaaccctggactgaacagcccccaattcgccggacaacaacagcagttctccgcaaaggccggcccagcccagccctacatccagcagtctatgtacggtagaccgaactatcctggatcaggcggttttggcgctagttaccctggcgggccaaatgcacccgctggaatgggtataccgcctcacacacgcccaccagctgattttactcaaccagccgcggctgccgccgccgccgcagtggctgcggcagccgctactgcaactgcaacagcaactgccacagtcgccgctctgcaggagactcagaataaggacattaaccagtacggtccgatgggaccgactcaagcctacaactcacagtttatgaatcagcccggccctaggggccctgcaagcatgggaggctccatgaacccggctagcatggcagccgggatgacccctagcgggatgagcgggccgccgatggggatgaaccaacctagaccccctggcatcagcccctttggtactcatggtcagcggatgccccagcaaacttacccgggccccagaccacaatctctgcccattcagaatattaaaaggccctatcctggcgagcccaattacgggaatcagcagtacggccctaactcccagttcccaacacaacctggtcagtacccagcccctaatcccccaagacccctgacctctccaaattatccaggacagcggatgcccagccagccgtcctcgggtcagtatcccccccctactgtcaatatgggacagtattataagcccgaacagtttaacggacaaaacaataccttctcaggttcctcctactctaactacagccaggggaacgtaaaccggcctccacgtcccgtgcccgtcgccaattacccacactcacctgtacctggaaatcccactccaccgatgaccccaggctcaagcattccaccctacctaagcccatctcaggatgtgaaaccgcccttcccacccgatatcaaacctaacatgtccgcccttccgcctcctcccgccaatcacaatgatgaattacggttaacgttccccgttagagacggagtggtcctggaacctttccggctcgaacacaatctcgcagttagtaaccatgtttttcacttacgacctacagtgcatcagaccttaatgtggcggtctgaccttgagttgcaatttaagtgctaccaccacgaagataggcaaatgaacacgaactggcccgcgagcgtgcaggtgagcgtgaatgctactcccctaacaatcgagagaggtgacaacaagaccagtcataagcccctgcacctcaaacacgtgtgccagcctggacggaacacaatccaaataacggtgacagcatgttgttgctcacatctcttcgttctgcagctggtgcatcgcccctctgtgcggtctgtactccaggggcttctcaaaaagcgactgctgccagcagagcactgcataacgaagattaaaaggaacttcagtagcgtggccgcctcatccggcaacaccacacttaacggcgaggatggcgtggaacagacagcaataaaagtgagcctcaaatgtccgattactttcagaaggatccagctgcccgcccgcgggcacgactgcaaacatgtgcagtgcttcgatctggagagttatctgcagcttaattgcgagagaggtacctggaggtgtccagtctgtaacaagacagctttgctagaggggctggaagtagaccagtacatgtggggcattttaaatgccattcagcattctgagtttgaggaggtaaccatcgacccgacctgttcctggagacccgtgcccatcaagtcggacctgcacataaaggatgatcccgacggaattccctcgaaacgttttaaaaccatgtcgccctcccagatgatcatgcctaatgttatggagatgatcgctgcactgggacctgggccctcgccctatccactgccccctccccccggcggtaccaattctaatgactattcctcccagggtaacaattaccagggtcacgggaactttgattttcctcatggcaatcctgggggcacaagcatgaatgatttcatgcatggtcccccccaattgagccatcctcccgatatgcctaacaatatggcggcgctggagaaaccacttagtcacccgatgcaggagaccatgccgcacgcgggatcttctgaccagccgcaccccagtatccaacagggcctgcacgtcccccacccctcttctcagtccgggcccccactccaccacagcggtgcccctcctcctcctccctcccagcctcctaggcagcccccgcaagccgcaccgagttcacacccccactcagacctgacattcaatcctagctccgctctcgagggacaagctggtgcacagggggcctctgatatgcctgagccgtccttggaccttctgcctgagctgactaacccggacgagctgctctcctatctcgacccaccagatctgcctagtaactccaacgacgacctcttatctctttttgagaacaactag

SEQ ID NO: 24068 - DNA, 3405 bp, Artificial Sequence
  Description of Artificial Sequence: Synthetic coding sequence
atgggcaaggagcaggagctgctggaggccgcccggaccggccacttgcctgccgtcgagaagctcttgagcggaaagcgtctgagcagtggtttcggtggtggcgggggcggtggtagtggtggtggaggtgggggctcaggggggggcggaggcggtctgggatcatcatcccaccccctgagcagcctactatctatgtggcgcggccctaatgtcaattgtgtagatagcacaggatacacccccctacaccatgctgccctcaacgggcataaggatgtagtcgaggtactcctcagaaatgatgccctgaccaatgtggctgatagtaaaggctgctatccactccacctggccgcatggaaaggagatgcacagatcgtgcggttgcttatccaccaaggcccttcacacacacgagtaaatgaacaaaacaatgacaatgagaccgcgctgcactgcgcggcacagtacggtcatacagaagtagtgaaagtgctgctcgaggagctgaccgaccctactatgaggaataataagttcgaaacacccttggatttggccgcactgtatgggcgactggaggtcgtgaagatgctgttaaacgctcatccgaacctgctgtcttgtaatactaaaaagcacacgcctctgcaccttgccgctcggaatggccacaaggcggtggtacaggtcttgttggacgctggcatggactcaaactatcagactgagatgggcagcgccttgcacgaagcagctctctttgggaaaaccgacgtggtccaaattctattagccgccggtacagatgtcaatatcaaagacaatcatggtctcaccgctctcgacaccgtgagggaactaccttcccaaaagtctcagcagatcgcagcactaattgaggaccacatgacaggcaaaaggtctacaaaggaggtggacaaaactcctccaccgcaaccaccactcatttcaagcatggactctattagtcaaaaatctcaaggggatgtggagaaggctgtgaccgagcttattatcgacttcgatgcgaacgccgaagaggaaggcccatacgaggcactgtacaacgctatcagctgccatagtctggattcgatggctagtggacgctccagcgaccaggattcgacaaataaagaggctgaagccgccggtgtcaagcccgctggagtccgacctcgtgaaaggcccccgcccccagctaaaccaccacccgatgaggaggaggaggatcacatcgataaaaaatacttccccttaacagccagtgaagtgctgtctatgcgccctaggattcacggctctgcggccagagaggaggatgaacacccgtacgagctgctgctcaccgccgaaactaaaaaggtagttctggtggacgggaagacaaaagaccataggcggtccagctcttctcgcagccaggatagtgcagaagggcaggacggacaagtgcccgagcagttttccggtctgctccatgggtcttctcccgtgtgtgaggtcgggcaggatcctttccagcttctgtgcaccgccggccagtctcatcccgacgggtctccgcaacagggtgcgtgccacaaggccagcatgcagttggaagagacaggggtgcatgcccctggtgcttcacagccctccgccctagaccagtcaaaacgggtcggatacctgacgggactcccgactactaattccagatctcatcccgaaaccttgactcatacggcatcacctcaccctggtggtgctgaagagggcgatcgctctggtgccaggagccgcgccccacctactagtaaacccaaggccgaactgaaactctctagatcgctcagcaaatctgacagcgatctactgacatgttctcctaccgaggatgcaactatgggctctcgatctgaaagcctgtctaattgttctattgggaaaaaacgacttgagaaatctcccagcttcgcttccgagtgggatgagatcgaaaagatcatgtcttccattggcgaggggatagacttctcccaggaacgtcaaaaaatttctggcctgcggacgctggagcaaagtgtgggagaatggcttgaatcaattgggctccagcagtatgaaagcaagttgctgctcaacgggttcgacgacgtgcacttcctcggctccaacgtgatggaggagcaggacctgagagatatcggcatcagcgatcctcaacacagaagaaagctcctgcaagctgctcggagtctccctaaggtcaaagccttgggctacgatggcaacagcccgccctctgtaccatcatggctcgattctcttggactgcaagattacgtgcatagtttcctcagctcggggtattcctccatagacactgtaaagaatctgtgggaactggaactcgtgaacgtgctcaaggtccagctccttgggcatcgcaaaaggattatcgcatcattggctgaccgcccatacgaggaaccaccgcagaagcccccccggttcagtcaactccggtgtcaggaccttcttagccaaacatccagtcctcttagtcagaatgattcctgcaccggcaggtcagcagacttactgctgccccccggcgacaccggtcggcgcaggcacgacagcttacatgacccagccgccccctctagagctgaacgcttccgaatccaagaagagcaccgagaagccaagctcaccctgcgaccaccatcactcgccgccccatatgctcctgtgcagagttggcagcaccagcctgaaaagttgatctttgagtcttgcggatatgaggccaactacttgggtagtatgctgatcaaagatctgaggggaaccgaatcgactcaggacgcctgcgcaaagatgaggaagagcactgagcatatgaaaaagataccgacaataatcctaagcataacttacaagggagtcaaatttattgacgcgtcaaacaaaaatgtgatagctgagcacgaaataaggaatatctcctgcgccgctcaggaccccgaagatttgtgcacattcgcttatataaccaaagatttacagacctctcatcattactgtcacgtttttagtacagtggatgtcaaccttacctatgagattattctcactttaggacaagcgttcgaagtggcctatcagctcgcacttcaagcccagaagtcccgcgccaccggggctagcgctgcagagatgattgagactaagtcttccaagcctgtacctaagccaagagtcggggtgcgcaagagcgctttagagcctccagatatggaccaagacgcccagagccacgcaagcgtgagctgggttgtagatcctaaaccagactcaaaaaggtccttgtccacgaattag

SEQ ID NO: 24069 - DNA, 3099 bp, Artificial Sequence
  Description of Artificial Sequence: Synthetic coding sequence
atggaggccgccgccgccgtggtggccgccgaggccgaggtggagaacgaggacggtgactcctcatgcggggacgtttgcttcatggataaaggcctgcagtctatctccgagctgtccctggattccactttacatgctgttaacctgcattgtaacaatatttcaaaaatcgaggcgattgaccatatttggaacctgcagcacctggatctctcttctaaccagatttcccgtattgaaggactaaataccttgactaagctgtgcacactgaacctgtcgtgtaatttaataaccaaggttgaaggcctggaagagctcatcaatctaacccgcctaaacgtctcttataatcacatagatgacctgagcggccttatcccactacacggcatcaaacataagctgagatatattgacctacattcaaaccgcatagactcaattcatcacttgctgcagtgtatggtcggacttcatttcttgactaacttaatcctggagaaggacggtgatgataaccctgtttgtagacttcccggctatcgcgccgttatacttcagacactccctcagttgcgcatcctggactgcaagaatatttttggcgaaccagtgaatttgacggaaatcaattcttctcagctccagtgtttagaagggttgctggataaccttgtgagttctgacagcccactgaatattagtgaggatgaaattattgatcgcatgcccgtgatcacagcgcccatagatgagctggttcctttggaacaatttgcctcgacccctagcgacgcagtactgacaagctttatgtctgtctgtcagtctagcgaacccgagaaaaataatcatgaaaacgacttgcagaatgagataaaactgcagaaattagacgaccagatacttcaactgttaaacgaaacaagcaactccattgacaacgtgctggagaaggacccacgtcccaaacgggatacagatatcacaagcgagagtgattacggcaaccgcaaagagtgcaaccgtaaggtgccccgcagaagtaaaataccgtatgatgcaaaaacaattcaaaccattaagcatcacaacaaaaactacaatagttttgtgtcatgtaacaggaaaatgaagcctccttacctgaaggaactctacgtgtcatcttccttggctaattgcccgatgctccaggaatcagaaaagccaaaaaccgaaatcataaaagtggaccagtctcactcagaagacaacacataccagtccctggtcgagcaactggatcaggaacgagagaagcgatggcgtgctgaacaggctgaaaataaactcatggattatatcgatgagctgcataaacatgctaacgagaaagaagatattcacagtctggctctgctgaccacagaccgtcttaaagagattatcttcagagagagaaatagcaaaggacaacttgaagttatggttcacaaattgcaaaatgaaattaagaaactcaccgttgagcttatgaaggccaaggaccagcaggaagatcaccttaagcacctacgaacgctagaaaagacacttgaaaaaatggaacggcagaaacggcagcagcaggcagcccagatcaggctcatccaggaggtcgagctgaaagcgtccgccgccgatcgggaaatctacctacttagaacctccctccaccgcgaaagagaacaggcacagcagctccatcaattactcgccttgaaagagcaggagcataggaaggagttggaaacccgcgaattctttacggacgctgactttcaggatgccctcgccaaagagatcgcgaaagaggaaaagaaacatgagcagatgatcaaagagtatcaagagaagatcgacgttctgtcacagcagtatatggacctcgaaaatgaatttagaatagctctgacagtcgaggcccggagattccaggacgtcaaagatggattcgagaatgtggctacagagctggccaaaagcaagcatgccctgatttgggcacaaaggaaggaaaacgaatcctctagcctcatcaaagatctgacttgcatggtaaaggagcagaaaacgaagcttgccgaggtgagtaaacttaaacaggagacagctgccaatctgcagaaccagataaatacactggaaatcctgatagaagatgataagcagaaatccatccagattgaacttttaaagcacgagaaggtgcagttaatatccgagctggcagctaaagaatccttaatttttggcttgcgcactgaacgcaaggtgtggggtcatgagcttgctcagcaggggtcttccctggctcaaaaccgagggaaactggaggcccaaatagaaagcttgagtcgagagaatgagtgcctgcggaagacgaatgaaagcgactctgacgcattgcggatcaaatgtaagattatcgacgatcagactgagaccatcagaaaattgaaggattgtcttcaggagaaggacgagcatatcaagcgtctccaggaaaagattactgaaattgagaagtgcacacaggagcagctggacgagaaatcttcccagctcgatgaggtgctagagaagctcgaacggcataacgagcggaaagaaaagctgaagcagcaactgaaggggaaggaagttgaactggaggaaattagaaaagcctactccactctgaacaggaaatggcacgataagggagaattactgtgccatctagaaacacaggtcaaagaggtgaaagaaaaattcgaaaacaaggagaagaaactgaaagccgagcgcgataagtccatagagcttcaaaaaaatgctatggaaaaactccactccatggacgatgcattcaaacggcaggtggacgcgatcgttgaggcccatcaggccgaaatcgcccagcttgctaatgaaaagcagaagtgtattgactcagccaacttgaaagtacaccagatagaaaaagagatgcgagagctcttagaggagacatgcaaaaacaagaaaacaatggaggcaaagatcaagcagctggcattcgctctgaatgagattcagcaggacatgtag

SEQ ID NO: 24070 - DNA, 219 bp, Artificial Sequence
  Description of Artificial Sequence: Synthetic coding sequence
atgagctaccagcagcagcagtgcaagcagccctgccagcccccccccgtgtgccctactccaaaatgtcctgagccatgcccacctcccaagtgccccgaaccatgtccctctcccaagtgtccacagccctgtcctcctcagcagtgccagcagaagtatccccccgtcacccctagtcctccttgccaacctaagtgccctcccaaatcaaaatag

SEQ ID NO: 24071 - DNA, 888 bp, Artificial Sequence
  Description of Artificial Sequence: Synthetic coding sequence
atggagctgatccaggacaccagccggccccccctggagtacgtgaagggagtgcccctgataaaatactttgctgaggccctcggtccactccagtccttccaagctaggccagatgacctgttaattaatacttatcccaagtctggcactacctgggttagccaaatcctcgatatgatataccaggggggtgatcttgaaaagtgcaacagagcgccaatttacgtcagagtcccttttctcgaagttaatgatcccggagaaccaagcggactggaaacattgaaggacaccccacctcctcgtctgatcaagtctcacctgcccctggctctcttaccccaaactctgctggaccaaaaggtgaaggtagtctacgtcgcgaggaaccccaaagacgtcgcggtgtcctattatcactttcataggatggagaaggcacacccagagcctggaacatgggactcgtttttggaaaaattcatggcaggcgaggtgtcctacggaagctggtatcagcacgttcaggagtggtgggaactgtctaggacacatccagtcttgtacctgttttacgaagatatgaaagaaaaccccaaaagggagatccagaagatcttagagttcgtgggacgttcgcttccagaagagactatggatttcatggtgcaacatacctcatttaaggaaatgaagaagaatccgatgacgaattatactacggttccccaggagctgatggatcacagtattagcccgtttatgagaaagggcatggcgggtgattggaagacaaccttcactgtcgcacagaacgagcggtttgacgccgattacgcggaaaagatggctggttgcagcctgtccttccgtagcgagttgtag

SEQ ID NO: 24072 - DNA, 1491 bp, Artificial Sequence
  Description of Artificial Sequence: Synthetic coding sequence
atgaagctgggcaagaagcccatgtacaagcccgtggacccctactcccgcatgcaatctacatataattataatatgagaggcggagcctaccccccccgatatttctacccattccctgtgccgccgcttctgtaccaagtcgagctctccgtggggggacagcagttcaatggcaaagggaagaccagacaggccgccaaacacgatgccgcagccaaagcattacggatcttgcaaaatgagccgcttccggagaggctcgaggtgaacggaagagagtcagaagaggagaacctcaataaatccgagattagccaggtgttcgagatcgctctcaaaagaaatcttccagtcaattttgaagtggccagggaatccggtccacctcacatgaaaaactttgtgacgaaagtttcggtgggagaatttgtgggtgagggcgaggggaaaagcaaaaagatctccaaaaagaatgcagcaatcgccgtgctggaggaactgaagaagctgccacctctcccggctgtggaacgggtgaaaccccgcatcaagaagaaaacgaaacccattgtgaagccacagacttctccagagtacgggcagggcattaatcctatctccaggctcgcacagattcagcaggcgaaaaaggagaaggaacctgagtacacattgttgacggaacgaggcctgcccaggagacgtgaattcgtgatgcaagtgaaggtgggaaatcatactgcagaaggaactggaacgaacaaaaaagtcgccaagcgaaacgccgcagagaacatgttagaaattttgggtttcaaagtgcctcaagcccagcccacaaaacctgccctgaaatcagaagaaaaaacacctattaagaaacccggggacggcagaaaagtgacctttttcgagccgggctcaggcgacgaaaatggcacgtctaataaagaggacgagttccgcatgccatacctatcccaccagcagctgccggctggcatactacccatggtcccggaggtggcccaggctgttggggtgtctcagggtcatcatactaaggatttcaccagggccgcgcctaatcccgctaaagccaccgttacagccatgatcgcaagagaactgttgtacggaggcacgagcccaacagccgaaaccatactcaagaataacatctcttcaggccacgttccccatggccccttaactcggccttccgaacagcttgattacttgtctagggtccaaggcttccaggtggagtataaggatttccccaaaaataacaagaacgagtttgtgagcctgatcaactgtagctcccagcctcccttgatttcccatggtatcgggaaggacgtggaaagctgtcacgacatggctgcgcttaacatccttaagctgctcagcgagcttgatcagcagtcgacagagatgcccaggaccgggaacggcccaatgtccgtgtgcggccgttgctag

SEQ ID NO: 24073 - DNA, 1575 bp, Artificial Sequence
  Description of Artificial Sequence: Synthetic coding sequence
atgagcagctgcgtgagcagccagcccagcagcaaccgggccgcccctcaagatgaattgggcggcaggggctcatcatccatccatctgggaatggagagctttattgttgtaacggaatgtgagcccggctgtgcagtggacctcgggcttgccagagataggcccttggaggccgatggacaggaagtccccctcgacacctcaggtagtcaggcaaggcctcacctgtcaggacgcaaactgtctctacaggaaagaagtcagggaggtttggctgcgggcggaagtctagatatgaacgggaggtgtatctgcccgagcctcccatatagcccagtttcctcaccccagagttccccgcggctgccccggcgtcctacagttgagtcgcaccacgtgtcaattaccggtatgcaggactgcgtccagctaaaccaatataccctgaaggacgagataggcaagggttcttacggagtggtcaaattggcctacaatgaaaatgacaatacatattacgccatgaaagtcctttccaaaaagaagcttattcgacaggctgggttcccgcggaggcccccaccccggggcactcgacctgcgccaggggggtgcatccagccacgtggtcctatcgaacaggtctaccaggagattgccatcctgaagaagctggatcatcctaacgtggtgaagctggtggaggtgttggatgaccccaatgaagaccacttatatatggtattcgagctggtcaatcagggacccgttatggaggtgcccacactcaagccgctgtcagaggatcaagcccgattttattttcaagaccttatcaagggcatagagtatcttcactaccagaagataatccatcgcgacattaagccaagcaatttgcttgtcggggaggacgggcacattaaaatcgctgatttcggagtgagcaacgaattcaagggcagcgatgcactgctcagcaatactgtggggacccccgcttttatggccccagaaagcctatctgaaactagaaaaatattctctgggaaggccctggatgtgtgggctatgggcgttactctgtactgcttcgtgttcggccaatgccctttcatggatgagcgaataatgtgtctgcacagcaagatcaagagtcaggccttggagtttcctgaccagcctgacatcgctgaagatctgaaagaccttatcacccgcatgctggataagaaccccgaatctcggatcgttgtccctgaaattaaactccatccatgggtgacccgccacggcgccgaaccattaccttccgaagacgagaactgtacgttggtggaagtaactgaggaggaggtggagaattctgtcaaacatattccgtctttggccaccgtgatcctggtgaagacaatgattaggaaacgctcatttggcaatcctttcgagggcagccgcagggaggaacggagtctgtctgcgcctggcaatctgctcaccaagcagggatcagaggataatctgcaaggcaccgatcccccacccgtgggcgaggaggaggttctgttgtag

SEQ ID NO: 24074 - DNA, 1902 bp, Artificial Sequence
  Description of Artificial Sequence: Synthetic coding sequence
atgaaggccatcaagaagagcctgaccgaggaggagtacctgtacctggatttctctcaccaaaccgaaggctgtatcttccccctgcacacgtcggttaccttatttctacttagttactgtgattgcaagattttcaaaatttgtctcgtggtcacaaaggaagtgtcaagagatagctcgctgctgagggacgatctcattcaggatgtggagatccagatcatctcacggcaagagctgccacccatcgtgcagaattgctgcctaccagcagtggtggaacgcagcgataatttttgtcgggccggtttagctgtggttctgcggcatatcatccagaagtcatatgaggcggatcctctgaagaaagagctgctggagctactggggtttaaaaaaacttgtctcaaggcctgtgccgaggtgtcacagtggacccggctgtgcgaactgaccatacctcttgccatcgagaatttccttcgtgagtcttccgaccaaccaccaaccatccccgttgaaatcttacaacttgaaaagaagttgtccgaacctgtccgggtccacaatgatgataagctgcgcagacaaaagctgaagcaacagaaggctgacggcgtgggcccacctctcaccaagggcaaagcaaagagcaaggtgcacacccaggaaacgagtgaagggctggattcaagcagcaagtcactagaactaaaggttgccttcagcaagctgacagtacaggaggaacccgccactaccaaccgggaaccgagtcacattcgcaaggctaaagcctccgacttgccacccctagaacacgtgtttgccgaggggctgtatttcacgttggctgacattgtcttgttgccttgcatccaccatttcctagtgataattagtcggaaattttctgagaagctcgtcgagttccccctacttgcgagttggtatcagaggattcaggaagttcccggagttaagacagcagcctctaagtgtgggattcaattcctccacctcccaaagctgctaactacaagtaccgaacagcaccctaacctgtgtgaggttccaggtgttgaggaacagtctgatccactgtttatcggggggccccgacccactatggcgaaactcatggagaaggggatcgaagtgatgttcagcccccacccgtgccctacctggaccctggactggaatgtgttgccagccgcagtgagtccaaaagaggggaaaatgtcctccgatagagctctgcgcaaacaacaacagcttaacaatttggtctacgtggtgacaaatcaggccaaacctggggacagaattgtcgacttctgctcaggtggcggccacgtggggatcgtcttggctcacatgctgccctcttgtcaggtgacgctcattgagaacaaggaattaagtctgatacgagcgaagaaacgaagcgacgagctggggctgagtaacatttggtttatacaggccaacatggagtacttcacgggaatgttcaacatcggagtcgccctgcacgcatgcggagtcgccaccgatatggtgatcgagcactgtataaagacgcgagcaagctttgttacttgcccctgttgttacggtttcatccagaacacaagcaaatttaattttcctaaatccgagcagtttaaaaagaccctctcttataaggagcatatgattctctgccggttcgccgatcagaccgctgtgcagctgccgcctcagaggcgtctgattggtaaacagtgcatgtgtttggtggacttggatagggctagagccgccgaagagtgtggatatagcgtgcaggtaatttccatggagcccgaatcatgttctcctaagaataatatgatagtcggagtccccatctag

SEQ ID NO: 24075 - DNA, 519 bp, Artificial Sequence
  Description of Artificial Sequence: Synthetic coding sequence
atgagcagcggcaactaccagcagagcgaggccctgagcaagcccaccttcagcgaagagcaggcctccgccctggttgaatctgtcttcggccttaaagtctcaaaggtaaggcccctgccctcctatgatgaccagaattttcatgtatacgtgtccaaaacgaaagacggtcccactgagtacgttctaaaaatcagtaacactaaggcgagtaaaaatccagatttgatagaagtgcagaaccatataatcatgttcctgaaggccgcagggttccccaccgcttccgtgtgtcacactaagggggataatactgccagtctggttagcgtagactcaggcagtgagatcaaaagctacttggtgcgccttttgacatacctgcccggacggcctattgctgagcttcccgtctctccacagcttttgtacgaaatcggtaagctcgctgccaagttggacaaaaccctgcaagagggtaagcctcgtgtgacccctttgctggcaaaaaactag

SEQ ID NO: 24076 - DNA, 2937 bp, Artificial Sequence
  Description of Artificial Sequence: Synthetic coding sequence
atgggctggaagcccagcgaggcccggggccagagccagagcttccaagcctcaggtctgcaaccacgatccctgaaggctgctagacgggctaccggcaggcccgaccgaagcagggccgctcgcccaactatggacccctccgcccatcggagccgggctgctccgccaaacatggatccagatccgcaagcgggggtccaggtcggtatgagggtcgtgaggggtgtagactggaaatggggacagcaggatgggggagagggcggcgtgggcaccgtggtcgaactggggagacacgggtccccttcgacacccgatagaaccgtggtggtgcagtgggaccagggtacaagaaccaactacagggcaggctatcaaggcgcacatgacctgttactgtatgacaatgcgcagattggagtgagacacccgaatatcatatgtgattgctgcaagaaacacggactgaggggaatgaggtggaaatgtcgagtctgcctggattacgatctttgtacacaatgctatatgcataacaagcacgagttggcgcacgcattcgaccggtatgaaacggcccacagccgcccagtgactctgagcccacgccagggtctgcccaggattcctttaagagggatttttcaaggagctaaggtcgtgcgcgggccagattgggagtggggctcccaggacggaggagaaggcaaaccagggcgcgttgttgacattagaggatgggacgtggaaacgggccggtccgttgcatccgtcacttgggctgatggaacaacgaacgtctatagggtgggccacaaagggaaggtggatttgaagtgtgtgggcgaggcggctggaggtttttattataaggaccatctcccacggctaggtaagccagccgagcttcagagaagggtgtctgccgattcacaaccatttcagcacggggataaagtgaagtgcctgctcgatactgacgtcctccgcgagatgcaggaagggcatggcgggtggaaccctcggatggcggaatttataggccagactggaactgttcatagaatcaccgacaggggggatgtgcgcgtccagttcaaccatgagacccgctggactttccacccgggtgctctgactaaagccctcggccgcgtaggcaaagttgtgaaagtgttcggtgatggaaacctgcgggtggctgtggcaggccagcgctggactttcagtccctcttgcctggtagcctaccgccctgaagaagatgccaaccttgatgtagctgaacgggcccgagagaataaatcctctttgagtgtagctctggataaactaagggctcagaagagtgatcccgagcatccaggacgcctggtggtcgaggttgcccttggaaatgctgcaagagctttagacctgcttaggaggcggcctgagcaagttgacacaaaaaatcaggggcggaccgcactccaggtggcagcttacttggggcaagtggagctcattcgcctgctgcttcaggcacgagctggggtggacctccccgatgacgaagggaacactgcactccattatgcagctctgggaaaccaacccgaggcaactcgcgtacttctatcagccggctgccgcgccgacgccattaacagcactcagagcaccgcactccacgtcgcagtccagcgagggttcctggaggtggtgcgggctctgtgcgagcggggatgcgacgtgaacctccctgacgctcactccgatacacctctgcacagtgctatttcggcgggcaccggcgcctctgggatcgttgaagttctgaccgaagtccccaatatcgacgttactgctaccaattcccaaggcttcacactgctgcatcacgcttcccttaaaggtcatgctctcgccgtcaggaagattctggcccgggctcggcaattggtcgacgcaaaaaaggaggacgggttcaccgcgctgcacctggccgccctgaacaaccatagagaggtggctcagattctcatcagagagggcagatgcgatgttaacgtgcgaaaccgtaagttacagtctccactacatctggccgtgcaacaagcccacgtcggactcgtgcctctactggtcgatgctggctgcagcgttaacgctgaagacgaggagggggataccgccctccacgtggccttgcagcggcaccagctcctgcctctagtggctgatggcgccgggggagaccctggacccctgcagctactgtctagacttcaggccagcgggctgcctgggagcgcagaactgaccgtgggcgctgctgttgcctgtttcctggctctcgagggcgccgacgtgtcatacacgaaccacaggggtaggagcccactggacctcgccgcagaaggccgggttctgaaggccctccagggatgtgcccagcgctttcgggagagacaagccggtgggggagcagccccagggccccggcaaactctgggcacccccaatactgtgacaaacttgcacgtgggcgctgcacctggaccagaggcagccgagtgcctggtgtgttctgagctggccctcctcgttctgtttagcccttgtcagcatagaactgtgtgcgaagagtgcgcgcgacgaatgaagaagtgtatccgatgccaggtggttgtgtccaagaaactccggccagatggaagcgaagttgctagcgcagccccagcccctggcccccccaggcagctcgtggaggagctgcagtcaaggtaccgccagatggaggaaaggattacctgcccaatctgcattgattcccatatcagacttgtgtttcagtgtggccacggcgcttgcgccccatgtggaagtgctcttagtgcatgcccaatatgcaggcaaccaatacgcgacaggatccagatcttcgtgtag

SEQ ID NO: 24077 - DNA, 1074 bp, Artificial Sequence
  Description of Artificial Sequence: Synthetic coding sequence
atgggcggcgccgtgagcgccggcgaggacaacgacgacctgatcgacaatctcaaagaggctcaatacatccgaaccgaacgagtggaacaggcattccgagccatcgaccgcggtgattactatcttgagggatatagagataacgcctataaagatctcgcttggaaacacggcaacatccacctttcagccccgtgcatctatagtgaagttatggaagcactgaagttgcagcccggcctgtcctttttgaacttaggcagcgggactggctatttgtcaacaatggtcggcctgatcctgggtcccttcgggataaatcacggcattgagctccatagcgatgtggttgagtacgctaaagaaaaactcgagagctttatcaagaacagtgatagtttcgacaaatttgaattctgtgaaccagcattcgtggtgggcaactgtctgcaaatcgcctcggactctcatcagtacgacaggatttattgcggtgcaggggtccaaaaagatcatgagaattacatgaagatccttctgaaggtgggggggattctggtgatgcctatcgaagatcagctcacgcagataatgcgcacaggacagaatacttgggaaagcaaaaacatcctggccgtcagctttgcgccactcgtccaaccctctaagaacgacaacggcaagcccgattcggtcgggctgcccccctgcgccgtcagaaaccttcaggatcttgcaaggatctatatccggaggaccctccgcaacttcataaacgatgagatgcaggccaaggggattccccagcgggcgccccccaagaggaagcggaagagagtgaaacagcggattaatacctatgtgtttgtgggcaatcagctgatacctcagccactcgattccgaagaggatgagaagatggaggaggataataaggaggaagaggagaaggaccacaacgaagctatgaagccagaagagccgccccagaatctgttgcgggaaaaaattatgaagctgcccctgccagagtctttgaaagcctatttaacgtattttcgggataagtag

SEQ ID NO: 24078 - DNA, 633 bp, Artificial Sequence
  Description of Artificial Sequence: Synthetic coding sequence
atgagctgccccaactactgcagcggcaacagcaacagcggcagcttgcgaacgagtagacacattcccctgacgtctatcgatttgtgtcctactagtgtgagctgcggcgatgtcctgtacttgcctacgagtagtcaggaccacacttgggtcacagacaattgtcaagagacatgtggggagccaacttcttgccagcccgttcattgtgagaccggtaatctcgagacatcgtgtggcagtagtacagcttactacgttcctcggccctgtcaggggagttcctttctgcccgcatcctttttctcgtcaagttgtctgccagtgtcgtgcagaccccagcggtatgtaagcagcgggtgcagacctcttcgccctcttttaaactcgtatcagcctatcggagactgtgtgcccaatgcttatcgcccccagttttgtctaagtaagtcctgccagccccagaatctcctcacctctgggtgtcagccctcttcttgcttggcttaccggcctcagtccctgcacgtagtaagtagctcactgcggcctctggggcctctgttttccgggtgccaacctttaacacatgtttttagcacttgccgtccttcttgctcagggctgtag

SEQ ID NO: 24079 - DNA, 606 bp, Artificial Sequence
  Description of Artificial Sequence: Synthetic coding sequence
atggccagcggcgacgacagccccatcttcgaggacgacgagagccccccttactcccttgaaaagatgactgacttggtagctgtgtgggatgtagccctgagcgacggagtacataaaatcgagtttgagcacggtaccaccagcggtaagagggtcgtgtatgtcgatggaaaagaggagattagaaaggagtggatgttcaaactggttggaaaagaaacgttttatgtgggcgccgcaaaaaccaaagcaacgattaacattgacgccataagcggttttgcctacgaatacaccctggagataaacggtaaatccttaaaaaagtacatggaagatagatcaaagacgactaatacttgggttctgcatatggatggtgaaaactttaggattgtattggaaaaagatgccatggacgtgtggtgcaatggaaagaaactcgagacagctggcgagttcgtggatgatggcacagagacccactttagcattggcaaccatgactgttacattaaggcagtctcttccggcaagagaaaggaggggatcatacacaccctaatcgttgataacagggagatccctgagatcgcaagctag

SEQ ID NO: 24080 - DNA, 3390 bp, Artificial Sequence
  Description of Artificial Sequence: Synthetic coding sequence
atgcccgccacccggaagcccatgcggtacggccacaccgagggccacactgaagtctgctttgatgatagcgggagttttatcgtaacttgtggtagcgacggagatgtgcgtatctgggaagacctggacgatgacgacccaaaattcatcaatgtgggcgagaaagcttatagctgtgctcttaagtcaggtaaactcgtcacagctgtatcgaataatacaattcaggtgcacacatttcctgagggagtcccagacgggattcttacgaggttcaccacgaatgcgaatcacgtagtgttcaacggagacggtaccaagattgcggccggctcctccgattttctggtgaagatcgtcgacgttatggattcgagccagcagaaaaccttccgagggcatgatgcacccgtgttgtcactgtccttcgacccaaaggatatatttctcgcgagcgcctcttgtgatgggagcgtgagggtttggcagatttcagatcaaacctgcgctattagctggcctctattgcagaaatgtaacgacgtgattaacgctaaatcaatttgccgcctggcttggcagccaaagtctggaaagctgctggcaattcctgtggagaagtcagtaaaactgtacaggcgcgagagctggtcccaccagtttgatctatccgataactttattagtcagacgctaaatatcgtaacatggagtccatgcggccagtatctcgctgctggctccattaatggtctcattatcgtgtggaatgtggagaccaaagattgcatggaacgcgtgaaacacgaaaaaggttatgccatatgcgggctggcttggcaccctacatgcggccgtatttcctacacagacgctgagggaaacctggggctgctggaaaacgtgtgcgacccatctggcaaaaccagctcatctaaagtgagttccagggtagaaaaagattataacgacctgttcgacggagatgatatgtcaaacgcaggcgacttcctcaacgacaacgctgtggagatccccagctttagcaaaggtataattaacgatgatgaggacgatgaagacctcatgatggctagcggaaggcctcggcagagaagtcatattctggaggatgacgagaactccgtcgacattagtatgctcaaaacaggtagctcattactgaaagaggaggaggaggatggccaggaggggtctatacacaacctgcctcttgtgacctcgcagcgcccattttacgacggcccaatgcccaccccgcgacaaaaaccattccagtcaggttcaacacccctccatctaactcacaggttcatggtgtggaactctatcggaatcattagatgttataacgacgaacaagacaacgctatagatgtcgaatttcatgatactagcattcaccacgctactcacctttctaacaccctaaattatactatcgctgatctctcacacgaagcaattctgctggcttgtgagtccacggatgaattagcatctaaactgcattgccttcacttctcaagctgggactcatctaaggagtggattattgacctcccccagaatgaagacatagaggccatatgcttaggccaggggtgggccgccgctgctacgtccgcactactgctgcgtttgttcactatcggcggcgtccagaaggaggtcttcagtctggccggcccggtcgtgtctatggcagggcacggagaacaactcttcatagtatatcaccgtggaacagggttcgatggcgatcagtgcttgggggtccaactgctcgaactgggaaaaaaaaaaaaacaaatcctgcacggagatccactaccactgacccggaaaagttacctcgcttggatcgggttcagcgccgaaggtaccccctgctacgtggactctgagggcattgtgcggatgcttaatcggggattagggaatacttggacaccaatttgtaacaccagagaacactgtaaaggcaagtccgaccactattgggtggtgggcattcacgaaaatcctcagcaattgcggtgtattccatgtaaggggagcaggttcccacctactctcccaaggccggctgtggccatcctgagcttcaaacttccttattgccagatcgctactgaaaaaggccagatggaggagcaattctggcggtccgtgatctttcacaatcacctcgattatcttgctaagaatggttacgaatacgaggaatcaactaaaaaccaggcaacgaaagagcagcaggagctcctgatgaaaatgctagctctgagttgcaaactcgaacgggagtttaggtgcgttgaactggccgatctgatgacccagaatgctgttaatttagcgataaagtacgcttcccgttcccgaaagttgatcctggctcagaagctcagcgagctcgcagtggagaaggcagccgaattgacagctacccaggtggaggaggaggaggaagaagaggactttcgtaaaaaactaaatgcaggatattccaataccgctacggagtggtcccagcccaggttccgaaatcaagttgaagaggatgccgaagacagtggagaggcagacgatgaggagaagcccgagattcacaaacctggtcagaactccttcagtaagtctacaaatagctctgacgtttccgctaagtccggagccgttactttcagctctcaggggagagttaatccctttaaagttagcgcatcatccaaagaacctgccatgtctatgaactccgcaagatctacaaatattttggacaacatggggaaatcctctaaaaaatctactgccctctctagaactaccaacaacgaaaagtcccccataattaaacccttgataccgaagccgaaaccaaaacaggccagtgctgccagttacttccagaagaggaattcacagacaaataagacagaagaggttaaggaagagaacctgaagaatgtgctcagtgagactccagcgatctgccctcctcagaacacagagaaccagcgccctaagacaggtttccaaatgtggctcgaagagaatcggtccaatatcttgagcgataatccagatttctcagatgaggccgatatcataaaagaggggatgattcgcttccgcgtactgagtaccgaggaaaggaaggtgtgggcaaacaaggccaagggagaaactgcttcagaggggacagaagccaaaaagagaaagagggtggtagacgagtcggatgaaacagagaatcaggaagagaaagcgaaagagaacctgaatctgagtaaaaaacagaaacccttagactttagcacaaaccaaaaactgtccgcttttgctttcaaacaggagtag

SEQ ID NO: 24081 - DNA, 1476 bp, Artificial Sequence
  Description of Artificial Sequence: Synthetic coding sequence
agcggcagcagccacagcttccccggcagcctggaggtgaccgccctcatgactacttggtcctcactgcagggatctcatgtctctaaacgtgctcttgcctatgcgctggtcgttacaaactgccaggaacggattcagcattggaaaaaggtggataacgattacaacgcgctgagggaaagactcagtaccttacctgacaagctcagttacaatatcatggtgccattcggcccgttcgccttcatgccagggaaactcgtgcataccaatgaagtgaccgtgctccttggtgataactggtttgcgaaatgctctgcaaaacaggctgtgggcttggtcgagcatcggaaggagcacgtgagaaaaacgatcgatgatctcaagaaagtgatgaagaacttcgaatctcgcgtcgaattcactgaggacctacaaaagatgtccgatgccgctggcgatattgtggatataagggaggaaatcaagtgtgacttcgagtttaaggcaaagcaccgcattgcacataagccccactcaaagcctaaaacaagcgatatttttgaagccgacattgcaaatgatgtgaagtccaaggacctgctggctgacaaggagctgtgggcccgcctggaagaactggaacggcaggaggaactcctgggtgagctggattccaagccagacaccgtcatcgcaaacggcgaggacactacgtcgagcgaagaggaaaaggaagacagaaacacaaatgttaatgccatgcatcaagtaaccgactcacataccccatgtcataaggacgtcgcatcatctgaacctttttccggccaggttaactcacagttgaattgtagcgtgaatgggtcctcctcttatcattctgatgatgatgatgatgacgacgatgatgacgatgatgacaacatcgatgacgacgacggggacaacgaccatgaggctcttggtgtaggagacaacagcatccctactatctacttctctcacaccgtagagcccaagcgggtccggattaatacaggcaaaaataccactctcaaattttctgaaaaaaaggaggaagcaaagagaaaacgcaagaacagtactggaagtggacactccgctcaggagctacccaccatcaggacacctgcagatatttatagggcctttgtcgatgttgtcaacggggaatatgtgcctcggaaatccatcctcaagtcccgctcaagggagaacagcgtctgctccgacacatcagagtccagcgccgcagagttcgatgatcgaaggggagtgcttcgcagtatttcctgtgaggaagcaacatgttccgacacttctgagagtatactggaagaagagccccaagaaaatcaaaagaaacttctgcctttaagtgttactcctgaagttctacgcctggtggggtactccagaaatctggcacccttgaatgtgattctttag

SEQ ID NO: 24082 - DNA, 981 bp, Artificial Sequence
  Description of Artificial Sequence: Synthetic coding sequence
atgctgctgagcaagttcggcagcctggcccacctgtgcggccccggtggcgtggaccacctgcctgtaaagatcctgcagccggccaaagcagacaaggaaagcttcgagaaagcctaccaggtaggtgctgtattaggcagtggcggctttggcacagtgtacgcggggtcacgcatcgctgatggccttcccgtggccgttaaacatgtagttaaggagcgtgtgaccgaatggggatccctcggaggcgctactgtgcctctcgaggtcgttctccttagaaaagtaggggcagctggcggggctaggggtgtgataagacttctggactggttcgagcggcctgacggctttctcctggtcttggagagaccggagcctgctcaggacctgttcgattttatcacagaacggggtgctctggatgagcctctggcccgcagattctttgctcaggtcctagccgccgttcgtcattgccacagctgcggggttgtccaccgagatataaaagacgagaacctactggtcgatctgaggtccggcgaacttaagctaatcgactttggtagcggcgccctcctgaaagacacagtgtataccgacttcgacggcacacgggtttactcccctcccgagtggatcaggtaccatagataccatggcagaagtgccacagtgtggtcattaggggtgttgctatatgacatggtgtgtggcgatatccctttcgaacaggacgaagaaatcctgagggggaggttgttattccgaagaagagtatctccagagtgccaacagttgattcggtggtgtctctccctccggccgtctgaaagacccagcttggatcaaatcgctgcccacccttggatgctgggcgcggatggtggtgtgcctgagagttgcgacctcagactttgtaccctggatccagatgatgtggctagcacgacatcctcgtctgagtcactgtag

SEQ ID NO: 24083 - DNA, 2880 bp, Artificial Sequence
  Description of Artificial Sequence: Synthetic coding sequence
atggccgccagcaccggctacgtgcggctgtggggcgccgcccggtgctgggtgctgcggagacctatgctggccgccgccgggggacgtgtgccaaccgcggccggcgcctggctcttgcggggccagcggacctgcgatgccagtccaccttgggccctttggggcagggggcctgctatcggcggccagtggaggggattttgggaggccagttcacgcggagggggggccttctcgggaggcgaagatgcatctgagggcggcgctgaagaaggggcgggtggagctgggggttcagccggggcaggcgaaggccccgtcatcacagccctaactccaatgacaattccagacgttttcccccatctcccacttatcgctattactcgaaatccagtcttcccccggttcattaagatcatcgaggtaaaaaataagaagctggttgaacttctaagacgcaaggtgaggctcgcccagccatatgtgggagttttcctgaagcgtgacgactccaatgaaagcgatgtggtcgagagtctggacgaaatataccacaccgggacctttgcacagatccatgagatgcaggatcttggcgacaaactgcgcatgatcgtgatgggccaccgacgggtgcatatatccaggcaactcgaagtggaaccagaggagccggaggcagagaacaagcacaaaccacgtaggaagagtaagcgcggtaagaaagaggccgaggacgagctgtccgcacgacacccagcagagctcgccatggagcctacaccagagttgccagcggaagttctcatggtggaagtcgagaatgtggtccatgaagactttcaggtgacggaggaggtcaaagcccttactgccgagattgtcaagacaatcagggatatcatcgcactgaatccactttatagagaatctgtgttgcagatgatgcaggctggccagcgggtggtggacaaccctatatacctaagcgatatgggagcagctttaaccggagctgaatctcacgagctgcaggatgtgctcgaagaaacaaatatcccgaaaaggctgtacaaggcactcagcttgttgaagaaagagtttgaactttctaagctgcagcaaagactggggcgagaagtggaggagaagattaagcagacacatcggaaatacctacttcaggagcaactgaagatcattaagaaggaacttggactggaaaaggacgataaggatgccatcgaggaaaagttccgggagcgcttgaaggaactcgttgtccccaagcatgtgatggatgtcgtagacgaagagctatccaagctaggtctgctagacaatcactccagtgaatttaatgttactcggaattatctggattggctgacctcaatcccatgggggaaatacagtaacgagaatctggacctcgccagggcgcaggcggtattggaggaggatcactatgggatggaggacgtgaagaagcgcatcctcgaattcatcgcagtgtctcagcttcggggatcgacccagggtaaaattctgtgcttttatggaccccctggcgttggcaagaccagcatcgcgcgcagtatcgctagagcgctgaatcgagagtactttcgattcagtgtcggtggcatgactgacgtcgctgaaatcaagggccaccggagaacttacgtgggagccatgccaggtaaaattatccagtgtctaaaaaaaacaaaaaccgagaacccactgatcctcattgacgaagtggataagatcggaaggggttatcaaggagatccttcaagcgcccttctcgaacttctggatcccgagcagaacgccaacttcctggatcattacttggacgtgcccgtggatctgtcgaaagtgcttttcatatgtaccgcgaatgtgacagataccattccagaacctctgcgtgatcggatggagatgattaacgtgagtggatatgtggcccaggaaaagctggccatcgctgagagatatttggtgcctcaggcaagagcgctctgcggcctggacgagtcaaaggccaaactctcttccgacgtgcttacgctcctgattaagcagtactgtcgggagtctggagtgaggaatctccagaagcaggtggagaaggtactcaggaaatctgcctacaagatcgtctcaggcgaagcagagtccgttgaggtgaccccagaaaatctgcaggatttcgttggcaagcccgtctttactgtggagaggatgtatgatgtgaccccgcccggtgtggtcatggggctcgcctggacagctatggggggaagcactttgttcgtggaaacctcattgcgtagaccccaggataaggatgctaaaggcgacaaagatggatccctggaggttacaggacagctgggtgaagtcatgaaggaatccgcccgaatagcatatacattcgcacgtgcattccttatgcagcacgcgccagcaaacgactacctcgttactagtcacattcacctgcacgttcccgagggtgccactcccaaagatggaccaagtgctgggtgcacaattgttacggcgctgctgtctcttgccatgggcaggcccgtacggcagaaccttgcgatgacaggagaagtttcactgaccggcaaaattcttcctgtaggcggcattaaggaaaaaaccattgcagctaaacgggcaggcgtgacttgtatcgttctcccagctgagaataagaaagacttttacgacctcgctgcgtttatcactgagggattggaggtgcacttcgtcgaacactacagagagattttcgacatagcgttccccgacgagcaggctgaggctctagcagtggaaagatag

SEQ ID NO: 24084 - DNA, 1203 bp, Artificial Sequence
  Description of Artificial Sequence: Synthetic coding sequence
atgaaccccgccagcgcccccccccccctgcccccccccggccagcaggttattcacgtgacgcaggacctggatacagatctggaagcgcttttcaatagcgttatgaatcccaagccgtcctcttggaggaagaaaatcctgcccgagtcatttttcaaagagccagatagtggatcacatagcaggcaatcctctactgatagtagcgggggacatccaggccctaggctcgctggtggcgcccaacatgttcgctcgcacagttcgcctgcctctttgcagcttggtactggcgcaggcgcagccggctctcccgcacagcagcacgcgcacctgcggcaacagagctacgacgtgacagacgagttgccactgccacctggatgggagatgacattcactgcaacgggacagaggtactttctgaaccacatcgagaaaatcacaacgtggcaggatccaaggaaagctatgaatcaaccgttgaaccatatgaacctgcatcctgcagtgtcgtctaccccagtgccgcagcgtagcatggctgtcagccagcccaacctcgtaatgaaccatcagcatcagcagcagatggctccaagtaccctgtctcagcagaatcaccccacacaaaatccaccagctgggctcatgtccatgcccaatgccctcaccacccagcagcagcagcaacagaagttacgtcttcagcgcattcaaatggaacgggaaaggattagaatgaggcaggaggagctgatgcgccaggaagctgcactgtgccggcaactgcctatggaggcggaaacattggcaccagtgcaagctgccgtgaatccacccactatgacaccggacatgcgcagcattacaaacaactccagcgacccttttcttaacgggggaccctatcattccagagaacaaagcacagactctggcctcgggctcggctgttacagcgtcccaactaccccagaagatttcctttccaacgtggatgaaatggataccggggagaacgcggggcaaactcctatgaacatcaacccacagcagactaggttccccgattttcttgactgccttccggggacaaacgttgacctggggaccttggaatcagaggacctgatacctctgtttaatgacgtggagagtgcccttaataagagcgagccttttctcacttggctttag

SEQ ID NO: 24085 - DNA, 2625 bp, Artificial Sequence
  Description of Artificial Sequence: Synthetic coding sequence
atggaggtgctgcgggagaaggtggaggaggaggaggaggccgagcgggaagaggctgcagagtgggcagagtgggcacggatggaaaagatgatgcggccggtcgaggtgcgcaaggaggagattaccttaaagcaggaaacgctcagagatctcgagaagaaactcagcgaaatccagatcaccgtgagcgccgagctgcccgcattcactaaagatactattgacatcagcaagctgccaataagttataagactaatacgcccaaggaggaacatttgctgcaagtagctgacaatttctctcggcagtattctcacttgtgccccgatagggtccctttatttttgcacccattaaatgaatgcgaggttcctaaattcgtgagcactactctcaggccaacactcatgccataccctgagctgtataactgggattcatgcgcgcagttcgtgtcagactttcttacaatggtccccctacccgaccctctgaaaccccctagtcacctttatagctcaaccactgtgcttaagtatcaaaaaggaaattgtttcgacttcagcactctgctgtgctcgatgctgatcggcagtggctacgacgcttactgcgtgaacggttacggctcccttgacctgtgtcacatggatctgacccgggaagtttgcccccttaccgtgaagccaaaagagaccatcaagaaggaggagaaggttctgcccaaaaaatacacaattaagccgccaagggatctgtgtagccgatttgagcaggaacaagaggtgaaaaagcaacaggagattagagcccaggagaagaagcgcctacgtgaggaagaggagaggctcatggaagcagagaaagcgaaacccgatgcactgcatggtttgcgggtgcattcttgggttctggtgttgtccgggaaaagagaggtgcccgagaacttttttatcgatcccttcacaggccactcttattccactcaagatgagcatttcctgggtatcgagtcactctggaaccataaaaactactggattaacatgcaagactgctggaactgctgcaaggatctgatattcgatcttggcgaccccgtgcgctgggagtatatgctgttgggtaccgacaaaagccagcttagtctgaccgaggaggacgactccggaattaacgacgaggatgacgtcgaaaacctggggaaggaggacgaagacaagtcctttgacatgccgcatagctgggtagagcagatcgagattagccccgaggcattcgaaaccaggtgtcccaacggcaaaaaagtgatacagtataagagggcaaagctcgagaaatgggccccttatctaaactccaatgggctagtgtctcgcctcaccacctatgaggacctgcagtgcacaaatatcctggagattaaagagtggtatcagaaccgtgaggacatgcttgaactcaagcatattaataagacgaccgaccttaagaccgactatttcaaacccgggcatccccaggcattgagagttcattcttacaaaagtatgcagccagaaatggaccgcgtgattgaattttacgagactgcccgggtcgatggtctgatgaagcgggaggaaacccccagaacaatgaccgaatattatcagggacggcccgactttttatcttatcgccacgccagctttgggccaagagtaaagaaactgactctgagctcggctgagtctaatccaagacccatcgtcaaaatcaccgagagattcttccgtaatccggcaaagcctgcagaagaggacgtggccgaaagggtgttccttgttgccgaagaaaggattcaactgcggtaccactgtagggaggatcatataacagcatccaaaagagagttcctcagacggaccgaggtcgatagtaaggggaataaaatcatcatgactcccgatatgtgcattagcttcgaggtggagccaatggagcacacgaaaaagctgttgtaccagtacgaagccatgatgcacctgaagcgggaggagaagttgagtagacaccaggtttgggaatcagagttagaagtgttagaaatactgaaacttagggaggaggaggaagccgcacataccttaactatttcaatctacgacactaaacggaacgaaaaaagcaaagagtacagggaggcaatggaacgcatgatgcatgaggagcatctgaggcaggtggagacacaattggattacctcgctccttttctcgcccagctcccgcccggagaaaaactgacttgctggcaagccgtgaggctgaaagatgagtgtttatccgactttaaacagagactaattaacaaagcaaatttaatccaggcccgcttcgagaaggagacccaggagctccaaaagaagcagcagtggtatcaggagaaccaagtcaccctgacccctgaggatgaagatttgtacttatcctactgttcccaggccatgttcaggattagaatcctcgagcagcggttgaacagacataaggagttggcccccctgaaatatctagcactagaagagaagctttacaaggatccaaggctcggcgagctccaaaagatattcgcatag

SEQ ID NO: 24086 - DNA, 1851 bp, Artificial Sequence
  Description of Artificial Sequence: Synthetic coding sequence
atggacgtgatgctggagaactactgccacctgatcagcgtgggctgtcatatgaccaaacctgacgtgatcctaaagctagagcggggggaggagccctggacctcgtttgcagggcatacatgtcttgaagaaaactggaaagccgaagacttcttggtcaagttcaaagagcaccaggagaagtattctcgctcggtggtatctatcaatcacaaaaagctcgttaaagaaaaatctaagatctatgaaaagactttcacattgggaaaaaatccagtcaactcaaagaacctgccgcctgaatatgacactcacggtcgtattctgaaaaatgtgtccgaactgattattagcaatctgaaccctgccaggaaacgactcagtgaatacaacggttatggcaaaagccttctgtcaaccaagcaggaaacgacccaccccgaagtgaagtctcacaaccagtcagcgagagccttctcccataatgaggttctgatgcagtaccagaaaactgaaacacctgcacagagctttggctacaatgactgcgaaaaatcttttctccaaaggggagggctgatcacacatagtagaccatataagggtgaaaaccctagcgtgtataataagaagcgccgggccacaaacatcgaaaaaaagcacacatgtaatgagtgcggaaaatcgttttgtcgtaaatccgtactgattctgcatcaaggaatccatagcgaagaaaagccatatcagtgtcatcagtgcggtaatgcatttagaagaaagagttacctaattgatcatcagcgcactcatacaggggagaagccatttgtgtgcaacgagtgtggaaagagtttcaggctgaaaactgccctgactgatcatcagagaacccacacaggggagaaatcgtacgagtgtttgcagtgccgcaacgcatttaggctcaagagccatttgatccggcatcagcgcacacacacaggtgaaaagccttacgaatgcaacgactgtggaaaatctttccggcagaagacaaccctatcactccaccagaggattcataccggcgaaaaaccatatatctgtaaagaatgtggaaagtcttttcaccagaaagcgaatttgaccgtgcaccagagaacacatacaggcgaaaaaccttatatctgcaatgagtgtggtaaatccttctcccaaaagacgacactcgctctccacgaaaagacacataatgaagaaaagccttacatttgttcggagtgtggaaagtcttttaggcagaaaactaccctggtggctcatcagaggactcataccggggagaagagctacgaatgtccacattgtgggaaggcttttaggatgaagtcctacttaatagaccaccaccggactcacacaggggaaaagccctacgagtgcaacgaatgtggaaaatccttcagccagaaaactaatttgaacctgcatcagcggatccatacaggggaaaaaccctatgtctgcaacgagtgtgggaagagcttccgtcagaaggcaacactgactgtacatcagaaaattcatacaggccagaaatcctatgagtgccctcagtgtggcaaggcttttagccggaagtcatacctgatacatcaccagagaacgcacactggcgaaaagccttataaatgctccgagtgcggaaagtgtttccgacagaaaaccaacctcattgtgcaccaacggacccacaccggagaaaagccatatgtttgcaatgagtgtggcaagtctttctcatacaaaaggaacctcattgtgcatcagcggactcacaaaggcgagaatattgagatgcagtag

SEQ ID NO: 24087 - DNA, 441 bp, Artificial Sequence
  Description of Artificial Sequence: Synthetic coding sequence
atgtgccacaccagctgcagcagcggctgccagcccgcctgctgcgccccgagcccttgtcagcccgcttgctgtgtgcctagctcctgccaagcgtcctgctgcgtgcctgtgggctgtcaaagcagtgtttgtgtcccggtctctttcaaaccagcagtgtgtctgccagtgagttgccagtcctccgtctgcgtacctatgtccttcaagtccgcggtctgtgtgcctgtgagctgtcagagctcggtgtgcgtccccgtctcttgtagacctatcgtctgcgcagctccttcctgccagtcttcgctctgcgtgcccgttagctgccgccccgtggtgtacgccgctccaagttgccaatcaagcggttgttgccagcctagctgcacaagtgtgttatgccgacccatctcttactccattagctcttgttgttag

SEQ ID NO: 24088 - DNA, 1257 bp, Artificial Sequence
  Description of Artificial Sequence: Synthetic coding sequence
atgcgggagtgcatcagcatccacgtgggccaggccggcgtgcagatcggtaatgcttgttgggagctgtactgcttggagcatggcattcagcctgatggacaaatgccctcggacaagaccattggtggtggagatgactcttttaatacatttttcagtgaaacaggtgcaggaaaacatgtcccgcgtgccgtcttcgtggatttggaaccaacggtggtggacgaagtaaggaccgggacctataggcagctgtttcacccggagcagcttattactgggaaagaagatgcggctaataactacgcccgtgggcattatacgattggtaaagaaatcgtggatttagtgctagaccgtatccgtaaattggccgatctttgcacagggttgcagggatttctgatcttccactccttcggaggcgggaccgggtcaggcttcgcctccctcctaatggaaagactctccgtagattatggaaaaaagagcaaactcgagttcgccatttatcctgcaccacaggtatctacagctgtggtggagccgtacaattcaatcctgaccacacatactacgctagaacattcggattgtgccttcatggtcgacaatgaggccatctacgatatatgcagaaggaacttagatattgagcggcccacgtacactaatctgaaccgcctcatagggcagattgtgagctctattaccgcgtcccttaggttcgatggggcactaaacgtggacctcactgagttccagacaaacttagtgccatatccaagaattcactttcctttggctacctacgccccagtcattagtgctgaaaaggcatatcacgaacagctttctgtagccgagattactaacgcgtgctttgagccagctaaccaaatggtgaaatgcgatccacggcacggaaaatacatggcctgttgcatgctgtataggggtgatgtggttccgaaagatgtgaacgcggctattgctactattaagacaaaacgcacaattcagttcgtggactggtgtccaaccgggttcaaggtcggcattaattaccagccacccaccgtggttcctggcggtgatctggctaaagtgcagagagccgtatgtatgctctcaaatacaaccgcaatagccgaagcatgggcaagactggatctggccgcgctggaaaaagattacgaagaggttggagtcgatagtgtggaggctgaggcggaggaaggtgaggagtactag

SEQ ID NO: 24089 - DNA, 3351 bp, Artificial Sequence
  Description of Artificial Sequence: Synthetic coding sequence
atgtacggcagcgcccggagcgtgggcaaggtggagcccagcagccaatcaccaggaagatctccaaggctccctcgaagcccaagactgggtcataggaggaccaacagcacaggaggatccagcggatctagcgtcggggggggctccggtaagacactctctatggaaaatattcagtccttgaacgccgcttatgccacctcaggccctatgtatctgtccgatcatgaaaatgtcggcagtgagacgcccaagtcaactatgacgctcggtcgtagtggcggacgactgccctatggcgtcaggatgactgcaatggggtccagcccgaacatagcatcttctggagtcgcctctgacaccatagccttcggagaacaccacctaccacctgtgagtatggccagcaccgtgccacattctctcaggcaagcaagggacaataccatcatggacctgcaaactcagctgaaggaggtgctgcgcgaaaacgatctactgagaaaggacgtggaggtcaaggaatccaaactgagctcaagcatgaactctataaagacattttggtcacctgaactgaaaaaagagagggccctcaggaaggatgaggcctccaagatcactatatggaaggagcaataccgagtagtgcaggaagagaaccagcatatgcagatgacaattcaggcactgcaggatgagttgagaatccaacgggacctgaaccaattattccagcaggacagctcgtcgcgcaccggagagccctgcgtcgccgaactgaccgaagaaaacttccaacgcctgcatgccgaacatgagcgacaggcaaaagagctgtttctgctgcgcaagactctggaggagatggaacttcggatcgaaactcagaagcaaaccctgaacgcaagagatgagagtatcaagaagcttttggaaatgctgcaaagcaagggactaagcgccaaggctactgaggaggatcacgagcggacacgccggcttgcagaggcagagatgcacgtgcatcatctggagagcctactcgagcagaaagaaaaagagaattccatgcttcgtgaggaaatgcacaggcgattcgagaatgctccagactccgctaagacaaaagcgctccagactgtcattgagatgaaggactcgaaaattagctccatggagcgagggctgcgggatctggaggaggagattcagatgctaaaatccaatggcgccctctccacggaggaaagggaagaagaaatgaagcaaatggaggtatatcggagccacagcaaattcatgaagaataaggtggagcaacttaaagaagagctgagcagcaaagaagcgcagtgggaggaactgaagaagaaggcagcaggactgcaggctgaaattggccaggtgaagcaggaactctcgaggaaagatacggaactgctggccctgcagacgaagctggaaactctgaccaatcagttttctgactccaagcagcatatcgaggtgctgaaagagtcgttaactgccaaggaacagagagccgccatcctgcagacggaagtggacgctctgagactgaggctggaggaaaaagaaaccatgcttaacaagaagacgaagcagatccaggacatggccgaggaaaagggcacccaggcaggagagatccacgacctgaaggacatgctggacgtgaaagagcggaaggtaaatgtgctccagaagaaaattgagaatttgcaagaacagctccgtgacaaggaaaagcagatgtcttccctgaaagagcgcgttaagagtctccaagctgacaccactaatacggatacagccctcacaacgcttgaggaagcgctggccgagaaggaaagaaccatcgagagactcaaagaacagagggacagagacgaaagggagaagcaggaggagatcgataattataaaaaggacttaaaagacctgaaggaaaaggtgagtctgctgcagggtgatctcagtgaaaaggaggcttctctgctcgatctgaaggagcatgctagctcattagccagttccggcttgaagaaagatagcagactgaaaacactggagatcgctctcgagcaaaagaaggaagagtgccttaaaatggagtcgcagctgaaaaaggctcacgaggcagccctcgaagcacgggcatctcctgagatgtccgatcgaatacaacatctggagcgtgagatcaccagatataaggacgagagttcaaaggcacaagccgaggttgaccggcttctagagattcttaaggaggtcgagaatgaaaagaatgataaggataaaaagatcgcggaactcgagaggcaggtgaaagatcagaataagaaagtggccaatcttaagcataaagagcaggtggagaagaagaagtccgcccagatgcttgaggaggcgaggcgcagagaggacaatttgaatgactcctcccagcagttacaagattcactgcggaaaaaggatgaccgcattgaagaactcgaagaggccctgagagaatcggtccaaatcacggccgagagggaaatggttctggcgcaggaggagtccgcacggactaatgccgaaaaacaagtggaagagcttctaatggccatggaaaaggtgaagcaggagttggagtccatgaaagcgaagttgtccagcacacaacagagcttggctgagaaagaaacacatctcacaaatctgcgagcagaaagacgaaagcacctggaagaagtattggagatgaagcaagaggctctccttgccgccatcagtgagaaagatgcaaacatcgcccttctggaactgtcgagctctaagaagaagacacaggaggaggtcgcagccctaaagcgagaaaaggacagactggtgcagcagctcaaacagcaaactcagaaccggatgaagttgatggctgacaactacgaagacgatcacttcaaaagtagccattccaaccagactaatcacaagccgagtcccgaccagatcattcaaccgctgctcgagcttgatcaaaacaggagcaaattgaaactatatattgggcatctaaccactctctgtcacgaccgggatccgctcatcctccgtggactgacacctccggcgtcttacaacctcgatgatgatcaggcagcatgggagaacgagttgcagaaaatgactcgtgggcagctgcaggatgagctggagaagggagagcgcgataatgctgaattacaggagtttgcgaatgcaatcctgcaacagattgctgatcattgtcctgacatcttagagcaggttgtgaatgcgcttgaagaaagctcatag

SEQ ID NO: 24090 - DNA, 3075 bp, Artificial Sequence
  Description of Artificial Sequence: Synthetic coding sequence
atgaacttcatcaaggacaacagccgggccctgatccagcggatgggcatgaccgtgattaagcagatcacagatgacctgtttgtatggaacgtgcttaatagggaggaagttaatattatttgctgtgaaaaagttgaacaggatgcagcaagaggcataatccatatgattttaaaaaaaggctcagagtcatgcaacctatttctgaagtccctgaaggagtggaactaccctctgttccaggatctgaatggccagagtctgttccatcagacttctgagggcgacctcgatgacctggcccaagatctaaaagacttataccacacccccagtttcctgaatttctatcctctgggtgaggatatcgatatcatcttcaatctgaagagcaccttcacagagcccgtgttgtggcgtaaggatcagcatcaccatagggtggaacagctgaccctcaatgggctgctgcaagcgttgcagtctccttgtatcatcgagggcgaatccggaaagggcaaaagcaccctcctgcagcgcattgccatgctttggggctctgggaagtgcaaggcactcaccaagtttaaatttgtgttctttctgaggctaagtcgggcccaaggcggcttatttgagacgctgtgcgatcaactgctggatatccctggcacaattaggaaacagacgtttatggccatgctgttgaaattgcgccaaagggttttgtttcttctagacgggtataatgagttcaaaccacagaactgccccgagatcgaggccttaatcaaagagaaccacagattcaaaaatatggttattgtgactacgactactgagtgcctgcgccacattcgacagtttggggccctgacagctgaagtgggcgatatgaccgaagatagtgctcaagcactcatcagggaggttctgatcaaggagctggcggaggggctgttgctgcagatacagaaatcacgttgtctgcgtaacctgatgaagacacctctctttgtggtaattacttgcgccattcagatgggggaaagtgagttccactcacatacccagaccactctgtttcacactttctacgatctcctgatccagaaaaataaacataaacataagggggttgcggcaagcgattttattagatctttagaccattgcggcgaccttgccttggaaggagttttttctcacaagttcgactttgagctgcaggacgtgtcatccgtgaacgaagacgtgctcctgacaactggattgctatgtaagtatacagcccaacggttcaagccaaagtacaagttctttcataaaagcttccaggaatatactgccggtcgtcggcttagctctttgcttactagtcatgaacctgaagaggttacaaaagggaatgggtacctccaaaaaatggtatccatctccgacattaccagtacctatagctcactcttgagatatacatgcggcagttcagtggaagccactcgcgcagtcatgaaacacctggccgctgtttaccagcatggctgtttactgggtctgtccattgcgaaacgacctctgtggcgccaagaatcactgcagtctgttaaaaacaccacggaacaggagatattaaaagccataaatatcaattcctttgtggagtgtggtatccatttgtatcaggaatcaacgtccaagtcagcactgtcccaggagtttgaggccttctttcaaggtaagtcactgtacatcaactccggcaatattcctgactatctcttcgacttttttgagcatctaccgaactgcgcttcagccttggacttcattaagctcgacttctacggaggtgccatggcatcctgggagaaagccgcagaggacacaggaggcatacacatggaagaagctccggaaacatacatcccctcccgtgccgtctccttgtttttcaattggaagcaggaatttcggacattggaggtaactctacgcgacttcagcaagctgaataaacaggatatccggtacctgggaaagattttcagtagtgcaacttcacttaggctgcaaattaagagatgtgcgggtgtggccggatccctctccctggtcttgtcaacatgcaagaatatttattcgttgatggtggaagcctctcccctcacaattgaggacgagcgtcatataactagcgtgacgaacctgaagactctctcaatccacgatctccagaaccagagactgccaggtggacttactgacagccttggaaacctcaaaaacctgacaaagctcattatggacaatatcaagatgaacgaagaggatgcaattaagctcgctgaggggctcaaaaacctgaagaagatgtgtctcttccatcttacacaccttagtgacattggcgagggtatggactacatcgtcaaatctctttctagcgaaccttgcgacttggaggaaatccaactggtttcatgttgtctgtcagcaaacgcagtgaaaattttagctcagaacctgcacaacctcgtgaaactgtctatcctggatttgagtgagaactacctggagaaagacggtaatgaggctctgcacgaactgatcgatcggatgaatgtgctagaacaactgacagccctcatgttgccatggggatgtgacgtccagggatccctatcttcccttctcaaacatctggaggaagtaccacaactcgttaagctcgggcttaagaattggcggctgacagataccgagatccggattcttggtgctttttttggaaagaatcctttgaaaaattttcagcagctcaacctagccgggaatcgcgtcagctcagatgggtggctggctttcatgggcgttttcgagaatttaaagcagctcgtatttttcgacttctcaactaaagaattcctgcccgaccctgccttagtcaggaagctcagtcaggtcttatcaaagctaaccttcctgcaagaggcccgactggttggttggcagtttgacgacgacgatctttctgtgattacgggcgccttcaagctcgtcaccgcctag

SEQ ID NO: 24091 - DNA, 1065 bp, Artificial Sequence
  Description of Artificial Sequence: Synthetic coding sequence
atggccgagagccccaccgaggaggccgccaccgccggcgccggcgctgcggggcccggggcgagctccgtggctggcgtcgtgggagtgtcaggctctggcggcggttttggccctcctttcctccctgacgtctgggctgcagccgctgccgcggggggcgcgggggggccaggttccggtctggcccctctccccggactgccgcccagcgcggcggcacatggcgcagccctgctgagtcactgggatccaactctatcaagcgattgggacggggagcgtaccgcccctcagtgtttgcttagaatcaaacgtgatatcatgtcaatctacaaagagccgccaccaggcatgttcgttgtccccgacacagtggacatgacaaagatccacgccctgattacagggcctttcgataccccctacgaagggggttttttcctatttgtgtttcgctgcccccccgactacccgatccacccgccccgggtgaaactcatgaccaccggcaacaacacagtaagattcaacccaaacttctatcgtaacgggaaggtctgcctgtctatcctgggcacgtggaccggccccgcctggagcccagcccaaagcatttctagtgttctgatcagcattcagtctcttatgacagagaacccataccataatgaaccagggttcgagcaggagcgccaccccggcgatagtaagaactacaatgagtgtatcagacacgagaccatccgcgtcgccgtctgtgacatgatggaaggaaagtgtccctgtccggaacctttgcgtggtgtgatggagaaaagctttctggagtactatgacttttatgaggtggcctgcaaggaccggttacacttgcaaggtcaaacaatgcaggaccccttcggggaaaagaggggccactttgattaccaatctctactaatgcgactgggcctaattcgacagaaggtcttagagaggcttcacaatgaaaatgcagagatggacagcgattcttccagttctggcactgagacggatcttcatgggtcactgagagtttag

SEQ ID NO: 24092 - DNA, 2487 bp, Artificial Sequence
  Description of Artificial Sequence: Synthetic coding sequence
atggacagcgaggccttccagagcgcccgggacttcctggacatgaacttccaatcattggcgatgaagcacatggacctcaagcaaatggagcttgacactgcagctgccaaagtagacgaacttaccaaacagctggagtcgctgtggtccgactctcccgctcccccggggcctcaagccggccccccctcaagacctcccaggtactcaagctcatcaatacccgagccttttgggtctcgaggtagcccccgtaaagccgcaaccgacggcgctgatacaccctttggcaggtccgaatcagcccccaccctgcacccatatagcccactgtcacctaaaggcagaccaagtagcccgaggacccccctctacctgcagcctgatgcgtacggatccctcgatagggccacgtctcctaggccgcgggcctttgacggagccgggtcttcactgggccgggccccctctcctaggccagggcctggccctctgcggcagcagggaccacctactccgtttgacttccttggccgcgccggttctccgcggggttcccctttagcggagggacctcaggccttctttcccgaacgggggccttcacctcggcccccggccactgcctatgacgctcccgcgagtgccttcggttcctcccttctgggctctgggggatctgcattcgccccccctcttagagctcaggatgacctgacgttgagacgccgcccaccaaaggcatggaacgagtcagacctggacgtggcctatgaaaagaagcctagccaaacagcatcatatgagcggttagatgtctttgcaaggccggccagcccctcccttcaattgctgccttggagggaaagcagccttgatggcctgggtggtaccgggaaggacaaccttactagcgccacgctgccccgaaattacaaggtgtctccacttgcctccgaccgacgctctgacgctggctcttataggcgatctctggggtccgccggtccatctggaactttaccccggagctggcaacccgtaagccgaataccaatgcccccctctagcccacagcctaggggtgccccccgtcagaggcccatccctctaagtatgatttttaaactccagaacgctttctgggaacatggagctagcagagcgatgctgccaggtagccccctgttcacgcgggccccaccaccaaaacttcaacctcagcctcaaccacagccccagccacagtctcagccccagccccaattgccgccccagcctcagacacagcctcagacccctactcccgccccccaacatccacaacagacttggccaccagtgaatgaaggcccccctaaacctcctaccgaactggaaccggagcccgaaattgaagggctgttgacacctgtgctggaagcaggagacgtggatgaaggtccagtggctcgcccattaagtccgacccgtctgcagccagcgttaccacccgaggctcagtcagtgcctgagcttgaggaagtcgcaagggttttggctgaaatccccaggccactgaaaaggaggggttcgatggagcaagcgccagccgtcgcgttgccaccaacccacaaaaaacagtaccagcagatcatttctagattattccacagacatggaggaccaggcccaggcggacccgagcccgaactgtcgcctatcactgaaggcagcgaggcgagggcgggcccaccagcgccagcccccccagccccaattccaccccccgcgccctctcagtcctcaccgccggaacaaccccagagtatggaaatgaggtcggttctgaggaaggctggatcccctagaaaggctaggagagctagactcaatcccctggtcctgctgctcgacgcagccctgaccggcgagctcgaagtggtgcagcaagccgtgaaagagatgaacgatccatcccaaccaaatgaagaaggcataacagcccttcataacgcaatctgtggcgctaattacagtattgtggacttcctcatcacagctggggccaacgtgaacagtccagacagccatgggtggacccctttgcattgtgctgcctcctgcaatgacactgtcatttgcatggctttagtccagcatggagctgccatttttgctaccactctcagtgacggtgccacagcttttgagaagtgtgatccttatagagagggttatgccgactgcgcgacttatctggccgatgtggagcagagtatgggactgatgaacagcggcgcagtttacgccctctgggattactctgcggagtttggcgacgaactttcctttagagagggcgagtccgtgacagttctgcgtagagatggcccagaagaaactgattggtggtgggccgcactgcatggtcaggaggggtacgtgccacgtaactatttcggtttattccctagagtgaagccgcagcggagtaaggtgtag

SEQ ID NO: 24093 - DNA, 1131 bp, Artificial Sequence
  Description of Artificial Sequence: Synthetic coding sequence
atggtggtggaggtggacagcatgcccgccgccagcagcgtgaagaagccttttgggttgcggtcgaagatggggaagtggtgctgccgttgttttccctgctgtagggagtccgggaaaagcaacgttggaaccagcggggaccatgacgattctgctatgaaaacattgcggtctaagatggggaagtggtgccgccactgctttccatgctgccggggatcaggcaaatcaaacgtgggcgcgagcggcgatcacgatgattcagcaatgaagacactcagaaataaaatgggaaaatggtgttgtcattgcttcccctgctgcaggggctcctccaaaagtaaagtgggtgcctggggcgattatgacgattctgcttttatggaaccaaggtaccatgtcagaggtgaagaccttgacaaactgcacagagccgcctggtggggaaaggtgcccagaaaagacctgattgttatgctcagagacacggacgtcaataaacaggacaagcaaaaacgaactgcactgcatcttgcttcagctaatgggaattctgaagtggtcaagctgctgctggacaggaggtgccaactgaatgtccttgacaacaagaaacgaaccgccctgatcaaggctgttcagtgccaggaggacgagtgcgccctcatgttgctagagcatggtactgaccccaatattcctgacgagtatggtaacaccaccctccactatgcaatttataacgaagataagctgatggctaaggccttgctgctgtacggagccgatattgaaagcaagaacaagcacggtctgaccccgctccttttgggtgtacatgagcaaaagcagcaagttgtcaagttcctgattaagaaaaaggctaaccttaatgcgttggataggtacggaaggactgccctcatccttgcagtttgttgcgggtctgctagcatcgtaagcctattattagagcagaacatcgacgtgtcttctcaggatctttcaggccagaccgccagggagtacgcagtcagctcccatcaccatgtaatctgccagctgttgtccgactacaaggaaaaacagatgttgaagatctcaagtgagaatagtaatccggggtag

SEQ ID NO: 24094 - DNA, 765 bp, Artificial Sequence
  Description of Artificial Sequence: Synthetic coding sequence
atgcccgccagcttccccatgctgcggtgcgcccggagcccctgctggaccgtctgttggagtccttggtgccgtgcactgcctgacggtagatgtagttgcctcagctcccccccgtctccactcggacccactcgggaccctgtggccacgttcctggagacctgtcgcgaaccaggcagtcagcctgctggccccgccagcctcagggctgagtaccttccacccagcgttgctagcataaaggttagtgcagagctgctccgagctgccctgaaggacggtcactctggggtgccactttgttgtgctacattgcaatggctgttggcagagaacgctgctgtagatgtcgtgagggctcgggctttaagtagtattcagggggtcgccccagacggtgctaatgtacacttaatcgtgagagaagtcgctatgacagatctttgtcccgccggacccattcaggcagttgagatccaggtggagagcagttccctcgcggacatatgcagggcacaccacgccgtcgtcggtcgcatgcaaaccatggtcaccgaacaggctacccagggctcttccgccccagacctgcgagttcagtatctgcgtcagatacatgccaatcatgaaactcttctaagggaagttcagacgttacgcgatagattgtgcaccgaagacgaagccagttcttgcgcaactgctcagcgtctactccaggtttatcgtcagctgaggcatcctagcctgattctgctgtag

SEQ ID NO: 24095 - DNA, 2046 bp, Artificial Sequence
  Description of Artificial Sequence: Synthetic coding sequence
atgtgcggcatcttcgcctacctgaactaccacgtgccccggaccaggagggagatactggaaacattgattaagggcctccagaggttggagtaccgaggatacgattcagccggtgtcggcttcgacggagggaacgacaaggactgggaggccaatgcctgcaaaattcagctcatcaagaaaaaggggaaagtgaaggccctcgatgaggaagttcacaaacagcaggacatggatttagatattgagttcgacgttcatctcgggattgctcacaccagatgggcaacgcacggggagccatctcctgtcaacagtcacccccagcgatcagacaaaaataacgagttcattgtgatccacaatgggataatcactaattacaaagacctgaaaaaattcttagaaagcaaaggatacgattttgaatctgaaaccgacaccgaaacgatcgctaaactcgtaaaatatatgtatgacaatagggaatcccaggatacttccttcacaacgctagtggaaagggtgattcagcagctggaaggcgcgtttgctctggtttttaaatccgtgcattttcctggtcaagctgttgggactcggcgcggtagccctctgctaattggcgtccgctctgagcacaaactgtcaactgatcacattccaatcctctacaggacaggaaaggataaaaagggatcttgtaacctatctcgagtggatagcaccacctgcctgttcccagtggaagagaaagctgtcgagtattactttgcttctgacgcaagcgcagtgatcgagcacacaaatagagtgattttcttggaagatgatgatgttgctgctgtggttgacggccgactgagcattcatcggattaaacgcacagccggcgatcaccccggacgtgccgtacaaacattgcagatggaattgcagcaaatcatgaaaggcaatttttcaagcttcatgcagaaggagatctttgagcagccagagagtgttgttaatacaatgcgcggccgggtgaacttcgatgattatactgtcaacctgggaggcctgaaagaccacatcaaggaaattcagcgctgccgcagactcatcctgattgcctgcggaacctcataccacgcaggagtggctactcggcaggtcctagaggagcttaccgaactacctgtcatggttgagctggccagcgatttcctcgataggaatactccagtttttcgcgacgacgtttgcttctttctgagccagtcaggtgaaaccgccgataccctgatggggctgcggtactgtaaggagcgtggcgccctgactgtcggcattacaaatacagtgggctcgtcaatatctcgggagacagattgcggagtgcatatcaatgccggcccagagattggtgtggcctcaaccaaggcctatacgtcacagttcgtgtctttagtgatgttcgccttgatgatgtgtgatgatcgtatatccatgcaagagcgacggaaagagattatgctcgggctgaagagattgcctgacctcatcaaagaagtcctttctatggatgatgaaatccagaaactggccacagaactctatcatcagaaaagcgtcctgattatgggcagaggttaccactacgcaacatgtctggagggcgccctgaagatcaaagaaatcacctacatgcactccgagggcatcctggcgggcgaattgaaacatgggcccctggctctggttgataaattgatgcccgtaattatgattattatgcgggaccacacctatgcgaagtgtcagaacgcgcttcagcaggttgtggcccgtcagggcaggcctgtagtcatttgtgacaaggaggacaccgagactattaagaacaccaagcggacgatcaaggtgcctcactcagtggattgtctccaaggcattttgagcgtgatccccctccaattattagccttccatctggcagttctgaggggttacgatgtagacttcccgaggaacctggctaagagcgtgacagtggagtag

SEQ ID NO: 24096 - DNA, 498 bp, Artificial Sequence
  Description of Artificial Sequence: Synthetic coding sequence
atggaggacctgttcgagaccttccaggacgagatgggcttcagcaacatggaagacgacgggcccgaggaggaggaacgcgtggctgaaccccaggcaaatttcaataccccacaggcccttcgttttgaggagctactggccaacctactgaacgaacaacaccagatcgctaaagaattatttgagcagctcaagatgaagaagccctcggctaaacaacaaaaggaggtcgagaaggtcaagccacaatgtaaagaggtacaccagactctgatcctggaccccgcacaaagaaagcggctccagcagcagatgcaacagcacgtacagctactgacccagattcacctgctggctacttgtaacccgaaccttaaccccgaggcatccagcacccgcatttgcctgagctgggagccattgctgaaggccccatccccctttacaatttctactactccgtcgtttaggccttgttcaaatccagttacctag

SEQ ID NO: 24097 - DNA, 633 bp, Artificial Sequence
  Description of Artificial Sequence: Synthetic coding sequence
atggccgccagcgtggagcagcgggagggcaccatccaggtgcagggacaggctctgttctttcgggaggctctgcccggaagtgggcaggcacggttctccgtgttacttcttcacgggattcggttctcttcagagacttggcaaaatctagggaccctgcacagactggcccaggctggatatagggccgtcgctatcgatctgccgggcctcgggcacagcaaagaagccgctgcgcccgcacctatcggagagcttgcacccgggtcttttctggcagcagtggttgacgcgctggagttgggaccgccagtggttattagtccctctttgtccggtatgtactctttgcccttcctgactgcacccggctcccaactccccggctttgtacctgtggctcccatctgtactgataagatcaatgccgctaattacgctagcgtgaagacccctgccctgatcgtgtacggggatcaggaccctatgggccaaacctcttttgaacacctaaaacaacttccaaatcatagagtgctgatcatgaaaggcgccgggcatccatgctacttagacaaacccgaagaatggcacaccggacttctggactttcttcagggcttacaatag

SEQ ID NO: 24098 - DNA, 1248 bp, Artificial Sequence
  Description of Artificial Sequence: Synthetic coding sequence
atgcgggccgccgacagcggcagctgggagcgggtgcggcagctggccgctcagggggagcctgcccccagttgtggggccggtgctggacccgcgcgaccgcctggacccgccgcttgcgaacagtgcgtagatgcggcaggccctggagacaggccaagagcaggggtgccaagagttcgggcagacggcgactgtagccagcctgtgctgctgagggaggaggtgtcccgtttgcaggaggaagttcacctactgagacagatgaaggagatgctagcgaaggatctcgaggaaagccaaggtggcaaatcttccgaggtgctgtcggccacagaattaagagtacagctggcacagaaggaacaggagttggcgcgcgcgaaagaagccctacaggccatgaaggccgatagaaaaaggctaaagggggagaagactgatctggtgtcacagatgcagcagttatacgctaccctggagtcgcgtgaggagcagctgcgggattttatacgaaattacgaacagcatagaaaggaaagtgaagacgccgtgaaggccctcgccaaagaaaaagacttattggagagagaaaagtgggaactccggcgccaggcaaaagaggcgacagaccacgcaacggcccttaggagtcagctagatcttaaagataatcgcatgaaggagctcgaagcagagttggctatggccaaacagagtctcgccacgctgacaaaagatgtgcctaaacgccactccctggcgatgccgggagagactgtactgaatggcaaccaggaatgggtcgtccaggccgatctacctctgacagccgccatccgccagagccagcagaccctgtaccatagtcaccctccgcacccagctgatagacaagccgtgcgggtttccccgtgtcactctagacagccctctgtcatcagcgacgcctccgccgcggagggggaccggagctcgaccccaagtgacattaattctcctcgtcaccggactcactctctttgtaatggtgacagtcctggtcctgttcagaagaatcttcacaatcccatcgtgcagtcacttgaggatctggaggaccagaagagaaagaaaaagaaggagaaaatgggattcggaagcatttctagggtgtttgccagaggaaaacagaggaagagcctggatcccgggttgttcgacggcactgctccagactattatatcgaggaagacgctgattggtag

SEQ ID NO: 24099 - DNA, 693 bp, Artificial Sequence
  Description of Artificial Sequence: Synthetic coding sequence
atggaggccgccgagaccgaggccgaggccgccgccctggaggtgctggccgaggttgctgggatcctcgaacccgtgggattgcaggaggaggccgaactgccggccaagatccttgtggagtttgtggtggacagccagaagaaggacaagctgctttgctcgcagctgcaggtcgcggatttcctccagaatatcctggctcaagaagatacagccaaggggttagaccccctcgcatctgaagatacctcacggcagaaagccatagccgccaaagaacaatggaaagagttgaaggcaacatatcgggagcacgtggaggccatcaagatcggcttgaccaaggccctaacccagatggaagaggctcagcggaagaggacccagctgagagaggccttcgaacagctgcaagccaaaaaacagatggcaatggaaaagagaagggcagtgcagaatcagtggcagttgcagcaggagaaacacctccaacacctggcagaggtgagtgctgaagggaaacttctcttccctgaggccgaggcggaagcagaaaatctgcccgatgataagcctcaacagcccacgcgcccccaagaacagagcacgggtgacaccatgggacgggatccaggagtttcattcaaggctgtcggacttcagccggcaggggacgtaaatttaccgtag

SEQ ID NO: 24100 - DNA, 2547 bp, Artificial Sequence
  Description of Artificial Sequence: Synthetic coding sequence
atgcaggccgaggccgccgactggttcagcagcatgcccttccagaagcacgtgtactaccctctggctagcgggcccgaaggaccagacgtcgcagtagcagccgcggccgcgggtgcggcctccatggcttgcgccccaccgagcgctgcaagcggccccttgcctttctttcagttccgaccaagactcgaatccgtggactggcgccgactcagtgctattgacgtggataaagttgctggggcagtggacgtgcttactttacaggaaaatatcatgaacatcaccttctgtaaactggaggacgaaaaatgcccacattgtcaaagtggtgtagacccggtgctgctgaaacttatccgactcgcccagttcacaatcgagtacctactacattcacaggaatttcttacatcgcagttgcacactttggaggagagactgaggcttagtcactgtgatggcgagcagtccaaaaagctgctcactaaacaggctggagaaatcaagactctgaaggaggaatgcaaacggcggaagaaaatgatttctacgcagcagttgatgatagaagccaaagccaactattatcagtgccatttttgcgataaggccttcatgaaccaggcttttttgcagtctcatattcagagacgacacacagaggaaaactcacactttgaatatcagaaaaatgcacagatagaaaagctgaggagtgaaatcgtcgtgctgaaggaagagctccagctcacgcggtctgaattagaggcggctcaccatgcatccgccgtgcgcttcagtaaagagtacgagatgcaaaagacaaaggaggaggattttctcaaactatttgatcgctggaaagaggaagagaaggagaaacttgtggatgagatggagaaggttaaggaaatgtttatgaaagagttcaaggagctaacatcaaagaacagcgcgctcgagtatcagctaagcgagatacagaagtctaatatgcaaattaagagtaatattgggacattaaaggacgcacacgagtttaaagaggaccgcagtccatacccacaagatttccacaatgtaatgcaattgctggactctcaagagtccaaatggactgcccgcgtacaggccatccatcaagagcataagaaagaaaaaggtaggctcctgagtcatattgagaaactcagaacaagtatgatcgatgacctgaatgcctccaatgtgttttataaaaagcgcattgaggagctgggccagcggctgcaggaacagaacgaactcattatcacccagaggcagcagattaaagatttcacatgtaatccactgaacagcatttcagaacccaaagtaaacgcccccgcactgcatacgttggagacaaagtcttccctgcccatggttcacgaacaggctttttccagccatatcctggagcccatcgaggaactgtcagaagaggaaaaaggccgtgagaatgagcagaaactcaataataacaagatgcacctccggaaagctctgaaatccaactcttcactgacaaagggtctgcgaactatggtggagcagaatttgatggagaagctggagactctgggaatcaatgccgatattaggggaatatctagcgaccagcttcaccgcgtgctgaagagtgtggagtctgagcgccataagcaagagcgggagatcccgaattttcaccagatcagagaatttttggaacatcaggtttcctgtaagattgaagagaaggcactcctgtcaagcgatcagtgtagcgtatctcaaatggataccttgtccactggtgaagtgcccaagatgatccaacttccctcaaagaatcgtcagctcatccgccagaaagctgtgtcaaccgaccgaacctccgtcccaaaaatcaaaaagaacgtgatggaagatccgtttccccgcaagtcctccaccatcactacacctcctttcagctccgaagaagaacaggaggacgacgacctgataagggcgtatgcttctccaggccctttacccgtaccacccccccagaataaagggtctttcgggaaaaacactgtgaaatctgatgctgacggcactgaggggtctgagattgaggacaccgatgacagcccaaagcctgccggggtggcggtgaaaacacctacggaaaaagtggagaagatgtttccacaccgaaaaaatgtgaacaagccggtggggggcacaaacgtccctgaaatgtttattaaaaaggaggaattacaggagctcaagtgcgcggacgtcgaggacgaagattgggatatcagcagtcttgaggaggagattagcttggggaagaaatctggtaaagagcagaaagaacccccacctgccaaaaatgaaccacatttcgcccatgtactcaacgcatggggagcctttaatcccaaaggacccaagggcgaagggttacaagaaaatgaaagcagcacccttaaatcaagccttgtgaccgtcactgactggtccgacaccagtgatgtttag

SEQ ID NO: 24101 - DNA, 1185 bp, Artificial Sequence
  Description of Artificial Sequence: Synthetic coding sequence
atggtggtggaggtggacagcatgcccgccgccagcagcgtgaagaagccattcggcctgagaagtaaaatgggcaagtggtgttgccgctgcttcccatgctgtcgcgagagtggcaaaagtaatgtcgggaccagcggggatcatgacgactcggcaatgaagaccctgcgttctaagatggggaagtggtgccgccactgtttcccttgctgcagggggtcaggtaaatccaacgtgggggccagtggcgaccacgatgattcagctatgaaaacccttcggaacaagatgggcaagtggtgctgtcattgttttccctgctgcagggggagtagtaaaagcaaagtcggggcttggggagattacgatgacagtgccttcatggagccccggtaccatgtccggggcgaggacttggataagctgcaccgagctgcttggtgggggaaagtccctcgcaaagatctgattgtgatgctacgcgataccgacgtgaataagcaagacaagcagaagcgaacggccttacatctggcaagcgcaaacggaaactccgaagtggtgaaattactgcttgatcgtcgttgccagctgaatgtccttgataacaaaaaaaggacagctctgataaaagtgtgctcctcacagctatatcagcacgaagccgtccagtgccaagaggatgagtgcgccctcatgctgctggagcatgggaccgatcctaacatcccagatgaatacgggaacacgacactgcattatgctatctataacgaagacaaattaatggctaaggccctgctgctttacggtgcggatatcgaaagcaaaaacaaacatgggctgacccccttactgctgggcgtgcacgagcaaaaacagcaagtggtaaagttcctgatcaagaaaaaagcaaatcttaatgcacttgataggtacggccgcacagctctaatccttgccgtgtgctgtgggagtgcgtcaatagtgtctctgcttctcgagcagaatatcgatgtgagctcacaagatctttctggccagacagcccgagaatatgccgtctcatcccatcaccacgtgatctgccagttgctgtcggattacaaagaaaagcagatgctcaaaatctcatcggaaaattcgaatcccgagaacgtcagtcgcacaagaaataaatag

SEQ ID NO: 24102 - DNA, 1308 bp, Artificial Sequence
  Description of Artificial Sequence: Synthetic coding sequence
atggcccccttcggccggaacctgctgaagacccggcacaagaaccggtctccaactaaggacatggactccgaagagaaggagattgtggtgtgggtgtgccaggaggaaaaacttgtctgcgggcttactaagcgtaccaccagcgctgacgtgatacaagcccttctggaggagcatgaggccacctttggtgagaagcgcttcctcttgggcaagccttccgactactgtataattgaaaagtggcgtgggagcgaacgggtcctgccacctcttacccgcatcttaaagttgtggaaagcatggggtgatgaacagcctaatatgcagttcgtcttggtcaaggctgacgctttcctacccgtaccactgtggcgcactgctgaggctaagttggttcaaaacacagagaagctctgggaactgtcacccgctaattacatgaaaaccctccctcccgataagcaaaaaaggatcgtccggaagacattcagaaagctcgctaaaattaagcaggacactgtgtcccacgatcgcgataacatggagacactagtgcacctcataatctcccaggaccacaccattcaccagcaggtcaagcgaatgaaggagctggatctggagatagagaagtgcgaggcgaaatttcatttagatagagtggagaacgatggagaaaattatgtgcaggacgcgtatctgatgccctccttttcagaggtggagcagaatctcgaccttcagtacgaggagaatcagacgctggaggacctaagtgagtccgatggtatcgagcagctggaagaacggctgaaatactacaggatcctgattgacaaactgtccgccgaaatagagaaggaggtcaagtcagtgtgcatcgacattaatgaggacgccgagggagaggccgcatccgaactggaaagcagtaacttggaatcagtgaaatgcgatcttgaaaaatcgatgaaagccggactcaagatccattcacacctgtcaggtattcagaaggaaataaaatactcagactctcttctgcaaatgaaagcgaaggaatacgaattgctggctaaggaatttaacagtttacacatctctaacaaggacggatgtcagctcaaagagaaccgtgcaaaggagtctgaggttccttcgagcaatggcgaaattccacccttcactcagagggtgttcagtaattatacaaacgacacggattccgataccggcatcagctccaaccactcacaggacagcgaaacgacggtcggagacgtcgtgcttctcagtacatag

SEQ ID NO: 24103 - DNA, 1644 bp, Artificial Sequence
  Description of Artificial Sequence: Synthetic coding sequence
atggccggcaccaagaacaagacccgggcccaggccaagaccgagaagaaagccgcaatacaggctaaggcgggagctgagcgagaggccacaggcgtggtgagacccgtggccaagacgcgggccaaagccaaagccaaaaccggctcaaagaccgacgctgtcgctgagatgaaagccgtgagtaaaaataaagtagtggcggaaacgaaggaaggggctctgagtgagcccaagactcttggcaaagccatgggcgattttacacctaaggcaggcaacgaaagtactagctctacgtgtaagaatgaggccggcaccgatgcctggttctgggctggcgaagaggccaccatcaactcatggttctggaatggcgaagaagccgggaacagcttcagcacaaaaaacgacaaacccgagatcggcgctcaggtctgcgctgaggagctcgaaccagcagcaggtgcagactgtaagcctcgctctggtgcagaagaggaggaggaggagaacgtgatcggcaattggttctgggagggagacgatacctctttcgacccgaatccaaaaccagtatcacggattgtgaaaccacagcccgtctatgaaatcaatgaaaaaaatcgcccaaaagactggagtgaagtgaccatctggcccaacgcccccgccgtgacacccgctgtgttgggcttccgtagtcaggctccgagcgaggcatcaccaccgagttatatcgtcctcgcaagtgctgaagaaaacgcttgcagcctgcccgtcgcaactgcttgccgtcctagtcgcaatacgcggagttgcagccagcctattcctgagtgccggtttgacagcgacccctgtatccagactatcgatgaaattcgcaggcaaatacgaattcgagaggttaacggaataaagccctttgcttgtccgtgtaaaatggagtgctacatggatagcgaggagtttgagaagctggtgagcctgctcaaatcaactactgatcccttgatacacaaaatagcgcgaattgcgatgggcgttcacaatgtccacccattcgcccaggaattcatcaatgaagttggagtagtcaccctaattgagtctcttttgagttttcccagtcccgagatgcgcaagaagactgtaattacacttaatcctccgtccggggatgagcgccaacgcaaaattgaactccatgtcaagcatatgtgtaaagagacaatgagcttccctctgaattcgcccggccagcagtcaggtctcaagatcctgggacagctcaccaccgacttcgtccaccattatatcgtcgccaactattttagcgaactgtttcacctgcttagttctggaaattgtaaaacccggaatcttgttttgaagttgctcctgaatatgagcgaaaaccccacagctgccagagatatgattaatatgaaggctcttgctgctctcaagttgatctttaatcagaaagaagcaaaggccaacctcgtttccggggttgctatcttcattaacattaaagagcacatcagaaagggctccatcgtggttgtagaccatctgtcttataatacccttatggccatttttcgtgaggtaaaagaaatcattgaaaccatgtag

SEQ ID NO: 24104 - DNA, 1362 bp, Artificial Sequence
  Description of Artificial Sequence: Synthetic coding sequence
atggcccggaaggtggtgagccggaagcggaaggcccccgccagcccaggagccgggagtgacgcccagggcccacagttcgggtgggatcactcgttgcataagcgcaaacgtctgccccccgtgaaaagatcgcttgtctattacctgaaaaacagggaggtccgattacaaaacgagacttcctactcacgcgtgctgcacggatacgcggcacagcagctcccatcactcctcaaggagcgagaattccacctcggcaccctgaataaggttttcgctagtcagtggttaaaccatcgacaagtagtgtgtggaaccaagtgtaacaccctgtttgtggtcgacgtgcagactagccaaatcaccaagatccctattctgaaggatagggagcctggcggagtcactcagcagggctgcggaatacatgcgatcgagctcaatccaagccgtacactgctggctacaggcggcgataatcctaactcactggccatctaccgactccccaccttagatcccgtatgcgtgggcgacgacggacacaaagattggatttttagtatcgcgtggatttccgacactatggcagtttctggttcgcgggacggctccatgggcctatgggaggtcaccgatgatgtgctgactaagagcgatgcaaggcataatgtctcacgggtgcctgtctacgctcatatcacccacaaggcactgaaagatataccgaaagaagacaccaaccctgacaactgtaaagtgcgagctttggccttcaacaacaagaataaggagctgggagctgtatccctcgatgggtattttcatctctggaaggcagagaatacacttagcaagctgctctctactaaattgccatattgtcgcgaaaacgtctgcttggcatatggtagtgagtggagcgtgtatgctgtaggcagtcaggcccatgtgtccttcctggatcccaggcagcctagctataatgtgaagtccgtatgctcccgtgagcggggctccggaattagaagcgtctcattctacgagcatattattaccgtcggcacaggccaggggtctctattattttacgacattagggcccagagattcctggaagagaggctgtccgcttgttacggaagcaaacccaggctcgcaggcgagaacctgaagctgacaaccggcaagggctggctaaatcacgatgaaacctggaggaactatttctcagatatcgactttttccccaatgccgtttatacccactgctacgatagctctggaaccaagctttttgttgcggggggacccctaccctcgggactgcacggtaactatgcgggcttgtggagctag

SEQ ID NO: 24105 - DNA, 2439 bp, Artificial Sequence
  Description of Artificial Sequence: Synthetic coding sequence
atggaggccttccaggagctgcggaagcccagcgcccggctggagtgtgaccattgttcctttcgaggcaccgactacgagaacgttcagatccacatggggactatacatcccgaattctgtgatgaaatggacgccggaggccttgggaaaatgattttctaccagaagtccgctaaactttttcattgtcataagtgcttttttacatccaagatgtactctaatgtgtactaccacatcacttctaaacatgcatctcctgacaaatggaacgataagcccaagaaccagctgaacaaggagacagacccagtcaaatcccctccattgcctgaacaccagaagataccctgcaactctgctgagcctaagtctatccctgctctgtctatggagactcagaagctcggatccgtcctcagtccggagagtccaaagcccacccctctgaccccattagaacctcaaaagcccggatccgtagtcagcccagagctccagactccactgcccagtccggagccctctaaacccgcgagcgttagcagcccggagccccccaaatccgtgccagtgtgcgaaagtcagaaactagctcctgtgcccagcccagaaccccagaaacctgcaccagtatccccagaatccgtaaaggccacactctctaaccctaagccacagaagcagtcccatttcccagaaacactcgggcctccaagtgcttcctcacctgagagccccgtgctggctgcctcccctgagccctgggggccaagtcccgctgcaagcccggaaagtcggaaaagtgcccgcactacaagtcccgagccacgaaagcctagccccagcgagtcccctgaaccgtggaaacctttcccggctgtgtcacctgagccccgacgccccgcacccgccgttagccccggaagctggaagccaggacctccagggtctcctcgcccgtggaagagtaacccatccgcatcctccggtccatggaagccggctaagcccgcacccagcgtttcacccggtccatggaaacccatccctagtgtgagccctggaccctggaaacccacacctagcgtatcctcagctagttggaaatcgagcagtgttagtccatcgagttggaaaagcccccctgccagccccgagagctggaagtcgggccctcctgagctgaggaagacagcccctactttaagccccgaacactggaaggccgtgccacccgtatctcccgaactcagaaagccaggtccgccactttcacctgagattcggtcccccgcgggatcacctgaactccggaaacccagcggaagcccagacctgtggaaactctcccctgatcagagaaaaacttcccccgccagtctggacttccctgaatcccaaaaaagttcgcgagggggcagtcctgacctgtggaagtcgtcctttttcattgaaccccagaagcccgtcttcccagagaccaggaagcccgggcccagcggaccctcggagtcacccaaagctgcatcagatatatggaagcctgtgttatccatagatactgaacctaggaaaccggccttgtttccagagcccgcaaagacagcacctcctgcttcgccggaggcaaggaagcgcgctctctttccagaacctcggaagcatgctctcttccctgaattgcccaagtccgccctattctccgagtcacagaaagcagtggagcttggggatgagctgcagattgacgctatcgacgaccagaaatgtgacatcctggtgcaggaggagctgctggcatcgccaaaaaaacttttggaggataccctttttccttcttctaagaagctgaagaaagataatcaggaaagctcagacgccgagcttagttcttctgagtacattaagaccgatctcgacgctatggatattaaggggcaggagagcagcagtgaccaggaacaagtcgatgtggaaagcattgattttagtaaagagaacaaaatggacatgacaagtcctgaacagagtcggaatgtcctgcagtttactgaagaaaaggaggcctttatctcagaggaggagattgctaaatacatgaaaaggggcaagggcaaatactactgcaaaatctgttgttgcagagcgatgaagaagggcgcagtgctccaccacttagtgaataagcacaatgtgcacagcccatataagtgcaccatttgcggaaaggcgtttctgctcgagagtctactcaagaaccacgttgcagctcacgggcagtcgttgctcaaatgtcccagatgcaatttcgaatccaattttccgagaggttttaagaaacatctgacacactgtcaatctcgccacaatgaagaggctaacaagaagcttatggaggctttggagccaccccttgaggagcagcagatctag

SEQ ID NO: 24106 - DNA, 1974 bp, Artificial Sequence
  Description of Artificial Sequence: Synthetic coding sequence
atggacgagcaggaggccctgaacagcatcatgaacgacctggtggctttgcagatgaaccgccggcataggatgccaggctatgaaaccatgaaaaacaaggacacaggccatagtaatcgtcaaaaaaaacacaactctagctcaagcgcactgctcaattcccccaccgttactaccagttcatgtgctggagcttcagagaagaaaaaatttcttagtgacgtccggattaaatttgaacacaacggagaacggaggataattgccttcagccggccggttaaatacgaagacgtagagcacaaagtcacgactgtttttggtcagccactggacctgcattacatgaacaacgagctctccattctgctcaagaatcaggacgatcttgataaagcaatcgacatcctcgaccggagtagttccatgaagagcttaaggattttactcctcagccaggacaggaatcacaattcaagctctccacattccggagttagtagacaagtgaggattaaggcttcccagagcgcgggcgatattaacacaatctaccagccacctgaaccaaggagcagacacctgagcgtgtcctcccagaatcccggacgtagctcccccccccccggatacgtgcctgagcgccaacagcatatcgccaggcagggatcctacaccagcattaattctgagggggagtttattcccgagaccagtgagcaatgcatgctggatccactttccagtgcagagaactctctgtcagggagttgtcagagcctggaccggagcgccgattcaccatccttccggaagagtcggatgtccagagcccagtcatttcccgacaaccgccaggaatattcagacagggaaacccagctgtacgataaaggcgtcaagggcgggacataccctcgccggtaccatgtcagtgttcaccataaggactatagtgacggtcgcaggacattcccacgaatccgcagacatcaagggaatttgtttaccctcgtgccatctagccgaagtctctccacaaacggggagaatatggggctagccgtgcagtacctggacccaaggggtcgcttacggagcgctgactctgagaatgcactgagtgtgcaggagcggaatgtgcctaccaagtcacctagcgctcctattaattggagaaggggtaaattgctaggccagggcgccttcggcagagtctacttgtgctatgatgttgacaccgggcgggaactcgctagtaagcaggtgcaattcgatcctgactctccggaaaccagtaaggaggtctccgctctagaatgcgaaattcagcttctcaaaaatctgcagcacgaacgcattgtccagtattatggctgccttagggatcgagccgaaaaaacactgaccatctttatggaatacatgcctggggggagcgtcaaggaccagctgaaggcctatggcgctctgactgagtcggtgacccgtaaatacactaggcaaattctagagggcatgtcttatctgcactccaacatgattgtgcatcgcgatatcaaaggggcaaatattttgcgagattccgcaggcaatgttaagctgggcgattttggggccagtaaaagactccaaactatttgcatgtcgggcacagggatgaggtcagtgacaggcaccccctactggatgtcacctgaagtgatttcaggagagggttatggtcgaaaggcagacgtgtggagcctgggttgcactgtcgtggaaatgctgaccgaaaaacccccatgggccgagtatgaagccatggcagctatctttaagatcgccacacagcctactaacccccaactgcctagccatatctcagagcacgggcgtgatttcctgcggagaatattcgtggaggcccggcaacgcccgtcggcggaagaactccttactcaccacttcgcccagcttatgtactag

SEQ ID NO: 24107 - DNA, 2547 bp, Artificial Sequence
  Description of Artificial Sequence: Synthetic coding sequence
atgcaggccgaggccgccgactggttcagcagcatgcccttccagaagcacgtgtattaccccttggcaagcggccccgagggacccgatgttgccgtggccgccgccgctgctggagcggcttccatggcctgcgcgcctcccagtgctgcttcaggccctctacctttcttccagttccgtcctagacttgaatcagttgattggaggaggctctcggcaatcgacgtggataaagtggctggagcggtcgatgtcctcactctgcaggaaaacataatgaacattacgttttgtaagttggaagatgagaagtgtccgcattgccaatccggggtagatcctgtgctccttaagctcatcaggctggcccagttcactatcgagtacttgctccactctcaagagtttctcactagtcaactacatactttggaggagcggctgaggctctctcactgcgacggcgagcaatccaaaaaacttctgaccaagcaggccggggagataaagacactcaaggaggaatgtaagaggaggaaaaaaatgatcagcacgcagcaactgatgatcgaagcaaaggcaaattattaccagtgtcatttctgtgacaaagcatttatgaaccaggcgttcctgcagtcccacatacagcggcggcataccgaggaaaatagtcactttgagtatcagaagaacgcgcaaatcgaaaagctgaggtctgaaatcgtggtccttaaagaagagctgcagctgacgcggtctgaattggaagccgcacaccacgcttccgctgtgcgttttagcaaggagtacgagatgcagaagacaaaagaagaggactttctcaaattatttgatcgctggaaggaagaggagaaagagaagctggtggacgagatggaaaaagtgaaagagatgtttatgaaggagtttaaggagctgacaagcaagaattcggccctggagtatcagctatccgaaatacagaaaagtaacatgcagatcaagtctaacattggcacccttaaggatgcccacgagttcaaggaggaccggtcaccctacccccaggatttccacaacgtaatgcaactgctggattcccaggagtccaagtggactgcacgagtccaagcgattcatcaagaacataagaaggagaaaggaagactattatctcatatcgagaaactacgcactagcatgattgatgatttaaatgccagcaatgttttctataaaaagagaattgaagaactagggcagaggttacaagagcagaacgaactgatcattacccagcgtcagcaaattaaggatttcacctgcaaccctctcaattccatctctgagccaaaggtgaatgcacccgccttacatacactcgaaaccaaaagctctctacccatggttcacgagcaggcattctcctcgcacatcctggaaccaatcgaggagttatctgaagaggagaagggcagggagaacgagcaaaaactgaacaataacaaaatgcatctgcggaaagctttaaaatctaattcatcactgacgaaaggactgcgcaccatggtcgagcagaatttgatggagaagctcgaaaccctgggaattaacgccgatataagaggaatttcgagcgatcagctacacagagtacttaaaagtgtcgaatccgagagacacaagcaggaaagagagattccaaacttccaccagattcgcgagtttcttgagcaccaggtgagttgcaaaatcgaagagaaggctttgttatcaagtgatcagtgcagcgtttctcaaatggatactctgtctaccggcgaagtgcctaagatgatccagctgccaagtaagaatcgccagcttattagacagaaggcggttagtacagaccggaccagcgttcccaaaataaagaagaatgtgatggaagatccatttccccgaaagagctcaacgatcactacacctccatttagttcggaggaggaacaagaggatgacgatctgattagagcttatgcctctccgggacccttgcctgtgccccccccccagaacaagggtagcttcggcaaaaacacggtgaaatccgatgccgacggcaccgaggggtctgagatagaggatacagacgattccccaaaacccgctggagttgctgttaaaacccccacagagaaggtggagaagatgtttcctcataggaaaaacgttaataaacccgttgggggaaccaacgttcccgaaatgtttatcaaaaaggaggagcttcaggagttgaaatgcgccgacgtcgaggatgaggattgggatatatcgagcctcgaggaggaaatttccctaggaaaaaaaagcgggaaagagcaaaaggagcctccgcccgcgaagaatgaaccccatttcgctcacgtcctgaatgcttggggggcattcaatcccaaaggccctaagggagagggtctgcaagagaacgaaagtagtactctgaaaagcagccttgtaactgttactgactggagcgacacctctgatgtttag

SEQ ID NO: 24108 - DNA, 4074 bp, Artificial Sequence
  Description of Artificial Sequence: Synthetic coding sequence
atggccgacaccgacctgttcatggagtgcgaggaggaggagctggagccctggcagaagatatccgatgtgatcgaggattcggttgtagaagactacaactccgtggataaaactacgacagcaggcaaccccttagtgcagcagggagggcagcccctgattctcacccagaaccccgcaccagggctagggaccatggtgacgcaacctgtactgcgtccagtgcaagtcatgcagaacgctaaccacgtgacttcttctccggtcgcaagccaaccaattttcatcactactcaggggtttccagtccggaacgtgcggccagtgcagaacgccatgaaccaggtgggaatcgtgctaaatgtgcaacagggacaaactgtgagaccaattactctcgtgcccgcccccgggacgcaattcgttaaacctactgtgggcgtaccccaagtcttcagtcaaatgactcctgttcgacccgggtcaactatgcctgtgagacccacgacaaacacttttaccaccgtgattccagccacattgaccattaggtccaccgtcccacagtctcagagtcagcagaccaaatcaacaccgtcaacctctacaacaccaaccgcaacccagccaacatctctagggcagctcgccgtgcagtcgccaggccagtccaatcaaacgactaatccaaaacttgccccttcattcccatccccccctgcagtgagtattgcaagcttcgtgacagtcaagcgccccggggtgacaggtgagaactccaatgaagtggccaagctggtgaatacactgaatactataccctctcttggacagagtccagggcctgtcgtggtgtctaataatagctccgcgcacggctctcaacggacctcaggtcctgaaagctctatgaaagtaacaagttctattcccgtgtttgatttgcaagacggaggacgcaaaatctgtcccaggtgcaatgcacagttccgggttaccgaggcccttcggggtcacatgtgttattgctgccctgaaatggtcgaataccaaaagaaaggtaagtcgctggatagtgagccctcagtgccttcagccgccaaaccccccagcccagaaaaaactgctccagtcgctagtacacctagctctactcccattcccgctctgagtccccctactaaggtacctgaacctaacgaaaacgtgggagacgctgtgcagacaaaactgatcatgctggtggatgacttttactacggtcgggatgggggaaaagtcgctcagctgaccaactttccaaaggttgcaaccagcttcagatgtccacattgcaccaaaaggctaaagaataatatcagattcatgaaccacatgaagcaccatgttgagctggatcagcagaatggggaggtcgacggacatactatatgtcaacactgttacaggcaatttagtacccccttccaactgcaatgtcatctagaaaatgtacacagcccttacgagtcaactaccaagtgtaaaatctgtgagtgggccttcgagagcgagcccctgttcctgcagcatatgaaggacacccataagcccggagagatgccctacgtatgtcaagtttgccaataccgctcttccttatattctgaagtggacgttcattttcggatgattcatgaagacacccggcatctgctctgtccttactgtctaaaagtatttaagaatggaaatgctttccagcaacattatatgcggcatcaaaagagaaacgtgtaccactgtaacaagtgcaggctgcaattcttgttcgctaaggacaaaatcgagcataaactccagcatcataagacattcaggaagcctaaacagttagagggactaaaacccggtaccaaggtgacaatacgggcatctcgcggccagccaagaaccgtccctgtctccagcaacgataccccaccatcagcattacaagaggctgccccgctgacgagtagcatggatccactgcccgtgtttctgtatccacctgtgcagagaagcatccagaagagagccgtccggaagatgagcgtgatgggaagacaaacctgtttggaatgcagcttcgagatccccgattttcccaaccactttcctacctatgttcactgcagcctttgtcgctacagcacttgctgcagtcgcgcatatgccaaccacatgatcaataaccatgtgccaagaaagtcacctaaatatctcgccctcttcaaaaattcggttagtgggattaagttggcctgtacttcctgcactttcgtgacatctgtcggcgatgctatggctaagcatctggtcttcaatccttcccaccgatcttcatccattctgccccgtgggcttacatggatcgcgcattcccggcatgggcagactcgcgatcgggtccacgatcggaacgtgaaaaatatgtaccctcctccatccttcccgaccaacaaggccgccacagtaaagagcgctggcgccacccctgcagagcctgaggagctgctgaccccactggcccccgctcttcctagcccagccagcacagccacacccccgccaacccccacacaccctcaagcccttgctctgccacccctcgccacagagggagctgaatgtctcaacgtcgacgatcaagatgaggggtcgccagtgacacaagagcctgaactagcctccggcggggggggatccgggggcgtgggaaagaaggagcagctgtctgtgaagaaactgagggtagtacttttcgcactgtgctgtaacacagaacaggccgccgagcatttccgaaatccccagcggaggatcagacggtggttgcgaagatttcaggcttcccagggtgagaatctggaaggcaagtatttgtcattcgaggctgaggagaagttggctgagtgggtattgacacaacgggaacagcagctccccgtgaatgaagagacactgtttcaaaaggctacgaaaattggtcggtccctcgaaggcggctttaagatctcttacgagtgggcagtcagatttatgctgagacaccatcttactccacacgcaaggcgggcagtggctcataccctaccaaaagatgtcgccgagaatgccggactcttcatagattttgtacagaggcagattcacaatcaagacctgcctttgagtatgattgtggctatagatgagatatctctgtttcttgacactgaggtgctgagcagcgatgacaggaaggaaaacgctttgcagacagtcggcaccggggagccttggtgcgacgtggtgctcgcaattcttgccgacggcacagtcttgcccaccctggtgttttatcgtgggcagatggatcagccagccaatatgcctgacagcattttgttggaggctaaggagtccggttattctgatgacgaaataatggaattatggtctaccagagtgtggcaaaagcacacagcttgccagaggagtaaagggatgctcgtgatggattgccaccggacccatctgtctgaggaagttcttgccatgctgagcgcgtcttcaacgctacctgcagtcgttcctgcgggttgctcctctaagattcagcctctagatgtctgcattaagcggaccgtgaaaaacttcctgcataagaagtggaaggaacaagcccgagagatggctgataccgcctgcgactctgacgtcctgctccagctcgtcctggtgtggctgggggaagttctgggcgtgattggtgactgtccagaactggtgcagaggtcctttctggttgcatctgtcctgcctgggccagacggcaacatcaattcaccaacccggaacgcagacatgcaagaggaactcattgcaagcctggaagagcagctcaagctctctggcgagcactccgagagttccacacctaggcctcgcagcagccctgaagaaacaattgagccagaaagcctccaccagctgttcgagggtgaatcagaaacagagtccttttacggctttgaagaggccgatctggacctgatggaaatttag

SEQ ID NO: 24109 - DNA, 2904 bp, Artificial Sequence
  Description of Artificial Sequence: Synthetic coding sequence
atgggccccggccagcccgccagcacctgcgtgcacctggccccccggactcagctggacggaaggagtgacccaaaggtgttgcagacgcaaaaccagctgcagttcaaccgcaatgtgcccacccacagctccaacctcgcgatccgctatagttgcccccacgctattcgcattgaaaaactgaaacatagctataatgagagctaccactgtaaagacgccgactgtagagtaggtcccgacctgggctcatctgtcagtttttctgtgatttcgcaggagcgattgtcttacgccgttcatctggccaggcgtgatgtcaagcgccgccaattcgaaaagcatatcaaggaacaccaccttcgtagccaaccccagtcaagtcaaaagtgtggtcacacgaagtacaaaattcccgatcacagagtggagcgcaaagagagtaagtcacaggcggcgtgtcagtgttctcatcaaccttcaaaagtggaaatctcatcctccggagcaaaggtatacctgtactcgtcgcaccctggtcagagtgacctgaccgttccaaattctccacctacccacgatcccggccttcagcctcatccacggatcggggaccacaaaaatatttctgaacagaaaagcctgctagaagtgcagcgcttacagaaagaactctcttcctgtattcacaaaatcgaagaggtcaccaaaaaggaccggctggaggaagctctggatcccgatgaggagcggcgtatacgaatacggcgtcaagaacaagctgccaggtccgcaaggatgttatacgtgcttcagcagcaggtgaaagaaatacaggaagaactcgacaaactgtcaccccacaaaataaagcatacaaagaaaagctgggcaatgagcaaactcgcggctgctcaccgcggcgccatacgcgccttgcagatgtttgttactcagttcaccgacagaggggaacatcccctgccagcccgatgtaaagagcttgggtcccttattcggcagctatctctctgctctgtcaagctagacgctgatccaagcgtgccggatgtagtgatcgacatcctgcagcagatagaggcattggagagccttctagagaagaagctttcgcctaagaaggtgaagaagtgctttagcgagatccggagtagattccctatcggcagccagaaggccctggagcgctggccttccacttcccccaagggtgagagacgacccctgactgcaaaagatacctttcctcaggaaacttcaagaccatcagtggcaaagcagcttctggctgacaaatatcagcctgatacagagctccctgaaacccaacggctgcaaagcgagctggatgtgttggacgctgatatcgttctcgaggaaggccctttcatcctggaccagtctgcctcgttcaaagatgaagtgttggccgtggccaaaaccaaggctggcaaaaaaaagccagtaactgaaaacgtgccttttaggaagaaggatacccttgcacctgctaggcagcaaggcctgaggaaagcagaaaggggacgccaatctcaacctcatagcaaatcacgggtgcagcagacgaccgtcagcagtaggctcaagatgaaccgtcagcctgttaaagataggaaagcgccgtggatcccaccgaaccctacatctccccccgctagcccaaaatgtgcggcatggctaaaggttaagacatctccccgcgacgcaacaaaggagccactccagcaggaagacccccaggaagagagtcatctgacaggcgctgtcgagcacgaggccgcacgcctggcttggctggacgccgagaccagcaaacggctgaaggaattggaggagttgaaggctaaagaaattgattctatgcagaagcaacgactcgactggttggatgctgagacttcccggaggacaaaggagctgaacgaactcaaagctgaggaaatgtatcgactacagcaattgagcgttagtgccacccatctggctgacaaggtggaagaggccgtcttagaccgcctaaaacctctactggtgaaagcacaaagggttaatagcacaacagaggccaatatccacctgaaagacggctcctcagtgaacacagccaaggcccaaccagcccaggaggtggccgcagtcgattttgagagcaataatatcaggcagctcgacgactttctcgaggactgcgcgtccgagctgtgggctgtgacgcacgctaaaatactgggaagcgagacacttgctaccgtggaggacagcaaggacagcccagacctggagatcatgatgaggcggatggaggaaatggagaaatatcaggagtcagtgcgccagaggtataataagatagcctacgctgaccccaggctgtggatgcaggaagagaacaacgaccagaaaataagcgccatatcagaaaaacccctaagcccacacccaatccgaatcactaagacagtggatcgtaaggatccagccgtgaatataatgctggaacggccttgcaatggaaatagtctggacgaatctgtcggcaccgaagagggctctgagaagagggaggccccgcttctgtctttggccgaggatagccagcaaaaagaaggacgggcgcccctctttgtcccaccggggatgcagcatagtattggagattattgctccagattcgaacagtatctgcgtataattagccatgaggcagtaggttcatttaacccctggctgatcgctgaatcattttctgaggagctggtggacgaggctctgggcgccgtggcagcagaactgcaggatatgtgtgaggattatgccgaagccgtgttcacatcggaatttctggaagccgcaacgtag

SEQ ID NO: 24110 - DNA, 6840 bp, Artificial Sequence
  Description of Artificial Sequence: Synthetic coding sequence
atgtaccggagcagcgcccggagcagcgtgagcagccaccggcccaaggacgatggaggcggcgggcccaggagcgggaggtcctctggttcatcatctgggcccgccaggcgatcaagcccacccccacccccatcgggttctagctctaggactcctgccagaaggcccagaagcccaagtggccatcgaggccgacgagcgtcacctagtcctcccaggggccggcgtgtgtccccttctcctccacgcgcacggagaggcagcccatctcctcccaggggaaggagactttttccgcccggtccagctggattccgcggctcctcccggggcgagtccagagctgactatgcgagagacggccggggtgaccaccctggggacagcgggtcaaggaggaggagcccaggcctgtgctccgattctctcgagaagagcctacgtattacggttgggaatgaccatttctgcgtgtcgacacctgagaggcgaaggttgagcgaccggctgggcagccccgtagataatctcgaagacatggatcgggacgacctgaccgacgacagtgtgttcacgcggtcaagccaatgctctcgaggactggagaggtacatatctcaagaggaaggcccactctccccctttctcggtcagttggatgaagattacaggacgaaagaaaccttcctgcacagatctgactatagtccgcatattagctgtcatgacgagttattgcgcggcacagaaaggaatcgggaaaaattgaagggttactctatccgctctgaggagaggtcccgagaggcgaaaagaccaagatacgatgatacagtgaagattaacagtatgggtggagatcatccttcttttacgagcggcactcgtaactatcgccagcggagaagaagccccagcccccgctttcttgatcctgaatttagagaactcgatctggctaggcgtaaacgggaggaagaggaggaacggtccagatctctgtcgcaagagctcgtcggcgtcgatgggggcggaactgggtgcagcataccagggttgagtggagttttgaccgcctcagagccaggctactctctgcaccgtcctgaggaggtgtcagtgatgcccaagaagtcaattttgaaaaagcgtattgaggtagacatcatggaaccctctatgcagttggagagcttttcctcctcaaccagttcaagtcaagatcatcctctctactccggccatcccagcctccctttatctggggcaatagcagcgttcgcttctgagattgagaataagggcaccatggtggagaccgcgctgaaagagcctcaggggaatctatatcagtgggggcccctaccagggatcccaaaggataactcccctttacgagagaaattcggtagttttctgtgccataaggataacctggacctcaaggctgaaggccccgaacggcacacggacttcctcttgccgcacgaaagggcttcccaagacggatctggctttagcagaatcctctccatgttggcagactccacaagcacccaagagaaaaggcgcaggagcttccccgacattgaggatgaggagaagttcctatatggagacgaagaagaggacctcaaggctgaaagcgttcctaagcccctcgggtcatccgaatctgaggtgatgagacagaaagccagttccctcccttccagtgctccggccgtcaagttggagtcactcgaggagaccaatccagaatatgcaaagattcacgatctgctgaagacgattggattagatatcggagttgctgagattagccaactcgccgcccgcacgcaagagcgactgcacggaaagaagccgtcactccgctcatctgctgaccggagatcttcagtggatcgatacttcagcgccgaccactgcagttctgtggatcaccgcttttccgccgacaggtgcagcagcgtggatcattgcttttccgcagacagacggtcgtctgatccccacaggctagagagcagggaggctcatcatagcaatactcactcaccagaggtgagccatccccatcccccttcacccgtggacccttatctcctcaccaaaaattcccccccattcctcaagtccgaccacccagtcggtcatatttctggaccagaggtggtaggctctggcttccaatctagcgtcgctgtgcggtgtatgttgccctctgcaccatcggcccccatccgtttgccacatacagccgctctaagtcagttccacatgcctcgtgcctctcaattcgccgctgctaggataccccctaactatcaaggcccagccatcccacctgctagctttgacgcataccgccactacatggcttatgcagcctctcgttggccgatgtacccaacgagtcagccctctaatcaccccgtgcccgagccacatagaatcatgcctatcaccaaacaggctacaagatcccgccctaatctacgcgtcatccctaccgtgacgcccgacaaaccaaagcagaaggagtcgcttcgcggcagcatcccagcagcacaagtcccagtgcaagtctcaattccctccttaatcagatataatcccgaaaagatcagcgatgagaaaaatcgggccagccagaagcagaaggtgattgaagagcgggaaaagctgaagaacgatcgggaagcccgtcaaaagaagatgtattacctgcgcacggaactggaacggctccacaagcaacagggggagatgctgcgaaaaaagcgcagggaaaaagacggtcacaaagatccactgcttgtggaagttagccggctccaggataatatcatgaaggacatcgccgagctccgccaggaagcggaggaagcagaaaagaaacagagcgagctggacaaagtcgcacagattcttggcattaacatttttgataaatctcagaagtcactcagcgatagcagagagccaaccgagaaaccaggcaaagccgaaaaatcaaagagcccagagaaagtaagcagcttctctaatagttcctcaaacaaagagagcaaagtgaacaatgaaaaattccgtacgaaaagccctaagcccgccgagagtccgcagtctgccaccaagcaattggaccagccaaccgcagcctacgaatattacgatgcggggaaccactggtgcaaggactgcaacactatctgcggcaccatgttcgacttctttacccacatgcacaataaaaagcatacccagacacttgacccttacaacaggccatgggcatcaaaaacacagtctgaggccaaacaagacgctatcaagagaactgataagatcacagttccagctaaggggagtgaattcctagtaccaatcagcggtttttactgccagctgtgtgaagagttcctcggggacccgattagtggggagcaacacgtcaaggggcaccagcacaacgagaaatataaaaagtacgtggacgagaaccccctgtatgaagagcgtagaaatctcgaccggcaggctggacttgccgtggtgttggagacggagcggcggaggcagtccgagctcaagcggaaattgtccgaaaaacctaaagaagaaaaaaaggaaaaaaaagccaaggcagtaaaggaggtcaaggaggatgataaggttagcgaaaagttggaggatcaattatcagaggggaggaactccccagagaaggctgaaaataagcgtaatacaggaattaagctccagctgaaggaagaggtgaaaaaggagtcccctacctcgagttctttcggcaagtttagctggaagaaaccagagaaagaggaggagaaaagcagtttggtgacgccatcaatttccaaagaagaaatcctagaatcgtccaaagacaaggaggacggtaaaacggaagcaggcaaggcgaaaccaattaaaatcaagttgtcgggcaagaccgtggttgcccacacctccccgtggatgccagtagttactacttcaacccaaacaaaaatccggcccaatctacctataccctccacagtgctccggaagtcttgtagcgccaccatgagcaaaccagccccactgaatacttttctgtcgatcaaatcgtctggtacaactgccaaacctctgccagtggtcaaagaaagttccgccgatttattgctcccgccagacattattagtaaagcgttcggaggggaggaagtgattctgaaaggatccccagaggagaaagtggttcttgccgaaaaatctgagccctcccacctgccagagcaaattctcccaccccctcctccccctcctcccccacctcctccccccccacccgtgattccccatcccgccgctccttctgccgctcaggctaatgcaattttggcgcccgtgaaatctaacccagtcgtctcccagacactttcgccagggttcgttgggcccaacatcctgaatcccgttctgcccgtagctataatggcctctgcacaacccgcagccatccctagcgatgaaaccgctcccggagtgtccgagtctgacagggatcagaccttgtttagcgtccttgtacggccccctccccctctgagcagtgtgttctccgaacaggctaagaaactggaaaagaggaattcatgcctggccactgcaaacgccaaagatctgtacgatatattttattcctcaggggggaaaggggcaccagagacaaagggcgcgcccgaaaccaaactgtctgggggccccttggctaacggagagaactctaatctttcccgcacaaagtcctctgatacttcatccacttcgcccctgaattcatccgcctcacaagaggaactccaccaggacgagggcctggtggctgcgcccatcgtttcaaactctgagaaacctatagcgaagacattggtagccttaggtaaatggtccgtggttgagcatgtcggacctaaatcaactggctctacctatggtttcctgcagcctctgacccgactatgccagagtaggccttatgaaaccataacgcccaaaactgacaccctcgccatctggacctcctccagcttccagagtgacaccagcagagacatttcccccgagaagagcgaactggatctgggtgagcctggcccccctggcgttgaacccccaccacagcttctcgacatccagtgcaaagaatctcagaagctggtcgaaatccatctccgtgaaagcgtcaatcaggacaaggagtcacaagagctgaggaagagtgaagattgcagagaaagcgagatagagacaaacactgagttgaaagaacgcgtcaaagaacttagtgaggggattgtggacgaaggagtgagcacctccataggccctcattcaatcgacgacagtaatttgaatcacggtaataggtacatgtgggagggggaagtaaaacagccgaacctcttaatgatcgataaggaagcagaacagtcgaacaagcttatgactggaagtgagacaccctccaaggtggtgatcaagctgagtccacaagcgtgcagctttacaaaagccaagttagactcgtttctcagcgaagccagatctctgctcaacccacaggacacccccgtgaagatttcagctcctgagctgctccttcactctcctgctcgctctgcgatgtgtcttacagggagtcctcaggagcaaggtgtgtctgtggtgagcgaagagggtctcgaaaactccgctcctgagtcagcaagtagaacatccagatatcgctcccttaagctcaaacgggagcgatctaaggacttccaggtgaaaaaaatctacgaactcgccgtgtgggatgagaataagaagcgaccagagacctgggagtcacccgaaaaacctaagaccgaagccctggagttacaggatgttcatcctgagttgacagtgactattgaatcaaaggcactggaggactttgaagccaccgacctgaaggttgaggagttgaccgcactgggaaatctgggtgatatgccagtggatttctgcaccacacgagtgagtcccgcccaccgatccccgacggtgctttgtcagaaggtatgcgaggagaactcagtaagtcctatcgggtgcaactcctccgatcctgctgatttcgaacctattccaagctttagtggctttcctctcgatagcccaaagacactggtactcgacttcgagactgaaggggagcggaattcccccaaccctaggagcgtgaggatcccgagtccaaatattctcaaaactggtctaacagaaaacgtagacagaggactggggggtctagagggcacacaccaagcccttgacctgctggccggcggaatgatgccagaagaggttaaggagtcctctcaattggataaacaagaatctctgggtttagaattgaaaacaattaatagtgccggcctcggccctagcccctgcctgcccgacctcgttgattttgtcacacgcacgtctggcgttcagaaagataaattgtgctcacctctctctgaaccaggggacccgagtaaatgcagttctctggagctgggacccctgcagctggagatatctaacgccagtacaaccgaagtggcaatcttacaggttgatgatgacagcggtgacccccttaacctggtcaaggcacccgtttccagatcccccccacgggagcaggtgatcgaggataatatggtgccgcagggcatgcctgagcaggagactaccgtgggtgccatccaggaccacactgagtcctctgttcacaactag

SEQ ID NO: 24111 - DNA, 1932 bp, Artificial Sequence
  Description of Artificial Sequence: Synthetic coding sequence
atgggccaggagagcagcaagcccgtgtggcccaaccccaccggcggatatcaatcaaataccggaagaaggtacggtcgccgacatgcatatgtcagttttcgacccccaacctctcagcgtgaaagaatagcttcccagcgaaaaaccaacagtgaagtccctatgcaccgatcggctccatcgcagacaacgaaacggtctaggtctcctttctcaacgacgagacgctcctgggacgattctgaatcatctggcacaaacctcaacatcgacaatgaggactacagtaggtatccccctagggaataccgtgcttccgggtcccgccggggcatggcctacggacacatcgactcatacggagcagacgactcagaggaggaaggagccggtcctgtggagcgtcccccagtgaggggaaagacaggcaaattcaaagacgacaagttgtacgaccctgaaaaaggcgctaggagcctggccggcccaccccctcacttttcttctttcagccgcgacgtgagggaagaacgtgataaacttgacccagttcccgcggcacgttgctcagctagccgggccgacttccttccccagtctagcgttgcttcacagtcgtcctctgagggaaagcttgccaccaagggagacagttccgagcgggagaggagagaacagaacctccctgcacggccttcccgagctccggtgagcatatgcggaggtggagagaatacctcaaagtctgctgaagaaccggttgtgcgcccgaaaatcagaaacttggcttctccgaattgtgtgaagccaaaaattttcttcgataccgacgatgacgatgatatgccccactcaacgtctcgctggagggacaccgcgaacgataacgagggccacagtgacggactggccagaagaggtaggggtgagagctctagcggctacccagaacctaaatacccagaagataaaagggaagcaaggtccgatcaagtaaagccagaaaaagtgccacgacggcggaggacaatggcagatcctgatttctggacacactccgatgactattacaaatattgcgacgaggactcagatagcgacaaggagtggattgcagccctgaggaggaaataccggagccgggagcagacgctgtccagcagcggagagtcatgggagactctgcctggtaaagaggagcgtgagcctccccaggctaaggtgtctgcatcaaccgggacctcacccggccctggggcatctgctagcgcgggcgcaggtgctggcgcatccgctgggagcaatggttccaattatctcgaggaagtaagagagccctccctacaggaagagcaagcctcactggaagaaggtgaaattccatggttgcagtaccacgagaatgactcatcgtcggagggcgacaatgactctggccacgaattgatgcagcccggagtgtttatgctggacggcaacaacaatttggaggacgactcgtccgtgtccgaagatctggaggtcgattggtctctctttgatggttttgccgatggacttggggtggctgaggcaatctcgtatgtggatccccagtttcttacctatatggccctcgaggagcgtctcgcccaggccatggaaaccgctctagctcaccttgaatctctggcagtcgatgtcgaggtggccaacccaccagcttcaaaggaaagcatagatgctctgccagaaattttagtcactgaggatcacggcgctgtggggcaagagatgtgctgtcctatatgctgctccgaatatgtaaaaggagaggtagccaccgagcttccgtgtcaccactatttccataagccatgtgtctctatttggctgcagaaaagtggcacatgccctgtgtgcagatgtatgttcccgccgccattgtag

SEQ ID NO: 24112 - DNA, 1113 bp, Artificial Sequence
  Description of Artificial Sequence: Synthetic coding sequence
atgcccaccgagaccctgcagaccggcagcatggtgaagcccgtgtcacccgccggaacattcaccagtgccgtacctctccggattcttaacaaggggccagactatttcagaagacaagctgaacccaatcccaaacgtctgtccgccgtagaaagactcgaggctgacaaagcaaaatatgtgaaatcacaggaagtaatcaatgctaagcaggaaccagttaagcctgccgtgctggctaagccacccgtgtgtccagcggctaaaagagcactcgggtcaccgacacttaaggtgttcggtaatcatgccaagaccgaaagtggggtccaacgcgaaaatctgaagctggagattctcaagaatatcatcaactcctctgaaggtagcagctccggaagcggccataagcattcaagtcggaactggcctccgcataggtctgaagcgacagatctgcaccggcacagttttgccgaatcgctgaaggtatatccgacccaggggcgccgctctccccaggagggcggctcccacgtcgggcgccgtctactggagcagtccgccgagtcgttcctacatgtgtctcactcttcatccgatattaggaaagtaacctcggtcaagcccctgaaagccattccatgctcgagcagcgctccaccgttgccccctaagcctaaaattgctgccatcgccagtatgaagtctccagaggcagacccagtggaaccggcttgtggggtgtctcgtcgacccagcctacagagatctaagtccgatttgagtgaccgctatttccgcgtagatgccgacgtcgaaaggttttttaattattgtggactcgatccagaggaactggagaacttagggatggagaacttcgccagagccaactcagacatcatctctctaaattttagatctgcctcgatgatcagcagcgactgtgagcagtctcaagactctaacagtgacctacgaaatgatgatagtgccaacgacagggtgccctatgggatctccgctattgagcgtaatgcgcggatcatcaaatggctctattccattaagcaagcacgcgagtcccagaaggtgagtcacgtctag

SEQ ID NO: 24113 - DNA, 3126 bp, Artificial Sequence
  Description of Artificial Sequence: Synthetic coding sequence
atggccgccgccgccgccgccggcgccgccagcggcctgcccggcccggtggcccaggggctgaaagaggctctcgttgatactttgactgggattcttagccctgtgcaggaagtgagagcagctgctgaagagcaaatcaaagtgctggaggtcaccgaggagttcggagttcaccttgcagagctcacagttgacccccaaggcgcacttgcgatccggcagctggccagtgtgatcctgaagcagtacgttgaaactcattggtgcgcacagagcgagaaatttcgacctcccgagaccactgaacgggctaaaatcgtcataagagagctcctgcccaatggcctccgcgaatctattagcaaggtgcggagcagtgtcgcatatgccgttagtgcaatagcccattgggattggcctgaagcttggccccagctctttaacctgctcatggagatgctggtctcaggcgacctcaatgcagtacatggagctatgcgggttctgacggagttcacaagagaggtgacagatacgcagatgccattggtggcccccgtgatcctacccgaaatgtacaagatattcaccatggctgaggtgtatggtattagaactcgctcccgggctgtggagattttcaccacctgtgcacatatgatttgtaacatggaggagctcgagaagggtgcggccaaggttctcatattcccagtcgttcagcaattcacagaagccttcgtccaagcgttgcagatccctgacggccctacgagtgatagtggttttaaaatggaggtgctgaaggcagtgaccgccctcgtgaaaaactttccaaaacacatggtgtcctcaatgcagcagatcctgcctatcgtttggaataccctaaccgagtccgccgccttctacgtcagaacagaagtgaattatacggaagaggtggaagaccccgtggacagcgatggtgaagttttgggctttgagaacctggtcttttccatcttcgaattcgtgcacgcacttttggagaattccaaatttaaaagtaccgttaagaaggctttgcccgagctcatttactacattattctgtacatgcagattaccgaggagcagatcaaggtctggaccgctaacccccagcaattcgtcgaggatgaggacgacgatacgttcagctacacggtgcgaatagcggcccaggatttgctgttagccgtagcaaccgattttcagaacgaaagcgctgcggctctagcggcggcggcgaccagacatttgcaggaagccgaacagacaaaaaattcaggcacagaacactggtggaaaatacacgaggcctgcatgctcgcccttggctcagtgaaggctatcattactgacagcgtcaagaacggccgtatccatttcgacatgcatgggttcctgacaaatgttattttggccgacttaaacctgagtgtgtccccgttccttctgggacgcgccctgtgggccgctagcagattcacagtggccatgagtcccgagctgatacagcagttcctgcaagccacagtgagcggactgcacgagacccagcctccgtcagtgcggattagcgctgtccgggctatttggggttactgtgatcaactgaaggttagtgaatcaactcatgtgttgcagcctttcctgccatccatcttggatggcctcattcatctggcagcgcagttctcatcggaagtactcaatctcgtgatggagacactgtgcatcgtctgtaccgtggatcccgaattcaccgcctctatggagtcgaaaatttgcccatttaccattgcaatttttctgaagtattccaatgatcccgtggtcgcttcgctggcgcaggacatcttcaaggaactcagccagattgaagcttgtcagggtcctatgcagatgagactgatccccaccttggttagcattatgcaggctccagcagacaagatccctgctggcctgtgcgccaccgctatagacattctcacaaccgttgtccgtaacacaaagccaccgctctcacaactgttgatctgtcaggccttccctgccgtcgcacagtgcacattgcatactgatgataatgcgactatgcaaaatggaggcgaatgcttgcgggcgtatgtgtccgttaccctcgagcaggtcgctcaatggcacgacgagcagggccacaacggcctgtggtacgtgatgcaggtcgtgtcccagctcttagaccctcggacaagcgagttcacagcagccttcgtgggcagactcgtttcgaccttaatctcaaaggcgggtcgtgaacttggcgagaaccttgatcagatcctccgcgctattctgtccaagatgcagcaggccgaaaccctctctgtaatgcagagtctcatcatggtttttgcacacttagtgcacactcaacttgagcctctgttggaattcttatgttctctaccggggcctacgggaaagccagccttggagtttgtcatggctgagtggacaagccgccaacacctgttttatgggcagtacgagggaaaggtcagctccgtggcactgtgcaaactgctgcagcatgggattaatgcggatgataagcgattgcaggacattagagtgaaaggcgaggagatttactccatggacgaaggcatccgaacaagatcaaagagcgcgaaaaaccccgaacggtggacaaacattcctcttctcgtgaagattttgaagcttattatcaatgagctcagtaatgtcatggaagcaaatgcagcgagacaagcaacacccgccgaatggtcacaggacgactctaatgatatgtgggaagaccaggaggaggaagaagaggaggaggaagacggactggctgggcaacttctttcagacatactcgccacctctaagtacgaggaagattattacgaggacgacgaggaggacgaccccgacgctctgaaagatcccctctaccagattgatttacaggcgtacctcacagatttcctgtgtcagttcgctcagcagccttgctacattatgtttagtggccacctgaacgacaatgagcggcgcgttctgcaaacgatcggaatttag

SEQ ID NO: 24114 - DNA, 156 bp, Artificial Sequence
  Description of Artificial Sequence: Synthetic coding sequence
atgagcagccacaagaccttccggatcaagcggttcctggccaagaaacagaagcagaacagacccattccccagtggattagaatgaagaccggaaataaaatccgctacaattcaaaaaggagacactggcgccggacaaagctcggactgtag

SEQ ID NO: 24115 - DNA, 3627 bp, Artificial Sequence
  Description of Artificial Sequence: Synthetic coding sequence
atggacagcctgcccgacgagttcttcgtgcggcaccccgccgtggaagaccagaggaaggaagaaactgaaaataagctggagaagtcttccggccagctgaacaagcaggagaacgatattcccaccgaccttgtgccagtgaatctcttgttggaagttaagaagctgttgaacgccattaacaccctgcctaaaggggtcgttccacacattaaaaaatttctgcaagaggacttctcctttcagacaatgcagcgggaggtagctgccaacagccagaacggcgaagaaattgttcccgcattgaccctgcgattcctcatcacacaactcgaagctgctctgcggaatatacaggccggcaattatactgcccaccagatcaacatcgggtactacttgaccctcctattcctgtacggggtcgccctcactgagaggggcaagaaagaagactacacagaggcagagaataagtttctggtgatgaagatgatgatacaggaaaatgaaatttgtgaaaactttatgagcctggtgtactttggtcgaggtcttctgagatgcgcccagaagcggtacaacggtggacttctggagttccataagagtttgcaagaaattggcgacaaaaacgaccactggttcgatatcgacccgactgaggacgaggacttgcctaccaccttcaaggacctgctcaataacttcatcaagaccaccgagtctaatataatgaaacagaccatttgcagttatctagattgtgagaggtcatgtgaggcggacattctgaagaacacctcatacaagggatttttccagctcatgtgctccaaatcttgttgcgtgtacttccataaaatctgttggaagaaattcaagaatctgaagtatccgggtgaaaatgaccagagcttttcaggtaagaagtgtctgaaagagggctgcaccggggatatggtgaggatgctgcaatgtgatgtccccggtatcgtgaaaatactgtttgaagtcgtgcggaaggatgaatacattaccattgagaacttgggggcctcataccggaagctcatctcacttaagataaccgacacagatatcaggccgaagatctccctgaagttcaataccaaagacgagatgcccatatttaagctcgattacaattacttttaccatctcttgcacatcatcatcatctccggcacagacattgtacggcaaatcttcgacgaggccatgccacctccattactcaaaaaggagctactgatccacaaaaatgtgctggaatcctattataatcatctttggactaaccatcctttgggcggcagttggcacttactgtaccccccaaataaggaattgccccaatccaagcagttcgatctgtgtctgctactggccctcataaagcacctcaacgtattccccgcgcctaaaaaagggtggaacatggaaccgccttcgtcagatatcagcaaatccgccgacatactgaggctatgtaaatatcgagacatcctgctgtctgagattctgatgaacggcctaacggagtctcagttcaatagtatctggaaaaaagtgtctgatatcctgctgcggctcggtatgatgcaagaagacatcgacaaggtcaaagagaatcccatagagaatatctccctggactaccaccagctgagtgtgtacctcggcatccccgtgcccgagatcatccaacgaatgttgagctgctaccagcagggaatcgctctgcaatccataaccggatcccagcgcattgagatcgaggaactgcagaacgaggaagaggaactgtcaccaccgctcatggagtataacattaatgtcaaatcccaccccgagatacaatttgcagaaattaataaggacggaaccagcatcccctctgaatcctccaccgaaagtctaaaagatctgcaggaggtcaaaagtaagcagaggaaaaaaaagaagacaaagaacaagaaaaacaaggattccaaagaagaccaggtcccctatgtcgtggagaaggaagagcaattgagaaaggaacaggcaaatcctcacagtgtaagtagacttattaaagatgacgcatcagacgttcaggaagattccgcaatggaggacaaattctactctttggacgagctgcacattctggacatgatcgagcaaggttcagcaggaaaggtgactactgactacggggaaaccgaaaaggagcgtctcgcaaggcaacggcagctgtacaagttgcattatcagtgcgaagactttaagagacagctgagaactgttacctttcgttggcaggagaaccagatgcagatcaaaaaaaaggacaaaatcattgcatcccttaatcagcaagtggccttcggcatcaacaaagtgtccaagttgcagagacagatccatgcaaaagataatgaaatcaagaacctcaaagagcagctgtccatgaaaaggagccaatgggaaatggagaaacataacctagaatcaacgatgaagacttacgtcagcaagctcaatgccgaaacctcacgcgctttgacggctgaggtgtattttctgcaatgccgacgtgattttggcttgctccatcttgaacaaaccgagaaagaatgcctgaatcagctggcccgtgttacccacatggcagccagcaatcttgaaagcctccaactaaaagccgctgtcgacagctggaacgctatagtggcagatgtgcggaacaaaattgctttcctgaggacacagtacaatgagcagatcaacaaagttaaacagggttttgccttgagcacactgccacccgtgcagttacctcccccacctccgtcccctgaaatccttatgcagcaatttcttggcagaccattggttaaggagtccttcttccgccccatcctcacagtgccccaaatgcccgcagtgtgccctggggtcgtatccgctactggacagcccagggccccactcatgactggtattgcatgggccctcccagctccagtcggcgatgccgtgccgccatcagccggactccggtcggacccctctatcatgaactgggaaaggatcactgatcggctgaagaccgcatttccgcagcagactcggaaggaactgactgactttttaagaaaactgaaagacgcgtacggcaagagcctgagtgagctgacctttgacgaaattgtctgcaaaattagccaatttatcgaccccaagaagagccagtctcaggggaaatctgtctccaatgtgaattgcgtgtccccatcacattctccgagccaacctgatgcagcccagcctcctaaaccagcctggcggcctctcacttcccagggcccagccacttgggaaggtgcctcgaacccagatgaagaagaagaggaagaggagccatgtgtgatctgccacgagaatttgagccctgaaaatctaagcgttctgccctgcgcacacaaatttcatgcccagtgcattcgcccatggctcatgcaacaggggacctgccccacttgccggttacatgtgctgctgccagaggagttccccggccatcctagtcggcagcttcctaagatatag

SEQ ID NO: 24116 - DNA, 996 bp, Artificial Sequence
  Description of Artificial Sequence: Synthetic coding sequence
atgagccggcagctgagccgggcccggcccgccaccgtgctgggcgctatggagatgggtcggcggatggatgccccaacctccgcagcagtcactcgtgccttcttagagcgcggtcataccgagatcgataccgccttcgtatatagcgaagggcaatcagaaaccatcttggggggccttggcctgcgcctcggcggttcggactgccgggtgaaaatcgatacaaaagccataccactgttcggtaacagcctcaaaccagattccctgaggtttcagctggaaacctccttgaaaagattgcagtgccccagggtcgacctgttctacctccacatgcccgatcacagtacccctgttgaagagacactccgggcctgccaccaactacaccaggagggcaagtttgttgagctgggtttgagtaactatgcagcctgggaagtagctgaaatttgtacgctctgcaagagtaatgggtggatcctcccgacagtgtaccaggggatgtacaatgctattacccgacaggttgaaactgaactgtttccatgcctgcggcactttggcctgcggttctacgctttcaatccactggccggtggcctgctcactggcaagtataagtacgaggataagaatggcaaacagcctgtaggaaggttttttggcaacacatgggctgaaatgtacagaaatcggtactggaaggagcatcacttcgagggcattgccctggtcgagaaggctctacaggccgcctacggcgcgtccgccccgtctatgacctctgcgaccctgcggtggatgtaccaccactcccaactgcagggagcccacggggacgccgttatactcgggatgagttccttggaacaactggagcaaaatctggcagccgctgaggagggtcctctagaacctgcagttgttgatgcatttaatcaagcatggcacctggtaacccatgaatgtccaaactacttccgctag

SEQ ID NO: 24117 - DNA, 1131 bp, Artificial Sequence
  Description of Artificial Sequence: Synthetic coding sequence
atgagccccgaggtggccctgaaccggatcagccccatgctgagccctttcatctccagtgtggtgaggaacggaaaggttgggttggatgccacgaactgtttaaggatcacagacttgaagagtgggtgtacctctttgactcctggccctaattgtgaccgctttaagctccacataccatatgcaggagagaccttaaaatgggacatcatattcaacgcgcagtacccagaactgcctcccgacttcatattcggggaggacgccgagtttctgccagatccttctgctttgcaaaatctggctagctggaacccatcaaaccccgagtgcctgcttctggtcgttaaggagctggttcagcaataccaccagttccagtgttcccgactgagggaatccagccgtctcatgtttgagtaccagaccctgctagaagaaccacagtacggcgagaacatggagatttacgctggcaagaaaaacaactggaccggcgagtttagtgcccgcttcctcctgaagctccccgtagacttttcaaatatccccacatatttgcttaaagacgttaatgaggatccaggagaggatgtcgccctactatccgtctcattcgaggacaccgaagctactcaggtgtatcccaagctctacctttcccccaggattgaacacgcattagggggatcaagtgctctgcacatcccagccttcccaggaggcggatgcctgatcgactatgtccctcaagtctgccacctcctaacgaacaaagtgcagtacgtaatccaaggctaccacaagcggcgcgagtatattgcagccttcctctcacattttggaacaggagtcgtcgaatacgatgcggagggcttcacaaaattaacacttctgctgatgtggaaagatttctgctttctggtccacatagatctgcccctgttctttcctagggaccagcccacactgacctttcagtctgtttatcacttcactaatagcgggcagctgtactctcaagctcagaaaaactacccatacagtcccaggtgggacggcaacgagatggccaaaagggctaagagagagagtaaccgggatggcgaggaatcttcaagcgcgtag

SEQ ID NO: 24118 - DNA, 1881 bp, Artificial Sequence
  Description of Artificial Sequence: Synthetic coding sequence
atggacgagcaggaggccctgaacagcatcatgaacgacctggtggcccttcaaatgaacaggcgacacaggatgccaggctacgagactatgaagaataaggatacaggacactctaaccggcagagcgacgtgagaatcaagtttgagcataatggcgagaggcggatcatagcatttagccggcctgtgaaatacgaggacgtggaacacaaggttaccacagtgttcgggcagcccctggacctccattatatgaataacgaactgagcattctgctcaaaaatcaggatgacctggataaagccatagatattctggaccgcagctcctctatgaagtcgctccgcatcctgctcctttctcaggacaggaatcataatagtagcagccctcactcaggtgtatcaagacaagttagaataaaggccagtcagtccgcaggcgatataaacacaatctaccaaccacccgagcccaggagtcggcatctgtcagtgtccagtcaaaaccctggcagatcctcaccaccaccagggtatgtgccggaaagacagcagcatattgctcggcaggggtcatacacaagtattaacagtgagggagagttcatccctgagacctctgaacaatgtatgctggacccgctgtcgagcgcggagaatagccttagcggcagctgccagtcacttgatcgcagcgcggattctccttcattccgcaaaagcaggatgtcacgggcgcagagtttcccagataatcggcaggaatactctgacagggaaacccaactgtatgataaaggagtcaaaggggggacctacccacgccggtatcacgtcagcgtgcaccataaagattattccgatgggcgaaggacttttccccgtatccgccggcaccaggggaacttatttacactggtgccttcctcacgctccctcagcacaaatggggaaaatatggggctggctgtccagtatctcgatcctcggggtcggttgagatcagcagatagcgagaatgctctcagcgtgcaggaacggaacgtccctacaaagagcccttccgcaccaataaactggaggcggggaaagctgctcgggcaaggggcctttgggcgggtatatctgtgttacgacgtggataccggccgggagctagcatccaaacaggtgcagttcgatcctgacagcccagagacttccaaagaagtgtcagctcttgagtgtgagatccagcttctcaaaaatctgcaacacgagcgtattgtacaatactatggctgcctgcgggacagggcagagaaaacactgacaatcttcatggaatacatgcccggagggtcagtcaaggaccagctcaaagcgtacggggcactaacagaatctgttacgcggaaatacacccggcagatcttggagggcatgagttatctccattctaacatgatcgtgcatcgtgatatcaagggagccaatatactgcgcgacagcgccggcaacgtcaaactcggcgattttggagcctccaaaagactccagaccatttgcatgtccggaactggtatgaggtccgttactggcaccccatactggatgagccccgaagtgatttcaggcgagggatatggaagaaaggcagacgtttggagccttgggtgtacggtcgttgagatgttgacggaaaagcctccctgggcggagtacgaggccatggcagcaatattcaaaattgccacccaacctaccaacccccagctgcctagtcatatcagtgaacacggacgcgactttttgaggaggatttttgtggaggccaggcagcgtcctagtgccgaggagctgctaacccaccactttgcccagcttatgtactag

SEQ ID NO: 24119 - DNA, 1701 bp, Artificial Sequence
  Description of Artificial Sequence: Synthetic coding sequence
atggacctgcaccgggccgccttcaagatggagaacagcagctacctcccaaatcctctagcttcccccgctctcatggttctggcttcaacggccgaggctagccgtgatgccagtattccatgccaacagccacgtcctttcggcgtgcctgtgtctgttgacaaagacgtgcatataccctttacaaacggttcatacacatttgcctccatgtaccaccgacaggggggcgtgcctggcacctttgcaaacagggatttccccccctcccttctgcacctgcatccacagtttgccccgcccaatctggactgcacccccatctctatgctgaaccattccggggtcggagcttttagacccttcgcctcgacggaagatcgagaaagctaccagtctgccttcaccccagctaaacgcctaaaaaactgccatgacaccgaaagtccccatctccgcttctctgacgcagacggcaaggagtatgacttcgggacacaacttccatcaagtagtccaggtagcctgaaggttgatgatacaggcaaaaagatttttgcggtttctggcctgatctcagatcgggaagccagctcctcccccgaggaccgtaacgatcggtgcaaaaaaaaagccgccgccctgtttgactctcaagcccctatatgtccaatctgccaggtgcttctgagacctagcgaactgcaggagcacatggaacaggagctggagcaattggcccagctgccaagttcaaaaaattcacttctgaaagatgcaatggcaccgggaacgccaaagtccttactgctgtccgcatctattaagagggagggggagtctcctactgcctccccacactccagcgcaacggatgaccttcaccactctgatcgctaccagacattcctccgggtgcgcgccaacagacagaccaggttaaatgctcgaatcggcaaaatgaaacgcaggaagcaggatgagggccagcgagagggttcctgtatggctgaggacgatgccgtggatattgagcacgaaaataacaacagatttgaagagtacgagtggtgtgggcaaaagagaatccgtgcaaccaccttactcgaaggagggtttcgtggatccggatttattatgtgttcaggcaaggagaatcccgactccgatgctgacctggacgtagacggggatgacactttagagtatggcaaacctcagtacactgaggccgatgttatcccttgcaccggcgaggagccgggcgaggctaaggagcgagaggctcttagaggggccgttctaaacggtggaccgccatccacacgaattaccccagagtttagtaagtgggccagtgatgagatgccttccacttcgaacggagagagctctaaacaggaagctatgcagaagacgtgtaaaaactccgacattgagaagattacagaggattctgccgttaccactttcgaggctcttaaagccagggtccgggagctcgagaggcagctgtcccggggagacaggtataaatgcctgatttgcatggatagctatagtatgccactgaccagcattcaatgttggcatgtgcactgcgaggaatgttggctcaggacactgggagccaagaaactctgcccgcaatgtaacacaatcaccgctcctggcgatctgcggcgtatctacttgtag

SEQ ID NO: 24120 - DNA, 456 bp, Artificial Sequence
  Description of Artificial Sequence: Synthetic coding sequence
atggagggctgcgtgagcaacctgatggtgtgcaacctggcctacagcgggaaacttgaggagttgaaggaatccattcttgctgacaagtcgctggcgactagaacagaccaagactctaggacagccctgcattgggcctgctctgccggccacactgagatagtcgaatttctgctgcaactgggggtaccggtcaatgacaaagacgacgcaggctggtctccactgcatattgccgcctctgcaggacgcgatgagattgttaaggctctgctcggcaagggggctcaggtcaacgcagtgaatcaaaacggttgcacacctttacactatgctgcgagcaagaatagacatgagatcgcagttatgcttttagaaggcggagcaaaccccgacgccaaggaccactacgaggcgacagctatgcatagggccgccgctaaggacacgtag

SEQ ID NO: 24121 - DNA, 2220 bp, Artificial Sequence
  Description of Artificial Sequence: Synthetic coding sequence
atgggcttcagcaacatggaggacgacggccccgaggaggaggagcgggttgctgaaccccaagctaattttaatacaccccaggcactgaggtttgaagaacttctggctaatctgctgaacgagcaacaccagattgcaaaggaactttttgagcagctgaaaatgaaaaagccttccgcaaagcagcagaaggaggtcgagaaggtgaagccgcagtgcaaggaggtacatcagaccctgatcttagaccctgcccagagaaaacgcttacaacagcagatgcagcagcacgtgcagctgcttacgcagattcacctgttggcaacatgtaatcccaacctcaacccagaggcctcgtctacgcggatctgtctcaaggagttaggaacatttgcacaatcaagtattgcactgcaccatcagtacaacccgaaattccagaccctgttccagccctgcaatctgatgggagccatgcagcttattgaagatttctctacccatgtcagcattgattgctccccccacaaaacagtcaaaaagacagccaacgaattcccatgtttacccaaacaggtcgcatggatactggctacgagcaaagtatttatgtacccagaactgctgcctgtctgctctctcaaagctaagaatccccaggataaaattctcttcactaaggctgaggacaacctgctggctctggggctgaagcattttgaagggactgagttcctcaaccccctcatttccaagtacctacttacgtgcaaaacagctcggcagttaacagtccggatcaagaatctcaatatgaatcgcgcaccggacaatattatcaaattctataagaaaaccaaacagctgccagttctgggcaagtgttgtgaggaaatacaaccccaccaatggaagccaccgattgagagggaagaacatcgtctgccattttggttgaaggccagtttgccctcaatccaggaggaactacgtcatatggctgacggagcacgcgaggtcggcaacatgaccgggacgactgagatcaattccgaccaggggctggaaaaggacaattccgaactgggctccgaaactcggtatccgctactgctgcccaagggagtggtgcttaagcttaagcccgtcgccgaccggtttccaaagaaggcctggagacagaagcggtctagtgtgttaaagccattactgatccagccaagtcccagcttgcagccgtcctttaacccaggcaagacaccggcacagagcacacattctgaggcaccccccagcaaaatggtgttgaggatcccacaccccattcaacccgcaactgtgttacagacagtacctggcgtcccaccgctcggtgtatccggcggagagagctttgagtctccagcagcactgcctgccatgccaccagaggcaagaacatcttttccattgtccgagtcacagactttgctatctagcgctcctgtgccaaaggtcatgatgccgtcacccgcatcctctatgtttcgcaagccatatgtgcggaggcgaccatctaagcgcaggggggctcgcgcctttcgctgtattaaaccagctcctgtgattcatccggcttctgttatcttcaccgtgccagccaccaccgttaagattgtatcgcttggcggaggctgcaacatgatccaacctgtgaacgccgctgtggcacaaagcccacagaccatccccatcgcaacactactagtcaatccaacaagctttccctgcccattgaatcagcccctcgtggcttcgtcagtgtcccccctgattgtgtcggggaacagtgtgaatcttcctatcccatcgacaccagaagataaggctcatatgaacgtggacatagcctgtgccgtcgcggacggggaaaatgcatttcagggcctggaacctaagttggaaccacaggagctttcccctctctccgctaccgtattccctaaggttgagcattcccctggacccccgcctgtggacaagcaatgtcaagaggggttgtccgaaaacagtgcctaccgatggactgtcgtcaaaacagaagaagggcgccaggcactggagcccttgccacagggaattcaggagtcactcaacaatagtagcccaggcgatctggaggaagttgtaaaaatggaaccggaggacgccacagaggaaattagcgggtttctctag

SEQ ID NO: 24122 - DNA, 1692 bp, Artificial Sequence
  Description of Artificial Sequence: Synthetic coding sequence
atgagccggcccagcagccgggccatctacctgcaccggaaggagtactcccaaaaccttacttccgagcctacgctcctgcaacaccgagtggagcacttgatgacatgcaaacagggttcccaacgcgtccagggcccagaagacgctttgcagaagctgttcgagatggacgcccagggcagagtctggtctcaggatttgattctgcaggtgagggacgggtggctgcagctgctggacatcgaaacaaaggaagaattggacagttacagactggatagcattcaagccatgaacgtggccctaaatacttgttcatacaactcaattctgagcattaccgtacaggagcctgggctgccaggcactagcaccctgttgttccagtgccaggaagtaggcgccgagcggctgaagacctcactgcagaaggcactggaggaagagttagagcagcggccccggctcggtgggttgcaacccgggcaagaccgatggcggggacccgctatggaacggcctctgcctatggagcaggccaggtacttagagcctggaattccccccgaacaaccacatcagcggaccctagaacattccctacctcctagcccccgaccactgcctagacatacgtccgctcgagagccctcagcctttacattacccccaccgagaagatcttcgagcccagaggatccggagcgagacgaggaggttctgaaccacgtcctgcgcgacatcgagctttttatgggtaaacttgagaaggcccaagcgaaaacttcccgaaagaaaaagtttgggaaaaagaataaggatcagggagggctgacacaagcccagtatatagactgctttcaaaagattaaacactccttcaacctcctgggtaggctggctacctggctgaaggaaacaagcgccccagaacttgtccacatcctgttcaagtccctgaatttcatcctagcccgctgccccgaagctggtcttgcagctcaggttatctcccccctcctgacacctaaggccatcaatttactacagagctgcctgtccccgccagaatctaatctgtggatgggtctgggacctgcctggacgacttccagggccgactggaccggcgatgaaccactaccataccagcccaccttcagtgatgactggcagctgccggagccctcatctcaggccccgttaggttatcaagatcccgtctcgctgagacccagtagtccaaagcctgcccagccagccctcaagatgcaggtactgtacgaattcgaagctcgcaatcccagagagcttacggtcgttcagggggagaagctggaagtcctggatcactccaagcgctggtggttagtgaagaacgaggccgggaggtcgggctatatcccttccaacatcctagaaccactgcagcccggcacccccggtacccagggccagagtccaagtcgggttccaatgcttaggctttctagtagaccagaagaagtcacggattggctgcaagccgaaaatttttctacagccacagtgaggacactcggaagcctaactgggtcccagctgcttcgtatacgacctggagagctgcagatgctgtgccctcaggaagcgccaagaatattatcccgcctggaggcagtccgtaggatgctcggcattagcccttag

SEQ ID NO: 24123 - DNA, 525 bp, Artificial Sequence
  Description of Artificial Sequence: Synthetic coding sequence
atgacctgctgccagaccagcttctgcggctaccccagcttcagcatcagtggaacttgcggctcttcatgttgtcaaccatcttgttgcgagacgtcttgttgccagccacggagctgtcagacttcattttgcgggtttccttccttttctaccagcggaacctgttcttcatcttgttgtcagccctcatgctgtgagacttcatgttgccagcccagctgttgtgaaacttcctgttgtcagcccagctgttgtcagatcagctcctgtgggacgggctgtgggatcgggggagggattagctatgggcaggagggttcgagtggcgcggtctccactcgcatccggtggtgccgaccagactccagggtggagggtacatatttgcccccgtgttgcgtggtttcatgcacaccaccctcatgctgtcagcttcaccacgcccaggccagctgctgtcgaccctcttattgcggtcaatcatgttgcagacccgtttgttgttgcgagccgacttgctag

SEQ ID NO: 24124 - DNA, 1173 bp, Artificial Sequence
  Description of Artificial Sequence: Synthetic coding sequence
atgcggggcgaccggggccggggccggggcggccggttcggcagcaggggaggacccgggggcggctttcgccccttcgtgccgcatattccatttgatttttatttgtgtgaaatggcctttccccgcgtgaagcctgcacccgatgaaaccagcttctctgaggcgctgctaaaaaggaatcaggatctggcccctaactccgccgagcaggctagcattcttagtcttgtgacaaagatcaacaacgtgatcgataacttgattgttgcgccaggcacttttgaggtgcagatcgaagaggtgaggcaggtgggaagttataagaaagggaccatgactaccgggcacaacgttgctgatctcgtcgttatcctgaagatcctccccacgctcgaggcagttgccgccttgggaaacaaagtagtcgaaagccttcgggcacaggatcccagtgaagtgctcacaatgctgacaaacgaaacaggatttgagatcagctcctcagatgcgacagtgaagattctgatcacaaccgttcctccaaatctgcgaaagctggaccctgagttacatctggatattaaggtgctccagtccgccctagctgccattcgacacgcgcgctggtttgaagagaacgcttcccagtcgaccgtaaaggtgctgatacgcctgctgaaggacctgcgtatccggttcccgggattcgagcctcttacgccttggatcctcgatctcctcggccactatgctgtcatgaacaatcccactcgccaacccctcgcactcaacgtagcttacaggaggtgcctccaaattctggccgccggtttatttttgcccggttctgtggggataaccgatccctgtgaatcgggaaactttagagtgcacacagtgatgacacttgaacagcaggacatggtctgttatacagcgcagaccttggtgcgcattctcagccatgggggattcaggaaaatccttggacaggagggcgacgcaagttacctggcaagcgagatttctacttgggatggagtgatcgtcactcctagcgaaaaagcctatgagaagccacctgagaagaaggagggcgaggaagaagaggaaaacactgaagagcctccccagggggaagaggaagagtcaatggaaacgcaggaatag

SEQ ID NO: 24125 - DNA, 3606 bp, Artificial Sequence
  Description of Artificial Sequence: Synthetic coding sequence
atgccccggggcgaggcccccggccccggccggcggggcgccaaggatgaagctctgggcgaagaatcgggggagcgttggtcaccggagttccatctgcagaggaagttggcagactctagccattccgaacaacaggacagaaacagggtgtctgaggaactgatcatggtcgtacaggaaatgaagaaatacttcccttcagaaagacggaacaaaccttcaaccttggatgctttgaattatgctctgcgttgcgtgcattccgtgcaggcaaacagcgaattctttcagattctgtcccaaaacggagctcctcaggctgacgtttctatgtactctctggaggagcttgcaacaatagcaagcgaacacacctctaaaaacacagatactttcgtggccgtgttttctttcctctccggtcgccttgtgcacatttcagaacaggctgccctgattttaaatagaaagaaggatgtattggcctcatcacatttcgtagatctcctggcccctcaagatatgagggtgttttacgcccatacggcccgagcccagctaccgttctggaacaactggacgcagcgcgcagcccgctacgagtgcgcccctgtgaagccttttttctgccgcattaggggaggggaagacaggaaacaggaaaagtgccattccccatttcgtatcattccctacctcattcacgtccatcatccggcccaaccagagctggagtccgagccatgttgccttacagttgtagagaaaattcattcaggctacgaggctccccggattcccgtaaataagcgcatttttacgaccacacacacccctggctgtgtcttccttgaggtcgacgagaaagctgtgcctcttttgggctacctgccccaggacctgataggcacttccatcctctcctatctgcaccctgaggaccgctccctaatggttgcaatccaccagaaagtcctgaagtatgcaggccacccacccttcgagcactcaccgattagattctgcacccagaatggcgattacattattctggatagcagctggtcttctttcgttaacccttggtcccgcaaaatctcatttataattggacgtcacaaagttcgcacttctcccctaaatgaggacgttttcgcgactaagattaaaaaaatgaacgataatgataaagatattactgaactgcaagagcagatatataaactgctgctgcagccagtccatgtgagtgtgagtagtggctacggaagtctcggatcaagcggcagccaggagcagcttgtgtcaatcgcctctagctccgaggctagcggccacagagtcgaggagacaaaagcggaacagatgactttacagcaggtgtatgcttccgtgaacaagataaagaatctagggcagcagttgtacatcgagagcatgaccaagagttcctttaaacccgtgacaggcacccggacggaaccaaacggaggtggggagtgcaaaacttttacgtcctttcatcaaacactcaaaaataatagtgtctatacagagccatgcgaggatctcagaaatgacgaacactcccccagttatcaacagattaactgtatcgatagcgtgattagatacctcaaatcctataatattcccgcgcttaagcggaagtgcataagctgcaccaacaccacgagctcctcttcggaagaggacaaacaaaaccataaagcagacgatgtgcaagccctccaagccggccttcaaattcccgccatcccgaaatcggaaatgcctactaatgggcgatcaatcgacacagggggtggcgccccccagattctgagcacagccatgctttccctgggcagtggtatcagccaatgcggttactcaagtactatagtccacgtgcctcccccggagacagcaagggacgctaccctcttttgcgaaccatggactctcaacatgcagcctgcccccttaacctctgaagagttcaaacacgtgggcctcacggcggcggtgctctcagcgcacactcaaaaggaggagcagaactacgtggacaagttccgcgaaaagattctatcatcaccttattctagctacttacaacaggagtccagatctaaagcaaagtatagttactttcaaggggattccacatccaagcaaactaggagcgcaggatgccgtaaagggaagcataagcggaaaaaacttccagaacccccagacagttcatcatctaacacagggtccggcccccgtaggggcgcccatcaaaacgctcagccttgctgcccatctgcggcaagctccccccatacctcaagccccacgttccctccagccgcaatggtgcccagtcaggccccatatctcgtacctgcattcccattacctgccgctacaagtcccggccgagagtatgccgcgcccggcaccgccccagagggcttgcatgggctgccactctcagaagggcttcagccctaccctgcattcccattcccttacctcgatactttcatgacagttttcctgcccgaccctcctgtctgccctcttttgtcccctagcttcttgccgtgcccgtttctaggggccacagccagctccgcaatttccccgtccatgagcagcgctatgtcacctacgctggacccccctccctctgttacgtcccagaggcgcgaggaggaaaaatgggaggcacagagcgaggggcacccattcatcaccagccgctcttctagcccgttacagctgaacttgctccaagaagaaatgccaaggccaagcgagagtcccgatcaaatgcgcaggaacacatgccctcaaactgagtactgcgttaccggaaataatggcagtgagagcagtcctgccaccacaggggccctatctacagggagtccaccacgggagaatccctctcatcccaccgcctccgctctgtctaccggcagcccacccatgaaaaacccaagccatccaacggccagcgctctctcaacaggttcaccaccgatgaaaaaccccagtcaccctaccgcatccactctgtcgatgggccttcctcccagtaggactcctagccaccctacagccactgtactgtcaaccggtagtcccccatcggagagtccctcccggaccgggagcgccgcaagcggttcttccgacagcagcatttatctcacaagttcagtctattcaagcaagatctcacagaacggacagcagagccaagacgtgcagaagaaggagacattcccgaacgttgccgaagaacccatttggagaatgatccgccagacacccgaacgcatcctgatgacctaccaggtgccggaacgcgtgaaggaggtggtgttgaaggaggacctggaaaagctggagagcatgaggcagcaacagccccagttctctcacggtcaaaaggaagagctcgcaaaggtgtataactggattcagagccagactgtaacccaggagattgatattcaggcctgcgtgacctgtgagaacgaagattccgccgacggtgccgccacttcatgcgggcaagtcttagtggaagattcgtgttag

SEQ ID NO: 24126 - DNA, 1296 bp, Artificial Sequence
  Description of Artificial Sequence: Synthetic coding sequence
atgagcgaccagatcaagttcatcatggacagcctgaacaaggagccctttcggaaaaattataacctgatcaccttcgactctctcgagcccatgcaactgctgcaggtcttgtcagatgtcctggccgaaatagaccctaagcaactggtggatattcgcgaggaaatgccagagcaaaccgcaaaacgtatgcttagccttctaggaatccttaaatataaaccatctggaaacgcgacagatatgtcaacattcagacaggggctcgtaatcggaagtaaaccagtaatctatccggttctgcattggttgttgcaacgcacaaacgagttaaagaaaagagcataccttgcgaggttcttgatcaaattggaggtaccctctgaattcctccaggacgaaaccgttgcagacactaacaaacaatatgaggagctcatggaagcgtttaagactctgcataaagagtatgaacagttgaagatttctggattctcaactgcggaaatacgaaaagacatctccgcaatggaggaggagaaagaccagcttattaaacgggttgagcacctgaaaaagcgtgtggaaactgcgcaaaatcaccagtggatgctaaaaattgctaggcagctgagagtggagaaagaacgtgaagagtacctggcccagcaaaagcaggaacagaaaaatcagctgttccacgccgttcagaggcttcaaagagtccagaatcagctcaaatcaatgaggcaagctgcagccgatgccaaacccgagagcctcatgaagcgcctggaggaggaaataaagtttaacctctacatggtcactgaaaagttccccaaagagctcgagaacaagaagaaggagctgcactttcttcaaaaggtggtctctgaacctgctatgggtcatagtgatctcctcgagctggaatccaagattaatgagattaacacagaaattaaccagctaatcgaaaagaagatgatgcggaacgaacccatcgaaggcaagctgtcactgtatcggcaacaggccagtataatctcacgtaagaaggaagcaaaagccgaagagctccaggaggcaaaggagaagctcgctagcctggagagggaagcatccgtgaaaaggaatcagacacgcgaattcgacggcacggaagtattaaaaggggatgagcggcaggatcttacgctgtcacctcggctggaatgcggaggcgtgatcatggcctactgcagtttaaagctcctcggcagcagtgatcccccgacaagcgcgtcctag

SEQ ID NO: 24127 - DNA, 1119 bp, Artificial Sequence
  Description of Artificial Sequence: Synthetic coding sequence
atggccagcagcgccagcgcccggacccccgccggcaagcgggtgatcaaccaagaagagcttagacggctgatgaaagagaagcaacgcttgtctacttcaaggaagcgtattgaatccccatttgcaaagtacaaccggctgggacaactctcctgtgctctctgcaataccccggtgaaaagcgaattactctggcagacccacgtgctggggaagcagcatagggaaaaggtggctgagctcaaaggcgcaaaagaagcgagccagggcagcagtgcctcttcagcaccacattcggtcaaaagaaaagcccctgatgcagacgaccaggacgtcaaaagggctaaggctactctcgtaccccaggtacaacccagtacatctgcttggaccacaaactttgacaagattggcaaagaatttatcagggccacccctagcaaaccttccggcttaagtctgctccccgattacgaagatgaggaagaagaagaagaagaagaagagggggatggcgaacgcaaaagaggggatgccagcaagcctttaagcgacgcgcagggcaaggaacactcagtaagtagcagcagagaggttactagctcagtgctgccgaacgatttttttagcaccaaccctccaaaggcaccaataattccccacagtggctccatcgagaaggctgaaattcacgaaaaggtggtggagaggagggagaataccgcggaggccctcccagagggattttttgatgacccggaggttgacgcccgcgttagaaaggttgatgctcctaaggaccagatggataaggagtgggatgagtttcaaaaagctatgcgacaggtaaatactattagtgaagcaattgtggcagaagaagacgaagagggtagactggatcggcagattggtgaaattgatgagcaaattgaatgttacaggagggttgagaagttacggaacagacaggacgagataaaaaacaagctgaaagaaatcctgaccatcaaagaactgcagaaaaaagaggaagagaacgcagactccgatgatgaaggggagctgcaggacttgctttctcaggattggcgcgttaagggggctcttctgtag

SEQ ID NO: 24128 - DNA, 1782 bp, Artificial Sequence
  Description of Artificial Sequence: Synthetic coding sequence
atgagccggcccagcagccgggccatctacctgcaccggaaggagtactcccagaacctcaccagtgagccaactctgctgcagcacagagtagagcacctgatgacgtgtaaacagggttctcagcgggttcagggccccgaagatgccttacagaaattgttcgagatggatgcccagggtagggtttggagccaggatctgatcctgcaagtgcgcgacggctggctacagttgttagacatcgaaactaaagaggagctggactcttatagactagactcaattcaggcaatgaacgtggccctgaacacatgcagctacaattccatcctgtcaataacagtccaggaaccagggctcccaggaacctctacgctgttgttccaatgccaggaggttggggcagaaagacttaagaccagtctacagaaagctctcgaggaagaactcgaacagcgcccgcgcctggggggactgcaaccaggtcaggaccgctggcgcggtccggccatggagcgccccctccccatggagcaggccaggtatctcgaacccggaattcctccagagcagcctcatcagaggactcttgagcactccctccctccctcccctaggcccttacctagacacacctctgctagagagcctagcgctttcaccctgccaccccctcggcgttcaagttcacccgaagaccctgagcgcgacgaagaagtcttaaaccacgtcctgcgggacatcgagctgtttatggggaaactggaaaaagcccaagcaaagacctcgaggaagaagaagttcggaaaaaagaacaaggatcaaggtggcctcacccaggcccagtatatagactgtttccagaagattaagcacagcttcaacctcctcggaaggctagcgacttggctgaaagaaacgtcagcacctgagctcgtccacatcctgtttaagagcctgaatttcatcttggctcggtgtcccgaggctggactggccgctcaggttattagtcctctgcttacaccaaaagctattaatctgctccagtcttgcctgagtccccctgagagcaatctctggatggggcttggtcccgcctggactactagcagagccgattggactggagatgaacccctcccatatcaacctacctttagcgatgactggcagctgcccgaacccagctctcaggcaccactgggctatcaggaccccgtctcattgagacgagggtcccacagattaggttccacctcacactttcctcaagaaaagacacacaatcatgatccccagccaggggatcctaactcgagaccgtcaagcccaaagcctgctcagcccgcgctgaagatgcaggtgctctacgagtttgaggcacgtaatccacgagagctgaccgtggtgcagggggaaaagctggaggttttagatcactccaaacgatggtggctggtcaagaacgaggcagggagaagtgggtacatcccaagcaatatcctcgaaccgcttcaacccggcacacccgggacgcagggacagagtcctagtcgcgtccccatgcttcgtctgagctccaggccagaggaggtgacagattggctgcaggccgaaaatttctctacggccaccgtaaggaccctgggcagtcttacaggcagtcaactactgcgcatcagaccgggggaactgcagatgctgtgcccccaggaggcaccgagaattcttagtcgacttgaagccgtgcggcggatgcttgggatttccccctag

SEQ ID NO: 24129 - DNA, 1050 bp, Artificial Sequence
  Description of Artificial Sequence: Synthetic coding sequence
atgaagctgaccagcgagaagctgcccaagaaccccttctacgcctctgttagccagtatgcggcaaaaaatcagaagtttttccagtggaagaaggagaaaaccgaaagcgattacacgcatgctaatctggtggacaaagccttgcaacttctcaaagaaaggattcttaaaggcgatacactggcctattttctccgcggccaactttatttcgaggagggttggtatgaggaagccttggaacagtttgaagaaattaaggaaaaagaccatcaggctacctatcagctgggagtgatgtactacgacggcctcgggactaccctcgatgccgaaaagggagtggactatatgaagaagatcttagattcaccgtgtcctaaagccaggcacctgaaatttgcagcagcatataatttgggcagggcctactatgagggaaaaggcgttaagcgctccaatgaagaggctgaaaggttgtggttgattgcagcggataatggaaatccaaaggcatccgtcaaagcgcagtccatgttgggtttatattattccactaaggaacccaaggagctcgagaaggccttttattggcactctgaggcgtgtggtaatggaaacctcgaatctcagggcgcactgggcctcatgtacctttacgggcagggaatacgacaggacacggaagcagctcttcaatgtcttagggaggcggcagaacggggaaatgtgtacgcacaagggaacctggtggagtattattataaaatgaagttcttcactaagtgtgtcgccttctctaagcgcatcgcagattatgatgaggtgcacgacatccccatgatcgctcaggtgaccgattgccttcctgagttcattggccggggaatggcgatggcttcgttttatcacgcacggtgtctgcaactgggcctgggaattaccagagatgaaacaaccgccaaacactactacagtaaagcctgtcgcctgaacccagcactggccgacgagctgcatagtctgctgataagacagcggatctag

SEQ ID NO: 24130 - DNA, 1236 bp, Artificial Sequence
  Description of Artificial Sequence: Synthetic coding sequence
atgggcctgaagaagatgaagggcctgagctacgacgaggccttcgccatggccaacgatcccttagaggggttccatgaggtgaacctggcaagtcccacatccccagacctgcttggagtttatgaaagtggcactcaggagcaaactacgtccccttctgtcatctaccgaccacatcctagcgcactgagtagcgtccccattcaggcgaacgctctggacgtaagcgaacttccaacacagcccgtatatagcagccctcggaggttgaattgtgccgagattagctctatatcctttcatgtaactgaccctgccccatgtagcacatctggcgtgactgccgggctgaccaagctgactactaggaaagacaactacaacgccgaacgagaattcctccaaggcgcgacaattactgaggcatgtgacggttccgacgacatctttgggttatctactgacagcctgtctaggctccgatcaccatctgttctggaagtgagggagaagggatatgaaagactcaaggaggagctggcaaaggcacagagagaactgaagctgaaggatgaggaatgcgagcggctcagtaaggttcgagaccagctgggccaggagttggaggagctgaccgcatccctattcgaggaggcccacaagatggttcgagaagctaatattaaacaggccacggccgagaagcagctgaaggaggcgcaggggaagatagacgtgctccaggcagaagtcgcagcccttaaaactctggtgctcagttcaagccctacatcgccaactcaggaaccactccccggtggaaaaactccatttaaaaaggggcacaccagaaacaagagcactagttccgccatgagtgggtcacaccaggatctgagtgtgattcaacctatagtgaaggactgcaaggaagccgatctgtccctgtataacgagttccgcctttggaaggacgagcccaccatggacagaacctgtccattcctggataaaatttaccaagaagacatattcccttgcctcaccttttctaagtcggagctggcaagcgcagttctggaagctgtagagaataacacactctcaatcgagcctgtgggtttgcagcctatcaggtttgtcaaggccagcgctgtggaatgtgggggacccaaatccctcctgtacgtgacattcttacatacctttgacaccttctcaagagattcttag

SEQ ID NO: 24131 - DNA, 2148 bp, Artificial Sequence
  Description of Artificial Sequence: Synthetic coding sequence
atgttcggccggaagcggagcgtgagcttcggcggcttcggctggattgataagactatgctagcatcgctcaaagtaaagaagcaggaactcgcaaacagttcggatgccaccctaccagatcgccctcttagcccaccattgacagcacctccaaccatgaagtcctcggagttcttcgagatgcttgagaaaatgcaagacgactacattccgtacccgtcaatagatgaagtggtcgagaagggtggcccatacccgcaggtgatcctgccccagttcggggggtattggatcgaagaccccgaaaacgtgggcacacctacatcgctgggatctagcatatgtgaggaggaggaggaggataacttgagccctaacaccttcggatacaaattggagtgtaaaggggaagcacgagcgtatagacggcatttcctgggaaaagaccacctcaacttctactgcaccggatcctcgttaggtaatctgatcctttccgtaaaatgcgaggaagccgagggcatcgagtatctgagggtgattctgcggtctaagctaaaaaccgttcatgagagaattccccttgccgggctgagtaagcttccatccgtgccacagattgccaaggctttctgcgacgatgctgtgggcctgcgatttaaccctgtgctgtatcccaaagcctcccaaatgatcgtgagctacgacgaacacgaagtcaacaatacgtttaagtttggtgttatatatcagaaggcccgacagactttggaagaagagctgtttggcaataatgaggaatcacctgctttcaaagaattccttgatctgttgggagatactattactctccaggattttaaggggtttcgcggcggcttagatgtgacacatggacaaaccggagtcgaaagtgtatacacaacatttagagacagggagattatgtttcatgtttccactaagctcccattcacagatggcgatgctcaacagctgcaacggaagcggcatataggtaacgacattgtggctatcatattccaggaagaaaacacaccattcgttcctgatatgatcgcctctaacttcctgcacgcttatattgtggtccaggttgagacccccggcacagagacgccttcctataaagtgtcagtcaccgcacgcgaagacgtgcctacatttggacctccactgccctcaccaccagtattccagaagggccctgaatttcgggaatttctgcttaccaaattaactaacgccgaaaacgcttgctgtaagtccgacaaatttgccaagctagaggatcggacacgagcggcactgctcgacaatctccacgatgaacttcatgcccatacacaagcaatgctggggctcggaccagaggaggacaagttcgaaaatggtggccacggcggattcctggaaagcttcaaacgggccatacgcgtgcggtctcactcgatggagacaatggtgggaggacagaaaaagtctcattccggaggcattccagggagtctcagtggcgggatctcacacaactccatggaggtgacaaagaccaccttttccccacctgtcgtcgccgctaccgtcaagaaccaatcaagatcacccatcaagaggcgatccggacttttccctaggctacacaccgggagtgaaggccagggggactctcgcgcccggtgtgacagcactagcagcactcctaaaactcctgatggtgggcattcgtctcaggagatcaaatccgagacatctagtaacccaagttctccagagatctgtcctaacaaagagaaaccctttatgaaactgaaagagaatggcagggctatctcccgctcttccagcagcactagttctgtatccagcactgctggtgagggtgaagcgatggaagaaggggactcaggaggcagccagccatcgacgacaagtccctttaagcaagaggtgttcgtctattcgcctagtccaagctctgagtccccatccctgggcgccgccgcgactcccattatcatgagccggtccccaacagacgcaaaatccagaaactcaccccgatccaatctcaaatttaggtttgataaactctctcatgcatcctcgggagctgggcattag

SEQ ID NO: 24132 - DNA, 2271 bp, Artificial Sequence
  Description of Artificial Sequence: Synthetic coding sequence
atggaggaggagctgaagtgccccgtgtgcggcagcctgttccgggagcctattattctgccttgctcacacaacgtctgcctgccatgtgctaggacaatcgcagtgcagacccctgacggtgagcagcacttgccgcaacctcttctgctgtcccggggaagtgggcttcaggcaggagccgccgccgcagctagtcttgaacatgatgccgctgctggacctgcatgtggcggcgccggggggagcgccgcgggtgggctgggcggaggcgcaggcggcggaggagatcacgcagacaagttatctctgtactcagagactgattcaggctatggcagctacaccccttctttgaagagcccaaatggcgtcagagttctgccaatggtgcctgctcccccagggtcttcagcggcagcggcaagaggggctgcttgtagctccctgagctctagttctagcagcataacctgtcctcagtgtcatcggtcagcttccctcgatcaccgaggcctccgcggttttcagcggaataggctcttggaggctatagtgcagcgctatcaacaaggaaggggtgcagtccccggcacatccgcggcagctgctgtcgctatctgtcaattatgcgatagaaccccgccagaaccggctgctactctatgcgaacagtgtgacgttctttattgttcagcctgccaactgaagtgtcatccgtcacgaggaccttttgccaaacacagacttgtgcagccccccccgccgcccccgccgcccgcagaggcagcaagcggacctactggcacggcacagggtgcgcccagcggcggtggcggatgcaagtctcccgggggtgctggcgctggggccacaggcggatcgacggcaagaaaattcccaacttgccctgagcacgagatggagaactattccatgtactgtgtctcctgccgcactccagtgtgctatctgtgcttggaagagggccggcacgcgaagcacgaagtaaagccccttggggccatgtggaagcagcacaaggcccagctttcccaggccctcaacggagtgtcggacaaggctaaggaagcaaaggagttcttggtccagttgaagaatatcctgcagcagatacaggagaacggcctggattacgaggcctgcttggtggcccaatgcgatgctctagtggatgctctcacacggcagaaagccaaactgcttacaaaggtgaccaaagagcgtgagcataaactgaaaatggtgtgggaccaaatcaatcactgcacgctgaagcttcggcagtcaacgggcctcatggaatactgtctggaggttatcaaagagaacgatccgtcaggcttcttacagataagcgacgctctgatcaagagggtccaggtttcgcaagagcaatgggttaagggggccttggagcctaaagtatccgccgaattcgacctgacgctggactcagagccgctattacaggctatccatcagctcgacttcatccagatgaagtgccgagtacctcccgtccccctgcttcaactcgagaagtgctgtacaagaaataatagcgtcaccctggcgtggaggatgccccctttcactcactctccagtggacggatatattctggagcttgacgacggggcgggcggccagttccgagaggtttacgtcgggaaggagactttgtgtacaatagacggcctgcacttcaatagtacctacaatgccagggttaaagccttcaacagtagcggcgtaggaccttactcgaagacggttgtcctccagactagtgatgtggcctggtttacattcgaccccaacagcggacacagggacatcattctctccaacgataaccaaaccgcaacttgcagtagctatgacgaccgggtggttttgggcacagctgcattttctaagggcgtccattactgggagctgcacgtggaccgctatgacaaccacccagaccctgctttcggcgtggcacgcgcttccgtggtcaaagatatgatgctgggtaaggatgacaaagcctgggccatgtacgtggacaacaataggtcgtggtttatgcattgtaacagtcacacaaacagaacggagggaggcgtgtgtaaaggcgcgaccgttggcgtgctgttggacctaaataagcacaccttaacatttttcattaatggccagcagcaggggcctaccgcattcagccatgaggtccagccctccgtgacaagcttgttctag

SEQ ID NO: 24133 - DNA, 2352 bp, Artificial Sequence
  Description of Artificial Sequence: Synthetic coding sequence
atggaggaggagctgaagtgccccgtgtgcggcagcctgttccgggagccgatcattctgccctgtagtcacaatgtgtgtttgccctgtgcccggactattgcggtccaaacaccagacggcgagcagcatctgccccagcctctgctgcttagccgaggctcgggtctgcaggcaggcgccgcagcggcagcttcactcgagcacgacgctgctgcaggtccagcttgcggaggcgccggggggtctgctgccggtggtttgggcgggggcgctggcgggggtggcgatcacgccgacaagctgagcctatatagcgagacagatagcgggtacggctcatataccccctccctgaagtcccctaatggcgtcagagtactgcctatggtgccagccccacccggcagctctgccgccgctgcccgcggggcagcctgcagtagcctttcctcttcctcatccagcatcacgtgtccgcagtgtcatcgttcagctagcttggaccaccgcgggctccggggcttccaacggaaccgcctgctggaagctattgtgcagaggtaccaacaaggcagaggtgccgttcccggcacttcagccgccgcggcagtcgccatttgtcaactttgtgatcgcactccgcccgagccggccgcaactctctgcgagcagtgtgacgtgctctattgcagtgcctgtcagcttaaatgccatccgtcacggggcccattcgccaaacaccggctggtgcaacctcctccaccccctcctccccccgctgaggccgcaagcggccccaccggaaccgcccagggggcgccgtcagggggcggaggttgcaaatccccgggaggcgccggcgcaggcgccactgggggatctaccgcccggaagtttcctacttgtccagaacatgagatggaaaactacagcatgtactgtgtctcttgcaggacaccagtctgttatctctgcttggaggaaggccgccatgccaaacatgaggtcaagcctctgggcgctatgtggaagcagcacaaagcccagcttagtcaggccctaaacggggtctctgataaagccaaagaggccaaagagtttcttgtgcagctgaagaacattctgcagcagatacaggagaatggcctggattatgaggcgtgcttggtggcacagtgtgatgcgctcgtggacgccctgacgagacagaaagcgaagctcctgacaaaggtgaccaaggaacgcgagcacaaactgaagatggtgtgggaccaaatcaaccactgtactctgaagctccggcagtcaacaggcctcatggaatactgtctggaggtgattaaagaaaatgatccctccggcttcttacagatcagcgatgcactcatcaagcgggtccaggtgagtcaagagcagtgggtaaagggtgccctggagcctaaagtgagtgctgaatttgatcttacacttgacagcgaaccactgcttcaagctatccatcagttggatttcattcagatgaaatgtcgcgtccctccggtgcctttactacagctggagaaatgttgcacgcgtaacaattctgtcacattggcatggaggatgcctccttttactcactctcccgtggacggctacattctcgaactcgatgatggagctggtggccagttccgggaggtgtatgtagggaaggaaacgttatgtactatcgatgggttacattttaacagcacatataacgcaagagtaaaagcattcaacagcagcggggtcggtccttattctaagacagtagttctccagacaagcgacgtggcttggttcacgtttgaccctaattccgggcaccgagacatcatactgtcgaatgacaatcagaccgccacatgctcttcatacgatgacagagttgtgctggggaccgcggctttctctaagggagtccattactgggaactgcacgtagatagatacgataaccaccccgaccccgcttttggcgtcgctagagcctctgtagtgaaggacatgatgctggggaaagacgataaagcctgggcaatgtatgtggacaataacaggtcatggtttatgcactgcaattcacataccaatcgtacggaaggcggagtttgcaagggcgctacagtcggtgttctgctcgatctcaataagcatacgctgacatttttcattaacggacagcaacaagggcccaccgccttttcacacgtggacggggtcttcatgccagctcttagtctgaatcggaacgtccaagttaccctacataccggcctcgaggttccgactaacctcggcaggcccaagctgtcaggcaactag

SEQ ID NO: 24134 - DNA, 471 bp, Artificial Sequence
  Description of Artificial Sequence: Synthetic coding sequence
atggtgcccgtgttcaccagcagcgccctgcccgtgaaggacgtggaggacaagcccgagcagcagactcgaacccgggaaacggacaagagcccaacgagcacagaaccaagacagcagcctagtgctctgttcgcccgagggaaccggaaagccgtcaagtcaccccagcgttcatcatccaagatcaaagagaataagcatccatttgccttgtacggttggggagaaaaacagacagacactggatctcaaaaaactcacaacgtatgcgcctctgcacccgtccatgagattcacgagtccgccctcagagctaagaaccgcaggcaagtagagaagcgcaaactggtcgctcaaaggcagagggctcacagcgtggacgttgaaaagaataggaaaatgaaggcgtcatccagtgaaaatccttggatgaccgagtacatgagatgctactccgcccgagcctag

SEQ ID NO: 24135 - DNA, 813 bp, Artificial Sequence
  Description of Artificial Sequence: Synthetic coding sequence
atgagccccggcagcggcgtgaagagcgagtacatgaagcggtaccaggaacctagatgggaagagtacggcccatgttatcgcgagctgctgcactatagacttggacgtcgcttacttgagcaggcccacgccccatggctgtgggacgactggggtccagcaggtagcagtgaggactcagcatccagtgaatcatcaggggccgggggtcccgccccacggtgtgcaccaccatcacctcccccccctgttgaaccagccactcaggaggaggccgaaaggcgtgctcgcggggccccggaagaacaggatgctgaggccggcgacgcagaggccgaagacgctgaagatgctgccctgcccgccctcccggtcaaagatgtagaggataagcctgagcagcagacccgcactcgggagacagacaagagccccacatctacagagccccgccaacagccatcagctctgttcgcccgcggaaaccggaaggctgttaagagtccccagcgttccagcagcaaaatcaaagagaataagcatccattcgcactctacgggtggggagaaaagcagacggacaccggttcccagaagacacataacgtgtgtgcctcagctcccgtccatgaaatccacgaatctgcactgagggctaagaacagacggcaggtggagaaaagaaaactggtcgctcagagacagagggctcactctgtggacgtggagaaaaacaggaagatgaaggcaagcagttcggaaaacccttggatgactgagtacatgaggtgctactccgcccgtgcatag

SEQ ID NO: 24136 - DNA, 1158 bp, Artificial Sequence
  Description of Artificial Sequence: Synthetic coding sequence
atggccgcccccgacctgagcaccaacctgcaggaggaggccacctgtgccatatgtctcgactacttcaccgatcccgtcatgacggattgcggccataacttctgccgggagtgtatccgtcgctgctggggacagccagagggcccttacgcatgcccagagtgtagagagttgagcccacaacggaacctgaggcctaacaggcccctggccaagatggctgagatggccagacgtctgcatccaccatcccccgtcccgcagggcgtgtgcccagcacaccgggaaccgttggctgcgttttgtggtgatgagttgaggctcctgtgcgccgcttgtgaacgcagtggcgaacattgggcccacagagtaaggcccctccaagacgccgctgaagatctgaaagccaagcttgaaaagtcattggagcatctgaggaaacagatgcaggacgcgctgctgttccaggcccaggcggacgagacttgcgtgctgtggcagaagatggtggagtcacagcgacagaatgtgctcggagaattcgagcggctacgcaggctattagctgaggaagaacagcagttgctgcagcgtctcgaggaggaggaactcgaagtgctgcctcgcttaagagagggggccgcacacctagggcagcagtctgctcaccttgcggagttaattgccgaactggaggggcggtgccaactcccagccctgggtttactgcaggatatcaaggatgctttgcggcgcgtacaggatgtcaagctccaaccccctgaggttgtgcctatggagttacgaaccgtgtgtagggttcccggtttagtagaaacactgaggagattcagaggcaggtgcggagggcctcgctggggtgatgattcacggcgaggtcccgctaaagatttgggctcacagcccagagtcctctgtcctgcgactgcttcttccaaattgactgtttcctggtggtgggtggttggaaagacgagtagcgcccatacttcagatatttcatgcgttggaatatttacaccaaacaacagcagcacctctgggaacgaactgggtatccagggctttcattccgcgctgaaccgcatagcctcagcagatactaccggcgtgtccaccgacccaacagactag

SEQ ID NO: 24137 - DNA, 1251 bp, Artificial Sequence
  Description of Artificial Sequence: Synthetic coding sequence
atgcccctgtacaacgacagcttccacgagatcagccacaagggccggcggcatactttagtcctgaagtccatccagagagcggacgctgggatcgtgagggcgagcagcctgaaggtgtctacttccgcccggttagaagtgcgggtgaagcccgtcgtgttccttaaggcccttgacgatctcagcgcggaggagcgaggcacattggctctgcagtgcgaagtgtcagatcccgaggcacacgttgtttggaggaaggacggtgtgcaactggggcccagcgacaagtacgattttctgcacaccgccggaaccagagggcttgtggtgcacgatgtctctcccgaggacgctgggttgtacacttgccacgtgggatcagaggagactagagcacgggtgcgtgtccacgacctccacgtcgggatcaccaagcgtttgaagacaatggaagttctcgaaggagagagttgttccttcgaatgtgtgcttagccatgagtccgcatctgatccagcgatgtggaccgttggaggcaaaaccgtcggttcctccagccgctttcaggctactaggcaaggcagaaaatacattctggtggtgcgggaagctgccccgagtgacgccggggaggtagtattttctgtgcggggcctgacaagtaaggccagcttgatcgtgcgggagaggccagctgcaatcattaaacctctagaagaccagtgggtggcccccggcgaagatgtggagctgcgttgtgagctctctcgtgcaggcactcccgtgcattggttgaaggacagaaaagccataaggaagagccagaagtatgatgtagtatgtgaaggcacaatggccatgctggttatccgcggagcttctctgaaagatgccggtgagtatacatgcgaggttgaggcatcaaagtcaacagcgtcattgcacgtcgaagaaaaggctaattgttttaccgaggaattgaccaacttgcaggtcgaggagaaaggaactgctgtgttcacttgcaagacagagcaccccgcggcaaccgtgacctggagaaagggtcttctcgaactcagggcctccgggaagcaccaaccgagccaagagggcctaacccttcgcctgacaatttctgccttggagaaagcggactctgacacatatacgtgtgacatcgggcaggcccagagtagagcgcagttgctcgtgcaaggggaagctgctaagtgcgcacgcgcctag

SEQ ID NO: 24138 - DNA, 2130 bp, Artificial Sequence
  Description of Artificial Sequence: Synthetic coding sequence
atggagaagcaccggggcgtgctggagtgccaggtgagccgggcctcagctcaggtgagatggtttaaaggaagccaggaacttcaaccggggcccaaatatgagctggttagtgatggtttgtatagaaagttgattatctctgacgtgcatgcagaggacgaagatacctacacctgcgatgccggcgacgtgaagacaagcgctcagtttttcgttgaggagcagagtattactatcgtcaggggtcttcaggatgtgacggtcatggaaccagcccccgcatggttcgagtgtgagacttcaatcccttcagtccgccctcccaaatggttgttagggaaaaccgtcttacaggcgggcgggaacgttggtctcgaacaagagggcactgtgcatcgcctaatgctgagaaggacctgtagcacaatgacgggtcctgtgcactttactgtaggaaagtctcggtcaagcgcacgactggtggtgagcgacatccccgtggttctcactagacccctggagccaaagacaggcagggagttacagtcggtggtgctgtcatgtgatttcagacctgctcccaaggccgttcagtggtataaggacgacacacctctgtctccctccgagaagtttaaaatgtctctggaggggcagatggctgaactacgcattcttcgcttgatgccggccgatgctggcgtgtatagatgccaggcaggcagtgcacattcatccacagaagttactgtggaagcaagggaagtgaccgttaccggaccccttcaggacgcggaggcgacagaggagggctgggcttctttcagttgcgaactctcacatgaggacgaggaggtcgagtggagtcttaatgggatgccactttataacgattcttttcacgaaattagccacaaaggcaggaggcacactctcgtgctgaagtccatccagcgagcggatgctggaatcgtccgcgcaagctccttgaaagtctccacctccgcacggttagaagtgagggtcaagccggtcgtatttcttaaggctctcgacgacctctctgcagaggaaagaggcacgctcgctctccagtgtgaggtgtccgatcccgaggcacatgtggtgtggaggaaagacggggttcagctgggcccatcagataagtatgatttcctgcacacggcgggcacccggggcctcgtagtccacgacgtgtctcctgaggatgccggtctctatacatgtcacgtaggaagcgaggagaccagggcacgagttcgggtgcacgatctgcacgttggcattaccaagagactcaaaaccatggaagtactggagggagagtcttgcagctttgagtgtgtgctctcgcacgaatcggctagtgacccagccatgtggactgttggaggaaagaccgtgggctcctcctctaggtttcaggctaccaggcagggcaggaagtatattctggtggtacgagaagccgccccctccgatgcgggcgaagttgtcttctcagttagagggctgacatcaaaggccagtctgatcgtgcgcgagcggcccgccgcaattatcaaacctctggaagatcaatgggttgcccctggggaggacgtggagctcaggtgtgagctcagtagagccggcacccccgtgcactggttaaaggacaggaaggccattcggaagtctcagaaatatgacgtggtttgtgaggggaccatggctatgctcgtgattcgcggcgcaagtctgaaagatgccggcgagtacacatgcgaagtcgaagctagtaaatctacggccagtctccacgtcgaggaaaaggcaaattgcttcacggaggagctgaccaacttacaagttgaagagaaagggactgcggtcttcacctgtaaaacagagcatcctgccgccacagtgacttggaggaagggactccttgaattgcgggctagtggcaagcatcaaccctcgcaagagggtttaaccctgagactgacgatttccgcacttgaaaaggctgattcggacacctacacttgcgacatcggccaggcgcagtcgcgcgcccaactcctggtacagggtgaggcagccaagtgtgcacgggcctag

SEQ ID NO: 24139 - DNA, 16809 bp, Artificial Sequence
  Description of Artificial Sequence: Synthetic coding sequence
atgctggtgatccggggcgccagcctgaaggacgccggcgagtacacatgcgaagtcgaggcaagcaagtcgaccgcctcgctccatgtagaggagaaagcaaattgttttaccgaagagttaactaatctgcaggtggaagagaagggcactgccgtctttacatgcaagaccgagcatcctgcggccaccgttacctggaggaaaggactgttggagcttcgagcctcgggaaagcaccaaccaagccaggaaggtctgaccttgcgactaaccatctccgccctggagaaagcggacagtgatacatacacttgcgacataggtcaggcgcagagccgagcccagctccttgtgcaaggccggcgggtccacataatcgaagacctcgaagacgtagatgtgcaggagggaagttccgctaccttcaggtgccgtatttcccctgctaattacgagcccgtgcattggttcctggataaaacacccctgcacgccaacgaacttaatgagattgatgcccagcctggtggttatcatgtcctgaccctgaggcagcttgcactgaaagattctggaaccatttattttgaggctggtgatcagcgcgcctctgctgctttgcgcgtcaccgagaagccttcagtcttcagcagagagctcaccgatgcaaccattacagaaggtgaagacttgacattggtttgcgagacgagtacctgtgatatccccgtgtgctggacaaaagacgggaagactcttcgagggagtgctaggtgccagctaagtcacgaggggcacagagcgcagctactgatcaccggagccacgttacaggacagcgggaggtacaagtgtgaggccggtggagcctgctcgtcaagcatcgtacgggttcacgcccgcccagtccgtttccaggaagctctgaaggatctggaggtgctggagggtggcgcggccacgctcagatgcgtgctttcatccgtggccgcgcctgtaaaatggtgctatggcaataacgtgctccggccaggagacaagtattcactgcgccaggagggagcaatgcttgaattggtagtgcggaatctcagaccgcaggactccggcagatattcatgtagtttcggcgaccagacgacaagcgccacccttacagttactgctctgcccgcccaatttattgggaaactcagaaacaaggaggccaccgagggggccacagccaccctgcgctgcgaactgtccaaggctgcgccggtggaatggcggaagggatcggagacactgcgggatggcgacaggtattgcctacggcaagatggagccatgtgtgagctgcagattagaggccttgcgatggtcgatgcggctgagtattcttgtgtgtgcggcgaggaaagaacttctgcatccctgacaatccgccccatgcccgctcactttatcggacgcctgaggcaccaggagtccatcgaaggagccacagctacgttgagatgcgagctgtctaaggccgccccagtcgaatggcgaaaagggcgcgagtctctgagggatggggatcgacatagcctgaggcaagatggcgccgtttgcgaactacaaatctgcggcctggccgtagcagacgccggtgaatactcatgtgtatgcggagaggaaagaactagcgccacccttaccgtgaaagctcttcccgcaaaattcactgaaggcctcaggaacgaagaggctgtggagggggccactgccatgctttggtgcgaactttccaaagtggctccggtagagtggcgcaagggcccagaaaacctccgagatggggataggtatatcctgaggcaggagggaactaggtgtgaattacagatctgcggtctggctatggccgacgctggggaatatctttgtgtctgtgggcaggaacgcactagcgccaccctgaccatcagagcactcccggctcggttcattgaggacgtgaaaaaccaggaggctagggagggggcaaccgccgtcctgcaatgcgaattaaattcagccgcccccgtagagtggagaaaagggtctgaaaccctgcgcgacggagataggtatagcctgcgacaggacggcaccaagtgtgaactgcagatccggggattagcgatggcagatactggagagtattcatgcgtgtgtggacaagaacggacatccgcaatgctcacagttcgggcattaccaattaagttcaccgaaggtctgcgaaatgaagaggcgacagagggcgcgaccgctgtgctacggtgtgaactatctaaaatggccccggttgagtggtggaaaggccacgagacgttgcgggacggggacagacactccctcagacaggacggtgcacggtgcgaactgcagataaggggtctcgtggctgaagacgccggcgagtacctgtgcatgtgcggtaaggagcgaacttccgctatgctaacggtgcgggccatgccgtctaaatttattgaagggctccgcaacgaagaagcaaccgagggcgacactgccactctctggtgcgagctctcaaaagctgctcccgtcgagtggcggaagggacatgagaccctgcgcgatggtgacaggcattccctgcgacaagatgggagtcgctgcgaactccagattagaggactggcagtggtcgatgctggcgagtacagctgcgtctgtggtcaagagcgcacaagtgccaccctcactgtccgtgcactccctgctcgtttcattgaggacgtgaaaaaccaggaggcccgcgaaggtgcgacggccgtgctccagtgcgaactgagtaaagccgcaccagtcgagtggagaaaaggctcagagacactcaggggaggcgaccgctattcgctaagacaggatgggactaggtgcgagctccagattcatgggttgagcgttgctgataccggggagtatagctgtgtgtgcgggcaggagcggacatcagcaacactcacagtcagagctctgcctgcgcgctttacacaagacctgaaaaccaaggaggcatccgagggggctaccgctacgcttcaatgtgagctgtccaaggtcgccccagtggagtggaagaagggtccagagactcttagggacggcggtcgctacagcctaaagcaagatggtacacggtgcgagctgcagatccacgacctctccgtggctgacgccggcgagtactcttgcatgtgcggccaggagaggacaagcgctaccctgacagtgagggctttgccggcccgttttactgaggggcttcggaatgaggaagcaatggagggggctaccgctactctccagtgtgagctatctaaggctgccccagtggagtggcgaaaaggtctcgaggctctgcgtgatggcgataagtattctctgcgccaggatggtgctgtttgcgagctgcaaatccacgggctggccatggccgacaacggggtttatagttgcgtgtgcggacaggaacgcacatctgccacgctcacagtacgtgccctccctgcccgcttcattgaagatatgcgcaatcaaaaggcgacagaaggtgctactgtcacattacagtgtaagttgcgtaaggccgcgccagttgagtggcgcaaaggtccgaacaccctcaaagacggcgaccgttattctctgaagcaggatggtacctcatgtgagctccagatcagaggcttggtgatcgccgacgccggcgaatacagttgcatttgtgagcaagaacgaacgtcagccacactgacagtacgtgccctgccagctagatttatcgaagacgtgcggaatcacgaggccacagagggagcaaccgcagttcttcagtgtgagttgtccaaggccgctccagtcgagtggcgaaagggcagtgagacccttcgcgacggggatagatactcgctgcgtcaagatggcaccagatgcgaattgcagatcaggggcttggcggtagaggacaccggcgaatatctgtgcgtttgcggacaggagaggacctccgctactcttactgttcgcgccctgccggccagattcatagacaacatgactaaccaggaagccagagagggtgccaccgcaaccctgcactgtgaactgagtaaggtcgccccggttgagtggagaaaagggccggaaacgctcagggacggggacagacattccctacgtcaggatggtacaaggtgcgagctgcagatccgcgggctctcagtcgccgacgccggagagtacagttgtgtttgtggacaggaacgtacctcggccaccttaactatccgcgaagccacagagggggctacagccatgctccagtgtgagctgtccaaagttgctccagtggagtggcgaaaggggcctgaaaccctgagagacggcgataggtacaatctgcgacaggacgggaccaggtgtgaattacaaatccatgggctgtccgtggccgatacaggggagtattcctgcgtatgtggacaagagaaaacatccgccacattaacagtgaaagcgccacagcccgtgtttagggagccactgcagtccctgcaggcagaagagggctctactgctaccctgcaatgcgaactctccgagccaaccgccactgttgtctggtcgaaggggggattgcaacttcaggccaacggccgtagggaaccacgactccaaggatgcacggccgagttagttcttcaggatctgcaaagggaagatactggcgaatacacatgcacctgcggaagtcaggcaacgtctgctacgctgacggtcacagccgcgcccgtgcgcttcttaagggagctccagcatcaagaggttgacgagggaggcaccgcccacctgtgttgcgaactgagtcgcgcgggagcaagtgttgaatggcgaaaggggtctctccagctgttcccttgtgcgaagtaccaaatggtccaagatggagccgccgcagagctcctagtccgtggagtggagcaggaggatgctggggattacacctgcgatacaggtcacactcagtccatggcatctttgtccgttagagtaccgcggcccaaatttaaaacaaggctgcaatcacttgagcaggagactggggacattgctcgactttgctgccagcttagcgatgccgagagtggagcggtcgttcaatggctgaaagaaggtgttgaattgcacgcaggaccaaagtacgagatgagaagccaaggagctacccgcgagctgctcattcatcagctcgaagcaaaagacacgggggagtacgcttgtgtcaccgggggccaaaaaacagctgcctcactcagggtgacagagccagaagtaaccatagtgcgtggcctagtggacgctgaagtgacagcagacgaggatgtggagttctcttgcgaagtgagtcgcgctggtgccacaggggtgcagtggtgtttgcagggattgccgctccagtcaaacgaagtaacagaggtggcagtaagagacggccgaatccatactttgaggcttaagggcgttacacctgaggacgcaggaaccgtgagttttcacttgggtaatcacgccagttccgcccagcttacagtccgtgcaccggaagtcactatactggagcccctgcaggacgtccagttgagcgaaggccaggacgccagcttccaatgccgcctttcaagagcatctggccaggaagccaggtgggcactgggtggcgtgccactgcaggcaaacgagatgaatgacataactgttgagcaagggacactccatttgcttaccctgcacaaggttaccctagaagacgctggtaccgtgtctttccacgtggggacatgctcctccgaggcccagcttaaagtgacggccaagaatactgtagtgcggggccttgagaatgtcgaggccttggaggggggcgaagcattgttcgagtgtcaattgtcgcagccagaggtcgctgcacatacctggctgctcgacgatgagccagtgcacactagtgagaatgccgaagtggtgttttttgagaatggactgagacacctgctgttgctgaagaatctcaggccacaggattcttgtcgcgtaaccttcctagccggggacatggtcaccagtgcatttctcacggtcagaggttggaggctggagatcctggaaccacttaaaaatgccgctgtgagggccggggcccaggcgtgcttcacttgcaccctgagcgaagccgtccctgtaggggaggcatcgtggtacattaatggagctgccgtgcaaccagacgactccgactggacggtgaccgccgacggcagccaccacgcactcttgctgcgttcggcccagccacatcatgctggtgaggtgacctttgcttgtagagatgcagtggcgagcgctagactcaccgtgcttggcctgcctgaccctcccgaggacgctgaagtggtggcacgttcgtcccacacagtgacgctcagttgggcggcccccatgtcggatggcggcggcggcctttgcggctatcgggtggaagtaaaagaaggggctactgggcaatggcgcctgtgtcatgaactggtacctggccccgagtgtgtggtggacggcctggcgccaggtgaaacttatcggttccgcgtggccgcagttggtccagttggggcgggcgagccagtacacctgccacaaaccgtccggctcgctgaaccgcccaaaccggtacccccacagccttccgcccccgagtcacggcaggttgcggccggggaggacgtttctctcgagctcgaagtcgtggcagaagccggagaagttatctggcacaagggtatggagcgcattcagcctggcggtagatttgaggtagtgtctcagggccgccagcagatgcttgttattaagggcttcactgctgaagaccagggtgagtatcattgcgggcttgctcagggtagtatctgccccgcagccgctacttttcaggtggcactgtcgccagcgtctgtcgacgaggcaccacagccttccctacccccagaagcggcacaggagggagacttgcacctgctgtgggaggcactcgcgagaaaacgccgtatgagccgtgagcccacgcttgactcgattagcgaactgccagaggaagacggccggtctcagcgattaccgcaagaagccgaggaggtggcccctgatttgagtgaggggtacagtacagccgatgaactggcccgcactggcgacgcagatctcagtcacacctcgtcagacgacgaatcccgggctggcacacccagcctggtcacttacctgaaaaaggctggcaggcccggaacaagccctttggcttctaaggttggtgcccctgctgctccatctgtgaagccccagcagcaacaggagcccttggctgctgtgcgccctccactgggcgatctatcaaccaaggatcttggggacccttctatggataaagctgccgtcaagattcaagccgcttttaagggctacaaagtacgcaaagaaatgaagcagcaggaaggaccaatgttctcccatacgttcggcgacaccgaggcacaggtaggtgatgctctgagattagagtgcgtggtcgctagcaaggccgatgtgcgggcaaggtggctaaaggatggtgtcgaactcacagatgggcggcaccaccacatcgaccaactgggcgacggtacatgttccctgttgattaccggattagatagagccgatgcggggtgctacacgtgtcaggtatcaaacaagtttggtcaggtgactcatagtgcatgtgtcgtggtttctggctcagaatcagaggccgagtctagctctggaggcgagctggacgacgctttccgaagggccgcacgtaggctccacagactctttagaacgaagagtccggccgaggtgagtgacgaggagttattcttatctgccgacgaaggaccggcagagccagaagaaccagcagactggcaaacatacagagaggatgagcacttcatctgcatccgcttcgaggctttgaccgaggcacggcaggccgtaacaaggttccaggagatgttcgcaaccctcggcattggagtcgagatcaagctggtcgaacaaggtccaaggcgtgtcgaaatgtgtatctcgaaagaaacacccgcgcccgtggttcctccggagccgcttccatcactcctgacgagcgacgctgcccctgtcttcctgacagaattgcagaaccaggaagtacaggacggatatcccgtcagcttcgactgtgtggtcacaggtcaacctatgcctagcgtgcggtggtttaaagatggtaagctactggaggaggatgatcattacatgatcaacgaggaccaacaaggaggccaccaactgataatcacagccgtagtgccagccgacatgggcgtttatcgatgcctcgcggaaaattctatgggtgtttcctctacaaaggcagagctgagggtcgaccttacttctacagactacgacactgccgctgatgcaaccgaaagttctagctacttctccgcgcaagggtatctctcctcacgagaacaggagggtactgagtctactaccgacgagggacagctgcctcaggtggtggaggagcttcgtgacctccaggtggctccaggaactagactcgctaagttccagctcaaagtcaaggggtatcccgccccccgactgtactggtttaaggatggccagccactgacagccagtgcccatatacgtatgacagacaagaaaattttacacacccttgagataatatccgtgactcgtgaagatagcggacagtatgctgcctacatatctaatgctatgggggccgcctacagcagcgccagattgctggtccgcgggccggacgaacctgaagaaaagcccgcctcagacgtccatgaacagctggtgccgccgcgcatgctcgaacggttcacccccaaaaaagtaaagaagggaagctctattaccttttcggtgaaggtggagggaagaccagtacctaccgtccattggctacgggaggaggcggaacggggcgtattgtggattggcccagacactcctggatataccgttgccagctcagcacagcagcatagtttagtgttgctcgatgtgggcagacaacaccagggcacatatacttgtatcgcctcaaacgccgccggtcaagccctgtgttccgctagcctgcatgtgagcggcctgcccaaagtggaggaacaggagaaggtgaaggaggcactcatctcaacctttctacaagggaccactcaggcaatatcagctcaaggtctcgagacggcgtcctttgcagacctggggggccagagaaaagaagagcctctcgccgcgaaggaagctcttggccacctatcgctggccgaggtgggaactgaagaattcttgcagaaactcacatcccagatcactgagatggtgtcagccaagattactcaggctaaattgcaggtccctggcggggactcagacgaagactccaagactccctctgcgtccccgcgtcatggcaggtctagaccaagttcctcaatccaggagtcgtcatctgagtctgaggacggagacgcaaggggagaaatatttgacatttacgtagtgactgcagactacctccccctgggcgcagaacaggatgctatcacactaagggaaggacagtatgttgaagttctcgacgccgcccatcccctacgctggttggtccgaaccaagcctaccaaatcaagcccatcaagacagggttgggtctctcctgcatatcttgaccgccggcttaagttgagtccagagtggggcgcagccgaggcccccgagttcccaggagaggccgtgtccgaggatgagtacaaagcacggctgtcatcagtcatccaggagctgctgagtagtgaacaggcctttgtagaagaactgcagttcctccagtcccaccatcttcagcatctggaaaggtgcccccacgtcccgatcgccgtagccggccagaaggctgtcatctttcgcaacgtgcgggatattgggcgctttcattccagctttctgcaggagcttcagcaatgcgataccgacgacgatgttgctatgtgttttatcaagaaccaggcagcgtttgaacagtacctggagtttctggtggggagagttcaggccgagagtgtggtggtatctacagccatccaagaattctataagaaatatgccgaggaagccctgttagccggggatcccagccaaccccccccacctcctttgcagcattatctggaacaacccgtggagcgggtccagcgttaccaagccctcctgaaagagctgattcgaaataaagcaagaaaccgccagaattgtgcactgcttgagcaagcctacgccgtcgtgagtgcactgcctcagcgcgccgagaacaagctgcacgtgtcgctgatggagaactatcctggcaccctgcaggcacttggcgagcccatccgccagggccattttatcgtgtgggagggagcacccggcgccaggatgccctggaagggccacaatcgtcacgtgtttttgtttaggaaccacctagtgatttgtaaaccacggcgcgattcccggaccgatactgtttcatacgtatttagaaatatgatgaaactgtcctctattgatcttaacgaccaggtggagggagacgaccgtgctttcgaggtctggcaagagcgagaggacagtgtacgtaagtatctcctgcaggctcggactgccattataaagtcctcttgggtgaaggaaatttgtgggatccagcagcgattggccttacccgtttggcgtcccccagactttgaggaagaacttgccgactgtacagcagagctgggagagacagtaaagctcgcctgccgcgtcaccggaacccctaaacctgtcatcagctggtataaagatggaaaggcggttcaggtggatccccaccacatacttatcgaggatcccgatggttcctgcgccctgattctggacagcttgaccggagtggatagtgggcagtatatgtgtttcgctgcctctgctgccggaaattgtagcaccttaggtaagattctcgtccaggtgcctcccaggtttgttaataaagtccgggcttcacctttcgtcgagggtgaggacgcccagtttacctgcacaattgagggagcaccttatccccagatccgctggtacaaggatggggctcttctgactacaggtaataaattccagaccctgagcgagcctaggtctggcctgttggttctggtgatcagggccgctagtaaggaggatctgggcctctatgaatgcgaattagtgaaccgcctgggcagcgccagggcctccgccgagctcaggattcagtcacccatgctccaggcccaggagcagtgccaccgcgaacagctggttgctgcggtagaggataccaccctcgagcgcgccgaccaggaagtgacatccgtgcttaagagactgttgggacctaaagccccaggtcctagcaccggtgacctgactggcccaggaccatgccctcgaggggcacccgccctgcaggagaccgggtctcagccacctgtcacggggacatccgaagcccctgccgttccacccagggtgccgcagcccctgctccacgaggggccagagcaagaacccgaggccattgccagggcacaggaatggactgtccctatcagaatggagggcgctgcatggcccggcgcaggcaccggcgagctgctatgggatgtacatagccacgtggtgcgggaaacaacccagagaacgtacacataccaggcgatcgacacacatactgccagaccaccgtctatgcaggttactatagaagatgtgcaggcccagacaggggggacagctcaatttgaggcaatcattgagggagacccgcaacccagcgtgacttggtacaaggacagtgttcagctcgtggatagcacccgtctctcacagcagcaggagggcacaacatacagtctagttctgagacacgtcgcatctaaggacgccggagtgtatacatgcttagctcaaaatactggaggccaggttctgtgtaaggctgagctcctggtgctcggtggggacaatgaaccagattctgagaagcagtcccaccgccgaaagctgcattccttttatgaagtcaaggaggaaataggtcgcggagttttcggctttgtaaaacgagtgcagcataagggcaacaagatactatgcgccgcaaagtttatccccctcagaagcaggactcgtgcccaggcataccgagaaagagatattctcgcagctctatcccatccactggtgaccggccttttggatcaatttgagactcgcaagactcttatactgattctggagctatgctcgtctgaagaactgttggacaggctgtatagaaagggtgtggtcacagaggcagaagtaaaggtgtacattcagcagctggtagaaggcctacactacctgcacagccatggtgtcctccatctcgacatcaaaccatccaatatcctaatggtgcatcccgccagagaggacatcaagatctgtgactttggcttcgctcaaaatatcactcccgctgagctccaattctcccagtacggaagtccagaattcgttagtccggagatcattcagcagaaccccgtctcggaagcctcagatatctgggcaatgggggttatcagttacttgtcactgacttgtagtagtccctttgccggggagtctgatagggcaaccttgttaaatgtcctagaagggagagtttcgtggtcctccccgatggctgcgcacttgtccgaggatgcaaaggacttcattaaggctaccctgcagcgggcaccccaagcccggccgtctgccgcccagtgcctctcacacccttggtttctgaagagcatgccggcggaggaagcccactttataaacaccaagcagttgaagttcctgttggcccgctcaaggtggcagaggagtctgatgtcttacaagagcatcctggtgatgaggagtatcccagaactcttacgtgggcctcccgatagtcctagcctgggtgtggctagacacctgtgcagagatacaggaggcagcagctcttcaagttcatcctccgataacgagttagcgccgtttgccagggccaaatcactgcctcccagccccgtgacacacagccccctcttgcacccccggggcttcctgcggccatccgcttcactgccagaagaggccgaagcgtctgaaaggagtacggaagcaccagcccccccagcctcgccggagggggccggacctcctgctgcccagggctgcgtaccccgccatagcgtcattagatccctcttttaccaccaggccggcgagtctcccgaacacggagccttggcccccggctccagacggcacccagcgcgaaggagacacctgcttaaaggaggttacatcgcgggggctcttcctggcctgagggaacctctgatggagcatagggtgctcgaggaggaagccgctcgcgaggagcaggcgacattgctggctaaggcaccaagtttcgagacagcactccggctgcccgcctccgggacccacctcgcccctggacatagccacagccttgaacacgattccccatctacacctcgcccctcctcagaagcctgtggcgaagcccagcggctgccctctgcaccatcgggaggtgccccgatacgggacatgggacatccacagggttctaaacagctccccagcaccggcggtcacccagggacagctcaaccagagcgtcctagtcccgacagtccttggggacagcctgctccattctgtcatccgaaacaggggtctgctccccaggaagggtgcagtccccaccccgccgtggctccttgtccacccggatctttcccaccgggcagttgtaaggaagctccgctcgtcccatccagcccgtttttaggtcagccccaggcgcctcctgcgccggctaaggctagtcctcccctggatagcaaaatggggcctggggacatcagccttcccggcagaccaaagcctggcccatgctcctctccaggttctgcctctcaagcctcaagcagccaggtgagctctctgagggtggggtcatcccaggttggtaccgaacccggcccaagtcttgatgctgagggctggacacaggaggctgaagacctctctgattcaacacccaccctgcagagacctcaggaacaggctaccatgcgcaagttcagcctaggtggcaggggtggctacgctggcgtggccggatatggaacttttgccttcgggggtgatgccggcgggatgctgggtcagggccctatgtgggcacggattgcttgggcggtcagtcagtcagaggaggaagaacaggaggaggcccgtgccgaatcccagtccgaggaacagcaggaggcgcgagcagaatcacctttacctcaagtcagcgctcgcccggtccccgaagtgggaagggccccgactcggtcttcccccgagcctacaccctgggaggacatcggacaagtgagccttgttcagatcagagacctatcaggggacgctgaggctgccgataccatttctttagatatcagtgaagtagaccctgcatatctgaacctatcagatttgtacgacatcaagtacctccctttcgaatttatgatctttcggaaagttcccaagtccgctcagccggagcctcctagcccaatggcagaggaagagctggccgaattccccgagcccacttggccctggcccggcgaactggggccgcacgccggactagaaattacggaagaatccgaagacgtcgatgccctcctggctgaggcggcagtgggcagaaaaagaaagtggagctccccctccaggtcgttgttccatttccctggtaggcacttgcccctggatgagccagcagaactgggcttacgagagagggtgaaggctagcgttgaacatataagccggatactgaagggtcgacccgagggtctggagaaggaaggccccccacgcaagaagccgggactcgcgtccttccggctgagcgggctgaaaagttgggacagagctcccaccttcttacgcgaactcagcgacgagaccgttgtgctgggccaaagcgtgactctggcctgtcaagtgtcagcacagcccgccgctcaggccacttggtcgaaagacggggctccactcgaaagttcatcacgcgttttgatttctgccaccctgaaaaacttccaacttttgaccattctggtagtagtggccgaggacctaggcgtgtacacatgttccgtttcaaatgcgctgggaactgtgacgaccacaggggtgcttcgcaaagccgaaagacctagcagcagtccctgcccagacatcggcgaagtttacgctgacggcgtactcttagtctggaaacctgtggagtcgtatgggcctgtgacatacatcgtccagtgcagtcttgagggcgggagttggactaccctcgcctctgatatttttgattgctgttacctgacctcaaagctatccagaggaggaacttatacatttcggaccgcatgtgtctccaaggccggcatgggcccttattcttcccccagtgagcaggtattactgggagggccgtcccaccttgcaagtgaagaggagtctcaaggccgaagcgcccagccccttcctagcaccaaaaccttcgcatttcagacccagatccagagaggcaggttttcagttgtgagacagtgctgggaaaaagcctccggacgtgccctggccgcaaaaatcataccctaccaccctaaggacaagacagctgtgctgcgggaatacgaagcactcaaaggcttgagacatccccatttagcccaactccatgctgcctacctgtctcctagacatttggtgttgatccttgaactgtgcagcggtcccgagctcctaccctgtctggctgagcgagcctcctattcagaatctgaagtaaaggactacttgtggcaaatgctgagtgcgacccaatatctccataaccagcatatactgcatctagacctcaggagcgagaacatgatcatcacagaatataacctgctgaaagtggtggacttgggtaacgctcaatcactctcacaggagaaggtccttccaagtgataaatttaaagactaccttgaaaccatggctccagaactgcttgaaggccaaggcgctgtgccacaaaccgatatatgggcaattggggtgaccgcttttatcatgttgagcgcggaatatcccgtatcttcggaaggcgctagagatctgcagcgcgggcttcgtaagggactggttcgcctgagcagatgctacgctgggctctccgggggcgctgttgcctttttgcgttccaccctgtgcgcccaaccgtggggacgtccctgcgcaagtagctgcctgcagtgtccttggctgacggaggagggcccagcatgcagccgccctgcgccagtaaccttcccgactgctagattaagagtgtttgtgagaaatagagaaaaacgtagagccttgctgtacaaaagacacaatctcgcacaagtgcggtag

SEQ ID NO: 24140 - DNA, 11220 bp, Artificial Sequence
  Description of Artificial Sequence: Synthetic coding sequence
atgctggtgatccggggcgccagcctgaaggacgccggcgagtacacgtgtgaagtggaagcttccaagagcacagcgtctcttcacgtggaggaaaaagcgaactgtttcaccgaggagcttaccaatctgcaggtcgaagagaaggggactgccgttttcacctgtaagacagagcaccctgcagcaacagtcacctggaggaagggacttctggagctaagggcatccggcaaacaccagccctcacaagaaggattgacactgcggctgactattagcgcgctggagaaagccgacagtgatacatacacctgtgacatcgggcaggcccagagccgcgcgcagctcctagtacaggggcggcgagtgcatatcatagaagatctggaggatgtcgatgtccaggaaggaagctctgcaacattccgttgccggattagtccagccaactacgaacccgtgcactggtttctggataagacacctctgcacgctaatgagctcaatgagattgacgcccagcctgggggatatcacgtgctgacactgcgccagttagctcttaaggactctggcactatttacttcgaggctggagatcagcgcgccagcgctgccctgcgcgttaccgagaaaccatccgtattctcgcgggagctgaccgacgccactataaccgaaggtgaggacctgacgctcgtgtgcgagacatctacctgtgacataccagtgtgctggactaaggatggaaagacactgcggggctcagcgaggtgccaactgtcccatgaggggcatcgggctcagctgctgataacgggcgctacactccaggattcgggccgctataagtgtgaggcaggaggagcctgttccagtagcattgtccgagttcacgctaggccagttaggttccaggaagccctaaaagatttggaggtgctcgaaggcggagcagctaccctgcgttgcgtgctgtcttctgtcgcagctcccgtaaaatggtgctacgggaataacgtgcttaggcccggggataaatactcactgagacaggagggggcgatgctagagttagtggtcaggaaccttcgtccacaggattcagggcgctatagctgctccttcggggaccagacaacaagcgccacgctaactgttaccgctctgccagctcagtttattgggaagctgagaaataaggaggccactgaaggggctacagcaacccttagatgtgagcttagcaaggccgcccccgtagagtggagaaagggtagtgaaactttgcgagatggtgaccggtattgcctccggcaggatggagccatgtgcgaattacagatccgggggcttgccatggttgacgccgctgagtatagttgtgtgtgcggcgaggaaaggacttctgcatctctgaccattcgccccatgccggctcactttatcggcagactgagacaccaggagtctattgaaggcgccacagccacgctcagatgcgagttgtctaaggcagcccctgtggaatggcgcaagggtagggaaagcctgcgagatggtgatcgccatagtcttcgccaggacggcgccgtctgcgaactgcagatttgcggtctggcggtagccgacgcaggtgagtacagttgcgtctgtggcgaggagcgtaccagcgcaaccctcaccgtgaaagccctgcccgctaaattcactgagggtctcaggaatgaggaggccgtagagggggccaccgccatgttgtggtgcgagcttagcaaagtggcccctgtcgagtggcggaaggggcctgaaaatctcagagatggcgaccgctacattttacggcaggaaggcacaagatgtgagcttcagatatgcggtcttgctatggctgatgcaggcgaatacctctgcgtgtgcggacaggagaggacctctgccaccctgaccattcgtgctcttcccgcgagatttatcgaagatgtgaaaaaccaagaggcgagggaaggtgctacggcggttttgcagtgcgagctcaattcagcggcccccgtggagtggaggaagggatccgagaccttacgggacggcgacaggtactctctcaggcaggacggaaccaaatgtgaactgcagattagagggctggctatggctgacactggcgagtattcttgcgtgtgtgggcaggagcgcacatccgcaatgttgactgtgagagcccttccaatcaagttcacagaaggcttaaggaatgaggaggccaccgaaggggcgaccgcagtgctgcggtgtgagttatccaaaatggccccagtggagtggtggaagggccatgagacgctgcgggatggcgacaggcattctctgcggcaggacggcgctagatgtgaactgcagatccgtggactggtagccgaggatgccggtgagtacctttgcatgtgcggtaaagagagaacttcagctatgctcacagtgagggctatgccttctaagtttattgagggtctgcgtaacgaagaagctacagagggcgatactgcaaccctatggtgcgagctgagtaaggccgctccagtggaatggcgcaaaggacatgaaactctgcgggatggcgatcgtcactccctaagacaggacgggtctagatgcgagctgcaaatcaggggtctggcagtcgtggatgctggagaatacagctgcgtgtgtgggcaggaaagaaccagcgccactctgaccgtgcgggcccttcccgcacgttttatagaggacgttaaaaatcaggaggcccgcgagggcgctactgccgtgcttcagtgcgagctttcaaaagctgcccccgttgaatggcggaaagggtctgaaaccctgcgcgggggagaccggtatagcctccggcaggacggtacccgatgcgagctgcagattcacggcctgtccgtggccgatacaggagagtattcttgcgtctgtggacaggagaggacaagtgctacactcaccgtaagagcccctcaacccgtcttccgtgaaccactccagagcctgcaagcagaagagggaagcaccgctacccttcagtgcgagctgtcagagcccacagctactgtagtgtggtctaaagggggcctgcaattgcaggcaaacggccggcgggaacccagattgcaggggtgtaccgccgagttagtcctgcaagatctgcagagagaagataccggcgagtatacatgtacttgtggcagccaagccacaagtgcaacgctcaccgtgaccgctgcccctgttcgttttctgcgcgagctgcagcaccaagaggtcgacgaaggcggaacagctcatttgtgttgtgagttatctcgggcaggggccagtgtagagtggagaaaaggctcactccagctttttccttgtgccaaataccaaatggtgcaggacggcgccgccgccgaacttctcgtgcggggggtggagcaagaagacgctggagattacacttgtgatacaggacacacgcaatccatggctagcctttccgttagagttcctaggccaaagtttaaaactaggcttcagagtctggaacaagagaccggtgatatcgcgcgactgtgctgccagctgtctgacgctgaatccggggcggtggtacaatggcttaaggaaggggttgagctccacgccggccctaagtacgagatgcgatcccagggcgccaccagggaattactgatacatcagctcgaagctaaagatacaggcgaatatgcttgtgtcactggaggacagaagactgctgcctcgctccgtgtgactgagccagaggtaacaattgttcgcgggctcgttgatgccgaggttaccgcagatgaggacgttgagttctcatgcgaagtgtcccgcgcaggcgccaccggcgtccagtggtgccttcaaggactgccattgcaatccaacgaggtgaccgaggtagcagtgagggacgggagaatccacacgctgagactgaaaggcgttacacctgaagacgctggcacagttagtttccacctgggcaaccatgcatcttctgcccagctcactgtgcgcgcgcctgaggtaacgatccttgagccactccaggatgtgcagctcagcgaaggtcaggacgcgtcttttcagtgtcgtttaagcagggccagcggtcaggaggcgcggtgggccttaggaggggtccccctgcaagcaaatgagatgaatgacataactgtggaacagggcactctgcatttactcacactgcataaggtgactcttgaggatgcgggtaccgtgagcttccacgtcggcacatgcagctctgaggcgcaactcaaggtcacagccaagaacacggtggtcaggggattggaaaatgtggaagcactggaggggggggaggcattgttcgagtgccagttgagccagccagaggtcgccgcacacacctggctgctggatgatgaaccggtccatacaagtgagaacgcagaggtcgtcttttttgagaacggactacggcatctgttgctgttgaaaaatttgcggcctcaggacagctgcagagtgactttcctggcaggggatatggtcacgagcgctttcctgactgttaggggttggagacttgaaatcctggagcccctcaagaatgccgcagtgcgggctggagcacaggcatgttttacatgtactctttccgaagcagtgcctgtaggggaagcttcctggtacataaacggtgccgcagttcaaccagacgattcagactggacagtgaccgccgacggttcccaccatgctctcctgctgcgctccgcccagcctcatcacgcaggcgaggtcaccttcgcctgtcgcgacgcagtcgcatcagcacgcctaactgtcctgggactccctgatccccctgaggacgctgaggtggtggctaggtcgagccacacagtaacactgagctgggccgcaccgatgtccgacggcggtgggggcctgtgtggttaccgggtggaggtcaaagaaggcgcaacgggacagtggcgcctgtgtcacgaactcgtgcccggcccggagtgcgttgtcgacgggctggcccccggggagacttatcgctttagggtcgcggccgtaggcccagttggggccggagagccggtgcatttgcctcagaccgttcgtttggctgagccacccaaaccggtaccgccccagccgtctgcacccgaatcacgccaagtcgccgccggggaagacgtgtccctggaattggaggtagtagcggaagcaggcgaagtcatttggcacaaagggatggaacgcatccagcccggagggagatttgaggttgtgagccagggcagacaacaaatgcttgtaataaagggcttcacagctgaagaccagggcgaatatcactgcggccttgcccaaggatctatttgccccgccgcggctacctttcaggtggctcttagcccagcatcagtggacgaagcgccccaacccagtctgcctccggaggccgcacaggagggagacctgcacctgctatgggaggctctggcgcggaaaagacggatgtcacgggaacccactcttgattccatcagtgagctccctgaagaagatgggcgtagccagagactccctcaagaggcagaagaagtggcccccgacctgagcgaggggtactctacagccgacgaattggctcgaaccggggacgccgacctgagtcacacctcctcagacgacgagtcacgtgccggaacaccgtctctggtgacatacctcaaaaaagctggcaggccagggactagtcccctcgcatccaaagtgggggcccccgccgcacccagtgttaaaccccagcagcagcaagagccactcgcagccgtgcgcccacccctcggagacctatccacaaaggacctgggggacccttcgatggataaagccgcagttaaaatccaagcagcattcaaaggctacaaggtgcggaaagagatgaaacagcaggagggtcccatgtttagccacacttttggggatactgaagcacaagtcggcgatgctctgaggctagagtgcgtggttgcttctaaggctgacgtccgggctcgttggctcaaagacggagtggaacttactgatggccgtcaccaccacattgaccagctgggggacggaacttgttccttactgattaccgggctagacagagctgatgccggctgttacacttgtcaggtgtcaaacaagttcggtcaggtaacgcactcagcctgtgtagtcgtctcagggagcgagagcgaagccgagtcctcatccggcggagaactagatgacgcattcagaagagctgctcggcggctacaccgtctgtttcgaactaagtctccagccgaagtctcggacgaggaattgtttttatccgccgatgaaggcccagctgagcctgaagaacctgccgattggcagacttatagagaagacgagcactttatctgtattagattcgaggccctcacggaagccaggcaggcagtcacacggttccaggagatgttcgcgacactgggcatcggcgtcgagattaaattggtcgagcaaggacctcggcgagtggagatgtgtatttcgaaagagacccctgcacccgtggtccctcctgagccgctccccagtctgctgacaagtgacgcggcacctgtttttttaaccgagttacagaatcaggaagtacaagatggctacccagtctcctttgactgcgtggtgacagggcagcctatgccttcagtgcggtggtttaaggatggcaagttgctcgaagaggatgatcattatatgataaatgaggatcaacagggcggacatcaactcataatcaccgccgtcgttcccgctgacatgggagtatacagatgcctggccgaaaacagtatgggcgtatctagtaccaaagcagagttacgcgtggacctgactagtaccgactacgacacagccgccgatgccaccgagtcaagcagttatttcagcgcgcaagggtatctcagcagccgggaacaggaggggacagagagtacaacggatgagggccagctgccccaggtggtagaggagctgagggaccttcaggttgctccagggacaagactagctaaatttcagctgaaggtgaaggggtatccagcccctcgtctgtattggtttaaagacgggcagccactgaccgccagcgcacacattcggatgaccgataagaagatcctgcatacgttagaaatcatttcggtaactcgtgaggatagcgggcaatacgcagcctatatctccaatgccatgggggccgcatacagctcggccagacttttggtgagaggcccggacgagccagaagaaaaacccgccagcgacgtgcacgaacagttggtgccaccaagaatgctagagcggtttacaccaaagaaagtaaagaaaggtagtagtatcaccttcagtgtgaaggtggagggtcgtccggtgcccaccgttcactggctacgcgaggaggcggagaggggcgtgctgtggatcgggcccgacacaccaggatacaccgtggcttcctcggcacagcagcacagcttagttctcctggacgttggacggcagcatcaggggacctatacatgcattgcatcaaacgccgccggtcaagctctgtgcagtgcgtctctgcacgtctcaggactccccaaggtcgaagaacaagaaaaagtgaaagaggctctcattagcactttcctgcaggggactactcaggccatcagtgcacaggggctggaaacagccagcttcgctgatctgggcggccagcggaaggaggagccgctggcagccaaagaggctcttggtcatttgagtctggccgaggttggcactgaagaatttttacagaagctcacttcccagattacagagatggtgtctgccaaaatcacccaggcgaaactgcaagttcctggtggggactccgacgaggacagcaaaaccccaagtgccagcccccgacatggccgcagtcggccatcctcaagcatacaggaaagtagtagtgaatctgaggatggtgacgcccggggagagattttcgacatttacgtagttaccgctgactaccttcctctgggcgccgaacaggacgcaataaccctccgcgagggccaatacgtggaggtgttggacgccgcccacccccttcgatggctggtgcggacaaaacctacgaaaagctccccgtcacggcagggctgggtctccccagcataccttgaccggcggctgaagctgtcaccagagtggggcgccgctgaggcccctgaattcccaggggaagcagtttctgaagatgagtataaggcccgccttagctccgtcatccaggagcttctctctagtgagcaagctttcgttgaggagctgcagttcctccagtcccaccacctacaacatctggaacggtgcccacatgtccccatcgcagtggcgggccaaaaagctgtgatctttcgtaacgtgcgtgacatcgggcgcttccacagctcatttcttcaggaactgcagcagtgcgatacggacgacgatgtcgccatgtgtttcattaagaaccaggcagcgtttgaacagtatttggaatttctggtggggagagtacaagcagagtccgtcgtggtgtctactgctatccaggaattctacaaaaagtatgccgaggaagcgctcctagcaggcgaccccagtcagccaccccctccccctctgcaacattacctggaacaaccagtcgagagagttcagcgttaccaagcgctcttgaaggagctcatacggaataaggctagaaaccggcagaattgcgcgttacttgagcaagcttacgccgtggtgagcgccctgccccaaagagccgagaacaagctccacgtgtccctgatggaaaattaccccggcacgcttcaagcacttggggagcccatcaggcaaggccatttcatcgtgtgggagggagccccaggcgcgcgcatgccttggaagggacataaccggcatgtgttccttttccggaatcacctggtcatatgcaaacctcgaagggattctagaactgatacagtctcctacgtcttcaggaacatgatgaaactgagctccatcgacctgaacgatcaagtggaaggcgatgatcgggccttcgaagtgtggcaggaacgcgaggatagcgtgcggaagtacctcctccaggcgcgaaccgctattattaaatccagctgggttaaggagatatgcggcattcaacagcggctggctcttcccgtttggagaccacccgatttcgaggaagagctcgcggactgtacagccgaactgggggagaccgtgaaacttgcatgtagagttacaggaacacccaaaccagttattagctggtacaaggatggcaaggccgtgcaggtggatccccatcatatcctcatcgaggaccctgacggatcctgtgcactcatactggattcactcaccggcgtagactccggtcaatatatgtgcttcgccgcatcagccgctggaaattgtagcaccctcgggaagatcctggttcaggtcccaccacgcttcgttaacaaagtgagagcctccccttttgtggagggggaggacgcacagttcacctgcactatcgagggagccccctaccctcagattcgatggtacaaagatggtgctctgctcaccactggaaacaaattccaaactctgtcagagcccaggagcgggctgcttgttctggtcataagagccgcatccaaagaggacctgggtctctatgagtgcgaactcgtgaaccggctgggttctgcccgagcatcagctgagctgcgcatccagagcccaatgctccaggcacaagaacaatgccatcgagaacaattagtggccgctgtcgaggtgaccgaacaagagaccaaggtacctaagaaaacagtcataattgaagagactatcacaaccgtcgtcaaaagccccagaggacagagaagaagcccgagcaagtcaccctcccggtcaccttctcgatgtagtgcttccccgctccgccctggactgttggcccccgacctgctctatctcccaggtgcaggccagccgaggcggccagaggccgagccgggacagaagcccgtagtacctacactgtacgttaccgaggccgaagcacatagccctgctctcccaggactttctgggccgcaaccgaaatgggtcgaggttgaagagaccatagaagtgcgagtgaagaagatgggtccacagggcgtgtcacccacaaccgaggtacctaggtccagttctgggcatctgttcaccctgccaggggccactccggggggcgatcctaactccaacaatagcaataacaagcttctggcacaggaggcttgggcacaggggacagccatggtaggtgtgcgggagccactcgtgtttagagttgatgcccgcggatctgtggactgggccgcctctggcatgggaagtctggaggaggaaggcacaatggaggaggccggagaagaggagggagaagatggtgacgcgtttgtaacggaggagagtcaggatacccattctctgggagacagagaccctaaaatccttacacacaacgggagaatgcttacactggcagacctggaagattatgtgccaggagaaggggagactttccattgcggggggcctggcccaggagcgcccgatgatcctccttgcgaggtgtctgtgattcagcgggagataggcgagccaaccgtagggcagcccgttctgctgtctgtgggtcatgccctgggtcccaggggacccctgggcctgtttcggccggagcctcgcggtgcttcaccccctgggccacaggttcgcagcctcgagggtactagcttcctactccgcgaggcgccagcccgccctgttggtagcgccccctggacacagtctttctgcactcggatcagacgttccgcagattcagggcagtctagctttaccaccgagctgtctacccagacggtgaattttggaaccgtcggtgagaccgttacgctccacatatgccctgatcgagacggagacgaagctgcgcagccctag

SEQ ID NO: 24141 - DNA, 1071 bp, Artificial Sequence
  Description of Artificial Sequence: Synthetic coding sequence
atggccaccgccgccctgctgcggggcgccacccccggccggggcgggcccgtctggagatggaggttgagagcagcaccccgctgtagactggcacattcgtcctgtagcccaggcggggaccctaccgcaggagcagcctgggcctgcttcagattagacggtagaaccctgttaagagttcgcggcccggatgcagccccatttctgcttggactgttaaccaacgaactccctctgccttcccctgcagcggcaggcgcaccaccggcagcacgggctggctacgcccattttttaaacgtgcaaggtagaaccctttacgatgtgatactctacggtctgcaagaacactccgaggtatccggttttctccttgaatgcgactcatctgtgcagggggcccttcagaagcacctggcactttacaggatcagacggaaagtgaccgtcgagcctcatcctgagctgcgagtctgggctgtcttaccaagttcgcccgaagcctgcggcgcggcttccttacaggagcgggccggcgccgctgccattctcatcagagacccaaggacagcgcgtatgggctggaggctcctcacgcaggacgaggggccagctctggttcccggaggaaggctgggagatttgtgggattaccatcaacatcggtacctccagggcgtcccagagggagttagggaccttccaccaggtgtggccctgcctctcgagtctaaccttgctttcatgaatggcgtctctttcactaaaggctgctacattggtcaggaactgactgcgcgcacccaccacatgggagtgatacggaaacgactgtttcccgtccgctttctggaccccctgccaactagcggcatcactccaggtgctaccgtgcttacagcttctggccagactgtcggcaaattcagagctggtcagggcaacgtgggtctggccctgctctggtccgagaagatcaaagggcctttacacattcgtgcaagtgagggtgcccaggtggccttagccgcgtcagtgcctgactggtggccaacagtgagtaaatag

SEQ ID NO: 24142 - DNA, 1395 bp, Artificial Sequence
  Description of Artificial Sequence: Synthetic coding sequence
atgcgggccgcccggcggggcctgcactgcgccggcgccgagcggccccgcaggcgcggccggttgtgggacagtagcggcgtcccccagcgacagaagaggcctggcccatggcggacccagactcaggagcagatgtcccgcgatgtttgcatccatacttggccctgcacatactacttggagccgaaacgccggtgggtgaccggccaactcagcttgacttcgctgagcctcagattcatgaccgacagcaccggcgagattctagtttcatttcctcttagctcaatagttgagatcaagaaagaggctagccatttcatcttcagcagtatcacaattctggagaagggacacgcaaagcattggttttcaagcctgagaccatcaagaaacgttgtatttagtataattgagcatttttggcgggaacttctgcttagtcagccaggggccgtagcagacgccagcgtccctcgcacacggggagaggaactcacgggactcatggccggcagccaaaaacgcttggaagacaccgcacgggttctgcatcaccaaggccaacaactggactccgtgatgcggggtctcgataaaatggaatcagaccttgaagtcgctgatcgcctgctcaccgaactcgagtcacccgcatggtggccgtttagtagcaaactgtggaaaactcctccagaaaccaagccgcgagaagatgttagcatgaccagttgtgagccctttggaaaggagggcatcttaatcaaaatacccgcagttatatctcacagaaccgagtcccacgtgaaaccaggaaggttaactgtgctggtatcgggcctagagattcacgactcatcctcactcctcatgcatcgatttgagcgggaggatgtggatgacattaaggtgcactcaccatacgaaatcagcatcaggcaaagattcattggcaagccagacatggcttaccgactgatctcagctaaaatgcccgaagtcatccctatcctcgaagtccagttcagcaagaaaatggaattgctggaagacgctctggtgttgaggagcgcccgaactagttcgcctgcggagaaaagctgttcagtgtggcacgccgcatccggattaatgggtaggacccttcacagggagcctcccgccggggatcaggagggtactgcactccatcttcagacctccctgccagcactcagtgaggcggatactcaggaactgacacaaattctgcgtaggatgaaaggcctggccctcgaggcagaatccgagttagagaggcaagatgaggctctcgacggagtcgccgccgccgtagatcgcgccacattgaccattgacaaacacaataggcgtatgaagcggctcacctag

SEQ ID NO: 24143 - DNA, 669 bp, Artificial Sequence
  Description of Artificial Sequence: Synthetic coding sequence
atgaccagctgcgagcccttcggcaaggagggcatcctgatcaagatcccagccgtgatttctcacagaacagaatcacatgtgaaacctggccggttgaccgtgctcgtatcagggcttgagatccacgactcctcctccctcctaatgcaccggtttgagcgtgaagatgtcgacgacatcaaggtgcactccccatacgagatcagcattaggcagaggtttatcgggaagcccgacatggcgtaccgactgatttccgcaaagatgccggaggtcatccccatcctggaagtccagtttagtaagaaaatggagcttctggaagatgcgctggtactgcgaagcgccaggacaagctctcctgctgagaagtcatgctccgtgtggcatgctgctagcgggctgatgggtcgaaccttgcacagggaacctcccgccggggatcaagagggcaccgcactccacttgcaaacctccctgcctgcattgtcagaggccgatacccaggaattgacccagattctgagacgcatgaaaggcttagcactagaagctgagagtgagctcgaaagacaggacgaggccctcgacggagtggccgcggctgtagatagggccaccctcactattgacaagcataacaggcgcatgaagcggcttacctag

SEQ ID NO: 24144 - DNA, 201 bp, Artificial Sequence
  Description of Artificial Sequence: Synthetic coding sequence
atgccccagtaccagacctgggaggagttcagccgggccgccgagaagctgtacctagccgacccaatgaaagctagggtagtgttaaaataccgccattccgacgggaatctctgcgtaaaggtcactgacgacctagtacaatggcatctgaactattgcaccctcagacatggcatcgctggtgggctggagacttag

SEQ ID NO: 24145 - DNA, 249 bp, Artificial Sequence
  Description of Artificial Sequence: Synthetic coding sequence
atgccccagtaccagacctgggaggagttcagccgggccgccgagaagctctatttggccgaccccatgaaagcaagggtcgttctcaaatatcgccactctgatggaaacctttgtgtcaaggtgaccgatgacttggtccggcaatgcttagccctgctgttgcgcctgcagtgctctgggatgataatcgcccactgcatcctggatctcctcggatctagcggcccactggcctccgcatcttag

SEQ ID NO: 24146 - DNA, 651 bp, Artificial Sequence
  Description of Artificial Sequence: Synthetic coding sequence
atgcaggccaacggcgccggcggcggcggcggcggcggcggcggcgggggcggtggcggcggaggcggaggcggacaaggacagactccagaattggcctgcctttccgcacagaacggtgaatcttctccatcgagctctagttccgcaggtgatcttgcacacgcgaatggcctccttccctcggccccatctgcggcctctaataactccaacagcctaaacgtgaataacggagtgcccggcggagccgccgcggctagtagcgccactgtcgctgctgcaagcgctaccaccgccgcctcaagtagcctcgccacccccgaattgggcagctccctgaagaaaaagaagcgactctcccagagtgacgaagacgtgatacggctaattggtcagcatcttaacggactgggcctgaatcaaacggtggatctcctgatgcaagagtctggctgtcgactggagcatccgtctgcaacaaagttccggaaccatgtgatggagggcgattgggataaggcagagaacgacttaaacgagttgaagcctctggtgcactccccacacgccattgtagcccagacattttccgaaacttctattaactttttcccactgacggccgctttctgccacgtgcgcggctag

SEQ ID NO: 24147 - DNA, 2340 bp, Artificial Sequence
  Description of Artificial Sequence: Synthetic coding sequence
atgcggatcgaggagcggaagagccagcacctgaccggcctgaccgatgaaaaagtgaaagcctacctgtctctgcacccccaggttctggacgaatttgtaagtgagtcagtgtccgctgagaccgtcgagaagtggctgaaaaggaagaataataaaagcgaggacgagtcggccccgaaagaggtcagccgttaccaagacacgaacatgcagggagtggtttacgaactgaacagttatatagagcagcggctagataccggcggcgacaaccagttgttgctttatgagctctcttccataattaagatcgccaccaaggctgatgggtttgcgctgtattttttgggtgagtgcaataactctttgtgtatctttactccccctgggattaaagaaggcaagccccgcctaattccggcgggtccaatcacgcaaggaaccaccgtgagtgcttatgtggctaaaagtcgcaagaccctcttggtcgaggacatcttaggtgatgagagattccccagaggcacaggcctggagagcggtacaagaatccagtccgtgctgtgccttcctatcgtgactgctataggagacctgattggtatcttagagctttaccgccattggggcaaggaagccttttgcctttctcaccaagaagttgcaacagcgaacctcgcatgggcttccgtcgcaatccaccaggtgcaggtgtgccgcggtctggccaaacagaccgagctgaatgattttctcctagacgttagtaaaacgtattttgataatatcgttgcaatagattcccttctcgaacacattatgatctacgctaaaaatctggtcaatgccgaccggtgcgccctgtttcaggtcgatcataagaataaggaactctatagtgacctgttcgacatcggcgaggagaaggagggaaaacccgtgtttaagaagacaaaagagatccgcttctctattgaaaaaggtatcgcagggcaggtggcgcgcaccggggaggtgctgaacatccccgacgcctatgccgaccccaggttcaacagggaagtggatctctatactgggtacacaacaaggaacatactgtgtatgcccattgtgtccaggggctctgtgataggcgtggtccagatggtaaataagatatctggatccgcctttagcaaaacggacgaaaacaattttaagatgttcgcagtgttctgtgccttagcgctacactgcgctaacatgtatcacaggatcagacatagcgaatgtatttacagggtgacaatggagaagctgtcttatcattctatttgcaccagtgaggagtggcagggattgatgcagttcaccttacccgttcgcctgtgtaaagagatcgaacttttccattttgatatcggtcccttcgagaatatgtggcccggtatcttcgtctacatggtgcacagaagttgcggaacaagctgctttgagctggagaagctgtgcaggtttatcatgagtgtgaaaaaaaactacagaagggtaccctatcacaactggaagcacgccgtgactgtggctcactgcatgtacgccatactgcagaataatcacacgctgtttactgacttggagcggaagggtctgcttattgcgtgcttgtgtcacgatctcgatcacagaggtttcagcaattcctacctccagaagttcgatcaccctcttgctgccttatattcaacaagtacaatggaacagcaccacttctctcaaacagtgtcaatattgcaacttgagggacataatattttttcgacattgtcgtcatccgaatatgagcaggttctcgagatcatacgtaaggccataatcgccacagatctggccctttattttgggaacagaaagcagcttgaagagatgtaccaaaccggatccctcaatctgaataatcagagccacagggatagggtgattggtctgatgatgacggcatgtgacctgtgtagtgtcaccaaactgtggccagtgactaagctgacggcgaacgacatttatgctgagttctgggccgaaggcgacgagatgaagaaactcggaatccagcctattccaatgatggatagggataagaaggatgaagtgccccagggtcaactggggttttacaacgctgttgccataccttgttacactacactaactcaaattttaccgcccacagaaccgctccttaaagcctgccgggataatcttagccaatgggagaaggtgattagaggtgaggagacagccacatggatttctagcccatctgtggcacaaaaagccgcagcatccgaggactag

SEQ ID NO: 24148 - DNA, 666 bp, Artificial Sequence
  Description of Artificial Sequence: Synthetic coding sequence
atggccgccgccagcggcagcgtgctgcagcggtgcatcgtgagccccgctggacgccacagtgcttcccttatttttctccatggatctggagactcgggccagggactcagaatgtggatcaagcaggtgctgaaccaggatctgacattccagcacatcaagatcatctacccaaccgctcctccacgatttaagattacaaatgactgtccagagcacctcgagtctattgacgtgatgtgccaggtgctgactgatctcatcgatgaagaggttaaaagtggaattaagaagaaccggatcctgattgggggattttccatgggcggctgcatggccattcatctggcttacagaaatcaccaggatgtggccggagtgtttgccttgtcctctttcctcaataaggcgtcggccgtgtaccaagcactacaaaaatccaacggtgttttaccggagctgttccagtgccacgggactgccgatgagctagttctgcactcctgggccgaggaaactaattcaatgctgaaaagccttggggtgacaaccaagttccatagctttcctaacgtgtatcatgagctgtctaaaaccgagctggacattctgaagctctggattctgaccaagcttcctggcgaaatggagaaacagaaatag

SEQ ID NO: 24149 - DNA, 714 bp, Artificial Sequence
  Description of Artificial Sequence: Synthetic coding sequence
atggccgccgccagcggcagcgtgctgcagcggtgcatcgtgagcccagccggccggcatagtgccagcctcattttcctccatgggtctggagacagcggacagggcctgcgaatgtggattaagcaggtgctgaaccaggatctaacattccaacacattaagattatatacccaacagcccctccacgatcatatactcctatgaaagggggaatctcaaatgtctggtttgataggttcaaaatcaccaatgattgtccagaacacctcgaatccattgatgtgatgtgccaagtcctgaccgatctgatcgatgaggaggtcaagagcggaatcaagaagaatcgcatcctgatcggagggttcagtatgggcgggtgtatggcaattcatttagcttatcggaaccatcaggacgtcgccggggtttttgccctgagctctttcctgaataaagcctccgccgtataccaggctctccaaaagtcaaatggagtcttgcctgagcttttccagtgccacgggaccgccgatgagctcgtcctgcacagctgggcagaggagaccaactccatgttaaagtctctcggcgtgacgaccaagttccatagtttccctaacgtttaccatgaactgagtaaaactgaacttgatatcttgaaactatggattctcacaaagctgccaggagaaatggaaaaacagaagtag

SEQ ID NO: 24150 - DNA, 471 bp, Artificial Sequence
  Description of Artificial Sequence: Synthetic coding sequence
atggagaccgccaaggagatgacccgggagagcctgcccatcaagtgtctcgaggccgtgattttggggatctacctcacgaacggacagcccagcattgaacgttttcccatcagcttcaagacttacttcagcggtaattatttccaccatgttgtccttggcatttactgcaacggccggtacggctccttggggatgagtaggcgtgcagagctcatggacaaaccactgacatttcgcacgctcagcgacctgatctttgacttcgaagatagttataaaaagtacctgcacacggtgaaaaaggtcaaaataggattatacgtgccacacgaaccacattcctttcagcctatcgagtggaagcagctagtgctgaatgttagtaaaatgctgagagccgatatcagaaaggagttagaaaagtatgcgcgcgacatgcgtatgaaaggcttatgttcccattag

SEQ ID NO: 24151 - DNA, 936 bp, Artificial Sequence
  Description of Artificial Sequence: Synthetic coding sequence
atgaccggcagcgccgccgacacccaccggtgcccccaccccaagggcgctaaaggtacgcggtcacgttctagccacgccagaccggtgtctttggcgaccagtggagggagtgaggaagaggacaaggacggcggggtcctgttccatgtaaacaagtccgggtttccaattgattcccacacatgggagagaatgtggatgcatgtagcaaaggtgcatccaaagggcggtgagatggtgggcgctatccgcaatgccgctttccttgccaagccatcaatcccccaagttcccaactacagattatccatgaccatccctgactggctccaggccattcagaactacatgaaaacgctgcactacctaacgaatggccagccctccatcgagagatttcctatatcctttaagacatacttctctggcaactacttccaccatgtggtcctgggaatatactgcaacggccgttacggcagcctcggaatgtcccgtcgcgccgagctcatggataaacccctgacatttcgcaccctgagcgacctaatcttcgactttgaggacagctacaagaaatatttacatacggtcaagaaggtaaaaattgggttgtacgtgcctcacgagccccactctttccagcctattgaatggaaacagctggtccttaacgtcagcaagatgctgcgggccgacatccgaaaggagctggagaagtatgcccgggatatgcgcatgaaaattctgaagcccgcaagtgcccactcgccgacccaggtcaggagtagaggaaagtccctctctccgcgtcgccgacaagcatctcctccacggcggcttggacggagagaaaagtctcccgctcttcctgaaaagaaagttgcggatctctccaccctcaacgaggtagggtaccaaattcgaatctag

SEQ ID NO: 24152 - DNA, 873 bp, Artificial Sequence
  Description of Artificial Sequence: Synthetic coding sequence
atgtggatgcacgtggccaaggtgcaccccaagggcggcgagatggtcggcgctatccgcaatgcagcgtttctggccaaaccgagcatcccacaggtgcctaactataggctgagcatgacaattcccgactggctgcaggcaattcagaattacatgaagaccctgcagtacaaccacactggcactcagttttttgagattaggaagatgaggccactctcgggtcttatggagaccgctaaagaaatgacgagggagagcctcccgataaagtgcctcgaggccgttatcctgggtatctatctgacaaacggccagccaagcattgaaagattccctatatcattcaagacctacttctcaggaaattacttccatcacgtggtcctcggcatttactgtaacggccggtacgggagcctcggcatgtcccgacgggccgagctgatggacaagcccttaacgttcagaacgctgagtgatctaattttcgattttgaagattcctataagaaatatctccacactgtaaaaaaggtgaagattggcctctacgtgccacacgagccacactcctttcagccgattgagtggaaacagttagtgctgaatgtttcaaaaatgctgcgggccgatataaggaaagaactggaaaaatacgcccgcgatatgagaatgaaaatcctcaaaccagcctccgctcactctcccacacaggtccgcagtcggggaaaatccctcagtcctcgtcggcgacaggcaagccctccaagacggctaggacgacgagagaaatcacctgctctcccagagaagaaggtcgctgatctcagcacactcaacgaggtgggttatcaaattagaatatag

SEQ ID NO: 24153 - DNA, 756 bp, Artificial Sequence
  Description of Artificial Sequence: Synthetic coding sequence
atgaccatccccgactggctgcaggccatccagaactacatgaagacactgcagtataatcatacgggaacccagttttttgagatacggaagatgagacccttaagcggcctgatggaaaccgccaaggaaatgaccagagagtccctccctattaagtgtctggaggcagtcatcttgggcatctaccttaccaatggacagccttcaatcgaaagattccccattagtttcaagacatacttcagcggtaattacttccatcatgtggtgctcggaatctattgcaatggacggtacggcagtctgggcatgtcaagacgcgccgaactgatggataagccactgaccttcagaacactgtctgatctgatctttgattttgaagacagttataagaagtatttacacactgtgaagaaagtaaaaattggcttgtacgtgccccatgaacctcattctttccagcccatcgaatggaagcagcttgtccttaatgttagtaagatgctgcgggcggatatccggaaggagcttgagaaatatgcacgagatatgagaatgaaaatactgaagcccgcttccgcacactctcctactcaagtgaggtcccggggtaaatctctgagcccacgacgccgccaagcttcacctcctcgacgactcggaagaagagaaaaaagtcctgctctgcccgagaaaaaggttgctgatttgtccacactgaatgaagtcggatatcagatccggatatag

SEQ ID NO: 24154 - DNA, 873 bp, Artificial Sequence
  Description of Artificial Sequence: Synthetic coding sequence
atgtggatgcacgtggccaaggtgcaccccaagggcggcgagatggttggcgcgataaggaatgccgccttcttagcgaaaccttctatcccacaggttccgaactatcgcctatctatgactatcccagattggctgcaggcaattcagaattacatgaaaacccttcagtataaccataccggtacccagttctttgagattcggaaaatgcgccccctctccggacttatggagaccgcgaaggaaatgactcgggagtctctccccatcaaatgtctagaggctgtcattctggggatatatctgacaaatggccagccatcaatcgaacgattcccaatcagctttaaaacctatttctccggaaattattttcaccatgtcgtcctgggcatttactgcaacgggcggtatgggagcttagggatgtcacgcagagcggaattgatggacaaacctctgacgttccggacgctgagtgacctcatctttgacttcgaagatagttacaagaagtatctccacacggtaaaaaaggtgaagattggcctttacgtgcctcacgaaccccactcttttcagcccatcgaatggaagcaactggtattgaatgtctccaagatgctgagggccgacattcggaaggaactggaaaagtatgccagggatatgcgcatgaagatcctgaagcctgcgtcggcccacagccccacacaggtcagatcgaggggtaaatctctctccccccggcggaggcaagcctcccctccccgcagattgggtaggcgtgaaaagtcacccgcattacctgagaagaaagtcgccgacctcagcaccctcaatgaagtaggatatcagattaggatctag

SEQ ID NO: 24155 - DNA, 723 bp, Artificial Sequence
  Description of Artificial Sequence: Synthetic coding sequence
atggccggcagccccgagctggtggtgctggaccccccctgggacaaggagctggcagctggaaccgagagccaggccctggtttcggcgacaccacgtgaggatttccgcgtgcgctgcacgtcaaagcgggccgtcacagagatgctgcaactctgtggacgctttgtgcagaagctcggcgatgcgttgccggaggaaatccgagaacctgccttgcgggacgcacagtggacctttgaatcagctgtccaggagaacattagcatcaatggccaggcctggcaggaagcgagtgacaactgtttcatggactcagacatcaaggtgctcgaggatcagttcgacgaaattatcgtagacatcgccactaaaaggaagcagtatccacgcaaaatcctcgagtgtgttatcaagaccattaaggcaaagcaggaaattctgagcctaccagcactcatcgaacagggtgaagggttttcacaagtactacgtatgcagcccgtgatacatctgcagcggatacaccaggaagtgttctcctcctgtcatcggaagcccgatgccaaacccgaaaactttatcacacagatcgagaccacacctaccgagactgcctccagaaagaccagcgatatggtgctgaagcgaaagcagactaaggactgcccgcagagaaaatggtaccctcttcgccccaagaaaatcaacctggacacatag

SEQ ID NO: 24156 - DNA, 519 bp, Artificial Sequence
  Description of Artificial Sequence: Synthetic coding sequence
atggccggcagccccgagctggtggtgctggaccccccctgggacaaagaacttgccgcaggtaccgaaagccaggccctggtctccgctacaccaagggaggatttccgagttagatgcacctccaaaagagccgtgacagaaatgctacagttgtgtggcaggtttgtgcagaagctcggggacgccctgcccgaagagatcagggaaccagcacttagagacgcacagtggacattcgaatcggctgttcaggaaaatatctctatcaacggacaggcctggcaggaggcgtcagataactgcttcatggactcagacataaaagtcttggaagaccaatttgacgagatcattgtcgatattgcaacaaagcgcaagcaatacccccgaaagatcctggagtgcgtgatcaaaacaattaaggcgaagcaagagatccttaaacagtaccatcccgtcgtgcatcctttagatctgaagtacgacccagatcctgtcctggcttgcattaattag

SEQ ID NO: 24157 - DNA, 846 bp, Artificial Sequence
  Description of Artificial Sequence: Synthetic coding sequence
atggccggcagccccgagctggtggtgctggaccccccctgggacaaagagttggcagctggcacagagagccaggcgttggtcagcgcaaccccaagagaagatttccgggtcagatgcacttctaaaagggccgtcactgagatgctgcagctttgcgggagattcgttcagaaactgggagatgccctgcctgaggagatcagagaaccagctcttcgagacgcgcagtggacctttgaaagcgcagtccaggaaaatatttccatcaatggacaagcatggcaggaagcctcggacaattgttttatggactcggacatcaaggtccttgaagatcagttcgatgaaattatagtggatatcgccacaaaacgaaagcagtatcctcggaagattctggagtgcgttatcaaaacaattaaagccaagcaagaaattctgaagcaataccatcctgtggtgcaccctctggatctgaaatacgatcccgaccctgcccctcacatggagaacctcaaatgcagaggggaaactgtcgcaaaggagatcagcgaggctatgaaaagccttcctgcactcatcgagcaaggcgagggtttttctcaagttctgcgcatgcaaccagtcatacacctgcagcggatccaccaagaggtgttctcctcctgccatcggaagcccgacgccaagcccgagaatttcatcacacagatcgagacaacgcctacagaaacagcaagtcgaaagacgagtgacatggtgttaaagagaaaacagacaaaggactgtccccagaggaagtggtaccccttacgcccaaaaaaaattaatctggacacctag

SEQ ID NO: 24158 - DNA, 228 bp, Artificial Sequence
  Description of Artificial Sequence: Synthetic coding sequence
atggacagcgacatcaaggtgctggaggaccagttcgacgagatcatagtcgatattgcgaccaaacgaaaacagtacccacggaagatccttgagtgtgtaattaagaccattaaggcaaagcaggagatcctgaagcagtaccatccagtagttcatcccctggatttaaaatacgaccctgaccctggagcaaagcccggcggcctggcactgggcgctgtttag

SEQ ID NO: 24159 - DNA, 279 bp, Artificial Sequence
  Description of Artificial Sequence: Synthetic coding sequence
atggaggactaccaggccgccgaggagaccgccttcgtggtggacgaagtgagcaacatagtgaaggaagccatcgagagtgcgattgggggaaacgcctatcagcacagcaaggtgaaccagtggactaccaacgtggtggagcagaccttatctcagttaactaaactcggtaagccgttcaaatatatcgggaatggcgtactgtttctactgtatctacgggacgggttcttaactttaattcggggtgctagcagcacgcgaaataatagctag

SEQ ID NO: 24160 - DNA, 204 bp, Artificial Sequence
  Description of Artificial Sequence: Synthetic coding sequence
atgcagaagaacggcgccggcctgcacaccgccagcagctgcttctgggacagttcaaccgatgggatgatttttatccacgtatgcgaagtgcttctctgtgagatctacgattggaaatttcctatcttcgaatgcaacgcatgtctatctcctttcaaaactttcaacaacagacttgctaaggtgttgtgcgtggcttag

SEQ ID NO: 24161 - DNA, 342 bp, Artificial Sequence
  Description of Artificial Sequence: Synthetic coding sequence
atggaggactaccaggccgccgaggagaccgccttcgtggtggacgaggtttcaaacatagtcaaggaagctatcgagtctgcaatcggaggtaatgcttatcagcattccaaagtgaaccagtggactacgaacgttgttgagcagaccttgagccaactgaccaaactggggaagcctttcaagtatatcgtgacatgtgtgattatgcagaagaatggggcggggttacacacagctagtagctgtttctgggattcctcaaccgacgggtcgtgtacggtgcggtgggaaaacaagaccatgtattgcattgttagtgcgttcggactcagcatatag

SEQ ID NO: 24162 - DNA, 2037 bp, Artificial Sequence
  Description of Artificial Sequence: Synthetic coding sequence
atgtacgccgccgtggagcacggccccgtgctgtgcagcgacagcaatattctgtgtttgtcctggaaggggagagtcccaaagagcgaaaaggagaagccggtctgcagaagacggtactacgaggaaggttggttagcaactggaaacgggcgaggcgtggtcggggtcacattcacctcctcccattgcaggagagatagatccacacctcaacgcattaacttcaacttaagaggacataactctgaggtggttttagtgcggtggaacgaaccatatcagaagctggcaacgtgcgatgctgatggcgggatctttgtttggatccagtacgagggacgctggtcggtggaactagttaatgacaggggagcccaagtcagcgactttacctggtcccacgacgggacacaggcactgatcagttacagggacgggttcgttttagtcggaagcgtatctggccaacggcactggagctctgagattaatttagagtcgcagatcacttgcggtatctggacccctgatgaccaacaagtccttttcgggactgccgatggtcaggttatcgttatggactgtcatgggagaatgttggcccatgtactgctacatgaatcagacggagtacttgggatgtcctggaactaccctatattccttgtggaggatagctccgagagcgacaccgactctgatgactacgccccacctcaggacggaccggccgcttatccgatacctgtgcagaatataaaacctctgctgactgtttcttttactagcggcgacattagccttatgaataattatgacgacctcagcccaacagtgattaggtcagggttgaaagaggttgtcgcccagtggtgcacacagggcgatctactggccgtggcaggcatggagcgacaaactcagctcggtgaactgcctaacgggccccttctgaagtctgccatggtgaaattttataatgttcgtggtgagcacatattcacgctggacaccttagtacagaggcctatcatttcgatctgttggggacacagagacagccgattgctcatggcatccggccctgcgctgtatgtggtgcgcgtcgagcacagagtatcgtcattgcagctgttgtgtcagcaggccatagcctctacattaagggaggataaagacgtctcaaaactcacccttcctccaaggctttgcagctacctctccacagcattcatccccacgatcaaacccccaattccggatcctaacaatatgagagatttcgtgagctatccttcagcagggaacgagcgactccattgcacaatgaagcgtactgaggacgatccggaggtgggtggcccatgctataccttgtacctggaatatctcggcggcctcgtccctatcctgaagggccgacgtattagcaagctgcggcccgagttcgtgattatggatcctcggaccgattccaaaccagacgagatctatgggaacagcctaatatctacagttatagacagctgtaactgttccgactcatccgatattgaactctccgatgattgggccgcaaagaaatctcctaagatctctagagctagcaaatcccctaaactaccgcgcatttctattgaggctcggaaaagtccaaagctgcccagagcggcccaggagctctcacgctccccaagactgcctcttaggaaaccgtcagtaggctcaccaagcctaactagacgagagttcccatttgaggacatcacccagcacaattatctggctcaagtgacatctaacatctggggcaccaagttcaagatcgtgggcctggcagccttcctcccgaccaacttgggcgcagtgatctataagaccagtctgctacacctgcagcctcgtcagatgacgatttacctccccgaggttcgcaagatttccatggactacattaacttacccgtattcaacccaaacgtgttcagtgaagatgaagacgacctccctggtgatgccgtgtggacagactag

SEQ ID NO: 24163 - DNA, 4632 bp, Artificial Sequence
  Description of Artificial Sequence: Synthetic coding sequence
atgtacgccgccgtggagcacggccccgtgctgtgcagcgacagcaacattttgtgtctgagctggaagggaagggttccgaagtctgagaaggagaagcctgtttgccgccggcgctactacgaagaggggtggctcgcgacaggcaatggtcggggagtcgtgggtgttacattcacctcgtctcactgcagacgcgatcggtccactccccagcgcatcaacttcaacttgcgtgggcacaatagtgaagtggtgctggtacggtggaacgaaccttaccaaaaactcgccacttgtgacgccgatggcggcatcttcgtttggatccaatacgagggccgttggagcgtagaattggtgaacgaccgaggagcccaagtctctgacttcacctggtcacacgatggtacccaggctctgatcagctatcgtgatggatttgtattagtcggcagcgtgtcaggccagcgccattggagctcagaaattaacctcgagagccagatcacctgtggcatatggacacccgatgatcagcaagtactctttggcaccgccgatggccaagtcatcgttatggactgccacggtcgcatgctagcacatgtcctgcttcacgagtctgatggcgtcctcggtatgtcttggaattatcccattttccttgtggaagattcttcggaatcagacacagacagcgatgactacgcgccacctcaggatggtcccgcagcctaccctattcccgtccagaacatcaagcccttactgactgtgagttttacctccggcgacatctcactaatgaataattatgatgacctcagcccaactgtgattcgctcagggcttaaggaggtggtggcacagtggtgcacccaaggtgatttactggccgtggccggaatggagcgccagactcagctgggcgagttgcccaacggtccactgctcaagtcggccatggttaagttctacaatgtgcgcggcgaacatatttttacactcgacacgctggtgcagcgacccattatcagtatttgctggggccacagagatagccgtctgcttatggcctccggtccagcgttgtatgtggtacgcgtggaacaccgtgtgagctccttacagttgttgtgtcaacaagccatcgctagtacactgcgtgaggataaggatgtctctaaactgacactcccaccccggctttgcagctacctgtctaccgcattcatcccaactatcaagccacccattcccgaccccaacaacatgagggattttgtaagctacccaagtgccgggaacgaacggctccactgcacaatgaaaagaactgaggacgatcctgaagtgggcggaccgtgttacaccctctacttggagtacctcggtgggttggttcctatcctcaagggacgccgaattagcaagctccgccccgaattcgtgattatggatccacgcacagattcaaaaccagatgaaatctacggcaacagtcttattagtacagttatcgattcatgtaactgtagcgacagctctgatattgagttatcggacgactgggccgcgaaaaaatcaccaaaaattagcagagctagcaagtctcctaaattgccgaggatctccatcgaggcgaggaagtcaccaaagcttccccgcgcagcccaagagctctcaagaagcccccgtctcccacttcgcaagccttcagtggggagtccatccctgacccgcagagaatttccattcgaagatatcactcaacataactatctcgctcaggtgacaagcaatatttggggaacaaagtttaaaatcgtcggtctggctgcttttttgcccaccaacctgggcgctgtgatttataagacgagcttattgcatctgcagccccggcagatgacaatctatctacccgaagtgcgcaaaataagtatggactacattaatttacccgtgtttaacccaaacgtcttctctgaggacgaggacgacctgcctgtgaccggtgcatcaggagtccctgaaaatagtccgccctgcactgtaaacattcccatcgcaccaatacatagctccgcgcaggccatgtctcccacccagagcattggcctcgtgcagagcctgttggccaaccagaacgtgcagcttgacgtgctcacgaatcaaacgacagctgtgggcactgcggaacatgccggcgattccgccacccagtacccggtttccaacagatattcaaaccccggacaggtgatctttggatccgtggagatgggccgaattattcagaaccctccgcctctcagcctgccgccccccccccagggtccaatgcagttgtcaacggttgggcatggcgaccgtgaccacgagcatctccagaagtccgccaaggctttgcgacccaccccacagctagccgctgagggtgacgccgtcgtttttagcgccccccaggaggtccaggtcaccaagatcaaccccccaccgccatatccgggcacaatcccagcggcccctactactgccgcccctccacccccgctgcctccacctcagcctcccgtggacgtgtgtctcaagaaaggcgatttcagtctgtatcccacatctgtgcattatcagacgcctctgggatatgagaggatcactacattcgattcgtctgggaatgtcgaagaggtctgccgaccacggacgagaatgctatgcagtcaaaatacctacacacttcccggtcctggcagctccgccacgctgagactgactgctacagagaagaaagtaccacaaccgtgcagtagtgcgaccctcaacaggctcaccgtcccgaggtattcaataccaaccggggatcctcctccctacccagagatcgcctcccagctggctcagggacgaggagccgcccagcgatcagacaactcactgatacatgcaacgctgcgccggaacaatagagaagcaacactgaagatggcgcagttggccgacagtccaagggctcccttgcagcccctcgctaaatccaaggggggacctggaggagttgtgactcagctcccagctagacccccccccgctctgtatacctgttctcagtgctctgggacaggaccttcctcccaacctggtgcatcccttgcacatacggcatcagcctcgccacttgcctcccagagcagttatagcctgctgagcccccccgacagcgctagggaccgcaccgattacgtcaactcagcattcacggaggatgaagcacttagccagcactgccaactcgaaaagcctttgagacatcctccgctgcccgaagcagccgtgaccctgaagcggccccccccatatcagtgggatccaatgctgggagaggacgtgtgggtgcctcaggagcgcacagcccagaccagcggccccaaccccctgaagcttagctcactgatgttgagtcagggtcaacaccttgacgtttcacgcttgccctttatctcacccaagagtcccgcctcccccacagctacctttcagacggggtatggaatgggggtgccctatcctggatcctacaacaacccaccactgcccggtgtgcaggctccttgttcccccaaggacgcattgagccctacacaattcgcacagcaggagcccgcggtcgttctccaacctctgtatcccccctccttgtcttattgcacactgcccccgatgtaccctggctcatccacctgctccagcctccagcttccaccagtggcgctacacccttggagttcctactccgcatgcccccccatgcagaaccctcaggggacgttgcccccaaaacctcacctggttgtggagaagcctctggttagccccccacctgcagatctacagtcacacttgggcacagaggttatggtggagactgcagacaacttccaagaagtcctgtcactcacggaatcacctgtccctcaacgcaccgagaaattcgggaaaaaaaatagaaagcggctggactcaagagcagaggaaggcagcgttcaagctattacggaaggcaaggttaagaaggaggctcgcacccttagcgattttaactcacttattagctctccccacctagggcgagaaaagaagaaggtgaagagccagaaagaccagctgaagtcaaaaaaacttaacaagaccaacgagttccaagactcatctgaatctgaacccgagctctttatatcaggcgatgagctcatgaatcagagccaaggaagcaggaaggggtggaaatcgaagcgaagcccacgagccgccggagaactggaagaggctaagtgcagacgggcaagcgagaaagaggatgggagactggggtctcagggctttgtttacgtgatggctaataagcagccactctggaatgaggcaacgcaggtatatcaactcgacttcggagggagggtgactcaggagagcgctaaaaatttccagattgaactcgaaggtcgccaggtcatgcaattcggcaggattgacggtagtgcctacattttggactttcagtaccctttcagcgctgtgcaggcgttcgcagtcgcactggcaaacgtcactcaacgattgaagtag

SEQ ID NO: 24164 - DNA, 3234 bp, Artificial Sequence
  Description of Artificial Sequence: Synthetic coding sequence
atggacagcaagatgaagaagatggccgagctgcagctgagcgtggtgtccgatccgaaaaacagaaaggccattgagaatcagattcagcaatgggaacagaacctcgagaaatttcacatggatctcttccgcatgcgctgctacctcgccagtctgcagggtggtgagctgcctaatcctaaaagcctccttgccgcagcatcacgaccatcaaaacttgctctcggacgtttaggaattctcagtgtcagttccttccatgctctcgtgtgtagcagagacgactctgcactgcggaaaagaactctgagtctgactcagcgtgggcggaataagaaaggaatcttcagcagtttaaaggggttggatacgttggctcggaagggtaaggagaagaggccgagcattacccagatcttcgacagttccggatcacacgggttttcaggaacccaactcccacaaaattccagcaacagcagtgaggtggatgagctcctgcatatatacggcagtacagtcgacggtgtccctagagacaacgcttgggaaattcagacctacgtccacttccaggacaaccacggagtgacagttggaattaagcctgagcacagagtggaagacattctgacacttgcctgtaagatgagacagttagagccaagccactacggacttcagctgcgtaaattggtggacgacaatgtggagtactgtatccctgcgccttacgaatacatgcaacaacaggtgtacgatgaaatcgaagtgtttccattaaacgtatacgacgtgcagctgaccaagaccgggtctgtgtgtgacttcgggttcgccgtgacagcccaggttgacgagaggcagcatctgtcacgcatcttcatcagtgatgtgctccctgacggactggcatatggggaggggctccgaaagggaaacgagataatgaccctgaatggagaggctgtgagtgacttggatctcaaacagatggaggccctattcagtgagaagtctgtgggtcttacactcattgctagacctccagacaccaaagcaactctctgtacaagctggtcagattctgacctgtttagtcgggaccaaaagtcactgctgcctccccccaatcagtcacagcttttggaggaatttctggacaacttcaagaagaatactgcgaacgatttctccaacgtgcccgacatcacaactggattaaaacgctcgcagaccgatggcactctggaccaagtctctcatcgggaaaagatggaacaaacattccggagtgcagaacaaataaccgccctgtgcagaagttttaatgactcccaagccaacggcatggagggccctagggagaatcaagatcctcccccccggagcctagcgagacacctgagcgacgcagatagattaagaaaagttatccaagaactggtcgatacagaaaaatcttatgttaaagatttatcttgcctattcgaactgtatctggaaccacttcagaatgagacattcctcacacaagatgaaatggagtccttgtttgggtcactgcctgaaatgttagagtttcagaaggttttcctggaaacgttggaggatggaatttccgcctctagtgacttcaataccttagagaccccctcccaatttaggaagctactttttagtctaggaggttcttttttgtattacgccgatcacttcaagctttattctggtttttgcgcaaatcacataaaggtgcagaaggttctcgagcgcgccaaaactgataaagctttcaaagctttcctagacgctcgaaaccccacgaagcaacattcatctacgttggagagttatctgatcaagcccgtccaacgagtcttaaagtaccctctccttttaaaggaactggttagcctcactgaccaagaatcggaggagcattatcatctgaccgaggcgctaaaggctatggaaaaggtggcttcccatattaatgagatgcaaaagatctatgaagattacggaactgtatttgatcagcttgtggccgaacagagcggaactgaaaaggaggtgacagaactgtccatgggcgagttactgatgcactcaaccgtgagttggttaaatccatttcttagcctcgggaaggcccgtaaagacctggagctgaccgttttcgttttcaagcgagccgttatcctggtgtataaagaaaactgtaaactaaagaaaaaactgcccagcaactcccggcccgcccacaatagcacagacctggatccttttaaatttcggtggcttattccaatttctgctcttcaagtgagactaggcaaccccgccgggacagaaaacaatagcatctgggagttaatccacacaaagagcgagatcgaggggagacctgagaccattttccagttatgttgttccgactccgagtcaaaaactaatatagtaaaagtgatccgctccattcttagagaaaactttcgtagacacataaagtgcgaactacccttggaaaagacatgtaaggaccgactggttccccttaagaatcgagttcctgtgtcagctaaactcgcttcttcacgaagtctcaaagtgctgaaaaactccagttctaacgagtggaccggcgagacagggaagggtactctactggacagcgacgaaggttccctttcttccggcacccagtcatctggatgtcccactgccgagggccggcaagattcgaaaagcacttcacccggcaagtatcctcacccaggcctggcagatttcgccgacaatcttatcaaggaatcagatattctgagcgacgaagacgacgatcataggcagaccgtgaagcagggatcccccacaaaggacatcgagattcagttccagcggctcaggatcagcgaggatccagatgtacaccctgaggctgagcagcagcccggtcctgagagtggcgaaggtcagaaaggaggggaacagcccaaactggtccgtggccacttctgccctattaaaaggaaagccaactccacgaaacgagatcgaggaactcttctgaaggcccagatcaggcaccagtcactagactcacagtccgagaatgccaccatagatctcaacagcgtgctagagcgggagttttcagtacaatcactcacctcagtcgtctctgaagagtgcttctacgagacagagtcacatggcaagtcctag

SEQ ID NO: 24165 - DNA, 579 bp, Artificial Sequence
  Description of Artificial Sequence: Synthetic coding sequence
atgagccagtgcgcctgcctggaggaggtgcacctgcccaacatcaagcccggagagggcttaggaatgtacatcaaatcaacatacgacggccttcacgtgatcaccgggaccaccgaaaatgtgggctggcaactgaaaaacctggttaaaaagttgcgggagaatccaacaggcgtggtgctactactgaaaaagcggcccacgggttctttcaatttcacccccgctcctctgaaaaacctcaggtggaaaccacctttggtgcagacatcaccccccccagcaacgacacagagccctgagtctacaatggatacttccctgaagaaagaaaagagtgctatcctggacctgtacatccctccacctcccgctgtgccctactcacctagggatgagaacgggtctttcgtgtatggagggtcaagtaaatgcaaacaaccactgcctggaccgaaaggtagcgaatcaccgaactcttttctcgatcaagaatctcggagaagacggttcacaattgcagattctgaccagctgccaggttattcggtggaaacaaatatcctgcccacctag

SEQ ID NO: 24166 - DNA, 1668 bp, Artificial Sequence
  Description of Artificial Sequence: Synthetic coding sequence
atggagcccgtgaccaagtggagccccaagcaggtggtggactggactagaggactcgacgactgcctgcagcagtacgtccataaatttgagcgcgaaaaaatcaatggggagcagctgctgcagatttcacaccaagaccttgaggaattaggagtcaccaggatagggcatcaggagctggttctagaagccgtggatctcctttgcgccttaaactatggacttgaaaccgacaacatgaagaatcttgtgcttaaactgagggccagcagtcacaatttgcagaactacatcagcagtcggagaaaaagccccgcatacgacgggaacacatcacgcaaggctccaaatgagtttttaacctctgtggtggagcttatcggcgccgcaaaggctcttctggcctggcttgaccgggccccgttcaccggaattacagactttagcgtgaccaaaaataagattatccagctatgtctagacctcacaactacggtgcagaaagactgtttcgtcgccgagatggaagataaggtgctgaccgttgttaaagtgctgaacggcatctgtgataaaaccatccggagtacgacggacccagtgatgtcccagtgtgcgtgtttggaggaggttcacttgcctaacatcaaaccgggagagggcctgggcatgtacatcaaatcaacttacgatggactgcatgtgatcacaggcaccaccgagaattccccagccgaccgttctcagaaaatccacgctggtgacgaagtgatccaggttaatcaacagaccgtggtgggatggcaattgaagaatttggttaagaaacttcgggaaaacccgaccggagtggtgctgctgctgaaaaaacgccctacaggaagcttcaacttcacgcctgcccccctgaaaaacctgcggtggaagcctccattggtccagacttctcctccccctgctacaacacaatcaccggagagcacaatggacacatctttaaagaaggagaaaagtgccattcttgacctttacattcctccgcctccagccgttccatactctccacgagatgaaaatggttcgttcgtatacggcggctcgtcaaagtgcaaacaacccctccccggaccaaaaggatccgagagccccaactctttcctggaccaggagagccggcgtaggcgttttacaatcgccgatagcgaccagttacccgggtacagtgtggagacaaatatccttccgaccaagatgcgcgagaagacacccagctatggcaagcccaggccgctgagcatgccagcagatggcaattggatgggcatcgtggatccatttgccaggcccaggggacacggcagaaagggagaggatgccttgtgtcgatacttctcaaatgagagaatcccccctattattgaagagtcctcctcccccccctacaggttcagcagacctaccaccgaacggcatcttgtgcggggagccgactatataaggggtagccgctgctacatcaatagtgacttgcattcgtctgccacaatcccattccaggaggagggaacaaaaaaaaaaagcgggtcttctgccaccaagtcttcctcaactgagccaagcctgttggttagttggtttacaaggctgaaactgcttacccactag

SEQ ID NO: 24167 - DNA, 708 bp, Artificial Sequence
  Description of Artificial Sequence: Synthetic coding sequence
atgcggagccgggtgctgtggggcgccgcccggtggctgtggccccgtcgtgccgttgggccagcaagaagacccctgtcatcaggctctccacctttggaggagttgtttactcgtggcggccctctgcggacatttcttgaaagacaggctgggagcgaagcacaccttaaagtccgcaggcccgaacttcttgcagtgatcaagctactcaacgaaaaggagagagaactccgggagaccgaacacctcctgcatgatgaaaacgaagatttgaggaaactggcggagaacgaaatcaccctgtgtcagaaagaaattactcagctgaagcaccagataatcttactgctggtgccttccgaagaaacggacgaaaacgacctcattctggaggttactgccggagtcgggggaggactgcgacatgcctctgcttcgataggcggatcggaagcatacaggcacatgaaatttgagggcggggttcaccgggtacaaagagttcctaaaacggagaagcagggccgagttcacaccagcaccatgactgttgctatactcccgcaacctaccgaaatcaacctcgttataaatcctaaagaccttcgcattgataccaaaagagcgtctggggcgggcggtcagcacgttaataccacggacagcgctgtcaggatcgtacatctgcctactgattggaaatag

SEQ ID NO: 24168 - DNA, 816 bp, Artificial Sequence
  Description of Artificial Sequence: Synthetic coding sequence
atgcggagccgggtgctgtggggcgccgcccggtggctgtggcccaggcgcgctgtgggtcccgcacgtcggcccttgtcttctggatctcctcctctggaagaacttttcacgcgaggaggtcccttaagaacatttctcgaacggcaagcgggatccgaagcgcacttaaaggttcgtagaccggagttactggccgtgattaaactcctgaatgagaaggaacgggagttacgggagactgagcacctgctgcatgacgagaatgaggacctaagaaagctagccgagaatgaaataaccctctgtcaaaaggaaattactcaactcaaacaccagatcatattgctcctggtcccgtctgaggaaaccgacgaaaatgacctgatcctggaggtcaccgctggcgtgggagggcaagaagcaatgttatttacttccgaaatcttcgacatgtaccaacagtacgccgcctttaagcgctggcactttgagaccctcgagtattttccttccgaactgggcggactgcgccacgcatccgcatctataggcggcagcgaggcataccgccatatgaaatttgaaggaggtgtccatcgagtccaacgcgtccccaaaaccgaaaaacagggcagggtgcacacatcgacaatgacagtggcaattctcccgcagccaacggaaattaatttagtcatcaatcccaaagacctaaggatagatactaaacgggcaagtggagcaggtggacagcacgtcaacaccacagattcagccgttaggatcgtgcaccttccgacagattggaagtag

SEQ ID NO: 24169 - DNA, 1143 bp, Artificial Sequence
  Description of Artificial Sequence: Synthetic coding sequence
atgcggagccgggtgctgtggggcgccgcccggtggctgtggcccagacgcgcagtgggtccggctcggcggcctcttagcagcgggagcccaccattggaggagctcttcacccgtggcggtccattgcgcacctttctcgagcggcaggccggctctgaggcacacttgaaggtgcgccgccccgagctgttagctgtaataaagcttttgaacgagaaggaacgcgaactgcgcgaaacggagcatctactccatgacgagaacgaagacctgcggaaactggccgagaacgaaatcacactgtgccagaaggagattacccagctgaaacatcagatcattttgttgctagtcccatcagaggagactgatgagaacgatttgattcttgaggtaaccgcaggggtcggtggccaggaagccatgctgttcacaagcgagatttttgatatgtatcagcaatatgccgccttcaagcgatggcactttgagactctggaatactttccaagtgagctcggaggtctgagacacgccagcgccagcattggtggctccgaggcctatcgtcatatgaagtttgaaggaggcgtccatagagtgcaaagagtccctaaaaccgaaaagcaaggaagggtccatacctctaccatgactgtggcaatactgccccagcctacggagattaacctcgttatcaacccaaaagatctgcggattgataccaagcgggccagcggggcgggaggccagcacgtaaatacgacagacagcgctgtgcgcattgttcacctgcccaccggcgtggtgagtgagtgccagcaggagaggagccagctgaagaacaaagagctggctatgaccaagctccgggccaaactgtactcaatgcacttagaggaggaaataaacaagcgccagaatgcccggaaaattcaaatcggcagtaagggtcggtctgaaaaaatccgtacctacaatttcccacaaaaccgtgtgaccgatcatcgcataaataagaccctccacgatctggagacgttcatgcagggggattacctcctggacgagttggtgcagtcactgaaagagtatgcagactacgaaagtctcgtcgagatcatcagtcagaaagtgtag

SEQ ID NO: 24170 - DNA, 3561 bp, Artificial Sequence
  Description of Artificial Sequence: Synthetic coding sequence
atgtgcgaggtgatgcccaccatcaacgagggcgaccggctgggcccaccccatggtgccgacgccgatgctaacttcgagcagctaatggtgaatatgctggatgagagagagaaactcctggaatccttgagggaaagccaagagactttggcagctacacagtcacggctgcaggacgctatacacgaacgcgatcagttgcagagacatttaaattctgccttaccacaggagtttgcaaccctgacgcgagagctgagcatgtgtcgcgagcagttgctggagcgggaggaggagatatctgagcttaaggcagaacgcaacaacacgaggctcctgttggagcatctggaatgcctcgtgtctagacatgaacgcagcctgaggatgacagttgtgaagcgccaggcgcagtcaccgagcggtgtgtctagcgaggtcgaagtcctgaaggccctcaagtctctgtttgagcaccacaaagctttggacgagaaagtgagagaaaggttacgcgcggcactcgaacgggtgaccacactcgaagaacagttggctggcgctcaccagcaagtgtccgccttacagcagggagccggcgtccgtgatggggcagcggaggaggaaggcacagtagagttggggccaaagcggctgtggaaagaggacacaggacgagtcgaggaactgcaggagttgttggagaagcagaacttcgagctgagtcaagcccgtgagcgattagtaactctcaccacaacagtgacagagcttgaggaagatttgggtactgctcggcgagacttgattaagtctgaggagctttctagcaaacaccagcgcgatctacgtgaggcgttggcgcagaaagaagatatggaggagcggattacaaccctggagaagcgctacctggccgcccagagagaagcaacctctattcatgacctgaatgacaaactcgagaatgagttggctaacaaagaaagcttacacaggcagtgtgaagaaaaagcgaggcacttacaagagttgctagaggtcgcagagcagaagttgcaacagactatgaggaaagctgaaaccctgccagaggtggaagctgagctggcccagaggatcgctgccctaacaaaagccgaagagcgccacggaaatattgaagagcacttgagacagctcgaaggacagcttgaggaaaagaatcaggagctagcgcgcgtgaggcaaagggagaaaatgaatgaggaccataacaaaagactgtccgacaccgtggatagactgctgtcagagagcaacgaacgccttcagctgcatctgaaggagagaatggccgccctggaagagaaaggtcgcctgagcgaagagatcgagaaactgcgccaagaggtcgaccagctgaaggggcgcggagggccttttgtggacggagttcattcacggagtcacatggggtccgctgccgacgtccgcttctcattaggcacaaccactcatgcaccccccggagtccatcgccgctactcagcgctacgcgaagagtcggcaaaagactgggaaacttctcctctgccaggcatgctggcccctgccgccgggcccgccttcgacagtgatcccgaaatttccgatgtcgatgaagacgaacctggggggctagtcggcagtgccgatgtagttagtccatccggacattcagacgcccagactctggctatgatgctgcaagagcagctggatgctataaatgaggaaatcagaatgatccaggaagaaaaggaatctactgagctcagagccgaggagatcgaaactagagtcacatctggttccatggaggctctaaatctcaaacagctcaggaagaggggatcaatcccaacctcactgaccgctttaagtctagcctccgcaagtcctccgctctccggcagatctacccccaagctcacctccaggagtgctgcccaagacttagaccggatgggagtgatgacactgccctcggacctgagaaagcaccgtcgtaagctgctcagtcctgtatcccgagaggaaaaccgtgaggacaaggcaacaatcaagtgtgagacctctcccccgagttcacccaggacgctcaggctggagaaactgggacaccctgcgctcagccaggaggagggcaaaagcgcattggaggaccagggatctaatccgtcgagttccaattcgtcccaggatagtttgcataagggtgccaaaagaaagggcatcaagtctagtatcggtcgtctcttcgggaaaaaagagaaaggccgattgatccagctatccagggatggggctaccggccatgttctattgactgatagcgaattttccatgcaagagcccatggtgccagctaagctgggtactcaggccgagaaagacaggaggcttaaaaagaagcaccaacttctcgaggacgcacgccggaaaggaatgccttttgcacagtgggacggccccacagtggtgtcttggttggaattatgggtcggtatgccggcttggtatgttgccgcatgcagagctaatgttaaatctggggccataatgagcgcactcagcgacacagagatccagcgggagattgggatttctaatgcactacatagacttaaactgcgcctcgccattcaggagatggtgtcgctcacgagcccctctgcaccccccacatcaagaacatcgtcaggcaatgtatgggtgactcatgaggagatggaaactctggagacatccactaaaactgacagcgaggaaggaagttgggcccaaactctcgcctacggagacatgaatcatgaatggatcgggaatgagtggctacccagtctggggcttccacagtacagaagctatttcatggagtgcctcgtagacgcccggatgctcgatcatttgacgaagaaggatctaagagttcacctgaaaatggtagattcgttccataggacctctctgcagtacgggatcatgtgtctgaaaagactcaattacgacagaaaggagttagagaagcgaagggaggagtctcaacatgagataaaagatgtactggtgtggacaaatgaccaggttgtgcactgggtgcagagtattggccttagggactatgctggcaatcttcatgagtctggagttcacggggcattattggcactcgacgaaaactttgatcataataccttagcactcatcttgcagattcccacccagaatacacaggctcggcaagtgatggagcgtgagttcaataacttgctcgccctcggcaccgaccgaaaactagacgatggagacgacaaggttttccggcgtgccccttcttggcgaaaacggttccgcccaagggaacatcacggccgcgggggaatgctttctgctagcgccgagactcttcctgctggcttcagagtgagtactctcggaacattgcaaccaccccccgccccccctaaaaagatcatgcctgaggcccattcacactacctgtacgggcacatgctatccgcatttagagattag

SEQ ID NO: 24171 - DNA, 1803 bp, Artificial Sequence
  Description of Artificial Sequence: Synthetic coding sequence
atgagccgggtggccaagtaccggcggcaggtgagcgaggaccccgacattgactcactcctggagaccttgtcacctgaagaaatggaggaattggagaaggaacttgatgtggtagaccctgatgggtcagtgcctgtagggctgagacagaggaatcagactgaaaagcagtccacgggagtgtacaatagagaggcaatgctcaatttttgtgagaaggaaacaaagaagctgatgcagcgcgaaatgtcaatggacgagtccaagcaggtggagacgaagacagacgctaagaatggggaggagaggggacgcgatgcctctaaaaaagcactgggaccacggcgcgactccgatctcgggaaggagcccaagcgcggaggcctgaagaagtccttttcacgtgatagggatgaagctggcggtaagagtggcgagaagccgaaggaggaaaagatcatcaggggcattgacaaaggtagagtccgagctgcagtggacaaaaaggaggcaggaaaggacggccgaggggaagagagagccgtggctacgaagaaggaagaggagaaaaaaggttctgacagaaatactggtctctcacgtgataaggacaagaagagggaggagatgaaggaagttgctaaaaaggaggatgacgagaaggtcaagggcgagaggcgtaataccgacacacggaaagaaggggaaaagatgaaacgcgctggaggtaacacggatatgaagaaggaagatgagaaggtgaaacggggcaccggaaacaccgacactaagaaagatgacgagaaggtaaaaaaaaacgagcctttacacgaaaaggaggccaaggacgatagtaagacaaaaactcccgaaaaacaaactccaagcggccccaccaagccctccgagggacccgccaaggtcgaagaggaggccgccccaagtatctttgatgaaccactggagagggtgaagaataatgacccagagatgaccgaagtgaacgtgaacaactcagattgtattacaaatgagattcttgtgcgattcaccgaggcactggagttcaataccgttgttaagctctttgctctggccaacacacgtgccgatgatcatgtggcgtttgccatcgccatcatgttgaaagcaaataaaacgataacatccctgaacctggactccaatcatattactggtaaggggatcctggccatcttcagggctctgcttcaaaacaacacccttaccgagttaagattccataatcaaagacacatctgcggtggaaaaactgagatggagatagcaaaactcctgaaagagaatacaaccttgctaaaactaggctatcactttgaactggctggacctagaatgacggtcaccaacctcctgtcacgaaacatggacaaacagcgccaaaaacggctgcaagaacagcgtcaggctcaggaggccaagggggagaagaaggacctactcgaagtcccaaaggccggagcggtggcgaaaggttcgccaaaaccatctcctcaaccttcaccaaaaccatccccaaaaaattcaccaaagaagggcggcgcccctgccgcacccccaccaccgcctcctccactggcacctccactcataatggagaacttgaagaattcgctgtcgccggctacgcagaggaagatgggtgacaaagtgttaccagcccaggaaaagaactccagggatcagctgctggcagcgatccggtcctctaatctcaagcaactgaagaaagtcgaagtgccgaagttgctgcagtag

SEQ ID NO: 24172 - DNA, 828 bp, Artificial Sequence
  Description of Artificial Sequence: Synthetic coding sequence
atgggcacccggctgcccctggtgctgcggcagctgcggcggcccccccagcccccaggcccaccccggaggcttcgcgttccatgtcgtgcctccagtggcggcggcggcggcggtgggggcggacgtgaaggtttactgggtcagagaagacctcaggacgggcaggcccgatcgtcctgctctcccgggggacggacacccgcggcccgtgatagcattgtccgtgaagtgatacagaatagtaaggaggtactgtccctgctgcaggaaaagaacccggcattcaaaccagttctggccatcattcaggccggagatgataatctgatgcaagaaatcaatcagaatctcgctgaggaggccgggctgaacatcacccacatatgtctcccccctgacagctcggaggcagaaattatagacgaaatccttaaaatcaatgaagacactcgagtgcacggattggccctgcagatttctgagaatttgttctcaaataaagtcctcaacgctttgaaacctgagaaagacgtagacggcgttactgatattaacttaggtaagctggtgcgaggcgatgcccacgaatgttttgtctctcccgtggctaaagctgtcattgaactgctggagaaaagcggtgtaaacttggatggaaaaaaaatactggtcgttggggctcacggtagcttagaagctgccctgcagtgtctgttccaacgcaaggggagcatgacaatgagtatacaatggaagaccagacagctgcaaagcaagacagaatctcgctcagtcacaaggttagagtgccgacgagtgatttag

SEQ ID NO: 24173 - DNA, 999 bp, Artificial Sequence
  Description of Artificial Sequence: Synthetic coding sequence
tgaggccgggagggcctgctgggccagcggcggccccaggacggccaggccaggagcagctgctcccccggtgggcgaactcctgcggcacgagacagtattgtaagagaagtgatccaaaattcaaaggaggtacttagcctgcttcaggaaaaaaaccctgcatttaagccagttctggcaatcatccaggcaggggacgataatctcatgcaggaaattaatcagaatttggctgaagaggccggcctgaacattacccacatttgtctgccacctgactctagcgaggcagaaatcatcgatgagatcctgaaaataaatgaggatacccgcgtgcatgggctggctctacagatttctgagaatttgttttctaataaagtgctgaatgctctgaaacccgagaaggatgttgacggcgtaacggacatcaacttgggaaaactcgtcagaggtgatgcccatgaatgtttcgtctctccagtggccaaggccgtgattgaactactcgaaaaatctgtcggggtcaatttggatggcaaaaaaattttagtggttggggcccacggatcacttgaagccgcattgcagtgcctcttccagcgtaaggggtccatgacgatgtctatccaatggaaaactcgtcagttgcagagtaaactgcatgaggctgatatcgtggtcctcgggtcccctaagcctgaggagattccactgacgtggatccagccaggcaccacagtactcaactgctcccatgattttctgagcgggaaggtggggtgcggatctcctcgcatccactttggaggcctgatcgaggaggacgatgtgatcctgctcgccgcagccctgcggatccagaatatggtgtcctcaggtaggagatggttacgggaacagcagcaccggcgctggcggctccactgtttgaaattacagccactaagccctgtacctagcgacatcgaaatttctcggggccagactccctag

SEQ ID NO: 24174 - DNA, 2937 bp, Artificial Sequence
  Description of Artificial Sequence: Synthetic coding sequence
atgggcacccggctgcccctggtgctgcggcagctgcggcggcccccgcagccccccggccctcctcgcagactgcgtgtgccatgtagagcatcgagcggcggtggcggaggtgggggtggcggccgtgaaggacttcttggacagcgccgaccacaggacggacaggcccgcagttcttgctctccgggcgggcgtacacccgccgcaagggactccattgtgagggaagtaattcagaattctaaggaagtcctctctctgcttcaagagaaaaacccagcttttaaacctgtgctagcaattattcaggccggcgacgacaatctgatgcaggaaatcaaccagaatctcgccgaagaagccggactcaacatcacccacatttgcctgcctcctgacagctccgaagctgagataattgacgaaatactaaaaatcaacgaggatacccgtgtgcacggcctcgccctgcagataagcgagaatctctttagtaacaaagttctaaacgccctaaaaccggagaaggatgtagacggggtcacggatataaatttgggaaaactcgtgaggggggacgcacacgaatgctttgtctcaccagtggccaaggctgtcatcgagttactggagaagagcggggtgaatctggacggcaaaaagatcctggtggtgggtgctcacggctcgctcgaggcagctttgcagtgcctgttccaaaggaagggatccatgactatgtctatccagtggaaaacacgccaactgcagagtaaacttcatgaagccgacatcgttgtattggggtcccctaagccggaggagatccccctgacttggatacagcccggaacaaccgtgctaaattgctctcatgattttttgtccgggaaagtggggtgcgggagtcccaggattcactttggcggtctgattgaggaggacgacgttattctgttggccgccgccctcagaatccagaacatggtcagctcgggaagacggtggttgcgtgagcagcaacaccgaaggtggaggctacactgcctcaagcttcagccgctgtcccctgttccctctgatatcgaaatatcaagaggccagacacccaaggctgtggacgtccttgcgaaagagatagggctgctagcggatgaaattgagatctacggaaagagtaaggccaaggttcggctcagcgttttagaaaggttgaaagaccaggctgatggtaaatacgtgctcgtagccggtattacgccaacaccgctaggggaggggaagagtaccgtgactattggtctggtgcaagctcttaccgctcacctgaacgtcaactcctttgcctgtttgcgacaaccttcccaaggtcctacattcggagtgaagggtggagcagcggggggaggatatgcccaggtgatacctatggaggagtttaacttacacctgacaggcgatattcacgctattacggcagcaaataacttgctggccgccgcaatcgataccaggatcctgcacgaaaatacccagaccgacaaagccttgtacaaccgtttggttcctctagtgaacggcgtgagagagttctcagagattcagctggcccggctcaagaaactaggaattaacaagaccgatccctctaccctgactgaagaggaagtctccaaattcgcacgactggatattgatccttccaccatcacctggcagagggtgctggacacaaatgaccgatttctgaggaaaatcactataggccagggtaatactgagaaaggccattacaggcaagcccagtttgatatcgctgtggccagcgagattatggctgtgcttgccctaaccgattctcttgccgatatgaaagcccgattgggcagaatggtcgtagcctcagataaaagcggacaaccagtcactgccgatgatctaggagtaacaggtgctctcacagtgctgatgaaggacgccatcaagcccaatctgatgcaaaccttggaagggaccccggttttcgtgcacgcaggcccctttgccaacatcgcacacgggaacagcagcgtactggctgacaagattgcccttaagttggtgggagaagagggattcgttgtcaccgaagccggtttcggagccgacatcgggatggagaagttcttcaacataaaatgtagggcaagcggtttggtgcctaatgttgtggttctggtggcaaccgtgagggctttaaaaatgcacggcggagggcccagtgtcactgctggggtgcctctcaagaaagaatacacggaggagaacattcagctggtagccgatggctgctgtaatctgcagaagcagatccagatcacccaactgtttggggtgccggtggtggttgcactgaacgtgtttaaaacagacactagggcagaaatcgatctggtctgtgagttagctaagagggctggggccttcgatgcagttccgtgttaccactggtccgtgggagggaagggaagtgtggacctggctcgtgcagtgagagaggctgcgtctaagcggagcagatttcagttcctctacgatgtgcaggtccccattgttgacaagatccgcactatagcccaagccgtttatggtgccaaagacattgagctttcccccgaagcacaagctaaaatcgaccggtacacccagcaaggatttggaaacttgcccatctgcatggctaaaacacacctgtctctctcccaccaaccagataagaaaggcgttcccagagatttcatacttcctatcagtgatgtgcgggccagcatcggggcagggttcatatacccgctcgttggtactatgagcactatgcctgggctgcctacccgtccttgcttttatgatatagatcttgacactgagactgaacaggtcaagggcctcttttag

SEQ ID NO: 24175 - DNA, 408 bp, Artificial Sequence
  Description of Artificial Sequence: Synthetic coding sequence
atgatccccaacggctacctgatgttcgaggacgagaacttcatcgaatcgagtgtagctaagctaaacgctcttcgaaagtccggtcaattctgcgatgtccggctccaggtgtgtggccacgagatgctggcccatcgagctgttctagcttgttgctcgccctacctgtttgaaatctttaatagtgatagcgaccctcacggcattagccatgtgaaattcgatgacctcaatcctgaagccgtggaggtcctgcttaactatgcctatacagcacagctaaaagccgacaaggaactggttaaagacgtctactcggctgcaaaaaagctgaagatggatcgggtgaagcagcaccttctctacttctgtctccactccacaagcacttcctcccttttatag

SEQ ID NO: 24176 - DNA, 1929 bp, Artificial Sequence
  Description of Artificial Sequence: Synthetic coding sequence
atgatccccaacggctacctgatgttcgaggacgagaacttcatcgagagctctgtggctaagctgaacgcgcttagaaaatccggccaattttgtgatgtgcgtcttcaggtctgtgggcacgaaatgctggcgcatcgggctgtgctggcatgctgttccccttacctctttgaaatctttaactccgactcagacccccatggaatttcccacgtaaaattcgacgatctgaaccccgaagccgtggaggtgctgcttaactatgcctataccgcccagttgaaagcggataaggaattagtcaaagatgtgtactctgctgcaaaaaaactgaagatggaccgcgttaagcaagtgtgcggcgactacctgctatctcggatggatgtgaccagttgcatcagttaccgcaatttcgcttcatgtatgggcgacagcaggttgctgaacaaggtcgatgcttatatacaggagcatcttctgcagattagcgaagaggaggaatttctcaaactgccccgtctgaagttggaagtgatgttggaagacaacgtatgtctgccctctaatgggaaactatacacgaaagtgatcaattgggtgcagcgcagcatctgggagaatggcgactcattggaggaactaatggaagaagtgcagacactgtattattctgccgaccataagctgttggacggaaacttgctggatggccaagccgaagtatttgggagcgatgatgatcacattcagttcgtccagaagaagccccctagggagaacggtcacaagcagatttcgagttcatctacaggatgtctgtcatcaccaaatgcaacagtgcaaagtccgaagcatgaatggaaaatagtggcatcagagaagacttcaaacaacacgtacctgtgcctcgctgtattagacggaatcttttgcgtaatttttctgcacggtcgcaacagcccacagagttcacccactagcacgcctaaattgtctaaatctttaagttttgaaatgcaacaggacgagctgattgagaaaccaatgtcaccaatgcaatacgcgagatccggccttggcacagcagagatgaatggcaagctcatagcagccggaggctacaacagggaagagtgcttacggactgtagaatgctataacccccataccgaccactggtcctttctggctcccatgaggaccccacgcgcacggttccagatggctgttttaatgggccagctgtacgtggtgggcggtagcaatggacattctgacgacctatcctgcggagagatgtatgactctaacatcgacgattggatccccgtgccagaactgcgcaccaatcggtgcaatgccggcgtgtgtgcccttaatgggaagctctacattgtggggggttctgacccctacggtcagaaaggactgaaaaactgcgacgtgtttgatcctgtcaccaagctctggacttcttgcgccccattgaatatcaggcgccatcagtccgccgtgtgtgaattgggaggatatctatacatcatcggcggtgccgagagctggaactgcctgaacaccgtggagcggtacaacccggagaataacacctggacgctgatagcacctatgaatgttgcccgccgtggggcgggcgtggcagttctcaacgggaagctgttcgtatgcgggggcttcgatggttctcacgcaattagctgcgtagagatgtacgaccccactcggaacgaatggaagatgatgggcaatatgacttcacccaggtccaatgctggaatcgctaccgtggggaatacaatatatgcagtcggagggtttgacggcaatgagttcctgaacacagttgaggtctacaacctcgagtccaatgagtggagcccgtatactaagatatttcaattctag

SEQ ID NO: 24177 - DNA, 408 bp, Artificial Sequence
  Description of Artificial Sequence: Synthetic coding sequence
atgagcaagaacaccgtgagcagcgcccggttccggaaggtggacgttgatgagtatgatgagaacaaatttgttgatgaggaagacgggggtgatggtcaagctggtcccgacgagggcgaggtggacagctgtttgcgacaggggaatatgacagctgctttgcaggcagcccttaagaatccccccattaatacaaaaagccaggctgtgaaagatcgggccggtagcatagttctcaaggtgctaattagctttaaagcgaacgatatcgagaaggccgtacagtctttagacaaaaacggcgtcgacctgctgatgaagtacatctataagggatttgaatcgccctctgacaatagttctgccatgctgctgcaatggcacgaaaaagtgcctctggtgtag

SEQ ID NO: 24178 - DNA, 849 bp, Artificial Sequence
  Description of Artificial Sequence: Synthetic coding sequence
atggccagcagcttcctgcccgccggcgccatcaccggcgacagcggaggcgaactctcatctggagacgattccggggaagtcgagttcccacactctccagaaatcgaagaaacatcatgtctggctgagctgttcgagaaggccgccgcgcacctacagggcttaattcaggtcgctagcagggagcagctgttgtacctgtacgcaaggtacaagcaggtgaaagtcggtaactgtaacacccccaagccatccttcttcgattttgaaggcaaacagaagtgggaagcctggaaagctttaggtgactctagccctagccaggccatgcaagagtatattgccgtggttaaaaagctggacccgggctggaacccccagataccagaaaaaaaaggtaaggaagccaatacaggattcggtggaccggtcattagttccttgtaccatgaagaaaccattcgtgaagaagataagaacatcttcgactactgtagagagaacaacatagaccacatcactaaagctatcaagagtaagaatgtggacgtgaatgtcaaggatgaggaaggaagagcccttctgcactgggcgtgtgatcggggacacaaggagctggtgactgtactgttgcagcatcgcgccgatattaattgccaggataatgagggccagaccgctctgcactatgcctcagcctgcgagtttttggacatcgtggaactgctcctgcagagcggggctgaccccactctccgggaccaggacggctgcctccctgaggaagtcactggttgcaagacggtctctttggttctgcaaagacataccacagggaaggcctag

SEQ ID NO: 24179 - DNA, 9354 bp, Artificial Sequence
  Description of Artificial Sequence: Synthetic coding sequence
atgcggagcagcaagagcaaggaggtgcccctgcccaacccccggaactcccagtctaaggacacagtgcaggccgacatcactacgagttgggacgctctctctcaaacgaaggctgcccttaggcacatcgaaaacaaactagaggtggctcctacttccacagcagtctgcgacagtgttatggacacaaagaaatcctctacatcagcaacacgtaagattagcaggaaagacggccggtacctggacgattcgtgggtcaacgctcccatatccaagtcgacgaagagcagaaaggaaaaatcacgcagccctttgcgggccacaacactggagagcaacgtgaaaaagaacaatcgcgtagagttccgggagcctcttgtgtcctaccgagaaattcacggagccccaagtaattttagttccagccatctggaatccaagcacgtttactgcgtggatgtcaatgaggaaaagacagaaagcggtaactggatgattgggtccagggaagagcggaacattcgtagctgcgacttcgagagtagtcaaagcagtgtcatcaacgacacggttgtccgcttccttaacgaccggccagccatcgatgcactgcagaactcagaatgcctcatccgtatgggtgcatccatgcgaacggaagaggagatgcccaacaggactaagggctccgagaataatttaaagttgtccgttaataatatggcccatgatactgaccctaaggctctgcggttgacggactcctctccttcaagcacttctacatctaactcccagcggttggatatcctgaaacggaggcagcacgacgtcaagctggaaaagcttaaagagaggatcagaaagcagtgggagcacagtgaagaaacaaatggcaggggacaaaaactgggtcacattgatcatcctgtcatggtggtgaacgtcgataatagcgtgacagctaaggtaagaaaggtggcaaccgccccacccgctcccgcctacaaaggctttaacccctcggagacgaaaatacgtacccctgacggtaaggtgtggcaggaggcagagtttcaaaacatgtcaagggaactttacagggatctggctctccacttcgccgacgacatttccattaaagagaagcctgccgaaaagtctaaggaaaagaaagtggtgaagcctgtccggaaagtccagaaagtggcgcagctctcgagcactgaatgcagaactggttctagccacctaatctcaacgtcctcgtggagggatggccaaaagttagtcaaaaaaatcctgggacccgcccccagaatggagcccaaagagcaacgcaccgcgtctagcgatcgcggtggtcgagagcgaaccgccaaatctggtggccacattgggagagccgaatctgatcctagactggacgttctgcacaggcatctgcagagaaactcggagaggtcaagaagcaagtccagatccgagaataatattaagaaattagccagttctctgcccgacaacaagcaggaggaaaacacagcacttaataaggatttcttgccgatcgagatcagaggcatattagacgacttgcaactggactcaacagcgcataccgcaaaacaggacacagtggagttgcagaatcagaagagcagtgcccctgtgcacgcaccaaggagccacagcccagtgaagcgcaagcccgataagattacagccaatgaagatccccccgtgatcagcaagcgtagacattacgatacggatgaggtgaggcagtatattgtgagacagcaggaagaacgaaagaggaagcagaacgaggagaagaaggcgcagaaagaagcaacagagcagaagaacaagcgcctgcaggagctatataggaaacagaaagaggcatttaccaaggtgaagaatgtgcccccatcggagccaagcgccactaggcggctccaggaaacctactctaagctgctcctggagaaaaccttgctggaggaacccagccatcagcacgtgacgcaggagacccaggctaaaccaggataccagccatctggcgagagtgataaggaaaataaggtgcaagagagacctccatccgccagtagtagctcagacatgagcctgtcggaacccccacagccgctcgcgcggaaagacctaatggaatctacctggatgcaacccgagcgcttgtctcctcaggtgcaccactcacagcctcagccgttcgctgggaccgctggatccttgctttctcacttgctgagcttggaacacgtgggaatcctgcacaaagatttcgagtccatcctgccaactcgcaaaaatcacaacatggcgtcacgccccctaacattcactccacaaccgtacgtgactagccccgccgcatataccgatgctcttctgaagcccagcgcttcacagtacaagagcaaactcgatcgcattgaggcacttaaggccacagccgcttccctctccagcagaatcgagtctgaagctaaaaagctggccggagcaagcatcaattacggttctgcttggaacactgagtatgatgtgcagcaggccccccaggaggacggaccatggaccaaggccgttacacccccagtgaaagatgacaatgaggatgtgttcagtgcccggattcagaagatgctgggctcctgcgtcagtcacgctacttttgatgacgatctgccaggcgtcgggaacttaagtgagtttaaaaaacttcccgagatgatcaggccacagtctgccattagttccttccgggtccggagtcccggccctaaacccgaaggcctgctcgctcagctgtgtaagagacagacggacagctctagctccgatatgcaggcctgttcacaggacaaggcgaaaatctcactgggttcctctattgacagcgtgagcgagggaccgctcctatctgaaggcagtctgtctgaagaggaaggtgaccaggatggacaaccgctgcttaaggtggccgagattcttaaagagaaagaattttgccccggggagcgtaatagctacgaacctattaaggaattccagaaggaggcggagaagtttctgccacttttcggccatattggtggaacacagagcaaaggaccatgggaggagctcgccaagggctcaccccacagtgtgataaacatcttcaccaaaagctaccaactgtacgggaaaggctttgaggacaaactggatcgggggacgagcacttcccgccccttgaacgccactgctacccccctatctggcgtgtcatatgaagacgattttgtgagcagtccagggaccgggacttcaacggagaagaagagcacactggagccacacagtaccctgtccccccaggaggatcacagcaatcggaaatccgcgtatgaccctagttctgtggatgtgaccagtcaacattcctctggggcacagagcgctgcatcttcccggtcttcaacaagctcaaagggaaagaaaggcaagaaagagaagacagagtggttggatagctttactggcaacgttcagaatagtctgctagacgaagagaaggctgaacgcgggagccaccagggcaagaaaagtgggacctcctcaaagctgtccgttaaggatttcgaacagaccctggacacggatagtactcttgaagacctatctggccatagcgtgagcgtgtcttctgataaagggagatcccagaaaactcctacctcccctctgtccccctcttcccagaaatctttacaattcgatgtcgcaggcacttcttcggagcgaagtaagagctccgtcatgcctcctacaatcaccggcttcaagccgaacgctcctttgacggatctgaatcctgcagccagtcggacaactacagagaatatggccccgatcccaggctccaaacggttttcccctgcaggcctgcatcacaggatggccgccgaactgtcctatctgaacgcgattgaagaaagcgtgaggcagctgtccgacgtagagagagtaagggggatttcactggcacaacaagaaagcgtgtcactggctcagattattaaagcccagcaacagagacatgagcgcgacctcgccctgttaaagttaaaggccgagcaggaagcattagagagtcagcggcagctggaggaaactcgcaacaaggctgctcaggtgcatgctgaatcactgcaacaggttgtacaaagtcagcgggaggttaccgaggttcttcaggaagctacctgcaaaatcgcagctcagcagagcgaaactgcccggttaaccaccgatgctgcccggcagatctgcgaaatggcggaattgacaaggacgcacatttccgatgctgtcgtggcctcaggggctcctctggccatcctgtatgaccaccagcggcagcaccttcctgactttgtgaaacaacttagaactcgtacggagaccgatcgaaaatcccctagcgtgagcctgtcccagtccaaggaaggcactttagattcaaagcaccagaagtactcagcttcctacgatagctacagcgagtctagcggctacaagaaccacgaccgccgcagcagtagcggatcatcccggcaggagtccccctcagtgccctcctgcaaagagaatgaaaagaagctgaatggtgaaaaaatcgaatctagcattgacgagcaggtccagacagccgccgacgactctcttagaagtgattcagtaccgagcctcccggacgaaaaagattccacctctattgccaccgagtacagtttgaaattcgatgaaagcatgactgaggatgagatcgaggaacagagcttccgttctttactgccatctgagagccaccggcgctttaatatggaaaagcggagaggccaccatgacgattccgacgaggaggcaagtccagagaagacaaccttgagtaccgccaaagaattgaacatgccttttagtggcgggcaggatagctttagtaagttcaccatggagatggtgaggcaatatatgaaggaagaagagatgcgcgccgcccaccagtcttcacttttaagacttagagaaaaggcactaaaggagaagactaaggccgagctcgcctggctggagcatcagaaaaagcatcttcgggacaagggagaggatgacaaaatgcctccactacgtaaaaagcaaaggggcctgcttcttcggctccagcaggaaaaagctgagatcaaacgcttgcaagaagcgaacaaggccgcacgcaaggagagacagctgatcctcaagcagcaggaagagattgagaagattagacaaaccacgataaagctccaggaaaagctaaagtccgcaggagagtctaagcttgattctcatagcgacgacgatactaaggataacaaagcgacctcaccaggcccgaccgacttagaaacacgatctccctctcccatcagcatttcaagcagtgagacgtcttctattatgcaaaaattaaagaagatgagaagcaggatggacgagaagttcttgacaaagagggagcaaaaactgatgcagcgccgacagcatgcagaagagctactggagtggaaacggagactcgacgctgaagaggccgagatccgacagatggagaagcaggccttagcggcctgggataaggagctgataaagccaaagacccccaaaaaggagctggaggaccaacgcacagagcaaaaggaaatcgctagcgaagaggaaagcccagtgcctctttacagccatctcaacagcgagtccagtattcctgaagaacttgggagcccagccgtcgagtacgtgcccagtgagagtatcggccaggagcagcctggctcgcccgatcattccatactgacggaggagatgatctgtagccaagagctggaaagcagcacttccccctcgaaacatagcctgcccaaaagctgcacatcagtgtccaaacaggagtcttccaagggctctcacaggacagggggacagtgtcatcttccaatcaagagccaccagcactgttacagctggagcgatgagtcattatcaatgacgcaatcagaaactacaagcgatcagtcagacatcgaggggcgtatccgcgcacttaaagacgagctgcggaagcgcaagtctgtggtcaatcagctcaagaaagaacaaaaaaaacggcagaaagaacggttgaaagctcaggaggcctctctgatcaaacagctggaaagctatgacgagtttattaagaaaactgaggctgagctatctcaagacctggagacctcgcccaccgccaagccccaaattaagaccctgtcctccgcatccgaaaagcctaagattaagccccttactcctctgcaccggtctgagaccgccaagaattggaagtctctgacagagtcagaacggagccggggttcacttgagtcgatcgctgaacatgtggacgcctccttgtctggttcagagaggtctgtttcagagaggtccctgagcgcttatgccaagcgggttaacgagtgggacagcagaactgaggacttccagaccccatcgcccgttctgaggagtagtaggaaaatccgcgaagagtcaggtgacagcctcgagaacgtcccggcgctgcacctgctcaaagagctgaatgccacctcaaggatcctggatatgtccgatggcaaagttggggaaagttctaaaaagtctgagattaaggagattgagtacactaagttaaaaaagtccaaaatcgaggatgcttttagtaaggaggggaagagtgacgtcctgctaaaattagtgctggaacagggcgactcgagtgagatcttgtccaagaaagatctgccacttgatagtgaaaatgtacaaaaagatctggtcggcttggcaattgaaaatctacacaagtccgaggaaatgctcaaagaacggcagtctgaccaggacatgaatcactctcctaatatacagtctggcaaagacatccacgagcagaaaaacaccaaagagaaggatctgagttggtccgagcacctcttcgcgcccaaagagatcccctacagtgaggattttgaggtgtctagttttaagaaggagatttctgccgagctatataaggatgattttgaagtgagttcgctgctgagcctgcgaaaagattctcagagctgcagggacaaacctcagcccatgaggagtagtacctccggagccacatctttcgggtccaatgaagaaattagcgaatgtctgagtgaaaagagcctaagcatccactctaacgtacatagcgacaggctgctggagctgaagtctcctactgagctgatgaaatctaaggagcggtccgacgtagagcacgagcagcaggtcactgagagcccctccctggcctctgtgccgaccgcagacgaactgttcgattttcacataggtgacagggtgctgatcggcaatgtgcagccgggaatattacgatttaaaggagaaacaagttttgcgaaaggtttttgggccggagtggagcttgacaaaccagaagggaacaacaatgggacctacgacggcatagcgtatttcgagtgcaaggaaaaacacgggatcttcgcccccccccagaagataagtcacatccccgaaaattttgacgactacgtcgacataaatgaagacgaggattgctatagtgatgaaagataccagtgctacaatcaggagcagaatgacaccgaaggcccgaaagacagggagaaggacgtgtccgagtacttttatgaaaaatccctgccctcagtgaacgacatcgaggcttcggtgaacaggtccagaagcttaaagattgaaactgataacgtacaggacatctccggagtactggaagcgcatgtgcaccaacaaagctctgtggactcccagataagctccaaagagaacaaggatcttatttccgatgccactgagaaggtgtctatagcagccgaggatgataccctggataacactttttccgaagagttggagaaacagcaacagtttaccgaggaagaagacaatttgtatgccgaagcaagcgagaaactgtgtacgcctctcctggaccttctgacaagagaaaagaatcagctggaggcccagctgaagtcctccctcaacgaagaaaaaaagtctaagcagcagttagagaaaatttctctgctgaccgatagtctgcttaaagtttttgttaaggacaccgttaatcagctgcagcagatcaagaaaactagggacgagaagatccagctgagtaaccaggaactcctcggagacgaccaaaaaaaggtgacccctcaagacctgtcccaaaatgttgaggagcaaagcccatcgatttctgggtgttttttatcctcagaactggaagatgaaaaagaggaaatctccagcccggacatgtgccctcgccccgagtcgcctgttttcggtgcctccgggcaggaggagctggcaaagcggctggccgagcttgagctctctagggagttcctgtcagcattaggagacgatcaggactggttcgatgaagatttcgggctcagcagtagtcacaagatccagaaaaacaaagctgaagaaacaatcgtgccactcatggccgagcccaagagagtgacccagcagccttgtgagaccctcctcgccgttccacacaccgcagaggaggtggagatcctggttcataatgccgcagaggagttgtggaagtggaaggagctagggcatgacctgcactccattagcatcccaaccaaactgctgggttgtgccagcaagggacttgatatcgaaagtacatcgaaaagagtttataagcaggccgtgttcgacctcaccaaagagatattcgaggaaatatttgccgaagaccccaacttgaatcagcctgtctggatgaaaccctgtagaattaattcttcctattttcgtcgcgtaaaaaatcctaataatctggatgagatcaaatctttcattgcgagtgaagttctgaaactgttttcgctcaaaaaggagccaaatcacaaaactgactggcagaaaatgatgaagttcgggcgcaagaaaagggaccgggttgaccacatcctggtgcaggaactgcatgaggaggaggctcagtgggtgaactacgatgaggacgagctatgtgtgaagatgcagcttgccgacggcatttttgaaaccctcattaaggacactattgacgtgcttaaccaaatctcagaaaaacaggggcgtatgctactcgtttag

SEQ ID NO: 24180 - DNA, 2946 bp, Artificial Sequence
  Description of Artificial Sequence: Synthetic coding sequence
atgagcgagcaggagcggatccaggagtgcctgcggaaggagatccggtccctgctgatctccaccaaagatgggctcagtccacaggaactagagaaggaatacctgcttatggtcgggaaccacctgcctctacggatactgggatatcgatccaccatggagctggtcttggacatgcccgatgtggtacgggtgtgtccaggggctggggggactgtgatccttaaagcaatcccggacgaatccactaagggtattgccagcctggtggcaaagcagcggagttcccacaagttgaggaacagtatgcacaaagggcggcctagcatctattccgggccccgcagccataggagggtcccttatcgcggacgagtagctccaatcctgccagcagttgttaagtctgagctcaaggacctcttggccctttctccagtgttactgtcagactttgagaaggcattcgcaaagagattcgggaggagcttccagtatatgcagtacggttttctctcaatgttcgaagtcttgaacgccgccagcgatgtgatttcagttgaacaaacacgcgcaggaagcctgctcatgctgaaaaaaagtgtgacagaagagaaaccccgagggtgcccggctggaaagatctttacgcagccattcagaatgaagcagggatcctactccacaggttttcctgtcgctaagccctgtttttcacagcctactagcaacatggagccccccaagcagataatgtctatggaaaaaacctccaaactgaacgtggtggaaacatccagactgaaccacactgaaaaacttaaccagctggagaatacattcaaatcagttatcgcacagatcggtcccggaggcacaatttcgagtgagctgaaacacaagataaagttcgtggtgtccaagttccccgaggggttgttcattagtaaactgctaggcgaatacgaggtcattttcaaagaacaactctccccgaagaaactgggtttccttaacgtaactgaattagtgggggctctatctgacattctccacgtggagttccgtaagggacaccaggatcttctggtctttgatgccgataagaaaccactgccccccgtacagtccgacaaaaaaatcgaggctaaagcttgcgtgagcagtcctccacggaattctctcagcacagcggctgtgaaagaaacagtctggaactgcccgtctaaaaaacaaaaggagcctcagcagaagatttgtaagaaacccaacctggtcgtgaaaccattgcaacttcaggtggaaacaaataagtcagaactgaacctagctatggcgaatcacgatatcccccctgatgccgtcccaaataagaaactgtgccgtttaccaccgctcgatacaagttccctcattggagtgtttgtcgaatatattatttctccaagtcagttctatatccggatctactcgagagactccagtgaactgctcgaggacatgatgattgagatgcggcgctgctattccaatcaactggtcagcgatcggtacgtgatgcctgaatgcttcatccagcccggccatctttgttgcgtacgaatttcggaagataaatggtggtaccgggtgatcatccaccgagtgctcgaaaagcaggaagtcgaagtgttctacccggatttcgggaacatcggcatcgtgcaaaagagcagcttgcgattcctgaaatgttgctacaccaagttacccgcccaggccattccttgttccttagcatgggttagaccagtagaggaacactggacatccaaggcaatccttcaatttcaaaaattatgcggactgaaaccgctggtaggagtggttgatgagtacgtagatggcatattgaacatcttcttgtgtgacacctcctctaatgaagacgtatatttccaccacgtgctcagaacagaaggccacgctatcgtctgcagggaaaacatctctagtaaaggtttctctgagctgaacccactcgccctgtacaccacttcaagtggcggcccagaggatatagtgttaacggaattaggctacccctcccagcagcattacttcaacgaagatagaaagatcagtccacagagtaaagagtcagaattaaggatcctcgatgaaatccccactgggatgccctgtctggagagcgtcacaataggcgatgatatttgggatgagaattggctcccattgcaagccaagatgggtaaaggcggagacgccgccagccatttatttacagcatcactaggggggaaaaaccaatatagctcttgtaaagaaatgccccagaaggattggtgcttctcaaccccaaaggacacttgggatgactcatggcagccttccggactcgttaatggaacaaaggtcgaggttcataaaccagaggtcctcggggcccaggagaagaacactggcacaaaccggacacagaaacaactagatatcaacggctcatccgacagctcaaccctgccaaagctggaggagttttgtacctcattgacccaatctgaacagtcagcagacgggtcccaatctgagcccaacaatagtcagactcaacccaagcaaatccagctgtccactgcggcgccttgtagcactaccgctgttgacgacagcgcagaaaagccttctgggtccgtggaaagctcccctgagatcctcaaaaatgaagactttagcagctctcgggccatcaccctgtacaaagacaaacgacaggagtccgtggatcagttgagcctgatcttgtcatacgagtgccagattagtcagaagctttatattcctagatctactgctacggccgctctgggcgcagcggcccgcctggcaaccagccgttcactgttacattggtatccctcagtgaagaggatggaggcctag

SEQ ID NO: 24181 - DNA, 648 bp, Artificial Sequence
  Description of Artificial Sequence: Synthetic coding sequence
atgagcgccaagcgggccgagctgaagaagacccacctggtgaaggaaaggcactgttggaccagtaaaaattacaaggctgtgtgtctggagcttaagcccgagccgaccaaaacattcgattataaagccgttaagcaggaagggcgattcaccaaggctggggtgacccaggatcttaaaaacgagttgcgggaagtgcgcgaagaacttaaggagaaaatggaagagatcaagcagattaaggacctgatggataaggacttcgacaaactccatgagttcgtggaaatcatgaaagagatgcaaaaagatatggatgaaaagatggacattttaatcaatactcagaagaactacaaactcccattgagaagagcacctaaggagcagcaggagctgcgcctgatgggcaagacccatcgcgagccccagctgcggcccaaaaagatggacggagcttccggagtcaatggcgccccatgtgctctgcacaagaaaacgatggcgccccaaaaaactaagcaggggtctttggatccattgcaccactgtggtacctgctgcgagaagtgcttactgtgtgccctgaagaataactacaaccggggtatctatgcagccgtcggcctcctggacctctggtag

SEQ ID NO: 24182 - DNA, 606 bp, Artificial Sequence
  Description of Artificial Sequence: Synthetic coding sequence
atgagcgccaagcgggccgagctgaagaagacccacctgagcaagaattataaggctgtatgcctggagcttaaacctgagcccacaaagaccttcgattataaagcagtcaagcaggaaggcagatttacaaaggcaggagtcacacaggaccttaaaaacgagctgcgcgaggtcagggaggaattgaaagagaagatggaggagattaaacagattaaagacctgatggacaaagactttgataaactccatgagtttgtggaaatcatgaaagagatgcagaaagatatggatgaaaaaatggacatcctcattaatacccagaagaattacaaactcccacttaggagagcgccgaaggaacagcaggaattgcgtctgatgggcaaaacccacagggagccacagctgagacctaagaaaatggatggcgcatctggggtgaatggggctccttgcgcacttcacaagaaaacaatggcaccacagaagacaaagcagggaagtttggatcctctccatcattgcgggacctgctgtgtttccgagaccctgcctgagcccagtaccggggccagacccctcgcccccgccccctggtag

SEQ ID NO: 24183 - DNA, 300 bp, Artificial Sequence
  Description of Artificial Sequence: Synthetic coding sequence
atgagcgccaagcgggccgagctgaagaagacccacctgagcaagaattataaggcagtatgcctggagctgaagcccgaacccacgaaggtgcggtcccctttcgaggccatgcaggctgcgaggcctgaaattcacggtgaggtgacccggtcacagggaagttttgccgatccaagcggacaggatctctcccagacattcgattataaagccgtcaagcaggaaggcagattcactaaggcaggtcgcaccccccgactgttggaggaactgtcgctgctgcttctccctttgtag

SEQ ID NO: 24184 - DNA, 639 bp, Artificial Sequence
  Description of Artificial Sequence: Synthetic coding sequence
atgagcgccaagcgggccgagctgaagaagacccacctgagcaagaactacaaagccgtgtgccttgaattgaagcccgaacctacaaagaccttcgactacaaagcagtgaaacaggaggggagatttacaaaggctggggtgacacaggatctcaagaatgagctgagagaagtgcgggaggaactgaaagaaaagatggaggaaattaaacagataaaggatttaatggacaaggacttcgacaagttgcacgaattcgtggagatcatgaaagagatgcaaaaggatatggacgagaagatggatattctgataaacacccagaagaattataagctgcctctgcggagagcccctaaggaacagcaggagctacgccttatgggcaaaacccatagggagcctcagcttagacccaagaagatggacggagcaagtggagtcaacggtgctccttgcgcactgcacaaaaaaacaatggctccacaaaagactaagcagggtagcctggatcccctccatcactgcggcacgtgctgtgaaaagtgccttttatgcgccctcaagaacaattacaatcgagcacagctgcagaacctgccggcggtgccaatccatcaccttcaggccccatag

SEQ ID NO: 24185 - DNA, 402 bp, Artificial Sequence
  Description of Artificial Sequence: Synthetic coding sequence
tgatacgagctgcgggaggagcacctggacaagatcttcaagcacagggaactgcaacagaaattggttgatgccaaattagagcaggcccaggagatgatgaaggaagccgaagaacgccacaagcgggaaaaagaatacctccttaatcaggccgcagagtggaagcttcaggctaaggtccttaaggaacaggaaacagtactgcaggcccaggttagaccaggcggaagagggatgggtgtgctgtcctctctatcccccgacaaaaaagctggggctaagggcggacaacaaaaatcctcatatgtcgccggggacggcggaatggggatcggtaacgaggaacagctgcacatctactcctacttccaagtaaagataaaggctcagtactattag

SEQ ID NO: 24186 - DNA, 687 bp, Artificial Sequence
  Description of Artificial Sequence: Synthetic coding sequence
atggccagcgaggagctgcagaaggacctggaggaggtgaaggtgctgctggaaaaagccacccggaagcgggtgcgagatgcactgactgctgaaaagtcaaaaatcgaaaccgagatcaagaataaaatgcagcaaaaatctcagaaaaaagctgagctattggataacgaaaaaccggccgctgttgttgcaccaatcactactggctatacagtcaaaataagtaattacggctgggaccaaagtgacaagttcgtgaagatttacattaccttgactggcgtgcatcaggtgccaacagagaatgtccaggtacactttactgaacgatcctttgatcttctcgtgaaaaacctgaatggcaagtcctattcaatgatcgtcaacaacctgctgaaacctatttcagtcgagggctcttcgaaaaaggtgaagacagatactgttctcattctctgccgcaagaaagtagaaaatacaagatgggattacttaacccaggtggaaaaagaatgtaaggaaaaggagaagccctcctacgatactgagactgacccgtcagagggtctgatgaatgtcctgaagaagatctacgaggatggcgacgatgatatgaaacggaccatcaataaggcatgggttgagtctcgggaaaagcaagccaagggggatacagagttctag

SEQ ID NO: 24187 - DNA, 558 bp, Artificial Sequence
  Description of Artificial Sequence: Synthetic coding sequence
atgcagcagaagagccagaagaaggccgagctgctggacaacgagaagcctgccgctgtcgtcgcacctatcactactggctacacagtcaagatatcaaactatggttgggaccaatccgacaagtttgtgaagatatacataacactgaccggggtgcatcaggtgccaactgagaatgtgcaagtacatttcaccgagaggtcctttgacctcctggtcaaaaaccttaatggtaagtcttactctatgatagtcaataatctgctgaagccaatctctgtcgagggatcgagtaagaaggttaagactgatacagtccttattctgtgcaggaaaaaggttgagaacacccgctgggactacctgactcaggtggaaaaagaatgtaaggaaaaggagaagccaagctatgatacagagaccgacccgagcgaggggctgatgaatgtgctgaaaaagatatatgaggacggcgacgatgacatgaaacgtaccatcaacaaagcctgggtcgaatccagagaaaaacaggcaaagggggacaccgagttttag

SEQ ID NO: 24188 - DNA, 1134 bp, Artificial Sequence
  Description of Artificial Sequence: Synthetic coding sequence
atggagcagctgcccgacctgcacagccacttcagcgacctgaacctcgaggctcatatgtacgcatcccagtggtttttgactctgttcactgccaagttccccctatgcatggttttccacataattgacttattgctgtgtgagggactgaacattatctttcacgtggctcttgctcttctgaagaccagtaaggaggacctactgcaagctgactttgagggcgccctcaagttttttcgagtacagctgccgaagaggtatcgggccgaggaaaacgcccgccgcctgatggaacaagcctgcaacatcaaagtgcccaccaaaaaactgaagaagtacgagaaagagtaccagaccatgagggaatctcagctgcagcaggaggatccaatggacaggtataaaagggagaatcgacggctgcaagaggcctctatgaggctagaacaggaaaacgacgacctggcccacgagttagtgacctccaagatcgccctgagaaacgacctggaccaggctgaggacaaggctgatgtccttaacaaggagctcttgctgacaaagcagaggctggttgagaccgaggaggaaaagcgaaagcaggaagaagagaccgcacagttaaaagaagtgttcaggaagcagctggagaaagcagagtacgagataaaaaagaccaccgcgattattgccgaatacaaacagatctgttcccagctgtccacccgcttggagaagcagcaagcggcttccaaagaggagctagaggttgtgaaaggaaagatgatggcttgtaaacattgtagtgatatattttctaaggagggagccctgaaacttgctgcaaccggacgagaggaccagggcattgaaaccgacgacgaaaaagactccctcaagaagcagctcagggagatggagctggaacttgcccaaaccaagttgcagttggtggaagcaaaatgcaagatacaggagttggagcaccagcggggagccctcatgaatgaaattcaagccgcaaagaattcgtggttttctaaaacactaaacagcatcaaaacagccacgggtacccaacccttgcagcccgctccagtgacacagccacccaaagaaagcacatag

SEQ ID NO: 24189 - DNA, 762 bp, Artificial Sequence
  Description of Artificial Sequence: Synthetic coding sequence
atgatcgagaacagcagctggagcatgaccttcgaggagcgggagaaccggcggctgcaggaggcaagtatgaggctggagcaagaaaatgacgatctggcccacgaactggtcaccagcaagatcgccttgcggaacgacttagaccaggctgaggacaaagccgacgtgctgaacaaggaactgctgcttacaaaacaacgactggtggagaccgaagaagagaaacgtaagcaagaggaggaaacagcccagctcaaggaagtctttagaaagcagctggagaaggccgaatacgaaattaagaagacaacggctatcattgcagagtataagcaaatttgtagccagttgagcaccaggctggaaaaacaacaggctgcctctaaagaagagctggaagtagtgaaaggaaagatgatggcatgcaaacactgctctgatatcttttctaaggagggagccctaaaactggccgccaccggccgcgaggaccagggcattgaaactgatgatgaaaaggactccctgaagaaacaattaagggagatggagctcgagctcgctcagactaagctccagttggtggaggcaaagtgtaaaatccaggaactggaacatcagaggggcgccttgatgaatgagatccaggccgccaagaatagttggttttctaagactctgaactccattaaaaccgcaacgggaacacagccactgcagcctgcaccagtgactcagccccccaaggaatccacatag

SEQ ID NO: 24190 - DNA, 759 bp, Artificial Sequence
  Description of Artificial Sequence: Synthetic coding sequence
atgggcaagagctacgacggccgggcctacgtgatcaccggcatgtggaatccaaatgccccagtgtttttggccttaaacgaggagacccccaaagataaacaagtgtatatgacggttgccgtggacatggtcgtcacggaggtagttgagccagtgcggtttctgcttgagacggtagtacgggtttaccccgccaatgaaaggttctggtatttctctcgcaagactttcacagagacgttctttatgcgccttaaacagtctgaaggaaagggccacacaaatgccggggacgcaatttacgaggtcgtcagtttgcagagggagagcgacaaagaggaacctgtcacccccacctccgggggtggcccaatgtcgccgcaggacgacgaagcagaagaagagtcagataatgagctgtcaagtggcacaggcgacgtgagtaaagactgcccagagaagattctgtacagctggggggaactcctcggcaaatggcactcaaatttaggggctagacctaagggtctttctactcttgtgaagtcaggagtccctgaggcgctcagggcggaggtgtggcagctattagcgggctgtcatgacaaccaggccatgttggacagatatcgcatcctgatcactaaggtgtgttggagcctgcttgaggttcacagtcgcccctgcctccctgggtaccaccagtggaagctgcagaatagcaagtattgcagaatggctaacgtcgcagcatag

SEQ ID NO: 24191 - DNA, 2484 bp, Artificial Sequence
  Description of Artificial Sequence: Synthetic coding sequence
atggaggtgcgggccagcctgcagaaggtgagcggcagcagcgactctgtcgccactatgaattccgaggagttcgtcctcgttccccagtacgctgatgacaacagcactaagcatgaagagaagccgcaactgaaaatcgtgtccaacggcgatgagcagttggaaaaggccatggaggagattctgcgtgattccgaaaagagaccctcatcacttctggtggactgtcagtcttctagcgagatatctgatcacagctttggtgacattcccgcaagccaaacaaataaaccctcgttacaactaattttagatcctagtaacaccgaaatttcaaccccccggccatcaagtcctggagggttgccagaagaggacagtgtgcttttcaataagttgacctacctcggatgtatgaaggtctcttccccccggaacgaggttgaagccctgcgggctatggccacaatgaagtccagtagccagtatccattcccagtcacactctatgtccccaatgtccccgaggggtctgttcgcatcatagatcagtctagtaatgtggagatcgcctcatttcctatctacaaagtgctgttttgtgcgagggggcatgatggcacgactgagagcaattgcttcgcattcacagagagttcccacggcagtgaggaattccagatccacgtgtttagctgcgaaataaaggaagcagtgtcgaggatcctgtatagcttttgcacggccttcaagcggtcttcccgtcaagtctccgacgtgaaagattcggttattcctaccccagacagtgacgtatttacgttcagtgtaagcctagaagtgaaagaagacgacggcaagggcaatttccgtctgcttgtgatcccaattcccttcgagtacttctcccccgtccctaaagaccgggacaagttttacttcaaactcaaacagggcattgagaagaaggtggtgataactgtgcagcagctctccaacaaagagcttgcaattgagagatgtttcggcatgctccttagtccgggccggaacgtgaaaaactctgacatgcacttactggatatggaatctatgggcaagagctacgatgggagggcttacgtgataaccggaatgtggaaccccaatgcccccgtgttcctggcactcaatgaagaaacacctaaggacaaacaggtgtacatgaccgtggcggtggatatggtggttacagaggttgttgaacctgtgcgcttcctgcttgagacagtcgtgcgcgtgtaccctgcaaacgaacgtttttggtattttagcaggaaaaccttcacagagaccttcttcatgagactgaagcagtctgaggggaaaggacataccaatgccggcgatgccatttatgaggtggtgtcactccagagggagtcggacaaggaagagccggtgactcctacatcaggcggaggaccaatgtccccccaggatgatgaagccgaggaagagagtgacaacgaactgtcttctggaacaggcgatgttagcaaagactgtcccgagaaaatcctttacagctggggcgaactgttaggcaaatggcattctaatctgggcgcacgcccaaagggcctgagtaccctcgtgaaatctggcgtgcccgaggccctgagagccgaagtttggcagctattggctggctgccatgataaccaggctatgttagataggtaccggatcttgataactaaagatagcgctcaggagtcagttattacaagggacatccaccggaccttccctgcccatgactatttcaaggataccgggggcgacggtcaggagagcctatacaagatctgtaaggcctattccgtttatgatgaggatattggatactgccagggacagtcttttctggctgcagtgcttctactccatatgcccgaggagcaggcattttgcgtcctggtgaagattatgtacgactacggtctgagggacctttatcgcaataatttcgaagacctgcactgcaagttttaccagctggagagactgatgcaggaacagctccctgacctgcacagtcacttctccgacttgaacttggaagcacacatgtatgcaagtcagtggttcctaactttgtttaccgctaaatttccactgtgcatggttttccatatcatcgatctcctactgtgtgaagggttgaacattatttttcatgtcgccttagcactgctgaagacatctaaggaggacttactgcaagcggactttgagggcgccttaaagttctttcgggtccagctacccaaaagataccgagcagaggaaaatgctagacgcctcatggagcaggcctgtaatatcaaggtgcctaccaagaaactgaagaagtatgagaaggagtaccagacgatgcgggagtctcagttacagcaggaagaccctatggacagatacaagttctttttcctgtag

SEQ ID NO: 24192 - DNA, 2580 bp, Artificial Sequence
  Description of Artificial Sequence: Synthetic coding sequence
atgggcaaccgggagatggaggagctgatccccctggtgaaccggctccaagacgccttttcagcattgggacagtcttgcctccttgaattgccacagatcgccgtcgtgggtggccaatccgccgggaagtcatcggtattagagaactttgtgggcagagattttctcccccggggtagtggcatcgtgaccaggagacctctcgtactccagcttgtgacaagcaaggccgaatatgcagaatttctccactgcaagggcaaaaaatttaccgattttgacgaagtccgcctcgaaattgaagctgagacggatcgtgtgacaggcatgaacaaggggatttcctccatccccataaacctgcgcgtttattccccgcatgtattgaatttaactttaattgacctgccaggcataacaaaagtgccggttggagatcagccccctgacatcgagtaccagatccgggagatgatcatgcagtttatcacccgtgagaactgcctcatacttgctgtcacgcctgccaacacagaccttgccaactctgatgcgctgaagctcgccaaggaagtcgacccccagggcctgcgaacgatcggcgtgatcacaaagcttgacctgatggacgagggaactgatgcccgtgacgtcttggagaacaagctgcttccactcagaaggggctatgtgggcgtcgtgaataggtcacagaaagacatcgacggaaagaaagatataaaggcagctatgctcgctgagcggaaatttttcctcagtcaccccgcctacaggcatattgccgatagaatggggaccccacatctgcagaaggttcttaatcagcagctgacaaatcatattagggacacgctgcctaatttccggaataagttacagggccaactcctaagtatagagcacgaggtggaagcttataagaactttaagcctgaggacccgacacgcaagacaaaggcattgctacaaatggttcagcagttcgctgtggattttgaaaagagaattgaagggagtggagatcaagtggatacattagagctctccggtggtgcgaagattaatagaatctttcatgaaaggttcccgttcgagatagtaaagatggagtttaatgagaaggaattacgcagggagatctcctacgcaattaagaacattcatggcatccggacagggctgttcactccagacatggcctttgaagcgattgtgaaaaaacagattgtgaaactgaaaggccctagcctcaaaagcgtggatttggtcatccaggagctgatcaacacagtgaagaaatgcactaagaagctcgctaattttccgcgcctgtgcgaggaaacagagaggatcgtcgctaaccacatcagagagcgcgagggcaagacgaaggaccaagtgctgcttctgattgacatccaggtgtcgtatataaatactaaccacgaggattttattggatttgcaaatgcccagcagaggtcttcccaagtgcataagaagactactgtcggcaaccaagttatacgcaagggctggctcaccatctcaaacataggcattatgaagggcggttccaaaggctattggtttgtgctgaccgcggaatccctgtcctggtataaggatgatgaagagaaggaaaagaaatacatgctgcctctcgataaccttaaagtgcgggacgtcgagaaatcgttcatgtcaagcaaacatatcttcgccttattcaacaccgaacagcgaaatgtgtataaagattacaggtttttagaacttgcctgtgattcacaggaggacgtcgactcctggaaggcttccctgttacgcgcgggggtgtatcctgataagtctgtcgccgagaacgacgagaatgggcaggccgagaacttcagtatggatccgcaattggaacgacaggttgaaacgatacgtaatcttgtcgacagctatatgtccattataaacaaatgcatccgtgatttaatcccaaagacaatcatgcatcttatgattaacaatgtgaaagattttattaactcagaactgctggcacagctgtactccagcgaggaccagaatacactgatggaggaaagcgcagagcaagcgcagcgcagagatgaaatgctgaggatgtaccaggctctgaaagaggctttaggcattatcggcgacataagcacagctactgtgtctacacccgcgccacctcccgtagacgactcatggattcagcactcccggcggagtccacctccgtcccctacaacacaacgacgccctaccctcagcgcaccgctggcacgtcctacctccggcaggggccctgcgccagccatcccgtctcccgggccgcattcaggcgcccctcccgtgccatttaggccggggccactccctcctttcccgtcttccagcgatagcttcggtgcccccccccaggtcccatctaggccaacaagagcaccgccttccgtcccttcacgccgtcctcccccaagccccacaaggcctactatcatccggccgctcgagagctcactcctggattag

SEQ ID NO: 24193 - DNA, 1761 bp, Artificial Sequence
  Description of Artificial Sequence: Synthetic coding sequence
agcgagagcctgagcagcgccgtgttcgtggagggcctgaagcggcagggaggttgtgcacggctggaagaagcatgtttgagcgaggctggtgaagatctcacgggtgtaagattcagcctgcccgggaaaaacttcccctgtggatcatctagctcatcttctcgaagtaggaactcaagcagctccaactctagctcatcgagcagtaccacgaccaccacgacatccagttccggggctcaggacagaatgcctgtactggaacggtattttcaccccgcggagctcggcagaaggtggaccggccctgagggagtcctaccctctagcccaggctcccggcccggttgtcagcagggccccctgccgtgggatctgcctgaaatgatacgaatggtgaagttagtgtggaagtctaagtccgagctccaagctactaaacagcgcggaatactggacaacgaagacgccctccggtcttttcctggcgatattcggctcaggggccaaaccggcgtgagggcagagagacgaggctcatacccatttatcgactttcgattgcttaatagtacaacctactccggcgaaatcggcacgaagaagaaagtcaagcgactgctgtccttccagaggtacttccatgcatccaggttgctgaggggaataatacctcaggcccctctgcacctcttggatgaagactatctgggtcaggcaaggcatatgctgagcaaggtgggtatgtgggactttgacatattcctcttcgaccggttaacaaatggaaattcgctggtcacacttctgtgtcatctctttaacacccacggacttattcaccattttaagttggatatggtcaccctgcaccgtttcctggttatggtccaggaagattatcactcacagaatccctaccataacgcagttcacgccgccgacgtcacccaggctatgcattgctacttaaaggagccaaaacttgcatccttcttgacccctctagacataatgctcggcctgctggctgcagcagcacatgacgtcgatcatcctggtgttaatcagccattcttaattaagaccaaccaccatttggcgaatctttaccagaacatgtctgtgctggaaaatcatcactggaggtccacgatcggaatgttacgcgagtcaaggcttctggctcatttgcccaaagagatgacgcaagatatcgaacaacaacttgggtctctcatattagctaccgacattaaccgccaaaacgaattcttgacccggctgaaggctcacttgcataataaagacctgcgcttggaagacgcccaggaccggcactttatgcttcaaattgccctgaaatgcgccgatatctgcaatccctgccgaatctgggagatgagcaagcagtggtccgaacgggtatgcgaagagttctacagacaaggtgaactcgagcagaaattcgagctggagatttcccccttatgtaatcagcagaaggattctattccatctatccagatcggcttcatgagctacatcgttgagccactgtttcgcgagtgggctcactttaccggcaacagcaccctgtccgagaacatgctaggacatctggcccacaataaggcacaatggaagagtttattgccgcgacagcaccgctctagaggatcctccggtagtggacccgatcacgaccacgcgggccaaggcaccgagtccgaagagcaggaaggcgactcgccatag

SEQ ID NO: 24194 - DNA, 525 bp, Artificial Sequence
  Description of Artificial Sequence: Synthetic coding sequence
atgaccaccaagaacctggagaccaaggtgaccgtgaccagcagccccataagaggtgcaggcgacggcatggaaacagaagaacctccaaaatcggtggaggttaccagcggcgttcagtcccgaaaacatcactccctgcagagcccctggaagaaggccgtgccatccgagtctcccggtgtcttacaactcgggaagatgctcaccgagaaagccatggaggttaaggctgtgagaatcctggtgccgaaagcggccattacccacgatatccccaataagaatacaaaggttaaaagtttggggcaccataaaggtgaatttttgggacagtccgagggggtgattgagcctaataaagagctatctgaagtgaagaatgtgctcgagaagctgaagaacagcgaacgcagactgctgcaggataaagaaggcctcagcaaccagctgcgcgttcagaccgaagtgagacgcgctctgattgacaaaatgagtaccactctctacgtgtggaccttttag

SEQ ID NO: 24195 - DNA, 1203 bp, Artificial Sequence
  Description of Artificial Sequence: Synthetic coding sequence
atgaccaccaagaacctggagaccaaggtgaccgtgaccagcagccctattagaggtgctggggacggaatggagacggaggagccccccaagtcggtagaagtgacaagtggcgtccagtctcgcaaacaccacagcttacaatctccgtggaagaaagcggtgcccagtgagagtcctggggtcctgcagctcggcaagatgcttaccgagaaagcaatggaggtgaaggccgtgaggattcttgtccccaaggccgcgatcacacacgatatacccaacaaaaacactaaagtaaagagtctgggacatcacaagggagagtttctgggacagtcagagggcgtgattgaacccaacaaagagctgtcagaagttaagaacgtgcttgagaagctgaagaactcagaaagaagattgctgcaagataaagaaggtcttagtaatcagctccgcgtccagacagaagtgaatcgagaattaaaaaaactgctggttgcttcagtgggcgacgatcttcagtaccactttgagagattggccagggagaagaaccagctaatactcgagaatgaggctttggggcgcaatacagcgcagctgtccgaacagctggaacggatgagcattcagtgcgacgtgtggcggtccaaatttctagcaagtcgcgtgatggctgatgaactgaccaactcacgcgctgctctccagcgccaaaatcgcgatgcccacggagcaatccaagatttactctccgagcgtgaacagtttaggcaggagatgattgcaacccagaagcttctcgaagagctgcttgtgagcctccagtggggcagagagcaaacgtactcaccatctgttcagccacattctacagccgagctcgccctgacaaaccacaaactcgcaaaagccgttaactcccacttacttggaaacgttggcatcaataatcagaagaaaatcccatccaccgtggaattctgttcaactcccgccgagaaaatggccgaaactgtcctgaggatcctcgatccagtcacctgtaaggaaagcagcccagataatcctttctttgagtctagtcctactaccttgctggccactaagaagaatatagggcgcttccatccctatactagatacgaaaatatcacatttaactgctgtaaccactgccgaggagaactgattgccttgtag

SEQ ID NO: 24196 - DNA, 276 bp, Artificial Sequence
  Description of Artificial Sequence: Synthetic coding sequence
atggacgccgacagcgacgtggccctggacatcctgatcaccaacgtggtgtgcgtgttcaggacccgctgtcaccttaacctgcgaaaaatcgcactggagggggccaacgtcatctacaaaagagatgtcggcaaggtcctgatgaaactacggaaacccagaataacagctacaatttggtccagtggcaagatcatctgcactggggcaacatctgaagaggaagccaaatttggagcgcgtagactagccagaagcctgcagaagctctag

SEQ ID NO: 24197 - DNA, 492 bp, Artificial Sequence
  Description of Artificial Sequence: Synthetic coding sequence
atggacgccgacagcgacgtggccctggacatcctgatcaccaacgtcgtgtgtgtgttccgcacaaggtgccatcttaatctgcgcaagattgcactggaaggcgctaacgtgatttacaaacgggatgtgggcaaagtgctgatgaaactgcggaagccccgaattactgcaactatctggagctcaggtaaaattatctgcactggagccacttccgaggaagaagctaaatttggcgcgagacgcctggcacggtcattgcaaaagctaggtttccaagtcatttttacagatttcaaggttgtcaacgtgttagctgtatgcaatatgccattcgagattcgtctgccagagttcaccaagaacaaccgtccccacgcctcctatgagccggaactgcatccagcagtctgctaccggattaagtcactgagagccaccctgcaaatatttagtaccggctccataaccgttacagggattctgtag

SEQ ID NO: 24198 - DNA, 1023 bp, Artificial Sequence
  Description of Artificial Sequence: Synthetic coding sequence
atgctggaggcccccggccccagcgacggctgcgagctgagcaacccctcagcatcgagggtctcttgtgcgggacagatgttagaggtacagcctgggctgtattttgggggcgcagccgctgttgctgagccagatcatctccgcgaggcgggaatcactgcagtgctgacggtggactcggaagagccttctttcaaggctggacctggagtagaggatctgtggcgtctgttcgtccccgctttagacaaacccgaaaccgatcttttgtcacatctggatcgctgcgttgcgtttattgggcaagctagagcagagggccgagcagtgcttgtgcattgccacgctggagtctccagatccgtggccattatcaccgccttcctcatgaaaacagaccagctgcctttcgagaaggcctacgagaaacttcaaattctcaagcctgaagcgaaaatgaatgaaggcttcgagtggcaattgaaactatatcaagcgatgggctatgaggtggacactagcagtgccatatataagcagtaccggctacagaaggtaaccgagaagtaccctgaactgcagaacctgccccaggaactgtttgccgtcgaccctaccacggtgagtcagggactgaaggatgaggtgctgtataagtgccgcaaatgtcggagaagcttgttccggtcttcaagcatccttgaccatagagagggctccggacccattgccttcgctcataaacggatgacgccgtctagtatgttgactaccgggaggcaagcgcagtgtacttcctactttattgagcctgtacaatggatggaatctgcacttctcggagtcatggacggacaactgctctgcccaaaatgctcagccaagctgggcagtttcaattggtatggggagcagtgtagctgtgggcgttggatcacccccgcgtttcagattcacaaaaaccgggttgacgaaatgaaaatcctgccagttctaggatctcagacaggcaagatttag

SEQ ID NO: 24199 - DNA, 807 bp, Artificial Sequence
  Description of Artificial Sequence: Synthetic coding sequence
atgtggcccctgaccgccctgctgctgctggccaccctggagaagcctatcctgtctctgcatcccccgtggaccaccatcttcaagggggagcgtgtcaccttgaagtgcgatggataccaccctctgctgctggagttgcagcccatctcaacactgtggtatttgggccatctactgctaccttcgcacaagaagtctattgaagtgcagacacccggcgtgtatagatgccagacaaggggggccccagtgtcagacccaatccatcttagtgtgtctaatgactggctgatcttgcaggtaccttacgctccagtgtttgagggagagccactggtcctgagatgcagggggtggtacgacaaggttgtgtataagcttcactattatcatgacggccaggccgtgagatatttccatagctctgccaattatacggtactgcaggctcgggccagtgactcaggaagataccagtgttccggaacaatgcggatcccagtcgaaagtgcaccaatgttttccgctaaagtggccgtgacagtgcaggaggccagacacgcggcagccgtaagagtgctgcaggtgcagcctagaggagcacccctgcgcctgggacggagagtacattcaccaggtgcccgaggccgcggcgctagaatcgtgctagtacggggaggataccggcaccctcagtgccctgagacacaatccgtcgcagctgccccaggggcagggttctctcccggacctggccttcaccaccggccttcctccatgggcagatccttaggctcatggtag

SEQ ID NO: 24200 - DNA, 936 bp, Artificial Sequence
  Description of Artificial Sequence: Synthetic coding sequence
atgtggcccctgaccgccctgctgctgctggccaccctggagaagcctattctatctcttcatcctccctggactacgatcttcaaaggcgaacgggtgaccctcaagtgcgacggatatcaccccctgttgttagagctgcagcccatttccaccctgtggtatttgggacatcttctgctgccaagtcacaagaagagcattgaggtacagactcccggtgtgtaccggtgtcagactcgtggggcgcccgtgtcagacccaatccacctcagtgtgtccaacgattggctaatcctgcaggtgccgtacgctccagtttttgagggtgagccactggtcctgagatgtagggggtggtatgacaaagtcgtatacaagttgcattactatcatgatgggcaggccgtgagatactttcactcttcagcaaattacacagtcctgcaggcccgcgcttcagactctgggcgctaccagtgttcaggcacaatgcgcattcctgtggaatctgctcctatgttcagtgctaaggtggccgtgactgtccaggccgcccggtgtgcggccagcacgggcgctccctctacacagagccggtccccccgaagtagaagttcgaacaggactggcgcccgcagactgcctcctccggcagtgagcggtaatgcggtccgggggtgctcctctaggggccgagtgctcccctggacacgtcccccacctcccccacagcttcacggcccccaaccctggctgttggtgataggacgttttcctagcgagtcaccccgttgccccgaccgcagcagatggtctcccccctctggaactcctccacccccaggttgttcatcccggcgggcagcgccacggctgcgcgggcatcctcctgcactgcgcagacggccctggaacaataggctggagccctag

SEQ ID NO: 24201 - DNA, 957 bp, Artificial Sequence
  Description of Artificial Sequence: Synthetic coding sequence
atgtggcccctgaccgccctgctgctgctggtgcccagcagcggccaggctgcaaccctagagaagcctatcctgtccctgcaccctccctggacaacgattttcaaaggcgagcgagttaccctgaagtgcgacggataccatccactgcttctcgaactgcaacctattagtacgctttggtatctggggcacctcctgctgccatcacataagaagtctattgaggtgcagacacctggcgtttacaggtgccagacacggggcgccccggtctccgatcctatccacctcagcgtgagcaacgactggctcatactgcaggtaccctacgcaccggtgttcgagggcgaaccattagtcctccgttgcagagggtggtacgacaaggtggtctacaagctccattattaccatgatggacaagctgtacgctactttcacagctccgctaactatacagtgcttcaggcaagagccagcgattctggtcgctaccaatgctccggcaccatgaggattccagtggagtctgcgcccatgtttagtgcaaaagtcgccgtcaccgttcaggccgcccggtgtgctgcgtccacaggtgctccatccacacagagccgttccccacgctcccggtcttcaaatagaacaggagcacggcgcctaccaccacctgctgtaagcggcaatgcagtgagagggtgctcttccagagggcgagttctgccgtggacccgccctccaccaccccctcagctccacggaccccaaccttggctattagtcatcggccggtttcccagcgagagcccccggtgtcccgatcgtagtaggtggagtccaccctcaggcaccccacccccacccggctgcagcagccgccgggctgctccaaggctgagaggccatcctcccgctctccgtagaaggccatggaacaatcgtttggagccatag

SEQ ID NO: 24202 - DNA, 1281 bp, Artificial Sequence
  Description of Artificial Sequence: Synthetic coding sequence
atgtggcccctgaccgccctgctgctgctggtgcccagcagcggccaggctgccaccctggagaagccaatacttagcctgcatcctccctggacaacgatctttaagggagaacgggtcaccctgaaatgtgacggatatcatcctttgttgctggaacttcagccgatttctactctctggtacttaggtcacttgttgctgccaagccacaagaagagcattgaagtgcagacacctggtgtgtacaggtgccagacccgtggagcacccgtttctgatcccattcacctcagcgtgtcaaacgattggctcatcctgcaggtcccatatgcccccgtgtttgagggggagccacttgtcctccgatgccgtgggtggtacgacaaggtggtctacaaactgcattattatcatgatggccaggcggtgaggtactttcattccagcgccaactacactgtgttgcaggcgcgggcctcagacagcgggcggtaccagtgctctggcactatgcggatcccggtcgagagcgctcccatgttcagcgcaaaggtggccgtaacagtgcaggagctgtttcgcgcccccgtgctgcgagtgatggggccaagggaggctaggggcgccgctctcggcggggtggtgctgaggtgtgatacacgtctacacccccagaaaagagatactcccctccagtttgccttttacaaatatagcagggcagtaaggcgcttcgactggggcgccgaatacactgtgcctgaacccgaggtggaggagctggagtcctactggtgtgaggctgctaccgcaactcggagtgtgagaaaacgtagcccttggctgcagctgccaggcccaggctcgccactggatccagccagcaccactgcacccgccccctgggccgcagcactcgcgccaggaaatcgtccccttagcttcagaaagccgccggtctcaaggtccgttccgttggtgacgtccgtgaggaatacaacttccacgggtctgcaatttcctgccagcggcgcccctaccgcaggcccaccggcgtgtgctccccccacacctctggagcagtccgcaggggctcttaaaccagatgtagacctcctcttgagagaaatgcaactgctgaagggcctgttgtccagagttgtgctcgagctaaaggaaccgcaggcactccgcgagctgcgcggtacccccgaaacaccaacaagccatttcgcggtctcgcccggtacgcctgaaactaccccagttgaaagctag

SEQ ID NO: 24203 - DNA, 369 bp, Artificial Sequence
  Description of Artificial Sequence: Synthetic coding sequence
atggccggcggctgccgggcccccagcagcgcccccaccgtgagcctcccagagttgagatcgctgttggcgagtggacgggccaggctgttcgacgtcagatcccgagaagaagcggccgccggcaccatcccaggagccctgaacatccctgtgtccgagctggagtcggctctgcagatggagccagctgccttccaggcgctgtatagcgccgagaagccaaaattggaggacgaacacctcgttttcttctgtcagatgggtaagcgggggctccaggccacacagctggccagaagcctggggtatactggcgctcgcaactatgcaggagcctatcgcgagtggctcgagaaagagagctag

SEQ ID NO: 24204 - DNA, 225 bp, Artificial Sequence
  Description of Artificial Sequence: Synthetic coding sequence
atggccggcgtgagcgagctggagagcgccctgcagatggagcccgctgcatttcaggccttatattcagcggaaaagcctaaattggaagatgagcacctagtcttcttttgtcagatgggcaaacggggcctgcaagctacccagctcgctcggtccctgggctacacgggggccagaaattatgcaggcgcttaccgcgaatggttggaaaaggaaagctag

SEQ ID NO: 24205 - DNA, 1794 bp, Artificial Sequence
  Description of Artificial Sequence: Synthetic coding sequence
atgagcagcaagggcagcagcaccgacggccggaccgacctggccaatgggagtctaagcagcagccctgaagaaatgtctggtgccgaggaggggcgcgaaacaagctccggaatcgaggttgaggccagtgatctgtccctttctctgactggcgatgacggggggcccaatagaactagtactgaatcaagaggtaccgacacagaaagctccggcgaagataaggactctgacagtatggaggataccggtcattactctatcaatgacgaaaatcgtgtccatgaccgtagcgaggaggaggaggaggaagaagaagaggaagaggaggagcaaccgcgacgtcgtgtgcaacgtaagcgggccaatcgtgaccaggatagctctgacgacgaacgggctctggaggattgggtcagttctgaaacaagcgcactgccacggcctcgatggcaggctctcccagccttgagagaacgtgaactgggctctagcgccaggtttgtctacgaagcttgcggggcccgcgtgttcgtccagcgtttccggctgcagcacggcctagaagggcatacagggtgcgtgaatacactgcattttaatcaacgcggcacatggcttgccagtggatcggacgacttaaaagtggtggtttgggattgggtcagaagacagcctgtcctggatttcgagtccggacacaagtccaatgtcttccaggcaaaattccttccaaacagtggagattctacgctggccatgtgcgcgagggatggtcaagtgcgtgtggctgaactgtccgctactcagtgctgcaagaataccaagcgggtggcacaacataagggggcctctcacaagctggcccttgaaccagattccccttgcacgtttctctccgccggtgaggacgctgtggtatttacaatcgacctgaggcaggatcgtccggcgtccaaactggtggttaccaaagaaaaagaaaagaaggtgggtctgtacactatctatgttaacccagccaatacccaccagtttgcagttgggggacgagatcagttcgtgcgcatttacgatcagcgcaaaattgatgaaaatgagaacaatggcgtcctcaagaaattttgtcctcaccatcttgtgaatagcgaaagtaaagcgaatatcacttgcctggtgtacagtcatgatggcacggagttactggcatcctataatgacgaagatatttatctcttcaatagttcccacagcgatggcgcccagtacgttaaacgctacaaagggcaccggaacaatgctacagtcaagggcgttaacttttatggccctaagagcgagttcgtggtgagcggctcagattgtggacacatcttcctgtgggagaagagctcttgccaaattattcaatttatggagggcgataaggggggggtcgtcaactgtcttgaaccacacccgcacctcccagtgctggccacatcaggcctcgaccacgacgtgaaaatttgggcgcctacggccgaagctagtaccgagctgacgggccttaaggacgtaatcaaaaaaaacaagcgcgagagggatgaggatagtctccatcaaacagacctgtttgatagccacatgctgtggttcctgatgcatcatctgaggcagcgccgacaccacagacgatggagagagccaggcgtgggagctacggatgctgactcagatgaatctccaagcagctcagataccagcgatgaagaggagggcccagatagagtccagtgtatgccatcatag

SEQ ID NO: 24206 - DNA, 1794 bp, Artificial Sequence
  Description of Artificial Sequence: Synthetic coding sequence
atgagcagcaagggcagcagcaccgacggccggaccgacctggccaacggttcattgagctctagcccggaggaaatgtccggagctgaggagggcagagaaacctccagcggaatagaggtggaggcctctgacctgagcctcagcctgacaggcgacgatggcggtcctaatcggacgagtaccgagtccagaggcacagataccgaaagctccggtgaagataaggattccgatagtatggaggataccggacactactccattaacgacgagaacagggtccacgatagaagtgaagaggaggaggaagaggaggaagaggaagaggaggaacagcccaggcggagggtacaacggaaaagggccaaccgcgaccaagatagttctgatgacgaacgtgcactggaagactgggtgtcgagcgagacaagcgcccttccgcgaccccgttggcaggcacttccagccttacgggaaagagagctggggagttccgcacgattcgtgtatgaagcctgcggcgccagggtttttgttcagcgcttcagactgcaacacggtttggagggtcataccggatgtgtgaacaccctgcacttcaaccagcgtggcacttggctagccagtggctcggatgatttaaaagtagtggtgtgggactgggtgcggaggcagcccgtcctcgacttcgaaagtggacacaagagcaacgtttttcaagccaaattcctcccaaactcaggggactcaacactggccatgtgcgcaagagatgggcaagttagggttgctgagctgagcgccactcaatgctgcaaaaataccaagagagtggcccaacacaagggagcctcacacaagctcgctcttgaacccgactccccctgcacgttcctgtcagcgggtgaagacgccgtcgttttcaccatcgacctgaggcaggaccgacccgcctccaagctggtggtgaccaaggagaaggaaaaaaaggtcgggctgtataccatttacgtaaatccagcaaatacgcaccagtttgcggtgggtggccgggaccagtttgttcgcatctacgatcagagaaagatagacgaaaacgagaataacggcgttctcaagaagttctgccctcaccacctggtgaacagtgagagtaaggcaaatattacttgtctggtatactcccatgatggtacggaattgctggccagctataacgatgaagatatttacctgttcaactcatctcactcagatggtgcacagtacgtgaagagatataaggggcaccgcaataacgcgaccgtgaagggtgtcaacttctatggacctaaaagtgaatttgtggtcagtggctcagattgcggccacattttcctatgggaaaaatctagctgccaaataatccagtttatggaaggagataagggcggcgttgtgaactgtttggagccacatcctcacctgccagtgttggccacatcaggtctggatcacgatgtgaaaatttgggctcctacagccgaagctagtacggagttaacgggcctcaaggatgtgatcaagaagaataaacgggagcgcgacgaagattccctgcatcagacagacctatttgactcacacatgctgtggtttctgatgcatcacctgcgccaacgcagacaccaccgccggtggagggagcccggcgtgggggctaccgatgccgatagtgatgaatctccatccagcagtgacacttccgacgaggaagaaggccccgatagagtacagtgcatgccatcctag

SEQ ID NO: 24207 - DNA, 453 bp, Artificial Sequence
  Description of Artificial Sequence: Synthetic coding sequence
atgggcgtgcagccccccaacttcagctgggtgctgcccggccggctggctgggctggcactgcctcgtctgcctgcacactaccaattcctgttggacctgggggttcgccatcttgtatccctgacagagaggggtcctcctcattcagacagttgtccaggtctcacgctccaccggctgcggatcccagatttctgtcctcccgcccctgaccaaatcgaccgattcgtgcagattgtggacgaagcaaacgcacgtggggaggcagtgggcgtccattgtgccttaggtttcgggagaactggcaccatgctggcatgctatctggtgaaggagagaggtctcgctgccggagacgctatagccgagattaggaggttaaggccaggcagcatcgagacgtacgaacaggagaaagccgtgttccagttttatcagcgcaccaagtag

SEQ ID NO: 24208 - DNA, 453 bp, Artificial Sequence
  Description of Artificial Sequence: Synthetic coding sequence
atgggcgtgcagccccccaacttcagctgggtgctgcccggccggctagccggattagctcttccccgattgcccgcccattatcagtttttgttagatctgggtgtgcgtcatctcgtgtctcttacagaacgaggaccgcctcacagcgactcctgtcctggcctgaccctgcacagactaaggattccagatttctgtcctcctgcccccgatcagatcgatcgtttcgtgcagattgtggatgaggcgaacgctcgcggagaggcagttggagtccattgtgctctaggattcgggcggaccggaactatgttagcatgctaccttgtgaaggagcgaggtctggccgcaggggatgccattgcagagatccgacggcttcgacccggctctattgagacttacgaacaggagaaagccgtctttcaattttaccagcggactaagtag

SEQ ID NO: 24209 - DNA, 453 bp, Artificial Sequence
  Description of Artificial Sequence: Synthetic coding sequence
atgggcgtgcagccccccaacttcagctgggtgctgcccggccggctcgctggactagctctgccgcggctgcctgctcattatcaattcctgctggaccttggggtgaggcacttggtgagcttgacagagcgaggtccgcctcatagtgactcatgtcccgggctgactctgcatcgactgcgcattcctgatttctgtcctcccgcccccgaccagattgataggttcgtgcagatcgtggatgaggccaacgcccgcggcgaggcggttggcgtccactgtgccctcggattcggccggaccggaaccatgctggcctgctatctagtgaaagaacgggggctcgcagctggcgacgctatagcggagatccgccggctgcgccctggttccattgaaacatatgaacaggagaaagcagttttccagttctaccagcggacaaagtag

SEQ ID NO: 24210 - DNA, 4866 bp, Artificial Sequence
  Description of Artificial Sequence: Synthetic coding sequence
atggagggctgcatgggcgaggagagcttccagatgtgggagctgaataggcgattggaggcgtacctggcaagggtcaaagcgctggaagagcagaacgaactgttgagtgctgaactcggaggattgcgagcccagtcagcagacacaagctggagggcgcacgccgatgacgaactcgcggcactcagggccttggtggaccagcgctggcgggagaaacatgctgctgaagtcgcccgcgataatctcgcagaagagttggagggagtcgcggggaggtgtcaacagctgaggctcgccagagagagaactacagaagaggttgctaggaaccgccgggcggtggaggccgagaaatgcgccagggcatggctgtcttcacaggtcgctgagttggagcgtgagctggaggcactgcgcgtggcgcacgaggaggaacgagtgggcttgaatgcccaggctgcatgcgccccaaggtgcccggcaccgccaaggggccctccggcccctgcccctgaggtggaggagctggcacgccgcctcggcgaagcctggcggggtgctgttcgtgggtaccaggaacgcgtagcgcacatggaaaccagtctaggccaggcgcgggaacggttagggagggccgtccagggggctcgggaagggagactcgagctccagcaactccaggcagagcgaggcgggctgctggagcgtagggccgcattagagcagagactcgaaggtcgctggcaggaacgtcttcgcgccacagaaaaatttcagcttgcagtggaagctctggagcaggagaaacagggcctgcagtcacagattgcacaggtcctggaggggcggcaacagcttgcccatttgaagatgagcctttcactggaggtggccacatatagaacactgctcgaagcagagaactcccggctgcagacaccagggggaggttccaagactagtctctcattccaagatccaaaattagagctacaattcccccggacaccggaggggaggcgtctgggcagtcttctccccgtgctttctcccacatccctgccatcacctttacctgctacactcgagacgccggtcccagccttcctgaaaaatcaggaattcctgcaggccaggacgcctaccctggcatccaccccaataccaccgacgcctcaggctccaagtcccgccgtcgacgctgaaatcagggcccaggacgctccgttaagccttctacagacgcagggcggccggaagcaggcgccagaaccactcagagcggaagccagagttgcaattccggcgtccgtactgcctggccctgaagaaccaggggggcagagacaagaggcgagcacaggccagagccctgaggaccatgcctcgttggcccccccccttagcccggatcactcctctttagaggcgaaagatggagaaagtggcggctcccgtgtcttttcaatttgccggggtgagggcgagggccaaatttggggtttggttgagaaagagaccgcaatcgaggggaaggtcgtgtcctctctgcagcaagaaatatgggaggaggaagacctcaatagaaaagagatccaagattcgcaggtgcccctggagaaagagacactgaaatctctgggcgaagaaattcaggagagcctgaagactttagagaaccagtcccacgaaacacttgagagggaaaatcaagagtgcccacgtagtctggaggaggatcttgaaactctgaagtcgctcgaaaaagaaaacaaggaactgctcaaagatgtagaggtggtgagacccttggagaaggaagccgttggccaactcaagccgactggcaaagaggacactcagaccctccagtccctccagaaagagaaccaggaactgatgaagagccttgagggcaatttggagacctttctctttcctggaacagagaaccaagagttggtctcttccttgcaggagaatctcgagtctttaactgccctcgagaaggagaatcaggagccactcagaagtcctgaggtcggggatgaggaggctttacgaccgctgaccaaagagaaccaagagcccctgcggtcgcttgaggatgaaaacaaagaggcgttcagatccctggagaaggaaaaccaggaaccattaaaaacgttggaagaagaggatcagtccatcgttcggcccttggaaacggaaaaccacaagagccttcgatcactcgaggagcaggatcaggaaacactgcgtacgctggagaaagagacacaacaacgccggagatctttaggggaacaggatcagatgaccctgcggccccctgagaaggtagatttggagccgctgaaatcactcgatcaagagatcgctcgccccctggagaacgaaaatcaagagtttctgaaaagtctaaaagaggagtcagtcgaagccgtcaaatccctagaaacagagatcctcgaaagcctgaaatcagccggacaggagaatctggaaacattgaaaagtccagagacccaggctcctctctggaccccagaagagattaaccagggagctatgaacccacttgagaaggagattcaagagccccttgagtcggtggaagtgaatcaagagacattccgactcttggaagaggagaaccaggagagtctgcgatcactgggagcgtggaacctggaaaacttacggagcccggaggaggttgataaagaaagccagcgcaacttagaggaagaagagaatcttggaaagggggaatatcaggaaagtcttcgcagcctagaggaagagggccaggaacttccccagtctgccgatgtgcagcgttgggaggacaccgtggagaaagaccaggaactggctcaagagagccctcccggaatggcaggtgtcgaaaacgaggacgaggccgagcttaatttaagggaacaggatgggttcactggcaaagaggaagtggtggagcagggagaactgaacgccacagaagaggtctggattcctggtgagggccatccagaatctcctgagcctaaagaacaaagagggttggtggagggggcctcggttaaagggggtgctgagggcttgcaagatcccgaagggcagtcccagcaggtgggagcccctggtctccaagcccctcagggacttccggaggctattgagccactggtcgaggacgacgttgcacccggaggtgatcaggcttctcccgaggtcatgctcggatctgagcccgcaatgggcgagtctgcggccggagctgaacctggccccggacagggcgtgggcggactgggagaccctgggcatttgacgcgggaagaagtgatggaacctcctcttgaagaagagtctttggaggccaagagagttcaaggcttggagggtccaaggaaagatcttgaggaggccggcgggttgggcaccgaattctcagaactgcccggaaagtcccgagacccatgggagccccctagggagggaagggaagaaagcgaggccgaagctccacggggcgcggaagaggccttcccggcagagacacttggtcatacagggagcgacgcacctagcccatggccactgggaagtgaggaggccgaagaagacgtgcctccggttctcgtgtccccatcaccaacgtatacccctatccttgaagatgcgccagggccccagccccaggcagaggggagccaagaggccagctggggagtgcaggggcgcgcagaggcactgggaaaggtcgagagtgagcaggaagagctaggaagcggagaaatcccagaaggcccccaggaagaaggagaagaaagccgggaggaatctgaggaggatgaactgggtgagaccctgcctgactctaccccactgggattctatctccgatcacccactagtccacgatgggatccaacaggggaacagagacctcctcctcagggagaaacaggcaaggaagggtgggacccagccgttctggcctctgagggccttgaggccccccccagcgagaaagaggagggcgaggaaggcgaagaggaatgtggacgggactctgacctaagcgaggaattcgaggacctgggcactgaagcgcccttccttccaggcgtgccaggcgaggttgctgaaccgttagggcaggtaccccagctgctcctggaccccgccgcatgggaccgagatggggagtctgatgggttcgctgacgaggaagagtctggagaggagggcgaagaagaccaggaggagggtcgagaacccggggccggacgatgggggccaggaagctcagtgggttcactgcaggccctgagcagctctcagaggggggaattcctcgagtccgactctgtctcagtaagcgtcccctgggacgattccttacgcggcgcggttgcgggcgcgccgaagaccgctctcgagaccgagtcccaggactctgccgaaccctcaggttccgaggaggagtccgatcctgtgtcacttgaacgggaggataaggtccctgggccgttagagattccttctggtatggaggatgcaggccccggagctgatatcattggcgtgaacggacaagggcctaatcttgaagggaagtctcagcacgtgaacgggggggttatgaacggcctggagcagtcagaggaagtgggccaaggaatgcctctcgtgagtgaaggagatcgaggctccccatttcaagaggaggagggtagtgccctgaagacatcatgggccggtgccccggtgcacctggggcaagggcagttcttaaagttcacccagcgagaaggagacagggagtcttggagctccggcgaggactag

SEQ ID NO: 24211 - DNA, 378 bp, Artificial Sequence
  Description of Artificial Sequence: Synthetic coding sequence
atggagcggcacaccagccaccccaaccggaaggtgcccgccaaggaggaggccaacgcagtgccgctttgtcgggcgaaaccatccccgagttacattaaccttcaggcttcatcacccccagccacattcctgaatatccagacaactaaacttccgagcgtggatcacaaacctaaggaatgtttaggactcctcgagtgtatgtacgccaatttgcagcttcagacgcagctggcccagcaacagatggctgtattggaacacctgcaagcctctgttacccagctcgcccccggcagaggatcaaacaacagctcccttcccgctctcagccctaacccactactgaatcacctgccacagttttctaagtag

SEQ ID NO: 24212 - DNA, 378 bp, Artificial Sequence
  Description of Artificial Sequence: Synthetic coding sequence
atggagcggcacaccagccaccccaaccggaaggtgcccgccaaggaggaagcaaatgctgttccgctttgccgggcaaagcccagtccaagttacattaacctccaggcgagctctcctccagccacctttctgaatatccagacaaccaaactgcccagcgttgaccataaaccgaaggagtgcctgggccttctggagtgtatgtacgcaaatttgcagctccaaacccagctagcgcaacagcagatggcagtgttagaacacttacaggcctctgtgacacagttggctccgggccggggctcaaataattcctcgctgcctgccctctctccaaatccactcctgaatcatctccctcagttcagtaaatag

SEQ ID NO: 24213 - DNA, 378 bp, Artificial Sequence
  Description of Artificial Sequence: Synthetic coding sequence
atggagcggcacaccagccaccccaaccggaaggtgcccgccaaggaggaagctaatgctgtccccctttgcagggctaagccaagccccagttacataaatcttcaggcctcttccccgccagcaacattcctgaacatccaaacaaccaaactgccatccgtcgaccacaagcctaaggaatgtctggggctcctggagtgtatgtatgctaatctccaactgcagacccagctggcgcaacagcagatggccgtattagagcacctgcaggcatccgtgacgcaattggcaccaggccggggtagtaacaattcttccctaccagccctttcacctaaccccctgctgaatcacttgccacagttctcaaaatag

SEQ ID NO: 24214 - DNA, 378 bp, Artificial Sequence
  Description of Artificial Sequence: Synthetic coding sequence
atggagcggcacaccagccaccccaaccggaaggtgcccgccaaggaggaggccaatgcagtgcccctgtgccgcgctaagccaagcccatcatatataaatctgcaagcttcatccccccccgccacctttcttaatatccagaccactaagcttcccagtgtagatcataagcctaaagaatgtttagggttgctagaatgtatgtacgccaaccttcagctccaaacacaattggctcaacagcagatggcagttctggagcatctgcaggcctctgttactcagcttgcccctggacgtgggtcaaataactcgtcacttccagccctgagtccgaacccgctgctgaaccatcttccccaatttagtaagtag

SEQ ID NO: 24215 - DNA, 378 bp, Artificial Sequence
  Description of Artificial Sequence: Synthetic coding sequence
atggagcggcacaccagccaccccaaccggaaggtgcccgccaaggaggaagctaatgccgtcccgctctgtcgagctaaaccaagcccaagctacatcaatctccaggcaagctctccaccggctacgttcttgaatatacagacaacgaagctaccatctgtcgatcacaagcccaaagagtgtctcggactgttggagtgtatgtatgccaacctccagctacaaactcagctagcacagcaacaaatggctgtgctcgaacacttgcaggctagtgttacccaactggccccaggtcggggatccaataattcgtctctcccggcactgtcgcctaacccactacttaatcatctgccccaattctcaaagtag

SEQ ID NO: 24216 - DNA, 624 bp, Artificial Sequence
  Description of Artificial Sequence: Synthetic coding sequence
atggccgaggccagcagcgccaacctgggcagcggctgcgaggagaaacgccacgaggggtcttccagtgaaagcgtaccccctgggactacgatttcacgggtaaagctgctggataccatggtcgatacattcctgcagaaactggtggcagccggctcctccccgctgttacactgggacggctctgccggcccaagactgccatccggcggacaatccgtgaagcaagccttttcatgggccgcctgtcggctgccccagggcaggaaagaagagatctccgacatcaaggaggaaggaaatcttgaggccgtgctgaacgcacttgataaaattgtggaggaggggaaagtgcgcaaggagcctgcatggcggcccagtggtatacctgagaaggatctgcacagtgtgatggcaccgtactttttgcaacagagagacacactgcggcgtcacgtccagaagcaggaggcagagaatcagcaattagccgacgcggtgctggccggtcggcggcaggtcgaggagcttcagcttcaagttcaggcccagcagcaggcatggcaggcactgcatagagagcagcgtgagctggttgccgtgctgcgcgagccagagtag

SEQ ID NO: 24217 - DNA, 618 bp, Artificial Sequence
  Description of Artificial Sequence: Synthetic coding sequence
atggccgaggccagcagcgccaacctgggcagcggctgcgaggagaagcggcacgagggatctagctccgaaagtgttcctcccggaacaacgatcagcagagtgaaactcctagatacaatggtagatacctttctgcagaaattggttgctgctggaagttaccagcgttttactgactgctacaagtgtttttatcagcttcagccggccatgactcagcaaatatatgacaaattcattgcgcagttgcagacctctatacgagaggagatctctgacatcaaggaagagggtaatctggaggcagtcctgaatgcactcgataaaattgtggaagagggaaaggtacgcaaggagcctgcatggcgcccctcagggatccctgagaaagaccttcatagtgtcatggcaccatatttcctccagcagagagatactcttcgcaggcacgtgcagaagcaggaggctgaaaaccagcagctggctgacgctgtgctggcagggcgaaggcaggtcgaagagttgcagctccaggtccaggcgcagcaacaggcctggcaggctctgcatagggaacagcgggaattagtagccgtgctgcgcgaacccgaatag

SEQ ID NO: 24218 - DNA, 543 bp, Artificial Sequence
  Description of Artificial Sequence: Synthetic coding sequence
atggccgaggccagcagcgccaacctgggcagcggctgcgaggagaaacggcacgagggaagcagcagtgagagtgtgccaccaggtaccacaatcagtcgtgttaaactgcttgatacaatggtggatacatttctgcagaagctggtagctgcaggcagttatcagcggttcactgactgttacaaatgtttttaccaattgcagccagccatgacccaacagatctatgataagtttattgcacagctgcaaacctctattagagaagagataagtgatattaaggaggaggggaaccttgaggctgtcctgaatgcccttgataagatcgtggaagagggtaaggttcgcaaagagccagcatgcaacggaactccttgcggcgccatgtgccggaatcgtaggcccaggacatcatcctggcagatgccgtcttggcagggcggtggcagatggcggagctgctcctaccgctcccgaccctcttccagaccggggcgcctgtataccgagaatagaggtagctggctcttgtgttag

SEQ ID NO: 24219 - DNA, 2253 bp, Artificial Sequence
  Description of Artificial Sequence: Synthetic coding sequence
atggaggacctgttcgagaccttccaggacgagatgggcttcagcaatatggaggacgatggccctgaagaggaggagcgtgtggctgagccccaagccaacttcaacacaccgcaagccctacggtttgaggagttactggccaacctcctgaatgagcagcatcagattgccaaggagctatttgagcagctgaaaatgaaaaagcccagcgcgaagcagcagaaagaggtggagaaggtaaaacctcagtgcaaggaggtgcatcaaactctcatcctcgaccctgctcagcggaagcggctgcaacaacagatgcagcagcacgttcagcttctgacccagatccacttgctggccacctgcaaccctaacctgaacccagaggcatctagcaccagaatctgtctcaaagagttgggcacttttgcacagtcttcgatcgctctccaccaccagtataatccaaaattccagaccctgtttcagccatgtaacctgatgggcgcaatgcagctcatcgaggatttcagtacccacgtgtcaatcgattgctccccccataaaacggtcaagaagaccgcgaacgagttcccttgtctaccaaaacaggtcgcttggattctggcaacatcaaaagtatttatgtaccctgaactactcccagtgtgtagcctcaaggccaaaaacccccaggacaaaatactgttcacaaaagctgaggataacctgttagccctaggtttgaaacacttcgaggggaccgaatttctgaaccctctgatcagcaagtatctactcacatgcaagaccgcccgccagctgacggtgagaattaaaaaccttaacatgaacagagctcctgataacattatcaagttctataaaaagacaaaacagcttcctgtgctgggcaaatgctgtgaagagatccagccccaccaatggaaacctcccattgaaagagaggagcatcggcttcccttctggctgaaagccagcctcccctcaattcaggaagaactgaggcacatggcagatggagcccgggaagttggaaatatgacgggaacgacggagatcaatagtgatcaaggcctagagaaggacaactctgagcttggctctgagacaagatacccgcttttattgccgaaaggtgtggttctcaagttgaagcccgtggctgatcgcttccccaagaaggcctggcgccagaagcgctcaagcgtgctgaaacccctgctgattcagcccagcccttctttgcaacccagcttcaaccccggcaaaactcctgcccaatccacgcactctgaggccccacccagcaagatggtactcagaattccccatcctattcagccggcgaccgtcctgcagaccgtgcctggcgttcctcccctcggcgttagcggaggcgagtctttcgagtctccagccgctctacccgccatgccgcctgaggcgcgcaccagttttcccctgtccgagtcccagacactcctatcgtctgccccagtccctaaagtgatgatgcctagtcccgcatcatcaatgttccgcaaaccttacgttaggcgaaggccatctaagcgacgtggagctagggctttccgctgcatcaaacccgcccccgtgattcatccggctagtgtgatcttcactgtgccagctacgactgtgaagatcgtcagtctgggtgggggctgcaacatgatccaacccgtcaacgccgccgtcgcccagtctcctcagactatccctattgccaccttattggtgaacccaacctcgtttccctgccccctgaatcagccccttgtcgcttctagtgtctcaccgctaatcgtgagtggtaatagcgtgaatctcccaataccctcaacacccgaagacaaggcacatatgaacgttgacatagcatgcgctgtagccgacggagaaaatgcttttcaaggcctggagcctaagctggagccacaggagctctcgccactgagtgcaacggtgtttcccaaagttgagcactcccccgggccacccccagttgataaacagtgtcaggaaggcctgtctgagaactctgcctatcggtggacagtggtcaagactgaggaggggagacaggctctggagcccttgccccaggggatccaagaatccctcaataattcctcaccaggcgacctggaggaagttgtgaagatggagccggaggacgcaacggaagaaatttcagggtttctttag

SEQ ID NO: 24220 - DNA, 2667 bp, Artificial Sequence
  Description of Artificial Sequence: Synthetic coding sequence
atggccggcgtgggccggagcggcggcccctggggccggacccggggcgggagatcagggaggctgggtgttagcctaggagctctttcctccctcccgctggaggaactgccccgccccctgtgctgcagacggtgcaggagacactttggatttgccctgcggggcgaaaccatccctgttagtgtcgccggctctgcttcaagccagtttgccccgctggctttacaccttagcctcttactgagcaggatttccgcatcacggctcacacggtggccccctcctgacaaaagggaggggtccgccgtggatcccgggaaacgtcgcagtctggctgccacaccgagttcctccctgccttgtaccttaatcgcactggggttgaggcatgaaaaggaagctaatgagctgatggaagatctctttgagacatttcaggacgaaatgggatttagcaacatggaagacgatggaccagaggaagaagaacgggtcgcagagccccaagcaaatttcaacaccccacaggctctgcgcttcgaggaactgctcgcaaatctcctaaacgaacagcaccaaatcgccaaagagctgtttgagcaactgaagatgaaaaaacctagcgccaagcaacagaaagaggttgaaaaggtgaaaccacaatgcaaggaagtgcatcagacactgattctcgaccccgcccagaggaagcgcctacagcagcaaatgcagcaacacgtacagctgctgacccagatccacctattagctacttgtaacccaaacttgaaccctgaagcttcttccaccaggatttgtcttaaagagctgggaactttcgcccagtcctcgattgctctccatcatcagtacaatcccaagtttcagactctgtttcagccttgcaacctgatgggcgcaatgcagctcatagaggatttttcgacccacgtctccatcgactgttctcctcataagaccgtgaagaaaactgccaacgaatttccttgcttgccaaagcaggtggcttggatcctggccacatctaaagtctttatgtacccagagttgttgccagtctgttctctaaaagccaaaaacccacaggacaaaatcttgttcaccaaagccgaagataatctgctggccctcggtttaaagcacttcgaggggacagagttcctaaatcctctgattagcaaatatctgcttacctgtaagacggcccgccaactgactgtgagaattaagaatctgaatatgaatcgcgcacccgacaatatcatcaagttctacaaaaaaacgaagcagctgcctgttctgggtaagtgctgcgaagagattcagccacatcagtggaagccacctattgagcgtgaagagcaccgcctccctttttggcttaaggcatcccttcctagtatacaggaggagctgcggcatatggctgatggtgctcgcgaggtaggaaatatgacaggcaccacagagataaactccgatcaggggttggaaaaggataacagcgaactgggcagcgaaactcgatacccgctcctgctgccaaaaggcgtcgtgttaaagttaaaacccgtcgcagatcgatttcccaagaaggcttggcgtcaaaagagatcctctgtcttgaaaccccttctgatccagccaagcccttctctgcaaccctcgtttaaccccgggaagacaccggcccaatcaacacattctgaggccccaccgtcgaaaatggtgttgcggattccacaccccatacagcccgccactgtcctacagactgttccaggtgtgccacctctcggagtaagcgggggggagtccttcgaaagcccagccgcccttcccgccatgcctcccgaagctagaacctcttttcccttaagcgagagccagacacttctgagcagcgcccctgttcctaaagtcatgatgcccagcccagcgtccagcatgttcagaaaaccatacgtacgccgccgccccagtaagagacggggggcccgcgccttccgctgcattaaaccagcaccggtaatacatccagccagcgttattttcactgtgcccgcaacaacagtcaagattgtctccctcggtggcggatgcaatatgattcagcctgtgaatgctgctgtagcccagtccccccagaccatacccattgcaacactgctcgtcaatccaacctctttcccatgtccacttaaccaacctttggtagcctcaagtgtgagccctctaatcgtgtccggcaattcagtaaacctcccaatcccatcaacacctgaagacaaggcccatatgaatgtggatatcgcttgcgcggtcgccgatggcgaaaacgcattccagggcttggagcctaagctggagccgcaggagctgagcccgctgagcgcaacggtgttccccaaggtcgagcactctcccggacctccccccgtggataagcagtgccaagagggactgagcgagaactctgcctaccgttggaccgttgtgaagacagaggaaggtcgtcaggctcttgagcccctaccacagggcattcaagagtctctgaacaactccagcccaggagatctagaagaggtagtcaaaatggagcctgaggacgctacagaagagatatccggattcctatag

SEQ ID NO: 24221 - DNA, 2607 bp, Artificial Sequence
  Description of Artificial Sequence: Synthetic coding sequence
atggccggcgtgggccggagcggcggcccctggggccggacccggggtggccgtagcggacgactgggcgtgagccttggcgcattaagctctttgcccttagaggaactgccaaggccattgtgttgccggaggtgtcgtcggcactttggcttcgctctcaggggggagacaatccccgtatctgtggccggatctgctagtagtcagttcgctcctcttgctctgcatctgtccctcttgctatctcggatctccgcgtctcgcctgactagatggccaccccctgacaaaagggagggatcagcggttgatccaggaaagcggagatcactggctgcaaccccctcctcttcgctcccttgcacactcatcgcccttggtctccggcatgaaaaagaggccaatgagttgatggaggacttattcgagacctttcaggacgagatgggattcagcaatatggaggacgatggccccgaggaagaagagcgtgtggcagaaccccaggctaacttcaacacgccccaagccctgcggtttgaggaattactagccaacctgttaaacgaacaacatcagattgccaaagaactcttcgagcagcttaagatgaagaagccctccgccaaacaacagaaagaggttgaaaaggtgaaaccacaatgcaaggaggttcaccaaacactgattctggaccctgcgcaacgcaagagactccagcagcagatgcagcagcatgtccagctcctgacccagatccatctgttggccacttgcaaccctaatctcaaccccgaggcatcatcaaccagaatctgcctcaaagagctcggaacattcgcacagagtagtatcgcactgcatcaccagtataatccaaaattccagacactcttccagccatgcaacctcatgggggctatgcaactaatcgaagatttcagcacacacgtgtctatcgattgctccccccataagactgtcaagaagacggctaatgagttcccgtgcctcccaaagcaggtggcttggatattggccacaagtaaggtatttatgtaccccgaactacttccagtgtgctcccttaaagccaagaatccacaagataaaatactctttaccaaggctgaggacaacaagtatctattaacatgcaaaaccgcccgccaactgacagtgagaattaagaaccttaatatgaaccgcgcccctgataacattattaagttttataaaaaaacaaagcaactgccagttctgggaaaatgctgtgaagagattcagccacatcaatggaaaccccctattgagagggaggaacaccggctgccgttctggctgaaagcatccctgccatctatccaggaagaactgcgccacatggccgacggcgcacgcgaggtgggaaatatgaccggcactacagagatcaactcagaccagggattggagaaggataactccgaattgggttccgaaacaagatatcccctgctgctccccaaaggagtcgtgctcaagcttaaaccagtcgccgaccgtttcccaaagaaagcctggagacagaagcgaagcagtgtgctgaagcctctgctaatacagcccagtccatccctgcagcctagctttaacccagggaagacgcccgcacaatccactcactccgaggcccccccctctaaaatggttctgcgtatcccccacccgattcagcccgcgacagtcttgcaaacggtcccaggggtgccacccctgggtgtgtctggtggcgaaagttttgaaagccccgccgctcttccagccatgccacctgaggcaaggaccagcttcccactttctgaatcacagacgttgctgtcttccgcgccggtcccaaaggttatgatgccatctcctgcaagttccatgttccgaaaaccctacgtgagaagacggccttccaagcggcgaggtgctcgcgcattcaggtgtattaaacctgccccggtcatccatccagctagtgtgatctttaccgtccccgctacaactgtcaagatcgtctctctggggggggggtgcaacatgattcaaccggttaacgccgcggtcgcacagtctccccagaccattcccattgctactctgctggttaaccccacttcttttccgtgtcccctgaatcagccactggtggcgtccagcgtttccccgttgatagtgtctggtaatagtgttaacctgcctattcctagcacacctgaagacaaggctcatatgaacgtggacatagcttgcgcggtagcagatggagagaatgcctttcagggactggagccaaaactcgagcctcaggagctgagtcctctgtcagcaaccgtctttccgaaggtggagcatagcccaggtccccctccggtcgacaaacagtgtcaggaggggcttagtgagaatagcgcctacaggtggacagttgtcaagacagaagaaggacgccaggcgctggagcccctgccccagggaattcaggaaagcctgaataactccagtccgggcgatctggaggaagtggtgaaaatggagcctgaagacgcaactgaggagatcagcggcttcctgtag

SEQ ID NO: 24222 - DNA, 1575 bp, Artificial Sequence
  Description of Artificial Sequence: Synthetic coding sequence
atggccggcggcgcccgggaggtgctgaccctgcagctgggccacttcgctggctttgtcggagcccattggtggaaccagcaggatgctgctctgggccgcgccacagactccaaggagcctcccggcgagctctgccccgatgtactatacagaacaggccggactctccacggacaggagacctacacaccgaggctcattctgatggatcttaaaggctcattgtcttctctgaaagaagaggggggtctgtatcgggacaagcagctcgatgcagccatcgcctggcaaggcaagttgaccacccataaaggaagctctccactgcccaccgcaaccacccccaaacccctgattcctacagaagcatctattcgcgtttggtcagattttttgcgggtgcatcttcatccaaggagcatctgcatgatccagaagtacaaccacgatggtgaagccggcagactggaggcctttggtcaaggcgagtccgttctgaaggagcccaaatatcaggaggaattggaagataggttgcacttctacgtcgaggaatgtgactatctgcaggggttccagatattatgtgacctgcacgacgggttcagtggcgtcggggctaaggccgctgaactcctacaggatgaatattccggacgaggcataattacctggggccttttgcccggtccctatcaccggggtgaggctcagagaaatatctacaggctgctgaatacagctttcggcctggtccacctgactgcacatagctccttggtttgcccactcagcttgggcggctctctcgggttgcggccagagcctcctgtcagcttcccttacctccactatgacgcaactcttccttttcattgcagtgcaatcttggcaacagccctagataccgtgacagtcccttatcgactatgttcctcacccgtcagcatggtgcacctcgcagatatgctgagcttttgtgggaaaaaagtggtgacagctggcgccataatcccttttccccttgcccccggacaaagtttacctgactcactcatgcagttcgggggcgcaacaccatggacccccctcagcgcatgtggtgagccatcaggaacaaggtgcttcgctcagtccgttgttctcaggggaattgaccgggcctgccacaccagccagctgactcccggcacgcctcccccctctgctctgcacgcttgtaccacaggcgaggaaattctcgcgcagtatctgcagcagcaacagcctggcgtgatgagtagctcacatctgttactcaccccatgccgcgttgctccaccctacccacatcttttctccagctgttctcccccagccgtggagagtattccggtgttcggggccctttgttcaagttcctccctgcaccagacgctggaggcgctggcccgagacctaaccaaattagacctgcgccgatgggcttctttcatggatgctggcgtggagcacgacgacgtcgccgagctccttcaggaactgcagtccctggctcagtgctaccagggaggcgattctcttgttgactag

SEQ ID NO: 24223 - DNA, 1479 bp, Artificial Sequence
  Description of Artificial Sequence: Synthetic coding sequence
atgccccccacctgcagccccggcctgcggcggcaggactgggcccccggtcgctgtgccggtctgcacctgccccccagggcccctagtagtcctgccctgcaagccttggccggacaggctggcgtgcggtcctcctggagctttgccggtgtcccgggtgctcagcggctgtggatggccgaagcgcagtcaggcaccggccaactgcaagaacaaaagaaggggctgcttattgctgtgtccgtgagcgttgacaaaattatctctcactttggcgctgcacgcaatttagttcagaaggctcagttaggcgacagccgcctgtcgcctgatgtgggtcatcttgtcttaacaactctttgtcctgccctgcatgccctggtggctgatggcttgaagcctttccggaaggacctcataactggccagcgcagatcttcaccctggtccgtggtcgaagcctctgttaagcccggaagttccacacgttcccttgggacgctgtattcacaagtaagccgcctcgctcccctctctagctcaagatccagatttcatgcctttatcctgggtttgctgaatactaagcagttggagctgtggtttagctcactccaagaggatgcgggactgctaagtttgttatatctgccaaccggatttttcagcctggctcggggaggctgccccagtctgagtacagaacttcttctgctgctacagcccttgtcagttctgacgttccacttggatctgctcttcgaacaccatcaccaccttcctctgggccctccccaagcacccgcacctcccggaccccctcctgctcttcaacagaccatgcaggccatgctacactttgggggccggctggcccagtcactccgggggacttccaaggaagctgcatccgacccttccgatagtcctaatctaccaacgcctggctcctggtgggaacagctcacgcaggcctctagggtgtacgctagcggcgggaccgaaggttttccactctcccgctgggcacccggaagacacggaacggctgctgaggaaggcgctcaggaacgacccctgcccacggacgaaatggcgccgggaagaggattgtggctgggtcggttattcggcgtcccaggggggccagctgagaatgaaaacggtgcccttaaaagccgacgcccatctagttggctgcctcctacggtcagcgtgctcgctctcgtaaaacgtggagcaccaccagaaatgcccagcccccaagagctggaagcttcggccccgaggatggttcagacacacagggctgtgcgcgctctgtgcgaccatactgccgccaggcccgatcaattgtcctttaggcgtggtgaggtattgagagttattaccacggttgatgaagactggctccggtgtggccgggatggcatggagggactggtgcctgttggctacacttccttggtactgtag

SEQ ID NO: 24224 - DNA, 1302 bp, Artificial Sequence
  Description of Artificial Sequence: Synthetic coding sequence
atggccgaggcccagagcggcaccggccagctgcaggagcagaagaagggactgctcattgcagtctcagtcagtgtcgacaagataatttcccacttcggggccgcccgcaatctggtgcagaaggcccagctaggagacagcagactgagccccgatgtagggcatctggtgttgacaacgctttgccctgccctgcatgccttggtcgccgacggtctgaagcccttcagaaaagatctcataaccgggcaacggcgttcttctccgtggtcggtcgtggaggcctctgtcaagcctgggagcagtacccggagcctgggcacgctgtactcccaggtttcccggctcgcccccctgagttcctctcggtctcgatttcacgcttttattctaggtctcctaaataccaagcagctggagctctggttcagctccctccaggaagacgctggcctcctgtctttactgtatctccctactggttttttctctcttgcgagaggcggctgcccctccctgtcaacagaattacttctactgctgcagcctttaagtgtgctgacatttcacctggatctcttgttcgagcaccaccatcacttgccactcggacctcctcaggctccggctccacctggccctccccccgccttgcagcagacgatgcaagctatgttacatttcggaggcagactggcccagagcctccgagggacgtccaaagaggcagcgtcagatccaagcgactctcccaacttgcctaccccaggttcttggtgggaacaactgacgcaggcgagccgcgtgtacgcgtccggcggtaccgaaggctttcctttgtcccgctgggcacccgggcggcacggcacagcggctgaggaaggtgcacaggagcggcccctccctactgacgaaatggcaccgggccgtgggctctggctgggacgactgtttggcgtgcctggtggtcccgccgagaacgagaacggggcgttgaagagccggcgcccatccagttggctgccacccaccgtcagcgtgttagctttagtgaagcgaggggcccccccagaaatgccatccccgcaagaactagaagcatccgctcccagaatggtgcaaacccaccgcgccgtcagagccctttgcgaccacaccgctgccagaccagaccagcttagttttagaagaggtgaggtactgcgggtgataactacagtggacgaggattggctaagatgtggcagagacggtatggaaggcctggtcccggttggctacacaagcttagttctgtag

SEQ ID NO: 24225 - DNA, 2709 bp, Artificial Sequence
  Description of Artificial Sequence: Synthetic coding sequence
atgctgagcccccagcgggccctgctgtgcaacctgaaccacatccatctgcaacacgtcagcctcggactgcatctgagccgtcgcccggaactgcaggaggggccactatcaacgccccctccccccggagacacaggcggcaaggagtccaggggcccttgctccggcacactcgtcgatgccaattccaactcaccagctgttccatgtagatgttgccaagagcatgggcctggcctggagaaccgacaggacccgtctcaagaggaggagggggccgctagtccctcagaccccggctgtagctctagtctgtctagttgcagcgatctcagtccagacgagagccccgtctcagtgtacctacgcgatttgccaggggatgaggacgcacaccctcagccatccattatacctctcgagcaggggagccctttggcctccgccggccccggcacttgctcccctgatagcttttgctgttccccagacagttgtagtggcgcatccagttcccccgaccctggcttggactcgaattgcaacgcactgaccacctgtcaagacgtcccatcccctggtcttgaggaggaggatgagagggccgagcaggacctgcccacgtctgagttactggaggcagatgatggcaagatcgacgccgggaaaacagagccctcttggaaaattaaccctatctggaagattgacaccgagaaaaccaaagctgagtggaaaactacggaaaacaataacactggatggaagaataacggaaacgtcaattctagctggaaaagcgaaccagagaaattcgattctggttggaagactaacactagaattaccgattctgggtccaagaccgatgccgggaagatcgatgggggttggcgatccgatgtttccgaagaacctgtgccacatcgtacaatcacgtccttccacgagctggcgcagaaaagaaaacgtggtcccggactgcctctcgtgccccaagctaagaaggatcgctccgattggttgattgtgttttctcccgataccgaactacccccttcaggcagccccggaggctctagtgcgccaccaagggaagtaacaacatttaaggaattgagatctcggtctagagcgccagcccccccagtgccccccagagatccacctgtcgggtgggcgctggtaccgccgcgcccaccacctccgccagtcccaccaagaaggaagaaaaatcgaccagggcttcagcctatagccgagggtcaatcggaggagggcagagcagtctccccggcggctggtgaagaggctcccgctgccaaagaaccaggggcacaggcgggcctggaggttcggtcttcttggtcatttgcaggcgtccccggcgctcagagactctggatggctgaggcccaatccggcactgggcagttgcaggaacagaaaaaggggctgctaattgccgtctccgtgtcggtagacaaaatcatcagccattttggcgcagctcgtaacctggtgcagaaagcccaattgggcgatagtagactgtcccccgatgttggtcacctggtgttaaccactttatgccctgccctgcatgccctggtggccgatgggttgaaacccttcaggaaggacctgatcactggccagcgtcgatcttctccttggtctgttgtggaggcaagcgtgaaacccggatcttcaacacgctctcttgggacactgtatagccaagtgtcgaggttagctccactgagctcctcccgatcaaggtttcacgcgttcatcttgggcctgctcaacaccaagcagttggaactctggtttagttccttgcaagaagacgctggattattgagtctgctatatctaccgacagggttcttttccctggctcgcggcgggtgcccaagcctgtcaacagaactccttctgttattacagccactgtcggtgttgacatttcatctggacctgcttttcgagcaccatcaccatctgcctttagggccgccacaggcacccgcgccacccggtccccccccggccctgcaacaaactatgcaggccatgttacattttggcggaagactcgcgcagtcccttagaggcacctcgaaggaagccgcttcggacccctctgattcaccaaatctgcctactccaggaagctggtgggaacagctgacgcaagctagccgcgtctacgcctccgggggtacagaagggttccccttgtcccggtgggctccaggaaggcacggcaccgctgccgaagagggcgctcaggaacggccccttccaactgacgaaatggcaccgggtcgagggttatggctgggccgcctgttcggcgttcctgggggcccagccgagaacgaaaacggagccctgaaatccagaaggccgagcagttggctgccccctacagtctccgttcttgcccttgtaaagagaggcgcaccccctgagatgcccagcccacaagagctcgaggcaagtgccccaagaatggtccaaacacaccgggctgtacgggctttgtgtgaccacacagcagcaagacccgatcagctctcattccgtcgcggtgaggtgctgcgggttattaccactgtcgatgaagactggctcaggtgcgggcgggacgggatggaaggcctggtgcccgtgggctacacttccctggtactgtag

SEQ ID NO: 24226 - DNA, 2391 bp, Artificial Sequence
  Description of Artificial Sequence: Synthetic coding sequence
atgctgagcccccagcgggccctgctgtgcaacctgaaccacatccatctccagcatgtgtccctcggccttcacctgagtaggagacctgagttgcaggaagggccgctaagcactccacccccccctggggataccggggggaaagagagccgcggtccttgcagtggaactctggtcgacgccaattccaattcaccggccgtaccttgcaggtgctgccaggaacatgggcctggcttagaaaacagacaagacccgtctcaggaggaagaaggcgcagcttcgccttccgacccaggctgttcatcttcgctgtccagttgctctgatttgtcacctgacgagagtccggtgtccgtgtacttaagagatctaccgggagatgaggacgctcacccgcaaccgtctatcattcccctggagcaggggtcccctctcgctagcgccggccccggcacatgctcacctgactccttttgttgtagccctgatagctgttctggggcaagtagcagccctgatccaggattagacagcaattgtaatgccctgaccacctgccaggacgttccttcacccggcctggaggaggaagacgagagggctgagcaggacctgcccacctccgagttactcgaggccgatgacggcaagatcgacgcgggcaaaacagagccttcgtggaaaatcaaccctatctggaaaattgatacagagaaaaccaaggctgaatggaaaacaaccgaaaacaacaacactggctggaagaacaacggcaatgtgaattccagctggaaatctgagcctgaaaagtttgacagtggttggaagacaaacacgcgcattaccgacagcggctccaagaccgatgctggcaaaattgatgggggctggcggtcagacgttagcgaggagccagtgccccaccgtactattacatcctttcacgagttggcacagaaacgaaagcgcggccctgggctgccactagttcctcaggcgaaaaaggacagatcagattggcttattgtgtttagcccggataccgagctgccaccttccggcagtcccggaggctcaagtgctcccccaagagaagtgactacattcaaggaacttagatcccgaagcagggcgcctgccccccctgttcctccgcgcgacccccccgtggggtgggctcttgttcccccccgcccgccgcctccgcccgtccctcctcgacggaaaaaaaatagaccagggctgcagccaatcgcagagggtcaaagtgaggagggcagagctgttagccctgctgcgggggaggaagctcccgccgccaaggaaccaggtgcacaagctgggcttgaggtgcgcagctcttggtcttttgcgggggtacctggggctcagaggctctggatggctgaggctcaatctggcaccgggcagctgcaggagcagaaaaagggcttgctcatcgccgtttccgtttccgtggataaaattatcagccatttcggggcagccagaaatttggtccagaaggcccagctgggcgactcgcgcctgagtcccgatgtcggacaccttgtcctgactaccctgtgccctgcactgcatgcactggtcgccgatggtctcaagccctttagaaaagatctgatcacaggccagcgtaggtcatcaccctggtcagttgtggaggcctctgttaagcccggcagtagcacgagaagtttgggaaccctgtattctcaggtgtcccgcctcgccccacttagctcatcccggtcccgtttccatgcattcatactcggccttttaaacaccaagcagcttgaattatggtttagttcgctccaagaggacgcaggcagttggtgggagcaactcacacaggctagccgggtgtatgctagcggaggcacagagggctttcccctttcaaggtgggcaccagggcggcacggtacagctgccgaggagggggcccaggagcgacctcttccgacagacgagatggcccccgggcgcgggttatggctgggcaggttattcggagtgcccggcgggcctgcagagaacgagaatggcgcgctgaagtctcgccgaccatcctcttggttaccccctacagtaagcgtgttggccctggtaaaacgaggggctccgccagagatgccctcccctcaggaactggaggctagtgctcctcggatggttcagacacatagggctgtgagagcactatgtgatcacaccgcggctagacctgatcagctctctttccgtaggggagaagtcctgcgagtcatcaccacagtggacgaggactggctcaggtgtggacgcgatgggatggaaggactagtgcccgttggctatacgagccttgtcctgtag

SEQ ID NO: 24227 - DNA, 513 bp, Artificial Sequence
  Description of Artificial Sequence: Synthetic coding sequence
atggccagcgtgagcagcgccaccttcagcggccacggcgcccggagccttctgcagttcctgcggctggttgggcagctgaaacgggtgccacggaccgggtgggtgtatcggaacgtccaaagaccagagtccgtgtctgatcacatgtaccgaatggctgtgatggccatggttattaaggacgaccgcctcaacaaagatcgcgaggccatgaagcaaattacgcagctgctgccagaggaccttcggaaggaactctacgaactgtgggaggaatatgaaacacagtcgtctgcagaggcaaaatttgtaaaacagttagaccagtgtgagatgatactgcaggcttcagaatacgaagatttggaacacaagccgggtcgcctgcaggatttctacgattcaacggcaggcaagtttaaccacccagagatcgtgcagctagtgtccgaactagaagcagaacgcagtaccaatattgcggccgccgcctcagagccccacagttag

SEQ ID NO: 24228 - DNA, 396 bp, Artificial Sequence
  Description of Artificial Sequence: Synthetic coding sequence
atggaggcccaggcccagggcctgctggagaccgagcccctgcagggcactgatgaagacgcggtagcgagtgctgacttttcctctatgctcagcgaggaagaaaaggaggagcttaaagccgaactcgtccagttagaggacgagatcactaccctgcggcaggtgctgtccgctaaagagagacacctagtcgaaattaagcagaagctgggcatgaatttgatgaacgagctgaagcagaatttttcaaagagctggcacgacatgcaaacaactaccgcatataagaaaacccacgaaaccctgtcccacgccggtcagaaggctactgcggctttttctaatgtgggcaccgctatctcgaagaagttcggagacatgcgaagaaagtag

SEQ ID NO: 24229 - DNA, 435 bp, Artificial Sequence
  Description of Artificial Sequence: Synthetic coding sequence
atggaggcccaggcccagggcctgctggagaccgagcccctgcagggcacagatgaggatgccgtggctagcgctgattttagctctatgctgtccgaggaggagaaagaggaactgaaagccgaacttgtccagctggaggacgaaatcaccactttgaggcaggttctgagtgctaaagaaagacatctcgttgaaataaagcagaaactcggtatgaacctgatgaacgagctcaagcagaatttcagcaagtcctggcacgatatgcagactaccaccgcatacaaaaaaacacacgaaaccctgagccacgccggacagaaggccacagcggccttctccaacgtcgggacagccatctccaagaagttcggcgatatgagttatagtatcagacattccataagcatgccagctatgagacgtaagtag

SEQ ID NO: 24230 - DNA, 948 bp, Artificial Sequence
  Description of Artificial Sequence: Synthetic coding sequence
atggccagctgccccgacagcgacaacagctgggtgctggccggctccgaatccctgcctgtcgaaaccctcggcccggccagcaggatggatcctgagtccgaaagggctctccaggcgcctcacagcccttccaaaactgatggcaaggaactggcagggacaatggatggcgagggcacgctttttcagaccgagagcccacagtcagggtcaatcctgaccgaagagactgaggtcaaagggactctggaaggcgacgtctgtggggttgaaccaccaggtcccggcgatacagttgtgcagggagacctgcaggaaacaacagtcgttacaggtctgggaccagatacccaggaccttgagggccagtctcccccacagtctctcccctccacccctaaggctgcctggataagagaggaaggccgatgttcctcaagcgacgatgacaccgatgtggatatggagggtctgcgacgtcgtcgtggacgggaggccgggccccctcaacccatggtccccctcgccgtggagaatcaagcaggagggggcttatcagagtccgagacaggaccaatggaggaggtcgaacggcaagtgcttcctgaccctgaggtcttggaggctgtgggggacagacaggacgggctcagagagcagttgcaggctcccgtgccaccggactcagtgccctccctgcagaatatgggattactgctggacaaactagccaaagagaaccaagacatcaggctactccaagcacagttacaggtgggcacaggccgccgtgggtgggcccgggtgacccacttgggccaggcctcagtcctggcgtccagtccgaagcgtaatgtgtcttacctccccacccatcccgatcctcctctgtcccattattcgcaaggcgtgtttcctgtgttgggttcccacccattatgctag

SEQ ID NO: 24231 - DNA, 2196 bp, Artificial Sequence
  Description of Artificial Sequence: Synthetic coding sequence
atggccagctgccccgacagcgacaacagctgggtgctggccggcagcgagagccttccggtggaaacgttaggcccagcttctaggatggaccccgagagcgaaagagccctgcaggctccccatagtcccagcaagaccgacggaaaggagctggcagggacgatggacggtgagggcaccctctttcagaccgaatcaccacaatcgggaagcattctgaccgaggagacagaggtgaagggcacattggaaggggacgtctgtggggtcgaaccccccgggccaggggacacagtggtgcagggggatttgcaagaaaccacagtggtgacagggctaggtcccgatacacaggatctcgagggacagtcacctcctcagtccttgccatcgacacccaaggccgcttggatcagggaagagggaagatgttccagctctgatgatgatacagacgtggacatggaggggttgcgcagacgaagagggagggaggctggtcctcctcagccaatggtgccgctggcagtggagaatcaggccggcggtgagggtgccgggggcgaactggggatttctctcaacatgtgtcttctcggtgccctggtcttactgggcctaggtgtcttactcttctctggaggtctctccgaatccgagaccggtcctatggaagaagtggagcgacaagtgctcccagaccccgaggttctagaggctgtgggagaccggcaggatggactccgtgaacagctgcaagcccccgtgcctcctgatagtgtgcctagcctgcaaaacatgggtctcttacttgacaaacttgcaaaggaaaaccaggacatccgactgctgcaagcccagcttcaggcacagaaggaggaactgcagtctctcatgcaccagcccaaggggctggaggaggaaaatgcacagctgcgaggtgctctgcagcaaggggaagcattccaacgggcccttgaatccgaattgcaacagctgagggcaagactgcaaggcctggaagctgactgcgttcgagggcccgatggagtctgtctgtctgggggacgaggaccacaaggggataaagcgatacgggaacagggaccacgggagcaagagccagaactgagttttttaaagcaaaaggagcagctggaagcggaagcccaagctcttagacaagaactcgagagacagagacgactgctaggctctgtacagcaagacctcgagcgttctttacaggacgcctctcggggagaccctgcccacgcagggctcgccgaattgggccataggttggcccaaaagctccagggtcttgagaactggggacaagatccaggagtgagtgctaacgccagcaaagcttggcaccagaagagccacttccagaacagtcgcgagtggtccggcaaagaaaagtggtgggatggccaacgagaccgaaaggctgagcactggaaacacaagaaggaagagtccggccgggagcgcaaaaaaaactggggcggacaggaggaccgcgagcccgccggtagatggaaagaaggtaggcctcgagtcgaagagtcgggttctaaaaaggagggtaagcggcagggacccaaagaacccccacggaagtccggtagctttcatagcagcggagagaagcagaaacaaccccgatggcgtgaaggaaccaaggattcgcatgaccctctgccttcctgggctgagctattacggcccaagtacagggcccctcagggctgttcgggagttgatgaatgtgcccgccaggaaggcttaacttttttcggaacagagctcgccccagttcgccagcaggaactcgcttctctgctcagaacctatctggccagactaccttgggctggccagctcacaaaagaactgccactgagccctgccttctttggtgaggatgggatcttccggcatgataggctgaggttccgtgattttgttgacgcccttgaggactctctggaggaagtagctgtccagcagaccggcgatgatgacgaagttgatgacttcgaagactttatcttcagtcactttttcggggacaaggcacttaaaaagcgttccggcaaaaaggataagcactcacagtccccacgggctgcaggtcctcgtgaaggccatagccactcacatcatcatcatcatcgcggatag

SEQ ID NO: 24232 - DNA, 2109 bp, Artificial Sequence
  Description of Artificial Sequence: Synthetic coding sequence
atggaccccgagagcgagcgggccctgcaggccccccacagcccctccaaaacagacgggaaagagctggccggcactatggatggagaaggcaccctattccagacagagtccccacagtctggcagtattctgaccgaggagaccgaagtcaaggggactctggaaggagatgtttgcggagtcgagcctccaggccccggcgataccgtcgtccaaggcgatcttcaagagactactgtggtgaccggactgggccccgacacccaggatctcgaaggccagtccccacctcagagcttgccatccacacctaaggcagcctggatcagagaggaggggcgctgctcaagctccgacgatgacacggacgtggatatggagggcctgagacgccggaggggacgcgaagctggccctccgcagcctatggtaccactggctgtggaaaatcaagcaggaggggaaggggcaggcggagagctcggcatttctttaaatatgtgcttgctgggcgcccttgtgctgctgggtctcggcgtgctgctgttcagtggcggcttgagcgaatccgagaccgggcctatggaggaggttgagcgacaggttttaccggatcctgaagttttagaggcggtgggagatagacaggacggtcttagggagcagttgcaggctcctgtgccccctgatagcgtcccatcattgcaaaacatgggcctcctcctggacaaacttgccaaggagaatcaagatatacggctgctgcaggctcaattacaggcccaaaaagaggagttgcagtcacttatgcatcagccgaagggcttagaagaggagaacgctcagctccgaggggcactccagcagggggaggcctttcaacgtgcactggagagcgaactccagcagctgcgagccagacttcaaggcctggaggctgactgcgtgcgaggcccagacggcgtatgcctgtcgggagggagaggaccacagggcgataaggccatacgcgagcaggggcctagggagcaggagccagaactgagctttctgaagcagaaagaacagcttgaagccgaggcccaggcgctaaggcaggagttagagaggcagaggagattgttggggtcagtccaacaggacttggaacggtctctccaggacgcttcccggggggatccggcccacgcaggattggccgagctcggtcaccgattggcccagaagttgcagggccttgaaaattggggccaggacccaggagtgagtgccaacgcgagcaaggcctggcatcagaagtcacatttccagaactctagggagtggtccggcaaagaaaagtggtgggatggacagagggacaggaaggcagaacattggaagcacaagaaagaagagagtggtcgcgagaggaagaaaaattggggaggtcaagaagatcgagagcctgcgggccgctggaaagagggtcgtccacgagtggaggagagcggtagcaagaaagagggcaaacggcagggacccaaagagccaccccgcaaaagcgggtccttccactcgtccggcgaaaagcagaagcaacctaggtggagagagggcaccaaggatagccacgacccattgccttcttgggcagagctcttgaggcctaagtaccgggcacctcagggatgtagtggagttgatgagtgtgctcggcaagagggactgaccttcttcggtaccgagctggcacctgtgaggcagcaggagctcgccagcctcctgcgcacatacttagcccgtttgccatgggcaggccagctgaccaaggagttgcctctaagtccagcgttttttggagaggacggaatattcaggcatgaccgactacgttttagggactttgttgacgcgttggaggactccctggaggaagtagctgtgcagcagaccggagacgatgacgaggtcgatgatttcgaggacttcatattcagtcacttcttcggggacaaagccctgaaaaagcgctcaggaaaaaaggataagcattcccagagcccaagggctgctggtcctcgggaagggcatagccacagtcaccaccaccaccatcgcgggtag

SEQ ID NO: 24233 - DNA, 2427 bp, Artificial Sequence
  Description of Artificial Sequence: Synthetic coding sequence
atgatctggcggaacaactggaagagcaccaccggccggctgaacgttaaacttcaaagcgataagctgcaacatggatgcgggcccgattactcttctgcatggctgcccgccaatgagagcctgtggcaggccacgaccgtacctagtaatcatcggaataatcacatccgaaggcatagcatcgccagcgatagtggggacacaggaatcgggacctcatgctctgactcggtggaggatcactcaacctctagcggcactctgtctttcaagccttcccaatctctcattactctgccaaccgcccatgtgatgccatctaactcttctgccagcattagcaagcttagagaatctttaactccagacggatccaaatggtcaacctccttgatgcagaccctggggaaccattcacggggggagcaggattcctcacttgatatgaaagatttccgcccactgcggaaatggtcttcattgtctaagctgaccgctccggataattgtggacagggcgggactgtgtgccgagaagagagccgaaacgggctcgaaaagattgggaaagcaaaggcactcacatctcaacttagaaccatcgggccctcctgcctccatgattctatggaaatgttaagattggaagacaaagaaataaataagaaaaggtcctctacacttgactgcaagtataagtttgagtcgtgttcgaaagaagatttccgagcttctagtagtaccctccgaaggcagcccgtggatatgacatacagcgcactcccggaatccaagcctatcatgacctcctctgaggcatttgagcccccaaagtatttaatgctgggccagcaggcagtcggaggcgtgcctatccagccctccgtgcggacacaaatgtggctcaccgaacagctacgtacaaatcccctcgaggggcgtaataccgaggacagctatagccttgccccctggcagcaacagcagattgaggactttcgccaaggatcggagaccccgatgcaggttctaaccggcagttcgcgccaatcatactcacctggataccaggatttttctaagtgggaatccatgctgaagataaaagaaggactgttgagacagaaagagattgtcattgacagacagaagcagcagatcactcatttgcatgagaggatcagggataacgaactacgggcgcagcatgccatgttagggcattatgtaaattgcgaggattcatacgtagcaagtctccagccccagtacgagaatacttctttacagactcctttctccgaggagtccgtctcccacagccagcagggggagttcgagcaaaaacttgcaagtaccgaaaaggaggtgctgcagttgaatgagtttctgaagcaacgacttagcctttttagcgaagagaagaaaaaactggaggaaaagctgaagactagggacagatatattagttctctcaagaaaaagtgtcagaaggaatcagaacagaataaagaaaagcagcggcgcatcgaaactttggagaaatacctggcagatctgcctacgctggacgacgtccagagccagagtttacagcttcagatcctcgaggagaagaataagaatctccaggaggccctaattgataccgaaaagaagctggaagaaatcaagaaacagtgtcaagataaagagacccagctgatttgtcagaaaaaaaaagaaaaggagctcgttaccactgtacagtcccttcaacagaaggtagagagatgtttagaggacgggatccggttgcccatgctggacgctaagcagttgcagaatgagaacgacaacttacgacaacaaaatgaaaccgcttccaagatcattgattctcagcaggacgagatagacagaatgattttagagatacaatctatgcagggcaaactgtcaaaggagaagctgactacccagaaaatgatggaggaactggagaaaaaggagcggaatgtgcagagactcactaaagcgctgttggagaatcagcgtcaaaccgatgagacatgttcactcttggaccagggacaggaacccgatcagagcagacagcagaccgtgctcagcaagcgccctctgttcgacctaacggtcattgatcagctgttcaaggaaatgtcgtgctgcctctttgatctcaaggctttatgtagcatactgaatcagcgcgctcagggtaaggaacccaatcttagcttactgctgggaatccgttccatgaactgttccgcagaggaaaccgagaatgaccattccacggagacactcactaagaaactgtcagacgtgtgccaactaagaagagatattgacgagctcaggaccacaattagtgataggtacgcccaggacatgggagataactgcatcacgcagtag

SEQ ID NO: 24234 - DNA, 2418 bp, Artificial Sequence
  Description of Artificial Sequence: Synthetic coding sequence
atgtggggccggttcctggcccccgaggccagcggccgggacagccctggcggagctcgcagcttcccggctggacctgactacagttctgcttggctgccagcgaacgagagcttgtggcaggctacaaccgtcccgtcaaaccaccggaataatcacatcaggcgccactccatcgctagcgactctggggacactggcataggcacctcttgcagtgactcagtagaagaccactccaccagtagcgggacactctcatttaaaccaagtcagagtctgattactctgccaaccgcacatgtgatgcctagcaatagctcggcctccatctctaagctgcgggaatcactgaccccggatggttcaaagtggtccacgagtttaatgcagactctgggtaatcattcgcgcggcgaacaggacagttcactggacatgaaggatttcagacctttacggaaatggagtagcctgagtaagctgacagctccggataactgtggtcagggagggactgtttgtagggaggaaagcaggaacggactcgagaagattggtaaggcaaaagctttaacatctcagctccgcactatcggaccaagttgcctgcacgacagcatggaaatgctacgcttggaggacaaagagatcaataagaagagatctagtactctggattgcaagtataagtttgagagctgctcaaaggaggattttagggcaagctctagcaccctgcggcgccagccagtggatatgacttattctgcccttccagagtcaaagccaatcatgacttcttccgaagcattcgaacctcccaagtatctaatgttgggacaacaggctgttggcggcgtgccaattcagccttccgttagaactcaaatgtggttgacagagcagttgcgaacgaaccctctcgaagggcggaataccgaggacagttactccctggccccatggcaacaacaacagattgaggactttcgacaaggctctgagacgccaatgcaggtactgactggatcaagtaggcagtcgtacagccctgggtatcaagacttttcgaaatgggaaagcatgttgaaaatcaaggagggcctgctgaggcagaaggagatcgtaattgatagacagaagcagcagatcactcatcttcatgagagaatccgcgacaacgaattgagagctcaacacgcaatgctcggccattatgttaactgtgaagattcttatgttgcaagtctgcaacctcagtatgaaaatactagtctgcaaactccattttcggaggagtcggtctcccatagccaacagggggagttcgagcagaaactagccagcaccgaaaaagaagtgttgcagcttaacgagttccttaagcagagactctccctgttctcagaagaaaaaaagaaactggaagagaaactgaagacccgcgaccggtacattagcagtctcaagaaaaagtgccagaaagaaagcgaacaaaataaggaaaagcaacgccgcatcgagactctggaaaagtacctggcagaccttcctactctcgatgatgttcagtctcagagcctccagttgcaaatcttggaggagaaaaataagaacttgcaggaggctctcatagatacagaaaaaaaattagaagagatcaaaaaacagtgtcaggacaaagagacccagctgatttgccagaagaaaaaggaaaaggaactcgtcactacggtccagtccttgcagcagaaagtcgaacggtgcctggaagatggtattcggttgcccatgctcgacgctaaacagctgcagaatgaaaatgacaacctgcgacagcaaaatgagactgcaagcaaaattattgattcacagcaagacgaaatcgacaggatgatcctggaaatccaaagtatgcagggcaaactatcaaaagaaaaactgactacccagaagatgatggaagagctcgagaagaaggagcgcaatgtccaaaggttaaccaaagccctgctagagaatcagaggcaaacggatgaaacctgcagtttgcttgaccagggccaagaacctgatcaatcacgtcagcagacagtgttgtcaaagagaccgctttttgatcttaccgtgatcgaccagttatttaaagaaatgagctgttgcctgtttgatctaaaagccttgtgcagcattttgaatcagcgcgcccagggcaaggagccaaacctgagcctcctgctcgggattaggtctatgaactgcagcgccgaagagacggaaaacgaccactccaccgaaacactgactaagaagctctcagatgtttgtcagttaagacgcgatattgatgaacttcgtaccaccataagtgatcgctatgctcaggacatgggtgacaattgcattacccagtag

SEQ ID NO: 24235 - DNA, 1488 bp, Artificial Sequence
  Description of Artificial Sequence: Synthetic coding sequence
atggtggaggagcacgagctgcggaaggagcggatccaggaggactataacgataagtactgggatcagcgttacaccatcgtgcaacagcagattccatcttttcttcagaagatggctgataagattctctccaccgggaagtacctcaatgtggtgcgtgaatgcgggcacgatgtgacttgccccgtggccaaggaaatcatttacaccctcaaagagagagcctacgttgagcagattgagaaggcattcaattacgcatcaaaagtccttttagactttctcatggaggagaaagagttggtggcccacctccgaagcataaagagatactttctcatggatcaaggcgatttctttgtgcattttatggacctagcggaggaagaattgcggaagcctgtggaggatatcaccccccctaggttggaggccttgctcgagctcgcccttaggatgagcaccgccaacaccgacccttttaaggacgatctcaaaatcgacttaatgccccacgacctaatcacccaattgcttagagtgctagctattgagacaaaacaagaaaaagctatggcgcatgcagatcctacggagctcgcactgtcagggttggaagcattttccttcgattacatcgtgaaatggccactctcgttaatcataaaccgcaaggccctgacaagatatcagatgttgtttagacacatgttctactgcaaacacgtagagcggcagctttgcagcgtgtggatatctaataagaccgcaaaacagcacagcctgcattccgcccaatggttcgccggagctttcaccctaagacagcgcatgctgaatttcgtgcagaatatccaatactatatgatgtttgaggtgatggagcccacttggcatatcttggaaaagaatctcaaaagcgcctccaacatcgatgatgtgctagggcatcataccggctttctcgacacgtgcctgaaagactgtatgttgactaacccagagctgctgaaagtgttctcaaagctcatgagtgtatgcgtcatgttcacgaactgtatgcagaagttcacacagtcgatgaagctggacggggagcttgggggacagacactggagcatagtactgtgcttggacttccagctggcgcagaggaacgtgcacgcaaggagctggcgcgaaagcacctggccgaacacgccgacacggttcagttagtgagcggatttgaagccaccatcaacaaatttgacaagaatttcagtgcccatctgttggacttgctggctcgcctttcaatttattctaccagcgactgtgaacatggaatggcctccgtaataagccgcctggactttaacgggttctatacggaaaggctcgagagactgtccgccgagaggtcccagaaggccacgccacaagtgcctgtgttgagaggcccccctgcgcccgctccccgggtggctgtgaccgcacagtag

SEQ ID NO: 24236 - DNA, 2709 bp, Artificial Sequence
  Description of Artificial Sequence: Synthetic coding sequence
atgagcgagttccggatccaccacgacgtgaacgagctgctgagcctgcttcgagtccatggaggtgatggtgcagaggtgtacattgacctcctgcaaaaaaatcgcactccatacgtgactaccacagtttctgcccactccgctaaagtgaaaattgcggaattctcgcggaccccagaggactttctgaagaaatatgacgaattgaagtccaagaacacacgtaatctggaccctttggtgtatttattgtctaaactgactgaagataaggagacgttacagtacctgcaacaaaacgcaaaggagagggctgaactcgctgccgccgcggtggggagttccaccacgagcatcaatgttccggctgccgcctctaagatttccatgcaggaactcgaagagctgcggaagcagttaggctcagtggcgacagggtcgaccctgcaacagtctctggaacttaagagaaaaatgctccgagacaaacagaacaagaagaactcgggccaacatctgcccattttccccgcatgggtgtatgaaagacctgcacttattggcgatttcttgatcggggctgggatttcgacggacaccgctctgcctattggcaccttgccactggccagccaggaatcagctgtagtggaagatttactatatgttctggtcggcgtggatggccgctatgtttccgctcagcctctggccgggagacaaagccgaacattcctggtggacccgaacctcgatctgtccatcagggagctggtacaccgcatcctaccagtggccgccagctactctgccgtgacgcgctttatcgaagaaaaatcctcgtttgagtatggacaggttaaccacgccctagccgccgccatgagaaccctggtcaaggaacatttgatcttggtgtcccagctggagcaactgcatcggcagggcctgctgagcctgcagaaattgtggttctacatacagccagccatgcgaactatggacatactggcctccttggccacttcggtggataagggcgaatgcctgggtggtagcacacttagtctgctacatgatcgctcgttcagctacaccggcgactctcaagcacaggaactttgtctgtacctaaccaaagctgcatcagccccttacttcgaggtcctagagaaatggatctaccgcggcatcattcacgatccttattccgaattcatggtcgaagagcacgagttaagaaaggagcggatccaggaggactacaatgataaatattgggatcagcggtatacgatagttcaacagcaaataccaagctttctgcagaagatggccgacaaaatcctgtccactggaaaatacctcaatgtggtgcgggaatgtggacatgatgtaacctgccctgttgccaaagaaattatctatacattgaaggagagagcttatgtggagcagattgaaaaagcgtttaactacgcatcaaaagtcctcctggattttttaatggaggagaaagagttagtggcccatctgcgtagtatcaaaaggtacttcctgatggaccagggagacttcttcgtgcatttcatggacctcgccgaggaggaattgagaaagcccgttgaggatatcacccccccgcgactagaggctctgttggaattggcacttaggatgagtacggctaataccgatccattcaaagacgatctaaaaatcgatcttatgccgcacgacctgataacacagctcctgagggtgctggctatagagacaaaacaggagaaagctatggcccacgccgacccaactgagcttgccctatccggcctcgaggctttcagctttgactatattgtaaagtggcctttgtcgctgatcataaatcggaaagccctcacaaggtaccagatgttgtttcggcacatgttttactgcaaacatgtagaacgccaactgtgcagtgtctggatttccaacaagactgccaagcaacacagccttcactccgctcaatggttcgccggggccttcacacttcgccaacgtatgctgaacttcgtgcaaaacatccagtactacatgatgttcgaagttatggagcctacatggcatattctcgagaaaaatctgaagtcagcatcaaatattgacgacgtgctggggcaccacaccgggtttcttgacacctgcttaaaggactgtatgctgaccaacccagaactcctgaaagtgttttccaaactgatgtccgtttgcgtgatgtttaccaactgtatgcagaaattcacccagtcaatgaagttggacggtgagctgggcggccagaccctggaacactcaaccgtgctggggttgcctgccggggccgaagagcgcgcaagaaaagagctggcgcgcaagcacctagccgagcatgccgatactgtgcagctggtcagtggctttgaggcaacaataaataaatttgacaaaaatttctccgcacacctcctcgacctcctggccagactcagtatctattcgacatccgactgcgaacacggaatggccagcgtcatctcccgattggattttaacgggttctacactgaaagactggagcgattgtccgctgagcgcagtcagaaggctacgccgcaggtcccggtgctgcggggtcctcccgcccccgcaccgcgagtagccgtgaccgctcagtag

SEQ ID NO: 24237 - DNA, 1620 bp, Artificial Sequence
  Description of Artificial Sequence: Synthetic coding sequence
atggacgccatggccagccccggcaaggacaactaccggatgaagtcctataaaaataaagcgctgaacccacaggagatgagacgccgacgggaagaggaaggaattcaattgaggaagcagaaaagggaggagcagctattcaagaggcggaatgtctacttgccgcgcaatgatgaaagcatgctagagtcacccatccaggatcccgacatctcttctacggtaccaattccagaagaggaggtcgttactaccgatatggtgcaaatgatcttttctaacaacgcagaccagcagttaacagcgacccagaaattccgcaagctattatcaaaagaaccaaaccccccaattgatcaggtgatccagaaaccaggagtagttcaacgatttgtgaagtttttggagcggaacgaaaactgtactttgcaattcgaggctgcttgggccttaacaaacatcgccagtggaaccttcctccatacaaaggttgttattgagacaggggctgtacctattttcattaagcttttaaacagcgaacatgaggatgtgcaagaacaggccgtgtgggcactgggcaatatagcaggagataacgcagaatgtagggacttcgttctgaattgtgagatcctcccaccacttctggaattgctgacaaattctaatcggctcaccacgaccaggaatgctgtctgggccctcagcaacctttgccggggtaaaaatccacctcccaacttttctaaggtttccccttgcctgaatgtgctgagtcgtctgcttttttcctcagaccctgacgttctggccgacgtctgctgggccttatcttacctgtccgatggcccgaatgataaaattcaggctgtgattgattccggggtatgtcggcgactggtcgaactgctcatgcacaacgactataaggtcgtatccccagctttgcgggccgtcggaaacattgtgaccggcgatgatatccagacacaggtgatactcaattgcagcgcgctgccttgcctcctgcaccttttgagtagccctaaagaaagcattaggaaggaggcttgctggaccgtgtctaatattactgccggcaaccgcgctcaaattcaggctgtgatcgacgcaaatatttttcctgttctgattgagattctgcaaaaggcagagtttagaacgcgcaaggaggcagcttgggcgattactaacgctacaagcgggggtactccggaacaaatcaggtacctggtggccctgggctgtatcaagccgttgtgcgacctcctgactgtgatggattctaagatcgttcaggtggcgctgaacggcctggagaacattttgaggctgggcgaacaagagtcaaagcaaaacggcataggaatcaacccctactgcgcccttatagaggaagcatatggattagacaaaattgagttcctacagagtcatgagaatcaggagatctaccagaaggccttcgatctcatcgagcactacttcggagtggaagaggacgacccaagcattgtgcctcaggtggacgaaaatcagcagcagttcattttccaacaacaagaggctcccatggatggtttccagctgtag

SEQ ID NO: 24238 - DNA, 453 bp, Artificial Sequence
  Description of Artificial Sequence: Synthetic coding sequence
atgcggggcgaccggggccggggccggggcggccggttcggcagcagaggaggccccgggggtggctttcggccatttgtccctcacatcccatttgatttctatctgtgtgagatggccttcccccgggtgaaacctgcacctgacgaaacctccttcagcgaagctcttcttaagagaaaccaggaccttgctcccaattctgcagaacaagcgagcatattgagtttagtgaccaaaatcaacaatgtgattgacaatctgatcgtggcccccggtacgttcgaggttcagatcgaggaagtgcgacaagttgggagctacaagaagggcacaatgacgactggtcacaatgtggccgacctggtggttattcttaaaatcctgccgacctgcgagtgtgcctgcttctggagctgggaacagaacatcgcgctgggcctgggagtgtag

SEQ ID NO: 24239 - DNA, 348 bp, Artificial Sequence
  Description of Artificial Sequence: Synthetic coding sequence
atggccttcccccgggtgaagcccgcccccgacgagaccagcttcagtgaggcgctcctgaaacggaaccaggacctggcccccaattcagctgaacaggcttctattctcagcctggttaccaaaataaataatgtgatcgacaacctgatagtggcccctggcacgttcgaggtccagatcgaggaggtgcggcaggtggggtcttacaagaaaggcacaatgaccacgggtcataacgtagccgatttggtggtgatcttgaaaattcttcccacactggaagccgtggccgcattgggcaataaggtggtggaatcattgagagcccaagatccatccgagtag

SEQ ID NO: 24240 - DNA, 312 bp, Artificial Sequence
  Description of Artificial Sequence: Synthetic coding sequence
atgagcgactgctacaccgagctggagaaggccgtgatcgtgctggtcgaaaacttttacaaatatgtctcaaagtacagcctagttaagaataaaatctctaaaagcagcttcagggaaatgctccagaaagagctaaaccatatgttgagcgatactgggaatcgtaaagccgcagataaactgattcagaatttggacgccaatcatgacggccggatctcttttgatgaatattggacactaatcgggggcattaccggtccgattgcaaaactgattcatgaacaggagcagcaatcgagcagctag

SEQ ID NO: 24241 - DNA, 312 bp, Artificial Sequence
  Description of Artificial Sequence: Synthetic coding sequence
atgagcgactgctacaccgagctggagaaggccgtgatcgtgctggttgagaatttttataaatacgtatccaaatacagccttgttaagaataaaatttccaaaagttcctttcgcgaaatgttgcagaaagaactcaaccacatgctgtctgataccggtaaccggaaagctgctgataaactgattcagaacctggacgctaaccatgacggtcggatatcctttgatgaatattggacactgataggcggcatcacgggtccgatagctaaacttattcatgagcaagaacagcagagcagctcctag

SEQ ID NO: 24242 - DNA, 312 bp, Artificial Sequence
  Description of Artificial Sequence: Synthetic coding sequence
atgagcgactgctacaccgagctggagaaggccgtgatcgtgctggtcgaaaatttctacaaatatgtaagcaaatattctcttgtgaagaacaaaataagcaagtccagtttccgtgagatgcttcaaaaggaactaaatcacatgttgagtgatacgggaaatcgcaaagccgcagataagttgatccaaaacttggatgccaaccacgacggaagaattagtttcgacgagtattggacacttatcgggggtatcactgggccaatcgctaaactcattcacgagcaagaacagcagtcctctagctag

SEQ ID NO: 24243 - DNA, 312 bp, Artificial Sequence
  Description of Artificial Sequence: Synthetic coding sequence
atgagcgactgctacaccgagctggagaaggccgtgatcgtgctggttgagaacttctataaatacgtctccaagtactccctcgtgaaaaataagataagcaaatcatcattcagggagatgctccagaaggagctcaaccacatgctgagtgatactgggaatcggaaagctgctgacaagctgattcagaaccttgacgctaatcatgacggaaggatatcgttcgatgagtattggacacttattggcggcatcaccggtcccatcgccaagctcatccatgagcaggagcagcagtcttcttcctag

SEQ ID NO: 24244 - DNA, 306 bp, Artificial Sequence
  Description of Artificial Sequence: Synthetic coding sequence
atgagcaacacccaggccgagcggagcatcatcggcatgatcgacatgttccacaagtacacaggacgtgatggcaaaatcgagaagccaagtctgttgaccatgatgaaggagaattttcctaacttcctcagcgcctgtgataagaaggggattcactacctagccacggtgtttgagaagaaagataaaaacgaagacaagaagatcgacttctccgaatttttgagccttctgggcgatatcgccgccgactaccataaacagtctcatggtgccgctccttgctccggtggttctcagtag

SEQ ID NO: 24245 - DNA, 306 bp, Artificial Sequence
  Description of Artificial Sequence: Synthetic coding sequence
atgagcaacacccaggccgagcggagcatcatcggcatgatcgacatgttccacaaatacacaggccgggatggaaaaattgaaaagccttcgcttttgacaatgatgaaagagaattttccaaatttcctgagcgcctgtgacaaaaaggggatccactaccttgccacggtcttcgagaagaaggacaaaaatgaggataagaagatcgatttctcagaattcctgtctctgcttggcgacatcgccgccgattatcataaacagagccacggtgccgcaccttgttcaggcggcagtcaatag

SEQ ID NO: 24246 - DNA, 222 bp, Artificial Sequence
  Description of Artificial Sequence: Synthetic coding sequence
atgagctaccagcagcagcagtgcaagcagccctgccagcccccccccgtttgtccaacaccaaagtgccctgagccttgcccaccccccaaatgccccgagccgtatctgccacctccctgcccgcccgagcattgcccacctcccccttgccaggataaatgtcccccagtccagccatatcccccttgccaacagaagtatccacctaagtctaaatag

SEQ ID NO: 24247 - DNA, 219 bp, Artificial Sequence
  Description of Artificial Sequence: Synthetic coding sequence
atgagctaccagcagcagcagtgcaagcagccctgccagccccccccggtgtgtccaaccccgaagtgtcccgagccctgcccacccccaaagtgcccagagccttgtcccccacctaagtgtccacaaccgtgtcctccacagcagtgccaacagaagtgtcccccagtaactccctcccctccatgtcagcctaagtgcccccctaagtccaagtag

SEQ ID NO: 24248 - DNA, 219 bp, Artificial Sequence
  Description of Artificial Sequence: Synthetic coding sequence
atgagctaccagcagcagcagtgcaagcagccctgccagccccccccagtctgccccactcctaaatgtccagagccatgtcccccacctaagtgtcccgagccatgcccccctcccaagtgcccccagccctgcccaccccagcagtgccagcaaaagtgtcctcctgtgacaccatctcctccctgccagccgaagtgcccacctaagtctaaatag

SEQ ID NO: 24249 - DNA, 219 bp, Artificial Sequence
  Description of Artificial Sequence: Synthetic coding sequence
atgagctaccagcagcagcagtgcaagcagccctgccagcccccccctgtttgcccaactcccaagtgtcccgagccgtgtcctcccccgaagtgtccagagccgtgcccatctcctaaatgtccccagccttgtcctccacagcagtgtcagcagaaataccccccagtcaccccctcccctccttgccagccaaaatgtccccccaaatccaaatag

SEQ ID NO: 24250 - DNA, 219 bp, Artificial Sequence
  Description of Artificial Sequence: Synthetic coding sequence
atgagctaccagcagcagcagtgcaagcagccctgccagcccccccccgtctgccccacgcctaagtgtccagagccttgtccccccccaaagtgtcctgaaccctgtccaagccctaaatgcccccagccatgcccgcctcagcaatgccagcagaaataccctcccgtcacaccgtcacctccctgccaacccaaatgtcccccaaagagtaagtag

SEQ ID NO: 24251 - DNA, 219 bp, Artificial Sequence
  Description of Artificial Sequence: Synthetic coding sequence
atgagctaccagcagcagcagtgcaagcagccctgccagccccccccagtatgccccacacctaaatgtcccgagccctgcccaccacctaaatgcccagagccttgtccttcgccgaagtgcccacaaccgtgcccccctcaacaatgccagcaaaagtacccacctgtcacaccctcccccccatgccaacctaagtgtccacccaagtctaaatag

SEQ ID NO: 24252 - DNA, 8553 bp, Artificial Sequence
  Description of Artificial Sequence: Synthetic coding sequence
atgcccaagctgctgcagggcgtgatcaccgtgatcgacgtgttctaccagtacgccacccagcacggcgaatatgatacactcaataaggccgaactgaaggagctgcttgagaacgaatttcaccagatcctaaagaacccaaacgacccagacactgttgatattatcctgcagtccctggatagagatcataacaagaaggttgacttcactgagtaccttctgatgatctttaagctcgtacaggctaggaacaaaataatcggcaaggattattgccaggtttcaggatccaagctccgcgacgatactcatcagcatcaagaagagcaagaagagacagaaaaagaggaaaataagaggcaagaatcctctttcagccatagctcctggtctgctggcgagaatgatagctatagtcggaacgtgagaggcagcctgaaaccggggaccgagtctatttcacggcgcctcagtttccagcgggatttttctggtcagcacaatagctatagtgggcagtcatcttcttacggcgagcagaacagcgattcccaccagtctagcggacggggccagtgcggttccggttccggccagtcgccaaattatgggcagcatggcagcggctctggacagtcctcctctaacgatactcatggcagcggaagtggtcaaagctcggggttctcccagcataagagcagttccggccagtcctccgggtatagtcagcacggcagcggttctggccattcttctggttatggccagcacggctctcgttcggggcaatcatcccgaggagagaggcatcgaagttcttcaggttcgtcctcgtcttatggccaacacggttcagggagccgtcagtctctcgggcatggacgtcaaggtagtggctcgagacagtcaccctctcacgtgcgacatgggagtgggtcgggtcactcatcatcacacggccaacacggttctggttccagctactcatatagccggggacactatgagtctggctccgggcagacatcggggtttggtcagcatgagtctgggtccggacagtcttctggatacagtaagcacggaagcggctctggccacagctccagtcagggtcagcatgggagcactagtggtcaggcgtcttcatccggccagcacgggagctcatctcgccagtcatcctcatacggacagcacgaatctgcatcaagacacagcagcggacgcggccagcatagttctggatcaggtcagtcccctggccacggtcagcgagggtctggctctgggcagtcccctagttctgggcagcatggtacagggtttggacggtccagctcttcagggccttacgtgtctgggagcggctattccagcgggttcgggcatcacgagagtagcagtgaacacagctctgggtacacgcaacatggaagtggatcgggccactcctccgggcatggccagcatggatcgagatccggtcagtcatcccggggagagcggcagggatcctccgccgggtccagctcaagctacggccagcatggatctggtagcaggcagagtctgggccatagcaggcatggtagcggcagtgggcagtcaccctctccttcccggggaagacacgaatccgggagccgacagtcctcgtcctacgggccccacggttacggctccggtagatcctctagcagaggtccttatgagagcgggtccggccatagtagcgggctgggccatcaagagtcaaggagcggccaatcctcgggctacggccagcatgggtcatctagcggccactcaagcactcatgggcagcacggcagtacctccggccagagctcctcctgcggccagcatggtgcgacctccgggcaatctagcagtcacggacaacacgggtccggctcttcgcagtccagtagatacggtcagcaaggctcaggctcaggacaatcaccctctcgtggccggcatgggtccgattttgggcatagctcatcgtatggtcagcacggttccgggtccgggtggtcatcttcgaacggacctcacggctccgtctccggtcagtccagcggttttggccacaaatccggcagcggacagtctagtggatattctcagcacggctccgggtcctctcatagcagtggttacaggaagcacgggtcacgtagtggccagtcctctaggtccgagcagcacggaagcagttctgggttgtcctcatcttacggacagcacggctcaggaagccaccagtcctccggccacggtagacagggatccggatccggtcatagcccgtcacgagttcggcatggttcctcatctggacactcatcctcccatggtcagcacgggagcgggacctcctgttcgtcaagttgtggccactacgagtcagggagtggtcaggcctccgggttcgggcagcacgaatcaggctcagggcagggatatagtcagcatggatccgccagcggtcattttagctctcagggccggcatggatccaccagcgggcagagttcaagctcaggacagcacgatagtagttctggccagtcttcttcgtatggacaacacgaatcggcctcccaccacgcgagcggccggggcaggcatgggtcaggatcggggcagagccctggacacgggcagcgtggcagtgggtctggacagtcgccgagctacggacgccatggcagcgggagcggcaggagctcttcatcaggaagacacggcagtggcagcggacagtcttctggcttcggacataaatcaagctctggacagtcttcgggctacactcagcatggaagcggatcgggtcactcctcctcctatgagcaacacggctctcgtagtggacagtcgtctagaagtgaacagcatggatcttctagtgggtctagctcctcctatgggcagcacggaagtggatcgcggcaatccttgggacacggacagcacgggtccgggagtggccagtcaccctcgccatccagaggacggcacgggagtgggagtgggcagagttcatcctacgggccctaccggtcaggctctggatggtcatcctcacgtggcccatatgagtctggtagcggccattctagtggacttggccaccgcgagagccggtccgggcaaagtagcggctacggtcaacacgggagctcatccggacactcctcaacgcatggccagcatggtagcacctctggccaatcatcctcttgcggtcagcatggcgcctcttcaggacaaagctcatctcatggccagcacgggtctggctctagtcagtcttccggttatggccgacagggctccggctctggacagtcgcccggccatggccagagaggcagcgggagccggcagagcccatcctatggtagacacggctccggctccggtcgatcttcatcatctggccagcacgggagcggacttggtgaatcttctggattcgggcaccacgagagcagcagcgggcagagttcttcttattcccagcacggctctggtagcggacacagcagtgggtacggccagcacggcagtcggtcaggtcaatcctccaggggggaacggcatgggagctcttcagggtcatcctcacactacggacagcatggctccgggagccgacaatccagcgggcacgggagacagggctccgggtcgggccattccccctcccgaggccggcatggatccggccttgggcacagctcctctcatggacagcacggctccgggagcggcagatctagcagccgagggccttacgagagccgttccggacacagttccgtttttggccagcacgaaagcggaagtggccattcgtctgcctactcccagcacggtagcggaagtggccatttttgctcacaaggacagcatggtagcactagtggacagagcagtaccttcgaccaggagggcagctccacaggtcaaagctcctcttacggacaccgagggtctgggtcctctcagagtagcgggtacggccggcacggcgcaggtagtgggcagtccccaagccggggccggcatgggtctggttcaggacatagtagttcctacggacagcacggctcaggctccggctggagctcttctagtggtcgacatggatcaggttctggtcaaagcagtggtttcgggcaccatgagagcagttcctggcagagcagcgggtgtactcagcatggctctggatcaggccacagtagctcctatgagcagcatggctcaagatcgggccagagctcccggggtgagcggcatgggtcgtcctccggcagcagcagctcttacggccagcatggctcgggaagccgtcagtcactgggccatggccagcatgggtccgggtccgggcagagtccatctccgtctagaggccgacacgggagtgggtccggccaaagcagttcctatagcccatatggctctgggtccgggtggtcaagctcaagggggccttacgagagcggctccagtcatagtagcggtctgggacaccgcgagtctcgatcgggacagtctagtggctatggccagcatggctcctcgtctgggcactcatccactcatgggcagcacgggagcaccagcgggcaatcctcctcttgcggccagcatggcgctagtagcgggcaatctagctcacacggccagcacggatctggcagctcccagagctcagggtacgggcgccaaggcagcggctccgggcagtctcctggacatggtcagagaggctctgggagtcggcagtctccctcatacggcagacacggatctggatctggcaggagcagttcatcgggccaacacggcagcgggctgggtgaatccagcggttttggccatcacgagtcaagctccgggcagagcagtagctactctcaacatggcagcgggagcggacatagttccgggtatggccaacacggttcacgtagcggacagtcctctaggggcgaaaggcacggtagctcatcccgctcatcctctaggtatgggcagcatggcagcggttcgcgccagtcctccggacatgggagacagggctctggttccggccagagcccttctcgtggcaggcacgggagcggcctggggcactcgagttcgcacgggcaacacggatcaggcagcggtcgctcttcttcaaggggtccatacgaaagtagaagcggccactcctcagtgttcgggcagcacgagtccggctcaggacattcctcagcatactcccagcacgggagcggaagtggccacttctgtagccagggtcagcacggttctacttcaggacagagctcaaccttcgaccaggagggttcttctacaggccagtcatcttcgcacggccagcacgggtcaggcagcagccagtcctcttcttatggacagcaaggctccggctccggccagtctccctcccgaggtagacacggatccggttccggccacagttccagttatggccaacatggttctggctcaggctggtctagcagcagtggtcgccacggcagtggatccggccagtcaagcggctttggacaccacgagtctagttcctggcagtcttctggatatacacagcacgggagcgggagtgggcactcaagcagctacgagcagcacggttctcggtcaggccagtctagcaggggtgagcagcatggctcttcctctggctcctcgtctagttacggccagcacgggtctgggagtaggcagtccttaggccatggtcagcatggaagtggcagcggacagtctcccagcccctcccgtggaagacatggttctggctcaggccagtcctccagctatgggccttatggctcaggaagcggttggagcagcagccgaggcccatatgaaagtgggagtgggcacagctccggcttgggccatcgggaatctagatcaggccagtcgtccggatacggacagcacggtagctcatcagggcattcctctactcacggccagcacggctcggcttcagggcagagctcgagctgcggacagcatggtgcttcttctggacaaagctcaagccatggccagcacggctcaggctcaagccagagttcgggatacggccgccagggaagcggaagcgggcagagccctggtcacggacagcggggcagcggtagccgccagtctccctcttacggcagacatggttcagggtctggccggtcttctagcagcgggcagcatggcccggggttgggtgagtcttctggattcggacatcacgaatcttccagcggccagagttcgagctattcgcagcacggctctgggtccggacattctagcggctacggacaacatggctctcgttctggccaaagcagccgcggagaacggcacggctccagcagcggctccagcagcagatatgggcagcatggctccggtagccgccagagcagcgggcatgggaggcaaggatcaggaagcgggcactctccatctcgcgggcgccacgggagtggaagcggccattcatcttcccatggacagcacggctcgggcagtggaagatcatcaagccgcggcccctacgagtcgcgctccggacactcgtccgtgtttggtcagcacgagagtgggagcggccactcctcagcctactcacaacatggcagcggtagcggtcacttctgttcacaggggcagcatggctcaacatccggacaatcttccacttttgatcaggagggtagctcaacaggacagtcctcttctcatggccagcacggttctggctcttcccaatcttccagttacggccagcaggggtccggctcaggacagtcacccagtaggggacgccacggatccggatcagggcatagctccagctacgggcagcacggaagcgggtctggatggtcaagctcaagcggccgccacggctcagggtctggtcagtcttccggtttcggacatcacgagtcctcatcttggcagtcttctggctatacacagcatggctctggaagcggacatagctctagctatgaacaacacggcagccgaagcggccagtcctcacggggagaacggcacggtagttccagtggatcatcgtcatcttacgggcagcatggatctgggagtcgtcagtcactgggccatgggcagcacggctctggtagcggccagtctccttcaccctctagagggagacatggatctggaagtggccagtcttcctcatacagtccctatggtagcggtagcgggtggtcctcatcccgtggaccctatgaatcggggtcagggcactctagtggactgggacacagggaatcaagatccgggcagtcctccggatacggtcagcacggatcttcctcggggcacagctctacccatggacaacatggatctacttcaggacagtctagcagctgcggacagcatggcgcctctagcggccagagcagtagccacggccagcatgggtcagggtcaagccaaagctctgggtatggccgccagggatccggatcaggtcagagtcccggacatgggcagcgcggcagcgggagccgacagtcacctagctatggcagacacggttcaggcagcggaaggtcgtcctcctcagggcagcacggctcaggcctcggagagtcttctggcttcggccatcacgagtctagctccggccagtccagcagctattcccaacacgggagcggctctggccatagctcgggttacgggcagcacggctcaaggtcaggtcaaagctccagaggggagcgccacggcagcagtagcggtagtagttcccactatggtcagcacggttcagggtcccgtcaatcctcaggccacggacgacaggggtctggctccgggcagagcccctcgcgcgggcgacacggatccggattgggacatagctctagccacggccagcatggctccggctctggaagatctagttcaaggggaccttacgagtccaggctgggccactcatctgtatttggtcagcatgaatcggggagtggccacagcagtgcttactcgcagcacggaagcggctccggtcatttttgttcgcaaggtcaacatggcagcacctctggtcaaagctctaccttcgatcaagaggggtcatccacaggccaaagctcctcatacggtcacagaggctctggctcctcccaaagttcagggtatgggaggcatggcgctggcagtggccagtccctcagccatggccgccacgggagcggatccggtcagtccagcagctacggccagcatggctctgggagcggccagtcctccggttattcccaacacggtagtggaagtggacaagacggctactcctattgtaaggggggtagcaaccacgatgggggttccagtggttcttacttcttgagcttcccatcatcgacctcaccatacgaatacgtgcaggaacagagatgttacttttaccagtag

SEQ ID NO: 24253 - DNA, 876 bp, Artificial Sequence
  Description of Artificial Sequence: Synthetic coding sequence
atgagcagcggcgccgacggcggcggcggcgccgccgtggccgccagatccgacaagggatctccgggagaagacggcttcgtgccatctgcgctcggtaccagagagcactgggacgctgtctacgaaagagagttacagacgtttcgggaatatggtgatacgggagaaatctggtttggagaagaatccatgaacaggctgatccgatggatgcagaaacacaagattcctctagacgctagcgtgctagatattggcactggcaacggggtatttctcgttgagcttgccaagtttggatttagcaacatcaccggcatcgattattcgccgtcagccatccagctctcaggttccattattgagaaagagggcctgtctaacattaagctgaaggtagaagatttccttaatctgtcaactcagctgtctggcttccatatctgcattgacaagggaaccttcgacgccatcagccttaaccccgataatgctattgagaaacgtaagcagtacgtgaaaagtctgagtagagtgctgaaagtgaagggattcttcctcattacatcctgcaattggacaaaggaagagctactcaacgaatttagtgaagggtggagtactgtggccggcttttggctcacggccgctctgacttcttgggcccaggccatattttccacctcagcctctagggttggcggtacaacaggaacacatcaccacgcgtggatcatcttcgtgttcttggccgagactcgcttctgtcacgtagtacaggctgggctggagttgctggggtctagcgatagccctacatggcctccgaaggtcctcggtttgtaccatgcccggcctagcctcgcattttag

SEQ ID NO: 24254 - DNA, 633 bp, Artificial Sequence
  Description of Artificial Sequence: Synthetic coding sequence
atggccccctggggcaagcggctggccggcgtgcggggcgtgctgcttgatattagtggtgtgctgtacgatagcggagcaggcggcgggaccgctatcgcagggtcagtggaagcagtcgctagactgaagcggagtcggctgaaagtgcggttttgtactaacgaaagccagaagtcaagggcggagctggtggggcagttgcagcggctaggatttgatataagcgaacaggaggtgacagcccctgctcccgctgcctgtcagatactcaaagagcaaggattgcgaccttatctgttgatccatgatggggtccgctccgaatttgaccagatagacacttctaacccaaactgtgtggtcatcgcggacgcgggagaaagcttttcttaccagaatatgaataacgcgttccaggtgttaatggaactcgagaagcccgtccttatctcactgggcaaaggtcggtactataaagagacgagcggtttgatgctggacgtgggcccatatatgaaggccctggagtatgcatgtgggatcaaagccgaggttgtcggtaaaccatcccccgagttcttcaagtcagccctgcaagcgataggggtcgaggcccaccaagcccaatag

SEQ ID NO: 24255 - DNA, 813 bp, Artificial Sequence
  Description of Artificial Sequence: Synthetic coding sequence
atggccccctggggcaagcggctggccggcgtgcggggcgtgctgttggacataagcggcgtgctctacgatagtggagccggcgggggtacagccatcgctgggtctgttgaagcagttgcgagactcaagaggagtcgtctcaaggttcggttctgcaccaatgaaagtcagaaatctcgcgctgagctggtgggccagcttcagaggctcggatttgatatttctgagcaggaagtgaccgccccagcgccagctgcttgtcaaatcctgaaggagcaaggtctaaggccatatctcctaatccacgacggcgtaaggtctgagtttgaccaaatcgataccagcaaccccaactgcgtggtgattgctgatgctggggagtccttcagttatcagaacatgaacaatgccttccaagtgcttatggaactggaaaaaccagtcctcatcagtctagggaaaggccgttattataaagagacatctgggctgatgcttgatgtgggcccatatatgaaggcccttgagtatgcctgtgggattaaagcggaagttgtaggcaagccttctccagagttttttaaatccgctttgcaggccatcggggttgaagctcaccaggccgtcatgattggagatgacatcgtgggtgatgtggggggcgcacagcggtgtggcatgcgggcccttcaagtcagaacagggaagttcagaccatccgacgaacaccacccagaagtcaaggctgatggttatgttgacaaccttgcggaggccgttgacctactgctgcagcatgccgataaatag

SEQ ID NO: 24256 - DNA, 3948 bp, Artificial Sequence
  Description of Artificial Sequence: Synthetic coding sequence
atggccgacaccgacctgttcatggagtgcgaggaggaggagctggagccctggcaaaaaatttctgatgtcatagaagactcggtggtcgaagattacaattccgtggacaaaacaaccacagttagtgtatctcagcagcccgtgtcggcaccggtgcctattgctgcccatgctagtgtggcaggccacctttccacctcaacaaccgtgtcgtcttccggagctcagaacagcgatagtacaaagaagactctcgtgacactcatcgccaacaacaatgccccaggcacccagttcgtgaagccgacagtgggagttccccaagtgttcagccagatgacccctgtgagacctggatccacgatgcccgtgcggccgaccaccaatacttttaccacagtcattcctgcgacccttaccatccgctctactgtgccacagtcccagtcacagcagacaaaaagtactccatcaacatcaacgactccaacagctactcagcccaccagtttagggcaattggccgttcaaagcccaggtcaatcaaaccagaccacaaaccctaagcttgcaccctccttcccctctcctcctgctgttagcatcgcatcgttcgtgacagtgaagagacccggagttaccggggaaaatagcaatgaagttgcaaaactggtaaatactcttaataccattccatccctcggacagagtcccgggcccgttgtcgtctctaacaactcctctgcccatgggtctcagcgcactagcggccccgagagttccatgaaagtcacatccagcataccagtcttcgacctgcaggacggggggcgtaaaatctgtccccggtgtaatgctcagttccgagtgacagaagctctaagaggccatatgtgctactgctgtccagagatggtcgagtaccagaagaaaggcaagtcattggattctgagccttcagtgcctagcgcggctaagcccccctcccccgaaaagacagcccccgtcgcttcaacaccaagcagtacgccaattcccgccctgtcaccaccgacaaaagtcccagagccaaatgaaaatgtgggagatgcagtacagactaagctcatcatgttggtggacgacttttattatggcagagacggaggtaaagtcgcccagctcacgaattttcctaaagtggccacctcatttaggtgtcctcactgtacaaagaggttgaaaaataatatcaggttcatgaatcatatgaagcaccatgtggagctagatcaacagaatggggaagtcgacggtcatactatctgtcagcactgctacaggcaattttctacgcccttccagcttcagtgccacttagagaacgttcactctccatacgagagcacgactaagtgtaagatttgtgagtgggccttcgagagcgaacccctgtttctccagcacatgaaggacactcacaaacctggcgagatgccatacgtttgtcaggtgtgtcagtatcggtccagtctgtattcagaggtggacgtccatttccgtatgatccacgaagacacccgccaccttctgtgcccctactgcctgaaggtgttcaaaaatggcaacgcattccaacaacattatatgaggcaccaaaagagaaatgtgtaccattgtaacaagtgtaggttgcagttcctgtttgccaaagacaagatcgaacacaagctgcagcatcacaagaccttcaggaagcccaagcagctagaagggctgaagccgggtactaaggtgactattcgagcgtcaagaggtcagccccgcactgtccctgtgagttctaatgacaccccaccatccgccctacaagaggctgctcctttaacctcatctatggaccctttaccggtgttcctttacccccccgtgcaacgctctatacaaaagcgcgctgtccgcaagatgtcggtgatgggtcgtcagacttgtctcgagtgttctttcgaaatacctgattttccaaaccattttccaacatacgttcactgttctctttgccggtacagcacttgctgcagtagagcctatgccaaccacatgattaataatcatgtgccccgcaagtcacccaagtatttggctctctttaaaaattctgtgtccgggattaagctggcctgtacctcctgcactttcgttacaagcgtaggagacgcgatggccaaacatctagttttcaacccttcccaccggtcatcctccatcctgccgcggggcttgacctggatcgcccattctaggcacgggcagaccagggacagagtgcacgatagaaatgttaagaacatgtatccgcccccctcatttccaaccaataaagctgcgactgtgaaaagtgccggggccacacccgctgagccagaggagcttctgaccccactagcccctgccttgccttcccccgcatctaccgctacccccccccccacacctacccatcctcaggcgttagcattgcctcctctcgcaaccgagggtgcggaatgcttaaatgtggatgatcaggatgaaggatcacccgttactcaggagcccgaactggcatctggggggggagggtccgggggcgttgggaagaaggagcagctgtcagttaaaaaactgcgtgtggtcctgtttgctctgtgttgtaataccgaacaggctgctgagcacttcagaaacccacaaaggaggattagaagatggttgagacgattccaggcttcacaaggagagaacttggaggggaagtacctgtctttcgaggctgaggaaaaactggccgagtgggtactgacccaacgggaacagcaattgcccgtgaatgaagaaaccctgtttcagaaggcaactaagattgggagatccttagagggaggcttcaaaatatcatatgagtgggctgttcgcttcatgcttaggcaccatttaacaccccatgcccgccgagccgtcgcacataccctcccaaaagatgtcgcagagaatgctggtctgtttattgacttcgttcaaaggcaaatccacaaccaggatctgccactgtccatgattgttgctattgacgaaatctccctatttctcgatacggaggtgctctcctctgacgatcgaaaggaaaacgccctccagactgtgggcaccggtgaaccctggtgcgatgtcgtgctggccatcttagcagacggaactgtgctgccgaccctggtgttctaccgaggccagatggatcaacctgctaatatgcccgactctatcctactggaagctaaggagtcaggctattccgatgatgagataatggagttatggagtactcgcgtgtggcagaaacacactgcatgccagcggagcaagggcatgttagtaatggactgccataggacgcatctgagtgaagaagtcttggcgatgctttccgcttcttccactctgcctgcagtggtcccggccggatgttcttctaagatccagcccctcgacgtatgcatcaagaggacagtaaagaattttctgcataagaagtggaaggagcaagcccgggaaatggctgacacggcttgcgatagtgatgtgttattgcagttggtcctagtatggctcggcgaggtccttggcgtgatcggcgactgtccagaactggtgcagcggtcattcctggtcgctagtgttctgcccgggcccgacgggaacataaactccccgactcgcaatgcggacatgcaggaagagctaatcgcatcgctagaggaacaactgaagctctccggggagcactcagagagtagcaccccacgcccacgatctagtccagaagaaaccattgagccagaaagtttgcaccaactctttgagggagagagtgaaaccgagtctttctacggttttgaggaagctgatctggatctcatggaaatatag

SEQ ID NO: 24257 - DNA, 2406 bp, Artificial Sequence
  Description of Artificial Sequence: Synthetic coding sequence
atgggcgacaccgtggtggagcccgcccccctgaagcccaccagcgagcccacttccgggcctcccgggaataacggcgggtcgctcttgtccgtcattactgaaggggtaggtgagttatccgttatcgatcccgaagtggctcagaaggcctgtcaagaagttctggaaaaggtcaagttgctgcacggtggggtcgctgtgagcagtaggggcaccccgttggaattggtgaacggggacggggtcgactccgagatacgatgcctcgatgaccctcctgcccaaatcagggaggaagaggatgagatgggcgctgccgtggcttctggcactgctaaaggcgcaagacggcgccgccagaataactcagccaagcagtcctggctactgcggctgtttgagtcaaaactgtttgatatttccatggctatcagctacctgtacaattcgaaggagccaggggttcaggcctacatcggtaaccggcttttctgctttcgcaatgaagatgtcgatttttaccttccacagcttctgaatatgtatattcatatggatgaggatgtaggcgacgcgatcaagccttacattgttcaccgctgccgccagagcatcaatttcagcctacaatgtgcattgctgctaggcgcctatagcagtgacatgcacataagtacacaaagacactcacgcggtaccaaactgcgcaaactaatcctgtcagacgagctcaagcccgctcataggaagagagagctcccaagtctctcgccagcacccgatacaggcctgagccccagtaaacgtactcaccaacgatcaaagagtgatgctactgctagcatttcactgagcagtaatctgaagaggactgcaagtaaccccaaagtggaaaatgaagacgaacctgttaggttagcacccgaacgggagtttatcaaatctctgatggctatcggtaagcgactcgctactctgcccacaaaggagcaaaaaactcagagactgatatctgaactgagcctcctgaatcacaagttgcccgctagggtgtggttgcctactgccggattcgaccatcacgtcgtccgggtgcctcacacacaggcagtggtgctcaactccaaggacaaagccccctatctaatctacgtcgaagtcctggaatgcgagaactttgacacaacctcagtgccagcccgcatccctgaaaatcggatccgtagcactcgatctgttgagaacctcccagagtgtggcattacacacgagcaacgagccgggtccttttccactgtgcccaattatgacaatgacgatgaggcttggtctgtggatgacataggtgagctgcaggtcgaattgcccgaagtgcatactaactcatgtgataacatcagtcagttctcagtggattccatcacctcgcaggaaagcaaggagccggtctttatagctgcaggcgacatccgtaggcgactatcggagcagctggcgcatacccccacggcgttcaagcgggacccagaggacccaagcgcagtggccctgaaggagccatggcaagaaaaagtccggcgcattcgagaagggagtccatatgggcacctacctaactggcggctcttaagcgttattgtgaagtgcggggacgacttgcggcaggagctgcttgcattccaggtcctgaaacagctgcaaagcatatgggagcaagaacgggtgcctctgtggatcaaaccctacaagatcctcgtaatctcagcagattctggcatgattgagcccgtggtgaacgctgtctctatccatcaagtgaaaaagcagtctcaactaagtctgctggattatttcctacaagaacacggttcctacacaaccgaagcctttctgtcagctcagcgaaatttcgtgcagtcctgtgctggctattgcctcgtttgttacctgctccaggtgaaagacaggcacaacggtaacatcctgttggatgccgagggacacattatccacattgacttcgggttcatcctcagttcgtctcccaggaaccttgggtttgaaacctcagcgtttaagctgaccactgagtttgtcgacgtgatgggagggctcgacggcgacatgtttaactattataagatgctgatgctgcagggcctgatcgcagcaagaaaacacatggacaaggtcgtgcagatagtcgagatcatgcagcagggtagccagctgccctgttttcacggctccagtaccattcgtaacttgaaagagaggtttcatatgagtatgaccgaggagcagcttcagctgctggttgaacagatggttgacggaagcatgaggtctattactaccaaactctatgacggattccagtatctgaccaacggaattatgtag

SEQ ID NO: 24258 - DNA, 2451 bp, Artificial Sequence
  Description of Artificial Sequence: Synthetic coding sequence
atgggcgacaccgtggtggagcccgcccccctgaagcccaccagcgagcccacatccgggccgcctggaaacaacggtggctctcttctgagcgtgataacagagggcgtgggggagcttagtgtgatagatcctgaagtggctcagaaggcctgccaggaagtgctggaaaaggtgaaactgttgcacggaggggtggcagtcagctcacggggaaccccccttgagctcgttaacggagacggggtggactcagaaattcgctgcttggacgatccaccagcacagatcagggaggaggaggatgagatgggtgccgctgtggcttcaggcacagcaaagggggcacggcgtcgccgccagaacaactccgccaagcagtcctggctgctgagactgttcgagtccaaactgttcgatattagtatggctatcagctatctttataactctaaagagccgggcgtccaggcatatataggtaacagactcttctgtttccgaaatgaggatgtggacttttacctgcctcaattactaaatatgtacatccacatggacgaggatgtgggtgatgcaatcaaaccgtacattgtccatcggtgccgccaatcaattaatttcagtctccagtgcgccctgctgctgggggcctatagttccgatatgcatatctccactcagcgacactcgagaggaaccaagctcaggaagctcatcctgagcgacgaattgaagccagcccaccgcaagcgcgagcttccaagcctctcgcccgctcccgacaccggcctctctccttctaagagaactcatcaaagatcaaagtctgacgcgacggcatccatttcccttagtagtaacctgaagcgaacggcgtcaaaccccaaagtggaaaacgaggatgaagagctgtcttcttccactgaatccattgataactctttttcgtctccggtgcgcttggctccagaaagggaattcatcaagtctctgatggcgattggaaaacggctagctactctaccaactaaggagcaaaagacccagcggttgattagcgaactttcgctcctgaatcataaactgcccgccagggtgtggctcccaaccgccggatttgaccaccatgtggttagggtgccccacacccaggccgtggttctgaacagtaaggacaaggcgccatacctgatatatgttgaagtcttagagtgcgaaaacttcgacacaacatctgtgcccgctaggatccctgagaaccggataagaagcacacgctccgtggaaaatttacccgagtgtggcatcactcatgaacagcgagcaggaagctttagcacagtacctaattacgacaatgacgatgaagcctggagcgtggatgatatcggagagttacaagtagagcttccagaagtccacaccaactcttgcgacaacataagccagttttctgtggacagtatcacatcccaagaatcgaaagagccagtgttcattgcggccggagatatcagacggaggctctcagaacagctcgcgcacacacccaccgcattcaagagggacccagaagacccttctgccgtcgccctcaaagagccctggcaagaaaaggtgcgtagaatccgggagggttcaccatacgggcacctgcctaactggagactcttgtctgttatagtcaaatgcggcgacgaccttcgacaggaactgcttgctttccaagtcttgaaacagctgcagagtatttgggagcaggaaagagtgcccctatggattaaaccatataagatcctagtgatctctgccgactccggcatgattgagcccgtggtgaacgccgtgtctattcaccaagtgaagaagcagtcgcaactttctttgctggactacttcctacaggagcatggatcttacactaccgaagctttcctgtccgcccagcgtaattttgttcaaagttgtgccgggtactgcctcgtctgttacctgctgcaggttaaggacagacacaacggcaacatcctcctcgacgctgagggacacatcatccatatcgactttggttttattctgtcaagcagcccaagaaacttggggtttgagacttccgccttcaaactgacaactgagttcgtagacgtaatgggggggctcgacggcgatatgtttaactactataagatgctgatgttacagggcctgattgctgcgcgcaaacacatggacaaggtcgtgcagattgtggagattatgcagcagggttcccaattaccatgctttcatggatcatcgacaatcaggaaccttaaagagcgctttcatatgagtatgacggaagagcaacttcagttacttgttgagcagatggtggacggctcgatgcgcagtataacaactaagctgtatgatgggttccagtatctgacgaacggcatcatgtag

SEQ ID NO: 24259 - DNA, 2406 bp, Artificial Sequence
  Description of Artificial Sequence: Synthetic coding sequence
atgggcgacaccgtggtggagcccgcccccctgaagcccaccagcgagcctaccagcggcccccctggcaacaacggcgggagcctgctgagcgttatcactgagggggtcggggaactgtccgtgattgatccggaggtggctcagaaagcttgtcaggaggtcctggagaaggtgaagttgctccatggcggagtcgctgtgagtagtcggggcacccccttggagctcgtgaacggtgacggcgtggattcagaaattcggtgtctggatgatcccccagcccagattagagaagaggaagatgagatgggggccgcagtggcttctggtacagcaaagggcgccagaagacgacgtcagaataactccgctaaacagtcatggctactccggctattcgagagcaaactgttcgacattagtatggctatctcctacctgtacaattccaaagagcccggcgtgcaggcatacatcggaaatagactgttttgcttcaggaatgaggacgtcgacttctacctacctcaactcctcaacatgtacatccacatggacgaggacgtgggcgatgctatcaaaccttatatagtgcacaggtgtcgccagtcgatcaactttagcctgcagtgtgcacttctgctcggggcctactcaagcgacatgcacatctcaactcaaagacattccaggggtaccaagttgaggaaactgatccttagcgacgagctgaagcccgcacatcgaaagcgggaactgccatctctgtcccccgccccagacaccggtcttagtccatctaagcgcactcatcagcgcagtaaatccgatgccaccgcgagtatatctctcagctccaatcttaaaaggaccgcttcgaatccgaaggtggagaacgaggatgaaccagtccggctggctccagagcgggagttcattaagtcgctgatggcaatcggaaagcgactggctactttaccgacaaaagaacagaagacacaaagactcatctctgagctgtccttactgaaccataagcttccagccagggtttggctccctaccgccggattcgatcatcacgtcgtccgggtcccacacacacaggccgtggttctgaattctaaagacaaagccccttacctcatatacgtggaagttctggaatgcgagaactttgatacaactagcgtgcccgcccggatacctgagaacaggataagaagcactaggagcgttgagaacctccccgagtgcggcatcacacacgagcagcgggcaggctcgtttagcaccgtcccgaactatgacaatgacgacgaagcatggtcagtagatgatattggggaactgcaggtagagttgcccgaggtacacaccaatagctgtgataatatctctcagttttctgtcgactctatcaccagccaagagagtaaagaacctgtcttcattgctgccggggatatccggaggcggttgagtgaacagttggctcatacacccacggcgtttaagcgcgatcccgaggatccctctgcagtggcgctgaaagagccctggcaggaaaaagtgaggcggattagggagggtagcccctacgggcatctccccaattggcggctgttgtctgtgattgtgaagtgcggggatgatctgcggcaggaactgctcgcgttccaggtgctcaagcagctgcaatcgatttgggagcaggagagggttccactctggatcaaaccatataagatacttgtgatctccgccgactccgggatgattgagcccgtcgttaatgcagttagcatccatcaggtaaaaaagcagtctcagcttagcctcttggactactttctgcaggagcacgggagctataccacagaagcgtttttatccgcccaacgcaattttgttcagtcctgtgccggttattgcctggtttgttatcttcttcaggtgaaggaccgccataacgggaacattctgctcgacgctgaggggcacatcatccacattgacttcgggtttattctgagcagttcaccaaggaatctcggatttgagacatccgcttttaagttgaccacagagttcgtggatgttatgggtggcctggacggtgacatgtttaattactataaaatgctcatgctgcagggcctgatcgctgccaggaaacacatggacaaggttgtgcagatcgtggagatcatgcagcagggatctcagctgccctgtttccatgggtcatccactattcgtaatctgaaggagcggtttcatatgtccatgacggaagagcagctgcagctgctggtcgagcagatggtggacgggtcgatgagaagtataactacaaaattatatgatggttttcaatacctgaccaatggcatcatgtag

SEQ ID NO: 24260 - DNA, 2487 bp, Artificial Sequence
  Description of Artificial Sequence: Synthetic coding sequence
atgcggttcctggaggcccggagcctggccgtggccatgggcgacaccgtggtggagcctgcccctctgaaacccacctctgaaccaacctcagggccgccaggcaacaatggaggctcgttactgtctgtgattacggagggggtgggcgaattatctgtgatcgatccagaggtcgcacagaaagcctgccaggaggtccttgagaaggttaagcttctgcacggcggagtcgccgtttccagcagaggtacacctttagagttggtcaatggggacggagtggacagcgagattcggtgtctggacgacccacctgctcagattcgcgaggaggaggatgaaatgggcgcagctgtggcctccggaaccgctaaaggtgcgcggcggcgcagacaaaataactcagccaaacagtcatggctgctcaggctattcgaatcaaaattgttcgatatttccatggctatatcttatctgtacaactccaaggagcccggtgtgcaggcctatatcggcaataggcttttttgtttcagaaatgaagacgtggacttttatctcccacagttactgaatatgtatattcacatggacgaggacgtcggggatgccataaaaccttatatcgtgcatcggtgtcgacagagtataaacttttcgctgcagtgtgctctcctgctgggagcctatagctcggacatgcacatcagtacacagaggcactctaggggcaccaagctgcggaaactcatcctgtctgatgagctgaagcccgcccaccgaaagcgtgaactcccatcactatctcctgccccggataccggcctatcccccagcaaaagaacccatcaaagatccaagagtgacgctaccgcctccattagcctcagctcgaacctcaaacgtactgcttccaatcctaaagtggaaaatgaggacgaagagctgtcctcttcaaccgaaagcatagacaatagcttcagtagccctgtacggttagctcctgagcgtgaatttatcaagagcctgatggcgatcggaaagcgcctcgcaacgctgcccaccaaggaacagaaaactcagcgcttgatatctgagttgagtctgctgaatcataagcttcccgcccgtgtctggctgcctaccgccgggtttgaccaccacgtggtacgtgtcccgcacacccaggctgttgtcttgaacagcaaagacaaagctccttacctcatctacgtggaagtattagaatgtgaaaatttcgatactacttcggtcccggcgcgcatacctgaaaaccgtattaggtcaactagatcggtagaaaacctgcctgagtgtgggattacacacgagcagagagccggatcattcagcacagttcctaactatgataatgacgacgaagcctggtctgttgatgacatcggagaactacaagtggaattgccggaggtacacactaactcctgcgataatatttctcagtttagtgtagactccattacaagccaggaaagcaaagagcctgtttttatcgcagcaggcgacattcggaggaggctctctgaacagctggcacacacccctacagcattcaaacgagacccagaggacccctctgcagtggcactgaaggagccttggcaagaaaaggtgaggagaatccgggagggcagcccctacggccatcttcccaactggcggctcctctcggtcatagtcaagtgcggagacgatttacgtcaggagttgctggccttccaggttctcaagcaactgcagagcatctgggaacaagagcgagtgcccctctggatcaagccatacaagatactggtgatatccgcagactcaggaatgatcgaaccggttgttaatgccgtgagtatccaccaggtgaagaagcaaagccagctgtcacttctggactacttccttcaggaacacggctcttacaccaccgaggcattcctcagtgctcagcgtaacttcgtgcaaagctgcgctggctattgtctggtctgctatctgcttcaggtgaaggacagacataacggtaacatcctgctggacgccgaaggacacattattcacattgacttcggttttattctcagctcttctcctagaaacttgggtttcgaaacgagtgcattcaaactgacgacagagttcgtggacgtcatgggaggcctggatggagacatgttcaattattacaagatgcttatgctgcaaggattaatcgctgcaagaaaacatatggataaggtggtccagatcgtcgaaatcatgcagcaggggtcacagctgccttgttttcatgggtcctccacaatacgaaatctcaaagagagatttcatatgagtatgactgaggagcaattgcaactgctcgtggagcaaatggtggacggctcgatgcgctcgatcaccaccaaactctatgacgggtttcagtatctgacaaatggcataatgtag

SEQ ID NO: 24261 - DNA, 1143 bp, Artificial Sequence
  Description of Artificial Sequence: Synthetic coding sequence
atggtgctggagagcaccatggtgtgcgtggacaacagcgagtacatgcgaaatggagatttcctgcccacacgtctgcaagcccaacaggacgccgttaatatcgtgtgtcacagcaagactaggagcaaccccgaaaataacgtcgggctgatcaccctcgccaacgattgtgaagtgcttacaacgctgactcctgatacggggagaatcctctccaagctccacacggtacaacccaagggcaagattaccttctgtactggcattagagtggcacacttagctttgaagcaccgccagggcaagaatcacaagatgaggatcatcgcattcgttgggagccctgtagaagataacgagaaggatctagtgaaactggcaaaaaggctcaaaaaggagaaagtcaacgttgatataatcaattttggggaggaggaagtcaataccgaaaagctcaccgcatttgtgaatacactgaacggcaaggacggaaccggttctcacctagtgaccgtcccaccaggcccttccttggcagatgccctgatttcttccccaatccttgctggggaagggggagccatgctagggctgggagcttcagattttgagtttggggtggacccgtctgccgaccccgaactggccctggcccttcgggtctcaatggaagaacaaagacagagacaggaggaagaagcaaggagggcagccgccgcgagcgctgcagaggccggtatcgccactacaggaacagaaggcgagagagattccgacgacgcgttactgaaaatgaccatcagccaacaggagtttggccgaactgggcttcccgatctgtcaagcatgaccgaagaggaacagatcgcttatgctatgcagatgtctctgcaaggcgctgaattcgggcaagccgagtccgcagacatcgatgctagctcagccatggatacctccgagcccgctaaggaagaggacgattatgacgtgatgcaggaccccgaattcctgcagagtgtcctggaaaatttacccggtgttgaccctaataatgaagccatacgcaacgccatgggcagcttagcctcccaggctacaaaggacggaaagaaagataagaaagaagaagacaaaaagtag

SEQ ID NO: 24262 - DNA, 1134 bp, Artificial Sequence
  Description of Artificial Sequence: Synthetic coding sequence
atggtgctggagagcaccatggtgtgcgtggacaacagcgagtacatgaggaacggtgattttttgccgacgcggctccaagcacagcaggacgctgtgaacatcgtgtgtcattcaaaaacacgctctaatcctgaaaataatgtaggactgataacgcttgccaatgactgtgaggttttgaccacccttactcccgacactggacggatcctctccaagctgcacacagtccagcccaagggaaaaattactttctgcactggcattagagtggctcacctggctctgaaacaccgccagggcaaaaatcataagatgagaattatcgcattcgtggggtctcccgtggaagacaatgaaaaggatttagtgaagttagctaagaggctcaagaaggagaaagtgaatgtggatattatcaactttggcgaagaggaggtcaacactgagaagctgactgccttcgtcaacacccttaatgggaaggacggaacaggctcccacctggtcacagtgcctcccggtccttcactggcggatgctctgatctcctccccaatactagctggcgaagggggggccatgctggggctcggggcctccgactttgagtttggggttgatccaagcgctgaccctgagctggcattagctctacgcgtgagtatggaagagcagaggcagaggcaggaggaagaggctcgccgggcggccgccgcctccgcagctgaggcagggattgcaaccaccggcaccgaggatagtgatgacgctcttctcaagatgaccatcagccagcaggagttcggtcgaactgggttgccagacctctcctcaatgacagaagaagaacagatcgcctatgccatgcagatgtctctgcaaggcgcagagttcggccaggcagaaagtgccgacattgacgcctcttccgcaatggacaccagcgagccggccaaagaggaagacgactacgatgtgatgcaggaccccgagttcctccagtcggtgctggaaaatctgccgggcgttgacccaaataatgaggcaatcaggaacgctatgggtagcttagccagccaggccaccaaagacgggaaaaaggacaaaaaggaggaagataagaagtag

SEQ ID NO: 24263 - DNA, 933 bp, Artificial Sequence
  Description of Artificial Sequence: Synthetic coding sequence
atgcggcccgcccggcactgggagacccggttcggcgcccgggactttggcggatttcaggattgcttttttcgagacagattaatggacacggctaggatcgctgttgtgggagcaggtgtcgtgggcttgtctacagctgtttgcatctctaagctggtaccgcgatgcagcgtcacaattatcagcgataagtttacgcccgacactacttctgacgtggccgccggtatgctgatcccccatacatatcctgatacgcccatacacacccagaaacaatggttcagagaaacctttaaccaccttttcgcgatcgcgaactctgccgaagccggggacgctggggttcatctggttagcggcattaagggtagcggggggtggacccttacacgacgtattgaagatctttgggagctccatccaagtttcgacatagttgttaattgctcaggacttggctcgcggcagctggccggcgacagtaagatctttcccgtgagggggcaagtcctccaagtccaggcaccctgggtggaacatttcatccgggatggatccgggctcacttacatctatccaggtacaagtcacgtgaccctcgggggcacccggcagaaaggagattggaatctgagccccgacgccgagaactcccgggagatcctgtccagatgctgtgccctcgagccatccctacacggagcctgcaacatccgtgaaaaagtgggcctccggccatacaggccgggagttcggcttcagacggaactcttagccagagatggacagcgcctgccagttgtccaccactacgggcatggcagcggcggtatctctgtgcattggggaactgcactggaagctgcacggctggtcagtgaatgcgtacatgccctccgcacgccaatccctaaaagtaatctctag

SEQ ID NO: 24264 - DNA, 1110 bp, Artificial Sequence
  Description of Artificial Sequence: Synthetic coding sequence
atgcggcccgcccggcactgggagacccggttcggcgcccgggacttcggagggttccaggattgcttcttccgtgacaggctgatggacactgctaggattgcggttgtcggcgctggtgtggtggggctgtctaccgcagtctgtattagcaagctggtcccgagatgctcggtgacaatcatttcagacaaatttactcccgacacaacttcagacgtcgctgctggcatgctgatcccgcatacttatcctgacacaccaatccatacacaaaaacagtggttcagagagacattcaaccacctttttgccatcgctaattctgctgaagctggagatgcgggggtgcacttggtttccgggtggcagatcttccaaagcacccctaccgaggaagtcccattctgggctgacgtagtcctcggctttcggaaaatgacggaagccgaactcaaaaagttccctcagtatgtgtttggacaggccttcaccacgctgaagtgtgaatgccctgcttatctaccgtggctcgagaaaaggattaaaggtagcggcggatggacattgacccgtcgaattgaggacctgtgggagctgcacccatcgttcgacatcgtcgttaattgcagcgggctgggtagcagacagttggcaggggatagcaaaatctttccagtgagaggccaggttcttcaggtacaggcgccgtgggttgagcattttataagggatggaagcggcctgacgtacatctatccgggcacttcccatgtgaccctcggcggcactcgccaaaagggggactggaatcttagtcccgacgccgagaatagccgcgaaattctgtcccgctgctgcgctctcgagccgtctcttcacggcgcctgcaatattcgagagaaggttgggctccggccatatagaccaggcgtaaggctgcagaccgagcttctagctcgtgacgggcagaggttgcccgtggttcatcactacggccatggctcaggaggaatatccgtccactggggtacggccctggaggcggccaggctggtatccgaatgcgttcatgctctacggacacccataccaaaatctaatctttag

SEQ ID NO: 24265 - DNA, 1026 bp, Artificial Sequence
  Description of Artificial Sequence: Synthetic coding sequence
atggacaccgcccggatcgccgtggtgggcgccggcgtggtgggcctctctaccgcagtatgcattagcaagctagtcccgcgctgtagcgtgaccatcatatctgataaatttacaccagatacaacctcagatgtcgctgccggtatgctgatcccacatacatatcccgacacgcctattcacactcagaagcaatggttccgggaaacttttaaccacctgtttgcaattgccaactcagctgaggcgggcgatgccggggtgcacctggtgtctggttggcaaatctttcagagtactcctacagaggaggtgcccttctgggctgacgtcgtcctgggtttccgcaaaatgaccgaggcggagctgaagaagttcccacagtacgtgttcggccaggccttcactaccttgaagtgcgagtgtcccgcataccttccttggcttgaaaagaggatcaaggggagcggaggctggacccttacaaggaggattgaggacctatgggaacttcatccttcattcgacatcgtcgtgaattgttctggcttaggctctcggcaactggccggcgactctaaaattttcccggtgcgaggacaagtgctccaggtgcaggctccttgggtcgagcattttattagggatggctctggcctaacgtacatttaccctggtactagccacgtcactcttggaggtacccgacagaagggagactggaatttgagccccgacgccgagaactctcgggaaatcctctcccgatgctgcgcactggagccaagcttacacggagcatgcaatatcagagaaaaggttggcctgaggccatacaggcccggagttcggttgcagacggagctcctcgcccgtgatggccaaagactcccggtcgtgcaccactatggccacggtagcggcggcataagcgtccactggggcaccgctctcgaagccgcaaggctagtgagcgaatgtgtgcatgcactgcgaactcctatacccaagtccaatctctag

SEQ ID NO: 24266 - DNA, 1074 bp, Artificial Sequence
  Description of Artificial Sequence: Synthetic coding sequence
atgggcaccatccaggaggccggcaagaagaccgacgtgggcgtgcgggaaatcgccgaggcccccgaactgggagcagcccttcgccacggtgaactagaactgaaggaggagtggcaggacgaagagtttccccgcttgttaccggaggaagccggcactagcgaagatccagaggatccaaaaggcgatagtcaggcggctgccggaactcctagcactctggctctttgcggtcaacgacctatgagaaagcggttgtccgcccccgagctccggctgtccctaaccaaaggtcccgggaacgacggggcctccccgacacagagcgccccatcctccccagacgggtcgtccgaccttgaaatcgatgaacttgagactcccagtgatagtgagcagctggacagcggacacgagtttgagtgggaagatgagctgccacgagctgaaggtcttggcacgagcgagacggcagagcgactcgggaggggttgcatgtgggacgtgaccggggaagacggtcaccactggcgcgtgttcagaatgggtccgcgcgaacaacgggtcgatatgaccgtgatcgagccatataaaaaggtcctgtcccacggtggctaccacggtgatggattaaacgcagtcatcctctttgctagctgttaccttcctaggtcttccattcccaattatacgtatgtcatggaacacttgtttcggtacatggtaggtacccttgagctgttagtggccgagaattaccttttagttcatctgagcggcggaacatccagagcacaggtcccccctttgtcctggatccggcagtgttatcgtaccctggaccgtagacttcggaagaatctacgcgcactggtggtagtccatgcgacctggtacgtcaaggcctttcttgcacttcttagaccattcatcagctctaaattcacccgcaaaatcaggttcctcgacagcctcggagaactggcccagctcatctccctggaccaggttcatatccctgaagcagtgagacagcttgatagagatttacacggcagtggcggaacatag

SEQ ID NO: 24267 - DNA, 1269 bp, Artificial Sequence
  Description of Artificial Sequence: Synthetic coding sequence
atgctgaagttcctggccaagggcgaggtgcccaagggcagctgcgaagacgagccgatggacagcacaatggatgacgccgttgctggtgacttcgctctcataaacaagctggacatccaatgcgaccttaaaaccctctctgatgatattaaggagagtctggagtccgaggggaaaaacagcaagaaagaagagccacaggaactcctgcagtcgcaggacttcgttggcgaaaagctaggctccggcgaacccagccattctgtcaaggtgcatacggtgcctaagcccggcaaaggagctgacctgtctaagcccccttgtaggaaggctaaggagattcgcaaggagcgaaaacgtctgaaactgatgcaacaaaaccctgcaggagaactcgagggcttccaggcccagggccatcctcctagtctgttccctccgaaggccaaaagtaatcagccaaaatctcttgaggacctgattttcgagtctttaccagaaaatgcctcccataagttggaagtccgacttgtacctgtgtcattcgaggaccccgagttcaaatcctccttctctcagtctttctcactctacgttaagtaccaagtggcgatccatcaggatccacccgatgaatgtggcaaaactgaattcactagattcttgtgtagttcacctcttgaggccgagacacctcctaacggccccgattgcggctacggtagtttccaccagcagtattggcttgacggaaagattattgccgtgggagtcattgacatcctgcctaactgcgtgtctagcgtctatctgtactatgatcccgattatagtttcctgagccttggtgtgtatagtgccctcagggagattgcattcactaggcagcttcacgagaaaacctctcagttgtcgtattactacatggggttctatattcacagttgccctaaaatgaaatacaaaggtcagtacagacccagcgatctgctttgtccagaaacttacgtctgggtcccaatcgagcaatgtttgccaagtctggagaatagcaaatattgccgctttaaccaagatcctgaggctgtcgacgaggatcggtcgacagagccagataggttgcaggtgttccacaagcgggcaattatgccttatggcgtctataaaaagcagcagaaagacccatccgaggaggctgccgtattacagtacgcttctttggtaggccagaagtgttccgaaagaatgttgttgttccgtaactag

SEQ ID NO: 24268 - DNA, 1557 bp, Artificial Sequence
  Description of Artificial Sequence: Synthetic coding sequence
atggccttctgggccggcggcagccccagcgtggtggactacttccccagcgaggacttctacaggtgtgggtactgtaagaatgaaagcggttcgcggtccaacggcatgtgggcacacagcatgactgttcaggattatcaggatctcatcgataggggctggcgcagaagtgggaagtacgtatacaagccagtgatgaatcagacttgctgcccgcagtacactatccgatgccggcctctccagtttcagcctagtaagagccacaagaaggtgttgaagaagatgttgaagtttctcgcaaagggtgaagtgccgaaaggttcttgcgaagatgaacctatggattccactatggatgacgccgtggctggcgattttgcccttataaacaaacttgatattcaatgtgacttaaagaccttgtccgacgacatcaaggagtccctggagagtgagggcaagaatagcaaaaaggaggaacctcaggagttgctacagtcacaggattttgtcggggagaaacttggcagtggggagccctcccattcagttaaagtccacaccgtccccaagccggggaagggtgccgacctgagtaaaccaccctgcaggaaagctaaagagattcgcaaggaacgcaaaagactcaaactcatgcagcagaatcccgctggtgaactggaggggttccaggctcaagggcatcctccctccctgtttccaccaaaagccaagtcaaaccagcccaagtctctggaggatcttatatttgagtccctgccggagaacgctagccacaaattggaggtgcgcctcgtcccagtgagctttgaagatcccgagttcaaaagttcattttctcagagcttctcactgtacgtgaagtaccaggttgccattcaccaggatccacccgacgagtgtgggaaaactgagtttacgcgctttctgtgttccagtccactcgaagcggaaacaccacctaacggccccgactgcgggtacggaagctttcatcagcagtattggttggacggaaagattattgctgtgggcgtgatcgacatattacccaactgtgttagttctgtttatctgtactacgaccccgattatagctttctaagccttggcgtgtactccgccctgagggagatagccttcactaggcagctacacgagaaaacctcacagctgagctactactatatggggttttacattcactcctgccccaaaatgaaatataaggggcagtacagacccagcgatctgctttgcccggagacatatgtctgggttccaattgaacagtgcttaccatcactagagaactccaagtactgtagattcaaccaggatccagaggctgtcgatgaggatcggagtacggagcctgaccggctccaggtatttcataagcgggctatcatgccatacggcgtatacaaaaagcagcagaaggacccctccgaggaagccgctgtactgcagtacgctagcctcgtgggacagaaatgctcagaaaggatgctgctgtttcggaactag

SEQ ID NO: 24269 - DNA, 3003 bp, Artificial Sequence
  Description of Artificial Sequence: Synthetic coding sequence
atggccgagcggaagcccaacggcggcagcggcggcgccagcacctccagctctggaaccaacctcctttttagcagttctgctaccgaattctcctttaacgttcccttcatccccgtgacacaggcctcggctagccctgcctcccttctgttaccaggcgaagactctacggatgtgggggaggaagattcttttttgggtcagacctccatccatacctccgcaccccagactttttcctatttctcccaggtgagctcttcaagcgacccatttggaaacattggccagtcccccctgacgaccgcggccacaagtgtggggcagagcgggttcccaaaacctcttacagccctgccattcaccactggctctcaagacgtgagtaatgcattcagtccaagtatttccaaagctcagccaggagccccgcctagctccctgatgggcattaactcctacctcccctcgcagccgtcatccctccccccttcctactttgggaaccagccgcagggcattcctcaacccggctataacccctaccggcacacccccggatcttccagggccaacccctacatcgccccgcctcagttgcaacaatgtcagacccctggtccaccggcgcaccccccacccagcggccctccagtccagatgtaccagatgccaccggggagtctgcccccagtgccctctagtgtgcagagccccgcgcagcaacaagtccccgcacgaccaggcgctccttccgtgcaggtgccaagccctttcctgcttcagaaccaatatgaacctgtacagcctcactggttctattgcaaagaagtggagtacaagcagctgtggatgccattttctgttttcgatagtctaaatctggaggagatatataatagcgtgcagcccgaccctgagtcagtcgtgttaggaaccgatggcggccgctatgatgtgtacttatacgacagaatccggaaggctgcctactgggaggaggagccggcagaggtacgccggtgtacctggttctacaagggggatactgacagtcgtttcatcccttacacggaggagttttccgaaaaacttgaagcagaatacaagaaagcggtgaccacaaaccagtggcaccgcagactagagttcccctcaggagagaccattgtaatgcataatcctaaagttatcgttcagtttcagccaagcagcgtacccgacgaatggggcaccactcaggacggtcagacacgcccacgcgtcgtcaaaaggggcatcgatgataacctcgacgagatacctgacggcgaaatgccacaggtggaccacctggtatttgttgtccatgggattggccctgtgtgtgaccttcgatttaggtctattatagagtgcgttgacgactttagagtggtgagcttaaaacttctacgtacacactttaagaaaagcttagacgacgggaaggtctctcgggtggaatttctgcctgtgcattggcactcatccctcgggggggatgccacaggagtcgatagaaatatcaaaaaaataaccctgccctctattggccggttccggcattttacaaacgagacactgctggatatcttattctacaacagcccaacatactgccagaccattgtagaaaaagtcggtatggagatcaaccatctgcacgcgctcttcatgagtaggaaccccgacttcaaagggggcgtgagcgtggccggacactccctggggtccttaatcttatttgacatcctgtctaatcagaaggacctcaacctttctaagtgccccggccccttggctgtagcgaacggggtggtaaaacagcttcactttcaggaaaagcagatgcctgaggagcctaaactcacgctcgacgaaagctatgatctggttgttgaaaataaggaggtgctgacccttcaggaaacattggaagcactgtctctttccgagtacttttcaacttttgaaaaagaaaaaattgacatggagtccctgcttatgtgtaccgtggacgacttaaaggaaatgggcattcctttggggccccgcaagaagatcgccaattttgtcgagcacaaagctgctaagttgaagaaggctgcttctgagaaaaaggctgtggccgctaccagtactaagggacaagaacaatctgctcaaaaaactaaagacatggccagcctcccttctgagtccaacgaaccgaagcggaaactgcctgtcggcgcatgcgtgtcttccgtttgcgtgaattatgagtccttcgaagttggggcagggcaggtcagcgtcgcgtataattccctagactttgaaccggaaattttcttcgccctggggagccctatcgctatgttcttaacaatccggggagtggatagaatcgacgagaactactccctccccacatgtaaaggcttcttcaatatttatcatcccctcgatcccgtggcctacagattggaacccatgatcgtgcccgatttagacctcaaagcggtcctgattccacaccacaaaggccgcaagcggctacatctggagctgaaggagagtctgagccgaatgggctctgacctgaagcagggatttatcagctctcttaaaagtgcctggcagacactgaatgagtttgcaagagctcatacatcttctacccaactccaggaggagttggaaaaggttgcgaaccaaattaaagaagaggaggagaagcaagttgtggaggctgagaaggtggttgagagcccagatttcagcaaggatgaagattatctcggcaaagtcgggatgctgaatggcggtaggagaatcgactacgtcctccaggagaaacctatcgaatccttcaatgaatacttgtttgcattgcaatcgcacctctgctattgggagtctgaggacacagcccttctgctgctgaaggagatctatcggacaatgaatatctctccggagcaaccgcaacattag

SEQ ID NO: 24270 - DNA, 495 bp, Artificial Sequence
  Description of Artificial Sequence: Synthetic coding sequence
atggtgaacagcgtggtgttcttcgacatcaccgtggacggcaagcctctgggacgcatttcaataaaattgtttgctgataaaatactgaagactgccgaaaatttccgagccttgtctactggcgaaaaggggttccgatacaaggggtcatgctttcatcgaataattccaggattcatgtgccagggcggcgattttacgcggcataatgggacaggtgataaaagcatctacggagaaaaattcgacgatgagaacttgattcgcaaacatacaggctctggaattctttccatggcgaacgcaggccccaacaccaacggctcgcagttttttatttgtgccgctaaaaccgagtggttggacgggaaacatgtggcattcggcaaagtgaaggagagagtgaacatcgtcgaagctatggaacatttcggttatcgcaactctaagaccagcaaaaaaatcaccatcgccgattgtggacagttctag

SEQ ID NO: 24271 - DNA, 426 bp, Artificial Sequence
  Description of Artificial Sequence: Synthetic coding sequence
atgaagatcctggacgtgggctgcggcggcggcctgctgaccgagcccggaggtagcctgtttattacaacaataaataagacccagctctcatatgctctgggaatcgtcttctcagagcaaattgccagtatagtcccaaagggtacacacacttgggagaaatttgtaagcccggaaacgttggaaagtatcctcgaatcaaacgggctgtctgtccagacagtggtggggatgctatataaccccttctccggttactggcattggagcgaaaacaccagtctgaactacgcggcctacgctgtgaagagccgcgtgcaggaacatcctgcttccgcagagtttgttctgaagggcgaaaccgaggagttgcaggccaatgcctgcacaaatccagcagtgcatgagaaactgaaaaagtag

SEQ ID NO: 24272 - DNA, 426 bp, Artificial Sequence
  Description of Artificial Sequence: Synthetic coding sequence
atgaagatcctggacgtgggctgcggcggcggcctgctgaccgagcctggaggttcactgtttataaccacaatcaataagacccaactttcctacgctctcggaatagtgtttagcgagcaaatcgcgtccatcgtgccaaaaggtacccatacatgggagaaattcgtgagccccgaaacactggaatcaatcctcgaaagtaacggtctaagcgtccagacggtggttggtatgctgtataacccgttttccggctactggcactggtccgagaacactagcctgaactacgcagcatatgcggttaagagtcgggtgcaagagcacccagcctctgcagaatttgttctgaagggagagactgaggagctgcaggctaatgcatgcaccaaccccgctgttcatgagaagctcaaaaagtag

SEQ ID NO: 24273 - DNA, 2157 bp, Artificial Sequence
  Description of Artificial Sequence: Synthetic coding sequence
atgctgatgaccctggagatgaccgagctgaccgacccccaccacactatgggggattacaaagtcgcgcatcctcaggacccccaccaccccagtgaaaagcctgtgatacattgccacaaatgtggagaaccatgtaagggtgaggtgcttcgcgtccaaacgaaacacttccatatcaagtgttttacatgcaaggtgtgtggctgtgacctagctcagggcggcttctttatcaagaatggggagtacctttgtacgctggactaccaacggatgtacgggacaagatgtcacgggtgtggcgaattcgtggaaggcgaggtcgtgaccgccttggggaaaacctaccaccccaactgctttgcttgcactatctgtaaacggccttttccacccggggatagagtgactttcaatggtcgcgactgtctgtgccagctctgcgcccagccgatgtctagttcccctaaggaaacaacattttcttccaattgtgcgggttgtggcagagatatcaagaacggccaggctcttttggctctcgataagcagtggcacctgggctgtttcaagtgtaaaagctgcggcaaagttctcaccggcgagtacatttcaaaagacggggccccttactgcgagaaagattaccaaggcttgtttggggtgaagtgcgaggcttgtcatcagtttattaccggaaaagtgctggaggcgggggataaacattatcatcctagctgcgccaggtgcagccggtgcaaccaaatgttcaccgagggagaggaaatgtacctccagggtagcactgtgtggcaccctgactgcaaacagtccactaaaacagaggaaaagttacggccaacacgcacaagctccgagtccatttactctagacctggcagttctattccgggaagtcctggtcacacaatttatgcaaaagtggacaatgagatactcgattataaggacctcgccgcgatccccaaggtgaaggccatttatgatatcgaacggcctgatctaatcacatatgaacctttctacacgagcggctacgacgataaacaggaacgacaatccctgggagagtctccacgcaccctgagcccgactccatcagctgaaggctaccaggacgtccgcgataggatgatccacaggtccacgagccagggcagcattaatagtcctgtttattccaggcattcttatacccctacaacctcccgctctccccaacattttcacagacccggcaatgaacccagctcaggcagaaatagcccactgccatatagacccgatagtagacccctgactcccacctacgcccaggcaccaaaacattttcacgttccagaccagggcattaacatctacaggaagccccctatctataagcagcacgcagcactcgccgcacagtcaaaaagcagtgaggacataatcaaattctcaaagttccccgctgcccaggctcctgatccttcagagacaccaaaaatagaaaccgaccattggccaggaccccctagcttcgctgtggtggggccagacatgaagcgtcgctctagcgggcgggaggaggatgacgaggagctgctgagacgaagacagcttcaggaagagcagctcatgaaattaaacagcggcctggggcagctcatccttaaagaggaaatggagaaggaatctcgggaacggtccagtctgctggccagtcgctacgactctcccattaattccgcgtcgcacattcccagctcgaaaaccgccagtctgccaggatatgggagaaatggcctccaccgccccgtaagcactgactttgcccagtataacagttacggtgatgtcagcggcggggtgagagactatcagacactgcctgatggacatatgccggccatgagaatggacagaggcgtgtccatgcctaatatgcttgaaccaaagatcttcccgtatgagatgctgatggtgactaacagaggcaggaataaaatcctgcgcgaggtcgacagaactcggctggaacggcacctggcacccgaggtctttcgggaaatatttggcatgtctatccaggaattcgatagactgccattgtggcggcggaatgatatgaagaagaaagcaaagctgttctag

SEQ ID NO: 24274 - DNA, 1593 bp, Artificial Sequence
  Description of Artificial Sequence: Synthetic coding sequence
atgttcaccgagggcgaggagatgtacctgcagggcagcaccgtgtggcaccccgattgcaaacagtcaacaaaaacagaggaaaagctgcggctgccgaacatcagacgaagttcttccgacttcttctactccaaatcacttattcggcgtactggaaggagcccctcgctacagcccacacgcacatcatcagagtccatctactcgcgacccggtagctcaattccaggcagtcccgggcacacaatctacgcgaaagtggacaacgagatccttgactacaaggaccttgccgccatacctaaggtgaaggcgatctatgacatagaacggcctgacctgattacctatgaacccttttatacgagtggatatgatgataagcaggagaggcagtctctgggagagagcccaaggaccctcagcccaacaccatcagctgaggggtaccaggacgtgagagatcgtatgatccatagatcaacgagccagggttctattaactcaccagtgtactcaaggcattcttacacacctacaacctcacgttcgccccagcattttcacagacccgaactgctgtcaccaggggtccaacggctatcatatctaagaactagcagtctcagcccaacccattccgactcccgaccaaacccccctttcaggcaccactttatcccccatatcaaaggaaatgagccttctagcggaagaaattctcccctgccctacaggcctgactccagaccactcactcccacctacgctcaggcacctaagcattttcatgtgccggaccaagggatcaatatttacaggaagccgccaatctacaagcagcatgcagcgttggctgcccagtcaaagagctcagaggacatcattaaattttcgaaattccctgcagctcaggcacccgatccatcagagactccaaaaatagagactgatcattggcctggtccacccagctttgcagttgtggggcccgacatgaaacgccgatcctctggtcgggaggaagacgacgaggagctacttaggcgccggcagttacaggaggagcagctaatgaaactgaacagtggtctgggtcagctgatcctgaaagaggagatggagaaagagagcagggagcgcagtagccttttggcgagtaggtatgacagccctatcaattcggccagccacattccgagctcaaaaaccgctagtctgcctggctacggacgaaatgggcttcatcggccagtctccactgactttgcacagtataactcatatggcgatgtttctggaggagttcgagattatcaaaccctgcccgatggacatatgccagcaatgcggatggaccgcggcgtttccatgcctaacatgcttgagccaaagatctttccatatgagatgctgatggtaaccaaccgtggcaggaataagatcctgagggaggtggaccggacacggctggaaagacacctggcccccgaggtctttcgagagatttttggaatgtctattcaggagtttgatcgactccctctgtggagacgaaatgacatgaagaagaaagctaagctgttttag

SEQ ID NO: 24275 - DNA, 2109 bp, Artificial Sequence
  Description of Artificial Sequence: Synthetic coding sequence
atggtgaaggagaaggtggcccacccccaggacccccaccaccccagcgagaagccggtaatccattgtcacaaatgcggcgagccatgtaagggtgaggtcctgagagtgcagaccaaacacttccacattaagtgtttcacatgtaaagtgtgtgggtgcgacctggcacagggcggcttttttattaaaaatggtgagtacctttgtacacttgactatcagagaatgtacggtacacggtgtcatggatgcggggagtttgttgagggcgaagtggtgaccgctctgggcaagacgtaccatccgaactgttttgcctgtaccatatgcaagcggccgtttcctccgggggatagagtcacatttaacggaagagactgtctttgtcagctgtgtgctcagccaatgagcagcagtcctaaagagacaacattttcatcaaattgtgcaggctgtggaagagacataaaaaacggccaagcccttctcgccttggataaacaatggcatctcgggtgcttcaagtgcaagtcgtgtgggaaagttctgacaggcgagtacatcagcaaggatggcgccccgtactgcgaaaaggactaccagggcctgttcggagtgaagtgtgaagcctgtcaccagttcattactgggaaggtgctggaagcgggggacaaacattaccatcccagctgcgcccggtgctcaagatgcaatcagatgttcacggaaggagaagagatgtacctccagggctctacggtgtggcatcctgactgcaaacagtccacaaaaactgaagaaaaactgcgacccaccaggacgagcagtgagagcatttactccagacccgggtcttccatacccgggtcgccaggccacaccatttacgctaaggtggacaatgaaatcttagattataaggatctcgccgccataccaaaggtgaaggccatatacgacatcgagaggcctgatttaattacttacgaacccttttatacaagcggctacgacgataaacaggagagacagagcttgggggaatcaccccggacacttagccccactccttcagccgaaggctaccaagatgtgagagataggatgatccaccgctcaacctcacagggaagcataaacagccccgtgtacagtcggcacagctatacccccacaacatcccgtagtcctcaacattttcatagacctggcaatgaacccagcagtggccgtaacagccccctcccctatcggccggatagtagacccctgacaccgacatatgcccaggcccccaagcattttcacgtccccgaccaaggcattaatatatacaggaaaccccccatttacaagcagcacgcagctttggcggcccagtcaaaatcaagcgaagatatcataaaattctctaagttcccagccgcacaggcgcctgatccttctgagaccccaaagatagagacggaccattggccagggccaccatctttcgccgtcgtgggccctgatatgaagaggcggagctcaggccgggaagaggacgacgaggagctcttgcgccggcgacaactgcaggaggagcagctgatgaagctgaactcggggctgggccagctgatccttaaggaggagatggagaaagagtctcgcgagaggagcagccttctggcatcccgttatgactcgcctataaattctgcatcccacattccatcttcaaagacagctagcctgcctgggtacggccggaatgggcttcatcgccccgtttctaccgatttcgcacagtacaacagctacggggacgtgtcaggtggcgtgcgggactaccaaactttgcctgatggccatatgccggccatgagaatggatcgcggggtgagcatgcctaatatgctggaaccgaagatctttccatacgagatgttaatggtcacgaacagaggtcgaaacaagatcttaagagaggtagaccggacccggctggagcgacacttagcaccagaagtgtttcgggagattttcggaatgtctatacaggagtttgatcgattacctctctggagacggaatgatatgaagaagaaggcaaagctattctag

SEQ ID NO: 24276 - DNA, 1206 bp, Artificial Sequence
  Description of Artificial Sequence: Synthetic coding sequence
atgttcaccgagggcgaggagatgtacctgcagggcagcaccgtgtggcatcccgattgcaaacaatccacaaaaacggaggaaaaactaagagctaaagtggataacgagatattagactacaaggatttagccgccatccccaaggtgaaggctatatatgacattgaaagaccggatctaattacctacgaaccattttatacctccgggtacgacgacaagcaggagagacaatctctgggagagagcccccggacactgagtcctacgccttcagccgagggctatcaggacgtccgggaccgtatgatccacaggtctacgagtcaaggaagcattaacagccctgtgtacagccggcacagctatactcctacgacgagccgcagtccgcagcacttccaccgcccagatcagggaattaacatatacaggaagcccccaatctataaacagcatgccgccctcgctgcgcagagtaaatccagtgaggacatcattaaattctccaagtttccagcagctcaagcccccgacccgtctgaaacgcctaagatagagacggaccactggcccggaccacctagtttcgccgttgtgggcccggatatgaaaaggaggtccagcggtcgggaggaggatgacgaggaattgttaagaaggcgccagctgcaggaagagcagctgatgaagctcaactctggcctcggccagttgatacttaaggaagaaatggaaaaagaatcaagggagaggagctcattgctggctagcagatatgattccccgatcaattcagcatcacatattccaagctccaaaaccgcctcgcttcctggatacgggcgaaatgggctccaccggcccgtgagcaccgacttcgcgcaatacaattcctacggggatgtgtctggaggggtacgggattatcagaccctccccgacggacacatgcccgccatgagaatggacagaggcgttagcatgccgaatatgctggaacctaaaatttttccatacgagatgcttatggtgacaaaccgaggccgcaataagatcctcagagaggtggatagaacaaggctggagagacacctcgcccctgaagtgttccgggaaatttttggcatgagtattcaggaattcgatcgcctgcctctgtggcggcgaaacgacatgaagaagaaagccaaactgttctag

SEQ ID NO: 24277 - DNA, 1968 bp, Artificial Sequence
  Description of Artificial Sequence: Synthetic coding sequence
atggtgaaggagaaggtggcccacccccaggacccccaccacccctcagaaaagcccgtgattcattgccataagtgtggggagccctgtaagggggaggtgcttcgcgttcagactaaacattttcacattaagtgcttcacctgcaaagtctgcgggtgcgatctggcacagggtggcttctttataaagaacggcgaatacttgtgtaccctcgattaccagagaatgtatggtactcggtgccacggatgtggggaattcgtcgaaggagaggtggttacggctctaggaaaaacctatcaccccaactgtttcgcttgcaccatttgcaaacgcccctttcctcccggggatcgcgttacctttaatgggagagattgcctctgccagctctgcgctcagcctatgtccagttcaccaaaggaaactacattcagcagcaattgcgcaggatgcggcagggacatcaagaacggccaagcattgctagcactcgacaagcagtggcatttgggctgttttaagtgtaagtcgtgtggtaaagtgcttacaggcgaatatatctccaaggacggcgcaccctattgcgagaaagactaccagggcctatttggagtcaagtgcgaagcttgccaccagttcatcactggcaaagtcctggaggccggcgataagcactatcatcctagctgtgcccgttgttcccgatgtaatcaaatgttcactgagggagaggaaatgtacctccaggggtcgaccgtgtggcatccggactgtaagcaatcaaccaaaactgaggagaaattaaggccaacaagaacaagcagtgaatccatctatagcagacccggttcgtccatcccaggctcccccggtcacactatctatgccaaggtggacaacgagatactcgattacaaggacctggccgcaatccctaaggtgaaagccatctatgacatcgagaggccagacctgatcacctatgaacctttttatacgtctgggtacgacgacaaacaagagcggcagagtctgggcgaaagtcctcgaaccctgtccccgactcccagcgcagagggttaccaggatgtaagggatcggatgattcatcgcagtaccagtcagggctctattaacagtcccgtgtatagtaggcatagctacactcctacgacctcaagaagcccgcagcacttccaccgtcccggcaacgaaccctcctcgggacgcaattcgccactgccttacagacccgatagcaggcccctcaccccaacctacgctcaggcgcctaaacatttccacgtccctgatcagggtatcaatatttatcgcaagccaccgatttacaaacagcacggcccagatatgaaacgacgctcatctggacgagaggaggacgatgaggaactgctgcgtcggcgacaactccaagaggaacagctgatgaagttaaattctggcctggggcagttgattctgaaggaagagatggaaaaagagtcccgtgaacgatccagtttgctcgccagccgctatgactcccccatcaattcggccagtcatatccccagcagcaaaaccgcctccctgccaggttacgggagaaatggcctacatagaccagtcagtaccgattttgcccaatataatagttacggcgatgtgtctggtggcgtcagggacttccagactctcccagacggtcatatgccagccatgcgcatggacaggggagtttctatgccaaatatgcttgagcccaagatctttccgtacgagatgttgatggttacgaatagggggagaaataagatcctgagggaggtggatcgaacgcgtctggaaaggcatctggcccccgaggtcttccgggagattttcggaatgagcatccaggagtttgaccgcttgcccctgtggcgccgcaatgatatgaagaagaaagcgaagctgttctag

SEQ ID NO: 24278 - DNA, 2541 bp, Artificial Sequence
  Description of Artificial Sequence: Synthetic coding sequence
atgcccgccttcctgggcctgaagtgcctgggcaagctgtgcagcagcgagaaatctaaggttacctcctccgagcgcacgagtgccaggggcagcaaccgaaagcgtctgatcgtggaagatcgacgagttagtggcactagttttacggcccatagaagggcaacgattacacatttactgtacctgtgtccaaaggattattgcccacgcggacgcgtgtgtaactccgtggacccatttgttgcgcatccccaggaccctcatcacccctccgagaaaccagtgatccattgtcataagtgtggggaaccatgtaaaggagaggtgctgcgggtgcagacaaagcatttccatattaagtgcttcacctgcaaagtgtgtggatgtgatctggcccagggtggattctttattaagaatggagagtacttatgtaccttggactaccaaaggatgtacggcacgagatgccacggatgtggcgagttcgtggaaggggaagtcgtgacagctttggggaagacgtaccacccaaattgctttgcctgcaccatctgtaaaagacctttcccgcccggcgatcgcgtcaccttcaatggaagggactgtctgtgccagctgtgcgctcagcctatgtctagctctcctaaggagactaccttctctagtaactgcgccggctgcgggcgggatattaaaaatggccaagcactgttggccctggacaagcagtggcaccttggatgtttcaaatgcaaaagttgcggaaaagtcctcactggtgaatatatctctaaggacggtgccccgtattgtgaaaaggactatcagggtttatttggcgtgaaatgtgaagcctgccaccagttcataactggtaaggtgctagaggccggcgacaagcactatcaccctagctgcgctcggtgctcccgttgtaatcagatgtttacggagggcgaggagatgtatctgcagggatccaccgtatggcatcccgattgcaagcagtccacaaagacagaggagaagcttcgcctgccaaatatccggcgctcttcatcagacttcttctacagtaaaagtctgattaggcggacaggcagatcccccagcctccagcccacaagaactagctcggaatccatttactcacgcccagggagtagtattccagggtcaccaggccatacaatctatgccaaggtcgataatgaaattttggattacaaggatctagccgccatcccaaaggtgaaagctatctatgacattgagcgcccagacctgatcacatacgagcccttctatacatctggatatgacgacaagcaagaaagacagtccctcggtgaatcaccgaggacacttagcccgaccccctccgctgaaggatatcaggacgtgcgcgatagaatgatacatcgctcaacgtcacagggctcaatcaactcacctgtgtattcaagacatagttacacaccaaccacttctagatccccccagcattttcatcggccagagctcttgtctccaggcgtgcaaagactgtcatatttaaggacctcttcgctttctcctactcattctgactcccggccaaacccgcccttccggcaccacttcatccctcacataaaagggaacgaaccttcctccggacgcaattcgcccctgccgtacagaccggactccagaccgcttacccctacatatgcgcaggcgcccaaacactttcacgttcccgatcaaggaataaatatctatagaaaacctcctatttataaacagcacgccgcgttggcagcccagagcaagagctcagaagatattattaagtttagtaaatttcccgctgcgcaggccccagatccatccgagacacctaaaatagaaactgaccactggcccgggccacctagctttgctgtggtggggccagatatgaaacgcaggtcatcaggacgggaagaagatgatgaagagctcttaagaaggcgccaacttcaggaagagcagttaatgaagctgaacagcgggctgggccagttaatcctgaaagaagagatggagaaggagtcccgcgagcggtcttccctgttggcgtcacgctatgattccccgatcaactccgcctcacacattccctcctcaaagaccgcttcactgcctggctatgggagaaatgggctgcatcgccccgtatccactgactttgcgcagtataactcatacggagacgtcagcggcggcgtgagagagtaccagacgctgcccgatggtcacatgcccgctatgagaatggaccgcggcgtttccatgccaaatatgctggagccaaagatttttccatatgagatgttgatggtgaccaatcggggcagaaacaagatactcagggaggttgacaggacccgcctcgaacgccatctagccccagaggtatttcgagagatcttcggcatgtccattcaagagtttgacagactgccactctggcgcaggaacgatatgaagaagaaggctaaactgttctag

SEQ ID NO: 24279 - DNA, 2109 bp, Artificial Sequence
  Description of Artificial Sequence: Synthetic coding sequence
atggtgcccgaccccgtggcccacccccaggacccccaccacccctcagagaagccagtgattcattgccacaagtgtggcgaaccctgtaaaggagaagtcctccgggttcagactaaacatttccatattaagtgctttacttgcaaggtgtgcgggtgtgatctggctcagggaggattcttcatcaaaaatggagagtatctgtgcaccctggattatcagcggatgtacgggaccaggtgccacggatgcggtgagttcgtggaaggcgaggtcgtgactgctctcgggaagacttatcatccgaactgctttgcttgcaccatttgtaaaagacccttccctcccggcgaccgcgtcacctttaatgggcgggactgtttatgccagctttgcgcccaacccatgagttcttcacccaaagagaccacgtttagctctaattgtgcagggtgtggacgcgacatcaagaacggacaagctttgttagctttagataagcaatggcatctggggtgtttcaaatgcaaaagctgtgggaaagtgttaaccggtgagtacatttccaaagacggcgccccttattgcgagaaagactatcaagggctgtttggcgtgaagtgcgaggcttgccatcaattcatcaccggaaaagtgctcgaagcaggggacaagcattaccatccaagctgtgcccgttgcagtaggtgcaaccagatgttcacagaaggcgaagaaatgtacctgcagggctcgaccgtttggcatcccgactgtaaacaatccactaaaacagaagagaaactcagaccgactcgcacgtccagtgagtcgatctatagcagacctggatcaagcatacccggctccccggggcacacaatttatgctaaagtcgataacgagatactcgattataaagatttggccgctatacctaaggtgaaagcaatctacgatatcgagcgccctgacctgatcacctacgagcccttctacacctcggggtacgacgacaagcaagagcggcagtctttgggagagtccccccgcaccttgagccccaccccgtccgcagagggttatcaagacgtgcgtgacagaatgattcaccggtctacaagtcagggtagcattaatagcccggtctactccagacattcctacactccgacaacatcacgctcaccacagcactttcatcgacccgggaacgagccaagtagtggacgcaactctccactcccatataggccggattccagacctttgacacctacatatgcacaagcacctaaacacttccatgtacccgatcagggcatcaatatttaccggaaaccaccgatctacaagcaacacgctgccctggccgcccagagtaagagtagtgaagacatcataaaattttctaagttccctgccgctcaggcacccgaccctagtgaaacccccaagattgagaccgaccattggcctggccctcctagttttgccgtcgtggggcctgacatgaaaagacggtctagcgggcgcgaggaagatgacgaggagctccttagacggagacagctccaggaagaacaattgatgaagcttaattccggcctgggccagctgattctaaaagaggaaatggaaaaagagtcacgtgagagaagcagtttgctcgcaagtcggtacgactctccgatcaacagtgcctcacatatcccaagcagcaagactgcctctctacctggttatggcagaaatgggcttcatagaccggtgtctactgatttcgcacaatacaactcatacggcgatgtgtctggaggagtgagagaataccagaccttgccagatggacatatgccagccatgcgtatggacagaggggtgtctatgcctaacatgttagagcccaaaatattcccatacgaaatgctgatggtgacaaatcgggggaggaacaaaatcctaagagaggtcgatagaacacgcctagaacgacaccttgcccccgaggtttttagagaaatcttcggtatgtccatccaggagttcgatcgactaccactgtggcgccgcaacgacatgaaaaaaaaagctaaactcttctag

SEQ ID NO: 24280 - DNA, 1368 bp, Artificial Sequence
  Description of Artificial Sequence: Synthetic coding sequence
atgttcaccgagggcgaggagatgtacctgcagggcagcaccgtgtggcatcctgactgtaagcaaagcaccaaaactgaggagaagcttaggctgcctaatattcgtcggagtagcagcgacttcttttacagcaagtccttgattcgccggaccggacgctcacctagtctccagcctacccgtacatcaagcgaaagcatttactcacgaccaggatctagcatcccaggctcccctggccacacaatctatgccaaagttgataacgagatccttgattacaaagatctggctgccatacctaaagttaaggcaatctacgatatagagagacccgacctcatcacctacgagccgttctatacatcaggctacgacgacaaacaggagagacagagcctgggcgaaagccccagaacactcagtccaaccccgtccgctgagggctatcaggacgtaagggataggatgattcaccggtcgacctctcagggctctatcaacagtccagtgtactcccggcattcatacacacccaccacctctaggagcccccagcactttcacagacccgatcagggcattaatatctacagaaaaccccccatttataagcagcatgccgctctggcggcacagagtaagagctccgaggatattatcaaatttagcaaatttcccgctgcccaagctcctgacccctcagagacacctaagattgagacagaccattggcccggaccaccaagcttcgctgtagtgggcccggacatgaagcggagaagtagcggaagggaagaggatgatgaagagcttctcagaagaaggcagcttcaggaggagcagctgatgaagcttaacagcggattgggccagctgatcttgaaagaagagatggagaaggagtcccgcgaacggagctcgctcctggctagccgctatgatagccctatcaattctgccagtcacataccctccagcaaaacggcttcactgccaggctatgggagaaatggtctgcaccgcccagtttcaacagattttgcacaatataactcctacggggatgtttcaggtggggtgcgcgacttccagacactgcctgacggacatatgcctgcaatgcgtatggatcggggagtgtccatgccaaacatgctggagcctaagattttcccatacgagatgctgatggtgacaaataggggccggaacaagatcctcagggaggtggaccgtaccagattggaacggcacctggccccggaggtctttcgtgagatctttggcatgagtattcaggaattcgaccgcttacccctttggaggcgaaacgacatgaaaaagaaagcaaagctattctag

SEQ ID NO: 24281 - DNA, 2241 bp, Artificial Sequence
  Description of Artificial Sequence: Synthetic coding sequence
atgctgatgaccctggagatgaccgagctgaccgacccccaccacacgatgggagactacaaggtcgcccacccacaggacccacatcatccctctgaaaaacccgtgattcactgtcataaatgcggagagccgtgtaagggagaggtcctccgagtgcagacaaagcattttcatatcaaatgttttacgtgcaaggtgtgcggttgcgacctcgcccagggaggtttttttattaagaatggcgaatatctctgcacgctcgattatcagagaatgtacggcacaaggtgccatggatgtggggaattcgtagagggagaagttgtgaccgcacttggcaagacataccacccaaattgctttgcctgtaccatatgcaaacgaccctttcccccaggcgatcgagtcacatttaacggccgcgactgcctgtgccaactgtgcgcgcaaccaatgtcatcatccccaaaggaaaccacttttagtagcaattgcgctggctgtggaagggacatcaaaaatggtcaggctctccttgcattggacaagcagtggcacctcggctgtttcaagtgcaaaagttgtgggaaagtattgacaggcgagtacatctccaaggatggagctccctactgtgaaaaggattatcaggggctcttcggtgtgaaatgtgaggcatgtcatcaattcataaccggaaaagtactggaggcaggcgataagcactaccacccatcttgtgccaggtgctcaagatgcaaccaaatgtttacagaaggagaggagatgtatttgcagggatccaccgtctggcatccagattgtaagcagtcaactaaaactgaagaaaagcttcggctccccaacatcaggcgatcaagctcagactttttctactccaaatccttaattcggcgcacaggccgaagccccagtctacaaccaacccggacgagttccgaaagcatctactccaggccagggtcaagtatcccaggaagccctggacacacgatctacgctaaggtcgacaatgagatccttgattataaggatctcgcagcgatccctaaggttaaagctatatacgatatagagagacctgatcttatcacctatgagccattttacacatccggctacgatgataaacaagagagacagtcactgggcgagagtccccgtactctgtcaccaaccccgagcgcagagggctaccaggatgtaagagacaggatgatacaccggtcaacatctcaagggtcaataaattctcccgtgtattcccggcactcgtatacccctaccactagccgctcgccacagcacttccacagacccggaaacgaaccgtcaagcggccgtaactcccctctgccttacaggccggactctaggccacttaccccaacttatgctcaggccccaaaacacttccacgtcccggatcagggcatcaacatctaccgcaaaccgcccatctataaacagcatgctgccctggctgcccagtcaaagtcatccgaggacattattaaattttccaaatttcctgccgcccaggccccggacccctccgagacccccaaaattgagacagatcactggcctggaccaccttcctttgccgttgtggggcccgacatgaaaagacggtctagtgggcgcgaagaggatgacgaggagctcctgcgaaggcggcagctacaagaggaacaactgatgaagctcaattcaggactcggccagctcatcctgaaagaagagatggagaaggagagtagagagagatcatcactgctggcaagccggtatgattcgcccataaacagcgccagtcatatccccagtagcaaaaccgcctccctacctgggtacggacgcaacggcctgcatcggcctgtcagcacagacttcgctcaatacaactcatatggcgacgtaagtggaggggtacgcgattttcaaaccctgcctgacggccacatgcccgcaatgcggatggatcgaggcgtttcaatgccaaacatgctcgagcctaaaattttcccatacgagatgttaatggtgacaaatagaggccggaataagatacttagagaagtcgacagaaccaggctagagagacacttagctccggaggtatttagggaaattttcggtatgtcgatacaggagttcgatcggttacctctgtggcgacgtaacgacatgaagaagaaagcaaagcttttctag

SEQ ID NO: 24282 - DNA, 915 bp, Artificial Sequence
  Description of Artificial Sequence: Synthetic coding sequence
atggccgaggccagcgccgccggcgccgacagcggcgccgccgtggccgcacacagattcttttgccatttttgcaagggcgaggtttcaccaaagctgccggagtatatttgcccaagatgcgaaagtggatttatcgaagaggtcacagatgattcctcctttctggggggcggaggttcaagaattgataacaccactacgactcacttcgctgagctttggggacacctggaccacaccatgttctttcaggactttagacccttcctgagcagcagccctctggaccaggacaacagagcaaatgaacgggggcatcaaacccataccgacttctggggagctaggcctcctagactgcccctggggcgcagatatagaagtcgtggatccagccggcctgaccgctccccagcaatagagggaattttgcagcatatttttgcgggatttttcgcgaattccgcaatacctggcagtccacacccttttagctggtctgggatgctgcacagtaaccccggggattatgcctgggggcagactgggcttgatgcaattgtcacccagctgctgggccagctcgaaaacacagggcctccaccagctgacaaagaaaaaatcacatcgctgcccaccgttactgttactcaggagcaggtagatatgggactggaatgccccgtgtgcaaggaggattatactgtggaggaggaagtgagacaactgccctgtaatcacttttttcacagctcatgcattgttccatggttagagctccacgatacatgcccagtttgccgcaaaagcctgaacggagaagattccacgaggcagtctcagtctactgaagcttccgcaagcaacaggttttctaacgactcgcagctgcacgacagatggacgttttag

SEQ ID NO: 24283 - DNA, 636 bp, Artificial Sequence
  Description of Artificial Sequence: Synthetic coding sequence
atgagctgcaccatcgagaagatcctgaccgacgccaagaccctgctcgaaaggctgagagaacacgatgccgctgcggaaagcctggtagaccagtcagctgctttgcataggagagtggccgctatgagggaagcgggcaccgccctgcccgatcaggtgcgccagcggtaccaggaggacgctagcgatatgaaggacatgtcaaaatacaagccgcacatactcctttcacaagagaatacccagatcagagatcttcagcaggagaaccgggagctttggatatccttagaagaacaccaggatgctctcgaactcattatgagtaaatatcggaagcagatgctccagctgatggttgcaaaaaaggccgtcgacgccgagccagtgcttaaagcccaccagtcacattccgctgaaatagagtcacaaatcgaccgaatttgcgagatgggcgaggtgatgcgcaaggctgtgcaagtggacgatgatcagttctgcaaaatccaggagaaactggcccaactcgaattggaaaacaaggagctgagggaactgcttagcattagcagcgaatcccttcaggcccggaaagagaactcaatggacacggcttctcaagccatcaaatag

SEQ ID NO: 24284 - DNA, 2451 bp, Artificial Sequence
  Description of Artificial Sequence: Synthetic coding sequence
atggtgctgatgttccagatccggtacatcagccagacccagggcttacccgcagaatacctgctatcggcaggaaccaagaccacacgtttctttaatcgggaccctaatctgggctaccccttatggcggttaaaaacccccgaggaacatgagctcgaaacagggattaaatccaaagaggctcgaaaatatatttttaactgccttgacgacatggcccaggtgaacatgtctactgatctggaggggaccgatatgctggctgagaaggctgatcggagagaatatatcgacctcctgaagaagatgttgacaatcgacgccgataaaagaatcactcccctgaagacgctcaaccaccagtttgtcaccatgacacacttgctcgacttcccgcactcaaatcacgtgaagagttgttttcagaacatggaaatctgcaagcgaagagtccatatgtacgatacagtgtcccagatcaagagcccctttactacccacgtggctcccaatacgtctacaaacctcacaatgtcctttagcaaccagctgaacactgttcacaatcaggcttcagtcctcgcctcgtcctcaaccgccgcagctgcgaccttatccttggccaatagcgatgtgagcctgctgaactaccaaagcgccctttatccctcctccgccgccccagtgccgggggtcgcacagcagggggtttcactgcagcccggaacaacccagatttgcactcaaaccgacccatttcagcagacattcatagtgtgcccccccgcctttcagaccgggctgcaggcaaccaccaagcactcaggattcccagttagaatggataacgcggttcccatagtgccacaggcccccgcagcgcaaccgctgcagatccagtccggagtgctgacccaagggtcctgcacccccttgatggtggctactctccatccccaggtcgccactataacgcctcagtatgcggtccccttcactttgtcatgtgccgccggacggccggcactagtggaacagaccgccgctgtgctgcaagcttggcccgggggcacccagcagatcttactaccttccacctggcagcagttaccaggcgtggccctgcataactcagtccaacctactgccatgattcccgaggcaatgggaagcggtcaacagctcgccgattggagaaacgcccactcccacggtaaccagtactctacaattatgcaacagccgtccttattgactaaccacgtgactctggccactgctcagccactcaatgtgggggtagcacacgtcgtcagacaacagcagagctccagcctaccgagcaagaagaacaagcagtcggcccccgtgtccagcaagagctccctggacgtgctcccgtcccaggtgtattctctcgtgggttcttccccgcttcggacgacttcatcctataactctctcgtgccagtgcaagatcagcaccagccaatcatcatccctgatacaccatcccctccggtgagcgtcattacaattcgcagcgacaccgacgaggaggaggacaataagtacaaaccatcctcctctgggcttaaaccccggtcaaatgtgattagttatgtgaccgttaacgacagccctgattccgattcttcactgtctagcccttattccaccgatacgctgtctgccttgcggggcaacagcggctcggtacttgaggggcccggacgggtcgtggctgacggtaccggcaccaggactatcatcgtgcctcccctgaaaacccaactgggagattgtactgtcgctacccaggcttctggattattgagcaacaagaccaaaccagtcgcatctgtttcaggccagtctagtgggtgttgcatcacacccaccggttacagagcccagagagggggcacctcggccgcccaaccgctgaatttaagccaaaaccagcagtcaagcgctgcccccacatctcaagaacggtcttcaaatccagcccccaggcgacaacaggcctttgttgccccactgtctcaggcgccttatacttttcagcatggaagccccctccattccaccggccacccccaccttgccccagcacctgcacatttgccctcccaggcccacctctacacatatgctgctcctaccagcgcggccgcactgggcagcactagctccattgcacatctttttagccctcaggggtcatcccgccacgccgcagcgtataccacccatccgtccaccctggttcatcaagtgccagtgagcgtcgggccctccctgttaaccagtgcttccgttgcccctgcacagtaccagcatcaatttgccacccagtcttacatcggatcgtcgcgtggaagcaccatttatacaggctaccctctctcacctacaaagatttctcagtatagctacctttag

SEQ ID NO: 24285 - DNA, 3498 bp, Artificial Sequence
  Description of Artificial Sequence: Synthetic coding sequence
atggccagccagctgcaggtgttcagcccccccagcgtgagcagcagcgctttctgtagcgccaagaaactgaagattgaacccagcggctgggatgtcagtgggcagtctagcaacgataagtattacactcactcaaagacactgcccgctacccagggccaagcaaactcatctcaccaagtagctaacttcaatatcccggcttacgaccaggggctactgttacctgccccagcagtggagcatatcgtagttacagcagccgatagctccgggtccgccgccacaagcacattccagagctcacagactctgactcaccgaagtaatgtgagcctgctggaaccttatcagaagtgtggtcttaaacggaagtccgaagaggtcgactccaacggatccgtgcagatcattgaggagcacccgccactgatgctccagaatcgcactgtggtcggggcagctgccacaaccactaccgtgacaaccaagagtagttcgagctctggagaaggggactaccagctcgtacaacacgagatactatgttccatgactaactcctatgaggtcctggaatttcttggaagagggacctttggccaggtcgctaaatgttggaaacggtccacaaaagagatagttgcgattaagatattgaaaaaccacccgtcatatgcgaggcagggccagattgaagtgagcattctcagcagactgtcttctgaaaatgctgatgagtataattttgtccgcagttatgagtgcttccagcacaagaatcatacgtgtcttgtgtttgagatgctcgagcaaaatctttatgactttctaaagcagaacaagttctctcccttgccactgaagtacatcagacctattctgcagcaggtcgctacggccttaatgaagctgaaatcattgggcttgattcatgccgacctcaagcctgagaacataatgctggtggatcccgtccgccaaccgtaccgtgtgaaggtcatcgacttcgggtccgcctcccacgtttctaaagccgtttgctctacttatctgcagagccgttactatcgcgcccccgaaatcatacttggactgcccttctgtgaggccatagatatgtggtctcttggctgtgtgatcgctgagttgtttctgggctggccactgtaccccggggcctccgagtacgaccaaatccggtacataagtcaaacacaggggctgcccgcggaataccttttgagcgcagggacgaaaactacacggttcttcaatcgggaccccaatctgggctacccgctctggcggctgaagacacccgaggaacacgaactcgagactggtattaaaagcaaagaagcaagaaagtacatcttcaattgtcttgacgacatggcacaggtcaacatgtcaactgacctggaaggcaccgatatgctcgcagagaaagctgaccggcgagagtacatagacctattgaagaagatgcttacaatcgacgcggacaagcgaataactcccctgaaaacgctcaatcaccagttcgtgacgatgacacacttgcttgacttcccccattccaaccatgtcaaatcatgtttccagaatatggaaatttgtaagaggcgcgtgcatatgtacgacacagtcagtcagatcaaaagcccttttactacacatgtggcccccaatacctccaccaacctcactatgagcttttctaaccaattgaacacagttcacaaccaggcttccgtgctggccagctcttcaacggctgctgcagctacactgagtctagctaattccgatgttagcttactgaattatcagtctgccttgtacccctcctcagcagcaccggtgcctggcgttgcccagcagggcgtgtccctccagccgggcacaacccagatctgcactcagaccgaccctttccaacaaacgtttattgtgtgtccacctgcattccaaacaggccttcaggcaaccacaaagcactcgggcttcccggtacgaatggacaacgccgttccaatcgtgccacaggctccagctgcacagccccttcagatccagtcaggggtgttaacacagcaggcctggccggggggcacacagcagatcctactgcccagcacctggcagcagctccctggagtggctcttcataattctgttcagcctactgccatgatccctgaggcaatgggttccgggcaacaacttgccgattggaggaacgcccacagccacggaaaccaatacagcaccatcatgcagcagccttccctattgacaaatcacgttacactggctaccgcacaacctttaaacgtcggggtggctcacgtggtccggcaacagcagtcctcctcactgccgagtaaaaagaataaacagtctgcccctgtctcatccaagagttcgttggatgtgcttccttcacaggtatattccctggttggaagctctcctctccgcactacatccagttacaacagcttggtgccagtgcaggatcagcaccaacccatcatcattcccgacacacccagccctcccgtatctgtaattaccatccgttctgacacagacgaagaggaagacaacaaatacaaacccagtagtagcggcttaaagcccagatccaacgttataagctatgttaccgtcaacgatagccctgactcagacagctcgttgtcatccccctattctaccgacacgttgtcggctttgcgggggaacagtggaagcgtgctcgaggggcctgggcgagtggtggcagatggaacaggaacaagaactatcatagtgcctcccttgaagactcagctaggggattgtacagttgctacccaggctagtgggctgttatcaaacaagacaaaacccgtagccagcgtcagcgggcaaagttccggctgttgcataacacctaccggctatcgggcccagcgtggtggaacctctgctgctcagccactaaacctgtcccagaaccagcagtcatccgccgctccaacaagccaggaacgaagttccaatccagctcctaggcgtcagcaggccttcgttgcccccctaagtcaggctccctacacctttcagcacgggagtcctctacattcaaccggtcatcctcacctggcccccgcaccagcccatttgcctagtcaagcgcacttgtatacttatgccgcacccacgagcgctgctgcactgggatccacctcatccattgcccatcttttttctccacaggggtcttctaggcatgccgccgcctataccactcacccttctacgctcgtgcaccaggtccccgtgtctgtgggacctagtttgctgacctccgcaagtgtcgccccagctcaataccagcaccagtttgccactcagtcttacataggctcctcacgcggttcaacaatctatacaggatacccacttagcccaaccaaaataagccagtattcctacctttag

SEQ ID NO: 24286 - DNA, 3498 bp, Artificial Sequence
  Description of Artificial Sequence: Synthetic coding sequence
atggccagccagctgcaggtgttcagcccccccagcgtgagcagctctgccttctgcagcgcaaaaaaactgaaaattgaaccaagcgggtgggacgtaagcggacagtctagcaatgacaaatattatactcattccaagacacttccagcaactcagggacaggccaattcttctcaccaggtcgctaactttaacattccagcctatgaccagggacttttgttgccggcaccagccgtagagcatatcgtcgttacagctgcagactcatctggtagtgctgcaacctcaacatttcagagctcacagaccctaacacatcgctcaaacgtcagtttactggaaccctaccaaaagtgcgggcttaagcgcaagtctgaagaggtagactcaaacggctctgttcagatcatcgaggagcatccacctctgatgcttcaaaaccggaccgttgtcggagcagcggctacaactacaaccgtgaccacaaaaagttcctcctcctcaggcgaaggagactatcagcttgtgcagcacgaaatcctgtgttccatgactaactcttacgaagtcttggagtttctaggtaggggaacttttggacaggtggctaagtgttggaagagatccacaaaagagatagtcgctattaaaatcttgaaaaatcacccgtcttacgcgaggcagggccagatcgaggtttccattcttagccggctctcctcagaaaacgccgatgaatacaacttcgttcgatcctatgaatgcttccagcataaaaaccacacctgcctggtcttcgagatgctcgagcagaatctctatgacttcctgaagcagaacaagttttcgccactgcccctaaaatatatccgccccatcctccaacaggtcgccaccgccctaatgaaactgaagtctctggggctcatccatgcggatctgaagccagagaacattatgttggttgatcccgttcgccagccttatcgagtgaaggtgatcgactttgggtcggcaagccatgtgtctaaagcagtgtgtagcacctacctgcagagtcggtactacagggctcctgaaattattcttgggctgccgttttgcgaggccatcgatatgtggagcctcgggtgtgtgattgctgagctttttcttggctggcccctataccccggggcaagcgaatacgaccaaattcgatatatctcacaaactcagggcctgcctgccgagtacttactgagcgccgggaccaagacgactaggttttttaacagagaccctaacttaggatacccattatggagactgaagacccccgaagaacacgagctcgaaaccgggataaagtctaaagaggcccgaaaatacattttcaattgcttggatgacatggcccaggtgaacatgtccaccgatctggaggggacagatatgcttgctgaaaaggccgatcgtagggagtatatcgatctgcttaagaagatgcttacaatcgatgccgataagcgcattacacctctgaagactttgaatcaccagtttgtcacaatgacccaccttttagactttcctcacagcaatcacgtgaagtcctgttttcagaacatggagatctgcaaacgacgggtgcatatgtacgatacagttagccagatcaagagtccatttaccacacatgtggcccccaatactagcacaaatctgacaatgtcttttagtaaccagctgaatactgtgcacaaccaggcctctgtcctggccagcagttcaacggcagcagctgccaccttgtccctggccaactcagatgtgagtcttctcaactaccaatccgcactatatccttctagcgcagcccctgttccgggagtcgcccagcagggggtgtcattacaacctggcactacgcagatctgtacccaaacggacccgtttcagcagacctttatcgtgtgtccccctgcgttccagaccggactgcaagccactactaagcatagcggctttcctgtgcgtatggacaatgccgtgcccatcgtgccacaagcgccagcagcccagccgttacagatccaatcaggggtgttgacacaacaagcgtggcccgggggaacccagcagattttgctgcctagtacttggcagcagctccccggggtcgcattacacaattcagtccaacctactgcaatgatcccagaggccatgggatctggccagcagctcgctgattggaggaacgcccatagccacgggaatcagtattcaactataatgcagcagcccagcctgctgactaatcacgtgacactggctacagcccagcctttaaacgtgggcgtagcccacgtagtgaggcagcagcagtcctccagccttccttccaagaaaaacaaacagtccgcaccggtgtcttcaaaaagttccctggatgttctgccatcccaggtttactccctggtgggcagctccccactgagaacgacgagctcctacaactctctagtgcccgtacaggatcaacaccaacccattatcatccccgacaccccaagcccccctgttagtgttatcacgatccgctctgatacagatgaggaagaagataataagtacaaacccagttcctctggcctgaagccacggagtaatgtgatatcttatgtcaccgttaacgattcacctgatagcgatagcagcctatcctcgccctatagtaccgatacactgtccgctctgcggggcaatagcggatcagtactggaagggccagggagggtagttgcagacgggacagggacccgcacaatcatcgttccgcccctaaagactcagttgggcgactgtacagtggccactcaagcatcaggcctcttgtcaaacaagactaaacccgtggccagcgtaagcggacagtccagcggatgctgcattactcctactggatatagggctcaacgtggaggcactagtgcagctcaaccactgaacctgagccagaaccaacaatccagcgccgctccaacgtctcaggagcgcagcagcaatcctgcaccacgcagacagcaagctttcgtggctccactgtctcaggccccatacacctttcagcacggaagcccactccactccacgggtcaccctcacctggctcccgcgcctgcccacctgccctcccaagcccacctgtacacctacgcagcgccgacctcagcggctgcgctggggagcaccagtagcatagcccacctattctccccccagggaagttcacgacatgctgcggcctacacaactcatccatcaaccctcgtccaccaagttcctgtgagcgtcggcccttctctcctaacatcagcttctgttgcacccgcccagtaccagcatcagtttgcgacccagagctacataggatccagccgggggtctacaatatacacgggatatcctttgagtccaactaagatctcccaatattcctatctatag

SEQ ID NO: 24287 - DNA, 3633 bp, Artificial Sequence
  Description of Artificial Sequence: Synthetic coding sequence
atggccagccagctgcaggtgttcagcccccccagcgtgagcagcagcgcattttgttctgctaagaagctcaaaatcgaaccttcaggctgggacgtgtctggtcagtcgtccaatgataagtactacacccactctaagaccctccccgcaactcagggccaggccaactcttcacatcaagtcgcaaatttcaacatcccggcctacgaccaagggttgctgcttcccgccccggccgttgaacatattgtagtcacagccgcggatagtagtggtagtgcggccacctccaccttccagtcttcacagacactgacccatcggtctaacgtgtcgctgctggaaccataccagaaatgtgggctcaagcgtaagagtgaggaggtagactccaatggatctgtacagatcattgaggagcaccctcctctgatgctccagaaccggactgtggtgggagccgctgctacaaccaccacggtcactacaaaatcttctagttcatccggcgagggcgattatcaattggtccaacacgagatactgtgttcaatgacgaactcctacgaagtccttgaattcctgggccgggggacattcggtcaggtggcaaaatgttggaagcgctctaccaaggaaatagtggccatcaagatcctgaagaaccatccatcttacgctaggcagggtcaaattgaggtgagtatcttatctcgcctgtcttctgagaacgcagacgagtacaactttgttcgaagctatgaatgcttccagcacaaaaatcacacctgcttagtgttcgagatgctggaacagaatttgtatgacttcctcaagcagaacaagttctcaccattacctttaaagtacatccgccccattttgcaacaggtggcgacagcactgatgaaactgaaatctctgggacttattcacgccgatctcaagcctgaaaatattatgctggtggaccctgtgaggcagccctatagagtgaaagtaatcgacttcggctcagccagccatgtgagcaaagctgtctgctctacttacttgcagtcccggtattatcgtgctcccgagattatcttgggactgcccttttgcgaggcaatcgacatgtggagtttgggatgtgtcattgctgagctctttctcggctggccgctctatccaggagcctcagaatatgatcagatcaggtatatttcccagacccaagggctccctgcggaatatctcctgtctgctggaacaaaaactactcgcttcttcaacagagatccaaatttgggctaccccctatggcgtctgaagacccccgaagagcacgagctggagacaggcatcaagtccaaggaggccagaaaatacatcttcaactgcttggacgacatggcccaggtaaatatgagcactgacttggaaggtaccgacatgttggcggagaaggccgaccggagggagtatattgatcttctgaagaaaatgctcacgatcgatgcagacaagcggatcacacctctgaaaacccttaaccatcagtttgttaccatgacccatctgctcgatttcccccattcgaatcacgtcaaatcctgtttccagaacatggaaatctgcaagagacgtgtgcatatgtacgataccgtgtcccagatcaaaagtcctttcacgacccacgtagcccctaatacatccaccaacttgacgatgagcttttccaatcagctgaacacagtgcacaatcaggcatccgtactcgcgtcttcatccactgctgccgcagctactttgagcctcgcaaactccgacgtgtcccttctgaattaccaaagcgctctctacccatcaagcgctgcaccagtcccgggcgtggcgcagcagggggtgagtctgcagcctggcaccactcagatatgcacccagactgatccatttcagcagactttcattgtatgccctcctgcattccagactggactccaggcaactactaagcatagcggatttcctgtgagaatggacaatgcggtgcccatcgtcccgcaagcccccgctgcccaaccacttcagattcaaagtggagtgctgactcagggctcatgtaccccgctcatggtggcaactctgcatccccaggtggcgaccatcacaccccagtatgcggtgccgttcactctttcctgcgcagctgggcgcccagcactggtggagcagaccgcggctgtgctgcaagcatggcccgggggcacccagcaaatccttctgccaagtacatggcagcaactgccaggtgtggccttacacaacagcgtgcagccaactgctatgattcccgaggctatgggctctgggcagcaactcgctgattggcgaaacgcccattcacatggaaaccagtacagcacaatcatgcagcagccttccctcctcaccaatcacgtgaccctggctacagcccagccactgaacgtgggcgtggcccacgtcgtgcgacagcaacagagctcatcactgccctccaagaagaacaagcagagcgcacctgtctctagtaagtcctccctggatgtcctgcccagccaggtctattccctggtcggcagcagcccattgcgaacgacctcttcttataactccctggtgcctgtgcaagatcagcatcaaccaatcatcattcctgacacaccgagtcctcctgtctccgtaattacaatccggagcgatacagacgaagaagaagataataagtacaagccatcatcttccgggttgaagcccaggagtaatgtgattagctacgtcactgtgaacgattctcctgattctgatagctcgctgtcctcgccttatagtactgacaccctctctgccttgagaggcaattcgggctcagtgctggaaggtcccggtagagtggtggcagacgggacaggaacaaggactattatcgtacccccactgaaaacccagctgggcgactgcaccgtcgctactcaggcatccgggttattgagtaacaaaaccaaaccagtggcatctgttagcggccagtcatccggatgctgtattacaccaacgggttaccgcgcccagagaggtggcacctcagcagctcagccattaaacttgtcacagaatcagcagagtagcgcagctccaacatctcaggaacgttcgtccaacccagcaccacgtcgccagcaggccttcgtggctcctttaagccaggccccctatacgttccaacacggctcccctctccactctacaggccaccctcatctcgctcccgcccccgctcacctacccagccaagcccatctgtacacctacgcagctccaacatctgctgccgctcttgggtcaacatctagtattgcccatttattcagtccgcagggcagcagtcgacacgctgccgcttacacaacacatccttcaaccttagtacatcaagtccctgtctccgtcgggccatctctcctgactagcgcttctgtcgcccccgcccagtaccagcatcagtttgccacccagagctacatcggatcatcacgcggctcaaccatttacactggatatcccctgtctccgactaagatcagccagtattcctatttgtag

SEQ ID NO: 24288 - DNA, 3228 bp, Artificial Sequence
  Description of Artificial Sequence: Synthetic coding sequence
atggccagccagctgcaggtgttcagcccccccagcgtgagcagctccgctttttgctcggcaaagaagctcaaaattgagcccagcggctgggacgtgagcggtcaatcgtctaacgataagtactatacccactcgaaaacactgcccgcaacccaggggcaagccaacagttctcaccaggtcgctaacttcaacatccccgcctacgatcagggacttcttctccctgcaccagccgtggaacacatcgtggtgacagccgccgattcctcaggatcagcggcgaccagtaccttccagagttctcagaccctaacccataggtcaaacgtctcattactggaaccctaccagaagtgtggtttaaaacggaagtcagaggaggtcgattcaaatggatcagtccagattatcgaggaacacccccctcttatgctacagaatcggacagtggtcggcgctgccgcaacaactaccactgtgaccactaagagttcgagcagcagcggtgagggggactaccagctggtgcagcatgagatcctatgcagtatgacaaacagctatgaggtcctggaattcctcggtcgggggaccttcggccaagtggcgaagtgctggaaacggtccacaaaagagatcgtcgcaattaaaattctgaagaatcacccttcttatgcacgtcagggccaaatcgaagtttccatcttgagcagattatcctccgagaatgctgatgagtataattttgtgcgatcttacgagtgttttcaacataagaaccacacctgcctggtttttgagatgctggagcagaatctatacgacttcctcaaacagaataaattcagcccactccccttaaaatacatccgtcctatcctgcagcaggtcgccactgctctgatgaaactgaaaagtctaggtctcattcacgctgatctcaaaccagagaatatcatgctcgtggatcccgttcgtcaaccgtacagagtgaaggtgatcgatttcggatccgcttcccacgtgtcgaaagctgtctgttctacgtatcttcagtcacgatactacagggcccccgagattatcctaggtttgcctttttgtgaggccatcgatatgtggagtctgggctgtgttattgcagaactttttctgggctggccactctaccctggagcctctgagtacgatcaaattcgatatatttcccaaacgcaggggctacccgccgagtacctactgagcgccggtacaaagacaactcggttttttaacagggaccctaatctcggttaccccctgtggagactgaaaacgccggaagagcatgagctcgagaccggcatcaaaagtaaggaagctaggaaatatatttttaactgtctggatgacatggcccaagtgaatatgagcacagacctggaaggaacagatatgttggccgaaaaggccgaccgtcgggaatacatcgacctgctcaaaaaaatgcttactattgacgccgacaagcgcatcacgcctctgaagactcttaaccatcagttcgtgacaatgacccacctcctggacttcccacatagcaatcatgtcaagtcatgcttccagaacatggagatttgtaaacgacgggttcatatgtatgacaccgtttcacagattaaaagccccttcacaactcacgtggcacctaatacaagtacaaatctcacaatgagctttagcaaccagttgaacaccgtccataatcaggcctccgtgctcgcctcgtcctcaacggccgcggctgctacactgtccctcgcaaactccgatgtatctctgctgaattatcagtcagcactataccccagtagtgcagcacccgttccaggcgtcgcacagcagggcgtgtcactgcaaccggggactacgcagatttgtacccagacagaccccttccagcagacatttatcgtctgcccaccggcatttcagactggattgcaggccactaccaagcatagtggtttcccagtccgaatggacaatgccgtgcccatagtcccccaggcccctgccgcacagcccctccagatacagagcggtgttcttacgcaagggtcctgcaccccacttatggtcgccacccttcatccgcaagtcgccacaatcacaccacagtacgctgtcccatttacattaagttgtgctgctggacgacctgcattggtcgaacagacggcggctgtgttgcaagcctggcccggcggcacgcagcaaattttactaccatctacatggcaacagctgcccggcgtggccttacacaactccgtgcagcccaccgccatgatcccagaggcaatgggcagtggacagcagctggcagactggcgaaacgctcattcccacggaaatcagtattcaactattatgcagcaaccctctctcttgactaatcatgtgaccttggccacagcgcagccgcttaacgtgggggtcgctcatgtggtgagacagcagcagtcatcctctttgccgtctaagaaaaataagcaatccgcccccgtgtcctctaagagtagcctcgatgtcctgccttcgcaggtttacagcctcgtgggatcctcacctctaagaaccaccagttcttataactccctggtccctgttcaggaccagcaccagcctatcatcattcccgacacacctagtcctccagtgtccgtgatcactatacgctccgatactgatgaggaggaggacaacaaatacaagccaagcagtagcggcctgaagccacgatcgaacgtgatttcatatgtgaccgtcaacgactcacctgatagcgactctagtctcagctctccttactctacagacactctgtccgctttgaggggtaactctggaagcgttctcgagggacctggtcgcgtggtggcggacggtacgggtactcggactatcatcgtacccccacttaagactcaactgggggattgcaccgttgcgacccaagcaagcggtctgttatcgaacaaaaccaaacccgtcgcctcagtgagcggtcagtcctcaggatgttgtataacaccaactgggtaccgcgcacaaaggggaggtacgagcgctgcccagcctttaaacctctctcaggtatctgcgatgggctactgtctactgttcggcccgtgtacggtcgtgactttctggcgtacactcctcctcgccggttgttag

SEQ ID NO: 24289 - DNA, 543 bp, Artificial Sequence
  Description of Artificial Sequence: Synthetic coding sequence
atgcaggccgagggccagggcaccggcggcagcaccggcgacgccgatggcccgggcggtcccggaatccctgacgggcctggcggcaatgcaggcggtcctggtgaggccggcgcgaccggcgggcgggggccgcggggcgctggagccgctcgcgcctccggaccgaggggtggcgccccgcgcggccctcatgggggggccgcctccgcccaggacggacggtgcccctgcggcgcaagaaggccggattcacgcctactacagttacatattactatgccgtttagtagcccgatggaggccgaactggtgcgtcgtattcttagccgcgatgcggcacccctcccgaggccgggcgctgtgctgaaagattttactgtgtcaggtaacctgctgttcattaggctgacggccgccgaccacagacagctgcaactcagtattagcagctgtttgcaacagctgtcactgcttatgtggataacacagtgttttctgcctgtgtttctggcacaggctccctccggacaaaggcggtag

SEQ ID NO: 24290 - DNA, 717 bp, Artificial Sequence
  Description of Artificial Sequence: Synthetic coding sequence
atgagcgaggacctggccaagcagctggccagctacaaggcccagctgcagcaagtggaggcagccttgtccggtaatggcgaaaatgaagatctcctcaagctgaagaaggacctgcaggaagtgattgagttgaccaaagacctattgtccacacaaccctctgagaccttagcctcctctgacagcttcgcctctactcagcctacccattcctggaaggtgggagacaagtgcatggcagtctggagtgaagatgggcagtgttacgaggcagaaatcgaggagatcgacgaggaaaacggcacagctgctattacgtttgcggggtacgggaacgcagaagtgaccccactgctgaatctgaagcctgtggaggaaggacgaaaggcgaaagaagactccgggaataaaccaatgtctaaaaaggaaatgatcgctcaacaacgtgagtacaaaaaaaagaaggccctgaagaaagctcagaggattaaggagctggagcaggaacgcgaggaccagaaggtcaaatggcagcaattcaacaaccgagcttactcgaaaaataagaaagggcaggtaaaacgctctatttttgcctctccagaatccgtaaccggaaaggtgggggtggggacttgcggcattgcagacaaacccatgactcagtatcaggatacgtccaagtacaacgtgcggcacctgatgcctcagtag

SEQ ID NO: 24291 - DNA, 717 bp, Artificial Sequence
  Description of Artificial Sequence: Synthetic coding sequence
atgagcgaggacctggccaagcagctggccagctacaaggcccagttgcaacaggtggaagccgccctctccggaaacggggaaaatgaagatctgcttaagctaaagaaggatctccaggaagtgatcgagttaacaaaggacctgctgtccacccagccctccgaaacactcgctagttccgatagttttgcatcaacacagcctactcacagctggaaggtcggggataagtgtatggccgtgtggagcgaagacggccagtgttatgaagcagaaatagaggagatcgatgaggagaacggtacagccgctatcacgtttgcggggtatggtaatgccgaggtaactccccttcttaatttaaaacctgtggaagagggacgcaaagcgaaggaagattcaggcaataagcccatgtcaaagaaagaaatgatcgcacagcagagggaatacaaaaagaagaaggctctgaagaaggcccagcgcatcaaggaactagagcaggaacgggaagaccagaaagtgaagtggcagcagttcaataaccgggcatattcgaagaataagaaggggcaggtcaagcggtctatcttcgcatcccccgagagtgtgaccgggaaggtaggtgtcgggacatgtggcattgctgataagcccatgacccagtatcaggacacctcaaagtacaacgttagacacttaatgccacagtag

SEQ ID NO: 24292 - DNA, 2229 bp, Artificial Sequence
  Description of Artificial Sequence: Synthetic coding sequence
gacctgagcagcggcggcggcatcgagccccagtgcagcagcgaggtctacttccgggctcgggaaagggggtgtgagaacgttgcatggagtctgggcttacgctcacactgctttctcgaggccgaacttcatcccctcccctggttcctcccaactaatgtttgctctccactgcctggcgccgcacataaactagtttgttattttacgaactgggcacactctcgccccgggcctgcatcaatcttaccgcacgacctcgatcctttcctttgtacccatctgatctttgcttttgctagcatgaataataaccagatagtggcaaaagacctgcaggacgagaaaatcctttatccggagtttaacaagttgaaagagaggatgtggcagcagctccccactggcgttaaaaatccagcgcatcagccctctttgtcacaccacagaaaccgggaactgaagacgctgctcagcatcggtggttggaactttggcacgtccaggtttaccaccatgctgagcacgttcgcaaaccgcgagaagtttatcgcctccgtcataagtctgctacggacacatgactttgacggcttagatctcttcttcctctaccccggactccgtgggagccccatgcacgatcggtggaccttccttttcctcatagaggagctgctgtttgctttcaggaaagaggctctgctgactatgcgccctaggttacttttgtctgccgccgtgtctggcgtgccacacatcgtccagacttcctatgacgtgcggtttctggggaggctccttgactttataaacgtgctgtcctatgatctgcacggctcatgggaacgattcaccggacataactctccacttttctccctccctgaggaccctaagagttctgcttatgcaatgaactactggaggaagctgggggcaccctcggagaaactcattatggggatacccacgtatggtcggacattccgcttactgaaggcatcaaaaaacggactgcaggctagggccatcggtcctgctagcccaggaaaatataccaaacaagagggcttcttggcctacttcgaaatctgcagctttgtctggggtgcaaagaagcattggatagactaccagtatgtaccttatgcaaacaaaggaaaggaatgggttggttacgataacgccattagctttagctataaagcatggtttattcgacgggaacactttgggggagccatggtttggacactcgacatggatgatgtgcggggcaccttctgtggcaccggccctttcccactagtctatgtcctgaatgatattctggttagagccgagttctcctccacctccctgccccagttctggctctcttctgcagtgaattccagctcaaccgaccctgagcggttggccgtaactaccgcatggaccactgattccaagattctgccgcccggtggggaagccggcgttacagagatccatgggaaatgcgaaaacatgaccatcacgccacgtggcacaaccgtcacgcctacgaaggaaaccgtgtctcttggcaaacatactgtcgcccttggggaaaagacagaaataactggggccatgacaatgactagtgtcggccaccaaagcatgacccctggtgagaaagccttaacaccggtgggtcaccagtccgtgaccactggacagaaaaccctgaccagcgtgggctaccagtccgtgactccaggggagaagacccttacgccagtgggccaccagtctgttacccccgtctcgcaccaaagtgtcagccctggggggaccacaatgacccctgtgcattttcagacagaaaccctccggcagaacacagtagccccacgacgcaaggccgtggcaagggagaaagttaccgtcccttctagaaacatttccgtcacgcctgaaggacagacaatgccacttcggggtgagaacctgaccagtgaggtgggcacacacccacggatggggaacctgggacttcagatggaggcggagaatcgtatgatgctcagcagcagcccagtgatccaactgccagagcagacccctcttgcctttgataaccggtttgtcccaatttacgggaaccatagtagcgtgaacagtgtcacaccccagacgagtcccttgagcctcaaaaaagaaatacctgagaatagcgcggtggacgaggaagcttag

SEQ ID NO: 24293 - DNA, 2037 bp, Artificial Sequence
  Description of Artificial Sequence: Synthetic coding sequence
atgtggaagctgctgctgtgggtgggcctggtgctggtgctgaagcaccatgacggcgcagcacataagctggtctgctatttcactaattgggcacactctcgcccgggacccgccagtattctgcctcatgatctcgatccattcctgtgcacgcacctgatctttgccttcgcatctatgaataacaatcagatcgtcgctaaggacctgcaggacgagaagatactgtatcccgagtttaataagctgaaggaacgaaatcgcgaactgaagactctactgtcaatcggaggatggaatttcggtacttctagatttacaaccatgttaagcacctttgccaatcgggaaaagttcattgcatccgtgataagcctcctcaggactcacgactttgacggacttgatcttttcttcctgtatcctggcctcagggggtcccccatgcacgaccgctggacatttcttttcctcatcgaggagctgcttttcgccttcagaaaggaggcgctactcaccatgcgccctcggcttctgctctctgcggcggtcagtggagtgccgcatatcgtgcaaacatcatacgacgtgaggttccttggacggctattggatttcatcaatgtactgtcctatgatttgcatgggagttgggagcggtttactggccacaatagccctttattcagcctgccagaggaccctaaatcatccgcatacgccatgaactactggcgcaaactgggcgccccctctgagaaactgatcatgggaatccctacatatgggcgcacgttcaggctcctgaaggcaagcaagaatggcctgcaggcacgcgcaatcggaccagcctcgcccggcaagtatacaaaacaggagggttttttagcatattttgagatctgcagcttcgtgtggggtgcgaaaaagcactggatcgactatcagtacgttccatatgcgaacaaggggaaagaatgggtcggatatgacaatgccatttctttttcgtacaaagcttggtttatccggagagaacacttcggcggagctatggtctggacactcgacatggacgatgtgagagggacattttgcgggactggcccttttcctctagtgtacgtgctcaacgatatcctcgttagggccgaattctcttccaccagtctccctcagttctggcttagctcagccgtgaatagcagcagcaccgacccagaaaggttggcagtgactaccgcttggactacagactcaaagatattgcctcccggaggagaagccggggttaccgagattcatggtaagtgtgaaaacatgacaatcacccctagagggactactgtgaccccaaccaaggaaaccgtttcactgggaaaacacacagttgctctcggagaaaaaacagaaatcactggggcaatgactatgactagcgtgggacaccagtccatgacgccaggtgagaaagcgctcactcccgtcggtcaccaaagcgtcaccacaggccagaaaactttaaccagtgtaggataccagagcgtaaccccaggggaaaagacactcactccagttggacatcagtctgtgacacccgtatcccaccagtctgtcagcccaggaggtacaaccatgacccctgtccactttcaaaccgagaccttaaggcagaacaccgtggcccctcgaaggaaggccgtggcgcgcgaaaaggtgaccgtaccctcacgtaacatttcagtgacacccgaaggccagacaatgcccctgcggggtgagaatctcacgagcgaagtggggacacaccctagaatgggaaaccttggcttgcagatggaggccgagaatagaatgatgttgtcatcctctccggtaatacaattgcctgagcaaacgcctctggcctttgataacagatttgtgcccatttatggcaatcatagttcggtgaattccgtgactccccaaacctctcccctgtctctgaagaaggagataccagagaattccgcagttgacgaggaagcatag

SEQ ID NO: 24294 - DNA, 1005 bp, Artificial Sequence
  Description of Artificial Sequence: Synthetic coding sequence
atgggcggcgccgtgagcgccggcgaggacaacgacgagctgatcgacaatttaaaggaagcccagtacatacgcaccgaattagtggagcaggcattccgggccattgaccgtgcagactactacctcgaggagtttaaagagaatgcttataaggatttggcgtggaagcacggcaacatacatcttagcgccccctgcatctactccgaagttatggaggcactggatttgcaacctggtttgagctttctgaatttggggtccggaactggctacctgtcaagcatggtcggcctgattttgggaccctttggggtaaaccacggagttgaattgcatagcgacgtgatcgagtatgctaagcagaaattagactttttcatacgcacgtccgattccttcgacaagtttgatttctgcgagccatccttcgtgacaggtaactgcctcgagatcagcccggattgtagtcagtatgatcgggtgtactgcggcgccggtgtccagaaggagcatgaggagtacatgaagaatcttctgaaagtaggggggattctcgtcatgcccctggaagagaaaccttgccatagcgagagcggcaagagtagactggtccagcttccacccgtagcggtccgaagcctccaggaccttgctagaatcgctatccgcggaaccatcaaaaagattatacatcaagaaactgtgtctaagaatggtaacggtttaaaaaatactccgcggtttaagcgccgccgcgtacgacgtcgccgaatggaaacaatagtgttcctggataaagaggtattcgcctcccgcatttctaacccctctgatgataattcatgtgaggatctagaggaggagcgacgcgaggaggaagaaaagacccctcctgaaaccaagcccgaccctccagttaactttctcaggcagaaggttttgtcactgcctttgcccgaccccttgaagtactacctgctgtactatcgggaaaaatag

SEQ ID NO: 24295 - DNA, 1785 bp, Artificial Sequence
  Description of Artificial Sequence: Synthetic coding sequence
atgagccggcccagcagccgggccatctacctgcaccggaaggagtactcccagaacttgacgagcgagcccacactgcttcagcaccgcgtcgaacatctaatgacctgtaagcagggctctcaacgggtgcagggtcctgaagacgcactgcagaagctgttcgaaatggacgcccagggccgggtttggtctcaggatctgattcttcaagtaagggacgggtggcttcagttacttgacattgaaacgaaggaagagctcgactcttaccgactggattccatccaagccatgaatgtcgcgctaaatacttgctcttacaatagcattctgtcaattactgtccaggaaccaggtcttcccggcacatcaaccctcttgtttcagtgccaggaagtgggagcagagagactgaaaacctcactgcagaaggctctcgaggaggaactggagcaaagccgtccccggctgggcgggcttcagccaggccaggataggtggaggggacctgctatggaaagaccactcccaatggagcaggcgcgctatctagaacccggaatcccacctgaacagccacatcagcgaaccctcgaacacagcctccctccctctccccggccgcttcctcgtcacacgagtgcgcgagagccatcagcgttcaccctacctcccccccgcagatcctccagcccggaggaccctgaaagggacgaagaggtcctgaaccacgttcttcgggacattgagctgttcatgggcaaacttgaaaaagcccaagctaagacatcacgcaagaagaagttcggcaaaaaaaataaagatcagggtggtctcactcaagctcagtatatcgattgtttccagaaaataaaacactcatttaatcttcttggacgacttgccacgtggctgaaagagaccagcgctcctgagctggtgcacattttgttcaaatcgcttaacttcatcctagccagatgtccagaggcagggctcgctgcccaggtgatcagtccgctgttaacaccaaaggccattaatttgctacagtcatgcctctccccacctgaatctaacttgtggatgggactgggccctgcttggactacctcacgagccgattggactggggatgaaccactaccataccagccaactttctccgacgattggcagctgcctgagccgagcagccaggctccactgggataccaagatccggtttctctgagaagagggtcacacaggctggggagcacatcacattttcctcaggagaagacacataaccacgaccctcagcctggtgaccctaatagccggccatcttcgcctaaacccgcccagccagctctaaaaatgcaggtgttatacgagtttgaagcccgaaaccctcgggaacttacagtcgttcaaggtgagaaactcgaggtgctggaccattctaagcgctggtggttggtcaagaacgaggctggccgcagcggctatatcccatccaacatccttgaaccactgcagcccggcactccggggacacaaggccaatctccatcacgcgtgcctatgcttcggttgtcttcacgaccagaagaggtgactgactggctgcaagctgaaaacttcagtacagcgactgttcgtaccttagggagcctgactggtagccagttactgagaattcgacccggagaactccagatgttatgtcctcaggaggcacctcggattctgtccagacttgaagccgtgcgccgtatgctcggaatttctccatag

SEQ ID NO: 24296 - DNA, 1500 bp, Artificial Sequence
  Description of Artificial Sequence: Synthetic coding sequence
atgagcttcggcagcgagcactacctgtgcagcagcagcagctaccgtaaggtgtttggagatggctcgcgcctgagcgctaggctaagcggagccggcggcgccggcgggtttcggtcgcaatcgttatccaggagcaacgtggcttcttccgccgcctgtagctcagcctcttctctgggattggggcttgcgtatcgtcgtcctcctgccagtgacggtctggatctttctcaggctgcggcccgcaccaacgagtacaaaatcattcgaactaatgagaaggagcagctccagggacttaacgacagatttgcggtatttatcgagaaagtccaccagctggagacccagaatagagccctggaggccgagctagccgctctgcgacagcgacatgctgagccttcacgggttggggagcttttccagagggagctgagagacttacgggcgcagcttgaagaagcatcttcggcccggagtcaagcattgctggaacgagacgggctggcggaagaggtccagcgcctgcgtgccagatgtgaagaagaaagtcgcgggcgggaaggtgcggagcgggccttgaaggcccagcagcgcgacgttgatggcgcaaccttggctcgattggacctcgagaagaaagtggaatccctgttggacgagctcgcttttgttagacaggttcatgatgaagaagtggcggagctcctggccacactgcaagcgtcctcccaggctgctgccgaggtggatgttaccgtggcaaaacctgacttgaccagtgctctgagggagatccgagctcaatacgaatctctcgccgcgaagaacctccagagcgctgaggagtggtacaaatcaaaatttgctaatctaaatgaacaggccgccagatccaccgaagctatccgggcttccagggaggagatccacgaatatcgaagacaactgcaggcccggacaatcgagatagagggccttcggggggccaatgaaagcctcgagcgtcagattctggagctggaggagcgccattctgccgaagttgccggatatcaggattctattggacagttggaaaacgacctccggaatacaaaaagcgaaatggcccgacatctccgcgaataccaagacctgctcaacgtgaaaatggcactggacatcgagattgctgcttacagaaaactcttggaaggcgaagagactaggttctctacaagcgggctgagcattagcggactcaaccccctgcccaatcctagctatctgctgcccccgcggatcctgagtgcaaccacatcgaaagtcagctcaacaggactgtcgctgaaaaaagaagaagaagaggaagaggccagcaaggtggcttctaaaaaaacttctcagatcggggagtcttttgaagagatcctggaagaaaccgtaattagcaccaagaagactgagaagtcaaatattgaagagacaaccatctcctcccagaagatatag

SEQ ID NO: 24297 - DNA, 1131 bp, Artificial Sequence
  Description of Artificial Sequence: Synthetic coding sequence
atggagagctacgacgtgatcgccaaccagcccgtggtgatcgacaatggcagcggagttattaaagccggatttgccggagaccagatcccaaagtactgctttcctaattatgtgggtaggccaaaacacgtgagggttatggctggggcattagaaggcgacatctttattggcccaaaggccgaagagcaccgtggcttgttgtcgatccggtatcctatggaacacggtatcgttaaagactggaacgacatggagcgtatatggcaatatgtgtattctaaggatcagctgcagacattctccgaggaacatccagtccttttgacagaggccccacttaatcctaggaaaaatcgggagagggctgccgaagtttttttcgagaccttcaacgttcctgctttgtttataagcatgcaggcagttttatctctctacgctaccggcaggactaccggtgtagttctggacagcggcgacggagtgactcatgccgttcctatctatgagggctttgccatgccccatagcatcatgcggattgacatagccgggcgggacgtgtcgcgtttcctgagactctatttacgtaaagaagggtatgactttcactctagctccgagtttgagattgtgaaggctattaaggagagggcttgctacctgagcatcaatccacagaaagacgaaacccttgagacagagaaagcccagtattacctgccggacgggagcacaattgaaattggcccctcccgatttcgggcacctgagctgctcttccgcccggatcttatcggcgaggagtctgagggaatacacgaggtcctggtattcgctatacaaaagagcgatatggacctccgcaggacacttttttcaaatatcgtccttagcggcgggtcaaccctgtttaagggcttcggcgatcgccttctgagcgaggtgaagaagctggcccctaaggatgttaagatcagaatctccgcccctcaggagcgcctgtacagcacttggataggcggaagcattcttgcgtccctggataccttcaagaagatgtgggtatccaaaaaagagtatgaggaagatggagcgcggagcatacatcgcaagaccttttag

SEQ ID NO: 24298 - DNA, 783 bp, Artificial Sequence
  Description of Artificial Sequence: Synthetic coding sequence
atgagcctgcagaagaccccccccacccgggtgttcgtggagctggtgccgtgggccgaccgtagccgcgagaataacctagcctccgggagggagactttgcctggcctgcgacaccctttgagctcaacacaggcccaaacagctacacgtgaagtgcaagtctctggcaccagtgaggtcagtgcagggccagaccgcgcccaggttgttgtacgagtctcctcaactaaagaagcagccgcagaggctaagaagtcggtgtgtcgccgcctcgactacatcacacagtccttgcagcagcagggcgtgcaggccgaaaatataaccgtgactaaagacttccggcgcgtggagaatgcctaccacatggaagccgaagtctgtatcacctttacggaattcggcaaaatgcagaatatctgcaattttctggtcgagaagctcgattcgtcagtcgtgatcagtcctccccagttctatcacactcccggctcagtggaaaatttgcggcgacaggcctgtctggtggccgtggaaaacgcctggagaaaagcacaggaagtctgcaatctggtcggtcagaccctgggaaaaccacttctgattaaagaggaagagaccaaggagtgggaggggcaaatcgatgatcaccaatcaagtcgtctctccagcagccttacagtgcaacagaaaattaagagcgctacaattcatgcagcttccaaagtcttcatcacattcgaggtgaagggcaaagaaaaaaggaaaaaacatctgtag

SEQ ID NO: 24299 - DNA, 891 bp, Artificial Sequence
  Description of Artificial Sequence: Synthetic coding sequence
atggagcccagcggcggcgagcaggagcccggcgccgtgcggttccttgacctgccctgggaggacgtgttgctgccccacgttcttaacagggttcctctgcgccagttactcagactgcaaagggtatcccgggcctttcgcagcctggtacagctccacttggctggccttaggagattcgacgccgcccaggtggggccccagattcctcgcgccgccctggccagactgctgcgcgatgccgaagggctgcaagaactggccttggccccatgtcacgagtggctgtccgatgaggatctagtgccggtactggcccggaaccctcagctcaggtctgtggccctaggcggttgtgggcaactttctagacgggccttaggagccttggcagaagggtgcccacgcctccagcgcctgtccctagcacattgtgattgggtggacgggcttgcactgagaggcctagctgataggtgccccgccctggaggaattggatctgacagcttgccggcaacttaaggacgaggctattgtctacctggcccagcgtcgtggcgccggtctacgcagcttgagtctggcggtgaacgccaatgttggagacgcggccgtacaggagctggctaggaattgcccagagctccaccacctggatctaacaggatgcctgcgcgtaggaagcgacggagtgcgaaccctggccgaatactgcccagtccttcggagtttgcgagtcagacactgccatcatgtcgcagagagttctctatcccgtttgcgaaagcgaggtgtggacatcgacgtggaaccaccgctccatcaggctttggtcctgctgcaagacatggcaggtttcgccccgttcgtcaatctccaggtctag

SEQ ID NO: 24300 - DNA, 2100 bp, Artificial Sequence
  Description of Artificial Sequence: Synthetic coding sequence
atggccgacgccggcatccggcgggtggtgcccagcgacctgtacccactcgtcctcggcttccttcgcgacaaccagctaagtgaggtcgcaaacaagtttgctaaagctaccggagcgacccaacaggatgctaatgcatcctctttactagatatctacagcttttggctgaagagcgccaaggtccctgaaagaaaactacaggccaacggccctgtcgccaagaaagccaaaaaaaaggcaagcagttccgactcagaggacagttctgaagaggaagaggaagtgcaggggccgccggcaaaaaaggccgcagtgccggcaaaaagggttggactgccgcctggcaaggctgcggcgaaggccagtgagtcatccagctcagaggaatcttctgacgacgacgatgaggaggaccaaaagaagcagcccgtgcagaaaggcgtcaaacctcaggctaaggctgcaaaggcccctccgaagaaggccaaatcgagcgactccgactctgatagctctagcgaggatgaaccgcctaaaaatcagaaacctaagatcacacccgttactgtgaaagcccagactaaggcccctcctaagccagcacgtgccgcgcctaagatagccaatggcaaggccgcttcctcaagctcctcaagcagttcatcgtcatcaagcgatgactctgaggaggagaaggccgcggctaccccaaaaaaaaccgtaccaaagaaacaggtggtagcaaaggccccggtgaaagcagcaacgacacccactaggaaatcatcctcctctgaagactctagcagcgatgaagaggaggaacaaaagaagccaatgaaaaacaaacccggtccttacagttcggtgcccccaccgtcagcaccaccaccaaaaaaaagcttagggactcagcccccaaaaaaggctgtcgagaaacagcagccagtggaaagcagtgaagattcctcagacgaatctgacagttccagtgaggaagagaaaaaaccacctacaaaggccgtcgtgtctaaggccacaactaagcctccccccgcaaaaaaggccgcggagagtagttctgacagctcggattccgactcaagcgaagatgacgaggcgccctctaagcctgccggcacgacaaagaatagcagcaataaacccgctgttaccaccaaaagccctgcggttaaacccgcagccgcccccaagcagccagttgggggggggcagaaattgcttacacgtaaagccgatagttctagcagcgaggaagaatcctcatccagcgaggaggaaaaaaccaaaaagatggtcgctaccaccaagccaaaggctaccgctaaggccgccctgagtctgcctgctaagcaggcaccccagggatctcgcgattcaagtagcgacagtgatagctcctcttccgaggaggaagaagaaaagacctcaaagagcgctgtaaagaaaaagccccaaaaggtcgcaggcggagcagccccctcaaagcctgcatccgccaagaaggggaaggccgaaagtagcaacagcagtagctccgatgattctagtgaggaggaagaggagaaattgaaggggaaaggctcacctagacctcaggcccctaaggctaacggaacaagtgccctgaccgctcagaatgggaaggctgctaagaattccgaagaggaagaagaggaaaaaaagaaggctgcagtggtcgtcagcaagtccggtagccttaagaagaggaagcagaatgaggccgcaaaggaagccgagaccccccaggccaaaaagatcaagttacagacacccaatacctttcccaaacggaagaaaggcgaaaaacgcgcctcaagcccatttaggcgggtgcgagaggaagaaatcgaagttgactctcgggtggccgacaactcctttgacgccaaacgaggcgcagccggtgactggggagaacgagctaatcaggtccttaaatttacaaaaggcaaatctttcaggcatgaaaagacaaagaagaagaggggtagttaccgaggcgggagcatctcggttcaggtcaatagtatcaaattcgacagcgaatag

SEQ ID NO: 24301 - DNA, 1275 bp, Artificial Sequence
  Description of Artificial Sequence: Synthetic coding sequence
atggaggagaacaacctgcagtgcagcagcgtggtggacggcaacttcgaggaagtaccgagagagacagctatccagtttaagcctcctttgtatcgacagagataccagttcgtgaaaaacctcgtcgaccaacacgagcctaaaaaagtagcagaccttggctgtggggatacatccctgctccgacttctgaaggtcaatccttgcattgagctgctggtcggagttgacatcaatgaagataaactgcgctggaggggtgactccctggctccctttttgggagacttcctgaagcccagagacttgaacctgacgatcaccctctaccatggatcagtggttgagagagattctcgactacttggtttcgacttaatcacttgtatcgaactgattgagcacctcgatagcggtgatttagcccggtttccagaagtagtgttcggttaccttagtccctctatgatcgtgattagtactcccaactcagaattcaaccccctttttcctagcgtgacactgagggattccgaccataagttcgaatggacgcggatggagttccagacatgggccctgtatgtagccaataggtacgattacagtgtagaattcaccggggtcggcgaaccccctgcaggcgcagagaatgtgggatattgcacacagatcggtatttttagaaaaaatggaggaaaagcgactgagtcttgcctgtccgagcagcatgatcagcacgtgtataaggccaggcaagggctcactatgctccctagacttgtcctgaattttcatcctcaggccatactcctaccccatttgcctaagatgctgcggcttcaggtgttcaccacaagctaccctagtctgcagcaagagaggttttttaagttggtattagtgaatgaggtatcccagcaggtggagagcctgagggtgagccatctcccacgccgcaaggagcaagcaggcgagcggggcgacaagcccaaagacataggtgggagcaaggctcccgtgccttgtttcggaccagtattcacagaggtagaaaaagccaagattgagaattcgcctacgccattctgcgtgggcgacaaatttttcgtgccattgcagaggctcttagcttatcccaagcttaaccggctgtgcgcaaacgaagagatgatgcgatccgtgattgcagacagtatccccttgagttccgatggctctgctgtggtggcagacttgagaaattactttgacgaacaatttgagttctag

SEQ ID NO: 24302 - DNA, 1182 bp, Artificial Sequence
  Description of Artificial Sequence: Synthetic coding sequence
atggaggagaacaacctgcagtgcagcagcgtggtggacggcaacttcgaggaagtgcccagagagacagccatacaatttaaaccacccttataccgtcagcgctaccaatttgtgaagaatctggtggatcagcatgaacctaagaaggtggctgatcttggatgtggcgacactagtttactcaggttgctcaaagtcaacccgtgcatcgagctcctcgtcggcgtcgatatcaacgaagataaactccgctggcgaggtgatagcctcgcaccatttctcggcgacttcctgaaaccacgggacctgaacctgactatcaccctgtaccacggatctgtcgtagagagagactcgcggttgttgggctttgatcttatcacatgcattgaactcatagaacatttagatagcggcgacttagctagattcccagaggtggtgtttggttatctgagcccgtctatgattgtgatttctacacccaattcagagttcaaccctctgtttccaagcgtcactttgcgagattccgaccacaaattcgagtggaccaggatggaattccaaacatgggccttgtatgtcgccaatcggtacgactactctgtggaattcaccggcgtgggtgaaccgcccgctggggcggagaacgtgggttattgcacccagatcggtatcttcagaaaaaatggcgggaaagccacagaatcatgcctcagcgagcagcacgaccagcatgtctataaagcagtttttaccacctcttatcctagccttcaacaggaacgctttttcaaattggtcctcgtgaatgaggtgtctcagcaggtggagtccttgagagttagtcacctgccaagacgaaaagagcaggccggcgagaggggtgataagcctaaggacatcggcggcagcaaggccccggtcccctgttttggtcccgtcttcacagaggtggaaaaagccaagatcgagaattcaccaactccattttgtgtcggcgacaagttctttgtgcccctgcagcgtctgttggcttaccctaaacttaataggctatgcgccaatgaggagatgatgcgcagtgtaatcgccgattctatcccactctcctcagacggtagcgcggttgtcgccgacttgaggaactattttgatgaacagttcgagttctag

SEQ ID NO: 24303 - DNA, 1701 bp, Artificial Sequence
  Description of Artificial Sequence: Synthetic coding sequence
atgagcgccagcaccggcggcggcggcgacagcggcggcagcggcggttcctcgagctcctcccaggcgtcctgcggaccagagagcagcggctccgagctggctctcgctaccccggtcccacagatgttacaggggctgctcgggagcgatgacgaagaacaggaggaccccaaggattactgtaagggcgggtatcatccagtgaagattggggatgtgttcaatggacggtatcatgtggtgcgcaaactcggttgggggcacttctcaactgtgtggctctgctgggatatacaaaggaaacggtttgtcgccctgaaggttgtgaagagtgctgggcattacaccgagacggctgtcgatgaaatcaagttactgaaatgcgtacgggattccgaccccagcgatccaaagcgggagacaattgtgcagctcattgatgacttcaggatcagtggagttaatggcgtacacgtgtgcatggtgctagaggtgcttggccaccaactgctcaagtggattatcaagagtaactaccaaggcctgcctgttccctgtgtgaagtcgatcgttcgacaggttctccatgggctcgattatttacataccaagtgcaagataattcacacagatattaagcccgagaatatcctgctctgcgtgggcgacgcttacattagacggctggccgctgaagccaccgagtggcaacaggccggggcccctccaccaagccgttcaatcgtttctaccgctccccaagaagtgcttaccggaaaactgtccaaaaataagaggaagaaaatgcggcggaagagaaaacagcagaagcggttgctcgaagagcgcctaagggatttgcaaaggctggaagccatggaggctgccacacaggctgaggacagcggccttaggttggatggtggtagtggttcgacttcttcctcaggttgccacccaggaggagctagagcaggcccgtcgcctgcatcgagtagccctgcccccggaggaggccggtctctgtccgctggctcccaaactagtggcttttcagggagtctgttttcccctgccagttgctctatactttcaggatcttccaatcagcgtgagacaggtggcctgctgtcaccgtctaccccattcggtgctagcaacctcttggttaacccattggagccccagaatgctgacaaaatcaaaattaaaatcgcagacctgggaaatgcctgttgggtgcataagcacttcaccgaagatattcagactagacagtatagggctgtcgaggtgttgatcggtgcggaatacgggccacccgcagacatctggtcaactgcatgcatggctttcgagctcgccactggggactacctgttcgagcctcactctggggaggattactctcgggacgaggaccatattgcgcatattgtggagttactcggtgacatacccccagcatttgcgctgagcgggaggtactccagagaatttttcaaccgacgaggagaactccggcatattcacaatcttaagcattgggggttatatgaggtgctgatggaaaaatatgagtggcctctggaacaagctacgcaatttagcgccttcctcttgcctatgatggaatatatccctgagaaaagggccagcgccgcagactgtttgcagcatccgtggctgaatccttag

SEQ ID NO: 24304 - DNA, 150 bp, Artificial Sequence
  Description of Artificial Sequence: Synthetic coding sequence
atggccggcccccgggtggaggtggacggcagcatcatggagggcggaggacagatcttacgcgtcagtactgccctctcttgtttacttggcctgcccctcagagttcagaaaattcgagcaggcaggtcaacaccagggcttcgttag

SEQ ID NO: 24305 - DNA, 1101 bp, Artificial Sequence
  Description of Artificial Sequence: Synthetic coding sequence
atggccggcccccgggtggaggtggacggcagcatcatggagggcggaggccaaattctgagggtgagtaccgccttatcctgcttattggggctgcccctccgtgtgcagaagatacgggccgggcgaagcacacccgggcttaggccccagcatctgtctggactggagatgatccgcgacttatgcgacggacaactggagggggccgaaatcgggtctaccgagattactttcactccggagaagatcaaggggggcatccacactgcagacaccaaaaccgccggcagcgtttgtctgctgatgcaggtcagcatgccatgcgtgctgtttgctgcttccccttcagaattgcacctaaagggggggacaaacgcggaaatggctccccaaattgattacacagtgatggtcttcaaacccatagtggaaaagttcggtttcatattcaattgtgatattaagacgagaggttactaccccaagggcggcggcgaagtgatcgtgagaatgtcccccgttaagcagcttaaccctatcaatttgacagagagaggatgtgtgacaaaaatctatggccgagcattcgtcgccggtgtgctcccctttaaggtagctaaagatatggctgctgccgcggtgcggtgcattaggaaagagatccgagacctttatgtaaacatacagcctgttcaggagccaaaggaccaggctttcgggaacggaaacgggattatcatcatagcagagacatcaactggttgcctgttcgccggctccagtctcggcaagaggggcgtcaacgctgacaaggtaggcatcgaggctgccgagatgttactcgccaatcttaggcatgggggtaccgtggatgaatacctccaagaccagctcattgtgtttatggccctggccaacggtgtgtcccggattaaaacaggtcccgtcacactccacactcaaactgcgatccattttgccgaacagatagcaaaggcaaagttcatcgtaaagaagagcgaagacgaagaagacgccgcgaaggacacatacatcatagaatgtcagggcatcggcatgactaatcccaacctttag

SEQ ID NO: 24306 - DNA, 1155 bp, Artificial Sequence
  Description of Artificial Sequence: Synthetic coding sequence
atggagggcctgggccggagctgcctgtggctgcggcgggagctgtctcctccaaggccccgactgctactgttggattgccggtcgcgagagctctatgagtctgcacgcatcgggggggctctgtccgtggcacttcccgctctattgctccggagacttaggcgtggatcactgtcagtgcgggcattgctgcccggacctcccctccaacctcccccgccagcacccgtgctcctttacgaccaaggaggcggacgcaggcgccgaggtgaggccgaggccgaggccgaggagtgggaagccgaatccgtgcttgggaccctgctgcagaagctgcgggaagaggggtatttagcgtactacctgcagggaggatttagtcggtttcaagctgagtgtccccatctatgtgaaacttcactcgcaggacgtgcggggagttccatggcaccagtgcccgggccggtacctgtagtgggattaggatctctctgcctcggttctgactgctccgacgccgaatctgaagcagatcgggatagtatgtcctgtggccttgacagcgaaggtgcaacccctcctccggttggtcttcgcgccagctttcccgtacaaattcttccaaacctatatctcgggagcgctcgggattctgccaacctcgagagtctggccaaacttggcatacgctatattctgaacgtgacacctaacctgcctaactttttcgagaaaaatggcgacttccactacaaacagatcccaatttctgatcactggagccagaatctcagcaggttctttcccgaagccattgagtttatcgacgaggctttgagccaaaattgtggggtcctagtgcactgtttagccggcgtgagccggagcgtgacagttactgtagcatacctgatgcagaaactgcatttatcgctcaatgatgcatacgatctcgtgaaacgcaaaaagtccaacatctcgccaaacttcaactttatgggacagctgcttgactttgagaggtctctccgcctcgaggagcggcatagccaggaacagggttccgggggccaggcctctgcagcctctaaccctccgtctttctttaccactcctaccagtgatggagcctttgagttggcacccacctag

SEQ ID NO: 24307 - DNA, 804 bp, Artificial Sequence
  Description of Artificial Sequence: Synthetic coding sequence
atggccgagcccgtgcaggaggagctgagcgtgctggccgccatcttttgtcgccctcacgagtgggaggtgttatcacgatcagagaccgatggaactgtctttcgcattcatacaaaagccgaaggtttcatggacgttgatattcctcttgaacttgtcttccatctgcccgtaaactatccgtcatgcctgcccggcatcagtattaatagtgaacagctcacgcgggcccagtgtgtcactgtgaaagagaatctgctggaacaagctgaaagcttgctgtctgagcctatggtgcacgaactggttttgtggatacagcaaaatctcagacatattctgtcacagcctgagactggctcagggtcagaaaagtgcaccttcagcaccagcacaaccatggatgatggcttgtggatcactctccttcacctggaccacatgagagcgaagacaaaatacgtgaaaattgtggagaaatgggcgtccgatctccggcttactggacgcttgatgttcatgggcaagatcattcttattctcctgcagggcgataggaataatttgaaagagtatttaatcctgcaaaagacatccaaggtggatgtcgacagttcaggcaagaagtgcaaggagaaaatgatatccgtactgttcgagacgaaagtgcagacggagcataaacggttcctagcattcgaggtgaaggagtactcggcgctggacgaactgcagaaagaattcgagaccgccggcttaaagaaactgttctcagaatttgttctggccctcgtgaagtag

SEQ ID NO: 24308 - DNA, 2010 bp, Artificial Sequence
  Description of Artificial Sequence: Synthetic coding sequence
atggccatcgtgcagaccctgcccgtgcccctggagcccgcccccgaagccgcaactgcaccacaggctcctgtgatgggaagtgtgagttctctgatctctgggagaccctgtcctggtgggcccgcgccccctagacaccatgggccgcccggtcccacttttttccgacagcaggatggtttgctccgaggagggtatgaagctcaggagcccctgtgtcccgctgtgccaccgcggaaagcagtgcctgtaacttcatttacgtacattaatgaagactttcggaccgagtcacctccaagcccgtcctctgacgtcgaagacgcccgggagcagcgtgcccacaacgcacaccttcgaggccctccacctaagctcataccggtcagcgggaaacttgagaagaatatggaaaagatcctgataagaccgacagcttttaagcccgtgttgcccaagccccgcggcgctccttccctcccatctttcatgggcccacgggccacagggttgtccggctcccagggaagcttgacacagctgttcgggggacctgcttcgtcttcctcgtcttcttctagttcatccgctgctgataagcccctggccttctccggatgggcctccgggtgcccttctggaacgctcagtgacagcggtagaaatagtctgagcagcctgcccacttatagcactggaggagccgagcctactacctcttctccgggcggccacctaccctctcatggatcaggcagaggcgcactgccaggtcccgcgcgaggggtcccaactggcccttcccacagcgacagtgggaggtcatcttccagcaagtctactgggtcgctcggggggagagtagccggcggcttactgggtagcggcacacgggcgtctccggattccagctcttgtggtgagagatcacccccacccccaccgccacccccctcagacgaggcccttctccattgtgtcctggagggcaagctcagggatcgcgaggctgaactgcagcagttgcgagactctctggatgagaacgaggcgaccatgtgccaggcttatgaggagagacagcgccattggcagagggagcgagaggccttgcgcgaggactgtgctgcccaagcccaacgagcccagagggctcagcagctcctgcaactccaagtcttccagctgcagcaggaaaagcgccagctgcaagatgattttgcacagctgttgcaagagagggaacagttagagagacgctgcgccactctcgagagagagcagagggaactaggcccccggcttgaagagaccaaatgggaggtgtgccaaaagtcaggagagatctccctgctcaagcagcagctgaaggagagccaggcggaactagtccagaagggctccgaactcgtagcgctgcgcgtggcgctacgggaggcacgcgctacgctaagagtgtccgaagggagagcccggggccttcaggaggcagcccgggcacgcgaactcgaactggaggcctgttctcaagaactgcagcgccatagacaggaagccgaacagctaagggaaaaggccggacagctggatgccgaggcggctggtttgagagaacctccagttcccccagcaactgcagacccatttctactggcagagagcgatgaagccaaggtgcagcgagctgctgcgggggtggggggatctttacgcgcccaggtggagaggttaagggtcgagttacaacgagagcgcagacggggagaggagcagagggattccttcgaaggagagcgcctggcttggcaggcagaaaaggaacaagtgatccgatatcagaaacagctccagcacaattacatccagatgtaccggcggaatcggcagctggaacaggagcttcagcaattgagcctggaactggaggccagggaactggcagatctgggcctggcggaacaggccccatgcatatgcctggaggaaatcactgccacagagatctag

SEQ ID NO: 24309 - DNA, 2010 bp, Artificial Sequence
  Description of Artificial Sequence: Synthetic coding sequence
atggccatcgtgcagaccctgcccgtgcccctggagcccgcccccgaggctgcaacagccccccaagcacccgtgatggggtctgtgtctagtctcatttcaggacgcccatgtcccgggggacctgcaccgccccgccaccacggaccacctggaccaaccttctttcgccagcaagacggcctgttgcgaggcggctatgaggcacaggaaccactctgtccagccgtgccccctcgaaaggctgtgccagtgacatcgttcacctatataaacgaggacttcaggactgagtcacctccgtcaccttctagcgacgttgaagacgctcgcgagcagcgggctcacaatgcacacctccggggtccccccccgaaactcattcccgtttcgggtaagttagaaaaaaacatggagaaaatcctgatccggcctacagcctttaagcctgtgctgcctaagccccgcggcgcaccttctctcccctcatttatgggtcccagggccactgggctctctggctcacagggatcccttactcagctctttggcggccccgcgagcagttcctcttcctcctcctcttcttcagccgctgacaaacctctggccttctccggctgggcctccggctgcccttctggtaccctgagcgattccggtcgcaacagcctgtccagtctgccaacctacagcaccggcggggccgagcccaccacctccagcccgggaggacacttgccatctcatggcagtggcaggggcgctttgcccggaccagccaggggggtgcctaccggtccgtcacattccgattctggccgcagtagttctagcaagtcgacaggctcactgggggggagagtggctggcggattgctgggttctggaactagagcctcacccgacagcagtagctgcggcgaacgcagccccccgcccccccctccaccaccgtccgatgaggccctccttcactgcgtgctcgaggggaagcttcgcgacagagaagctgagctgcagcagcttagggattccttggatgagaatgaagcaaccatgtgccaagcgtacgaagaaagacagaggcactggcagcgggagagagaagcacttagagaagattgcgccgcacaggcgcagcgggctcagcgggctcagcaactgctgcagcttcaagtgtttcagctacaacaggaaaaacggcagctacaggacgacttcgctcagctgctgcaagagcgggagcagctggaacgcaggtgtgctacattggaaagggaacagcgggagcttggtccccggctcgaagaaaccaagtgggaggtgtgccagaagagcggtgaaatatcgctcctaaaacagcagctgaaggaaagtcaagcagaattagtccagaaaggctccgagctggtggcccttcgcgtcgcgctcagagaagcccgggccaccttgcgcgtctctgagggaagggctcgcggcctccaggaagctgcccgcgctcgagaattggagctagaggcatgcagccaggaattgcaaagacatcggcaagaggccgagcagctgagggagaaggccggccagctggacgcggaggcagccggacttcgcgaacctccggtgccacctgctactgccgatcctttcctgctggccgagtcagacgaagccaaggtgcagcgggcggccgccggggtgggcggatctctgcgagcacaggtagagagacttcgggtggaactgcagcgggagcgccgacggggcgaagaacagagagacagctttgagggcgagagattagcatggcaggcagaaaaggagcaggtcattagataccagaagcagcttcagcataattacatacagatgtaccgccgcaaccgccagcttgaacaggagctgcaacagctcagtctcgaactggaggctcgcgagcttgctgatcttggcctcgccgagcaggccccctgcatttgtctggaggaaattactgccaccgaaatttag

SEQ ID NO: 24310 - DNA, 1059 bp, Artificial Sequence
  Description of Artificial Sequence: Synthetic coding sequence
atgaagctgaaggagctggagcggcccgccgtgcaggcctggagccctgcctctcagtaccctctgtatctcgcgacggggacatctgcccagcagttagatagtagctttagtacaaatggtacgttggagattttcgaagtcgatttccgcgacccaagtctggatctgaagcacagaggagtgctgtccgccctaagcaggttccacaaactagtgtgggggagttttgggtcggggctcctagagtcatccggggttatcgtgggaggaggcgataatggcatgttgatcctttacaatgtcacacacatcctatcatccggcaaagaacctgtcatagctcaaaaacagaagcataccggcgccgtgagggcactcgaccttaatccattccagggcaatcttctggcctcaggggcaagcgattcagagatatttatttgggacctcaataatttaaatgtccctatgactctgggctcaaagtctcaataccatgaacagcctcccgaagatatcaaggcactttcttggaacagacaggctcagcatattctgagtagcgcacacccttccggtaaggcagtggtttgggatctgcgtaagaatgaacctattatcaaggtgtctgatcactccaatagaatgcactgttccggtctggcatggcatccagatattgccacccagctggtgctctgctctgaggatgaccggttgcccgtgatccagctttgggatctgcggttcgcatcctcccctctgaaagtgctggagtcccattcacgggggatcctttcagtgtcctggagccaggccgacgcggagttgctgttgacctccgccaaagattcccagatattgtgcaggaatctgggaagcagcgaagtggtgtacaagttgccaactcagagcagctggtgctttgacgtgcaatggtgccccagggacccctccgtgttcagtgctgcctcatttaacggttggatcagtttgtactctgtgatggggcgcagttgggaggtccagcacatgcgccaggcagacaaggtgtag

SEQ ID NO: 24311 - DNA, 3540 bp, Artificial Sequence
  Description of Artificial Sequence: Synthetic coding sequence
atgaagctgaaggagctggagcggcccgccgtgcaggcctggagcccagcgagtcagtatcccttgtatcttgccacaggcacctctgcccagcaactggattccagtttttccactaatgggaccctggagattttcgaggtcgattttcgagatcctagtctggacctcaagcatcgtggggttctttccgctttatcacgctttcacaaactggtttggggatctttcgggtctgggctgctcgaatccagcggagtgatcgttgggggaggcgataacgggatgctgatattgtacaatgtgacacacatcctgtctagtgggaaggaaccagttatagctcagaagcaaaagcatactggggccgtccgtgcattagatctcaatccattccaggggaatcttctcgcctctggtgcgtctgatagcgaaatctttatatgggatctcaataacttaaacgtgcctatgaccctgggatctaaaagccaacagccaccagaagatattaaggccctatcttggaaccgccaggcacaacatattcttagctccgctcaccccagtggtaaggctgtggtctgggatctcaggaagaacgagccaattattaaagtttccgaccattctaatcgtatgcactgttcaggactggcttggcatcccgatattgccacacaacttgtgctgtgctccgaagatgaccgccttcctgttatacagctgtgggatctgaggttcgccagcagtcccctaaaagtgctcgagtcacactcaagagggatactgagcgtctcttggtcccaggccgatgccgaactcctccttactagcgccaaggactcacagatcctctgtcgtaacctcgggagtagcgaggtggtttataagttgcccacccagtcctcttggtgttttgacgtgcagtggtgtccgcgcgacccatctgtgttcagcgccgcctcgttcaacggctggatcagcctgtacagcgtgatgggccgatcatgggaagtgcagcatatgcgacaggccgataagatttcaagcagctttagcaagggacagcctctgcctccgttacaagttccagagcaagtcgcccaagcccctctcataccacctctgaagaaacctccaaaatggatcagaagaccaaccggcgtttcattcgcttttgggggcaagctggttaccttcggccttcctagcactcctgcacacttggtgcctcagccgtgcccccgtctcgtattcatttcccaggtgacgacagagtctgagttccttatgcgctccgccgaattgcaagaagcccttggctcggggaacctgctgaactactgtcaaaacaaatcccaacaggctctactccagagtgagaagatgttatggcagtttctgaaggtcactctcgaacaggattctcgaatgaagtttctgaaactcctaggctactctaaggacgagttgcagaagaaagtggcgacctggttaaagagcgatgtgggtctgggggaatccccacaacctaagggaaacgacctgaacagcgaccgacagcaagccttttgcagtcaagcttctaagcacacaacaaaggaagcttctgcatcctccgctttctttgatgagctggtccctcagaatatgaccccttgggaaattcccatcacgaaagacatagacggcctgctgagccaggcactgcttctaggcgaattgggccccgcagtggaactctgcctcaaggaagaacgattcgctgatgccattatccttgcccaggcaggtggtaccgacttgctgaaacagacccaggaaagatatcttgccaaaaaaaagacaaaaatcagctcattactggcatgcgtggtccagaagaactggaaggacgtcgtctgtacctgttcactgaaaaattggcgcgaggcattggccttattgcttacctacagtggtacagaaaaatttccagaactgtgtgacatgcttggtactcgtatggagcaagagggatcacgggctttaacttctgaagcacggttgtgctacgtttgttcaggcagcgtggagcggttggtggagtgttgggcaaaatgtcatcaggcactgagtccaatggccttgcaggacctgatggaaaaagtgatggtgctgaacagatcccttgaacagttgcggggaccacacggagtatcccctggtcccgccacaacatatagagtgacacagtatgccaatctgcttgcagcacaaggttcgctggctaccgccatgtcctttcttccaagggactgtgcacagccaccggtgcagcagctgagggataggttattccatgctcagggctccgcagtattgggccagcaatctcccccctttccttttcctcgcattgtcgtgggtgctacgctccacagcaaagagaccagctcctaccgactgggcagccagccatcccaccaggttccaaccccttctccccgccccagggtgtttacaccacagagttctcccgctatgccgctggccccttcccatccctctccatatcagggccctcggacgcaaaacatttctgattacagagctccaggcccccaggccattcaaccattgccattgtcacctggtgtgcgacccgcgagtagtcaacctcaactgctgggcggacagcgagtccaagtacccaacccagtgggcttccctggcacatggcctctgcccggttctccgttgccaatggcttgcccggggattatgcggccgggctcaacatccttacccgaaactcctaggctgtttcctctgctgcccctccggccactcggacctggacgcatggtttcccatacccccgcgcctccggcgtccttcccggtaccgtaccttcctggagacccaggggctccatgcagtagcgtactgccaacaactggaattctcacacctcacccagggccgcaggattcatggaaagaggcccctgccccacggggcaacctccagcggaacaagctccctgagacatttatgccaccagctcccataacagccccagtcatgtccctgacacccgagctgcaaggaatcttacctagccaaccacccgtcagttccgtctcccatgcgccacccggggtacccggagaactctctctccagctgcagcatttgccccctgaaaagatggaacggaaagaattaccccctgagcaccagtcactcaagtcatctttcgaagcactcttgcagaggtgtagcttatccgcaactgacttaaagacaaagaggaaacttgaggaggctgctcagcgcctggaatacctgtatgaaaagttgtgtgagggtacactttcaccgcatgtcgtggccggactgcacgaggtcgcccgctgtgtggatgcaggatccttcgaacaggggcttgcggtccacgcccaggttgcaggctgcagctcatttagcgaagtgagctctttcatgcccatacttaaagcagtgcttatcatcgcgcacaagttactcgtctag

SEQ ID NO: 24312 - DNA, 1635 bp, Artificial Sequence
  Description of Artificial Sequence: Synthetic coding sequence
atggacgacaagggcgaccccagcaacgaggaggcccccaaggccatcaagccaaccagcaaagaattcaggaagacttgggggttccgccggacaacaatcgccaaaagggaaggtgctggggacgccgaagccgaccctctcgaaccccctcccccacagcagcagcttgggctgagcctccggaggagtggacggcagccgaagagaaccgagcgggttgagcaattcctgactattgcacggagaagagggagacggtcgatgcccgtcagcctcgaagattcgggtgaacccacaagttgcccagctacggacgctgaaaccgcttcagagggaagtgtcgagagcgcgtctgagacgaggtcaggaccacagtccgcatcaacggccgtcaaggaacgacctgcctcttctgagaaggtcaagggtggcgatgatcacgacgatacgtccgattctgactctgacggccttaccctcaaggagcttcagaacaggctcagaagaaagcgtgagcaggagcccaccgaacgacccctgaaagggatccagagccgtctgaggaagaagagacgagaagaagggcctgctgagaccgtcgggtcggaagcctccgataccgtggagggtgtcctgcctagtaagcaagagcctgaaaacgatcagggcgttgtgtcccaagcaggtaaagacgaccgggaatccaaactcgaggggaaggcggcacaggatatcaaggatgaggaaccaggggatttaggccgccccaaaccagaatgtgaggggtacgacccgaacgccctctactgtatctgtcggcagccgcacaacaacagatttatgatctgctgcgatcggtgtgaggagtggtttcacggtgattgcgtcggaataagcgaagctaggggcaggctgctggaacggaacggagaggactacatttgcccaaactgcacaattctgcaagtccaagacgaaacacacagcgaaaccgcagatcaacaagaagctaagtggaggcctggcgatgctgatgggacagactgtacgtcaattggtacaattgaacagaaaagctccgaggaccagggtattaagggcagaatcgaaaaggcagccaatcctagcggcaagaagaagctgaaaattttccagcccgttattgaggcccccggcgcctcgaaatgtattggcccaggatgttgccatgtcgcccagccagactcagtgtactgctccaatgattgtatcctgaagcacgctgccgccacaatgaaatttctttcctcaggaaaggaacagaaaccaaagcccaaagagaaaatgaaaatgaaaccagaaaaaccaagcctgcctaaatgcggcgctcaggctggcatcaagatttcttcggtgcataagcgacctgcccccgagaaaaaagagacaaccgtcaagaaggccgtggtggttccggcaaggtcagaggccctggggaaggaggccgcatgcgaatctagtacaccatcatgggcctctgatcataactataacgccgtgaaaccagagaaaaccgcagctccgagccccagtctgctgtacaagtgcagtggaaaatactcctacagcttacaccccagcctcattgcctag

SEQ ID NO: 24313 - DNA, 1689 bp, Artificial Sequence
  Description of Artificial Sequence: Synthetic coding sequence
atggacgacaagggcgaccccagcaacgaggaggcccccaaggccattaaacctacctccaaagaattccgaaagacatgggggtttcgcaggaccaccattgcaaagagagagggagccggggatgcagaggccgaccccttggagccgccaccccctcaacagcagctcggcttgtcattgaggagaagtgggcgtcagcctaaaaggacagaaagggtggaacagttcctgacaatagctagacgacgtggcaggagaagcatgcctgtgtcgttggaagacagcggggagcccactagttgccccgccaccgacgcagagaccgcaagcgaaggatcagtcgaatccgccagtgaaacgcgctccggtccccagtctgcctctactgcagtgaaagagagaccagcctcaagtgaaaaagtgaaaggcggggacgatcacgatgataccagcgatagtgattctgacggtctgactctcaaggagttacagaacagactgcgtcgcaaacgggagcaggaaccaacagaaagaccactgaagggtatacaatctaggttgagaaaaaaaaggcgtgaggagggacccgctgaaacagtgggttctgaagcctcggatacagtggagggggtgctaccctctaagcaggagcccgaaaatgaccaaggtgtagtctctcaggctggcaaggacgaccgtgagtcaaagctggagggtaaggccgcccaggatataaaagatgaagagccgggggacctaggccgcccgaagcccgaatgtgaaggctacgatcctaacgctttatactgcatctgtagacaaccgcataataaccgatttatgatctgttgtgataggtgcgaagagtggttccacggagactgcgtgggaattagtgaggctagggggagacttctcgaacggaacggtgaggattatatctgtccgaactgcacaatccttcaggtgcaggatgagacacactctgagacggccgaccagcaggaggctaaatggcgacctggtgacgcagacggaacggactgtaccagcatcggaacaatcgagcagaagagtagcgaagaccaaggcataaagggacgcatcgagaaggctgcaaacccctctggcaagaaaaagctgaaaattttccagcctgtgatcgaggctcctggcgcttcaaaatgtatcggcccagggtgttgccatgtcgcccaaccggactcagtctattgcagcaatgattgtatccttaagcacgctgcggcaacgatgaaatttttatcctcaggtaaggaacagaagcctaagcctaaggagaaaatgaaaatgaagcccgagaagcccagcctccctaagtgtggcgcccaagccggcattaagatctcatccgtccacaaaagaccggcgcccgagaaaaaagagactaccgtaaaaaaagccgtggtcgtcccggccagatccgaagctttgggaaaggaagctgcttgcgaaagcagcaccccaagttgggcgtccgaccacaactataacgccgtgaagccagagaagactgcggcgccgtctccttcgctcctatataagtgtatgtaccacctgggcgtcgggctactggatccctctagaagtttctggatcgctatcccttgggcttgcccagggctcggcgtggcggctctgtgctag

SEQ ID NO: 24314 - DNA, 1689 bp, Artificial Sequence
  Description of Artificial Sequence: Synthetic coding sequence
atggacgacaagggcgaccccagcaacgaggaggcccccaaggccatcaaacccacatcaaaagagttcaggaaaacatggggattccgacgcactactattgccaagcgagagggcgcgggcgacgccgaggccgaccctctggaaccacccccccctcagcagcagctcggtcttagcctgcgcaggagtgggcgtcagcctaagcgcaccgagcgcgtggagcagtttctcactatcgcccgaaggcgcggcagaaggtcaatgcctgtgtccctggaagattccggcgaacccaccagctgtcctgctaccgatgccgagaccgcttctgaaggctccgtcgaatcggctagtgagaccaggagtggcccccagtccgctagcacggcagtcaaagagcgccccgcgtctagcgagaaagtgaaaggcggggatgatcatgacgacaccagtgatagcgactcagacggtctgaccctgaaggagctccaaaaccgcctacgccgcaagcgagagcaggagcctactgagcgccctctcaaggggattcagagccggctcaggaaaaaacggagagaggagggaccggcagaaaccgtcggcagtgaggcttccgatacagtggaaggagtgttaccatcgaaacaggagcctgagaatgaccagggagtcgtgagccaagctggaaaggatgatagagagagcaagcttgaaggaaaggctgcccaggacataaaggatgaggagccaggggatcttggccgccccaagccagagtgcgaaggttacgaccccaacgcactctattgcatttgccgacaaccgcacaataatcgcttcatgatctgttgtgaccgctgcgaggaatggtttcatggcgactgcgtcggcatcagtgaagcaagggggcgcctcctcgagagaaacggtgaggactacatctgtcccaattgcacaatcttgcaagtccaagacgagacccatagcgaaactgctgaccaacaggaggcaaaatggagacccggcgacgctgatggcactgattgcactagcattggcacgatcgagcagaaaagttcggaggatcagggcatcaagggccgtatagagaaagccgctaacccaagtggaaagaaaaaactgaaaattttccagcctgtaatcgaggcacccggcgctagcaaatgcattggtcccggatgttgtcacgtggcccaaccagatagtgtttactgctcgaacgactgtatcctgaagcacgctgctgctaccatgaaattcctttccagtggtaaagaacagaaacccaagccaaaggagaagatgaagatgaagcctgagaaaccttctctccctaagtgcggagcacaggccggcatcaagatttccagcgtccataagaggcccgcccctgaaaaaaaggagacgactgtgaagaaagccgttgtagtgccagcccgcagtgaggctctgggaaaagaggctgcatgtgaatcttctacgcctagctgggcatccgaccataattacaacgcagtgaaacccgaaaagacagccgctccctctccatcactgctgtacaaatgcatgtaccacctgggcgttgggctgctggacccctcacgaagtttctggattgctattccctgggcttgcccagggctgggggtggccgctctctgttag

SEQ ID NO: 24315 - DNA, 1272 bp, Artificial Sequence
  Description of Artificial Sequence: Synthetic coding sequence
atggaggacaagcggagcctgagcatggcccggtgcgaggagcggaattcccgagggcaggaccatggccttgagagggtcccctttccaccgcaattacaaagtgaaacctatctccatcctgcagatccatcacccgcatgggacgatcctggctctacagggtcccccaaccttcgtctgttaacagaggagattgcctttcagccactcgccgaagaggccagtttcaggcgcccacatcccgacggggacgtgcctccccagggggaggacaatttgctgagtctccccttcccccagaaactgtggcggctcgtttcttctaatcagttctccagcatatggtgggacgatagtggcgcttgcagagtcattaaccagaaactctttgagaaggagattctgaaacgggacgtggcacacaaagtttttgccactacctctatcaagagtttctttaggcaactcaatttgtacggctttcggaaacgtaggcagtgtacctttcggacatttaccaggatcttttcagcaaaacggctggtcagtatcctgaataaactggaattttattgtcatccttactttcaacgtgacagccctcacctgttggtacgaatgaagcggcgtgtaggcgtgaaaagtgcacctcgtcatcaggaggaagataaaccagaggcggcaggatcctgcttggctcccgccgacactgaacagcaagatcatacgagcccgaacgaaaacgaccaggtgactccccagcatcgtgaaccagccgggcccaatacacagattcggtctgggagtgctcccccggcaacaccagtcatggtgccggatagcgccgtggcttctgataattcccctgtgacacagccagccggggagtggtcggaagggagtcaggcgcatgttacaccagttgctgcggttcccgggcccgctgcactgccatttctatacgtcccaggtagcccaactcaaatgaatagctacggccccgtcgtggcactgccaacagcaagccgctcaactcttgcaatggatacgactggcctgcccgcccccggtatgctgccgttctgtcacctgtgggtcccggttacccttgttgccgcgggggctgcacagccggccgcttccatggtgatgtttcctcatctgcccgccctccatcatcactgtccccattcccaccggactagccagtacatgcctgcttccgacggaccgcaggcttaccctgactacgccgaccagtcgacttag

SEQ ID NO: 24316 - DNA, 675 bp, Artificial Sequence
  Description of Artificial Sequence: Synthetic coding sequence
atgcccaccctgttcaagggcgtgtggggcgtggtggagcacagccgagccctggggaggttctgtccagcctgcctgccctcaggtcctcacctgcatactcagccagcgctgggtacagctgaaatgacactgctgagctcccagagctcttctttagtagcgccctccggcagcgtttcagcggagaatcctgagcagaggatgttggaaaaaagagccaaggtaattgaggagcttctgcagacagagagggattacatacgagatttggagatgtgtatagagcgcatcatggtacctatgcagcaagcccaagtacccaatatcgattttgaagggctgtttggcaacatgcaaatggtcataaaagtaagtaaacaactgctcgccgcactggaaatctccgatgcagtcggacctgtctttctggggcaccgtgatgaacttgagggcacttacaagatctactgtcagaatcacgacgaagccatcgctctgctggaaatttatgaaaaagatgaaaagatccagaagcatctccaggactcgcttgcagatctcaattcgctggtgctgaagaagggctgtaccaattatattaacctcggatctttcctcattaaacccgtgcagcgggtcatgagatacccgctgctcctgatggagctatag

SEQ ID NO: 24317 - DNA, 1878 bp, Artificial Sequence
  Description of Artificial Sequence: Synthetic coding sequence
atgcggctgcccgagcggcacggcggcccccagggcagcctgtgcctgatggacccatgttgtcctctgtcacttgccctacaggacctggtcgagagggattgcaacggtgacactccaaatctctcattctatcggaatgaaatcagattcttgccaaatggatgtttcattgaggatatactccagaactggactgacaattacgatctcctagaggataaccactcctacatccaatggctctttcctctgcgcgagccaggggtgaactggcacgccaagccactgactcttagggaggtcgaagtgttcaaatctagtcaagaaatccaggagcgactggtacgtgcttacgagctaatgttggggttctatggcataagattggaggaccgtgggactggtaccgtcggacgcgcgcagaattatcagaagcggttccagaatctgaactggcggtcccataataatttgagaatcacgaggatactgaaatctttaggggagctgggcctggaacattttcaggccccactggtacgcttctttctcgaggagacactggtgcgccgggagcttccaggagtcagacagagtgcattagattatttcatgtttgccgttcggtgccgccaccagcgccgccagctcgtccacttcgcatgggagcacttcaggcctcgatgcaaattcgtgtggggccctcaggacaaacttaggagatttaaaccctcatccttgccacatcccctggagggctctcgtaaagttgaggaggaaggatcccctggtgaccccgaccacgaggcgagcacccagggcaggacctgcggccccgaacactccaaagggggcggtagagtggacgagggaccacagcccaggtctgttgagcctcaggacgctgggcctctggagaggtcccagggcgatgaagccggtggccacggagaggatagacccgaaccactcagccctaaggagtctaagaagcggaagcttgaacttagcaggagggagcagcccccaactgaacccgggccccagtctgcaagtgaggtggagaaaattgctctcaatttggaggggtgcgccctctcccagggatctttaaggactgggacacaagaggtgggggggcaagacccaggggaagccgtacagccttgtcgacaaccactgggcgcccgcgtcgcggacaaggtccgcaagaggagaaaagtggatgagggtgccggggactctgcggcggtagcttcaggcggagcacagacgctcgccctagcaggtagtcccgcacccagtgggcaccctaaggctgggcactctgagaacggtgtagaggaagataccgagggtcgaaccggccctaaggagggcactccgggaagtccttcagagactcctggcccctctcccgctggaccagctggagatgagcctgccgagtctccctccgagacgccaggccctcgacctgccgggcctgccggtgatgaacctgccgaatctccaagcgagacccccgggcccaggcccgccggaccagccggagatgagcccgcggagtctccgtccgagactcccggccccagccctgctggacctacccgcgatgaacccgcagaatccccatcagagactccaggccctcgacctgctggacctgcaggagatgaacccgctgagtccccatccgaaaccccaggcccacggccggctgggccggcaggcgatgagcctgccgagtcgccctcggaaacacccgggccctcacccgccggaccaaccagggacgagcccgcaaaggcaggagaggccgccgaactgcaggatgccgaggtagaatcttcagccaagtcaggcaagccctag

SEQ ID NO: 24318 - DNA, 1386 bp, Artificial Sequence
  Description of Artificial Sequence: Synthetic coding sequence
atggacgaccccgactgcgacagcacctgggaggaggacgaggaggacgcagaagacgccgaggacgaagattgcgaagacggcgaggccgctggtgccagggatgcagatgctggcgatgaagatgaggagtctgaagaaccaagggcagctagaccctcatcattccagtcaaggatgactggatctagaaattggcgggcaacccgtgatatgtgccgttatagacacaactacccggatctggtggagcgggattgcaacggcgacacccctaacctcagcttctaccgcaatgagatacggtttctgcctaatgggtgttttatagaagacatcctgcaaaactggacggacaactacgacctgcttgaagataaccactcttacatccaatggctctttcctctcagggagcctggggtgaactggcacgccaagccattgacccttagagaggtggaggtgttcaagtccagccaggaaatccaggaacgtctcgttcgggcctacgaacttatgctcggcttctacggaattcggctggaggacaggggcaccggaaccgttggaagggctcagaattaccaaaagaggttccaaaatcttaattggagaagccacaataacttgcgcatcacccgcatcctcaaatccttaggggagctgggacttgagcacttccaagctcccctggttcggttctttctcgaggaaaccctagttagacgggagctgccaggtgtgaggcagtccgcgctggactattttatgttcgcggttcgatgccgccaccagcgccgccagctggtacatttcgcttgggagcattttagaccaagatgtaaattcgtttggggtccgcaggacaaactcagacgctttaagcctagttctctgccacatcctttagaagggagtcgtaaggtggaggaagaaggatctccaggggacccagatcatgaggcgtctacacagggtcggacatgcggaccagaacattccaaaggtggaggaagggtggacgaaggcccccagcctcggtccgtcgagccacaggacgccggccccttagaacgctcacagggtgatgaggcaggtggtcacggcgaggaccgaccggaacccttgagtcctaaggagagcaagaaacgcaagttggagctctcacggagagaacagccacccactgagcccggcccgcagagcgccagtgaggtagagaagatcgcactgaacttggagggttgtgccctgagccaggggtccctcaggacagggacccaggaagttggtggacaagatcctggagagtcatcctgtccatgctgcagaggatggggcctgcgatcttgttgcggactcccgagcggtagcgcatcctag

SEQ ID NO: 24319 - DNA, 1539 bp, Artificial Sequence
  Description of Artificial Sequence: Synthetic coding sequence
atgcccagccccagccggagcggccggagccggtgcctgaaggccccacggcgatctagaagcggattatccgggcctacttcttcctgttgggcttccactatcaggctggaagatcgcggcactggaacagtgggaagagcacaaaactaccaaaagcgatttcagaaccttaattggcggtctcataacaacttaaggattacacgaatccttaagagtctgggtgagctcggcctggagcactttcaggctccgttggtgaggttctttctggaggaaaccctggtgcgcagggagttgcccggcgtgcgccagagcgctctggactattttatgttcgctgtgaggtgtcgacatcaacgcaggcaactggtgcatttcgcctgggagcatttcagaccaagatgtaagttcgtctggggcccgcaggacaagctgaggagatttaagccgtcatcacttcctcaccctctggagggaagccgtaaagtcgaggaggaaggctctcccggcgatcccgaccacgaagcttcgacacaggggcgcacctgcgggcccgaacattccaaaggggggggaagagtcgatgagggacctcagccgaggagtgtcgaaccacaagacgccgggcctctcgagaggagccagggcgacgaagcaggtggccacggtgaggaccgcccagaaccgttgtcacctaaagagagcaagaagagaaagctggaattgagccgccgcgagcagcctcctacagaacccggccctcagagcgcttctgaggtcgagaagatagcactgaatttggagggatgtgcactgtctcaggggtccctgcgaacaggtacccaagaagttggcgggcaggaccccggggaagcagtgcagccttgtcggcagcccttgggagctagagtggcagacaaagttcggaaacgtcggaaagtggatgagggggcaggtgacagtgccgcagttgcctcgggcggagctcagaccttggctcttgccgggtctcccgccccatcagggcatcctaaagcaggacattccgaaaacggtgtggaggaagacaccgaaggacgtaccggacctaaagaaggaacccctggttccccttcagagacccccggaccttctccagccggtcccgctggcgacgagccagcagaatctccatccgaaacccctggaccaagaccagctggacccgctggcgatgagcccgcagaatcaccgtcagaaacccctggaccttcccccgctggtcctactagggatgagcctgcagagagccctagtgaaacccctgggcctaggcccgccggtcccgctggggatgagcccgcagaaagtccaagtgaaaccccaggaccccggccagcgggacccgcgggcgatgagcctgccgagagtccgtcagagacgccaggtcctagtcccgctggacctactcgcgacgaacctgctaaggccggcgaagctgccgagctgcaggacgcggaagtggagagctctgcaaaatcaggaaaaccatag

SEQ ID NO: 24320 - DNA, 312 bp, Artificial Sequence
  Description of Artificial Sequence: Synthetic coding sequence
atgggccagcagagcagcgtgcggcggctgaagcggagcgtgccctgtgaaagcaacgaagctaatgaggcaaatgaagccaataagactatgccagaaacacccaccggcgatagcgaccctcagcctgcccctaagaagatgaagacgtctgagagcagcacaatcctcgtagtgcgctaccgccgaaacgtcaagagaacatcccccgaggagctggtaaacgatcatgcccgggagaaccggatcaacccagaccaaatggaagaggaggaattcatcgagataactaccgagagacccaaaaagtag

SEQ ID NO: 24321 - DNA, 1776 bp, Artificial Sequence
  Description of Artificial Sequence: Synthetic coding sequence
atggagaaggccgtgaacgacggcagccacagcgaggagctgttctgccatctgaaaaccatcagcgagaaggaagatctgcctcggtgtacttctgagagccacctgtcctgcctgaaacaagacatcttaaacgaaaaaaccgagctagaagcaactctaaaggaggccgagctggtgacccacagcgtggaattgctgctgccactcttcaaagacacaatagagaagattaacttcgaaaatgctaatttgtcagccctcaatctgaagatatctgagcagaaagagatcctgatcaaagagctggatacatttaaaagcgtaaaacttgcactggagcacctgcttaggaagcgcgactataaacaaacaggcgacaacttatcttccatgctcttggagaatctaaccgataacgaatccgaaaacaccaatcttaaaaagaaagtgtttgagaaagaggcccacattcaggaactcagctgcctgtttcaaagcgagaaagcaaatactctcaaagcaaataggttttcccagtctgttaaggtggtgcatgagcggctgcaaattcagattcacaagcgcgaggcagaaaacgacaagcttaaggaatacgtcaagagcttggagacaaaaatagcaaaatggaatctgcagtctaggatgaacaaaaatgaggcaatcgtcatgaaggaagccagtagacagaagactgtggccctgaaaaaggcttccaaggtatataagcagcgactggatcattttacaggcgccattgaaaagctaactagtcagatccgggaccaggaggccaaactttccgagactatcagtgcctcaaacgcttggaagtcccactacgagaaaattgtgatcgagaagactgagcttgaggttcagattgagactatgaagaagcagataatcaacctgttggaggatttgaagaaaatggaagaccatggcaagaactcctgtgaggagatcctgaggaaggtgcactccatcgagtacgaaaatgaaactttgaacctggagaataccaagttgaaaaccacgctggccgccctaaaagatgaagtggtatctgtggaaaatgagctatccgaactacaggaagttgagaagaagcagaaaacactgattgaaatgtataaaacacaggtccagaagctgcaggaggccgccgaaatcgtgaagtcacgttgcgagaacctcctgcacaaaaataaccaaataactaaaacaaaaaataagaacgtcgagaaagtggatggaaaccataatctgctgactaagctttccctcgaggaggaaaactgccttatacagctgaagtgcgagaacctccagcagaagttagaacagatggatgccgaaaataaggaactcgaaaagaagcttgcgaatcaggaggaatgtcttaaacattcaaacctgaaatttaaggaaaagagcgcggagtacaccgcactggcccgacagctggaagctgccttagaggaaggacgtcagaaggttgcagaggagatcgagaagatgtcttctcgggaatccgcgctgcaaatcaaaattctggatctggagactgaacttcgtaaaaaaaatgaggagcagaatcagttggtctgcaaaatgaatagtaaggcccaacatcaggaggtttgcctgaaggaggtacagaactccctcgagaaatcagagaaccagaacgaatccattaaaaactacctgcagttcctcaagacctcttacgtgactatgttcgagtag

SEQ ID NO: 24322 - DNA, 1935 bp, Artificial Sequence
  Description of Artificial Sequence: Synthetic coding sequence
atggagaaggccgtgaacgacggcagccacagcgaggagctgttctgccatctgaaaacgatctctgagaaggaggacctgccacgatgcacgtcagaatcacatctaagctgcttgaagcaagatatactaaacgagaagaccgaactcgaagccacactgaaggaggctgaattagtgactcactcagtggaactactgctgccacttttcaaggacaccattgagaaaatcaattttgagaatgcaaacctctccgctcttaaccttaaaatctccgaacagaaggagatactcattaaggaacttgatacatttaagtctgtgaaactggccctggaacacctacttagaaaacgggactacaagcagactggcgataacctgtctagcatgcttttggagaatctgacagataatgaatccgaaaatacaaatctcaagaaaaaggtgttcgaaaaagaggcacacattcaggaactctcttgtctttttcagtctgagaaagccaacacactgaaggctaacagattctctcagagtgtcaaggttgtgcacgaaaggctgcagatacagattcacaaacgagaggctgagaacgataagttgaaggaatatgttaaatcactggaaacaaaaatcgccaagtggaatctccagtccaggatgaacaagaacgaggctatcgtgatgaaggaagcatctcgccagaagacggtggcccttaaaaaagctagtaaagtctacaagcaacgcctcgaccatttcacgggggcaatcgagaaactgactagtcagatacgtgatcaggaggctaaactatcggaaacgattagtgcctccaacgcctggaaaagtcactatgaaaagattgttatagagaaaacagagctcgaggtccagattgagaccatgaaaaagcaaattatcaatctactggaggatctgaaaaagatggaggaccacgggaagaacagctgtgaggagattctgcgcaaggtgcactccatcgagtacgaaaatgagaccctgaatctggagaacacaaagctgaagaccacattggctgcacttaaagatgaggtcgtaagcgtggaaaacgaattgtccgaattacaggaggtggagaaaaagcagaagaccctcatcgaaatgtataaaactcaggtgcagaagctgcaggaagccgctgaaattgtgaaatctagatgcgaaaatctgctccacaaaaacaatcagattacaaagacaaaaaataaaaacgtggagaaaatgagaggacaaatggagagccatctgaaagagttagaaagagtttgcgatagtttgactgcggccgaacgcagactgcacgagtgccaggagagcctgcaatgttgcaaagggaaatgtgcggaccaagagcacaccatccgagagctgcaggggcaagtggacggtaaccataacctgctcacaaaacttagcctagaggaggagaattgtttgatccagctgaagtgcgaaaacctgcagcaaaaactagaacagatggacgccgaaaacaaagaactggaaaaaaagctggccaaccaggaggagtgccttaagcattcaaacctcaaattcaaagaaaaaagcgccgagtacacagcactggcaaggcagctggaagctgctcttgaggagggacggcaaaaggttgctgaggaaatcgagaagatgtcttcacgagagtctgccctacaaattaagatcctagacctggagacggaattgaggaagaagaatgaagagcaaaaccaactcgtctgcaagatgaatagcaaggcacagcatcaagaagtttgcttaaaggaggtgcagaatagcctcgagaaatccgagaatcagaatgaatccatcaaaaactacctgcagttcctcaagacctcatacgtgactatgttcgagtag

SEQ ID NO: 24323 - DNA, 2526 bp, Artificial Sequence
  Description of Artificial Sequence: Synthetic coding sequence
atgatggccgacggcgccgccgccggcgccggcggcagccccagcctgcgggagttgcgggcccgaatggtcgcagccgccaacgagatcgccaaagaaagaaggaagcaagatgtggtgaaccgcgtagctacccacagttcaaatattcgctcgaccttcaaacccgtgatagatgggagcatgctcaaaaatgacattaagcagcgactggctagagaacgcagagaggagaagaggcggcagcaggacgcaaataaagagacccagctacttgaaaaggagcggaagacgaagctacagtatgaaaagcagatggaggagcgccagcgaaaactcaaggaaaggaaagagaaggaggaacagaggagaatcgccgctgaggaaaaaagacaccagaaagatgaggcccagaaagaaaagttcacagcaatcctgtacagaactctagaaaggcggcgccttgccgatgattaccagcagaaaagatggagttggggcggctccgctatggcaaactcagaaagtaaaactggaaagactgacaaagagcgcagcagctctctgaacaggagagattcgaatcttcatagctccacagacaaggagcaggctgaacgaaagcctcgagttactggtgtgactaactatgtcatgcagtacgttacagtaccgctcagaaagtgcacctccgatgaacttcgcgccgtcatgttccctatgagtacaatgaagatccctcctcagacaaaagtggaggaaagcccactagaaaaggtggagacgcccccaaaggcatccgtagatgcccccccccaagtcaatgttgaagttttctgcaacactagcatggaggctagtccaaaagctggcgtgggcatggcaccggaagtcagcacagacagctttcccgtagtctcagtggatgtatctcctgtggtctcaacatacgattctgagatgagtatggacgctagccccgagctgtcgatagaagcactgccgaaggttgatctagagaccgtaccaaaagtgagcatcgtcgcctctcctgaggccagcctcgaggccccgccagaggtttctctggaggccctccccgaagtaagcgtcgaagccgcccccgaaggatctctggaggccccacctaaagggtctgcggaagtggctccaaaggagtccgtgaaagggagtcccaaggagtctatggaggccagtcccgaagcaatggttaaagcttccccaaagacctccctggaggcatctatggaggcatcacccaaagcaaaggcccgagatgcacctaaaaaatctgagatggacaagcaggcactgattccaattgccaagaagagactcagctcctataccgagtgctacaaatggtcaagttccccagagaatgcctgcggactgcctagcccaatcagtaccaatcggcagatccagaagaattgccccccgtctcccttacctctcattagcaagcagtcaccgcaaactagcttcccatataaaattatgccaatacaacacactctctccgtgcagtctgccagttctacagtaaaaaaaaaaaaggagacagtgtcaaaaaccaccaacaggtgtgaagcgctgagccagaggcacatgatatacgaggagtcgggcaataagtctaccgcaggcatcatgaatgccgaagccgctaccaaaatattaaccgaactccgacgactagccagggagcaaagagaaaaggaggaagaggaacgccagcgagaggaaatgcagcagcgagtaatcaagaagtcaaaggacatggctaaagaggctgtcggaggccaggctgaggatcatctgaaactgaaagacggacagcagcagaatgaaacgaagaagaagaagggatggcttgatcaagaagaccaggaagcgcccctccagaagggggatgcgaagattaaggcacaagaagaagcagataagaggaaaaaagagcacgagcgcataatgttacagaaccttcaggagaggctggaaaggaaaaagaggatcgaggagattatgaaacgcacacgaaagactgatgtgaatgcgtcgaaagtgaccgagacctcgtcgcacgatatttacgaggaggctgaagcagataatgaagaaagcgataaggactcattgaacgagatgttcccatccgccattctgaatgggacaggcagccctaccaagttcaagatgccttttaacaacgcaaaaaaaatgacacataagctggtatttctggaggacggcaccagtcaggtacgaaaggagcctaaaacgtacttcaatggggacttgaaaaatttccgacagaaaagcatgaaggacacctctattcaggaagtcgtgtcaagaccatctagcaaaagaatgacttcacataccaccaagactcgcaaagctgacgaaaccaatacaacatctagatcttcagcacaaacaaagtctgaaggcttccacgatatcctccccaaatctagcgatacgtttcgccagtag

SEQ ID NO: 24324 - DNA, 2577 bp, Artificial Sequence
  Description of Artificial Sequence: Synthetic coding sequence
atgaccagcccccgggtggccgccgccaacgagatcgccaaggagcgcaggaagcaggatgtggtgaatagggtagccacccattctagtaacatccgctctaccttcaaaccagtgattgatgggagcatgttgaaaaacgatatcaagcagcggctggcacgcgagaggagggaggaaaaaaggcggcagcaggacgccaacaaagagacgcagctgctggagaaagaaagaaaaactaagctgcagtacgaaaagcagatggaggagaggcagcggaaactgaaggagcgcaaagagaaggaagagcagagaagaatcgcggcagaagagaagcggcatcagaaggacgaggcacagaaggaaaaattcaccgcaatcttgtaccggaccttagagcgccgcagactggcggatgattatcaacaaaaaaggtggtcatggggaggctcagcgatggcaaactcggaaagtaagaccgcaaataaaagaagtgcaagtacagagaagcttgagcaggggacctccgccctcatacgtcaaatgcccctgtcatcagctggcctgcagaacagcgttgccaagaggaaaactgacaaggagcgctcctccagcctcaacagaagggacagcaatctgcattcttccacagacaaagagcaagcggaacgcaagccgcgagtgaccggcgtcaccaattatgtcatgcaatatgtgaccgtgccactcagaaagtgtactagcgatgaactgcgcgctgtgatgttcccaatgagcaccatgaagatccctccccaaactaaggtggaggaatctccactggagaaggtcgaaaccccaccgaaagccagtgtagacgcacccccccaagttaacgttgaagtgttctgtaacactagcatggaggcctcccctaaagccggagtaggaatggcccccgaggtgtctaccgatagtttcccggtggtatccgtcgacgtctcgccagtcgtttctacttacgattcggagatgtctatggacgcctcccctgagttgagcattgaggccctcccgaaggtcgatctggaaaccgtacccaaggtgagtatcgtggcatctccagaggccagtctggaagcccctcccgaggtctccctcgaggccttaccagaggtgtccgttgaagccgcaccagaagggtctctcgaggcgcccccaaagggatcggccgaggtcgctcccaaagaatccgtcaagggctcccccaaagagagcatggaggccagtcccgaggctatggtgaaagccagtccaaagacgtccctggaggcgtccatggaagccagtccgaaggccaaggccagagatgcccccaagaaatcagagatggacaaacaggctctcatcccaattgcgaaaaaacgactgtcaagctacacagagtgctacaaatggagcagctcaccagaaaacgcttgtggcctgccgtctcctattagcacgaatcgacagatccagaaaaattgcccaccttcacccctccccctaatctctaaacaaagtccccaaacttcttttccctataaaatcatgcccattcagcatactctgagcgtgcagtcagcttccagcacagtcaagaagaaaaaggagactgtatccaaaactaccaaccgatgcgaagcattgtctcagaggcatatgatttatgaggagtctggtaataagtcaactgcgggcattatgaatgcagaagctgctacgaagattttaacagagctgcgccgactggcacgcgaacagcgagaaaaggaagaggaggaacggcaacgcgaagagatgcagcagcgcgtcatcaagaaatccaaggacatggctaaagaggctgtggggggccaggcggaagatcacctgaaacttaaagacggacaacagcagaacgagacgaaaaagaagaagggctggctcgatcaggaagaccaggaagccccactgcagaaaggtgatgcgaaaataaaagcacaggaggaggctgataagcgaaagaaggaacatgagcgaataatgctgcagaatttgcaggagcgcctggaaaggaagaagagaatcgaagaaatcatgaagagaactagaaaaactgacgtaaacgccagtaaggttactgaaaccagctcacatgatatttatgaggaagctgaagccgacaatgaggaatcggataaagactctttaaatgagatgtttccaagtgcgatcctgaacggtaccgggtctcccacaaagttcaaaatgccctttaataacgcgaagaagatgacccacaaactggtctttcttgaggacggtacatcgcaggttcgtaaggagccaaagacctattttaacggtgacctcaagaacttcaggcaaaagtcaatgaaggacacttcaatacaggaagtcgtcagtaggccctcttcaaagcgaatgactagtcacaccacaaagacccgcaaagctgacgagacaaacacgacaagccgctccagcgctcagactaaaagcgaagggtttcacgatatcttgcccaaaagctcagacaccttcagacaatag

SEQ ID NO: 24325 - DNA, 948 bp, Artificial Sequence
  Description of Artificial Sequence: Synthetic coding sequence
atgcccctgaagctgcggggcaagaagaaggccaagagcaaggagaccgcgggcctggtagaaggcgagccaaccggagccggtggtggcagcttgtctgccagccgggcgcctgcacgccggctcgtctttcatgctcagctagcccacggaagcgcaaccggaagagtggagggcttttccagcatacaggaattatatgcgcaaatagccggtgccttcgagatctctccatccgagattctctactgcacactgaacacccctaagatcgacatggagcgcctgctgggggggcagctcggccttgaagatttcatttttgcccatgtgaaaggcattgaaaaggaagtgaatgtctacaaatctgaagacagcctgggactgactattaccgacaacggcgtcgggtacgcctttatcaagcgaataaaggacggtggtgtgattgacagtgtgaaaaccatctgcgttggtgatcatatagagagcatcaacggggagaacatcgttggttggcggcactatgacgttgcaaagaagctgaaagagcttaagaaggaagagttgttcactatgaaactgatcgagccgaagaaagccttcgagatcgagctacgctcaaaagcaggcaagagcagcggcgagaaaattggctgcggccgcgctaccctcagacttcgctccaaaggaccggcaaccgtggaagaaatgccgtccgagaccaaggccaaggccattgaaaagattgacgacgtgctggaactgtacatgggaatccgtgatatagatctcgccacaacaatgtttgaggctggaaaagataaggtgaaccctgatgagttcgcggtcgcattggatgaaacacttggagacttcgctttccctgacgaatttgtattcgacgtgtggggtgtaatcggtgatgcaaaacggagaggcctgtag

SEQ ID NO: 24326 - DNA, 2487 bp, Artificial Sequence
  Description of Artificial Sequence: Synthetic coding sequence
atgaccggcagcaacagccacatcaccatcctgaccctgaaggtgctcccacactttgaaagcctgggtaagcaggaaaagatcccaaataaaatgtcggccttccgtaatcactgccctcacctggactcggtgggcgaaattacaaaggaggacttgatccagaagtctctggggacctgccaagattgcaaggtgcaaggccccaatctgtgggcctgcctggagaacagatgctcctacgttggctgtggggagagtcaggtcgaccactctacgattcacagccaggaaactaaacactacctgaccgtaaacctgacgactttgcgggtatggtgttatgcctgttctaaggaagtctttctggacagaaaactgggcactcaaccatccctaccgcatgtgcgtcagccacatcagatacaggagaattccgtccaggacttcaaaattcctagtaataccactctcaagacaccactcgtggctgtgtttgacgatctggacatcgaggctgatgaagaagacgagctcagggcgagggggctgaccggactcaagaacataggcaacacttgctatatgaacgccgcacttcaggcactgagcaactgtcctccccttacccagttcttcctcgattgcgggggccttgctagaacagataagaagccagcgatatgtaagagctacttaaagctgatgacagagctgtggcataaatcacggccaggctccgtagtcccaacaacattgtttcagggcattaagactgtgaatccgacgtttaggggttactcccaacaggacgcgcaggagtttttgcgctgtctcatggatctgcttcacgaggagctgaaggagcaagttatggaggtagaggaggacccacagactattactacggaggaaacaatggaggaagacaagtcccagtcggacgtggattttcagagctgcgaatcgtgctcaaacagcgaccgggcagagaacgaaaacggctcaaggtgtttctctgaagacaacaacgagactaccatgctgattcaggatgacgagaacaactctgaaatgtccaaggactggcagaaggaaaagatgtgtaacaaaatcaataaagtgaactctgaaggagagttcgacaaggacagagatagcatatccgaaactgtggaccttaacaatcaggagacggtcaaggtccagatccattcaagagcttccgagtacatcacagatgtgcattcaaacgatctgtctacaccccagatattaccctccaacgagggagtgaaccccagactcagcgcttcccctccaaaatccggaaacctatggccgggcctggctccaccgcataagaaagcccagtcagcaagccctaaacggaagaagcaacacaaaaaatatagatctgtcatctccgacatattcgatgggaccataattagctccgtgcagtgcctgacctgcgatcgcgtttccgtaaccctggagacattccaggatctcagtcttcccattccgggaaaagaagacctcgccaaattacattcctcttcacatccaacgtctattgtgaaggctggttcctgtggcgaagcctacgctccccagggctggatcgctttcttcatggagtacgttaaatcttggttctgggggcccgtggtaaccctgcaggactgcttggccgcgttctttgcacgggacgagctgaaaggagataacatgtactcttgcgagaaatgcaagaaactcagaaatggcgtgaaattctgcaaggtgcagaattttcccgaaatcctgtgtattcacctgaagaggttccgccatgagctcatgtttagcaccaagatttccacacacgttagctttcccctggaaggattggacctccagccattcctggctaaagactcacctgcgcagatcgttacgtacgatctgctctccgtcatatgccaccacggaactgcctctagtgggcactatatcgcatactgtagaaataatcttaacaatctctggtacgaattcgatgaccagagcgtgaccgaggtctcagaaagcacagtgcaaaatgcagaagcatacgtgctgttctatcgcaaaagttccgaggaggcccaaaaggagcgaaggaggatcagtaacctacttaacatcatggaaccttctctgctccagttctatatctccaggcagtggctaaacaagttcaaaaccttcgcagagcccggtccaattagcaataacgattttctctgtatccacggaggagtgccccctaggaaagctgggtatatcgaggacctggtactcatgctcccacagaacatctgggataacctatactcccgctatggtggagggcccgccgttaaccacctgtatatttgccatacctgccagatcgaagccgagaaaattgagaagagaagaaaaactgagctggagatctttattcgtgtgaagaagtag

SEQ ID NO: 24327 - DNA, 2829 bp, Artificial Sequence
  Description of Artificial Sequence: Synthetic coding sequence
atgaccggcagcaacagccacatcaccatcctgaccctgaaggtgctgccacattttgagtcgctcggtaaacaggagaaaatccccaacaagatgtccgccttcaggaatcattgtcctcacttggatagtgtcggagagatcacaaaagaagatcttatacagaaaagtttgggaacttgtcaagactgcaaggttcaaggcccaaacctgtgggcgtgcctcgagaacaggtgctcttacgtcggttgcggagagtctcaggtcgatcacagcaccatacacagccaggaaaccaaacactacctgacagtcaacttaactactcttcgggtgtggtgctacgcctgctccaaggaggtcttcctcgaccggaagttaggcacccagcccagccttccccacgtgagacaaccacaccagatacaagaaaactctgtgcaggatttcaaaatcccttctaatacaacgctcaagactcccctggtagcagtgtttgacgacctggacattgaggcagatgaagaggatgagctgcgggccaggggtcttaccgggctgaaaaacatcgggaatacctgttatatgaacgccgccctgcaagctcttagcaactgtcctcctctgacacagttcttcctggattgtgggggtttggcgcgcactgacaagaaacccgctatatgtaagagctacctgaagcttatgacagagctgtggcacaagagtaggccggggtctgtggtgccgactacactttttcaggggataaaaacagtgaaccctacctttaggggttactcgcaacaggacgcccaggaattcttgcggtgcttgatggatttactgcacgaggagcttaaagaacaagtgatggaggtggaagaggatcctcagaccattacaacagaagaaactatggaagaggacaaatcccaaagtgacgtcgatttccaaagttgtgaatcctgcagcaatagcgaccgggctgaaaacgagaatggatcacgctgtttctcagaagacaacaatgagactaccatgcttatacaagacgatgagaacaactccgaaatgtccaaagattggcagaaagaaaaaatgtgtaacaagattaacaaggtcaactcagaaggggagtttgataaggaccgggattcgatttcagaaacagtcgacctcaataaccaagaaacagtaaaggtgcagattcacagtagagcatccgagtacataactgatgtgcattcgaacgacctgtcaacaccacagatcttaccatccaacgaaggtgtgaatccgcggctttccgcttccccccctaaaagcggcaatctgtggccaggccttgctccgcctcacaagaaggcccagtcagcctctccgaaacggaaaaagcagcataagaagtaccggagcgtgatttctgacatctttgacggtactattataagttcagtgcaatgcttaacctgcgatcgggtctccgttactttggaaacattccaagaccttagcttgcccattccagggaaagaggatctggctaagctgcactctagctcccacccgacttccatcgttaaggcaggatcttgcggagaagcttatgcaccccaggggtggatcgctttctttatggagtatgtcaagcggttcgttgtctcatgtgtgccaagctggttttggggtcccgtcgtcactctacaggattgtcttgctgccttctttgcacgggatgagttaaagggcgacaacatgtatagctgcgagaagtgcaagaagctgcggaatggggtgaaattctgcaaggttcagaacttccccgaaattttatgcatccacctaaagcggttcaggcacgaactcatgttttctaccaagatcagcactcatgtgtcctttcccctggaaggacttgacctccagccatttctcgccaaggatagtccagctcaaatcgtcacctatgacctcttaagcgtgatctgtcatcatgggaccgcttcaagcggtcattatattgcttattgcagaaataacctcaacaacctctggtatgagtttgatgaccagtctgtgactgaggtgtcagaaagcactgttcaaaatgctgaggcgtatgtgctgttctaccgtaagtcctcggaagaagcccagaaagaaaggaggcggatatctaacctgctgaacatcatggagccaagtcttctgcagttctatataagccggcagtggctgaacaagttcaagacattcgccgaaccaggtcctatctctaacaacgacttcctttgcatccacgggggagtccctccaaggaaagctggatacatcgaggacctagttctgatgttgccacagaatatttgggataacctctactcaagatacggcggagggcccgcagtgaatcatctgtatatctgccatacctgtcagattgaggctgagaaaattgagaaacggaggaagacggagctagagatcttcatccgtctcaatcgagcgttccagaaagaagatagcccagcaacattttactgcatctctatgcagtggttccgagagtgggagtctttcgtcaaaggaaaggatggggacccgccaggccctatcgacaacacaaaaatagccgttaccaagtgcggaaacgtgatgctcagacagggagctgacagcggacagatctccgaggaaacctggaacttcttgcaatctatttacggcgggggccctgaagtcattctgcgcccccccgtcgtgcatgtcgatcccgacattctacaggctgaagagaagattgaagtggagactcggagtttgtag

SEQ ID NO: 24328 - DNA, 2736 bp, Artificial Sequence
  Description of Artificial Sequence: Synthetic coding sequence
atgagcgccttccggaaccactgcccccacctggacagcgtgggcgaaattaccaaggaagatttgattcagaaaagtttgggaacctgccaggattgcaaggtgcagggtccgaacctgtgggcttgtctcgaaaaccgatgctcatacgtgggctgcggtgagagccaagtggaccatagcaccatccacagtcaggaaaccaagcattacctgactgtgaatctgacgacactgcgggtttggtgttatgcgtgttcaaaggaggtgttcctggatcggaagctgggaacccagccttccttaccccacgtgcgacagccccaccaaatccaggagaacagcgttcaggattttaagatacccagcaatacaacactgaaaacgcctctcgtcgctgtgttcgatgatctcgacatcgaggccgatgaagaggacgaattacgcgcaaggggcctaactggactcaaaaacatcggtaacacctgctacatgaacgctgcattgcaggcactgagcaactgtccaccacttacccagtttttcctagattgtggcgggttggcaagaacagacaaaaaacccgctatttgcaaaagctatctgaaactgatgacggagctctggcacaaatctcgtcctgggtccgtggtgcctaccactctcttccagggaatcaagactgtgaaccctactttccggggctactcacagcaggatgcacaggaattccttagatgtttaatggatctgttgcacgaggagctgaaggagcaggtcatggaagtagaggaggatccacagactataacgaccgaggagaccatggaggaagataagtctcagagtgacgtcgattttcagtcctgtgaatcttgctcaaactcagacagagccgagaacgaaaacggttctcgttgcttttctgaggataacaacgagacaacaatgctcatacaggatgacgaaaacaattccgaaatgtcaaaggactggcagaaggaaaagatgtgtaacaaaataaataaggtcaactcagagggggaatttgacaaagaccgggatagtattagcgaaacagtcgatctcaataatcaagagacggtcaaagttcagattcattcaagggctagcgagtacatcacggatgtccattccaatgatctgtccacacctcagattctcccaagtaatgagggtgtcaacccgagactgagcgctagtcctccaaaatccggcaacttgtggcccggactggcaccgcctcacaaaaaggcccagtcagcttctcctaaaagaaagaaacaacataaaaaatatagaagtgtcataagtgatattttcgatgggaccatcatcagctccgtccagtgcctgacctgcgaccgagtaagtgtcactctggaaacatttcaggatctgtcgctgcctatccccgggaaggaagatcttgctaagctccactctagtagccaccccacatctatcgttaaagccggatcttgcggtgaggcatacgcacctcaaggttggattgctttctttatggagtatgtcaagcgatttgtggttagttgcgtaccttcatggttctggggccctgtcgtcactctgcaggattgcctggctgcatttttcgctcgcgatgagctgaagggtgacaacatgtatagctgcgaaaaatgcaaaaaacttaggaacggagtgaagttttgtaaggttcaaaattttcccgagatcctttgcatacatcttaagcggtttaggcacgagctgatgtttagtaccaagatctcgactcatgtaagctttccactggagggtctggatctgcagccttttttagcaaaggattccccagcccagatcgtgacctatgatctcctgagcgtaatttgccaccacggaactgcctcaagcggccattatattgcatattgccggaacaatctgaacaatctctggtacgagtttgatgatcagagtgtgaccgaagtatccgagagcactgtccagaacgccgaggcatatgtactcttttaccggaagtcgtcagaggaggctcaaaaagagcgtcgtcggatctccaatcttctaaatatcatggagccgtccctactccagttttatattagccgccaatggttgaataagtttaaaacattcgctgagccgggaccgatttcgaacaatgacttcctgtgcatccacggcggcgtgccgccccgaaaagctggatacatcgaggacctcgtccttatgctgccccagaatatatgggataacctgtactcacggtatgggggcggtcccgccgtgaaccatctgtacatctgtcacacctgccaaatcgaagctgaaaaaatcgagaaacggagaaagactgagctggaaattttcatacgtcttaatagggccttccaaaaggaggacagtccagcaacattttactgtatctctatgcagtggttcagggagtgggaatcttttgtgaaaggaaaagatggcgacccacccggccccatcgacaatactaagattgccgtcaccaagtgcggtaacgtcatgctgagacagggagccgactcaggacagatctcagaggagacgtggaacttcttgcagtcaatttacggcggaggcccagaggtcatcctcaggccacccgttgtgcacgtcgaccctgacatcctgcaggccgaggaaaagattgaagtggaaactcgcagtttatag

SEQ ID NO: 24329 - DNA, 465 bp, Artificial Sequence
  Description of Artificial Sequence: Synthetic coding sequence
atggccccccccgtgcggtactgcatccccggcgagcggctgtgcaacctggaggaaggcagtccggggtctggcacctacacccggcatgggtatattttcagtagcttagcaggttgccttatgaagtctagcgagaacggagctctgccagtcgtcagtgtggtgcgtgaaaccgaatcccagctcctgcctgatgtcggggccatagtcacttgcaaggttgaaatttataaatcctttcgccccggggatatcgtcctggccaaagtcatctctctaggcgatgcgcaatcaaactatctgttgacaacagccgaaaatgagctgggcgtggtcgtggctcactccgagagcggcatccagatggtaccaatctcttggtgtgagatgcaatgtcctaagactcatacaaaagaatttcgcaaagtggcacgggtccagccggagtttcttcagacatag

SEQ ID NO: 24330 - DNA, 513 bp, Artificial Sequence
  Description of Artificial Sequence: Synthetic coding sequence
atggccccccccgtgcggtactgcatccccggcgagcggctgtgcaatctggaagaaggatcacctggcagcggtacctacaccagacacggctacattttctcttccctggccggatgcctgatgaagtcttctgagaacggagccgtttctagcatcaactcacggtttgcgaaagtgcacatcctctatgtgggcagtatgccccttaagaactccttcagagggaccatccgtaaggaggacgtgagggccaccgagaaggacaaagtggagatttacaagagtttcagacccggggatattgtgctcgcgaaagtcattagcctgggcgacgcccagtctaactacttgcttaccactgcagaaaatgaattgggagtggtcgtggcacactctgaaagcggaatacagatggtgcctatttcatggtgcgagatgcagtgcccaaaaactcacaccaaggagtttcgcaaggtcgcgcgcgtccagcccgagttcttgcagacctag

SEQ ID NO: 24331 - DNA, 537 bp, Artificial Sequence
  Description of Artificial Sequence: Synthetic coding sequence
atggccccccccgtgcggtactgcatccccggcgagcggctgtgcaacctggaggagggcagccccggctccggcacgtacactaggcacgggtatatcttttcaagcctggctggctgtctgatgaagagtagcgaaaacggcgcattaccagtggtgagcgtagtacgggaaactgagagtcaactgcttcccgatgtgggggcaatagtcacctgcaaggtttcttctataaacagcagattcgctaaagtgcacattttgtacgtcggctcaatgccactgaaaaactccttccgcggcactatccggaaagaggacgtccgggccacagaaaaggataaaattagcttaggtgatgcgcagtccaactacttacttacaacggcagaaaatgagctcggcgttgtcgtggcccacagtgagtcaggtattcaaatggtccctatatcttggtgtgagatgcagtgtcctaaaacacataccaaggagttccgaaaagtggcccgtgtccagcctgaattcctgcagacgtag

SEQ ID NO: 24332 - DNA, 2811 bp, Artificial Sequence
  Description of Artificial Sequence: Synthetic coding sequence
atggccgccgcccgggacccccccgaggtgagcctgcgggaggccacccagcgcaagttacgtcggttttcagaacttcgcgggaagctggtggcccggggcgagttttgggacattgttgcaatcaccgccgcggatgagaagcaggagctcgcatacaaccagcagctgtcagagaaactcaagagaaaagagctgccacttggtgtccaataccatgtctttgtcgatccagccggggcaaaaatcggaaacggtgggtctacgctgtgtgctttgcagtgccttgaaaagctatatggagacaagtggaactcttttacaatcctcctaattcactcggatgaatggaaaaagaaggtgtcggagtcatatgtaataactatagagcgactcgaggacgatctgcaaatcaaagagaaggaacttaccgagctccgaaacatatttggttctgatgaggcgtttagtaaagtgaatctgaactacaggacagagaacggtctctccttactacacctatgctgtatttgtggcggaaagaagagtcacatccgaaccctgatgttgaaggggctccgaccctctagactgacccgaaacgggttcaccgccctccacctggccgtctacaaagacaacgctgaactgatcacatctctcttacattctggagctgacatccagcaagtcggctatgggggcctcacagcgctccatatcgccaccatagccggtcaccttgaggccgctgacgtacttctgcagcatggggcaaacgtgaatatccaggatgccgtcttcttcactcctctacacattgccgcctattacggacacgaacaggtgactcgattattgttaaagtttggggcagatgtgaatgtgtccggcgaagtaggcgataggccactccaccttgcttctgctaagggcttccttaatatcgccaaactactaatggaagagggctccaaggcagatgtgaacgcacaggacaatgaggatcacgtgcccttgcatttttgctcgaggttcggtcaccacgatattgtgaaatatctcttgcagagcgatctggaagtgcaaccccatgttgtaaatatttacggcgacacgccccttcatttggcgtgctacaatggcaagttcgaagtggctaaagagattatccaaatttccgggacagagagtttaacaaaagaaaacatcttcagtgagaccgcatttcacagtgcgtgcacgtacggcaaaagcattgacctagttaaattcttgttagaccagaatgttataaacatcaaccatcaaggacgcgatgggcatactggccttcatagtgcctgttaccatgggcatattcgcttggttcaatttctgctggataacggtgcagatatgaacctcgtcgcctgtgatcccagtcgctcaagtggggaaaaagatgaacagacttgcctgatgtgggcctacgagaagggacacgatgcaattgtgactcttttaaagcattacaagcggccccaagatgagctgccttgcaacgaatactctcagccgggtggagatggcagctacgtttccgtgcctagccctttaggcaaaataaagagtatgactaaggaaaaagctgacattttgttactcagggctggcctgccttctcactttcacctccaactgagtgaaatcgagttccacgaaattatcggatccggtagctttggaaaggtctataagggcagatgtcgcaataaaatcgtcgccattaagcggtatcgcgctaatacctactgctcgaaatcagacgttgacatgttctgtcgggaggtgtcaattctctgccagctcaaccacccttgtgtgatacagtttgtcggagcttgtctcaacgacccaagccagttcgctatcgtgactcagtatataagcggaggcagtctgttcagcctgctccacgaacagaaacgtatattggacctccagagcaaactaattatcgctgtggatgtggctaagggaatggagtacctccacaatctaacccagcccattattcatagagatctgaactcccataacattctgctgtatgaagacgggcacgctgttgtggcagatttcggggaatccagatttctgcaatcccttgatgaggacaacatgacgaagcagccggggaacttgcgttggatggcccccgaagtgtttacccagtgcacaaggtacaccattaaggccgacgtatttagctatgccttgtgtctgtgggaaatcctcaccggagaaatacccttcgcgcacctaaaacccgccgccgccgcagctgacatggcttatcatcacatcagaccgcccattggctattcaatacctaaacccatcagctccttgctgatacgcggctggaatgcatgtccagagggacgaccggagttcagcgaggtggtcatgaaactggaagaatgcctgtgcaacatagaactcatgtctcccgcatcctcgaactcatccggaagtctgtccccctcctcatccagcgactgtctggtgaatcggggaggacccgggcggagtcacgtggctgcgttgagaagccgctttgaacttgagtacgctttgaacgcccggtcatatgctgctctatcgcagtctgccgggcagtactcttctcagggactcagcctggaggagatgaaaagaagtctccagtacactcctatcgataagtacggatatgtgtccgatcctatgtcttcaatgcattttcactcgtgtcggaatagttcttcgtttgaggactcctcttag

SEQ ID NO: 24333 - DNA, 510 bp, Artificial Sequence
  Description of Artificial Sequence: Synthetic coding sequence
atggccgccgcccgggacccccccgaggtgagcctgcgggaggccacacagcgaaaactgcgaagattttctgagctgagaggcaagctagtggcacgaggcgagttttgggatattgtagccatcaccgccgctgacgaaaagcaggagctagcgtacaatcagcagctgagcgagaagcttaagcggaaggagcttcctctgggcgtgcagtatcacgtgttcgtcgatcctgccggggcaaagattggaaacggtggaagcacattgtgtgcattgcagtgccttgaaaagctctatggagacaagtggaactccttcacaatactcctgatccactctgtcagtttccagatctaccagaacgccctcgctaagcatcccgtttcttttaaagcctactggattcaggacgttctctggcacctggcccagctgtggagcatcccggactggggactgatgttccaattgggcaagactgccctgctggtggtattgacatcctag

SEQ ID NO: 24334 - DNA, 1785 bp, Artificial Sequence
  Description of Artificial Sequence: Synthetic coding sequence
atggccgccgcccgggacccccccgaggtgagcctgcgggaggccacacagagaaagttgcgcaggttctccgagttgcgagggaaactcgttgcaaggggtgaattttgggacattgtggccattaccgctgcggacgaaaagcaggaattggcctataaccagcaattgtccgagaaactgaaaaggaaggaactcccgctgggtgtgcagtaccacgtgtttgtggatcctgcaggagcaaaaatcggcaacgggggtagcactctgtgcgcactgcagtgtctggaaaagctgtacggtgataagtggaacagtttcaccattttgctaatccattccggcggatactctcagagattgcctaatgctagcgccttggggaaaattttcacagcattgccactgggtaaccctatttaccagatgctggaacttaaattggctatgtacatcgattttccactgaacatgaacccagggattctggtcacctgcgctgatgacatcgagctttacagtataggcgagttcgagtttatacggtttgataagcctggattcacggcactggctcacccaagtagcctcactataggtaccactcacggcgtcttcgtgctggatccttttgacgaccttaaacacagggacctcgaataccgctcctgccaccgctttctccataaaccctccatagagaaaatgtatcagtttaacgccgtatgccggcctggtaacttctgccagcaagactttgccgggggagatatcgccgatcttaaactggatagcgactacgtttatacagacagtctgttctacatggaccacaaatccgcgaagatgctgctcgccttttacgaaaaaattggcaccttatcttgcgagattgatgcctacggagacttcttgcaggccttgggaccaggagcgacggtagaatacactcgcaacacgtccaacgttattaaggaagagtccgagctggtggaaatgagacagcgtatttttcacctgttgaaaggaacctccctcaatgtggtcgttctgaacaatagcaagttttatcatatcgggaccaccgaggaatatctgttttatttcacgtctgacaattccctcaagtcagaacttggcctgcagtctattaccttcagcatcttccccgatattcccgagtgctcgggcaagacgagctgtattatacagtcaatcctcgactcaaggtgctctgtcgcgcccggcagcgtcgtggagtactcacgtctcggccccgacgtgtctgtgggtgagaactgtatcattagtggatcctatatcctgactaaagccgcccttccagcacacagtttcgtctgctcactgagcctaaaaatgaataggtgcttgaagtacgccacaatggcgttcggcgtccaggacaacttgaagaaatctgtgaagacccttagcgatattaaactactgcagttcttcggcgtatgttttctgtcctgtctggacgtttggaacctcaaggtgaccgaggagttgttctccggaaataagacttgcctgtctctttggactgctagaatcttccctgtgtgcagtagtctctcagatagcgtgatcacatccttgaaaatgctgaacgccgtaaagaataagtctgcatttagcctcaacagctataaattactgtctattgaagagatgctgatttacaaagacgtcgaagatatgattacgtaccgcgaacagatattcctggaaatctcgctcaagagttcattgatgtag

SEQ ID NO: 24335 - DNA, 588 bp, Artificial Sequence
  Description of Artificial Sequence: Synthetic coding sequence
atggccccccccgtgcggtactgcatccccggcgagcggctgtgcaacctcgaggaaggttccccaggctctgggacctacacgaggcacggatacatattttcctcattggcaggttgcttgatgaagtctagcgaaaacggcgcccttcctgtggtttccgttgtaagagagactgaatcgcagcttctccctgacgttggggccatcgtgacatgcaaggtttcatccatcaactcacggttcgcgaaggtccacattttgtacgtggggagtatgccgttgaaaaattcattccggggcactattagaaaagaggacgtgagggctaccgaaaaggacaaggtcgaaatttacaagtcgtttcgcccaggggacattgttctggccaaggtgatatccttaggagatgcccaaagcaattacctcctgactaccgcagaaaatgaactgggtgtcgtagttgcacactccgaaagcggcatacagatggttcccatctcctggtgcgagatgcaatgtccaaagacacacaccaaggaatttaggaaagtggccagggttcagcctgaattccttcagacctag

SEQ ID NO: 24336 - DNA, 1626 bp, Artificial Sequence
  Description of Artificial Sequence: Synthetic coding sequence
atgaccggcgagaagatccggagcctgcggcgggaccacaagcccagtaaagaggaaggtgacttactcgaaccaggcgatgaggaagccgctgcagccctcggcggcacgttcacccggagcagaatcggtaagggtgggaaagcttgtcataagatatttagtaaccaccatcacaggctgcagttgaaggcagcgccggcctccagtaatcctcccggtgctcccgcactgccactgcacaactccagcgtcactgcgaattcccaaagtccagccctccttgccggcacgaaccccgtcgcagtagtggcagatggcggatcgtgcccagcccactaccccgtgcatgagtgcgtgttcaagggagatgttagaagattgtcttcgctgattcgcactcacaacattggccagaaggacaaccacgggaatactccactacacctggctgtgatgctcggcaacaaggaatgtgcgcacctcctactggctcacaatgcccctgttaaggtgaaaaacgcacaagggtggtcaccgttagccgaggcgatctcttatggagaccgtcaaatgataaccgctttgctgcggaaactgaagcagcaatccagggagtccgtcgaggagaaacgtcctcgcctgctcaaggccctgaaagaattaggtgatttctatttggaactccattgggacttccagagctgggtgcctctacttagtagaatcctgcctagtgacgcatgcaagatatacaagcaagggattaatatacgtctggacaccacactcatcgactttactgacatgaagtgccaaaggggcgatctgtcgttcatttttaacggcgacgcagcaccctccgagtcatttgttgtactggataatgaacagaaagtgtatcagagaattcaccacgaagagtccgagatggaaactgaggaggaagttgacatcctgatgagctctgatatctattcagccacactgtcgaccaagagcattagcttcactcgcgctcaaaccgggtggttatttcgcgaagataaaacagagcgggtgggtaactttcttgcagacttctacttggttaatgggcttgtgctcgagtcacgaaagaggagggagcacctgtctgaagaagatatattgcgaaataaagcgataatggagtcacttagtaaaggcggtaatattatggagcagaactttgaacctatcagacgacaatccctcacaccccctccacagaataccatcacctgggaggagtacatttcagctgagaacggaaaggctccccatctgggcagggagttggtctgtaaagagtctaagaaaacctttaaagctacaattgcaatgtcgcaggagtttccactgggtatcgagctgctcttaaatgtcctcgaagtggtcgccccttttaagcacttcaataagctgagagaattcgtgcagatgaaactcccccccggcttcccagtcaaactcgacatcccagtgttcccgactataaccgcgaccgtgactttccaagaatttcggtacgacgagtttgatggctctatattcacaattcctgatgattataaggaggacccctcccgatttccggatctttag

SEQ ID NO: 24337 - DNA, 840 bp, Artificial Sequence
  Description of Artificial Sequence: Synthetic coding sequence
atgccctgccggcgggaggaggaggaggaggccggcgaggaggccgaaggtgaggaggaggaagaggatagcttcctgctgcttcagcagagtgtagctctcgggagctcaggtgaggtggataggttagtcgctcagataggggagacgctgcagttagacgctgcacagcatagtcctgcgtctccttgtggcccgcctggcgcccctttgagggccccaggtcccttggccgcagctgttcccgcagataaggcccgcagtcccgctgtgcctctgctgctccctcccgctctcgccgaaaccgtaggccccgcaccacccggggtgttgcgttgtgctctgggggacaggggtagagtgcggggccgcgccgctccctactgcgtcgctgaattggcaactggtcccagcgccctgagtcctctgcctccgcaagccgacttggatggcccgcctggcgcgggcaagcaggggattccccagccgttgagcgggccttgcagaaggggttggctcagaggggcagccgcaagccgacgactgcagcagagacggggcagtcagcctgagaccagaactggcgatgatgatccacatcgcctcctgcagcagcttgtactgtccggtaatctgattaaagaggccgtgcgacggctgcactctcggagactacagctgagggcgaagctgccccagcggccactgctcgggccactctctgcgccagtgcacgagccccccagcccacggtcaccaagagctgcctgttctgatccaggggccagtggccgggctcagcttaggacaggggatggagttttagttccaggcagctag

SEQ ID NO: 24338 - DNA, 1209 bp, Artificial Sequence
  Description of Artificial Sequence: Synthetic coding sequence
atgcccctgcacagcagcctgggcaacaagagcgagaccctgagccagaaaaagaacaataacaacaaagagaagactaaacgcaactcgcgcaatccacccagaaccgctctgaaggaaggaaagatggaggagcttagccaagccctggcttcctcctttagcgtttcccaagacctgaacagcaccgccgccccgcatccaagactgtcgcagtataagtctaagtactcatctctggaacagtccgaacgccggcgaagactgttagaattgcagaaaagcaaacgcctcgactatgtaaatcatgctcgtagactggcagaggacgattggactggaatggagagtgaggaagagaacaagaaagatgacgaagagatggacatcgacactgtgaaaaagttaccaaagcattacgcaaatcagctaatgttgtcggaatggctaatagacgtgccatcagacctgggccaggagtggatcgtggtggtgtgtcccgtaggcaagcgcgctctgatcgtggcctctagggggagtacaagtgcatacactaagtccggttattgtgtcaataggttctcttctctgctgccgggcggcaaccgccggaactccacggcaaaggattataccattctggattgtatttacaatgaggttaaccagacctattacgtgttagatgtcatgtgttggcggggacatcctttctatgactgccagactgactttagattttactggatgcactccaagctccctgaagaggagggactgggggagaagaccaagctcaaccccttcaagttcgtcggccttaagaacttcccctgcaccccagagagtctatgcgacgttcttagcatggatttcccctttgaggtggatgggttactcttttaccataaacaaacccattattctccagggagcacgccattggtcggctggctaagaccctatatggtgagcgatgtcctaggcgtggctgtccccgctggccccctgacaactaaacccgattatgccgggcatcaactccagcagatcatggaacataaaaaatcccaaaaggagggcatgaaggagaagcttacacataaagcctctgagaatgggcactacgaattagagcatttgagcaccccgaaactcaagggttcgagtcacagcccagatcaccccggctgccttatggagaactag

SEQ ID NO: 24339 - DNA, 1107 bp, Artificial Sequence
  Description of Artificial Sequence: Synthetic coding sequence
atgagcctgttcggcaccaccagcggcttcggcaccagcggcaccagcatgttcggaagcgccaccacggacaatcacaatcccatgaaagacatcgaagtcacatcatctcccgatgacagtattggctgcctgtcttttagcccaccaacactgccaggaaatttcctgattgctggctcatgggctaatgacgtcagatgctgggaggtacaggacagtggacagactatccccaaagcacaacagatgcataccggacctgttctggacgtctgctggtctgacgatggaagcaaagtatttactgcttcatgtgacaaaaccgccaaaatgtgggatctaagcagtaatcaagctattcagattgcgcaacatgatgcccctgtgaaaaccatacactggataaaggctcccaactactcttgcgtaatgaccgggagttgggataaaacactcaagttctgggacactcggagctcgaatcccatgatggttctccagctccccgagcgatgctactgcgctgatgtcatctaccctatggccgtggtcgccacggcagagcgtggcctcatcgtgtaccagctggaaaatcagcctagtgagttcaggaggatcgagagtccactgaagcaccaacacaggtgcgtggctatcttcaaggacaagcagaacaaacccactggctttgctctcggcagcattgaaggacgggtggccattcactacattaaccctccgaatcctgccaaggataactttacatttaagtgccatagatcaaatggcaccaatacaagcgctccccaggatatatatgctgtgaatggcatagccttccaccccgtgcatggaacacttgctacagtgggaagtgatggccgcttcagcttttgggataaagacgcaaggacaaagctaaaaacaagtgagcagctggatcagccaatttccgcctgctgtttcaaccacaacggaaatatcttcgcatacgcaagttcatacgattggtcaaaggggcacgaattttataaccctcagaagaaaaattatatttttttgcgcaatgcggccgaggagttaaagcctagaaataaaaaatag

SEQ ID NO: 24340 - DNA, 552 bp, Artificial Sequence
  Description of Artificial Sequence: Synthetic coding sequence
atgcggaagagcagctgcgtggagagcttcgacgaccagcggcggatgtccctccacttacatggggcagattgcgaccctaaaacccagaacgagatgaatatatgcgaggaggaattcgtagagtacaaaaaccgcgacgcaatctcggctctgatgccactatttagcgaagaagaatcttccgacggatccaagcacaataacgggctgcccgatcatatctccgctcagcttcagaatacctacaccttgaaagcctttacggtgggctctaagtgcgtggtgtggtcttctcttaggaacacttggtctaagtgcgaaatactcgagacagccgaagaggggaccagagtgctgaacctgtccaacggaatggaggagatcgttaaccccgaaaacgtgtggaacgggatccccaagttggataaaagccccccggaggctgtgagccagagagtgggtaaggatctgtatttcatgagcgtaggcgacaccactatcaaggagaaggggttcggcggtgatggagatcttacagttgacctgtag

SEQ ID NO: 24341 - DNA, 1821 bp, Artificial Sequence
  Description of Artificial Sequence: Synthetic coding sequence
atgcccagcccccagctgctggtgctgttcggcagccagaccggcacagcacaggatgtatcggaacggcttggacgcgaggcaagacgaagacgcctgggatgccgtgtgcaggccttagactcataccccgtggtgaatcttattaacgaacccctagtgatttttgtctgcgccacgacaggtcagggtgatccccccgacaacatgaaaaacttttggagattcatctttcggaaaaatctcccatctaccgccctgtgccaaatggactttgcggtcctgggactcggcgacagcagttacgccaaattcaactttgtagctaaaaagctgcaccgtcggttgttgcagcttgggggatcggcacttctccccgtatgcctcggagacgatcagcatgagctcggcccagacgcagctgttgacccttggcttcgggacctatgggaccgagtgctggggctgtaccccccgccacctggtctcaccgagattccacctggcgtgccactgcccagcaaatttacactgttgttcctccaggaagcaccaagcacagggtctgagggccagagagtggcgcaccctggaagccaagagcctccctctgagtctaagccatttctcgcaccgatgataagcaatcagcgtgtgacgggtccaagccattttcaggacgttaggctcatcgaattcgatatcctgggatcagggatttctttcgctgctggggacgtggttctaattcagccgagcaattcggccgctcacgtgcagcggttctgccaggttcttggtctggacccggaccagctattcatgctgcagcctcgcgagcctgacgtgtccagtcccacccgtctgccacaaccatgctccatgcgccacctcgtcagccactatctggatattgctagtgtgccacgtcgaagcttctttgagctgctggcttgcctatccttgcatgagctagaacgggagaaactactggagtttagctccgcacagggccaagaggagttattcgagtattgtaaccgacctagacgtactatcttagaggttctgtgcgattttccccacaccgcagcggccatcccccctgattaccttctggatttgatccctgtgatacgacctcgcgctttctcgatcgctagcagcctcctcacacatcctagtcgtttacagattttggttgcggttgttcagttccagaccagactgaaggagccacgcaggggcctatgttcttcctggctcgccagcctggatcctgggcagggccctgtccgtgtcccactgtgggtaaggccgggctcactcgccttccccgaaactcctgatactcccgttatcatggttggacccggcaccggtgtggccccattccgggctgccatacaggagagagtcgcgcagggccagacaggcaactttctgttttttggctgcagatggcgcgaccaagacttttactgggaagcagaatggcaagaacttgagaaaagggattgtcttacactcatcccagctttctctcgagagcagccacctgccctgttctccgccttgcaagaacagaaggtctacgtccagcacagactcagagagctgggttccttggtgtgggagctgttagatagacaaggggcttatttctatctggcagggaatgctaagtcaatgccggccgatgtcagcgaggctctgatgagcattttccaagaagaaggaggcctgtgtagcccggatgccgccgcttaccttgctcgactgcagcagacccgtcggtttcaaactgaaacttgggcttag

SEQ ID NO: 24342 - DNA, 420 bp, Artificial Sequence
  Description of Artificial Sequence: Synthetic coding sequence
atggccgagagcgactgggacaccgtgaccgtgctgcggaagaaggggcctactgctgctcaggccaagtcgaaacaggctattctggccgcccagcgccgcggtgaggacgtcgagaccagtaagaagtgggctgccggccagaataagcagcattccattactaagaataccgcaaagctggaccgcgaaacggaggagctgcaccacgaccgagtgactttagaagtcggcaaggtgatccagcagggcaggcagtccaagggtctcactcaaaaagacctcgcaaccaaaatcaatgagaagccgcaagttatcgctgattatgaaagcggtcgggcaatacccaacaatcaggtgcttgggaagattgagcgggccatcggggagtgtcctagtactctccgtcgggtgcgatag

SEQ ID NO: 24343 - DNA, 426 bp, Artificial Sequence
  Description of Artificial Sequence: Synthetic coding sequence
atggccgagagcgactgggacaccgtgaccgtgctgcggaagaagggcccaactgccgctcaggccaagtcaaaacaagccatcttggcagcccagcgtaggggggaggacgtcgagacttccaagaaatgggctgccggtcaaaacaagcagcactctatcacgaaaaacacagctaaactggatcgggaaacagaagaactccaccatgaccgggtgactctggaggttggaaaagtaatacagcaaggacgccagagcaagggactcacacagaaggatctggcaactaaaattaatgaaaaaccacaggtcatcgcagactacgaaagcgggagagctatcccgaacaaccaggtgcttggaaagatcgaacgcgccatcgatgtgggcaccagaagcgctagagtcctgagagctcagtag

SEQ ID NO: 24344 - DNA, 150 bp, Artificial Sequence
  Description of Artificial Sequence: Synthetic coding sequence
atggccacccagcggaagcacctggtgaaggacttcaacccctacattacctgctatatctgtaagggttatcttatcaagccaaccactgtgaccgaatgtctgcatacgagcgcagagagctattggatgagtacatggatgagctag

SEQ ID NO: 24345 - DNA, 960 bp, Artificial Sequence
  Description of Artificial Sequence: Synthetic coding sequence
atgatggtgctgaaggtggaggagctggtgaccggcaagaagaacgggaatggcgaggccggtgaatttctccccgaagactttagagatggagagtacgaggccgctgtcaccctggaaaaacaggaagacctgaagaccctactggctcatccagttacgttaggagaacagcagtggaaatctgagaagcagcgggaggctgaattgaagaaaaagaaattggaacagcgatccaagcttgagaatctggaggatctagagattattatccagttgaaaaaacggaagaaatatagaaaaacaaaagtgcccgtggtcaaagaaccagaaccagagatcatcaccgaaccagtggacgtgccaacctttctgaaagccgccctagagaataaactcccagtagtggagaagttcctgtctgataaaaacaaccccgatgtgtgtgatgagtataaacggacggccctccaccgcgcttgccttgagggccaccttgcaatcgtggaaaagctgatggaggcaggtgcccagatcgagttcagggacatgctggaaagtaccgcaattcactgggcaagcagaggcggaaatcttgacgtgctgaaacttcttctgaacaagggagcaaagatttccgctcgcgacaaactgttgtccacagcactccacgttgcagtgcggacaggacactatgaatgtgccgaacatctaatcgcttgtgaagcagatttgaatgccaaagatcgcgagggcgacacacctctgcatgatgctgtccgccttaacaggtacaagatgataagactgctcataatgtacggagccgacctgaatattaaaaactgtgctggcaagacacccatggatctggttttgcattggcaaaacggcacaaaagcaattttcgatagcctgcgcgaaaattcttacaagacctctaggattgcgactttctag

SEQ ID NO: 24346 - DNA, 1089 bp, Artificial Sequence
  Description of Artificial Sequence: Synthetic coding sequence
atgagcggctaccagcggcggcccggcgccacccccctgagccgggcccgctctctggctatccctgacgatgaccgattcgaggatctggaagaagccaacccttttagctttagggagtttttgaaaactaaaaatcttggtttgtctaaagaggatcctgcatctagaatttacgcaaaagaagctagccggcattctctgggccttgaccataacagcccgccctctcaaacgggtggatatgggcttgaatatcagcagccgttttttgaagacccaactggagccggcgaccttcttgatgaggaggaagatgaggacactggatggtcaggtgcttacttgccatccgctattgaacaaactcacccggaacgggtcccagcggggacttctccttgcagcacctatttaagctttttctcgacaccctcggagctggccgggcccgagagcctcccaagttgggccttatcggatactgattctcgagtgagccccgccagcccagctggctccccaagcgctgactttgccgtccatggcgagtccctcggagatcgccatcttagaacattacagatctcctacgatgcactgaaggacgagaactcaaaactcaggcgcaaacttaacgaagtccaaagtttttccgaagcccaaaccgaaatggtgagaactctcgagagaaaattggaagcaaaaatgattaaagaagaaagcgattatcacgacttggaaagtgtcgttcagcaggttgagcagaacctagagctcatgaccaaaagagccgtgaaggcggagaatcacgtagttaagctcaagcaggagattagtctcctgcaggcccaggtctcaaacttccaacgagagaacgaagcccttaggtgcggtcaaggcgcatccctgaccgtcgtgaagcagaacgccgacgttgccttgcagaatctccgcgttgtgatgaatagcgcacaggcatcgataaaacagctggtgtctggtgcggaaacactgaacctggtggccgaaattctcaagtccatcgataggatttccgaagttaaggacgaggaggaggactcctag

SEQ ID NO: 24347 - DNA, 5463 bp, Artificial Sequence
  Description of Artificial Sequence: Synthetic coding sequence
atggagagcaacttcaaccaggagggcgtgccccggcccagctacgtcttttctgcagatcccatcgcccggccatcagaaattaatttcgacggtatcaaactggacctgtctcatgagttctctctagtggcgcctaacaccgaagcaaattccttcgagtccaaagattatctgcaggtctgcctcaggattcgaccatttacccaaagcgaaaaagaactggagagcgaaggatgtgtccacattctcgattcccaaaccgtggtgttaaaagaaccgcagtgcatacttggcagattatccgagaaatccagtgggcagatggcccagaagttctcattttcaaaggtgttcggcccggctacaacccagaaggaatttttccaggggtgtatcatgcagcctgttaaagacctccttaaaggccaatcaagattaattttcacctatgggctaacaaattcaggtaagacttacacattccagggcactgaggagaacattgggattcttccaaggaccctgaacgtgcttttcgacagtctgcaggagcggttatatactaagatgaacttgaaaccccaccgcagccgtgagtatctcagactgtctagtgaacaagagaaggaggaaatcgcctcaaagtccgccctcttgcgccagatcaaggaagtaaccgtgcacaatgactccgacgatactctgtatggtagcctcactaactccttgaacatttctgagttcgaggagtcaatcaaggattatgagcaagccaacctcaacatggcaaattctattaagttcagtgtttgggtttctttcttcgagatttacaatgaatatatctatgacttgttcgtgccagtatcctctaagttccagaagcggaagatgttgcgcctgagccaggatgtgaagggctactcgttcatcaaggatctgcagtggatacaggtgagcgactccaaagaagcttatcggttactgaagctcggtattaagcatcaaagcgtggccttcacgaagttaaacaacgcctctagcaggtcacactctattttcacggttaagatattacagattgaagactccgagatgtcgcgcgtgatccgagtcagcgaactgagtctgtgcgatttggccgggtccgagcgcacaatgaaaactcagaacgaaggtgagaggctgcgggagacaggcaacatcaatacgagcctgttgaccttaggaaagtgtatcaatgtcttaaagaactcagagaaaagtaaattccagcaacacgtcccatttagagaaagcaaattaacccactatttccaatcatttttcaatggcaagggaaaaatctgcatgatcgtcaacattagtcagtgttatttggcatatgatgaaacgctgaatgtgctcaaattcagcgccatcgctcagaaggtttgtgtgcctgacaccctaaatagcagtcaggagaaactcttcggacctgtgaagagctcgcaggatgtgtcactggacagtaattctaattccaagattctaaacgtaaagcgagccacaatcagttgggaaaacagtctggaagacttaatggaagacgaggacttggtggaggagttagaaaatgccgaggaaacacaaaacgtggaaaccaagctgctggacgaggacctggacaaaacactcgaagaaaacaaggccttcatttctcacgaagagaaacgaaagctgctggatttaatagaggatcttaaaaagaaactgatcaacgaaaagaaggagaagcttaccctcgagttcaagattagagaggaggtgacacaggaatttacgcaatattgggcccagagagaggcagactttaaagagacgcttctgcaggagcgcgaaattctcgaggaaaacgcagaacgtagattagccattttcaaggatcttgtggggaaatgtgacacaagagaggaagctgcaaaagacatttgtgctactaaggtggagacggaggagactcacaattatgtcgggttcgaagatatcatagattctcttcaggataacgttgccgacataaaaaaacaggccgagatcgctcatctctacattgcgtctctcccagaccctcaggaggctactgcctgcttagagctgaagttcaatcagataaaagctgagctcgccaaaaccaagggcgagctcataaagactaaggaagaactgaagaaaagggagaacgagtcagattcactaatccaggagctagagactagtaataagaagattatcactcagaatcagaggatcaaagagctgattaatataatcgaccaaaaagaggacactatcaacgagttccagaatctgaagtcccatatggaaaacacctttaagtgtaatgataaagccgatacttcctccctgatcattaacaataagttgatatgtaacgagactgtggaagtgcccaaagattctaagtcgaagatttgtagcgagagaaaaagggtgaacgagaatgagctgcagcaagatgaaccgccggcaaagaaggggtctattcacgtctcctcggccattactgaggaccagaagaaatcagaggaagtccgccctaacattgccgagatagaggatatccgcgtcctacaggagaataatgaagggctccgtgctttcttacttaccatcgagaatgagctgaaaaatgaaaaggaggagaaggccgaattgaataagcagattgtgcactttcagcaagaactgtccctctctgaaaagaaaaacctcacgctctcaaaagaggttcagcaaatccagtccaattatgacatagctattgcagaactccatgtgcagaagtcgaagaatcaagagcaggaggagaagatcatgaaactttctaatgagatcgaaacggcaacacggtccattacgaataatgttagtcagatcaaattgatgcacaccaagatagacgagctgagaaccctggattctgtttcgcagatatctaatatagacctcctgaacctgcgggacctctcaaatggctccgaagaagataaccttcccaacactcagctggacctactgggaaatgattaccttgtttctaagcaggtaaaggaatatcggatccaagagcccaacagggagaacagttttcacagctctattgaggcgatttgggaggagtgtaaggagatagtcaaagcatcgtcgaaaaaatcgcaccagatcgaagagctagagcagcagatcgagaaattacaggccgaggtaaagggatacaaagacgagaacaaccgcctgaaagagaaagagcacaagaaccaggacgatcttctgaaggaaaaagaaactcttatacagcaactcaaagaagagctgcaggaaaagaatgtgacactagacgtccagatccagcatgtcgtggagggtaagagggccctctcggaactcacgcagggtgtcacctgttacaaagctaagatcaaggagttggagactattctggagacccaaaaggtcgaatgttcacatagcgctaagctcgaacaggacattctcgaaaaagaaagcatcattctcaaacttgaacgaaatctgaaagaattccaggaacatcttcaggattccgtgaaaaacaccaaggaccttaatgttaaagaactcaaactgaaagaagagataacccagctcaccaataaccttcaggatatgaagcacctgctgcaactgaaggaagaagaggaagagaccaataggcaggaaactgagaaactgaaagaggagctcagcgcttcgtctgcccggactcagaacctaaaggcggatcttcaacgtaaggaggaggactatgcagatctcaaagagaagctgacggatgctaagaagcagatcaaacaagtgcagaaggaggtgtcagtcatgcgggatgaagataagctcctccggattaagatcaacgagctggaaaaaaagaagaaccagtgtagccaggaattggacatgaagcagagaacaatccaacagttgaaggagcagctcaataatcaaaaggtggaggaggctatccagcagtatgagcgggcctgtaaagacctcaatgtgaaggaaaagattatagaggatatgagaatgacactggaagaacaagagcagacacaggtggaacaagatcaggtgttggaagccaagctcgaggaggtagagcggctggccaccgagcttgagaagtggaaagaaaaatgtaatgatctggagacaaagaacaaccagcgctctaataaggagcatgagaacaatactgacgtgctcggaaagctgacgaacttgcaagatgagctccaggagtccgaacaaaagtataacgctgataggaaaaaatggctcgaagaaaaaatgatgctcattactcaggccaaagaagccgaaaacattcgcaataaggagatgaaaaaatacgccgaggatagggaacgcttttttaaacagcagaatgagatggagattttgacagcccagctgactgaaaaagatagcgatctgcaaaaatggcgggaggaacgggaccaactcgtggcagcccttgagatacaactaaaggctcttatcagctcaaacgtgcagaaagataacgaaatcgagcagctgaaacgcatcatatcagaaacatccaagatagaaacgcaaatcatggatatcaagccaaagcggatttctagtgccgacccggacaaactgcaaaccgaacctctcagtacatccttcgagatttctaggaacaaaatagaagatggttcggtggttcttgatagttgcgaggtctcaaccgaaaatgaccagagcacccggttccccaagcccgagctcgagatccagtttacgccactgcagcccaacaagatggccgtcaaacacccaggctgcaccactccagtgaccgtcaagattccaaaagctcgcaaacggaaaagcaacgagatggaagaggatcttgttaagtgtgaaaataagaagaacgctaccccaagaactaacttgaaatttcctatttcagatgaccggaattccagcgttaagaaggagcagaaagttgccattcgaccttcctctaaaaaaacatatagcctgagatctcaagcctccataatcggggtgaatctcgctaccaagaaaaaggagggcacgctgcagaaatttggagatttcctgcagcacagtcccagtatcctccagtctaaagccaagaagatcatcgagacgatgagcagcagcaagctcagcaatgtggaggccagcaaggagaatgtgagccaacctaagcgcgccaagcgaaagctatacacgtctgaaatatccagccctatcgacatcagtggtcaagtgattctgatggatcagaaaatgaaggagtccgatcaccaaattatcaagaggcgcctgcggaccaagaccgccaaatag

SEQ ID NO: 24348 - DNA, 1485 bp, Artificial Sequence
  Description of Artificial Sequence: Synthetic coding sequence
atgaagctgggcaagaagcccatgtacaagcccgtggacccctacagtcgaatgcagtctacatataattacaacatgcgaggcggggcttatcctccgaggtatttttaccccttcccagtgccccctcttctgtaccaggttgagttgagcgtgggaggccaacaattcaatgggaagggcaagacccggcaagcagcaaagcatgacgctgctgcgaaggccctgaggatccttcagaatgaaccccttcccgagcggcttgaagtaaacggccgagaatctgaagaggagaacctaaataagagtgaaattagccaagttttcgaaatcgcactgaaaaggaacctgcccgtcaatttcgaggtggcccgagaatctggccctccacatatgaagaacttcgtcactaaagtctctgtgggtgagttcgtgggcgaaggcgagggtaaaagcaagaagatctcaaagaagaatgccgccattgccgtactggaggaattaaagaagctacctcctctccctgccgtggagcgggtgaagccacggattaagaagaagacgaaacccattgtcaagacttcgccagaatatggccagggaatcaacccgatttctcgcttagcacagatacaacaggcgaaaaaagagaaagaacccgagtacactttgctcaccgaacggggactgccgcgccggagggaattcgtaatgcaagttaaggtcggaaaccatactgcagaagggacaggcaccaacaagaaggttgctaagagaaacgctgcagaaaatatgctagagattctcggatttaaagtccctcaggcgcagcctacaaagccggctcttaagtcagaagagaaaacgcctatcaaaaagcccggggatggacgaaaggtaacctttttcgaaccaggttccggagacgaaaatgggacctccaataaggaggacgagttcagaatgccatacttatcccatcagcaactgccagctggcattctgcctatggtgccggaagtggcacaggctgtgggggttagccaggggcaccacaccaaagattttacacgggcagcacctaatccagctaaggctaccgttacagcaatgattgcaagagagttgctctatggcggaactagccctaccgccgagactatccttaagaataatatctcctcaggacatgtgccacatgggcccctgacacgcccttctgaacagttggactatctgtcgcgagtccagggattccaggtagaatataaagatttcccaaaaaacaataaaaatgagttcgtgtctttgattaattgctctagccagccgccactgataagtcacgggataggaaaggatgtggagtcatgccacgatatggcagcactaaacatactgaagttgcttagcgaacttgaccaacagagtacggagatgcccagaaccggtaacggccccatgtccgtgtgcggtcgctgttag

SEQ ID NO: 24349 - DNA, 1509 bp, Artificial Sequence
  Description of Artificial Sequence: Synthetic coding sequence
atgaagctgggcaagaagcccatgtacaagcccgtggacccctactctcggatgcagtctacttataactacaacatgaggggtggcgcgtatcctcccagatatttctacccgttccccgtgccacccctgctgtaccaggtggagttaagcgtgggaggtcagcagtttaacggcaagggcaagacccgacaagccgccaaacacgacgccgcagccaaagctttgcgaatcctgcagaacgagcctctccccgaaaggctggaagtgaatggtcgggagtccgaggaggagaatctgaacaagtcagagatttcacaggtgttcgagatcgccctgaagaggaacctaccagtgaattttgaaagttttccattgaaacaggtagcccgtgaatctggacccccccacatgaagaactttgttactaaggtaagtgtgggggaatttgtaggcgagggcgaagggaaatctaaaaaaattagcaagaaaaatgccgctatcgctgttctggaggagctcaagaaactgccacccttgcctgccgtggagagggttaaaccgcgcatcaagaaaaagacaaagcctatcgtgaagcctcagactagcccagaatacgggcaaggcattaacccgatcagcagattggcacagatccagcaagcaaagaaggagaaagaaccggagtacactctgttgacagagcgcggactgccccggcgccgggaatttgtgatgcaggtgaaagtcgggaaccacaccgccgaaggcacaggcaccaataagaaagttgcaaagcgaaatgcagccgagaatatgttggaaatcctcggatttaaggtgcctcaggcacagcctacgaagcccgcgctgaagtcagaagagaagacacccattaagaagcctggagatggcaggaaggtcactttcttcgaacctggctctggcgatgaaaacggtacgtctaataaggaagatgaattccggatgccttatctgtcccatcagcaacttccagcagggatcctacccatggttccggaagttgcccaggctgtgggagtgtctcagggccaccacaccaaagacttcactcgggcagctcccaatcccgccaaggcaaccgtcactgcaatgatcgcgagagaactcctttatggggggaccagcccgacggcagaaacaatcctgaaaaataatatctcttccggccacgtgccccacggaccacttacccgtcccagcgaacagctcgactatctgtctagggtccagggctttcaggttgagtacaaggacttccctaagaacaataaaaacgagtttgtcagcttaatcaactgtagttcccagccaccgctcattagccatgggatcggtaaagatgttgagagctgccacgacatggcagcccttaatatcctgaaattgctcagtgaacttgaccagcagagcaccgagatgccaaggaccggcaatggtcctatgtctgtatgtggaaggtgttag

SEQ ID NO: 24350 - DNA, 1491 bp, Artificial Sequence
  Description of Artificial Sequence: Synthetic coding sequence
atgaagctgggcaagaagcccatgtacaagcccgtggacccctactccagaatgcagtctacctacaactacaatatgcgggggggggcctacccaccacgctatttctacccgttccccgtgcccccccttttatatcaggtggagctatctgtgggaggacagcagttcaacgggaagggcaagacgcggcaagccgcaaagcatgacgccgctgcgaaagctcttagaatcctgcagaacgagccattgcccgagagattggaagtcaatggtcgcgaatctgaagaggaaaatctgaataagagtgagatatctcaggtgttcgaaattgctcttaaacggaatctgcctgtaaacttcgaggtcgctagagaatctggcccaccccacatgaagaatttcgtaaccaaggtctccgttggggaatttgtgggggagggcgaaggcaagtccaagaaaattagtaagaagaatgccgccattgcagttctggaggagttgaagaagcttccaccactgcccgctgtggagagagtcaagccccgaatcaagaaaaagacaaaaccaattgtgaagccccagacctccccggaatatggccagggtattaacccaatctctcgcttggcccaaattcaacaggctaagaaggaaaaggaacctgaatacacactgctgacggaacgcggcctgccgcggcgaagggagtttgtgatgcaggtgaaggttgggaatcatactgctgaaggtaccggcaccaacaaaaaagttgcaaagcggaatgccgcggaaaacatgttggaaatcctaggttttaaggttccacaggcgcaaccgaccaagcctgcgctgaaatcagaggaaaaaacacccattaagaaaccaggagacggccgcaaagtcacttttttcgagccaggatcaggggatgagaacggcacgtctaataaagaggacgaatttcgtatgccttatctctctcaccaacagctccctgctggaatattgcccatggtccccgaggtggcgcaggcggtcggcgtctcacaaggccaccacactaaggatttcactagggccgccccaaatccagcgaaagccacggttaccgccatgattgctagggaactcctgtacggcgggacttcccccactgccgagacaatcctgaagaataacatctcaagtgggcacgtgccccacggccccttaacaaggccatctgagcaattggattatctgtccagagtgcaaggctttcaagtggagtataaagactttcctaaaaataacaagaatgagttcgtaagtctgatcaattgctcatctcagccccctctcatttctcacggcataggcaaggatgtggaaagctgccacgatatggctgcgcttaacattctgaaattgctatccgagttagaccagcagagtaccgagatgcctagaacagggaacggcccgatgtccgtgtgcggtcggtgttag

SEQ ID NO: 24351 - DNA, 1473 bp, Artificial Sequence
  Description of Artificial Sequence: Synthetic coding sequence
atgagcgaggtgaccaagaacagcctggagaagatcctgccccagctgaaatgccatttcacgtggaatctgttcaaggaggattccgtctcccgtgacctggaagaccgcgtctgcaatcaaatcgagtttctgaacactgagttcaaggctactatgtacaacctgctggcatacattaaacacctagatgggaacaatgaggccgcgttggaatgtctgcgccaggcagaggaactgatacagcaggagcacgccgaccaggctgaaatcagatcgttggtcacctggggcaactacgcttgggtttactatcacttaggcaggctgagtgatgcacagatctacgtcgacaaggttaagcagacttgcaagaaattttcaaatccctattcaattgaatacagcgaattagactgcgaggaggggtggacgcagttgaagtgcggaagaaatgagcgggccaaggtatgtttcgagaaagccctggaagaaaaaccaaataaccccgagttctctagtggccttgctatcgcgatgtaccacttagacaatcacccagaaaagcagttcagcaccgatgtgctgaaacaggccatagaactatcaccagataaccaatatgtcaaggttctcctcggccttaagcttcagaagatgaataaagaagcggagggcgaacagtttgtagaagaggcattggaaaagagtccgtgccaaactgacgttctgaggtcagccgcaaagttttacaggagaaagggagacctggataaggccatcgaactatttcagcgcgtacttgaatctacaccaaacaatgggtatctgtaccaccagataggttgctgttataaagctaaggtgagacagatgcaaaacacgggcgagtctgaagcgtctggtaacaaggagatgatcgaggcccttaaacagtacgccatggactactccaataaggccctggaaaagggactgaaccctctcaatgcctactcggatctagcggaattcctggagacagaatgttaccagacacctttcaacaaggaggtcccagatgctgagaagcaacagagccaccagcggtactgcaacctacagaaatataacggcaagtctgaagatactgccgtccagcacggcctagaggggcttagtatctccaaaaagtcaacggacaaggaagaaattaaggaccagccccagaatgtcagcgagaatctgcttccacaaaacgctcctaactattggtacttgcagggcttgatccacaagcagaatggcgatctgttgcaggccgctaaatgctacgaaaaggaattgggaaggctgctgcgggatgcaccaagcgggattggatcaatctttctgtcggccagcgaactggaagatggcagcgaggaaatggggcagggcgctgtgagctccagcccccgtgagctcctctctaactccgagcagctgaactag

SEQ ID NO: 24352 - DNA, 1473 bp, Artificial Sequence
  Description of Artificial Sequence: Synthetic coding sequence
atgagcgaggtgaccaagaacagcctggagaagatcctgccccagctcaaatgccactttacctggaatctatttaaggaggatagtgtgtcacgcgacctcgaagatcgggtctgcaaccagattgagtttctcaacacagaattcaaggctacgatgtacaacctgcttgcctatataaaacacttggacggcaacaacgaggctgcccttgaatgcttgagacaggctgaggagcttattcagcaggaacatgctgatcaggcagagatcaggtccctggtaacctggggcaattatgcatgggtctactaccaccttggcagattatcagacgcacagatttacgtggataaggtcaagcagacttgcaagaaattctctaatccatattcgattgagtattctgagctcgactgtgaggaaggctggacccagctgaagtgtggccggaacgaacgcgccaaagtgtgttttgaaaaagccctggaggagaaacccaataaccccgagttctctagcgggctggccattgcaatgtatcatctcgataaccaccccgaaaagcagttttcgactgacgtacttaaacaagctatcgagttgtcccctgacaaccagtatgtgaaggtgctgctaggactaaaactgcagaagatgaacaaggaggctgaaggtgagcagttcgtcgaagaggctttggagaagtccccatgccagacagatgtccttcgatccgccgctaaattttatcggaggaagggggacttagacaaggcgattgaactcttccaaagggtgctggaatcaacacccaataatggctacctgtatcatcagattggttgctgttacaaagccaaggtgagacagatgcaaaatactggcgaaagcgaggcctcaggtaataaggaaatgatagaggccttaaagcagtatgcaatggactacagtaacaaggccctcgagaaggggttgaacccactaaacgcttactccgatctggcggaattcctcgagaccgaatgctaccagacacctttcaataaggaggtcccggatgccgagaaacagcagtcacaccagagatactgcaacctgcaaaagtataatggaaagagcgaggacacagcagtgcagcatggccttgaaggtcttagtatcagcaaaaaatctactgataaagaggaaatcaaagaccagcctcagaacgtgtcggaaaatctgctgccccagaatgcccccaattattggtatctgcaagggttgattcacaagcaaaatggggatctcctgcaagcggcaaagtgttacgagaaagagctgggcagactgctcagggatgctccatcaggcattggaagcattttcctcagtgcgagcgagctggaggacgggtcagaggagatgggacagggtgccgtttcaagcagcccaagagaactcctctctaattctgaacaactgaactag

SEQ ID NO: 24353 - DNA, 1509 bp, Artificial Sequence
  Description of Artificial Sequence: Synthetic coding sequence
atgaagctgggcaagaagcccatgtacaagcccgtggacccctacagccggatgcagagcacatacaactataacatgcggggaggagcctatccaccaagatacttttaccctttcccggtacccccacttttataccaggtcgaactgtctgttggtggccagcagttcaatggcaagggaaagaccagacaggccgctaagcatgatgccgccgctaaggcgctcagaatcttacagaacgaacccctccccgagagattggaggtcaatggtagggagtcagaggaagagaatctaaataaatctgaaatatcccaggtgtttgagatcgcactgaagcgaaacctgcccgtgaacttcgagagctttccactcaaacaggtagccagagaatctggcccaccgcatatgaagaactttgtaacgaaagtgagtgtgggagaattcgtgggtgaaggtgagggtaaatcaaagaagatctctaaaaagaacgcagcaattgccgtcctcgaggaactgaaaaaattgccgccactcccggctgttgaacgggtgaagccaagaattaagaaaaaaaccaaaccaattgtgaagccacagaccagtcccgagtatggccagggaatcaaccctattagccgtctcgcccagatccagcaggcgaaaaaggagaaagagcctgagtacactctgctgacagagcggggactaccccggaggagagaattcgttatgcaggtgaaagtgggaaaccataccgctgaaggaacaggtactaacaaaaaagtagctaagaggaacgctgcagagaacatgttggagattctcggcttcaaagttccccaggcacagccgaccaaaccagccttgaagagcgaagagaagactcccattaaaaaaccaggcgatggccggaaggtaacatttttcgaacccggctccggcgatgaaaacggaacctctaacaaggaagacgaatttagaatgccttacctttcgcaccagcagctgcctgccggtatcctgccaatggtacctgaggtggcccaggccgtgggagtgagccaggggcaccacactaaggacttcaccagggcagcacctaaccccgcgaaggcaaccgtgacggctatgatcgcccgggagcttctgtacggagggacttccccaacagctgagacaatactaaagaacaacatctcctctgggcatgtccctcacggacccctgacccgacctagcgagcagctggactatcttagtagagtccagggattccaagtggagtataaagacttcccaaaaaataacaagaatgagttcgtgagcttgatcaattgttcatcacagcctccccttataagccacgggattgggaaagacgttgagagttgtcacgacatggctgccttaaatatcctgaaactactttctgaactggaccagcagagcactgaaatgccaagaaccggcaatggaccaatgtctgtttgcgggcgttgttag

SEQ ID NO: 24354 - DNA, 654 bp, Artificial Sequence
  Description of Artificial Sequence: Synthetic coding sequence
atggccgagggcagccagagcgcccccgaggccggcaacgacatgggtaatgacgacgcaattggcggtaatgtctccaagtatatcgttctgcctaccggctactgtgggcaacccaaaaagggtcacttgatttttgatgcttgttttgagtctggaaacttggggagggtcgaccaggtcagtgagttcgagtatgacctgtttatccgcccggacacctgtaaccctcggtttcgggtttggttcaattttacagtcgaaaacgtcaaggagagccagcgggtgattttcaacatagtcaattttagtaaaaccaagtctctgtatagagatggcatggcccctatggtaaaatctaccagtaggcccaagtggcagagactcccgccaaaaaatgtctactattataggtgcccggaccacaggaagaattacgtaatgtcattcgctttttgcttcgaccgcgaagaggatatctaccagttcgcatactgctatccctacacatacacccggttccaacattacttagatagcctccaaaaacgcaatatggactactttttccgggaacaattggggcagtccgttcagcagcggaaacttgatctacttaccataacttcccccgctggtcggtggagctggtag

SEQ ID NO: 24355 - DNA, 963 bp, Artificial Sequence
  Description of Artificial Sequence: Synthetic coding sequence
atggccgagggcagccagagcgcccccgaggccggcaacgacatgggcaacgatgatgcaattggggggaatgtgagtaagtatatcgtcttacccacaggctattgtggtcaaccaaagaagggccacctgatctttgatgcctgctttgagagcggaaatctgggtagggtcgatcaggtgagcgagttcgagtatgacctattcattagacctgatacatgtaacccacggttccgcgtgtggttcaattttaccgtagaaaatgtcaaggagtcacaacgggtgatcttcaatatcgtcaacttcagcaagaccaagagtttgtacagggacggtatggccccgatggtcaagagcacgagccgtcctaagtggcaaagattgccccctaaaaatgtgtattattatcgatgccctgatcacagaaagaactacgtcatgtcatttgcgttctgcttcgaccgagaagaagacatatatcagttcgcatactgctacccttacacctacactcgcttccagcattatctggattctctacagaaacgcaatatggactacttctttagagagcagttaggtcagtctgtgcaacaacgcaaattggatctcctgactattacatcgcctgataatctgagggaaggcgctgaacagaaagttgttttcatcacgggccgggtccaccccggtgagactcccagtagtttcgtttgtcagggcatcattgacttcctcgtaagtcagcatcctatcgcctgtgtgttgcgtgaatatcttgttttcaagatcgccccgatgcttaatcccgatggcgtttatctgggcaactaccgatgttcattaatgggtttcgatttaaataggcactggctggatccttccccctgggtccatcctactctgcacggcgtcaagcagctcatcgtgcagatgtataatgaccccgtgtcaaactag

SEQ ID NO: 24356 - DNA, 1512 bp, Artificial Sequence
  Description of Artificial Sequence: Synthetic coding sequence
atggccgagggcagccagagcgcccccgaggccggcaacgacatggggaatgacgatgccatcggcgggaacgtgagcaagtatatcgtgctgcctacgggctattgcggtcagcctaaaaaaggtcacctcatctttgacgcttgtttcgaatccggaaacctgggtcgggtggaccaggtgtcagagttcgagtacgatttattcatcaggcctgatacatgtaatccccgcttcagagtgtggtttaatttcactgtggagaatgtgaaggagtctcagagggttattttcaacatcgtcaacttttcaaagaccaagtccctatatagggacgggatggcaccgatggtcaagtctacctcaaggccaaaatggcagagactcccaccaaaaaacgtgtattattataggtgtccagatcacaggaaaaactatgtgatgtcctttgcattttgcttcgacagggaggaggatatctatcagtttgcttattgctacccgtacacctacacccgttttcagcactacctggacagcttacagaagaggaacatggactactttttccgggagcagctgggtcagtccgtgcagcagcggaagctggatctgctcactatcacgagtcccgacaatctgcgcgaaggagctgagcagaaagttgtgtttatcaccggaagagtccatcccggggaaacaccttcttcctttgtgtgccaggggattatcgactttctcgtgtcccaacaccccattgcatgcgtgctgagggaatacctcgtgtttaaaatagcacctatgctcaatccggacggggtgtatctggggaactatcgatgtagtctgatggggttcgacttaaaccgacactggctggatcctagcccttgggtgcatcccacactgcatggggttaagcagctcattgtccaaatgtacaatgatcccaaaacatcccttgagttctatatcgatatccatgcgcatagcacgatgatgaatgggttcatgtatggcaacatattcgaggacgaggagcggttccaacgtcaggctatattccccaaactgctttgtcagaatgctgaagatttttcatacagctccacctctttcaatagagatgcagtgaaggcgggcaccggccgacggtttttggggggactgctagatcacacctcatactgttatacccttgaggtgagcttttattcctatattattagcggcaccactgcagcagtaccttacacggaggaggcatacatgaagctcgggcggaacgtggccagaacctttctggactactacaggttgaacccggtcgttgagaaggtggctattcccatgcccagactgagaaataaggagatcgaagttcagaggagaaaagaaaagagccctccgtacaaacatccgctcctcagaggcccggcaagtaattatcctaattccaagggagacaagaaaagctccgttaaccacaaagaccccagcactccgttttag

SEQ ID NO: 24357 - DNA, 1734 bp, Artificial Sequence
  Description of Artificial Sequence: Synthetic coding sequence
atgagccaggtgcaggtgcaggtgcagaaccccagcgccgccctgagcggatcccaaatcttaaacaagaaccaaagcttgctttcccaacccctgatgtcgataccatctacgacttcctcgctcccaagtgagaatgctgggaggcctatccagaattcagctttgccttctgcttccatcacgagtacttctgccgccgccgagtccattactccaactgtggagctcaatgccctgtgcatgaagttgggtaaaaaaccaatgtataagccagtggatccatattcgcggatgcagtcgacatataactacaacatgcggggcggagcctatccccccaggtacttctaccccttcccagttcctcctctgttgtatcaagtggaactgagcgtgggaggacagcagttcaacggaaaggggaaaacccggcaggctgccaaacacgatgctgccgctaaggccctgagaatcttgcagaatgaacccctaccagaacgactggaggtcaacgggagagagagcgaagaagagaacctgaataaatcggaaatcagccaggtgttcgagatcgccctaaagcgaaacctccccgtcaacttcgaagttgctagagaatccgggccaccacatatgaagaattttgtcactaaggtgtctgtaggagaattcgttggagaaggagaagggaagtcgaaaaaaatcagtaagaagaatgcggctattgccgtgctggaggaactgaagaagttacctcccttgcccgcagtcgaaagagtgaagcctaggatcaagaagaagactaagcctatcgttaaaccccagacctcacccgaatatggccaggggataaaccctataagcagacttgcacaaatccagcaagcgaagaaggagaaggagccggaatacacattattgaccgagcgtggccttccgaggcgcagagagttcgtaatgcaggtgaaagtggggaaccataccgctgaagggacgggcaccaacaaaaaagtagcgaagcggaatgcagctgaaaacatgctggagatactaggctttaaggtgccccaggctcagcccaccaagcctgcccttaaatccgaggaaaagactccaattaaaaagcctggcgatggacgcaaggtcactttttttgagccaggatcaggagacgaaaatggtacaagtaataaagaggacgaattccgtatgccctacctgtcccaccaacaactccccgccggcattttgcctatggtccctgaggtggcccaggctgtgggcgtgagccaggggcatcacacgaaggatttcactcgcgctgctccaaaccccgcaaaggcaacagttacagcaatgattgctcgggagctcctctatggggggacctctcctaccgccgagactatcctgaagaacaatatttcctccggccatgtgcctcatggcccattaacaaggccctctgaacagcttgactacttaagccgtgtgcagggctttcaagtcgagtacaaagactttcccaagaataataagaatgagttcgtgagcttaattaactgttcttcccaaccacctctaatcagccacggaataggtaaagatgttgagagctgtcacgatatggccgccctgaatatcctaaagctgctgagtgagctggaccagcagtcgacggagatgcctcggacaggaaatgggcccatgagcgtctgcggtcgctgctag

SEQ ID NO: 24358 - DNA, 852 bp, Artificial Sequence
  Description of Artificial Sequence: Synthetic coding sequence
atgagcggcgccgtgctgctggagcgggagcggctgaccagcggcacgacttggcacaccgctggattactttggcagctgcggccatcagatgtggaggtggagctccttgctcacacacggagggtagtgagccgggagcttgaggaagaaaccggtctgcacactggatggatccagaacggggggttatttatagcatccaatcggcagcgcttggacgaatacaagaggctcatgtccctgggcaaagcctacggggtggagtcccacgtactaagtcccgccgaaacgaagaccctgtacccactgatgaacgttgatgatctgtatggtaccctgtacgtgccccatgacggcactatggatcccgctggcacctgtaccacactggcaagggccgcgtccgcaagaggggctcaggttatcgagaattgccctgtgacaggcatccgcgtgtggacagacgattttggcgtgcgccgagtcgcaggggtcgaaacgcaacatggatcgattcagactccttgcgtcgtgaactgcgctggagtgtgggccagcgctgtaggtcggatggccggagttaaggtgccattggtcgctatgcaccacgcatacgtggtgactgaaaggatcgagggcatccagaacatgcctaatgtacgtgatcacgacgcttccgtgtacttacggctgcaaggcgatgcgttgagtgttgggggctacgaggcaaaccccatattctgggaggaggctgtgaagtatcggccccgcgcagccggcggcttatgcctgaaaacctccaccgaaaaagtttgcgccgtatggtctgatgatctaaggcgagcttag

SEQ ID NO: 24359 - DNA, 1107 bp, Artificial Sequence
  Description of Artificial Sequence: Synthetic coding sequence
atgagctacttcggcaagttctacctggtgggcctggacgcccggaaagcggccgactggctgttcagcgctgatgtatctcgcccgccaggttccacagtgtacacttgcatgctgaatcaccggggcggtacggagtcagatctcactgtctcacgacttgctcccagtcaccaagcctcgcccctcgcccccgccttcgaaggggatggttattacctggccatgggcggcgccgttgctcagcataattggagccacattacaaccgtgctgcaagatcagaaaagtcagtgtcagctgatagatagttccgaggatctgggaatgatctccatacagggcccagcaagccgagcaatcctgcaggaagtcctggacgcggacctgagcaacgaggcctttcccttttcaacccacaaacttctgcgggccgctgggcatctggtccgggcaatgcggctgagttttgtcggagagttaggctgggagctgcacatcccaaaggcttcatgcgtgcccgtctatcgagcagtcatggctgcgggcgctaaacatgggcttatcaatgcaggctatcgcgccattgactctttaagcatcgagaagggctacaggcactggcatgctgacttgcggcctgacgactccccactggaggcgggactggcattcacctgtaagctaaaatcgcccgtgccatttttggggagggaggcactcgagcagcagcgagcggccggcttaaggaggcggttggtgtgttttacaatggaagagcctctgtggacccgcccacatccagctgtaagtggcgcccctgcattcagtaccgcgtcttctagtaaggttccgatgttcggcctcgaagctatatggaggaatgggcaggtggtgggacatgtacggcgcgctgatttcggatttgctattgacaaaaccattgcgtacggatatatccacgaccccagtggcgggccagtgtctttggattttgtcaagtcgggggattacgcccttgaacggatgggagttacctacggcgcacaggcccacctcaaaagcccattcgatcccaataataagagagtgaagggaatctattag

SEQ ID NO: 24360 - DNA, 2757 bp, Artificial Sequence
  Description of Artificial Sequence: Synthetic coding sequence
atggccagcctgagccgggccctgcgggtggccgccgcccacccccgtcagagtccgaccagaggaatgggcccgtgcaacctttcctcagctgctggccccaccgccgaaaagagtgtaccctatcagaggactctgaaggaagggcagggaacctccgtagtggcccaaggtccatcacggccattaccttctaccgccaacgtggttgtgattggtggcggatccctgggatgtcagactttataccatctcgccaaattggggatgtcaggagccgtcctgctagagcgagaaaggctgacctcgggaaccacctggcatacggccggcctattatggcagctgcgacccagtgatgtggaggtcgaactgttggcgcataccaggcgcgtggtgtcacgcgagctggaagaggagacggggctgcataccggatggatacagaacggggggctgttcatcgcttccaataggcaacgcctggacgaatataagaggctgatgtccctgggtaaggcctatggagtggaaagtcatgtactatcaccagccgaaacgaagactctgtatccactgatgaacgttgatgatctttatggtacactgtatgttcctcatgatggtacaatggaccccgctggcacctgtaccacgttagcgagagcagcctccgccagaggtgctcaggtcatcgagaattgtcccgttacaggcatccgcgtctggaccgatgacttcggcgtgcgccgagtggctggagtggaaacccagcacggctcaattcagacaccttgtgtggtgaattgcgccggcgtgtgggcgagtgcagttgggagaatggcaggtgtgaaagtgcctctggtggctatgcaccacgcctacgtcgtgacagaacgcatcgagggtatccagaatatgccaaacgtgcgagatcatgacgcttcggtgtatctacgcctccaaggagatgcactgtccgttggcggatacgaggcaaacccaatcttttgggaggaagtgtccgataaattcgcttttggcctattcgacctagattgggaggtcttcacgcaacacatcgagggtgctatcaaccgggtacccgtcctggaaaagacaggcataaagtcaaccgtgtgcggtcccgagtctttcacccccgaccacaagcccttaatgggtgaagcgccagagctgagaggattctttctcgggtgtggatttaatagcgccggcatgatgctcgggggcgggtgtgggcaggagttggctcactggatcatacatggtcgccctgaaaaggacatgcacggctatgatatcaggaggtttcaccattcactgaccgaccacccaaggtggatccgggagcgaagccacgagtcttatgctaagaactacagtgtggtgtttccacacgacgagccccttgctggaagaaatatgcggcgggacccactccacgaagagctcctggggcagggctgtgtgttccaagagcgccacggatgggaacgaccagggtggttccacccacgcggacctgcacctgtgctggagtatgattactacggcgcctacggtagcagagctcacgaggactatgcctatcggcgtctgctggcagatgaatacacatttgccttcccaccacaccatgataccattaagaaggagtgtttggcctgtaggggcgcggcggctgttttcgatatgtcttactttgggaagttttatctcgtcggactggacgcccggaaggccgcggattggctgttttcagcggatgtcagtcgcccccccggaagtaccgtatatacatgcatgctaaaccacaggggcgggaccgagagcgatttgacagtttctagactggctccgagccaccaggcttccccactcgccccagcctttgagggagatggctattaccttgccatgggcggcgcagtggcacagcataactggtcgcacatcaccactgtgctccaggaccagaaatctcaatgccaacttattgactcatccgaggacttggggatgatctcaatccagggtcccgcttccagagccattttgcaggaggttttagatgctgatctgagtaacgaggcctttcccttctcaactcacaagcttctgcgggctgccggccatctggtacgggcaatgcggttatcgttcgtcggggagttgggatgggaactacatattcccaaggcctcttgcgtgcccgtgtaccgagctgtcatggcagcaggcgccaagcacggccttatcaacgctgggtacagggccatcgacagtctttccatcgagaaaggctacaggcactggcatgcagacctgcggcccgatgattctcccttggaagctggcctcgcattcacttgcaagctcaaatctcctgtccccttcttgggtcgggaggctctcgaacagcagagggcagccggcctgcggagacggttggtgtgttttactatggaagacaaggtccccatgttcgggctggaggccatctggcgcaacggccaggtggtcggccacgtccgccgagccgattttgggttcgcaattgacaaaacaattgcttatggctacattcacgacccctccggaggtccagtcagcctcgattttgttaaatccggagactacgcccttgagcgaatgggggtgacctatggcgcacaggctcatctcaaaagccccttcgatcccaacaacaagagggttaagggcatatattag

SEQ ID NO: 24361 - DNA, 720 bp, Artificial Sequence
  Description of Artificial Sequence: Synthetic coding sequence
atggagggcaccgtggagagccagacccccgacctgcgggacgtggagggtaaggttggccgcaagacccctgaaggcctcctgcggggcctgcgtggggagtgtgaacttggaacctctggcgccctcctcctgcccggcgcaagctccacaggtcacgatctgggtgacaagattatggcactcaagatggagttggcttacctgagggctattgatgttaagatcctccagcaactggtgaccttgaacgaggggattgaagcggtacgttggctcttggaagaaaggggaaccctaacatcacattgctcgtctctgacaagctcacaatactccctgacgggtggttcacctgggaggagtaggagaggaagctgggacagtctcccggatacgagcactaccgaccgactcgacagcgtctccataggctcatttctggataccgtggctccctctgaactggatgaacaggggcccccaggagcaccccggtcggaaatggattgggcaaaggtgatagccggtggtgaacgagccaggacagaggtcgacgttgctgccacccggctcggatctctgcgcgctgtgtggaagcctcccggcgagcgactgcagggagggccacccgagtctccagaagacgagtccgctaaactggggtttgaagcccattggttttgggaacagtgccaggatgacgtgacctttctgtag

SEQ ID NO: 24362 - DNA, 294 bp, Artificial Sequence
  Description of Artificial Sequence: Synthetic coding sequence
atgagcagcggcaacgccaagatcggccaccccgcccccaacttcaaggccacagctgatgaaggtatttccttccgggggctgttcatcatcgatgacaaaggaatattaaggcagatcaccgtgaacgacctccctgttgggcggagtgtcgacgaaactctgagactggtccaggccttccagtttactgacaagcatggagaggtgtgtccagcagggtggaaaccgggttctgatacaatcaaaccagacgtgcagaagtctaaggaatactttagtaagcagaagtag

SEQ ID NO: 24363 - DNA, 1668 bp, Artificial Sequence
  Description of Artificial Sequence: Synthetic coding sequence
atggaccggagcaagcggaacagcatcgccggcttccccccccgggtggaaagattggaggaatttgaaggagggggagggggagaaggcaatgtgagccaggtaggccgggtctggcctagtagctatcgcgccctgatcagcgctttcagtcggctcactcggctagacgactttacctgcgagaaaattggttccgggttcttcagcgaggtattcaaagtaaggcatcgggcgtccgggcaggttatggccctgaagatgaacaccttatccagtaatcgcgcaaacatgctcaaagaggtccagcttatgaaccgcctcagccacccaaacatactgcgttacattaactccggtaatttggaacaactgttagactcaaacctgcacctcccttggactgtccgcgtcaagttggcctacgatatagccgtcggcctgtcctatctccacttcaaggggattttccaccgtgatctgactagtaaaaactgtctgattaagagggatgaaaacggctacagcgccgttgtggcagattttggactggccgagaaaatccctgatgtctcgatgggttcagaaaaacttgcagtcgttggatcccccttttggatggcccctgaggttctgagggacgaaccttacaacgaaaaagcagacgtcttttcatacggcatcatcctgtgcgagatcatagctcgcatccaagctgaccctgactacctgccgcgaactgagaactttggtctggactatgacgcctttcagcatatggtaggggactgtccaccggactttctgcaactgacatttaattgctgtaatatggatcccaagctgcgcccctccttcgtggagatcggcaaaaccctggaggaaattctgagccgtcttcaggaggaagagcaggagagagatcggaaactgcaacccaccgcaagaggactgctggagaaggctcccggggtaaaacgccttagcagcctagatgataaaatcccacataaaagtccttgcccacgccgaacaatctggctctctagatcacagagcgacatcttctctaggaaaccacctcggacagtgtccgtattagacccttactacagacccagggatggtgccgccagaacccctaaggtaaaccctttctctgcaaggcaggacctgatgggcggcaaaattaagttctttgacttaccctctaagtctgtcattagtctggtctttgacctggatgcccctgggcctggcacgatgcccctggcggattggcaggaaccactcgccccaccaatccgaaggtggcggtcactaccaggatcacctgaattcttgcaccaggaagcgtgtcccttcgtgggccgtgaagagtctttgagtgacggccccccacctaggctaagcagcctaaaatatcgggtcaaggaaattccaccttttagagcgtcagcgcttccagccgctcaagcacacgaggccatggattgctctatcctacaagaggagaatgggtttggctcacggccacagggtacgagcccgtgccctgcgggggcctcagaggaaatggaagttgaggagaggccagccggatctacccccgctacatttagtacgagtggcattgggctgcagacacaggggaagcaagacgggtag

SEQ ID NO: 24364 - DNA, 1629 bp, Artificial Sequence
  Description of Artificial Sequence: Synthetic coding sequence
atggaccggagcaagcggaacagcatcgccggcttccccccccgggttgagcggctggaagagttcgaggggggcggagggggtgaagggaacgttagccaggtaggccgtgtgtggccaagttcctacagagcactgattagcgccttctcgcggcttacaaggctcgatgatttcacttgtgaaaagataggttccggcttcttcagtgaagtgttcaaggttagacatagagcgagcggacaggtgatggccctgaagatgaatactctgtccagtaaccgagctaacatgctcaaggaggtgcaactcatgaaccggctgagccacccaaacatcctccgcttcatgggtgtatgtgtgcaccagggtcagctgcacgctctgactgaatatatcaattctgggaatctcgagcagctgctagactcaaatctgcacttgccctggaccgtgcgtgtgaaacttgcatacgatatcgccgtcggactcagctacctccattttaagggcatctttcaccgagacctcacgtccaaaaactgtctgatcaagagggacgaaaatggctattcagccgtggtcgcagacttcggtctggctgagaagattcctgatgtgtccatggggtccgagaagcttgccgttgtggggtcccccttttggatggcaccagaagtgctccgggacgaaccctataatgagaaagcagatgttttttcatacggtatcattctatgcgagatcatcgctcgtatccaggccgatcccgattacctgccaagaacagagatggaccccaaattacgcccttccttcgtcgagatagggaaaacgctcgaagaaatcctgtcaaggctccaggaggaagaacaggagagagaccggaagctgcagcctacagcgaggggcctcctggaaaaggcacccggtgtaaaacggttatcctctctggacgacaaaataccacataagtccccctgtccccggagaacgatctggctttccagaagtcagagcgacatcttctcacggaaacctccgcggacggtttcagtgctcgatccctattaccgcccccgcgacggagcagcccgcacacccaaagtgaatccattcagtgccagacaagacctaatgggggggaagatcaaatttttcgacctgccatcaaagtcagttatttctctcgtgttcgacctggatgcacccggccctggcacaatgcctctagccgactggcaagaacccctggcacctcccatccgaagatggcgctctctacccggtagcccagagttcctccatcaggaagcctgcccattcgtgggtcgggaagagagcctgagtgatggacccccaccacggctgtcaagcctgaaatatcgggtcaaagagatcccgccttttagagcttctgcgctccctgctgctcaagcccacgaggccatggactgctctatcctgcaggaagaaaatggctttgggagccgaccccaggggacctccccttgcccagccggagcgagcgaagagatggaggtggaggagcggcctgcgggctcaacacctgcaacctttagtaccagtgggatcggtctccagacacagggaaaacaggacgggtag

SEQ ID NO: 24365 - DNA, 1716 bp, Artificial Sequence
  Description of Artificial Sequence: Synthetic coding sequence
atggaccggagcaagcggaacagcatcgccggcttccccccccgggtagagcgccttgaggagtttgagggtggcggcggcggggaagggaatgtgtcacaagttgggagggtctggccaagctcatatcgggccctgatcagtgcatttagcagactcacacgactggatgactttacatgcgagaaaatcgggagcggttttttttcagaggtgtttaaggtgcggcacagagcctctgggcaggtcatggccctaaagatgaacaccttatccagcaaccgagcaaatatgttgaaggaggtgcaactcatgaaccggctctcacacccaaacatcctaaggttcatgggagtctgcgttcaccaagggcagctccatgccttgacagaatatatcaactcaggtaacctggaacagcttctggactctaaccttcatctgccatggacagtccgcgtaaagctcgcatacgacattgccgtgggcctgtcttatctgcattttaaggggattttccatcgggacctgaccagcaaaaattgcttgattaagagggacgagaacggatacagcgccgtcgtagcagactttggcctcgccgagaaaatccccgatgtttctatgggcagcgaaaagcttgcagtggtgggaagccctttctggatggcccccgaagtgcttcgggacgagccgtacaatgaaaaggccgacgtgttcagctatgggataattttatgtgagatcatcgctaggatccaggcggaccctgattaccttcctaggaccgagaactttggtttggattacgatgcgttccagcacatggtgggagattgtccacccgattttctgcaactgacatttaactgttgtaacatggaccctaagctgcgcccttcgtttgttgagatcggcaaaaccttggaagaaatcctgtcacggcttcaggaagaagagcaagagagggacaggaagctgcagcccacagccaggggactgctagagaaagcccctggcgtgaaaaggctgtcttctttggacgacaagattccccataagtccccgtgcccccgcaggactatatggctctccagaagtcaatccgatatctttagtcgcaaaccgccaaggaccgtgtctgtactcgatccttattacaggcccagggatggcgctgccagaacccctaaggtgaacccctttagcgctcgtcaggacctcatgggtggcaagatcaaattttttgatttaccgtccaagtctgtgatttccctcgtcttcgatcttgatgcaccgggaccaggcacaatgcctttggcagattggcaggaacctttagctcctcccattcggcggtggagatcccttcctgggtcccctgaatttttgcaccaggaagcttgtccctttgttggcagagaagagtccctgtctgatgggccccctcctaggctcagtagcctgaagtaccgtgtaaaggaaatcccaccgtttagagcttcagctctgccggccgcccaggcccatgaggccatggactgttccatactgcaggaggagaatgggttcgggtcccgcccccagggcaccagtccctgtcctgccggcgcttccgaggagatggaggtcgaagaaagacctgccggatccactcctgccactttttccacttccggaatcggcctgcaaacgcaggggaagcaagacggatag

SEQ ID NO: 24366 - DNA, 1416 bp, Artificial Sequence
  Description of Artificial Sequence: Synthetic coding sequence
atgctgggcagctggggctgctaccggtacgccaagctgttcagctgcagcctgtctacccacgccaggttcatcaaaatcctggatagcgtactgcaccaccttgtgcctgcttgggaccatacactcgggactttcagcgagatcaagcaggtcaagcagttccttctgcttagtaggcagcgcccaggccttgtggctcaatgtctgcgcgattccgagagctctaagccgtccttcatgcctagattgtacatcaacagacggcttgctatggagcaccgggcttgtccctcaagagacccggcctgtaaaaatgctgtctttacgcaggtgtacgaggggttgaagccgagcgataagtatgagaagccactggattaccgctggccgatgaggtacgaccagtggtgggagtgcaaatttatcgccgaggggatcatagaccaagggggcggatttagagatagtctggctgacatgtcagaggaattgtgtcctagctcagcagataccccagtgcctcttccattcttcgtgaggactgcgaaccagggaaatggcaccggggaagccagagatatgtatgtacctaacccatcttgcagagactttgcaaaatatgagtggatcgggcagctgatgggtgcagccttacgtggaaaagaatttctcgtcctggcgctgcccgggtttgtgtggaagcagcttagcggtgaggaggttagttggagcaaagatttccctgccgttgactccgttctggttaagctgctcgaagtgatggaaggcatggataaggagacatttgaatttaagtttggcaaggaactgacttttacaacagtcctgtccgatcagcaggtcgtggaactgattcctggaggagccgggatcgttgtgggctacggagaccgcagccggtttatacagttggtccagaaggccaggctggaggagtctaaggaacaggtggcggcaatgcaggccgggttgctcaaagttgtgcctcaggctgtgttggaccttctgacctggcaggaacttgaaaaaaaggtctgtggggatcccgaggtaacagttgacgcactgaggaagctaacccggttcgaggacttcgagccttcggattcccgggtccagtatttctgggaggccctgaataacttcacaaacgaggacaggtcaaggttcctccggtttgtcacaggacgctccagattgcccgcccggatttacatctatcccgataagcttgggtatgaaacgactgatgccctcccggagagcagtacttgtagttcaacgctgtttttaccacactacgcgtctgcaaaggtatgcgaggagaagcttcggtacgcggcctacaattgcgtagcaatcgacacagatatgagcccttgggaggaatag

SEQ ID NO: 24367 - DNA, 825 bp, Artificial Sequence
  Description of Artificial Sequence: Synthetic coding sequence
atggccgcccccgaggccgaggtgctgagcagcgccgccgtgcccgaccttgaatggtatgaaaagtccgaagaaacccacgcatcgcagattgaactcttggagacaagctccacacaggaaccgctcaatgcctcagaggcattctgccctcgtgattgtatggtgccggttgtattccccgggcctgtgagccaggagggatgttgccaattcacttgcgaactgctaaaacacattatgtaccagcgacagcaactgcccctgccttacgaacagctgaagcatttttaccgtaagccaagtccccaggcagaggaaatgctgaagaaaaagccacgcgcaactacagaggtgagctcaaggaaatgccagcaggcgcttgcagaactcgaaagcgtgttaagccatttggaggatttcttcgctcgcacactggtgcccagagtgttgattctcctgggtggtaatgcgctgtcaccgaaggaattttatgaactggacttgtcactgttggcaccatattccgtggaccagtcactgtctaccgcggcatgtttacggcggctgtttagagcaatcttcatggcggatgcattctcagaattgcaggcacctcccctgatgggaacagtggtgatggcccagggccacaggaactgcggcgaggactggtttcggcccaagctaaactatagggtcccctcgagaggccataagctgacagtcactttatcctgcggtcgcccctctatccggactaccgcctgggaggattacatctggttccaggcacctgttaccttcaagggatttcgggagtag

SEQ ID NO: 24368 - DNA, 2586 bp, Artificial Sequence
  Description of Artificial Sequence: Synthetic coding sequence
atggccggccccggccccggcgccgtgctggagagcccccggcagctgttgggtcgggtgcgcttcctggccgaggcagcacggtctctgcgcgcaggccgacctttacctgctgcgcttgcttttgtgccccgcgaggttctatataagctctataaagatcctgcgggcccctctcgcgtgctccttcctgtgtgggaagctgagggcctagggctgcgagtcggggctgccggacccgcaccaggtacaggcagcggcccactccgcgctgcgcgggattccatcgaactcagaagaggcgcttgcgttcggacaaccggcgaagagctgtgcaatggtcacggattatgggtaaaattgaccaaggagcagctggccgagcacctaggcgattgtggactacaggaagggtggttactggtgtgccggccggccgaaggcggagccaggctcgtgccaattgatactccaaaccatttgcagaggcaacagcagcttttcggcgtggattatcgtcctgtccttaggtgggaacaggtggtcgacttgacatactcgcatcgcttgggctctagaccccagccggcagaggcctatgccgaagctgtacaaagactcctatacgtacctcctacatggacctatgagtgcgacgaagacctgatccatttcttatacgatcacttgggtaaagaggatgagaatttaggctcagttaagcagtacgtggagtccattgatgtctcttcctataccgaggaatttaatgtgagttgtctgaccgattctaatgcggacacatactgggaatctgatggttcccaatgccaacattgggtgcgattaacgatgaagaaaggcacaattgtgaaaaagctgctccttacagtggacaccactgacgacaatttcatgccaaaaagagtggtcgtatacggtggcgaaggagataaccttaagaaactctccgacgtgtctattgatgagaccctgataggtgatgtttgcgtgctggaagacatgacagttcatctgcctatcattgaaattagaatcgttgaatgtcgcgacgatggcattgacgtacggttgaggggtgttaagatcaaatctagcaggcagagggaactgggcctgaacgcagacctgtttcaacctactagcctggttcggtacccaaggctggagggcacagaccctgaagtgctctaccggcgagctgtcttgctgcaacggttcatcaaaatcttggatagcgttctgcatcacctcgttccagcttgggatcataccttggggaccttcagtgaaataaagcaggtcaagcagttccttctgctaagtcgtcaacgtcctggactcgtagcccagtgcctcagggatagcgagtcctccaaaccctccttcatgcctcgcctgtatatcaatcggcgcctggctatggagcatcgggcttgtccaagccgtgatccggcctgcaagaacgcagtgttcacacaagtgtacgaaggtcttaaaccaagcgacaagtacgagaagcccctcgactatcggtggccaatgcgctacgatcagtggtgggagtgtaagttcattgcggaaggaataatcgaccagggcggaggctttcgcgattctctcgccgatatgtctgaagagctttgtcctagcagcgccgacacaccagtcccccttccattctttgtgcggacagcaaatcagggtaacgggaccggagaggcccgcgatatgtatgtcccaaacccttcgtgccgcgactttgccaaatatgagtggatcggacagctgatgggcgctgctctgcgcgggaaggagtttctggtgcttgccttgcccggcttcgtctggaagcagttgagtggtgaagaggtatcctggtccaaagactttcccgccgttgattcagtcctggttaagctgcttgaggtgatggagggaatggacaaagaaacctttgagttcaagttcggcaaagagctgacctttaccaccgtgctcagtgatcagcaagtggttgaacttatacctggcggtgctgggatcgtagtcgggtatggcgaccgaagtcgcttcatccaactcgtgcagaaagcacgcctggaagagagtaaagagcaagtagctgctatgcaggcggggctgctgaaagtcgtcccacaggcggttctggacctcctcacatggcaagaactcgaaaaaaaggtgtgtggcgatccagaggtcactgtcgatgctctgcgcaagctgaccagattcgaggatttcgagccctctgacagtagggttcagtacttctgggaggccttgaataatttcaccaatgaagaccgtagccgtttcctgcggttcgtgactggcaggagcagactgccggctaggatctacatctaccccgataagcttgggtacgagactaccgatgcattgcccgagtctagtacttgctcttcaaccctgtttctgcctcactacgcatccgccaaggtgtgcgaagagaaactccgctatgcggcctacaattgcgtcgctatcgacactgatatgagtccatgggaggaatag

SEQ ID NO: 24369 - DNA, 1197 bp, Artificial Sequence
  Description of Artificial Sequence: Synthetic coding sequence
atggagagcgtgctgagcaagtacgaggaccagatcaccatcttcactgattatcttgaagagtatccggatacagatgagcttgtgtggatcctgggcaagcagcacctgctgaaaaccgagaaaagcaagctgctctccgacataagtgcccgcctgtggttcacataccgcaggaaattctccccaatcggagggacaggccccagcagcgacgccggttggggatgtatgttgcgctgtggtcaaatgatgctggcccaagccttgatatgtcgacatctgggacgagattggtcctgggaaaaacagaaagagcaacccaaggagtatcagcgtattctgcaatgtttcctggatcgcaaggactgctgctatagtatccatcaaatggctcagatgggagtgggcgaaggaaagtcgatcggtgaatggttcggtcctaacaccgtcgcgcaggtcctgaagaagctggccctcttcgacgagtggaactcattggccgtgtatgtgtccatggacaacacggtggtgattgaggacatcaagaagatgtgccgagtgctccccctctctgcggatactgcgggcgatagacctccggatagcctaaccgcctccaatcagagcaagggaacatcagcctactgtagtgcatggaagccccttttgctgatcgtccccctgaggctcgggatcaatcagatcaacccagtctatgtagacgcctttaaggaatgctttaaaatgcctcagtccctgggagctttgggcgggaagccgaacaatgcctactatttcattggattcctgggtgatgaactgatcttcttggacccccacacaacacagaccttcgtcgacaccgaggagaacggcactgtgaatgaccaaacttttcactgtctccagtctccacagagaatgaatatccttaacctcgatccttctgtcgcgttgggcttcttctgtaaggaggagaaagacttcgataactggtgttctcttgtgcagaaagaaattctaaaagagaacctgagaatgtttgaactcgtccagaagcatcccagccattggcctccatttgttccaccggctaagcctgaagtgaccaccacaggcgcggagttcatcgacagcactgaacagttggaagagttcgatcttgaagaagacttcgaaatattgtctgtgtag

SEQ ID NO: 24370 - DNA, 1701 bp, Artificial Sequence
  Description of Artificial Sequence: Synthetic coding sequence
atggacctgcaccgggccgccttcaagatggagaacagcagctacctcccaaatcctttggcatcccccgctttgatggttctggcttcgactgcggaggcttccagggatgcgagcattccttgtcaacagccacggcctttcggagtcccagtgtctgtagataaagatgtccacattccctttacaaatgggagctatacttttgcctccatgtaccacagacagggaggcgtcccgggaacctttgccaacagagatttcccaccaagtcttctccatctgcacccacagttcgccccaccaaatctggactgcacaccaatctctatgctgaaccatagcggcgtgggggccttccgcccattcgcgagcaccgaagatagagagtcttaccagtctgctttcactcctgcaaagagattgaagaattgtcacgacacagagagccctcatcttcgattttcggatgccgacggaaaagaatatgacttcggaacccaactgccatcgagcagccccggatctctcaaagtagacgatacaggcaagaagatctttgcagttagcggtctgatttctgatagagaagcctcatcttcaccagaggatagaaatgacaggtgcaagaaaaaagcagctgcgctgtttgatagccaggcgccaatttgtcctatttgtcaggtgctgctgaggccctcagaacttcaggagcacatggagcaggagcttgagcagctggcacaactcccttccagtaagaactcactcctgaaagacgcgatggcaccaggaactccaaagagtctgctgctgagcgcttccattaagcgtgagggtgaatcaccaacagcttcccctcatagctccgcaactgatgaccttcaccatagcgaccggtatcaaacttttttgagagtcagagccaatcgccagacacggctaaacgccaggatcggcaagatgaaacggaggaagcaggacgaagggcagcgggaagggtcatgtatggccgaggatgacgccgtggatatcgagcacgagaacaataatcgctttgaggaatacgagtggtgtggccagaagcggatacgagctacaacattgttggagggcggcttcagaggaagtggatttattatgtgttctggcaaagagaaccccgactctgatgcggatttggatgtggacggagatgatacattagaatatggcaagccacaatacaccgaggccgacgtaataccttgtacaggagaggagcccggagaagccaaggagcgggaagccctgcgtggagccgtgcttaacggtggcccgccatctacgcgtattactcccgaatttagtaaatgggcttctgacgagatgccgtcgacttctaacggcgagtcgagtaaacaggaggccatgcagaagacttgtaaaaacagcgacatcgagaagatcacggaagactccgctgtgacaacgtttgaagccctcaaagcgcgggtccgagaactggaacgacagctgagcaggggtgaccggtataagtgcctaatctgcatggattcatattcaatgccactgacctctatccaatgctggcatgtacactgcgaggaatgttggctcagaaccctcggcgccaagaaactttgccctcagtgtaacactattacagcgcctggagatttgcggcggatctacctatag

SEQ ID NO: 24371 - DNA, 930 bp, Artificial Sequence
  Description of Artificial Sequence: Synthetic coding sequence
atgccccgggcccggagcggccggcggagccggggcgccggcggccgtgaggaaacgttcctgagagtgagagcgaatcggcaaactaggctgaacgcaaggattgggaagatgaaacggaggaagcaggacgaagggcaggtgtgtcctctctgcaaccgcccgctggccggctcagagcaggaaatgtcaagacacgtggagcactgtttgtcaaagagagaaggatcttgtatggccgaagatgacgctgtagacattgagcacgagaacaataaccgtttcgaagagtatgagtggtgcggccagaagcgcattcgtgccaccaccctgctggagggcggcttccgtggaagtggctttatcatgtgtagcgggaaagagaatccagactctgatgcggatctggacgtcgatggcgacgatacgctcgagtatgggaagcctcagtatacggaagcagacgtgattccttgtacgggcgaggaaccaggcgaagccaaggagagagaagctctccgcggcgctgtattgaacggggggcctccaagtacacgtatcacccccgagttcagcaagtgggcctctgatgcagaaatgcctagtactagcaatggggaaagcagcaagcaggaggcgatgcagaagacgtgcaagaactccgatatcgaaaagattacagaggactctgccgtgaccacatttgaagctctgaaggcccgcgtgcgagagctggagcgccagttatcccgtggtgacagatataagtgcctcatttgtatggactcttactccatgccactcacaagcatccagtgctggcacgtgcactgtgaggagtgctggctgagaacactgggggccaagaaattgtgtccccagtgcaacactatcactgctcccggagacctgagaaggatatatctttag

SEQ ID NO: 24372 - DNA, 1125 bp, Artificial Sequence
  Description of Artificial Sequence: Synthetic coding sequence
atggagagcgtgctgagcaagtacgaggaccagatcaccatcttcactgattacttagaggaataccccgacacggacgagctcgtatggatcctcggcaagcagcacctcctgaagacaggggggaccggcccctctagcgacgcggggtggggctgtatgctgcgatgtggacagatgatgctggctcaagcattaatctgtcggcacctgggtagagattggagctgggaaaagcagaaggaacaacccaaggaataccagcgtatccttcaatgtttcctggacagaaaagactgctgctattccatccatcagatggcacaaatgggagtgggtgaaggcaaatctataggcgagtggtttgggcctaacacagtggcacaggtgctgaagaagctggccctattcgacgagtggaacagtctggccgtctatgtgtctatggataatacagtcgtgatcgaggatattaagaaaatgtgcagggtcctcccactctctgctgatacagcgggcgatcgccccccagacagccttaccgctagcaatcagtctaaaggtaccagcgcttattgttctgcatggaaaccactgcttcttatcgttccgctccgtctgggaattaatcagattaatccagtctacgtcgacgcatttaaagagtgcttcaaaatgcctcagtccctgggagcactcggcggcaaaccaaataacgcatattactttattgggtttttgggggatgaattaattttcttggaccctcatacaacccagacttttgtcgacactgaggaaaacgggactgtaaacgaccagacgtttcattgtcttcagtcaccacagcggatgaacatccttaatctggatccatcagtggcattgggatttttctgtaaggaagagaaggactttgataactggtgctctctagtgcagaaggaaatcctgaaggagaatttacgcatgtttgaactggttcaaaagcacccctcacattggcccccctttgtaccgcccgctaaacctgaggtcaccactaccggggcggaattcatcgacagcaccgaacagttggaagagtttgacctggaggaagactttgagatcctttctgtttag

SEQ ID NO: 24373 - DNA, 558 bp, Artificial Sequence
  Description of Artificial Sequence: Synthetic coding sequence
atggagggctgcgtgagcaacctgatggtgtgcaacctggcctactcggggaaactggaagaactaaaagagagcatactggccgataaaagcctggccaccagaaccgaccaggattctagaacagctttacactgggcgtgcagtgccggacacacagagatagtcgaatttctgctccagctgggcgtccctgtcaatgacaaggacgacgcggcatccaagaaccgacacgaaatcgccgttatgttgcttgagggtggtgccaaccccgacgccaaagatcactacgaggctactgccatgcatcgagccgctgccaaggggaacctaaaaatgattcatattctcttgtactacaaggcaagcaccaatatacaggacacggaaggcaacactcccctgcacctcgcgtgcgacgaggagcgcgtagaagaggcgaagttactcgtgtcccagggggcatccatttacatcgagaacaaggaggagaagaccccactccaggtggccaaaggaggcctgggcctcatcctcaaacggatggtcgagggctag

SEQ ID NO: 24374 - DNA, 333 bp, Artificial Sequence
  Description of Artificial Sequence: Synthetic coding sequence
atggagggctgcgtgagcaacctgatggtgtgcaacctggcctactcagggaagctcgaggaactgaaggagagtatcctggcagataaatcccttgctactcgcacagaccaggattcccgcactgcccttcactgggcatgctctgcgggtcacactgagattgttgaatttcttcttcagctgggagtgcccgtcaatgacaaagatgatgcggctagtaaaaacaggcacgagatcgcggtcatgttgcttgaagggggcgccaacccagacgccaaagatcactatgaggccactgccatgcacagagcggcagccaaagatacttag

SEQ ID NO: 24375 - DNA, 546 bp, Artificial Sequence
  Description of Artificial Sequence: Synthetic coding sequence
atggtgctgggcgccggctggggctgggcctaccagctgcacctgctgcaggctttgaagagaaaaccagacctgttcctgtgtgaacggctagacgttaaggcagtgttccagtgtgccgtcctcgctttgaaattccctgaagcacccactgtgaaagcaagttgtggatttttcacagagctgctaccccgctgcggcgaagtggagagtgttggcaaggtagttcaagaagacggaagaatgttgttgatagcagttcttgaagcaataggcggtcaggccagtcgatccctgatggattgctttgctgatatcttgttcgcattgaataagcactgcttctcgttactgagtatgtggatcaaggaagcactccaacctcctggatttccttcagcccgcctcagtccggaacagaaagacacctttagccagcagatcctgcgggaaagggtgaataaaaggcgcgtgaaggagatggtcaaagagtttacactgctctgccgaggactccacggtaccgactatactgccgattattag

SEQ ID NO: 24376 - DNA, 2892 bp, Artificial Sequence
  Description of Artificial Sequence: Synthetic coding sequence
atggagcggcgggaggagcagcccggcgccgccggcgccggcgccgccccagcactggatttcactgtggagaacgtggagaaagcccttcaccagctgtactacgatcctaatattgaaaataaaaacctggcccaaaagtggctcatgcaagctcaggtttcccctcaggcatggcatttttcgtggcaattgctccagcctgataaggtgcctgaaatccagtactttggggcaagcgccctgcacattaaaatctcgaggtattggtcggatataccaactgaccagtatgaatccctgaaagcgcaactttttacccaaatcacacggtttgcaagtggaagcaagatcgttctcacccggctctgtgtggccctggccagccttgcactgagcatgatgcccgatgcctggccttgtgcagtagctgacatggtgcgactgtttcaagccgaagattcccccgtggatggacagggtagatgcctcgcactcctcgagctgctgaccgtcctgccggaggagtttcaaacctcgaggctaccacagtaccgaaaaggcctggtaagaacatccctggctgtcgagtgcggagccgtgttccccctactcgagcaattactgcaacaaccttcctctcccagctgcgtcagacagaaagtgctcaagtgtttttcaagttgggttcagctcgaggtgcctctgcaggactgtgaggcccttattcaagccgctttcgcagcactgcaggatagcgagttattcgattcaagtgtcgaagctattgttaacgcgatcagtcagcctgatgctcagaggtacgtgaatacacttctaaagctcatcccactggtgctgggcctgcaagagcaattgcgtcaggccgttcagaacggggatatggaaactagtcacgggatctgcaggattgcagtggccctgggagagaatcactctcgcgcccttttggatcaggtggaacactggcaaagctttttagcccttgtcaacatgattatgttttgtaccgggatccctgggcactatcctgtgaacgagaccacttcctctttgaccctgaccttctggtacacactccaggacgatatattgtcttttgaagccgagaaacaggcggtgtaccagcaggtttaccggcctgtgtactttcaactcgttgacgtacttctacacaaagctcagttcccctcagacgaagagtatggcttctggtcttcagacgaaaaggaacaatttagaatctaccgggtggatatcagcgatacactcatgtacgtctatgagatgctcggcgccgaactcctcagcaacctatatgacaagctgggcaggctgctcaccagtagcgaggagccttacagctggcagcatacagaagcattactgtacgggtttcagagcattgccgagaccattgacgtgaactattccgatgtggtgcctggcctcatcggcctcatccctcgcataagtatcagtaatgtacagcttgcagatacagtgatgtttactataggagcccttagtgaatggttggctgaccaccctgtgatgatcaactcggtactgcccctggtgctgcacgcactcgggaacccagagctcagcgtgtctagtgtttcaaccctcaagaagatttgcagagagtgcaagtacgatttgccaccttacgccgcgaatatagtcgccgtgagccaggacgtcctgatgaagcagatccacaagacatcccagtgtatgtggttgatgcaagccctaggcttcctactatctgcgctccaagtcgaggaaattcttaaaaaccttcacagtttgattagtccgtatatccagcagctggagaagctcgcggaggaaattcctaacccctcaaacaaattggccatcgtccacatcctcggactgctctcaaatctttttaccacccttgatattagccatcacgaggatgatcatgagggcccagagctgcggaagcttccagtgccccaaggtcctaaccccgtggtggtcgtattgcagcaggtatttcaattgattcagaaagtgttgtccaaatggttgaacgacgcccaggtggtcgaggccgtctgcgccattttcgagaaatcagtcaaaacacttctggatgacttcgctccgatggtcccacagctatgtgaaatgctgggtcggatgtacagcaccatcccacaagcatcggctcttgacctgacgcgacagttagtgcacatctttgcccacgaacccgcgcactttcctcccattgaagccctgttcctgttagtgacttctgtgactctgacactattccaacaggggccacgagatcaccccgacatcgtggacagctttatgcaattgcttgcccaagccttgaaaaggaagcccgatctttttctctgtgaacgccttgacgtcaaggcagtgtttcagtgcgctgtcctggcattgaaatttcctgaagccccaaccgtcaaagctagttgtggtttttttaccgagctgttgccaagatgtggggaagtcgagagcgttggaaaagtggtacaagaagatggacgcatgcttctcattgccgtacttgaagcaattggaggccaggcctcaaggtctctgatggactgcttcgccgatattctgtttgcgttaaacaagcactgttttagccttctatccatgtggattaaggaggctctgcagcctccaggctttccttccgctagactcagccctgaacaaaaagatactttttcccaacagatattgcgggagcgtgtgaacaaaaggagggtcaaggagatggttaaggagttcaccctgctgtgtcgcggtcttcatggaactgactatactgctgattattag

SEQ ID NO: 24377 - DNA, 2907 bp, Artificial Sequence
  Description of Artificial Sequence: Synthetic coding sequence
atgcggctgctgcggcacaccgagagcgagcagtggttccaccggtttccgctgtgcccctccctgacgttttgggcccccgtggcaatgtggccccaaacccactgcgtcggcgggcgctccagcgggctcactaaatggacctactctttcagtgcatcactccaggacggatcttttccatatgactcagtgccttggcagcagaataccaaccagcctcccggcagcctttctgttgtcacaacagtgtggggggtcaccaacaccagccaatctcaagctgatgtgctcatcccccacgctacatgtcggcctgggccactgctaatcaccgcatgggagccttacggacagtgccagcagccacacgaaagtagacgacagccccacggagttggacacgaccaccaacagccgcgccctcaattgccgaccgtctgtggagccgcggctgccgttctgtcccagggatggcccaggtccgccctccaccccgcagagcatgtgtggcctgctcagctccctcgccaaagagggctgtgggggcagccagcagctgcggccgcggcggccgccgtcgccgccgcagccgctaccgcaacggcaactgcaactgctactgtggccgctctccaggagacacagaacaaggacatcaatcagtacggacccgcccctgtgctactcccggacctgctcaaagatgggctgggcgatgaggaacggggagcgcccattggtatgcagaactccatgaatccagcctcaatggctgccggcatgacaccttctggcatgtccggccctccgatgggtatgaatcagccccggccaccggggatctctcctttcggaacgcacggccagcgcatgccacaacagacatatcctggcccgagaccccagagcctgccaattcagaatatcaagaggccctaccccggtgagcctaattacggtaaccagcaatacggtccgaacagccagttcccaactcagcccgggcagtaccctgctccaaatcccccacgtcctctgacctcccctaactaccctggtcaacgaatgcctagccagcctagctctgggcagtatcctcctcctacagtgaacatgggacaatattacaaaccggagcaattcaacggccagaataacacattctctggctctagctacagtaattactcccaggggaacgttaatcggcccccaagacctgtgcctgttgcaaattatcctcattccccagtaccgggcaaccccactcctccaatgactccaggttcctctattcccccatacctgtcaccttctcaggacgtgaaaccaccattcccacccgatattaaaccaaatatgagcgcgttgccaccaccgccggatcacaacgacgagttgcgactcacattcccagtgagggatggggtggtacttgaaccatttaggttggaacacaacctggcagtctccaaccacgtgttccacttgcgtcccacggtacatcagaccctgatgtggagcgacctcgagctgcagttcaagtgctatcatcatgaagatcgccagatgaatacaaactggcctgctagtgtgcaggtgtcagttaacgccacgccccttaccatcgagagaggggataacaaaacatcacacaagcctctgcatctgaagcatgtatgtcagccaggaaggaataccattcagatcacagtgacagcttgctgttgttcccacctgtttgtcctgcaactggtgcatcggccctctgtgaggagcgtcctccaggggctgctcaagaagcggctgctgcccgcagagcattgcattacaaagaagcgaaacttttcaagcgtggcagcctcaagcggcaatacaaccctgaatggggaagacggcgtggaacagacagccattaaggtcagcctaaaatgtcctatcacattcaggcggatccagcttcctgccagagggcatgactgcaaacatgtgcagtgctttgacctcgagtcttacctgcagctgaattgtgaaaggggcacgtggcgctgcccagtctgtaagaccgcccttcttgagggccttgaagttgaccagtatatgtgggggatactgaatgccatccatagtgaatttgaagaagtgaccattgaccccacgtgtagctggagaccagtgcccatcaaatcggatctgcacattaaagacgacccggatggcatcccaagtaagcggttcaagaccatgtcgccatcccaaatgataatgccaaacgtaatggaaatgattgcagcgttgggccccggtccatccccttatcctctgccgcctccacctgggggcactaacagcaatgactacagcagccagaataattaccagggccacggtaactttgacttcccacacgggaaccccggtggcacatctatgaacgattttatgcacggacccccacagctttcgcaccctcccgacatgccgaacaacatggctgcattagaaaagccgttgagtcatcccatgcaggagactatgccccacgccgggtcttctgatcaacctcacccttcaatacaacagggtctgcacgtgccccacccttcctctcaatccggaccacctcttcaccattccggagctccacctccgccaccttcacagccacccaggcaaccacctcaggccgcaccaagctcccatccgcattctgatctgaccttcaatccaagtagcgcgcttgaaggacaggccggagcccagggcgcctccgacatgccggagcccagcctggacctgctgcctgagcttaccaacccagacgaacttctaagttacctagacccacccgatctccccagcaacagcaacgacgacctgcttagcttgttcgaaaataactag

SEQ ID NO: 24378 - DNA, 603 bp, Artificial Sequence
  Description of Artificial Sequence: Synthetic coding sequence
atggccatggagatgcggctgcccgtggcccggaagcccctgagcgaacgtctaggcagagatacgaagaagcacctggtcgtcccgggtgacacaatcacgaccgatactggctttatgaggggccacgggacttacatgggcgaagagaaactcatagctagtgtggctggctctgtggagagagttaataaactcatttgcgtgaaggcccttaagacccggtacatcggcgaggtgggggatattgttgtagggagaataaccgaagtgcaacagaagaggtggaaggtggaaactaattccaggctggattcagtcctcctcctaagctcaatgaacctgcctggcggggagttgagacgtagatccgccgaagatgagctggccatgcgaggattcttgcaggagggagacctcattagcgcagaagttcaggcagtcttcagtgatggtgccgtgagtctgcacacacgcagcctgaagtacggcaagacccatttccacgacttaccgtgcggggcgtcagtcattctcggcaataacggattcatctggatctaccccacacctgagcacaaggaggaagaggcgggaggatag

SEQ ID NO: 24379 - DNA, 792 bp, Artificial Sequence
  Description of Artificial Sequence: Synthetic coding sequence
atggccatggagatgcggctgcccgtggcccggaagcccctgagcgaacggctcggccgggacaccaagaaacatctcgtggttcccggcgacaccattaccactgataccggcttcatgaggggccatggcacctacatgggcgaggagaaactcatcgcaagcgtggccggctccgtcgaaagggtgaataaattaatctgtgttaaggccttgaaaacacgatacattggtgaggttggggacattgtagtggggcgtattacagaacgacgccgcagtgccgaggacgaacttgctatgaggggatttctgcaagaaggcgacctaatttccgcagaagtgcaggccgttttctctgacggcgcagtgtcgctccacacacggtctcttaaatacggcaagctgggccaaggggtgctggtacaagttagtccctccctggtgaagagacagaaaacccatttccacgatttgccttgtggagcatcagtgattcttgggaataatggctttatatggatctacccaacacccgaacacaaggaggaggaagctggagggtttattgctaatctcgaacccgtatcattagccgatcgagaggtgatctctcgattgaggaactgcattatctctctggtcacgcagcggatgatgttgtacgacacgtcaatcttgtattgctacgaggctagtttgccccatcagatcaaagatatcctgaagccagagataatggaggagatcgttatggaaactagacagagacttctggagcaagaagggtag

SEQ ID NO: 24380 - DNA, 858 bp, Artificial Sequence
  Description of Artificial Sequence: Synthetic coding sequence
atggccatggagatgcggctgcccgtggcccggaagcccctgagcgagaggttaggccgcgataccaaaaagcacttggtcgtgcctggagatacgatcaccactgataccgggttcatgcggggacacggaacttacatgggcgaggaaaaactcatcgccagtgtggctggaagcgtagaaagggtcaacaagctgatttgtgtgaaggcgctgaagaccagatatatcggtgaagtgggagatatagtggtgggcaggattaccgaggttcagcagaaacgatggaaggtcgaaactaattccagattagattctgttctcctgctgagcagcatgaatcttccaggtggtgagttgagaaggagatctgccgaggacgagctcgctatgcgtggattcctgcaggagggtgacttgatctctgccgaagtgcaagctgtgttctccgatggggcagtgagtcttcacaccaggtctctgaaatacgggaaggtgagcccatcccttgttaaacggcagaagacccatttccatgacttaccttgcggggcgtcagtgatattaggcaacaacggttttatttggatctaccccacacccgagcacaaagaggaggaggccgggggttttatcgctaacttggagcctgttagtctcgccgatagagaggtaattagtaggctccgcaattgcattatttctttggtcacacagaggatgatgctgtacgacaccagcatcctgtattgctatgaggcctcccttcctcaccagatcaaggacattctcaagcctgagattatggaggaaatcgtaatggagacccgccagcggctgttagaacaggagggatag

SEQ ID NO: 24381 - DNA, 882 bp, Artificial Sequence
  Description of Artificial Sequence: Synthetic coding sequence
atggccatggagatgcggctgcccgtggcccggaagcccctgagcgagagactggggcgagacaccaaaaagcatctagtggtcccaggagataccattacaaccgatactggtttcatgcgtggccatgggacatatatgggggaagaaaagctaattgcatcagttgcgggctccgtggagcgtgtgaacaagttgatctgtgtaaaagcactcaaaactcggtacatcggggaagtgggggatatcgtggtgggtcgcataactgaagttcagcagaagcggtggaaggtggaaacgaactctcggttagactccgtgttgttgctatccagcatgaacctacccggtggcgaactccggcgcaggtctgcggaagatgagctcgcaatgaggggcttcctccaagaaggcgacctaatcagcgcagaggttcaggcagttttcagtgatggcgccgtttccctgcataccaggtctctgaaatatggcaagctggggcagggtgtgctggtccaggtgtctccaagtctggtcaagagacagaagacacattttcatgacctgccgtgtggggcttcagtcatactgggaaataacgggtttatctggatctacccaacccctgagcataaggaagaggaggcagggggctttattgctaacctcgaaccagtgtctctcgccgatcgggaggtgatcagccggctgcgaaactgcatcattagtctcgtcactcagcgcatgatgctgtatgataccagcatactctattgctacgaagccagcttaccacatcagattaaggatatcttgaagcccgaaatcatggaggagattgttatggagacaagacagagactcctggaacaggaaggctag

SEQ ID NO: 24382 - DNA, 3195 bp, Artificial Sequence
  Description of Artificial Sequence: Synthetic coding sequence
atggccagcgagagcgagaccctgaaccccagcgcccggatcatgactttttatcccacgatggaggaattcagaaacttcagccggtatattgcctacattgaatcccagggagcacatagagccggcctggccaaggtcgtgccacctaaagagtggaaacctagggcatcttacgacgacattgacgacctggtcatcccagctccaatccagcagcttgtgactggacagtccgggctgtttacacagtacaatatccagaaaaaggctatgactgtcagggagtttagaaagatagccaactcggacaagtactgcacccctaggtatagtgaatttgaggaactggaacgcaagtactggaaaaatctgacttttaacccgccaatctacggagccgatgtgaacggcacactgtatgagaagcacgttgatgagtggaatatcggaaggcttcggaccatactggatctggtcgagaaggaatcaggcatcaccatagagggagttaatacgccttacctttatttcggtatgtggaagaccagcttcgcttggcacaccgaagatatggacctctactcaattaactacttgcactttggcgagcccaagtcttggtattctgtgccgccggaacacggcaagcgcctggagcgactggccaaaggcttctttcccgggagcgcccagagttgcgaagctttcctgcgtcataaaatgacattgatttcccctcttatgctgaaaaagtacggaatcccgttcgataaagtcactcaggaagccggtgaattcatgattacattcccctatgggtatcacgctggattcaaccacggcttcaattgtgctgaatctacgaatttcgcgactaggcgatggatcgaatatggaaagcaggccgttctgtgctcatgccggaaggatatggtgaagatttcgatggatgtgttcgtgcgcaaattccaacctgagcggtacaagctgtggaaggccgggaaagataacaccgttatcgaccatacactgcctacccctgaggcagccgaattcttgaaggaaagcgaattgcccccacgcgctgggaacgaggaggagtgtcctgaggaagacatggagggcgtcgaggatggcgaggagggggacctaaagacttccttagctaaacatcgaatcggcaccaaacggcatcgagtgtgtctcgagattccacaagaggtatctcagtcagagttgtttcccaaggaggatctctcctccgagcagtatgaaatgactgaatgccccgctgctctcgctcccgtcagacctacgcactcctcagtgcgccaagtcgaggacggcctcacatttcccgattactcagatagcacagaggtaaagtttgaggagttgaaaaatgtcaagctcgaagaagaagatgaggaggaggagcaagcagcagccgctctggacctgagcgttaatccggcgagcgtgggaggtcgtttggttttctccgggagcaaaaagaagagttccagcagcctgggctctggcagttctcgtgattccatttcttccgatagcgagactagcgaacccttgtcctgccgtgcccaaggacagaccggtgtccttaccgttcattcctatgccaagggggacgggagagtcaccgtgggcgagccctgtaccagaaagaagggctctgctgctaggagtttcagcgagagggaactggcagaagtggccgacgagtatatgttcagcctggaagaaaataaaaaatcgaagggccgccgccaacccctgagtaagcttccgagacaccatcccttagtcctacaggaatgtgtttccgacgacgagactagcgagcagctgactcctgaggaggaagctgaggaaactgaggcttgggctaagcccctcagtcagctttggcaaaatagaccacccaacttcgaggccgagaaagagttcaatgagacgatggcacagcaggcaccccactgtgccgtctgcatgattttccaaacataccaccaggtggagtttggagggttcaaccagaattgcggcaacgcatcagacctcgctcctcaaaaacagcgtacaaagcctttaatcccagaaatgtgctttaccagtacaggatgtagcacagacattaatctgagtaccccctatctggaagaggatgggaccagtatcctagtatcctgtaagaaatgttccgtaagagtgcatgcctcctgctatggcgtgccacctgctaaggcatcagaggactggatgtgctcacgttgcagtgccaatgctctggaggaggactgttgtctctgtagtctgcgtggaggagctctccagagggccaacgacgaccgctgggtgcatgtgagttgcgctgttgccattctcgaggcacgcttcgtaaatatcgcagaacgttcccctgtcgacgtgtccaaaatcccgctccctcgctttaagcttaagtgtatcttttgcaagaagcgccgaaagcgcactgccggctgctgcgtgcagtgttcccatggccgctgtcctacggctttccatgtgagctgcgcccaggccgcaggagtgatgatgcagccagatgattggcctttcgtggtttttattacttgttttagacacaaaattcccaatttggagagagcaaagggcgccttgcagagcataacagccggacagaaggttatttctaagcacaaaaacggtaggttttatcagtgcgaagtggttagactgaccaccgaaacgttttatgaggtgaactttgacgatggatctttctctgacaacctctaccccgaggatatcgtttctcaggactgcttgcaatttgggcctcctgctgagggcgaggttgtgcaggtgcgatggaccgatggacaggtatatggagccaagtttgtggcttcccaccctattcagatgtaccaggtagagtttgaagacggtagtcaactggtcgtgaagcgagatgacgtgtatacactggacgaagagctgccaaaaagagtgaagagcagactgagtgtggcctccgacatgagattcaacgagatcttcaccgagaaggaggtcaaacaggaaaaaaaacggcagcgcgtgatcaattcgagataccgagaggactacattgagcctgccctctatagagccattatggaatag

SEQ ID NO: 24383 - DNA, 2745 bp, Artificial Sequence
  Description of Artificial Sequence: Synthetic coding sequence
atgggcgacagccgggacctgtgcccccacctggacagcatcggcgaagtcaccaaggaggatctgcttctcaagagtaaaggtacctgtcagtcttgtggcgttaccggaccaaatctctgggcatgtctgcaagtggcgtgtccttacgtcggctgtggagaatcattcgccgaccacagcacgatccatgctcaggccaagaaacacaacctcactgttaatctgacgacgttcagactatggtgctatgcatgcgagaaggaggtgtttttggagcaaagattggctgctcccttgctggggtctagttcgaaattcagtgagcaggattctccccccccttcccaccctctaaaggccgtcccaatcgccgtcgccgacgagggggagtccgaatccgaggacgacgatcttaaaccaagaggcctgacaggcatgaagaatttagggaacagctgctacatgaatgctgctcttcaggccttatccaactgccctcctctcacacaatttttcctggaatgtggggggctagtgcggaccgacaagaaacctgctctgtgtaagagctaccagaaactcgtgtctgaggtctggcataagaagcgtccgtcatatgtcgtgccaacttctttatctcatgggataaagctcgtaaatcccatgttcaggggctacgcccaacaggacactcaagaattccttcggtgcttgatggatcagcttcatgaggaactaaaagaacccgtcgtggcaactgtggcactcactgaggcaagagattccgactcttccgatactgacgagaagcgagagggtgacaggtcaccttccgaagacgagttcctgagctgtgactcctcctctgatcggggcgaaggtgatggacagggcaggggaggtggtagcagccaggccgaaacagaactcctgattcctgacgaagcagggcgggccatctccgagaaagaacgaatgaaggatcgcaagtttagctggggccaacagcgcacaaactccgagcaagttgacgaggacgccgatgtcgacacagctatggctgctctggatgaccaacccgccgaagcccagcctccttcgccccgatcttcgtcaccatgtaggacccccgaaccagataatgacgcacacttgcgttccagctcacggccatgtagtccggtccatcaccatgaggggcatgccaaattgtccagctccccaccaagggcctctcctgttaggatggccccaagctatgtgttgaaaaaggcccaggtgctgagcgccggctcaaggcgtagaaaggaacagagataccgttctgtaatctccgacattttcgatgggtccatcctgtcgctggtacaatgtctcacatgtgatcgcgtttccaccacagtggagacgttccaggaccttagcctgccgataccgggcaaagaagatctggccaaacttcatagcgccatttaccagaatgtaccggcaaagccaggcgcttgcggggacagttacgcagcacagggttggctcgcatttatcgtagaatacatccgacgctttgtcgtttcatgcaccccctcttggttttggggtccagttgtcacactggaagactgcctagctgcattcttcgccgccgacgaattgaagggagataatatgtatagctgtgagagatgcaaaaagctcaggaatggcgtgaagtactgtaaagtgctccggctgccagaaatcttgtgcatccaccttaaacgtttcagacacgaggttatgtatagctttaaaatcaatagccatgtttccttccctttggagggtctagacctgagaccctttcttgccaaagagtgtacctcgcagattactacctatgatttactttcagtgatctgccatcatgggacagcagggtcaggtcactatatagcttactgccaaaatgtgattaacgggcaatggtacgaatttgacgaccagtatgttaccgaggtgcacgagaccgtggtgcagaatgctgagggttatgttctgttctatcgcaagtcctctgaagaagccatgcgcgaaagacagcaggtcgtgtcactcgccgcgatgagagagccttccctgctgcggttctacgtctcgagagagtggctgaacaagttcaatacctttgcagaaccgggtccgatcaccaaccaaactttcttgtgttcccacggcggcattcccccccacaagtaccattacatcgatgatctggtcgtgatcctgccccagaatgtctgggagcacctttataaccggttcggaggcgggccagccgtcaaccacttgtacgtatgttcaatctgccaggtcgaaatcgaagcacttgctaaacgtcgtcggatagagattgataccttcattaaactgaataaggccttccaggctgaggagtctcccggcgtgatatactgcatcagcatgcagtggtttcgcgagtgggaagccttcgtgaaaggtaaggacaacgaacccccgggtcccatagataatagcaggattgctcaggttaaaggatctggtcatgttcagctcaagcagggtgcagactacggccaaatatccgaggagacttggacatatcttaacagcctgtatgggggcggccccgaaatcgccataaggcagagcgtggcacaacccttaggtccagagaatctgcatggggaacaaaaaattgaggcagaaacgcgcgcagtgtag

SEQ ID NO: 24384 - DNA, 1215 bp, Artificial Sequence
  Description of Artificial Sequence: Synthetic coding sequence
atggacttcaacatgaagaagctggccagcgacgccggcatcttcttcactcgagcggtgcagtttaccgaggagaagtttgggcaggctgaaaagaccgaacttgacgcacatttcgagaatctgctcgcaagggccgacagcacaaagaactggacggagaagattctccggcaaacagaagtcctcctccagcctaatccatctgcgagagtggaagaatttctctatgagaagctggataggaaagtccccagtagagtgaccaacggggaattgctcgcccagtacatggccgatgccgcctctgagctgggtccgaccaccccttatggcaaaacactgatcaaggtggctgaagcggagaagcagctgggagccgcggaacgcgattttatacataccgcttctatctcattcctgacccccctccgcaacttcctggagggggactggaaaactattagtaaggaacggagactgctccaaaatcggcggctcgatctggatgcctgtaaggccaggttgaaaaaagccaaggcggcagaggctaaagccacttgcgaaggagatacagtgccggacttccaagagacccggccgagaaattacattctcagcgcctccgcctccgccctgtggaacgacgaagtggacaaggccgagcaggagcttagggtggcccagacggagtttgacaggcaggcggaggtcacccgactgctgttagagggtatcagcagtacacacgtgaaccatctgcgatgcctgcatgaattcgttaaatcccagacgacctactatgcccaatgttaccgacacatgctggatctgcagaagcagctcggatcctctcaaggggctatttttcccggcacatttgttggaaccacagaacccgcatcgccacctttgagcagcactagccccaccaccgccgctgcgacaatgcccgtggtgcctagtgttgcatctctggcgcctccaggcgaagcttccctgtgtctggaagaagtggcgcctcctgcctcgggaactcgcaaagcacgagtactgtacgattatgaagccgccgacagctccgagctcgccttgctggccgatgaacttatcaccgtatactcccttccaggaatggatcccgattggctgatcggagaaagaggaaacaaaaagggaaaggtgcctgtgacttatctggaactcttatcatag

SEQ ID NO: 24385 - DNA, 1188 bp, Artificial Sequence
  Description of Artificial Sequence: Synthetic coding sequence
atggacttcaacatgaagaagctggccagcgacgccggcatcttcttcacgcgggccgtccagttcacagaggaaaaattcggccaggccgagaaaacggagctggacgctcacttcgagaatctgctcgctcgagccgattcgacaaagaattggacagaaaaaatactgaggcagacagaggtgttgttgcagcccaacccaagcgccagggtcgaagagtttctatacgagaagctggacagaaaagtaccttcacgcgttaccaacggcgaattgctggcccaatatatggcagatgctgctagcgaactaggcccaaccaccccatacggaaaaactcttatcaaggttgcagaggctgagaagcagctgggggctgccgaaagggacttcattcataccgcctctatctcctttcttacacctctccgaaacttcttggagggcgattggaagactatttccaaggagcggcgcttactgcaaaatcgtcgcttagacctagacgcgtgtaaggccagattgaagaaggctaaagccgctgaagccaaggcgacgacagtccccgacttccaggagacccgccctagaaactacatcctttcagcttctgccagcgcgctgtggaatgacgaggttgacaaggccgagcaagagttgcgtgtggctcagaccgagttcgaccgccaggcagaagtgaccagacttcttcttgagggaatcagctcgacccacgtgaaccacttaaggtgcctgcacgaatttgtcaagtcccagactacttattatgcacagtgttaccgacacatgctggacctccagaaacagctcgggcgatttcctggcacctttgtgggaaccactgagcctgcatcgcctcctctgtcgtctacatctccaacgacagccgctgctacaatgcctgtggtgccatcagtggcttcccttgccccaccaggagaggcttctctgtgtctggaggaggtggctcccccagccagcggaactcggaaggctagggttctctacgattacgaggcggccgattcctcagagctggcattgctcgccgacgagctcatcactgtttattcattgccaggcatggaccctgactggttgatcggggagcgtggcaataagaagggaaaagttccggtaacttacttagagctcctgagctag

SEQ ID NO: 24386 - DNA, 1188 bp, Artificial Sequence
  Description of Artificial Sequence: Synthetic coding sequence
atggacttcaacatgaagaagctggccagcgacgccggcatcttctttactagggccgtgcagtttactgaggaaaagtttggccaggctgagaagactgagcttgacgcccattttgaaaatctacttgcgcgcgcggactcgactaagaactggaccgagaagattttaagacaaaccgaggtattactgcagccaaatccctcagcccgcgttgaagaatttctgtatgaaaagcttgacagaaaggttcctagtagagtgactaacggggaactcctggcacagtacatggctgacgccgcatcagaactgggcccaacaaccccatacggcaaaaccctgattaaagttgcagaggccgaaaagcagctaggcgctgccgagcgggacttcatccatacagcttctatctcctttctgaccccactgcgcaactttttggagggcgattggaagaccatcagcaaggaacgcagattactgcagaatcgcaggcttgatctggacgcgtgtaaggcccggctgaaaaaagcaaaagcagccgaagctaaagcaactacagtccccgactttcaggagacccgcccccgcaattacatcctgagcgcatctgcctcagccctttggaacgacgaggtggacaaagctgagcaagaactccgagtggctcagacagaatttgataggcaggccgaggttacacgcctactcttagaagggatctccagtacccacgtgaatcatctgcgctgtctgcatgagttcgttaaatctcaaacaacttattatgcccaatgttatcgtcacatgctcgacctacaaaagcaactgggaaggttccccggcacattcgtcggcacaaccgagcctgcctcccccccactttctagcacgtccccaaccacagcagccgccacgatgccggtggtcccctccgtcgctagccttgctccaccaggagaagcgagcttgtgcctggaagaggttgcccccccagccagcggaacgcggaaagcccgggtcctgtacgactacgaggccgcggatagttcagaattagcgctgttggccgacgagctgatcacagtgtactctctgccaggtatggatcccgactggctgattggcgagagggggaacaagaagggaaaggtgccagtcacctatctcgaactactcagctag

SEQ ID NO: 24387 - DNA, 615 bp, Artificial Sequence
  Description of Artificial Sequence: Synthetic coding sequence
atgagctggacctgcccccggtgccagcagcccgtgttcttcgccgagaaggttagttctttagggaagaactggcaccgattttgtctgaaatgtgagcggtgtcactcaattctctcccccggcggacacgcagagcataatggacggccctactgtcacaagccctgctacggagcactcttcggccctcggggcgttaacattggtggggtcggatcctacttgtacaaccccccaaccccaagtcccggctgtaccacaccattgtccccctcatcattcagcccaccaagacctaggacaggtttgccacaggggaaaaagtccccacctcacatgaaaacatttaccggcgagacctcgctctgccccggatgtggagaacccgtgtactttgccgaaaaagtgatgagccttggtaggaactggcaccgcccctgccttcgatgccaacggtgtcacaagacattgactgctgggagccatgccgaacatgacggggtgccctattgccacgtgccctgctacggatacctctttgggcctaagggtgttaatatcggcgatgtgggctgttatatatatgatcctgtgaagatcaagtttaagtag

SEQ ID NO: 24388 - DNA, 1221 bp, Artificial Sequence
  Description of Artificial Sequence: Synthetic coding sequence
atggagagcctgcggggctacacccacagcgacatcggctaccggtcattggctgtaggagaggacatagaagaggtgaacgatgagaagctcactgttacaagcctgatggcacgcgggggggaggacgaggaaaacacacgctcaaaaccagagtacggcaccgaagctgagaataacgtcggtaccgagggcagtgtcccttccgatgaccaagatcgggaggggggcggcggtcatgagcccgaacagcaacaggaagaaccccctctgacaaaaccagagcagcagcaggaagaacctccacttctcgagctcaagcaggaacaggaggaaccaccccagacaactgtcgaagggccacagcccgcagagggaccccagaccgcagagggaccccagccacccgaacggaagcggaggcgtcggactgccttcacgcagttccagctgcaggagctggagaatttctttgacgagtcccagtaccccgatgtggtggctcgtgagaggctggctgccaggttaaatcttactgaagaccgggtacaggtgtggttccaaaacagacgcgcaaaatggaaacggaaccagagagtcctcatgttaaggaatacggccactgccgatctggctcaccctctggatatgtttctcggaggggcttattatgccgcgcccgcgcttgaccctgcgctgtgtgtgcatctagtaccccagctgccccgtccaccagttctgcccgtgcctccaatgccaccgaggcctccaatggtaccaatgcccccgagacctcccatcgcaccgatgccccctatggcacccgtcccgcccggatccaggatggcccctgtgccgccgggcccaaggatggctcctgtgcccccttggccaccaatggcacccgtgcccccttggcccccgatggccccagtgccgaccggccctcccatggcgcccgtgccaccgggaccacctatggcaagagtgcctccaggtccccctatggctcgtgtgccacccggtccaccgatggcccctttgcccccaggcccacccatggccccactgccacccggccctccaatggctccactgcctcctggcccccctatggctccactaccaccgcggtcacatgtgccccacaccgggctggcccccgtccatattacatgggcaccggttatcaacagttactatgcttgcccgttcttctag

SEQ ID NO: 24389 - DNA, 873 bp, Artificial Sequence
  Description of Artificial Sequence: Synthetic coding sequence
atgagccccagcgccaagaagcggcccaagaacagccgggtgagcaagatgcaagacgagaaactgcgggacgaaaccgagcaaccagtgagtaaagtgattgaaagaaaccggctgcgcacagtgcttaaaaacctgtctctcttaaaattactgaagagttccaaccgaagaattcaagaactccataagttagcgaaacggtgttggcattctctgctttctgtccccaagattctgcggatatcgagcggcgagaactcagcttgtaataagaccaaacaaaacaatgaggaattccaggagatcggatgctccgaaaaagaactgaaatccaaaaaactcgaatctacaggcgaccctaagaaaaaagagtacaaggagtggaagagtcaggtccagtctggaatgaggaacaaggagaaaacctctctcgctgctatgccacgaaaagaaaaacacatagagccagaggtaccaagaacatccagggacgactctctgaaccctggggtgcaaggaagacagcccctgacagaaggtcctagggttatttttatcaagccctacaggaatcgcacgccaatgggacacatgaagcaactggatgtggctgatcaatggatttggttcgaggggttacccacaaggattcacctgcctgcccctagggtgatgtgcaggtccagtaccctgcgttgggtcaagcgtagatgcacacgcttttgcagcgcctcccttgaaatgccaatgtggcacccctacaaggtggacgttacttggaccagggccagaggggcttctagaggttggcgctctaggcaccagctcaagggccggaacgggtggcgtaactcacgcgtttataagtag

SEQ ID NO: 24390 - DNA, 1644 bp, Artificial Sequence
  Description of Artificial Sequence: Synthetic coding sequence
atggccggcaccaagaacaagacccgggcccaggccaagaccgagaagaaagcagcgatccaggctaaggctggggccgagagagaggccactggtgtggtgcgtccagttgctaagactcgggccaaggccaaggccaaaacaggtagtaagacagatgccgtcgcagagatgaaagcggtcagcaagaataaagttgtcgcagaaacaaaagaaggggccctgagtgagcctaaaacactcggaaaggctatgggggatttcacccccaaggcaggcaacgaatctacttcaagcacctgtaagaacgaggccggcactgatgcatggttttgggctggagaggaggcgaccatcaacagctggttttggaacggcgaagaggctggtaactctttttccaccaaaaatgacaagcctgaaatcggcgcacaggtttgcgccgaagagcttgaacctgctgcaggggcggactgcaaaccacgatcaggcgctgaagaagaggaggaggaaaatgtgattgggaattggttctgggagggggatgacacgtctttcgaccccaacccaaagccggtgtcccggatcgtgaagccacaacctgtatacgaaatcaacgagaagaatcgaccaaaggactggagcgaagtgaccatttggcccaacgcccccgcagtgacaccggccgtgctcggattccgaagccaagctcccagcgaggcgagccctccctcctacatcgtgttagctagcgcagaagagaacgcttgcagccttcccgttgccactgcatgccggcctagtcggaacacacgatcgtgcagtcagccaattcctgagtgtcggttcgattcggacccttgcatccagactatagacgagatacgacggcagatcaggatccgggaagtgaacgggatcaagccttttgcttgcccctgcaagatggaatgttacatggacagcgaggagtttgagaagctagtgtcacttctgaagtccactacagaccctctgatacacaagatcgcccggattgccatgggcgtgcataacgtgcacccttttgcgcaggaattcatcaatgaggtgggtgtcgtgacgctgatagagtccctgctgtcttttcccagtcccgagatgcgtaagaagacggttattaccctaaatccaccttccggggacgagcgccagaggaagatcgagctgcacgtgaagcacatgtgcaaggagacaatgtcattccctctgaatagtcccggccaacagtccggcttgaagatactcggccagcttactaccgattttgtgcaccactacatcgtggcaaattatttttccgaacttttccacctcctgtcttccggcaattgtaaaacaaggaatctcgtgttgaaattgctgctcaatatgtccgaaaaccctacagctgcacgggatatgatcaatatgaaagcacttgctgcactcaaactgatctttaaccagaaagaggcaaaagccaatttagtctccggcgtcgctatcttcatcaacataaaggaacatattaggaaaggctcgatcgtggtggtggaccatcttagctataatacactgatggctattttcagggaagtgaaggaaatcatagagacaatgtag

SEQ ID NO: 24391 - DNA, 1881 bp, Artificial Sequence
  Description of Artificial Sequence: Synthetic coding sequence
atgtgcagcaccctgaagaagtgcggcacctaccggaccgaggtggctgagtgtcatgaccatggtagtactttccagggccgcaagaaagggggttcatcgtttcgggataatttcgacaagaggtcttgtcactacgagcacggtggttatgaaaggcctccctctcactgtcaagagaatgacggttcagtggaaatgcgtgacgttcacaaggatcagcagctgagacatactccatacagtatacggtgcgaaagacggatgaaatggcactccgaagatgagattcgaattactacatggcggaacaggaagccgcccgaacgaaagatgagccagaacacacaggatggatacacccgcaattggttcaaggtgactatcccttatggtatcaaatacgataaggcttggctgatgaactctattcaaagtcactgttccgacaggtttacccccgttgatttccactacgttcgaaatcgcgcgtgtttcttcgtccaggacgcctctgccgcttcagctcttaaggacgtttcatataaaatatacgatgatgagaaccaaaagatctgcatttttgtaaatcactcaacagctccatacagcgtcaagaataaactgaaacctggtcagatggaaatgctgaaacttaccatgaataagcggtacaatgtctctcagcaagcgcttgacctgcagaacctgagattcgaccctgatttgatggggcgtgatatcgacatcattctcaataggcgtaattgtatggccgcaacactaaaaattattgagcggaatttccctgaactactatctttgaatctctgtaacaacaaactatatcagttggatggactgagcgacatcaccgaaaaggcccctaaggtcaagactttaaacctgagcaaaaacaaactcgagtcagcctgggagttaggtaaagtgaaggggctgaagctcgaggaactgtggctggaaggcaatcccctgtgttcgaccttctcagaccaaagcgcatatgtttcagcaattcgcgactgttttcccaaattgctccggctggacggaagggagctatctgccccggtgatcgtggatatcgatagtagcgagaccatgaagccctgtaaagaaaattttactggtagtgagaccctcaaacacctggtgctgcaatttttgcagcagtactattctatttacgatagcggcgacagacagggtttgctcggggcataccacgacgaggcctgtttttccttagccatccctttcgatcctaaagattctgccccctcatcactctgtaagtattttgaggatagccggaatatgaaaacactgaaggacccatacttaaagggcgagctcttaagaagaactaagcgcgacatcgtagattccctgtccgccctcccgaagacacagcacgatctgagcagcatcctcgttgacgtctggtgccagacagaacgaatgttatgttttagtgttaatggtgtgttcaaggaagtggaggggcaaagccaaggtagtgttttggcattcaccagaacatttattgcgacgcccggcagcagcagtagcttgtgtattgtgaacgacgagctcttcgtcagagacgcaagtccccaggaaacacaatcagctttctctattcccgtgtcaactttgtcgtcttcaagcgaaccctcattatctcaagaacaacaggagatggtgcaagcctttagcgcacaaagcggcatgaaactcgagtggtcacagaagtgcctgcaggataacgagtggaactacacacgggcggggcaagccttcactatgttacagaccgaaggcaagatccctgcagaggcttttaagcagattagctag

SEQ ID NO: 24392 - DNA, 1881 bp, Artificial Sequence
  Description of Artificial Sequence: Synthetic coding sequence
atgtgcagcaccctgaagaagtgcggcacctaccggaccgaggtggcggagtgccacgaccacggttctacattccaggggcgtaagaaaggcggaagtagctttagggacaatttcgacaagagatcatgtcactatgaacacggcggctatgaacggccacccagccactgtcaggaaaatgacggtagcgtggaaatgagagacgtgcataaggatcagcagcttagacataccccctattcaattagatgtgagcgtagaatgaagtggcactcagaagatgaaataaggatcacgacatggaggaaccgtaaaccgccagaacggaagatgtcacaaaatacgcaagacggctatacaaggaactggtttaaggtgactattccctacggcattaaatatgacaaagcctggctgatgaatagtatccaaagccattgcagcgataggttcactccagtagatttccactacgtcaggaacagagcttgtttcttcgttcaggacgcatcagccgcctctgcactcaaggatgtgagctataaaatctacgatgatgaaaaccagaaaatctgcatcttcgttaatcactcgactgccccatatagcgttaagaataaactcaaacccgggcagatggaaatgctcaagctgactatgaataagaggtataacgtgagtcagcaagcattggatcttcagaacctccgattcgatcccgatcttatgggcagagacatagatataatcttgaaccgcagaaactgcatggcggcaacgctgaaaataatagaacgcaattttcctgagctcctaagtctgaacctgtgcaataacaaactgtatcagctggacggcttaagtgacataactgagaaagcaccgaaggtcaaaacactcaacctgtccaagaacaaactcgaatccgcctgggagctgggcaaagtcaagggtctgaaactggaagaactgtggctggaagggaaccctctatgctctaccttctcagatcaatctgcatatgtgtccgccatccgggattgctttccaaagctgttgagactcgacggcagagaactgagcgcccctgtaatagtggatatcgatagcagcgaaactatgaagccatgtaaagaaaatttcaccggatccgagacattaaagcacctggtgctgcagttccttcagcagtattattcgatatacgacagcggagatcgacaaggactccttggagcctaccacgatgaagcctgcttcagcctggccatcccgttcgatccgaaggactccgcaccaagttcactatgcaagtattttgaagactctcgcaacatgaaaacactgaaagacccctacctcaaaggggagcttcttaggagaaccaaacgcgatattgtcgatagcctgagcgcacttccaaaaacacaacacgaccttagttctatcctagtggacgtctggtgtcaaactgagaggatgttgtgcttctcagtgaacggcgtgtttaaagaggttgaagggcagtctcagggttctgtcctcgcgtttaccaggaccttcattgcaacccccgggagctccagctcattgtgcatcgtaaacgacgaattatttgtccgggacgctagtccacaggaaacccagagcgccttttccatccctgttagtaccctctcctcttcttctgagccatcactgtctcaggagcagcaggaaatggtgcaagccttttcagcgcaatctggcatgaaactggagtggtctcagaagtgtctgcaggacaatgagtggaattataccagggcgggccaggctttcacaatgctgcaaaccgaaggcaaaattcccgctgaagcatttaagcagatcagctag

SEQ ID NO: 24393 - DNA, 1230 bp, Artificial Sequence
  Description of Artificial Sequence: Synthetic coding sequence
atgaagtggcacagcgaggacgagatccggatcaccacctggcggaaccgaaagccccccgaacggaagatgtcacagaatacacaggatgggtatacgcgaaactggttcaaagtgaccattccgtacggaatcaaatacgataaggcctggcttatgaattctattcagagccactgttctgataggtttacacctgtcgatttccattacgtaagaaaccgcgcctgtttcttcgtgcaggacgccagtgccgcaagcgctctcaaagacgtctcttacaagatctacgacgacgagaatcagaaaatctgtatcttcgtcaaccactcaaccgctccttatagcgtcaagaataagctgaagcccggccagatggaaatgctgaagttaactatgaataagcggtacaatgtgagtcagcaagccttggacctccaaaatttacggttcgatccggacctcatgggtcgcgatattgacattatcctgaatcgtcggaactgcatggcggccaccctgaagattatagagaggaattttcccgagttgctatccttaaacttatgcaacaataagctctaccaactcgacggactttcagacataaccgagaaagcccccaaagtaaaaacccttaacctctctaagaataagcttgagtctgcatgggaactcggtaaagtgaaaggattgaaacttgaggagctctggctcgagggtaaccctttgtgcagcacattcagcgaccagtccgcatacgtgtctgccattcgtgattgtttccctaagctcttgcgactcgacggtcgggaattatctgccccagttatcgttgatatagattcatcagaaacgatgaaaccatgtaaagaaaactttacgggttcggaaaccctgaagcatctggtattgcagttcctacagcagtactatagtatatatgatagcggtgatagacaggggctgctgggtgcataccacgacgaagcctgcttctcactcgctatccctttcgaccctaaagactccgctccttcctcactgtgtaagtacttcgaggactctcgcaacatgaagactctcaaagatccttacctcaagggcgagttgctccggagaactaagagagatatcgtggatagcctatccgcactgcccaaaacccagcatgatctcagcagcatcctcgtcgacgtgtggtgtcagactgtgccatctggccagtag

SEQ ID NO: 24394 - DNA, 1326 bp, Artificial Sequence
  Description of Artificial Sequence: Synthetic coding sequence
atggccagcgtggccgccgcccgggccgtgcccgtgggcagcggcctgcgaggattacaaaggaccttacctcttgtggtgattctgggcgcaacaggcaccggaaagtctacattggccctgcagttagggcagaggctgggcggggagattgtctccgccgattctatgcaggtgtatgaagggctggatattattactaataaggtgtccgcacaagagcagcgaatttgcaggcatcacatgatttctttcgtggatcccctcgtcaccaattacactgtggttgacttcagaaaccgcgctacggctctaatcgaggatatttttgctagagacaagatacctatcgtcgtcggagggactaattactacatagaatcgctgctttggaaagtgctggttaatacaaagccccaagagatggggacagagaaagtcatcgaccgcaaagtggagctggaaaaggaggatgggctcgtcctgcataagagattgagccaggtagatccagagatggctgctaaactgcaccctcacgataagcgaaaggtcgcccggtctctacaggtcttcgaggagactggcataagtcattccgagttcttgcatagacagcacaccgaagaaggcgggggaccactggggggcccactgaagttctccaatccctgcattctctggctgcacgctgatcaggccgtcttagacgagcgcttggataagagagtcgacgatatgctggccgccgggctgctggaggagctgcgagatttccaccgacggtataaccagaagaatgtgagtgaaaacagtcaggattaccagcatgggatcttccagtcaattgggtttaaagaatttcatgaatacttgattactgagggcaaatgtacacttgagacatccaatcagttgctcaaaaagggccctggtcctattgtgccacccgtctatggcctggaggtgtccgacgtcagcaagtgggaggagtctgttctggagcccgcccttgagatcgtgcagagctttatccaaggtcacaaacctacggctactcccatcaagatgccttataacgaagcggagaacaaacgcagctatcacctgtgtgacctctgcgaccgaatcattattggcgaccgagagtgggccgctcatatcaaaagcaaatcccacttaaatcagctgaaaaaaagacgccggttggacagtgatgccgtcaataccatcgaatcccagagtgtgtcgcccgatcacaataaggaacccaaggagaaaggcagtcccgggcaaaacgatcaggaactcaagtgttccgtttag

SEQ ID NO: 24395 - DNA, 1158 bp, Artificial Sequence
  Description of Artificial Sequence: Synthetic coding sequence
atggccagcgtggccgccgcccgggccgtgcccgtgggcagcggcctgagggggctgcagaggacacttcccctggtcgttatcttgggagctacgggaactggaaagagtaccttggctctgcagctgggtcagcgacttggaggagagatagtatccgcagactctatgcagccccaggagatgggaaccgaaaaggtgatcgacaggaaagtggagctggagaaggaagacggcctggttctgcacaaacggcttagtcaggtggatccggaaatggctgccaaacttcacccacatgacaaacgtaaggtggctcgcagtctgcaggtgtttgaagagactggaatctctcacagcgagttcctgcacagacagcataccgaagaggggggcgggcctctgggggggccgctgaaattcagtaacccatgcattctgtggcttcacgccgatcaggcagacgaaagactggataagcgggtcgacgatatgctggccgcagggcttctggaggaacttagggacttccatcgacgctacaaccaaaagaacgtgtcagagaacagccaggattaccaacacggtatctttcagtcaattgggttcaaggagtttcacgaataccttattactgagggcaagtgcactctggagacctccaaccagctgctaaagaagggcatcgaggccttgaagcaggtgactaaaagatacgccagaaagcagaaccgatgggtaaagaacaggttcctgtctaggccaggtcccatcgtgcctcccgtttatggcctggaagtgtccgacgtcagcaagtgggaggaatctgtgctggagcctgccttggaaatcgtgcagtccttcatccaagggcacaaacccactgccaccccaattaagatgccgtacaacgaagcagagaataagagatcttatcacctctgtgacctttgcgacagaatcattatcggcgacagagaatgggctgcccatatcaagtctaagtcccaccttaatcagttgaaaaaaagacgccgcctggactcagatgctgttaatacgattgaatcacagtccgtgtcccccgaccataacaaagagccaaaagagaagggatctcctggacaaaacgaccaggaactaaagtgcagcgtctag

SEQ ID NO: 24396 - DNA, 987 bp, Artificial Sequence
  Description of Artificial Sequence: Synthetic coding sequence
atgaagcggcccaaggagcccagcggcagcgacggcgagagcgacgggcccatcgacgtcgggcaggaagggcagctgtcccagatggcaagacccctgagcactcctagcagttcacaaatgcaggccaggaagaaacaccggggcattattgaaaaaaggcggagggacaggataaattcttctctgtctgagctcaggcggttggtaccgacagctttcgagaagcaggggagttctaagctggagaaagcagaagtgcttcagatgaccgtggatcatctaaaaatgcttcacgccactggcgggacgggcttctttgacgcccgcgcactcgccgtggactttcgcagcatcggatttcgcgagtgcttgacagaggtaattcgttatttaggggtgctcgagggaccctccagtcgggcagacccggttagaatcaggctgctgagtcacctgaacagttatgccgcagagatggaaccttctcccacccctactggtcccttagcattccccgcttggccctggtccttctttcattcttgtcccggtctcccagcattaagcaaccagttggcgatcctgggtagagtgccatctcccgttttgcctggcgtctcatcccccgcctaccctattccagccctgaggacagctcctctccgaagggccactgggattatattgcccgctagaaggaatgtgctgccttcgcggggtgcttcatccacccgccgagcgcgaccactggaacggcccgctacacccgtccccgttgccccttcatctcgcgcagctcggagttcacatattgcacctctgctacagtcgagctctccaacaccacctggtccaaccggctccgcagcatacgtcgcagtgccaacgcccaacagctcctctcctggaccggcaggccgacctgcgggggctatgctgtaccattcctgggtgagcgaaatcactgaaatcggggcattctag

SEQ ID NO: 24397 - DNA, 2262 bp, Artificial Sequence
  Description of Artificial Sequence: Synthetic coding sequence
atggagaccttcgagcccatcagccaggagcccctgagccaggcctcatatgataaagctcctgatcccgtaccagaattacaagacagtttctacgctgaactgcaacgtgctgaaagcctccaggagaagagcattaaggaagccaagaccaagtgccgaacaatcgcttctttactgacagcagcaccgaatcctcacagtaagggggtgcttatgtttaagaaacggcgccagagagccaagaaatacactctggtctcatttggtgccgctgcaggcacgggggctgaggaggaggatggggtgccccctacatccgaatccgagctggacgaggaagcattcagcgacgccaggtcattaactaaccagtccgactgggattccccttacctggacatggagctggcccgcgccgggagtagagctagtgaggggcagggctccggactcgggggccagctgagcgaggtatcaggccggggcgtccaattatttgaacagcagcggcagcgagccgactcaagtactcaggagctcgccagagtcgagccagctgcaatgcttaacggcgagggcctccaatcccctccaagggcccagtccgccccaccagaggccgccgtgctacctccctcccccctcccagctcccgtggcgtctccacgaccattccagccaggaggcggtgctcctaccccggcaccgtccatatttaacaggtctgcaaggcccttcaccccaggacttcaagggcagagacccacaacaacttcggttatatttcggcctttggctccaaagcgggccaacgactcgctgggtggactcagtcccgctcccccgcccttcctgagcagccagggacctacaccactaccgtcctttacctcaggggtcccttctcatgctcctgtgtcaggcagtccttccacccctcgatcgagcgggcctgtcaccgcgacatcgtctctgtacatacccgccccctccaggcctgtcacacctggcggcgccccagaaccccccgccccgccttcagcggcggccatgacgagcacagcatccatcttcctgagcgcacccctgcgaccaagtgcccgccccgaggcccctgctccaggacctggcgcaccggaaccgccttcggcacgtgagcagagaatctcggtacccgccgcacgcaccggcatcttgcaagaggcaaggaggagaggcacccgcaagcagatgttcaggcccggtaaagaggagacgaaaaatagtcccaacccagaactcctatcccttgtgcaaaatctcgatgaaaagccccgagcggggggggctgagagcggacccgaggaggatgctttgtcccttggagcagaagcttgtaatttcatgcagcccgtcggagcccgctcttataaaacccttccacatgtgacgccgaagacccctccaccaatggcacccaaaactcccccacctatgaccccaaagacaccaccacccgtggcccccaagccccccagtcgtggtctgttagacgggctcgtgaacggcgccgcctcttctgccgggatacctgaacctccacgattgcagggacggggtggcgagctctttgccaagcgtcagagccgcgccgataggtacgtcgtggagggaacacctggccccggtctggggcctaggccaaggtcgcccagccctactccttcgctgcctccctcctggaaatactcacctaatatcagagcccctccacccattgcatacaatcctcttctgtctccattcttccctcaggccgcccggacactgcctaaagcacaatctcaaggcccacgggctacacctaagcagggcatcaaggccctggactttatgcgacaccagccctaccagctgaagactgctatgttctgctttgatgaggtgccccccactccaggacctattgcgtctggctcccctaaaacagcccgcgtgcaggagatcaggcggttttccacacctgccccccaaccaaccgcagagccacttgctccaaccgtcctggcccctagagcagccactactctggacgagcccatctggcggaccgagttagcatcagctccggtccccagcccagctccccctccagaggcgccacggggacttggcgcctccccttccagctgcggcttccaggttgctcgaccacgcttctcagcgacacgtacgggccttcaggcccacgtatggagacccggcgctggtcaccagtag

SEQ ID NO: 24398 - DNA, 1041 bp, Artificial Sequence
  Description of Artificial Sequence: Synthetic coding sequence
atggagagcgtgagctgcagcgccgccgccgtgcggaccggcgacatggaatcccaaagagatctgtccctggtgcccgagagactgcagcgtagggaacaggagagacagctggaggtggaaagaagaaaacagaagcgtcaaaatcaggaagtggaaaaggagaatagccacttcttcgttgccaccttcgtccgcgagcgcgctgccgtggaggaattgctcgagagagccgaatcagtagagaggctagaggaggctgcttcaagactgcaggggctgcagaaattaataaatgatagtgttttcttcttagcggcatacgacctgagacagggccaggaagcactggcacgtctgcaagcggccctggccgagcgcagacgggggctgcagccaaaaaaaagatttgcctttaagaccagaggcaaggacgctgccagttccaccaaggtcgacgccgctcccggtatccctcccgccgtagaatctatccaggacagccccctccctaaaaaagcagagggagatctcggccccagctgggtttgcggcttctccaatctggagagccaagtgctggagaaaagggcatctgagctgcaccagcgcgatgtgttgttgaccgagctgtccaattgcaccgtccgactttacggaaatcccaacacgcttagactgacaaaggcacacagctgcaaactgttgtgtgggcctgtgagcaccagcgtctttctggaggattgctcagactgtgttctggccgtggcatgtcagcagctgaggatccattcaacaaaggatacccgcatctttctgcaggtgacaagtcgtgccattgtagaagattgtagcggcatccaattcgctccttatacttggagctatccggaaatagataaagacttcgagtcttccggactggacagaagtaaaaataactggaacgatgtcgacgacttcaattggcttgctcgagacatggcttctccaaactggagcattctgccagaggaagagcgcaacatccagtgggactag

SEQ ID NO: 24399 - DNA, 1569 bp, Artificial Sequence
  Description of Artificial Sequence: Synthetic coding sequence
atgagcccccagaagcgggtgaagaacgtgcaggcccagaaccggacatcccaggggagttccagttttcagaccaccctgtccgcttggaaagtgaaacaggatccgagcaattccaaaaatattagtaagcatggacaaaacaacccagtgggggattacgagcacgcagacgaccaggccgaggaggacgcattgcagatggctgtgggatatttcgagaagggaccgatcaaggccagccaaaacaaagataagactctagaaaaacacttgaagacagtggaaaatgtggcttggaaaaacggtctcgcgtcagaagagatcgacatcctgctgaacatcgctctgagcgggaagtttggaaacgcagtcaacactcgtattctgaaatgcatgatccccgccacggttatctcggaagattccgtggtgaaggcagtctcatggctatgcgtcggaaagtgcagtggtagcaccaaggtcctgttttatagatggctagtggcaatgttcgatttcattgatagaaaagagcagatcaatctcttgtacgggttcttctttgccagccttcaggatgacgcactgtgcccttacgtgtgtcacttactgtatctgcttaccaaaaaggagaatgtgaaacctttcagggtacgcaagctgcttgacttgcaagcgaaaatgggcatgcagccccacctgcaggccctgctgagcctgtataaattttttgcgcccgctctcatttccgtatccttgccagtcagaaagaagatatactttaagaactccgaaaacctatggaagaccgcactgttagccgtaaaacagaggaatcgggggccctctcccgagcctttgaaactgatgctggggcccgcgaacgtgaggccgttgaagaggaagtggaattccttgtccgtgatcccagtgcttaatagtagttcatatacgaaggagtgcgggaagaaggaaatgagtctatccgattgtcttaacagaagcggctcgttccctttagaacagcttcagagcttcccacaactcctccagaatatccactgcttggagctgccaagtcaaatgggctcggtgctgaacaacagccttctactgcactatatcaattgcgttcgggacgaacctgtgctgctgcggttttactactggctgtctcagactctgcaggaggagtgtatctggtataaagtaaataattacgaacatggaaaggaatttactaatttccttgatacgattattcgcgcggagtgttttctccaggaagggttctatagctgcgaggcctttttgtataaaagtctgccactctgggacggtctttgctgtagatcccagtttctccaactggtctcctggattccgtttagttctttttctgaagtgaaacccctgttgttcgaccatcttgctcagctctttttcacgagtactatctacttcaagtgttccgtcttacagtcgttaaaagagctgttacagaactggctactgtggctgtctatggacatccacatgaagccagtcaccaatagccctctatag

SEQ ID NO: 24400 - DNA, 2271 bp, Artificial Sequence
  Description of Artificial Sequence: Synthetic coding sequence
atgagcccccagaagcgggtgaagaacgtgcaggcccagaaccggaccagtcagggctcatcttctttccagactacattatccgcctggaaggtgaagcaagacccatccaatagcaaaaacatatcgaaacacgggcaaaataaccccgtgggcgattatgaacatgctgatgatcaggcggaggaagatgcactgcagatggccgtgggttactttgagaaagggcctatcaaagcctcacaaaacaaggataaaacgctggaaaagcacctcaagactgtggagaatgtggcttggaaaaacggcctcgccagcgaggagattgacatacttttaaacatagcactgtcagggaagtttggaaatgctgtgaacacccgaatcctgaagtgcatgatcccagcaacagtcatttctgaggactcagtggtgaaagccgtcagctggttgtgcgttggaaaatgcagcgggagcactaaagttctgttctatcggtggctcgtggcgatgttcgattttatagaccggaaagagcagataaaccttctctatgggttcttcttcgcgagcctgcaggatgatgccctgtgtccttatgtttgtcatctcttatatttgctcaccaaaaaggagaatgtgaagccgtttagagtgagaaaactgctggatcttcaggccaagatgggcatgcagccgcacctacaggccctgttatcattgtacaaattcttcgcaccagcactcatttccgtcagcctccccgtacgcaagaagatttattttaaaaatagtgagaatctgtggaagacggccctgctggcagtgaagcaaagaaatcgaggaccatcccccgagccacttaaattgatgttgggccctgccaacgttcggcccctgaagcgcaaatggaatagtctgagcgtgattcccgttctaaattccagcagctatactaaagaatgtggcaaaaaagagatgagcctgagtgactgcctgaataggagcggaagcttcccccttgagcaattacagtcatttccccagctgctccagaatatccattgcttggagctgcccagccagatgggtagcgtactcaacaattccttactgctccactatataaactgtgtgagagatgaacctgtgttactgcgattctattactggttatcccaaaccctgcaggaggagtgtatctggtacaaggtcaacaactacgagcatgggaaggagttcactaactttcttgacacgatcatccgggccgagtgcttcctccaggaagggttctattcctgcgaggctttcctctacaagtctttgcctctgtgggatggactctgctgtcgcagccagtttctgcagcttgtttcctggatccccttcagctccttctccgaggtgaagcctctgctctttgaccatctggcacaactgttctttacttccaccatttattttaagtgtagtgttctgcagtcacttaaagaacttcttcagaactggctgctctggctctctatggatatccatatgaagccagtaaccaacagccccttggagaccaccttggggggctcaatgaacagtgtttccaagttgatccactatgttgggtggctgtctaccacggccatgcgactagaatctaataatacatttttgctccactttattttagatttctatgagaaggtctgcgatatctacatcaattataatctcccccttgttgttctgtttccgccagggattttttatagtgcactgttgagcctggacacatctatactcaaccagctgtgtttcattatgcacagatacaggaagaacttgacagccgctaaaaaaaatgagttggtccagaagactaagagtgagttcaatttttcaagcaagacgtatcaagagttcaatcactaccttacctccatggttgggtgcctctggacatcgaagccgtttggaaagggtatttacatagacccggagatcctggagaagacaggggtggcagagtacaaaaattcgttaaacgttgtgcaccatccgagcttcctgtcatatgctgtgtctttcctcctgcaggaaagccccgaagaaagaaccgtcaatgtgtcatccatccgcggcaagaagtggagctggtacctcgattacctgttcagtcagggccttcagggactaaaactcttcatccggtccagcgtccaccattcttctatcccaagggcggagggtatcaactgcaataatcagtattag

SEQ ID NO: 24401 - DNA, 933 bp, Artificial Sequence
  Description of Artificial Sequence: Synthetic coding sequence
atggccgacgccgccgccaccgccggcgccggcggcagcggcacccgcagtgggagtaaacagagcacaaaccccgccgataactatcacttagccagaagaagaactctgcaagtggtggtttcctccctcctgaccgaggcggggttcgaaagcgccgagaaagccagtgtggaaactttgacagaaatgctgcagtcctacatctctgaaattggccgaagcgctaaaagttactgtgagcacaccgccaggacacagcctacactctctgatatcgtggtcaccctcgtagaaatgggattcaacgtagacaccctgcctgcttatgcaaagcgatcccagcggatggtgattaccgccccacccgtgaccaaccagccagttacccctaaggctctgactgctggacagaatagacctcaccctcctcacatccctagtcatttccccgagtttccagacccacacacatacattaagaccccgacctatcgggagccagtgtcagactatcaagtcttaagggagaaggccgcttcgcaacgtcgcgacgtggagagagctttgactagattcatggcgaaaaccggtgagacccagagcttattcaaagatgatgtttccaccttccctctgatcgccgctcggccttttacaataccttaccttacggcgctcctgccgagcgagttagaaatgcagcagatggaggagactgactcttccgagcaggatgaacaaacagataccgagaacttggctctgcatatcagtatggaagattccggagctgagaaagagaatacgagtgtgctccagcaaaatccatctctgtcgggcagtaggaatggagaagagaatattatcgataacccgtatctccggccagtcaaaaaaccaaagatccgtcgcaaaaagtcccttagctag

SEQ ID NO: 24402 - DNA, 1935 bp, Artificial Sequence
  Description of Artificial Sequence: Synthetic coding sequence
atggaggagaccatgaagctggccaccatggaggacaccgtggagtactgcttgttcttgatcccggatgagtctcgtgattccgacaaacataaggaaatcctccaaaaatatatcgagcgtataatcacgcggtttgctcccatgctcgttccctatatatggcagaaccaacccttcaacctgaaatacaaaccaggcaaaggcggtgtaccagcgcatatgttcggcgtgactaagttcggcgacaacatcgaggatgaatggtttatcgtatacgtgatcaagcagatcaccaaggaattccctgagctggttgccaggatcgaggacaatgatggagaatttttgctgattgaggctgccgacttccttcccaagtggctcgatccagaaaattccactaatcgggtgtttttctgccatggcgagctatgcattatcccagctccccgcaagagtggggctgagagttggttgccgacaacaccacctaccatcccccaggctctgaatatcatcaccgcacacagtgaaaagatcctggccagtgaaagcattcgggccgccgtcaacaggcgcatacgtggctacccggagaagattcaggcttctcttcacagagctcactgtttccttccagcgggcattgtggcggtcctcaagcaacgcccacgcctggtcgctgcggccgtgcaggccttttatctgcgcgatcctatcgatctgcgcgcctgccgggtcttcaaaacattcttgcctgagacaagaattatgacttctgtgaccttcacgaaatgcctgtacgcccagctcgtgcagcagcggttcgttcccgatcgacgctctggttaccggctgcccccacctagcgatccccaatatcgcgcacacgaactgggtatgaagctcgcccacggttttgagatactctgttccaagtgcagtccccattttagcgattgtaagaagtctctcgttacggcctccccactctgggcaagctttctggagagcttgaaaaaaaatgactattttaagggtctgattgaaggatccgctcagtaccgcgagcgacttgagatggccgagaactacttccaactcagtgtggattggcctgaatcctcacttgctatgtctccgggagaagagattctcacattactccagactatcccctttgacatcgaggacctcaagaaggaggcagcaaatctgcctcctgaagatgatgaccagtggttagacctctcgcccgaccagctggaccagttactgcaggaggcagtcggcaagaaggagagcgagtctgtcagcaaggaggaaaaggaacagaactatgatttaaccgaggtgagcgagtccatgaaggcctttatcagcaaggtttcaacacacaaaggcgcggaactccccagggagccctccgaagctcccatcacgtttgacgccgatagcttcctgaactacttcgataagatcttgggtccgagacctaatgagtcggattccgatgacctagacgacgaggatttcgagtgtcttgacagcgacgacgatctcgattttgaaacccatgaaccaggcgaagaggcttccctgaagggcactctagataacttgaaatcatatatggcgcagatggatcaggaactggctcacacttgtatttcaaaatccttcacaactcgaaaccaggtggaacccgtcagccagaccactgacaacaattcagatgaagaggattctggtacaggcgaatccgtaatggcccctgtcgatgtcgacttgaacctcgtctctaatattctcgaatcgtactcttctcaggccggtctagcgggaccagcgagcaaccttctccagtccatgggggtacagctccccgataacaccgaccaccggccaacatctaaacccacaaagaattag

SEQ ID NO: 24403 - DNA, 2163 bp, Artificial Sequence
  Description of Artificial Sequence: Synthetic coding sequence
atgagcgtgagcggcaagaaggagttcgacgtgaagcagatcctgcgcctccggtggagatggttcagtcacccgttccagggctctacaaatactggcagctgcctacagcaggaaggctatgagcatcgaggtacccctgtacagggaaggctcaagtcgcacagtcgagacagaaacgggctgaagaaatcaaatagcccagtgcatcacaatattttggcccctgttccagggcctgcaccggctcaccagagagccgtgcagaacctgcagcagcacaacctaattgtccactttcaggccaacgaggatacacccaaaagcgttcccgagaagaacctttttaaggaggcctgcgagaaacgggcccaggatttggagatgatggcagatgacaacatcgaagactcaacggcacgtctggacacccagcactccgaagacatgaatgcaacccggtccgaggaacagtttcacgtaataaaccatgccgaacagacgctgagaaagatggaaaattatcttaaagagaagcagttgtgtgacgtgctcctgatagcaggtcacttgcggatcccagcccatagactggtcctgtctgccgttagcgattattttgctgccatgttcaccaatgacgtcttggaagctaaacaggaggaggtgcgaatggagggggtggacccaaacgcactgaattctttagtccagtacgcttacactggcgtactccaattaaaagaagacaccatcgagtcattactcgcggcagcatgtctgctccagctgacccaggtgatagacgtatgttctaatttcctcattaagcagctacatcctagtaactgccttggaatccgtagctttggcgatgcccagggctgcaccgagctcttgaatgtcgcccacaagtacaccatggagcacttcattgaggtgataaaaaaccaggaattcctgctccttcctgccaacgagatctcaaaactcttgtgcagtgacgacattaatgtgcccgatgaagaaacaatttttcacgccctgatgcagtgggtggggcacgatgtccagaacagacaaggagagctgggcatgctcctcagttacatccggctgccgctactgccaccacaacttttagccgacctggagaccagtagtatgttcactggcgacctggaatgccagaagctcctgatggaggcaatgaagtaccacctgctgccagagaggagaagcatgatgcagtcaccacgtacaaagccacggaagtccactgtgggggcgctgtatgccgtgggcgggatggatgccatgaaaggaactacaacaatcgaaaaatacgacttgaggacaaactcgtggctgcacatcgggactatgaatggcagacgcttgcagtttggagtggcagtgatagacaataagctctacgttgtgggtggtagagacggcttgaagacgctgaataccgttgaatgtttcaacccagtggggaagatctggacagtgatgccccccatgtctacacatagacatgggctcggagtggctaccctggaagggcctatgtacgctgtaggagggcacgatggttggtcctatctgaacacagttgaacgctgggaccctgagggacgccagtggaactacgtggcctccatgagcaccccgcgcagcaccgtgggagttgtggcgcttaacaacaagctatacgcgattggtggacgggatggatcctcgtgtctgaaaagcatggaatatttcgacccacacaccaacaaatggtctctctgtgctcccatgtctaagaggcggggaggtgtgggcgtggctacatataacgggttcctttatgtcgtcggggggcacgatgcacctgcttccaatcattgcagtagactgtcggattgtgtagaacggtatgatcccaaaggcgatagctggtccaccgtggctccgctaagcgtgcctagagacgcagtcgccgtatgtcctctgggcgataagctgtatgtggtaggcggttatgacgggcatacatacttgaacactgtggaaagctacgatgctcagcgaaacgagtggaaggaaagcatgcaagaactgttgcagaatttctataccacccagaaattaaaagaaaccctggggcactag

SEQ ID NO: 24404 - DNA, 2157 bp, Artificial Sequence
  Description of Artificial Sequence: Synthetic coding sequence
atgagcgtgagcggcaagaaggagttcgacgtgaagcagatcctgagactgcgttggagatggtttagtcatccgttccagggaagtactaatactgggagttgccttcaacaagaggggtatgagcacaggggcacccccgtgcagggcagactgaagagccattcacgggacaggaatggactaaaaaagagtaatagccccgtgcatcataacatacttgcaccagtccccgggcctgctcccgctcaccagagggccgttcagaatctgcagcaacataacctcattgtccatttccaggcgaacgaggacactccaaagagcgtgccggaaaagaatctttttaaagaagcctgcgagaaacgcgctcaagacttggaaatgatggccgacgacaacattgaagactcaacggcacggttggacacccagcattcagaggatatgaacgctactcgcagcgaagaacaattccacgtgattaatcacgccgagcaaacactgcggaagatggagaactacttgaaggaaaaacagttgtgtgacgtcctcctgatagcagggcatctccggatccccgcccacaggctcgtgctgagcgctgtgagcgattacttcgcggctatgttcacaaacgacgtgttggaagccaagcaggaagaggttagaatggaaggcgtggacccgaatgcattaaacagcctcgtgcagtatgcgtatactggcgtgttgcagttgaaggaagataccatcgagtccctccttgcagcagcatgcctcctgcaactgacccaagtgatagatgtatgctctaactttctcataaaacagctgcacccctcaaattgtctgggcattaggtcatttggcgatgcccaaggctgtaccgagctgctgaatgtggcccataagtacaccatggagcacttcatagaagtcattaaaaaccaagagttcttgctgttgccagccaatgaaatttctaagctgctttgctcagatgacattaacgtacccgacgaagaaacaatcttccatgcgctcatgcaatgggtggggcatgacgtgcagaaccggcagggggagctcgggatgctgttatcttatattaggcttcctctacttccaccccagctactggccgaccttgagaccagctccatgtttaccggcgatctggagtgtcagaaattactaatggaggccatgaagtaccacctgctacctgaacgtaggagcatgatgcagagcccgcggacaaagccccggaaatccactgtgggagccctgtatgccgtgggcggcatggatgcaatgaaaggcaccacgaccatcgaaaagtatgatctcaggacgaattcctggcttcatatcgggaccatgaatggcaggcggctgcaattcggcgtagcggtgatagacaataagctctacgtcgttggcggccgcgatgggctgaaaactcttaatacagtcgaatgctttaaccccgtcggaaaaatatggaccgtcatgcccccgatgtcaacacataggcacggcctaggggtcgcaaccctcgagggtccaatgtatgcggtaggcggccacgatggctggtcctaccttaatactgtcgagagatgggaccctgaaggccggcagtggaattacgtagcatctatgtctacacccaggtcgactgtgggggtagtggccttgaacaacaagctatacgctattggcggtcgcgatggaagttcgtgtcttaagtctatggaatactttgatccacacaccaacaaatggagcctttgcgcccctatgtccaagcggcggggtggagtcggcgtcgctacatataatggcttcctgtatgtcgtgggaggccacgatgccccggctagcaaccactgcagtagactgtcggattgcgtcgagcgatatgatccgaagggagactcttggagcaccgtggcccctctgtccgtaccccgtgacgccgtggccgtctgtcccctgggagacaagctctacgtggttggcggatatgatggtcacacgtatctgaacaccgtggagtcatacgacgctcagaggaatgagtggaaagaagaggttccagtgaacattggacgggccggcgcatgcgttgtcgtcgtaaagttgccctag

SEQ ID NO: 24405 - DNA, 1134 bp, Artificial Sequence
  Description of Artificial Sequence: Synthetic coding sequence
atgaacggccccgtgagccccaagagcaaggcccggcccagcagcccaagtacatcctggcacaggcccgcttccccttgtccaagcccaggccccggacacaccctacctccaaagccaccttcacctaggggaacaaccgcaagtcccaaaggtagagtacggcgaaaggaggaggctaaagaaagtccatcagcagctggcccagaagataagtcacagtctaagcgccgcgcctcgaatgagaaagagtccgccgccccagcgtctcctgcacctagccccgcccccagcccaactccggcccccccacagaaggaacaaccacccgccgagacaccaacggctcccgcgccaccagtgacaccttccaagcctatggctggcaccactgaccgcgaggaggccacccgcctactggccgaaaagcgccggcaggctagggagcagcgtgagcgcgaagagcaagaaaggcggttacaagctgagagggacaaaagaatgagagaggaacagctggccagagaggctgaggccagagcggagcgcgaagccgaggctcgccggagagaagaacaggaggctagggaaaaagcacaggcggaacaagaggagcaggagcgcctgcagaaacaaaaggaggaagccgaagcgcgaagcagagaagaggccgaacgccaaaggttggagcgtgaaaagcactttcagcagcaagagcaagaaagacaggagagaagaaaaaggcttgaagagattatgaaacgcacaagaaagtccgaagtttctgagacaaagaaacaggattccaaagaagctaatgccaacggttcatcacctgagccagttaaagccgtggaggcccggtcccctggcctccaaaaagaagctgttcagaaggaagagcccattccccaggagccccagtggtcactccccagcaaagagctcccagcttcactggtaaacggtctgcagcctctccctgctcatcaggagaacggcttttcaaccaatgggccctcaggagacaaatcactgagtcgcactcctgagaccctcttgccttttgcggaggccgaagcctttctgaagaaggccgttgtgcagtctcctcaggtcaccgaggtgttgtag

SEQ ID NO: 24406 - DNA, 2427 bp, Artificial Sequence
  Description of Artificial Sequence: Synthetic coding sequence
atggagagcggcccccgggccgagctgggcgccggcgccccccccgccgttgttgccaggactccccccgaacctagaccctccccagagggagatccttctccgccccccccaccaatgagcgcgttggtaccggacacacctccggatactcctccagccatgaagaacgctacctcctccaagcaactccctctggagcccgaatctccatctggccaggtcggtccccgccccgcaccaccacaggaagagtcgccatccagtgaggccaaaagtcggggccccacccctcctgcgatgggaccacgagatgcacgtcctcccaggaggtcctctcaacctagcccaaccgctgtgcctgcgtccgactcccccccaaccaagcaggaagtgaagaaagccggcgaaagacacaagctggccaaggaaagacgcgaagagagggccaagtacctggcggccaagaaagccgtctggctggaaaaggaagagaaggccaaagccctgcgggagaagcaactgcaggaacggcggaggcgactcgaggagcaaagactgaaagcagaacagagaagagccgctttggaagaacggcagcggcaaaagcttgaaaagaacaaagagcgctatgaggccgccattcagagatccgtgaagaaaacctgggctgaaatcaggcagcagcgctggtcttgggccggcgccttgcaccattcaagccccggtcataagacatctggaagcagatgttcagtctccgctgtaaatctgccaaaacatgtggattccattatcaacaaacgccttagcaagtcttctgctacactttggaactcgccaagcaggaaccgttcactacagctgagtgcctgggaatcctctatagttgatcggctgatgactccaaccctcagtttcctcgccaggtcccgaagcgccgtcacactgccgcggaatggcagggatcaggccgttcccgtctgtcctaggagcgcttctgcttccccattgacgccctgtagtgtcacacgctcagtccaccggtgcgctcccgctggagaaagaggcgagaggcggaaaccaaatgccggtggaagccctgccccagtgagacggagaccagaagccagtcccgtgcaaaagaaagaaaagaaggacaaagaacgcgaaaacgagaaggagaaatccgctctcgcgagggagcgatctctcaaaaaaaggcaatccttacctgcatcgcccagggctcgcctcagcgccagcacagcttccgaactgagccccaagtccaaagctcgcccttcctcaccttcaacatcctggcatcggccagctagcccttgtccctcacccggtccgggacacacccttcctcccaaacccccatctccacgaggaaccacagccagccctaagggccgcgtcaggcgaaaggaggaagctaaggagtctccttccgccgcaggccccgaggacaagtcacagtccaaaaggagagcttctaacgaaaaagagtcagctgcgcctgcttcccctgcacccagcccagccccaagtccgactcccgcaccacctcagaaagaacaaccccccgcggaaaccccaaccgatgcagcagtactgacatcaccccctgcccctgcaccccctgtgacaccaagcaaaccaatggccggcactactgaccgcgaggaagctacgaggctgctggcggagaagcgacgacaggcccgtgagcaacgtgaaagagaagagcaggagaggcggcttcaggctgaaagggataagcgcatgcgggaggagcaactggcccgagaagcagaggcccgcgctgagagggaggccgaagcgagacgtcgagaggagcaagaggctcgcgagaaagcccaggctgaacaagaggaacaggaaagacttcaaaagcagaaagaagaagcagaggcaaggagcagggaagaggcagagcggcagaggctcgaaagagagaagcattttcaacaacaagagcaggagaggcaggaacgaaggaaacgtctcgaagaaatcatgaaacggacaaggaagtcagaagtcagcgagactaagaagcaggatagcaaggaggccaatgcaaacggcagctctcccgagcctgtcaaagctgtggaggccagatcaccaggtcttcaaaaagaagcggttcaaaaggaggaaccgatacctcaggagcctcagtggtctctgccctctaaagaactgcctgctagtctggtaaatgggctccagccacttccagcacaccaggagaacggattctcaacgaacggtccttccggggacaagagcctctccaggaccccagaaaccttactgcccttcgcggaggccgaggcttttctgaagaaagccgttgtccagtcgccacaggtgacagaagtgttgtag

SEQ ID NO: 24407 - DNA, 2526 bp, Artificial Sequence
  Description of Artificial Sequence: Synthetic coding sequence
atggagagcggcccccgggccgagctgggcgccggcgccccccccgctgtggtggcgcgaaccccacccgagccccgaccttctccagaaggcgatccctcccctccaccaccaccgatgtcagcgctggtacccgacaccccgcccgacactccacccgccatgaagaatgctacgagcagcaaacagctgcctctggagccagaatctccatctggacaggtaggccctcgccccgcacctccccaggaagaaagcccttcgtcggaggcgaagtcccgcggtcctacaccgcccgccatgggacctagagatgcacgccccccaaggcgaagcagccaaccgtcccctactgccgttcctgcctcagattcacctcccactaaacaagaagtcaagaaagctggcgagcgacataaattggctaaggagcgccgcgaggagagagccaagtatttggctgcaaagaaggctgtctggttggaaaaggaagagaaagctaaggcgctgcgggaaaagcagctgcaggagcgacgtcgaagactggaagaacagaggctcaaggccgagcagcgccgagcagccctcgaggagcgccagcgccagaagcttgagaaaaacaaggagagatatgaagctgcgattcagagaagcgtgaaaaaaacgtgggctgagataagacagcaaaggtggtcttgggcgggagcgttgcatcactcaagcccgggccataagacgagtgggagcaggtgctccgtaagcgccgtcaatcttccaaagcacgtggatagcatcatcaataagaggctgagtaagtccagcgccacgctgtggaactcaccatcacgtaacagatctctgcagctgtcagcatgggagtcaagtattgttgaccggctgatgaccccgaccctgagctttctcgcgcgatccaggtctgccgtgacgctaccccgcaacggccgggaccagggccggggttgtgatcctggcagaggaccaacgtggggcagagccggggcgtctctcgcccgcgggcctcagcctgacagaactcacccttcggcagcagtgccagtttgccccaggtcagcaagcgcgtcccccctcactccgtgctcggtgacgcgaagcgtccatcggtgtgcccccgcaggggaaagaggcgagcggagaaagcctaatgccggaggtagcccggccccagtccgacggcgccctgaggccagtcctgttcagaaaaaggagaagaaagataaggaacgcgaaaatgagaaggagaagtcggctctcgcccgcgaaaggagtctcaaaaaaaggcagtcactgccggcctcccccagggcaaggctaagcgcatcaaccgcctctgagctctcacccaagagcaaggctaggccttcatcaccatcaacatcctggcatcgacccgcttctccctgccctagtcccggacccggccacaccctccccccaaaacctccttcacctcggggcacgaccgcaagccccaagggccgagttcggcggaaggaagaggctaaggagtcaccttctgccgctggtcctgaggataaatctcagagcaagagacgggcctccaatgagaaggagagcgccgctcccgcttccccagcaccgtccccagcccctagcccaactcctgcgcctccacagaaagaacagcccccagcagagacacctaccgacgcggccgtgctgacatccccccctgcgcccgctccgcccgtgacacccagtaaaccaatggcgggaacgacggacagagaggaggctacacgcttgcttgctgaaaaaagaagacaagcaagagaacagagggagcgcgaagagcaggaacgccggctgcaggccgaacgagataagagaatgcgagaagagcagctggcgcgcgaagccgaagctagagccgaacgagaagcagaggccaggagacgagaggaacaagaagcacgtgaaaaggcgcaggccgaacaggaggagcaggagcggctgcagaaacaaaaggaagaggctgaggcacgcagccgggaggaagccgagcgacagcgcctggagcgtgagaagcattttcagcagcaggagcaggagagacaggaaaggagaaagcgcttggaggagattatgaagcggacccggaaaagcgaggtttctgagaccaaacagaaacaggattcgaaggaggcgaacgcaaatggcagttcccccgaacccgttaaggctgtggaggcacggagcccaggcctacaaaaggaggcggtccaaaaggaggagcctatcccgcaggagccccagtggtcactgcccagtaaggaactcccggccagccttgttaacggcctgcagcctcttcctgctcatcaagaaaacggattttcaaccaacggtcccagcggtgacaagtcactaagtcgcacaccggaaacattactgccctttgcggaggcagaagcttttctgaaaaaggctgttgtgcagtcaccccaggtgacggaggtgttgtag

SEQ ID NO: 24408 - DNA, 495 bp, Artificial Sequence
  Description of Artificial Sequence: Synthetic coding sequence
aacctgcccaagcacgtggacagcatcatcaacaagcggcagcggttggagcgcgaaaagcactttcagcagcaggagcaggaacgacaggaacgtcgtaaacgactggaggagataatgaaacgcaccaggaaatctgaagtatctgagacaaaaaagcaggactctaaagaagcaaatgcaaacggaagtagccctgaaccagtgaaggctgtggaagcccgatctcctgggctgcagaaggaagccgtacagaaggaagaacccatcccgcaggagccgcagtggtccttaccttccaaagagttgcccgcctctctcgtgaatggtctccaacctctgccagcacaccaagagaatggctttagcactaacgggcccagcggtgataagtcattatccagaaccccggaaaccttactccctttcgcggaagcagaggcctttctaaagaaagcagtggtgcagtccccacaggtaacagaggtgctttag

SEQ ID NO: 24409 - DNA, 345 bp, Artificial Sequence
  Description of Artificial Sequence: Synthetic coding sequence
atggtgatccgggtgtacatcgccagcagcagcggcagcaccgccatcaagaaaaagcagcaggatgtccttggctttttagaagctaataagattggattcgaagaaaaggatatcgcggcaaacgaggagaataggaagtggatgcgcgaaaatgttcccgagaacagtcgacccgcgacaggctatccactccccccacagatcttcaatgaaagccagtacagaggtgactatgacgcttttttcgaagcccgcgagaacaacgccgtctatgcatttctagggctgacagctccccctgggtcaaaagaagctgaggttcaggctaaacagcaggcttag

SEQ ID NO: 24410 - DNA, 537 bp, Artificial Sequence
  Description of Artificial Sequence: Synthetic coding sequence
atgagcggcttcagcaccgaggagcgggccgcccccttcagcctggagtatcgcgtgttcttaaaaaacgaaaagggtcagtatatcagcccctttcacgatatcccaatctatgctgataaggacgtgtttcatatggttgtcgaagtccctcgatggtctaatgctaagatggaaatcgcaaccaaggaccctctgaatcccattaagcaggacgtgaaaaagggcaagttaaggtacgtggccaatctctttccatacaagggatacatctggaactatggggccatcccccagacatgggaagaccctggacacaatgataagcacacgggctgttgcggtgataatgaccctatcgacgtgtgcgagatagggtcgaaggtttgcgcccgcggtgagatcatcggtgtgaaggtccttggcatcctggcgatgattgacgagggcgagacggattggaaggtcatagcgatcaatgttgatgatcccgatgctgctaattataatgtatgcaattccgtggttattctgtag

SEQ ID NO: 24411 - DNA, 870 bp, Artificial Sequence
  Description of Artificial Sequence: Synthetic coding sequence
atgagcggcttcagcaccgaggagcgggccgcccccttcagcctggagtaccgtgttttcctgaagaacgaaaaaggccaatacataagcccttttcatgacattccaatttatgctgataaggatgtgttccacatggtggttgaagtgcctaggtggtcaaacgcgaagatggagatagcaacaaaggatcctctgaatcccataaaacaggatgtaaagaaaggcaaactgcggtatgtggctaacttgttcccttacaagggctatatttggaactatggggcaatccctcagacatgggaagacccagggcacaacgataaacatactggttgctgtggggacaatgaccctatcgatgtgtgcgagattggctcaaaggtttgcgcccggggagaaatcattggggtcaaagtactgggcatactggcaatgatcgatgagggcgagaccgactggaaggtgatcgccatcaatgtggacgatcccgatgccgctaactacaatgacattaatgacgtgaagaggctaaagcccggctatctcgaggcaacagtcgattggttccgacggtataaagtgcccgatgggaaaccggaaaatgagttcgctttcaatgctgagtttaaggataaagacttcgctatagatatcattaagtccacgcacgatcactggaaggccttagtaacaaagaaaactaatgggaaggggatttcttgtatgaacaccactctgagtgagtcaccattcaagtgcgatcccgatgcagctcgtgccatcgtagacgcgctgccaccgccctgcgaatcagcctgtaccgtcccaactgatgtcgataagtggtttcaccatcagaagaactag

SEQ ID NO: 24412 - DNA, 2103 bp, Artificial Sequence
  Description of Artificial Sequence: Synthetic coding sequence
atgaccgagcggtgcagcctgtggagcgccctgagcgccgccgcctgttgtttctataggggctcgtttgtacagttttccaaggagaagtacatcctcgacagtagtccagagaaactgcacaaggagctcgaggaggagctcaagctctcgagtaccgatttgcgctcacatgcctggtaccacggccggatacctagggaggtgagtgagacccttgttcagcgcaacggcgattttcttatcagggattcacttacaagtttgggcgactatgtgctgacatgcaggtggagaaaccaagctctgcactttaaaatcaacaaagtggtggttaaggccggggaaagttatacacatattcagtacctgttcgagcaggagagctttgaccatgtacccgccctggtgagataccacgtcggctctcggaaggcagtttctgagcagagtggcgccatcatctattgcccagtgaatcgtaccttcccactgcgctatcttgaggcctcctacgggctagggcagggatcctccaaacctgccagccccgtttctccgtctggtcccaaggggtcccatatgaaaagacggtccgtaactatgacggatggcctgaccgctgacaaagttactcgctctgatggctgccctacgtcaacatctctcccacgcccccgcgactcaatcaggagttgcgccttgtcgatggatcagatacccgaccttcattccccgatgagtccgatctctgaaagcccatctagcccagcttattcaaccgtgacacgggtccatgccgctccagccgcccctagtgccactgccctacccgcatcgcctgtcgcacgaaggtcgtcggaacctcaattatgtccgggtagcgctcccaagactcatggtgagagtgataaggggccacacacatccccctcacacacactggggaaagccagcccatcacctagcctcagtagctacagtgatccagattcaggacattactgtcaactgcagccaccagtgaggggatctagggagtgggccgctaccgagacatcctctcagcaggcaaggtcgtatggcgagagactcaaggaactgagcgaaaatggtgcgccagaaggagattggggcaagacctttaccgtgcctatcgttgaagtgacatcttcctttaacccagcaacatttcagagccttttaatcccccgcgacaatcgaccgctggaagtcggcctattacggaaagtgaaggagttgttagccgaagtggatgcccggactctggctagacatgtgacaaaggtagactgtctggtcgcacggatcctgggcgtaaccaaagagatgcagacattaatgggagtgagatgggggatggaactgttgacgctaccacacggacgacagttaaggctcgaccttctggagaggttccacaccatgagcataatgctggcagtggacatactgggatgcaccggctctgccgaggaacgcgccgccctgctccacaagactatccagcttgcagcagagctcaggggaacaatgggcaacatgtttagcttcgcagcagtcatgggagccctcgacatggcacagatttctagactcgaacaaacatgggtcacacttaggcagcggcacactgaaggcgccatcctctacgagaagaaactgaaacccttcctgaaatccctgaacgaaggaaaagagggaccacctcttagcaatactaccttcccccatgtgctgccgctgatcaccctcctggaatgtgactccgctcccccggaaggcccagaaccgtggggtagcaccgagcacggcgtggaggtggttctcgcccacttggaggccgccaggaccgtagcacatcacggaggcctgtatcatactaatgccgaggttaagctgcaggggttccaggcacgtcctgagcttcttgaggtgtttagtaccgaatttcagatgcggctgctgtggggtagccaaggcgcctctagctctcaagctagaagatatgagaaattcgacaaggtcttgacagccctgagccacaaattggagcccgccgttcgatctagcgaattgtag

SEQ ID NO: 24413 - DNA, 2379 bp, Artificial Sequence
  Description of Artificial Sequence: Synthetic coding sequence
atggcccccgccctgcccagcccccacaaggccgtggcccggcccgagctgctactcgatacagcagcgcattccggtaaattacgcgcaccagatggaggggagggggcagaatgcgccggccataatggcgggcctagctggggagtcgggcagggccaatcccaggagccatcccggcaaggcataccccaggccccttggctggtgtcctggcagaggcgagggtttcccccctcgagcttctgccctggcccattaagaaccgagaagttgcgggccggccgctgtccgctcctgctttgcggtggtgctgctggagaacctgaagctggaagtgattacgtcaagttttctaaagagaagtacattttggattcaagcccagagaagctgcacaaggagttagaagaagagctcaagctgtcctctactgacctccgctcccacgcctggtaccatggccgcattccccgagaagtttccgaaacactggtccagagaaacggcgacttcctgatacgcgattcactcacatccctgggcgattatgttctgacttgtaggtggagaaatcaggccctgcactttaaaatcaacaaagtagtcgtcaaagcgggggaaagttacacccatatacagtacctgttcgaacaagaatctttcgatcacgtgcccgccctcgtgaggtaccacgtaggctcgcgaaaggccgtgtccgaacagagtggcgctataatatactgtccggtcaaccgcacttttccactgcggtacctagaggcttcctacgggttggggcagggctctagtaagcccgctagccctgtgtccccgtctggaccaaagggtagccatatgaaacgtcgctcagtcaccatgaccgacggcctaactgctgacaaagtgacccgatcggacgggtgtcctacctcgacttccttaccccggccaagggattctattaggtcctgcgccctgtcaatggaccaaattccagacctgcacagtcccatgagcccgatctccgagtccccttccagccctgcttattcaaccgtgactcgcgtgcatgcagcccccgcagctccaagcgccaccgccctgcccgcatcccctgttgcacgcagatctagcgagccccaactgtgccctggtagcgcgccaaagacccatggcgagtcagataagggaccccacacgtccccaagtcatacactgggtaaggcctcgccatccccgtctctgagttcatactctgacccagattctgggcactactgccagctgcagcctcctgtgcggggctcaagggaatgggctgcgactgagacatcctctcaacaggcccgctcatacggtgagagactcaaggagctgagtgagaacggagcccccgagggcgactggggcaagaccttcacggtcccaatcgtagaggtaacctcttcttttaacccggccacatttcagtctctcctaatccctagagataaccgccctctcgaggtgggactgctcaggaaggtcaaggaactgttggccgaggtcgacgccagaacgctggcccggcacgttacaaaagttgactgcttagtcgcccggatcttgggtgtgactaaggaaatgcagaccctgatgggggttaggtggggaatggaattgttgacattgccacatggccgccagcttcgtctggatttgctggagcgtttccacactatgtctatcatgttggccgtggacatcctcggttgcacagggtctgccgaggagagggcagccctgctgcacaagactattcaactggccgccgagcttcggggaacaatgggcaacatgttctctttcgctgcagtcatgggggccctggatatggcccagatctcgcggttagagcagacttgggtgacgttaaggcagcggcacactgagggggccatcctatatgaaaagaagttgaagcccttcctgaagtccctaaatgagggcaaggaaggccctcccttgagtaatacgacattcccacatgtgcttccactaattaccctgttagaatgcgacagtgctccccctgaggggccagagccctggggcagcacggagcatggcgtcgaagtagtcctcgcccacctggaggctgctcgaaccgttgcccatcacggaggtttgtatcataccaacgccgaggtcaagctgcaagggtttcaggcccgccccgagctactcgaagtgtttagcacagaatttcaaatgcgcctgctgtggggttcccagggagcatcatcgtctcaggcccgtagatatgaaaagtttgataaagtgcttacagccctgtcccataaactggaaccggccgtccggtcttccgaattgtag

SEQ ID NO: 24414 - DNA, 2112 bp, Artificial Sequence
  Description of Artificial Sequence: Synthetic coding sequence
atgaccgccgtgggccggcggtgccccgccctgggcagccggggcgcagccggggagcctgaagcgggtagtgactatgtgaaatttagtaaagaaaaatacatcttggatagttcccccgaaaagctccataaagaactggaagaagaactgaaactgtcatcaacagatctgagaagccacgcttggtatcatggccgcattccccgggaggtgtcagaaacgctggttcagcgcaatggcgacttccttattagagattccttaactagtctgggggactatgtgctcacttgcagatggaggaaccaagccctgcatttcaagattaataaggtggtcgtgaaggctggtgaatcatatacccatatccagtacttgttcgagcaggaatcttttgatcatgtgcccgccctcgttcggtatcatgtgggaagtcgaaaagccgtgagtgagcagagcggggcaatcatctactgccctgtcaaccgcaccttccccctgagatatctcgaggcatcctacggcctaggccagggcagcagcaaacccgcatcacccgtctctccatctggccctaagggcagccacatgaagcgacggtctgtgacaatgacagacggactcacagctgataaagtcacacgcagcgatggttgtcccactagtacaagcctgcctcgtccacgtgactctatccgatcctgtgcccttagcatggaccagatccccgacctacattcccctatgtcccccatctctgagtcccccagtagtcccgcgtactccaccgtgactcgagttcacgcggcccccgccgctccatccgcgaccgccctgcccgcttctcctgtggcgagacgctctagtgagccccagctttgccctgggtctgccccaaagacccacggggaatctgacaaaggcccccacacttcgccctcccacaccttgggcaaagcaagcccgagtcctagcctgagctcatactccgatcccgactcagggcattactgccagcttcagcctccagtaagaggctctcgcgaatgggctgccacagagacatccagccagcaagccagatcctacggggagcggttgaaagagctgagcgaaaatggcgcccctgagggggactggggcaagacatttacagtgcctatcgtggaagtaacctcttcatttaaccccgcaaccttccagtcattgcttattccaagggataacagaccgcttgaagtgggccttctcagaaaagtaaaagaactcctggcggaggttgacgcacgcacacttgcgagacacgttacaaaagtggactgtctggtagcacgtattctgggggtgaccaaagagatgcagaccttaatgggcgtgagatggggcatggaactcctgactctgccccacggacgacagttaagactggatctcctggaaagattccacactatgtctatcatgctggctgtggacattctgggatgcacgggtagcgctgaggaacgcgctgcgctgctgcacaagacaatccagctggccgccgaactgagaggcaccatgggaaacatgttctcctttgctgctgtgatgggcgccctggacatggcacagatcagccgcctggaacaaacctgggtgacactgcgacagcgccatactgagggcgcgatcctgtacgaaaagaaattgaaacctttccttaagtctctcaacgaaggaaaggagggcccccccctgtctaacaccactttccctcacgtgctgccactcatcaccctcctggagtgtgatagcgctccgcctgagggccctgagccatggggttccacggaacacggcgtggaagtggtcctggctcatctcgaggcagctcgcaccgtggctcatcacggcggtctgtatcacaccaacgcagaagtgaaacttcaggggtttcaggctagacctgagcttctggaagtctttagcacggaatttcagatgcgactcctctgggggagccagggggcttcctcatctcaagctaggcggtatgagaagttcgacaaggtcctgacggcccttagtcacaagttggagccagcagtacggagtagcgaactgtag

SEQ ID NO: 24415 - DNA, 1869 bp, Artificial Sequence
  Description of Artificial Sequence: Synthetic coding sequence
atggaccagctgccccagaagaacctgctgcggctgcaccccgccggctctgccggatgttctaccggggtggaatcctcttcaatggacggcttctggatggaagtggaacagattcaacaacgcgatgaactgagagaggaagactcaggcggtaacgaggggcagctgcccgaggagggcgaagccgaatcacagtggctccaagatactggactttcaggtcttttgggcggtctgggactggacggagaccatcaagagctgctctcgacactaacacagactcaagtggcagccgtctgcagaagactggatatttatgcacggtctgttaggagacagcacaagacaccggtgagagacgtacgggacgtattcggggttttcaactccggcaagatgtcctccgagaatggggattcaggcatgaagggggcgcagctgagttctggggcaagcaaattccctcctgctgcggagccagggggcctgcaagagcaggctggccgagaggaggcctttaatatggactccgcttactctgagcaggcagccgtcttgctccagcgatccaggccaagccgaggcgggaccagcgcttggggaaagtgctccctgcctaaattcactgtgcccaaggggcggcttggcgtcacaagaatcggagatttgagtctccaggatatgcggaaagtcccatctctggcattgattgagctgacagcactctgtgacatcctgggactggaccttaagcgatctaaagcagggaaatggaaagccgctgagactcgcctgtttggcgttcctctggatagtctgctcgaggcagatcacaaggtgctcccctcaacccaggtccccttggtgcttcaagccctgctgtcttgtctggagaaaaggggtctcgacatggaggggattctcagggtcccaggctctcaggcgagagtgaaaggcttggagcagaagctcgagcgcgatttttacgccggtctcttctcttgggacgaagtccaccacaatgacgctagcgatctgcttaaacgctttatccggaaactgcccacacccctactgacagccgaatacctgcctgccttcgctgtggtgccaaatatcccaaacctgaaacagagactgcaggtccttcacctactgattctgattctgcctgagcctaatagaaatgcgctgaaagcactactggaattcctcaggaaggtcgtcgctcgtgagcagcacaataagatgacattgaggaacgtaagcactgtgatggctcctaacctgtttctacaccagggaagacccccaaagctcccaaaaggcaaggaaaagcagcttgccgaaggagcagctgaggtagtgcagattatggtgcactaccaggatctactgtggacggtggcatcgtttctggtcgctcaagtgcgaaagctgaatgattcgtcctctagaagaccacagctatgcgacgcgggcctgaagacatggttgagacgcatgcacgctgaccgggataaggccggcgacggactggaagctactcccaaggtggccaagatccaggtggtctggccgatcaaagatcctctcaaagttcccctgaccccctccacaaaggtcgcacacgtgttgagacagttcaccgagcatctctccccaggctcgaagggccaggaagacagcgaagatatggatagcctgctcctccaccaccggagcatggaaagtgctaatatcctactgtacgaagtaggtggcaatatcaacgaacaccgtctggaccctgatgcatacctgctggacttgtacagagccaatcctcacggagagtgggtcctcaagcaaaatccaacatag

SEQ ID NO: 24416 - DNA, 846 bp, Artificial Sequence
  Description of Artificial Sequence: Synthetic coding sequence
atggccaccgagctgcagtgccccgacagcatgccctgccacaaccaacaagtgaacagtgcttccacccccagtccggagcaactccggccaggcgacttaattctcgaccacgccggtgggaaccgagcctccagagccaaggtcatcctcttgacgggctacgcccacagctcccttcccgccgagctggattctggggcatgtggaggcagtagcctgaactctgaaggcaattcaggctcgggcgattctagctcttacgacgctcccgctggaaactccttcctcgaggattgcgagctaagccggcagatcggtgcgcagttgaagcttctgcccatgaatgatcagatccgggagttacagactatcatacgagataaaaccgcaagccggggcgactttatgttttctgccgaccggctaatcaggctcgtggtcgaggaaggcctgaatcaattaccgtacaaggagtgcatggtgacaactcccaccgggtacaagtatgagggcgtgaagttcgagaagggtaattgtggagtctccattatgcgctcaggagaagctatggagcaaggcctcagagactgttgccggagcattaggatcggaaagattctcatacagtctgatgaggagacacagcgtgcaaaagtatactacgctaagtttccgccggacatctataggcgcaaggtactgttgatgtatccaattcttagcactggcaatactgttattgaagccgtgaaagtcctaatcgagcacggagttcagcctagcgttattattctcttgtcactgttttcaacaccacacggggaattttccatgcgtcagtag

SEQ ID NO: 24417 - DNA, 930 bp, Artificial Sequence
  Description of Artificial Sequence: Synthetic coding sequence
atggccaccgagctgcagtgccccgacagcatgccctgccacaaccagcaggtgaacagcgcctccaccccttctccagaacagcttcgaccaggtgatctgatactcgaccatgctggcggcaaccgcgcctctagggcaaaggtgatactgctgacaggatacgctcactcctcactgcctgcagagttggattccggtgcctgtggtgggtctagtctgaatagtgagggtaattctgggtctggcgactcttcttcctatgacgcacctgctggcaattcctttttagaggactgtgaattgtcacggcagataggagcccagctgaaattactgccaatgaacgaccagatcagagaattgcagactatcatacgggataagacagcctcaaggggcgatttcatgttcagcgcggatagactgatccggctggttgtcgaggagggccttaatcagctgccttataaagagtgtatggtcactaccccaacagggtataagtatgaaggcgtcaagttcgaaaagggcaactgcggagtgagtattatgcggagcggcgaggcaatggaacaaggtctgagagattgttgccgctctattcgcattggaaagattctcattcagtccgatgaggaaacccagcgcgcaaaagtgtattatgcgaagtttcctcccgatatctataggaggaaggttctccttatgtaccccatactgagtacaggcaatactgtcatcgaagctgtaaaggtgctgattgagcatggtgtgcaaccgtccgtgatcattctgctgtcattgttcagcaccccccatggggcaaaatcgataattcaagagttccccgagattaccatcctcactactgaggtgcacccagtcgcccccactcactttggccaaaagtacttcgggaccgattag

SEQ ID NO: 24418 - DNA, 633 bp, Artificial Sequence
  Description of Artificial Sequence: Synthetic coding sequence
atggtgagcggcagcgagcagaagttcctgatcggcctgggcaagtcacaaatctatacatgggacgggcgtcaatcggacaggtggatcaaattggaccttaaaacagaactaccacgggacacactcttgtccgtggaaattgtgcatgaacttaagggggagggtaaggctcaaagaaagatctctgcaattcacatcctggatgtgttggtgctgaatgggacagatgtccgggagcagcatttcaaccagcgcatacaacttgctgagaagtttgttaaagccgtcagcaaaccaagcaggcccgacatgaatccgatccgcgtgaaggaggtctatagactggaagagatggagaaaatttttgtccgattggaaatgaaaatcataaagggcagttcagggactccaaaactgtcctacactggacgtgacgataggcactttgttccgatgggactatacattgtgcggaccgtgaatgaaccatggaccatgggcttcagtaagagcttcaagaaaaaatttttttacaataaaaaaaccaaagactctacatttgacctgccagccgattccatcgccccttttcacctaccctctctcgcatgtctgtccaaaatggattag

SEQ ID NO: 24419 - DNA, 1119 bp, Artificial Sequence
  Description of Artificial Sequence: Synthetic coding sequence
atgaagcggcggaccgaccccgagtgcaccgcccccatcaagaagcagaaaaaaagagtcgcagaactagcactgagcctgtccagcacctctgatgatgaaccaccatcatctgtaagccacggagctaaagcttctacaacatctctgtctggtagtgattcagaaacagagggcaagcagcactcatctgactcgtttgatgacgccttcaaagcagactctttggtcgagggaacctcttccagatactcgatgtataactccgtgtctcagaagctgatggcaaagatggggttcagagagggcgaagggttgggcaagtacagccagggccgcaaagatatcgtggaagcatcctcccagaaaggccgccgggggctgggactcactctgagaggattcgatcaggaacttaacgtggattggcgggacgagcctgaaccgtctgcctgtgagcaggtatcttggtttccagaatgcaccaccgaaattcctgacacgcaggagatgagcgactggatggtagtggggaaacgtaagatgataattgaagacgagaccgaattctgcggtgaagagctcctacatagtgtccttcaatgcaaaaaacccctagtcaaggatagagaggcagagctcctttacttcgccgacgtctgtgccggccccggtggcttcagtgaatatgtcttatggcgcaagaagtggcacgccaaagggttcggcatgactctcaagggccctaatgacttcaagctggaagatttctacagcgctagctccgagctcttcgagccttactacggcgaaggcggcatagacggcgacggggacattactcggcctgaaaatataagcgcttttcgcaactttgtgttggataataccgaccgtaaaggtgtgcatttcttgatggccgatggtggcttcagtgtcgaaggacaggaaaatctccaggaaatcctatctaaacagttgctcctgtgtcaatttcttatggctctgtctattgtacgcaccggcgggcacttcatctgcaagaccttcgatctgttcacccctttctccgtgggattagtctaccttctctactgctgctttgagcgtgtttgctag

SEQ ID NO: 24420 - DNA, 615 bp, Artificial Sequence
  Description of Artificial Sequence: Synthetic coding sequence
atggccggctacctgagcgagagcgacttcgtgatggtggaggaggggttcagcacaagagatctgctcaaagaactgactctcggggcttcacaggcaaccacagacgaggtggctgcattttttgtggctgatcttggcgcaattgtccgtaaacacttctgctttctgaagtgcctgccacgcgtgaggcccttttacgccgtgaagtgtaactcctcaccaggcgtacttaaggtgctcgcgcaactgggcctagggttctcctgtgctaataaaatcgctagcgtaataaattcagcactggacctgtacttccccgagggctgtggagtggatatttttgctgagttgggcagatactacgtgacgagtgccttcacagtcgctgtgtccattatcgccaaaaaggaagtcctgctagatcaaccaggacgggaggaggagaacggcagcacatccaagacaatcgtgtaccatctcgacgagggtgtgtacggaatttttaatagcgtactgttcgacaatatctgccccacccccattctgcaaaaatccaagaaccactcgccctgttatatgtctctggagagtatccacttcattgctgtgtag

SEQ ID NO: 24421 - DNA, 1443 bp, Artificial Sequence
  Description of Artificial Sequence: Synthetic coding sequence
atggccggctacctgagcgagagcgacttcgtgatggtggaggaggggttcagcacccgtgacctgctgaaagagctgacattaggcgcttcacaagctaccaccgacgaggtggcagctttttttgtggcggacctgggagctatagtgaggaagcacttctgtttcctgaagtgcctcccccgggtgagacctttttatgctgtgaaatgcaattcttcgcctggcgtcctgaaagtgctggcccagcttggattaggatttagctgtgcaaataaagctgaaatggaattagtacaacacatcggcataccagcaagtaagatcatatgtgccaatccctgtaaacagatcgcccaaatcaagtacgcggccaaacatggcatccagcttctcagtttcgacaatgagatggagttagcaaaggtcgttaaatctcatccctctgctaagatggttttgtgcatcgccaccgatgactcccattccttgtcgtgtctgtcattgaagtttggagtgtctctgaagtcctgcagacacctcctcgaaaatgctaagaaacaccatgtggaggtcgtaggagtctcttttcatatcggctctggctgccctgatcctcaagcgtatgcccagtctatcgccgacgcaagactggtttttgaaatgggtaccgaactgggacataagatgcatgtgctggacctggggggaggctttcctggcacggagggagccaaagtcaggttcgaggaaatcgcaagtgtcattaatagcgcattagacctctactttccagaagggtgtggagtagacatattcgctgaactcggccgatattacgttacctcagctttcacagtcgccgtgtctataatcgctaagaaagaggtgctcttggatcagcccggccgcgaagcgccccttccacctccccacatcgccacttgtgccgcctctgaaccaagtccccccgctgaggaaaacggatctacgagcaagactattgtttatcacttggatgaaggagtatatggcatttttaatagcgtgttgtttgacaacatatgtcctacccctatcttgcagaaaaaaccctcaaccgaacagcccctgtacagcagctcgctctgggggccggctgtagacggatgcgattgcgtcgccgaaggcctctggttgcctcagctgcacgtgggcgactggcttgtgtttgacaatatgggagcctacactgttggtatggggagcccattttggggtacccaggcctgccatattacctacgcaatgtcacgggtggcctgggaagcactgcgccgccaactcatggcggctgagcaggaagacgatgtggaaggcgtctgtaagccactcagttgcggctgggagatcacggacaccctatgtgttggccctgtgttcacacctgcatccatcatgtag

SEQ ID NO: 24422 - DNA, 1383 bp, Artificial Sequence
  Description of Artificial Sequence: Synthetic coding sequence
atggccggctacctgagcgagagcgacttcgtgatggtggaggagggtttttctactagggaccttctcaaggaactgacactgggcgcgtctcaggccacgactgacgaggtggcggccttcttcgtggcagatctgggagccatagtgagaaagcacttctgttttctcaaatgtttgccacgcgtacgtcccttttacgctgtcaagtgtaattcctccccaggcgtgttaaaagtgctggcacagctcggcctaggctttagctgcgcaaacaaggctgagatggaactcgtccagcacatcggtatcccagcttccaagatcatatgtgctaatccctgtaagcagatagcccagatcaagtacgcggctaagcacggaatccagctgctcagcttcgataacgaaatggagctggctaaagttgtcaaatctcacccttctgctaagatggttctgtgtatagctacggacgattcccatagtctgagctgcctttctcttaagttcggtgtgtccctgaaaagttgccgccatcttttggaaaatgccaagaaacaccacgtagaggtcgtcggcgtctccttccacataggctctggctgcccggaccctcaggcctacgcacagagtatagccgatgcaaggcttgtattcgaaatgggcactgaattgggccacaagatgcatgtgcttgatctagggggtggttttcctggcaccgagggagccaaagtgaggttcgaagaaattgcttcggtgattaactctgcactagacctgtattttccagaggggtgtggcgtggatatctttgccgagctggggcggtactacgtgacctcagccttcacagtcgcagtcagcattatcgcgaaaaaggaagtattgttggaccagcctggacgcgaagaagaaaatggaagtacgagcaaaaccatcgtttatcacctcgatgaaggtgtgtacgggatcttcaattccgtcctgtttgacaacatttgtcctactcctatcctccaaaagaagccgagcacggaacagccactatactcctcttcactgtggggtccagctgtcgacgggtgtgactgcgtggcagagggcctgtggctcccgcaacttcatgtcggagactggcttgtgtttgataacatgggcgcctacaccgtggggatgggcagtcccttctgggggactcaggcctgccacataacgtacgccatgagcagggtggcttgggaggcattgcgccgccaactgatggcggccgagcaggaggacgatgtagaaggcgtgtgcaaacctctcagctgtgggtgggagatcacggatacactgtgcgtgggccctgtgttcaccccagcatctattatgtag

SEQ ID NO: 24423 - DNA, 2508 bp, Artificial Sequence
  Description of Artificial Sequence: Synthetic coding sequence
atgaagcggcggaccgaccccgagtgcaccgcccccatcaagaagcagaagaaaagagtagccgagctcgccctgtctttgtcatctacatcagatgacgaaccaccctcaagtgtctcacacggagcgaaggcttccactacctcactgagcgggtccgacagtgagactgagggaaagcagcacagttccgactcctttgatgatgcatttaaagccgactcactagtggaaggtacctctagccgatactccatgtacaactctgtgagccaaaaactcatggctaagatgggcttcagggagggcgagggattgggaaaatactcccaaggccgtaaagacatcgttgaagcttcatctcaaaagggccggcgcggccttggcctgaccctacgaggattcgaccaggagttgaatgtcgactggagggacgaacccgaaccttccgcctgcgagcaagtgtcatggtttcccgagtgtaccactgagatccccgatacacaggagatgagcgattggatggtggtgggcaaacgcaagatgatcattgaagacgaaactgagttttgcggcgaggagttgcttcacagtgtgttgcagtgtaaatccgtgttcgacgttctcgacggggaggaaatgcggagggcccgaactcgcgcgaacccctatgagatgatcagaggcgttttctttctgaatcgcgccgcaatgaagatggcaaatatggacttcgtgttcgacaggatgttcactaatcccagagatagctatggaaaaccactcgttaaagatcgggaagcggagctcctgtactttgctgacgtctgcgctggaccagggggtttttccgaatacgttctgtggaggaaaaagtggcatgctaaaggattcggaatgactctgaaggggccaaacgacttcaaactcgaggatttctactcggcctccagcgaactgtttgagccctattatggcgaaggagggatagacggtgacggcgatattacacgaccagagaacatatctgccttccgaaactttgtcctggataacacggacaggaagggcgtacattttctcatggccgacggtggattcagtgtggaggggcaggaaaaccttcaggaaatcctgagcaagcaacttctgctgtgccagttcttgatggcgctgagcatcgtaaggaccggggggcatttcatttgtaaaacctttgatctgttcaccccattttccgtcggcctggtgtacctcctctattgctgttttgagcgagtttgccttttcaaaccaattactagtcggccagctaactccgagcggtacgtcgtgtgcaagggtttgaaggtgggaattgatgatgttcgggattatctctttgctgtgaacataaaacttaaccagctgcgtaacactgattcagacgtgaacctcgtcgtgccattagaagtgataaaaggagaccacgaattcacagactatatgattagatccaatgaaagccactgcagcctccaaattaaggctcttgccaagatacacgcttttgttcaagacacaaccctctcagaacctcgccaggcagaaattcgcaaagagtgcttacggctgtggggcatccccgaccaagccagggttgcccccagctcatctgatcctaaatctaaattctttgaattgatccaagggactgaaatcgatatcttctcgtataagccaaccctgctcacctcaaaaactctggagaaaatcaggcctgtcttcgactacagatgtatggtgagcgggtccgaacaaaaattcctgataggactgggtaaaagccaaatctacacatgggacggaaggcagtcagatcgatggatcaaattagatctcaaaaccgagctgccacgggacaccttactatctgtagagatcgtgcatgaactcaagggggagggtaaggcccagaggaaaataagcgccattcacatcttggatgttttagtactcaacgggaccgatgttagagagcaacatttcaaccagaggattcagctggccgagaagtttgtgaaggccgttagtaaaccgtcccgacccgatatgaacccaatccgagtgaaagaggtttatagactggaggagatggagaagattttcgtgcggctggagatgaagatcattaaagggtcatctggcacaccaaaattaagttacacggggagggatgataggcatttcgtgcccatgggactctacattgtgcgcactgttaacgagccatggacaatgggattttctaagagtttcaaaaagaaattcttctataataagaagacgaaggatagcaccttcgatctacctgccgattcgatcgcgccatttcatatctgttactatggcagattgttctgggagtggggagatgggatacgggttcatgactcccagaaaccccaggatcaagacaagctcagtaaagaggacgtcctcagctttatccaaatgcaccgggcctag

SEQ ID NO: 24424 - DNA, 252 bp, Artificial Sequence
  Description of Artificial Sequence: Synthetic coding sequence
tgacaggagctgctgaaggagaagaccctggccgagcagaacctggaagatacacgtcaacagctccttgcagcgaggtcgtcacaggctaaggctattaatacattggagacacgtgtgcgcgaacttgagcaaaccctgcaggccagcgaggagcagcttcaacagtctaaaggtatagtggctgcacaggaaacacaaatccaggaattagtgagcgcttattggtcttgctgtatccctggcccttag

SEQ ID NO: 24425 - DNA, 2304 bp, Artificial Sequence
  Description of Artificial Sequence: Synthetic coding sequence
atgttcgccaagctgaagaagaagatcgccgaggagaccgccgtggcccagagaccagggggcgctacgcgcatcccccgttccgtatctaaagaatcagtcgcgtccatgggcgccgactcaggggatgacttcgcatccgatggatcaagttcacgcgaggatttgtcctctcaactactccgcaggaatgagcagataaggaagttggaagctagactgagtgactacgcagagcaggtgaggaatttgcagaaaataaaggagaagctggagatagcgctcgagaaacatcaggacagctcaatgcggaagttccaagagcagaatgaaacttttcaggctaacagggctaagatggcagagggccttgcactggcccttgcccggaaagaccaggaatggagcgagaaaatggaccagctggaaaaggagaaaaacatcttaacagctcagctgcaagagatgaagaatcagtcaatgaatctgttccaacggcgcgatgaaatggatgagttagagggtttccagcagcaagaactttccaagatcaagcacatgctgctgaagaaggaagagtctctggggaaaatggagcaggaactggaagccaggacccgcgagttaagccgtactcaggaggagctgatgaacagcaaccagatgagttcggatctgagccagaaactggaagagctgcagaggcattattcgaccctggaggaacagcgtgatcacgtaatcgcctcaaagaccggggcagagagtaaaattacagcattagaacagaaggaacaagagctgcaggcactgatccaacagctgagcatcgatctccagaaagtcaccgctgagacacaggaaaaagaggacgtgatcacccatttgcaggagaaggtagccagtctggaaaaacgcctggagcagaacctgtcgggggaggaacacttacaggaactgctaaaagagaagaccctcgcagaacagaatctggaagacaccagacagcagctcctcgctgcccgttccagccaagctaaagctattaacacattggagaccagggtgcgcgaattagagcagaccttgcaggcctcagaggagcagctccagcaatccaaggggatcgtcgctgcccaggagactcagatccaggaacttgcggctgccaatcaagagtccagtcatgtgcagcaacaggccctggcactggaacagcagtttctggagaggacacaggccctggaggcgcaaatcgtggcactcgagagaacccgcgccgcagatcagacaaccgctgagcaggggatgagacaactcgagcaagaaaatgccgcgctgaaagagtgcaggaacgaatacgagcgctctttacagaatcaccagtttgaactgaagaaactgaaagaagagtggtctcagcgggagatagtcagtgtagcaatggcacaagccctggaggaagtcaggaaacagagggaagagtttcagcaacaggctgccaacctcacagccatcatcgacgagaaggagcagaacctccgcgagaagacagaggtcctcttacagaaggagcaagaaatcctccaactcgagcgggggcataactccgctcttctacagatccatcagctgcaagctgagctggaagcgctgcgcactcttaaagctgaagaggctgcagtggtggcggaacaggaggatctcctcaggcttcgcgggccacttcaagccgaggctctcagcgtaaacgagagccacgtaacatccagagcaatgcaggatcccgtgtttcagctcccaaccgctggccgcacccccaacggggaggtcggagcgatggatctcacccagcttcagaaggaaaagcaggacctcgaacagcaacttttagagaagaacaagaccatcaaacaaatgcagcagagaatgctggaattgcgcaagactcttcagaaagaactgaaaatcagacccgataatgagctgtttgaggtgcgggagaaacctggacccgagatggccaatatggccccctcggtcaccaacaacacggacctgactgatgctcgagagattaatttcgaatatcttaaacacgtagtgctcaagttcatgtcatgtcgcgaatcagaggcatttcacctcatcaaagccgtgtcggtgctgttaaacttttctcaggaagaggagaacatgcttaaagaaacactcgagtacaaaatgtcctggtttggcagtaaacccgcacctaagggatctattagaccaagtatctctaatccacgcatcccgtggtcctag

SEQ ID NO: 24426 - DNA, 291 bp, Artificial Sequence
  Description of Artificial Sequence: Synthetic coding sequence
tgagccaagatcaaggcccgggacctgcggggcaagaagaaggaggaactgttaaaacaattggatgatctgaaagtagaactgtcacaactgcgcgtggccaaagtcactggcggggctgcttccaaactcagcaagatccgagtcgtaagaaagagcattgcaagagtgttaactgttataaaccagacacagaaggagaacctgagaaagttctacaaagccgcggcaggaggcccttgcatccaaatggacagagtattaccacagccccccgcttgctcatgttag

SEQ ID NO: 24427 - DNA, 1035 bp, Artificial Sequence
  Description of Artificial Sequence: Synthetic coding sequence
atgcggcggcggcgggaggaggagggcatccagctgcggaagcagaaacgcgaacagcagctcttcaaacgcagaaacgtggaactgatcaacgaggaggctgccatgttcgactccttactcatggactcttatgtatcttctaccaccggagaatccgtcatcaccagggagatggtggaaatgttattctcggatgatagcgacctacagctggccacaactcagaaattccggaaactgctctccaaagagccctcccctcccattgatgaagtgataaacaccccaagggtggttgataggttcgtggagtttctaaagcgaaatgagaattgtaccctgcaagccgtttgggccctagggaacattgcaggggatagttctgtgtgcagagattatgtcctgaactgctcgatcctgaatcctctcttgaccctgctaactaagtcaacccggctcacaatgacccgtaacgcggtgtgggccctatcaaatctgtgcagaggaaaaaacccgcccccggaattcgcaaaggtatccccatgcctcccagtcctgtcgagacttttattctcctcagatagtgatttgttggcagatgcttgttgggccttaagttatctcagcgatggacctaacgagaagatccaggcagtaatcgactccggagtgtgtcgtaggttggttgaactgctcatgcacaacgattacaaagtcgccagccctgccttgagggctgtaggtaatattgttactggtgatgatattcagacccaggtgattcttaactgcagcgctctgccttgcttactgcacctcctctctagtcctaaggaatcgattcggaaagaggcctgttggacgatttctaatatcacagctggaaaccgtgcccaaatccaggcagtgattgacgccaacatcttcccagtgctgatcgagatcttacagaaagcggagtttcgcacccgtaaagaggcggcctgggccatcaccaacgccacatcgggaggcaccccggaacagatctag

SEQ ID NO: 24428 - DNA, 582 bp, Artificial Sequence
  Description of Artificial Sequence: Synthetic coding sequence
atgcccaccaccagccggcccgccctggacgtgaagggcggcaccagccctgccaaggaggacgccaatcaggaaatgtcgtctgttgcttatagcaatctcgcagtgaaggataggaaagctgtggccatactgcattaccccggagtggcatctaacggcaccaaagccagcggtgccccaacctcaagcagcggtagccctatcggatcacccacaactactccacccactaagcctccatcttttaatctgcatccagccccgcacttactggcttccatgcacctccaaaagcttaactcacagtaccagggaatggccgcggccaccccaggccaacctggcgaggctgggcccctgcagaattgggatttcggagcccaggcagggggcgctgagagcctctcacctagtgctggggctcagtctccagccatcattgactccgaccctgtagatgaggaggtcctcatgagcttggtggtggagctgggcctggaccgggctaatgagttgcccgaactgtggctgggccagaacgaatttgacttcactgctgatttcccgtctagttgctag

SEQ ID NO: 24429 - DNA, 1611 bp, Artificial Sequence
  Description of Artificial Sequence: Synthetic coding sequence
atggagaccatggccagccccggcaaggacaactaccggatgaagtcatataagaataacgcccttaacccagaggagatgagaaggagaagagaggaggaagggatccagctgcgcaagcaaaagcgtgagcagcagctgtttaagcgaagaaacgtagaactcatcaatgaagaggcagctatgttcgactcgctgttaatggactcctacgtttcttccactacgggggaaagtgtgattacaagagaaatggtggagatgctgttttccgatgatagcgacctgcagctggccaccacacagaagtttcggaagctcctttcaaaggagccttccccacccatcgacgaggtaatcaacacacccagggtggtggacagatttgtggagttcttgaagagaaacgagaattgtactctgcaatttgaggctgcttgggcacttacaaatatcgcatccgggacttcccagcagaccaagattgtgattgaagctggggccgtgcccatttttattgagttgttgaattctgactttgaggacgtgcaggagcaggctgtgtgggccctggggaacattgcaggagactcctcggtgtgtcgggactatgttctcaactgtagcattctgaaccctctcttgactctgcttaccaagtccacaaggctcacgatgactcgaaatgcagtctgggcactgagcaatctctgccgggggaaaaatccaccccctgaattcgctaaggtgtccccctgcctgcccgtgttgagtagacttcttttcagtagcgactcagaccttctggcggacgcttgctgggcactgtcctacctctctgatgggcccaatgagaagattcaggccgttattgatagtggagtctgccggcgactggtggaacttctgatgcacaacgattacaaagtagcttcgccagccttacgcgcagtaggcaacatcgtcacaggtgacgatatccagacccaggtgatccttaactgctcagctctaccctgtctgctccacctcctgagcagcccaaaagagtcaatacgcaaggaggcctgctggaccatctccaatatcaccgcaggcaatagagctcagatccaggcagtgatagacgctaatatctttccagtcctgatagagatcctacagaaagccgagtttagaacgcggaaagaagcagcctgggccatcactaatgctacgtccggtggcactcctgagcaaatccggtatcttgtatcactgggatgcattaagcccctgtgcgacttgctcacagtgatggacagcaaaatagtgcaggtggcgttgaacgggctagaaaacatccttagactgggggaacaggagggcaagaggtccggtagcggagttaacccgtactgtggcctaatcgaggaagcgtacggactggacaagattgaatttttacagagccacgagaatcaggagatctaccaaaaagccttcgacctgatagaacactacttcggagttgaggacgatgattcatcacttgctccacaggttgacgagacacagcagcaatttatcttccaacagccagaggcccctatggagggcttccaactatag

SEQ ID NO: 24430 - DNA, 2769 bp, Artificial Sequence
  Description of Artificial Sequence: Synthetic coding sequence
atgatcaccagcgccgccggcatcatcagcctgctggacgaggacgagccacagctgaaggaatttgccctgcacaaactcaacgccgtggttaacgatttttgggccgagatctccgaatctgtcgacaagatcgaggtgctttatgaggatgaaggcttccggtctcgccagtttgccgcgctggtggcgtcgaaggtattctatcatctcggagcttttgaggaaagtctgaactacgcgctgggggccggtgatttgttcaacgtcaatgacaatagcgagtacgtcgagaccattattgcgaaatgtatcgaccattacacaaaacagtgtgtggaaaacgcagacttaccggagggcgaaaagaagcccatagaccagcgactcgagggcatcgtgaataaaatgttccagagatgtctcgacgatcacaagtacaagcaggcaataggtatcgcattggagacgcgacgactggatgtcttcgagaaaaccatcctggagtctaatgacgtgcctggtatgttggcttattccctgaaactgtgcatgagcctgatgcagaataaacagtttagaaataaggtgctaagagtgctggtgaagatatacatgaatttggaaaaacctgacttcattaacgtttgtcaatgcttaatatttcttgacgatccacaggctgtttctgatatcctggaaaagttggtgaaagaagacaatctgttaatggcttatcagatctgttttgacctctatgaatcggccagccaacagttcctgagcagtgtgattcagaacctgaggaccgtcggaacaccgatagccagcgtcccagggagtactaacaccggaacggtgccagggtcagaaaaggattcggacagtatggaaacagaagagaaaacttcaagcgcgttcgttgggaagacacccgaggcgtcgccggagccaaaagatcagaccctgaaaatgatcaagatcctgtctggtgagatggcgattgagctccacctgcaattcttgatccgcaacaacaatactgatttaatgattctaaaaaacactaaggatgcagtgaggaactctgtttgccatacagctaccgtgattgctaactcttttatgcactgcggcacgacgagcgatcaattccttcgggataatctcgagtggctcgctcgggctacgaactgggcaaaattcacggctaccgcctcacttggagtcattcacaaagggcatgagaaagaagcactccaattgatggccacctacctacccaaagacacatccccaggctcggcttaccaggaaggcggcggcctgtacgccttaggcctaattcacgcaaatcacggaggagacatcattgactacctgctgaatcaactcaagaacgctagtaacgacattgtgaggcacggtggcagtctggggctcggactagcggccatgggaaccgcgcgccaagatgtatatgatctgcttaagacaaatctctaccaagatgacgcagtgacgggcgaagctgcaggtctcgcattgggcttggtgatgctcggctcgaagaacgcccaggcaattgaagacatggtgggctatgcccaggagactcaacatgagaaaatcctaaggggactggccgttggcatcgctctggtgatgtatggtagaatggaggaagcagacgctttgattgaaagtctctgtcgcgacaaagaccccattctgcggagatctggaatgtacaccgtcgccatggcctattgcggcagtggcaataacaaggccatccggcggttgctgcacgtagccgtgtccgatgttaatgacgatgtgcggcgcgcggccgtcgaatcccttgggttcattctgttccggaccccagaacagtgtccatccgtcgtttccttactaagtgaatcctataatccccatgtgcgctacggcgccgctatggcacttggaatttgctgcgccgggaccgggaacaaggaagccatcaacctgttagagccaatgactaacgaccctgtgaactatgtccgacagggggctctaatagccagtgcgctcattatgattcagcagaccgaaatcacctgccctaaagtaaatcagttcaggcagttgtacagtaaagtgataaatgataagcacgacgatgtgatggccaagttcggcgccatactagcccagggcattctggacgcaggtggccataatgtaacgatcagccttcaatctcggactggacacacccacatgccctctgtcgtgggggtgttggtctttacgcagttttggttttggttcccactgagccatttcctgagcctagcctacaccccaacctgcgtaattggcctaaacaaagacctgaaagtaagcaccgcggtactgtctatcactgctaaggctaaaaagaaggagaaagagaaagagaagaaagaggaagaaaagatggaggttgatgaagcagaaaaaaaagaggaaaaggaaaaaaagaaggagcccgaacccaattttcagctgttagacaacccagcacgagtgatgcccgcccaactcaaggtacttactatgcctgaaacatgtaggtaccagcctttcaagcccctgagcattggaggcattataatactgaaggatacgtctgaggacattgaggaactggtcgaacctgtcgccgcacacggacccaagatcgaagaggaagaacaggagcccgagccgcctgagccgttcgaatacatagacgactag

SEQ ID NO: 24431 - DNA, 1227 bp, Artificial Sequence
  Description of Artificial Sequence: Synthetic coding sequence
atgcccgaggagcaggccttcagcgtgctggtgaagatcatgttcgactatgggctgcgggagctttttaaacagaactttgaggatctccattgcaagttctaccaactggagcgactcatgcaggaatatataccagacttgtataatcattttcttgacatttctctcgaggcgcacatgtacgcctcccagtggtttctgactcttttcacagctaaatttcccttgtacatggtcttccacattatagatcttctcctatgcgagggaatttccgtgatttttaatgtagccctgggactcttgaagacgtcaaaggacgacctcctgcttacagatttcgagggggcactgaaattctttcgcgtccagctgcctaagcgatatagaagtgaagagaacgccaaaaagctcatggagctggcttgtaacatgaaaattagtcagaaaaagcttaaaaagtatgagaaagagtatcatacaatgagagaacaacaggcacaacaggaagatcctattgagcggttcgagcgggagaataggcgactgcaggaggcaaacatgcgcttggagcaggagaacgacgacctggcgcacgaattagtcacttctaaaattgcattgaggaaggatctggataatgctgaggagaaggcagacgcgctgaataaggaactgctaatgactaaacagaagctgattgacgccgaggaagagaagaggaggttggaggaggagagcgcccaactgaaagagatgtgccgaagagagctcgataaggccgaatccgagattaaaaagaactcaagtataatcggcgattacaagcagatttgctcccaattgtccgaacgactggagaagcagcagacagccaacaaagttgaaattgagaagatccggcagaaggtggatgactgcgaaaggtgccgcgagttctttaataaagagggcagggtcaagggcatatcatccacaaaagaggtgttggatgaagacacagacgaggaaaaagagaccctgaagaaccaattgagagagatggagctggagctcgcccaaactaaattgcaactggtggaggccgagtgcaagattcaggacctggaacaccacctgggactcgcccttaacgaggtgcaggcagccaagaagacctggtttaaccggacgctgtcaagtattaagactgctacaggagtccaagggaaggagacatgttag

SEQ ID NO: 24432 - DNA, 3210 bp, Artificial Sequence
  Description of Artificial Sequence: Synthetic coding sequence
atggacgacaaggccagcgtgggcaagatcagcgtgagcagcgactctgtttccacccttaacagcgaggattttgttctggtgtcccggcagggagatgagacacccagcaccaataacggttcagatgatgagaaaaccggattgaagatagtgggcaacgggtcagaacagcagctccagaaagagttggccgatgttttgatggatcctcccatggacgaccaacccggagagaaggaactggtgaagcgatcccaattagacggggagggggacgggccattgtctaatcagctgagcgccagctccaccattaaccccgtccctctggtgggtcttcaaaagccagaaatgtccctgcctgtgaagcccggccagggggatagtgaggccagctcaccatttacgcctgtggcggacgaagacagcgtagtgttttctaaactgacttacctcggctgtgcgtccgtgaacgcgccacgatcagaggtggaggcactgcgaatgatgagcatactgcggtctcagtgtcagatcagcctcgacgttacactatccgtgccgaatgtgtccgaaggaatagtgcggttactagaccctcagacaaacactgagattgccaattatcctatatataagatactgttttgcgtccgggggcacgatgggaccccagagtctgactgctttgccttcaccgaatctcattacaatgcggaactgttccggatccacgtctttcgatgcgaaatccaagaggctgtgagccggattctgtatagcttcgccaccgcatttcgaagatccgctaaacagacacctctgtctgcgacagccgccccacagactcccgattccgacatctttacattcagtgtgtcattagagataaaagaggatgacgggaagggctattttagcgcagtgcctaaggacaaggacaggcagtgcttcaagctgcgccagggaatcgataagaaaattgtgatttatgtgcagcagactacaaataaagaactggcaatcgagcggtgttttggactgctgctgtcccctggtaaagacgtacgtaattcagacatgcatctcctggatctagaatcaatgggcaagtcctcagatggcaagtcatatgtcattaccggctcttggaaccctaagtccccacactttcaggttgtgaatgaggagacacctaaggacaaagttctttttatgacgactgccgttgatctcgttatcacggaggtgcaggagccagttcggttcctgctggagacaaaagtaagagtttgtagccccaatgagagactcttttggcccttctccaagagatccacgactgaaaacttctttctgaaattgaaacagattaaacagagggaacggaagaataacaccgatacgctctatgaggtcgtgtgtcttgaaagtgaatccgagagggagaggagaaaaacgacagcatctccgtctgtgaggttgccccagtcagggagccagtcatccgtgattccaagccctcctgaggatgatgaagaggaagacaacgacgagcccctgttgtccggaagtggtgacgtgagcaaagagtgcgctgagaagatactcgaaacctggggcgagctcctttcgaagtggcatctaaatctgaacgtgaggcctaaacaactgtctagtctagtccgcaacggcgtgccggaggcactgcgcggagaggtttggcaactgctggccggatgccacaataacgaccacttagtcgagaaatacaggattttgattaccaaggaaagtccccaggattcagccataacacgtgacatcaacagaaccttccctgctcatgactatttcaaagacaccggaggtgatggtcaggactctctgtacaaaatctgcaaagcctactccgtctacgatgaggaaattgggtattgtcaaggccagtcttttctggccgccgtactgctgttacacatgcccgaggaacaggcattcagcgtgcttgtcaagatcatgtttgattatgggctgagggaactgtttaaacagaatttcgaggatctccactgtaaattctatcaattggagcggttaatgcaggaatacattccagatctgtataaccactttctggacatctcccttgaagcacacatgtacgcctctcagtggtttttgaccctttttaccgccaagtttcctttgtatatggtgttccacatcattgacctcttactttgtgaggggatcagcgtaatctttaatgtggccctcggtttgcttaagacctccaaagacgaccttttgttaaccgactttgagggcgcactcaagttcttccgggtgcagttacccaagagatatagaagtgaggaaaatgcgaagaagttgatggaactcgcttgcaatatgaaaatatctcagaagaagctcaaaaagtatgagaaggaataccataccatgcgcgagcaacaagcacagcaggaggatccaattgagcgcttcgagcgcgaaaaccgcagactgcaggaagctaacatgaggctggagcaggaaaatgatgatctggcgcatgagctggtgacatcaaaaatcgcgctgagaaaagatctggacaatgcggaagagaaggctgatgcgctaaataaggaactcctaatgacgaaacaaaagctgattgatgccgaagaagagaagcgccgactagaagaggaaagcgctcagttgaaagagatgtgccgccgggaactggataaggctgaaagcgaaattaagaaaaatagcagcatcattggtgattataaacagatctgctcacaactgtccgagaggctggagaagcagcaaacagcgaataaagtagagattgagaagattcgccaaaaggttgacgactgtgagaggtgcagggaattttttaataaagagggtagagtaaaaggtatcagctccactaaagaggttttggacgaggatactgatgaagagaaagagacactcaaaaaccaacttagggaaatggaactggagctggcacagaccaagctccagctggtggaagccgaatgtaagatccaggacctggagcatcatctggggctggcacttaatgaggtgcaagctgcaaaaaaaacttggtttaaccggactctgagcagcattaagacagccaccggcgttcagggaaaagagacatgttag

SEQ ID NO: 24433 - DNA, 2808 bp, Artificial Sequence
  Description of Artificial Sequence: Synthetic coding sequence
atgcagcggaagctggtgaccctggtgaactgccagctggtggaggaggagggaagagttcgtgcaatgagggcggcccggtctcttggggaacgcacagtcaccgaactcatactgcagcaccagaatcctcagcaattgagcgctaatctctgggcggccgtacgagcacgagggtgccaattcctgggccccgctatgcaggaggaagctcttaagctggtgctgctcgccctcgaagacggatctgccctcagcagaaaggttctcgtacttttcgtcgtccagcgtcttgaaccccgttttccccaggctagcaagacaagtattggacacgtagtccagttgctgtacagggcttcttgcttcaaggttacaaagcgggatgaagatagtagtctgatgcagttgaaagaggagttcagatcctatgaagctctacggagagagcatgacgcccagattgtccatatcgctatggaagcagggctgagaattagtcctgagcaatggtcttcccttttatacggtgaccttgctcacaagagccatatgcagagtattatagacaagctgcagtcacccgaatccttcgctaaatctgttcaggaactgaccatcgtgcttcaacgcactggcgaccccgccaatctgaaccgcctaagacctcacctggagttgctagcgaatatcgatccgaaccccgacgctgtgtcgcccacatgggagcagctagagaatgccatggtcgccgtgaagaccgtggtccacggtctagttgactttattcagaattactctcgcaaagggcacgagacgccacagccgcagcctaactccaaatacaagacttcaatgtgtcgggatttacggcaacaagggggatgtccgcgtggtaccaattgtacgtttgcccacagtcaagaggagttggaaaaatatcggcttcggaataaaaaaatcaatgccaccgtgaggacgtttcccctgctgaacaaggtgggcgtcaataacacagttactacaaccgccggaaatgtgatctcagtgatcggatccacggaaacgactggaaaaattgtccccagcactaatggcattagtaatgcggagaattctgtttcacaactgatctcccgctccaccgactccacactgcgggcgctggagacggtgaaaaaggtggggaaggtaggtgccaatggccagaatgccgcaggcccaagcgcagattctgtgactgaaaataaaattggatcgcctcccaagacaccggtcagcaatgttgccgcaacatcagcgggcccaagcaacgtcggcactgaattgaatagtgtccctcaaaaaagctcgccgttcctaacacgtgttcctgtctacccaccccacagtgaaaatatccaatattttcaggaccccaggacccagataccattcgaggttcctcaatatccccagactgggtactacccccccccacccaccgttccggccggggtggccccgtgcgtcccccgttttgtgagaagtaataacgtgcccgagtccagtctaccgcctgccagcatgccttacgctgaccactactccaccttctcaccgcgcgacagaatgaacagttctccgtatcaaccgccccccccacagccctatggccctgttcccccagtcccaagtggcatgtatgcaccagtttatgacagtcgacggatatggcgtcctccaatgtaccagagggatgatataattaggtccaacagcctgcctcccatggatgtgatgcacagcagcgtgtatcagacctcccttagggaacggtataatagtctagacggctactactctgtggcgtgccagcctccaagtgaaccaagaacgaccgttcccttaccccgggaaccttgcggtcatctgaagacatcttgtgaagagcagatcagaaggaagcccgaccagtgggcccaataccatacccagaaggcgcctctggtgagttctactctgccagtggctactcagtcaccaacacctccatcaccactgttcagcgtggattttagggcagatttttctgagtcggtcagtgggactaaatttgaggaggaccacttatcccactacagcccatggagttgcgggacgatagggtcctgtatcaacgccattgatagcgaaccgaaagacgtaatagctaatagcaatgctgttctgatggatcttgactcaggtgacgtgaaaaggagagttcacctttttgagacccagaggagaaccaaggaggaagatccaatcatccctttctccgatggccccattattagcaagtggggcgccatctctcggagtagtcggaccgggtatcacacaaccgacccagtgcaggcaaccgccagtcagggaagcgccactaaacccatctccgtctcagattatgtaccctatgtcaatgctgtcgactcacgttggtcctcctatggcaacgaggcaaccagtagcgcccattatgttgagagggatcgttttatcgtgacagatctaagcggccacaggaaacatagcagcacgggggatctgctgtccctggagcttcagcaggccaagtcgaactctttgctgttgcaacgggaggcaaatgctctggccatgcaacagaaatggaactcattagacgaaggacgccatctcacccttaatctgctgtctaaggaaatcgagcttcgaaatggggaagtgaagaaactgaatctgtccgcttcgtgcctcatgtatctgttttctgctgccgcatcatggctctaccattattag

SEQ ID NO: 24434 - DNA, 1437 bp, Artificial Sequence
  Description of Artificial Sequence: Synthetic coding sequence
atgcccgtgcaggccgcccagtggaccgagttcctgagctgccccatttgttacaatgagttcgacgagaacgtacataaaccaatttctctgggctgcagccacaccgtatgtaaaacttgcctgaacaaactgcatcgtaaagcatgccccttcgaccaaacggccataaacacagatatcgatgtcctcccggttaacttcgcactcctacagctggttggcgcacaggtccctgaccaccaatctattaaattgtctaaccttggggaaaataaacattacgaagtggcaaaaaaatgtgtggaagatctggccctatacctcaagccgctgtctggcggtaagggtgttgcctcacttaaccagtcagctctgagcaggcctatgcaacggaagctagtgacgttagtcaactgccaattggtggaagaggagggtagagttcgagccatgcgtgcagcccggtctttaggggagcgaactgtgactgagctcatcttgcagcatcagaatcctcagcagctgagcgctaatctctgggctgccgttagagccagaggttgtcagtttctgggccctgcgatgcaagaagaagctctgaagcttgttcttctggcactggaagacggttccgcactatctaggaaggtcttagtgttatttgtggtgcagaggctggaaccacgatttccacaagcttccaagaccagtataggccatgtggtccagctcttatatcgtgccagttgctttaaagtgaccaaacgggacgaggatagtagcctgatgcagctaaaagaggagtttcgcagttacgaagcccttaggcgggagcacgatgcgcagatcgtgcacatcgcaatggaggctggccttcgcatctctccggagcagtggtcgtccctgttatatggcgatttggcacacaaatctcacatgcagtctataattgataaactgcagtccccggagagctttgccaaatccgttcaggaacttacaatcgttctgcagaggaccggagatcctgcaaatttaaaccggctgagaccccatttggaacttttagctaacatcgaccccaatcctgatgctgtgtctccaacgtgggaacagctcgaaaacgctatggtagctgtgaagacagtggtacacggacttgtggactttatccagaattattcccgtaaaggccatgagacaccacagcctcagcccaattcaaaatacaaaacatctatgtgccgagacctgcgacagcaggggggatgccctagaggaacaaattgcacatttgcacattcacaggaagaactcgaaaagtatcggctccgaaacaagaagataaatgcaactgaagtgttaaagcagcagggcaagttgtttcaggtgcaaacggaattccagatgcagaaaaccgtgttcccttcttag

SEQ ID NO: 24435 - DNA, 3576 bp, Artificial Sequence
  Description of Artificial Sequence: Synthetic coding sequence
atgcccgtgcaggccgcccagtggaccgagttcctgagctgccccatttgctacaatgaattcgatgaaaatgttcataagccaatttctcttgggtgttcccatacagtctgcaagacatgtttgaataagcttcatcggaaggcatgtccatttgatcaaacagctatcaacaccgacattgatgtacttcccgtaaactttgcattgctccagctcgtgggggctcaggtgccggaccaccaaagcatcaaactctccaatctgggcgagaacaaacattatgaagtagcaaaaaaatgcgtggaggaccttgccctttatctcaagccactcagcggcggaaagggggtggccagcctgaatcagagtgccctgtcgcgaccaatgcagagaaagctggtgaccttggtgaactgccagctggtcgaagaagaaggccgggtacgggctatgagagcagccagatccttgggcgagcgaacagttactgaactcatactgcagcaccagaacccgcagcaacttagcgccaacctgtgggcagcggtcagggctagaggatgtcaattcctgggccccgcaatgcaggaggaagcgctgaaactcgtactgctggccctggaggatgggtccgcacttagccgcaaagtgttggtattatttgtggtgcaaagactcgagccaaggtttccccaggcgagtaagacatcaatcggccatgtagttcagcttctttatcgggcaagctgcttcaaggttacaaagagggatgaggactcttccttaatgcagttgaaggaggagttccggtcctacgaggccctcaggagagaacatgacgcacagatcgtgcacattgcaatggaagcaggtttgcggataagcccagaacagtggtcgtcccttctgtatggcgacttagcccataaatcacatatgcagtccatcatcgataagttgcagagtcctgagtctttcgccaagtcagtccaagaattaacaatcgtgctgcaaagaaccggggaccccgcgaatctgaatcggctaaggccacacctcgagctcctggcaaacattgacccgaaccctgatgcggtttcccccacctgggaacagctggaaaacgccatggtcgctgtgaaaaccgtcgtgcatgggctggtcgatttcatccagaactactctcggaaggggcatgagacaccacagcctcagcctaatagcaagtacaagacctctatgtgtagagaccttcgccagcaaggggggtgcccacgggggaccaattgcaccttcgcccacagccaggaagagttggagaagtataggctgaggaataaaaaaattaacgcaacggtccgaacttttccgctgctcaacaaagtgggcgttaacaataccgtcaccactaccgctggaaatgtaatctctgtgataggtagcaccgaaacgacgggcaaaatcgttccttcaacgaacggcatctcaaatgctgagaattcagtgtcacagctgatatccaggagtaccgactctaccctccgggcccttgaaaccgttaaaaaggtgggaaaggttggcgcgaacgggcagaatgccgctgggccgtccgctgatagcgttacagaaaacaagatcggctcgccccctaagacaccggtttctaacgtggctgcaacatccgccggaccctctaacgttgggacggaattaaatagcgtaccgcagaaaagttctccttttctgactcgcgtccctgtgtaccctccccattccgagaacatccaatactttcaggaccctcggacccaaattccctttgaggtgccacagtacccccagaccgggtactatccacctccccccactgtcccagcaggagtggccccgtgtgttccccggttcgtaaggagtaacaatgtgcccgagagcagcctcccacccgcgtctatgccgtacgcagatcactactccacgttttcaccccgggaccgcatgaacagctctccctaccagcccccaccccctcagccctacggccccgtcccacctgtccccagcggcatgtacgcccctgtgtatgattctcgaaggatatggagaccaccaatgtatcagagggacgatattatccgctcaaattctctgccccctatggacgtgatgcacagctcagtctaccaaacatctttgagagaacgttacaactctttggatggttattatagtgtggcctgtcagccaccctctgagcctcgaactacggtgcctctaccaagagaaccatgtggccacctgaaaacatcctgtgaggaacaaatccgccgaaaaccggatcaatgggcccagtaccacactcagaaagcaccactggtttccagcaccttgccagtcgcaacccagtctcccactcctccatcaccactgttctccgtggactttagggcagacttctcagaatctgtgtcgggaacaaaattcgaggaggatcatctcagtcattactctccttggagctgcggtacaattggcagctgtatcaacgcaattgacagcgaaccgaaggatgtgatagccaactccaatgccgtactgatggatttggatagtggcgacgttaagcgtcgcgttcatttattcgaaacccagaggcgcactaaagaggaagaccccataattcccttctcagatggtcccatcatctccaaatggggggctatcagccggtcttctcgaaccggataccacacaactgatccagtacaggctaccgcaagccagggctctgcaaccaagcctatcagcgtgtccgactacgtaccatacgttaacgccgtggattcaagatggagttcgtacggcaatgaagcaacaagcagcgcacactacgtggagagagataggttcattgtgactgaccttagcggtcacaggaagcactcaagcactggagacctattatcccttgagctccagcaggcgaagagtaattccttattgctccagagagaagccaatgccctagctatgcaacagaaatggaactcgctcgacgaggggaggcacctcaccttgaacctcctgtccaaggagatcgagctgcggaatggtgagttgcaaagtgactatacagaggatgccaccgacaccaaaccggacagggacatcgaactggaactgtctgctctcgacacggacgaacccgatggacagtccgaacctatcgaagagatcctagacattcagttggggatctctagtcagaatgaccaactgctcaacggtatggcagttgagaacgggcaccccgtccagcagcatcagaaggaacctccaaagcagaaaaaacaatcacttggggaggatcatgtgattctggaggagcagaaaacaatcttgcccgtgacctcttgtttctcccagcctctgccggtgtcaatctccaacgcctcatgtcttccaattaccacctcggtcagcgcgggaaacctgatccttaaaacccatgtgatgagcgaagacaaaaatgattttctgaagcctgtggcgaatggcaaaatggtgaactcatag

SEQ ID NO: 24436 - DNA, 1569 bp, Artificial Sequence
  Description of Artificial Sequence: Synthetic coding sequence
atggccgccagcgccaagcggaagcaggaggagaagcacctgaagatgctccgtgatatgacgggtctccctcataacagaaagtgcttcgattgcgaccagagggggccaacctacgtgaatatgaccgtgggcagttttgtctgcaccagctgtagtggatcactgaggggtcttaaccctccccatcgggtgaagtcaattagtatgaccactttcacccagcaggaaattgagtttctccagaaacacggtaatgaagtttgtaagcagatttggctcggcctcttcgacgatagatcctcagctatacccgacttcagagatccccagaaggtgaaggagtttctgcaagaaaaatacgaaaagaagaggtggtatgtgccccccgaacaagctaaagtggtcgcctccgtgcatgctagtatttctgggtccagcgcaagcagcacatccagtacccccgaagtgaaaccactaaagagcttgctcggggacagcgctcccaccctgcacctgaataagggcacccctagccagagcccggtggtcggccgatctcaaggccagcagcaggaaaagaagcagttcgacctgttaagcgacctcggaagtgatatctttgctgctcctgcccctcagtcaacggcaacagctaactttgccaattttgcccatttcaattcccacgcaggaggctccgccgcgagcgtcaatgctaattttgcccatttcgataatttccccaaatcttcatctgccgacttcggcacgtttaacacgagtcagtcccaccaaactgcgtccgctgtctcaaaggtatccaccaataaggccgggctgcagactgctgacaagtacgctgccttagctaatctggacaatatttttagcgccgggcagggtggcgatcaaggatccggcttcggtactactggcaaggcaccagtgggatctgttgtgtccgtgccatcccagagcagcgccagtagtgataaatatgccgctctcgccgagcttgattccgtattttcctctgcggcgaccagtagtaatgcatacacttcaacttccaacgcaagctcaaatgtttttggaacagtgcccgtggttgccagcgcacaaactcagccagcctcttcatctgtgcccgcaccctttggagctacccccagcacaaatccattcgtcgccgcagccggacctagcgtggcctcttccactaacccttttcaaactaacgccaggggcgcaactgccgctaccttcggcacagcctcaatgagcatgcccacagggttcggaacgcctgcaccctatagcctgccgactagcttttccggaagctttcagcaacctgccttccctgctcaggctgcatttccgcagcagactgcattctcccagcagcccaacggagccggattcgccgccttcgggcaaaccaaaccagtggttacaccatttggtcaggtggccgccgccggcgtctcgtctaatccctttatgaccggtgcaccaactggccaatttcccactgggagtagcagcacaaacccattcctttag

SEQ ID NO: 24437 - DNA, 1524 bp, Artificial Sequence
  Description of Artificial Sequence: Synthetic coding sequence
atgcaggacgacagcatcgaggccagcaccagcatcagccagctgctgagggaatcctacctggcagagactaggcatcgcggcaacaacgagcgctcccgagccgagccctcatccaatccttgtcatttcggtagtccatccggcgccgcggaaggcggcggggggcaggacgaccttccagatctgtctgcctttctgagtcaagaggaattggacgagagcgtcaacctcgcacggttggccattaattacgaccccctagagaaagccgatgagacacaggcccggaaacgactgtctcccgaccaaatgaagcattcccctaatctctcatttgagccgaacttttgccaggataaccctaggagccccacctcttccaaggagtcaccccaggaggctaagcgcccccagtattgctcagagactcaatctaagaaggtttttctgaacaaggccgccgatttcattgaagaattatcttctctgtttaaatcccattcttcaaaacgaattagacctcgagcatgcaaaaaccataaaagtaaactggaatcccagaacaaagtcatgcaggagaattctagctcctttagcgacctcagcgagagacgggagaggagctcagtgcctattcccattccagccgatacacgtgataacgaagtgaaccatgctctcgagcagcaggaagcaaagagaagagaagcagaacaagcagcttcggaggccgccggtggtgacacgaccccgggatcatccccctctagtttatattacgaggagccactcgggcagccaccacggtttactcagaaactgagatccagagaggtaccagaaggtaccagagttcagctggattgtatagtcgtgggaatcccacccccccaagttaggtggtactgtgaaggaaaggagttggaaaactcccctgacatacatattgtgcaggctggaaacctacattccctcactatcgctgaagctttcgaagaggacacaggccggtatagttgctttgcatcaaacatttatggaactgacagtacttctgctgaaatctacatcgagggagtgagcagcagcgactctgaaggggaccccaacaaagaggaaatgaatcggattcagaagcctaacgaagtgtcctcgcctcccactacttctgcagtgattcccccagcagtgccccaagcccagcacctggtagcccaacctcgggtggccactatccagcaatgccagtctccaactaactatctgcagggcctggatggcaagcctatcatcgcagctcctgtgtttacaaaaatgctacagaacctcagtgcgtccgagggccagctcgtggtgttcgagtgtcgtgtgaagggtgcccccagcccaaaggtggagtggtaccgcgaaggcactttgatcgaggactcccccgattttcgaatattgcagaaaaaaccccgttccatggccgagcccgggaaggacgattttaacttcaatctgcttgtgtacgagtag

SEQ ID NO: 24438 - DNA, 3150 bp, Artificial Sequence
  Description of Artificial Sequence: Synthetic coding sequence
atgctgtgctggggcaacgccagcttcggccagctgggcctgggcggtatcgatgaggagatcgtgctggagcctaggaagagtgacttctttatcaataagcgcgttagagatgttggctgcgggctgcggcatactgtgtttgtgcttgatgacggaactgtttacacctgcggatgcaacgacctggggcagttaggacacgaaaaaagtcgaaagaagccggaacaagtcgttgcactagacgcacagaatatagtggcagtgtcatgtggcgaggctcataccctcgcgctcaatgacaagggacaggtatacgcgtggggcttagatagtgatggccagttaggactggtcggttcagaggagtgcataagggtgccaaggaacatcaagtccctctctgacatacagattgtccaggtggcttgcggctactaccactccctcgcactgtctaaagccagtgaagtgttttgctggggtcaaaataaatacggccaactgggtttgggcacagactgtaaaaagcagaccagcccccagcttctcaaatcacttctgggtatcccttttatgcaggtcgccgcaggcggcgcacattctttcgttctgaccctgtcgggagctatttttggctggggtagaaacaaattcggtcagctcggcttgaacgatgagaatgacagatacgtgccaaatctgctgaaaagcctgcgctcgcagaaaatcgtgtatatttgttgcggcgaggaccacacagccgcactcacaaaggagggcggggtcttcactttcggggcaggaggatacggtcagctgggccacaatagcaccagccacgaaatcaatccacgcaaggttttcgagctgatgggtagcatcgtaactgaaatcgcctgcgggcggcaacatacctctgcctttgtcccttcttctgggcgaatctatagctttggacttggtggcaacgggcagctggggaccggcagcaccagcaaccgaaagagcccatttacagtcaaggggaactggtacccatacaatggtcaatgcttgcccgatatagactccgaagagtacttttgcgtaaagcgcatcttttcaggcggcgatcagtccttctcccactactcatctccacagaactgcggcccaccggatgactttcggtgcccaaatcctactaagcagatctggacggtcaacgaagcattaattcagaagtggttaagctatcccagcggtaggtttcccgttgagattgccaatgaaatcgatgggacctttagttcaagtgggtgtttaaacggctccttcttagccgtgtctaacgacgatcactaccggaccggcacacgcttctcaggagttgacatgaacgccgcacgcctgctgttccataagcttattcaacccgaccacccgcagatctctcagcaggtggcagctagtctggagaaaaatctaatacccaagctaacttcttctctacccgacgttgaagccctgcggttttacctcacactccctgaatgcccactgatgagtgattctaataacttcaccacaattgctattccttttgggacagccttagtgaacctggaaaaagcccccttgaaggtcctggaaaattggtggtccgtattggagcctcccctctttttaaagatagtggagttgttcaaagaagtcgtggttcacctgctaaaactatacaaaattggaattcccccatccgaaagacgcatctttaactccttcctccacacagcgttgaaagttctggaaattctccaccgggtgaatgagaagatggggcaaataatccaatacgataaattctatattcatgaagtgcaagaactaatcgacatacgcaatgactacattaattgggttcagcagcaggcatatgggatgctcgccgacattccagtgaccatttgcacttaccccttcgtttttgacgcgcaagccaaaacaaccctccttcaaactgacgcagtgctgcagatgcagatggctattgatcaggcacaccgtcaaaatgtctcttctctttttttgcccgtgatcgaaagtgttaacccctgtctgatcctggtggttcgccgagaaaatatagtcggtgacgccatggaagtattgaggaagactaaaaacatcgactacaaaaaaccactgaaggttattttcgtcggcgaagatgccgtggatgctggtggtgttcgcaaagaattctttctcctcatcatgagagagctgctggaccctaaatacggaatgtttcggtattatgaggactcaagacttatttggtttagtgataagaccttcgaagacagtgacctttttcacttgataggagtgatctgtggcctggccatctacaattgcactattgttgacttgcatttccccttggctctctataagaaactcctaaaaaagaagccctccctggatgatctgaaggagctgatgccagatgtgggaaggtccatgcaacagctcctcgattatcctgaagatgatatcgaagagactttttgtctcaattttaccatcaccgtcgagaattttggtgccacagaggttaaagagttagtcttgaatggggcagacacagcggtcaataaacagaaccgacaggaattcgtggatgcgtatgtggactacatcttcaataagtctgtcgcatcattgttcgatgccttccacgccggattccataaggtttgcgggggtaaagtcttactgctcttccagcctaatgaattacaagcaatggtgattggcaataccaattacgattggaaggaactggagaagaataccgagtataagggggaatactgggcagaacaccctaccattaaaatcttctgggaggtgtttcacgagctgcctctggagaaaaaaaaacagtttctcctttttctgaccggctccgataggatcccgatcctgggtatgaagtccctcaaactggtgattcaatcgaccggaggaggcgaagagtatctccccgtctcccacacatgctttaatttactggatctgccaaaatacacagagaaggagaccttaagatctaagcttatacaagcaatagatcataacgaaggattctcgctcatttag

SEQ ID NO: 24439 - DNA, 726 bp, Artificial Sequence
  Description of Artificial Sequence: Synthetic coding sequence
atgaacagcggccggcccgagaccatggagaacctgcccgccctgtacactatctttcagggcgaggttgcgatggttactgactatggagcatttatcaagatcccggggtgcaggaagcagggacttgtacataggacgcatatgtcttcttgccgagtcgataaacccagcgagatcgtggatgtgggtgataaggtatgggtgaagctgataggcagggagatgaaaaacgatcggattaaggtctccctatctatgaaggtcgttaatcagggcacaggcaaggatctggaccccaacaacgtcatcattgagcaggaggaacgccgacgccggtcatttcaagattacaccggacaaaaaatcacgctggaggctgtgctgaacaccacatgcaaaaagtgcggctgcaaaggccattttgccaaagactgctttatgcagcccggcggcaccaaatactccctgatccccgacgaagaggaggaaaaagaggaggccaagagcgcagaatttgagaagccagacccgactaggaatccctcccgaaaacggaagaaagagaaaaaaaagaagaagcacagggatcggaagtcgtctgacagcgactcaagtgatagcgagagcgatacagggaagagggctagacacacctcaaaagattcaaaagctgctaaaaagaaaaagaagaaaaaaaagcataagaagaagcacaaagaatag

SEQ ID NO: 24440 - DNA, 870 bp, Artificial Sequence
  Description of Artificial Sequence: Synthetic coding sequence
atgatcatcaactggaaccaggtgagcgtgctgtggaagtgcctgctgaaacaaagcgcatcttaccaggacaggaggcagagttggcgccgggctagcatgaaggaaactaatagacgaaaatcgctacaccccatccatcagggcattaccgagttgtcacgcagtattagcgtggacctggctgaatctaagaggctgggttgcttgcttctgtctagcttccaattctcaatccagaaactggagccgttcttgcgcgataccaaggggttcagtttagaaagcttccgagccaaggcttcgtcactgagtgaagaacttaagcacttcgcagacgggttggagacagatgggactctgcagaaatgcttcgaggactcaaacggcaaagcatcggacttttccctcgaagcttctgtggcagaaatgaaggaatacatcacaaagttctctctcgaaaggcagacttgggaccagttactactccattatcagcaggaagccaaagaaatcctatcccgagggtcgactgaggccaagattacggaggtcaaggtggaacctatgacttacctgggcagctctcaaaatgaggtgctgaacaccaagccggactaccagaaaattctacagaatcagtcaaaggtattcgattgcatggagctcgtgatggatgaactacaaggcagcgtgaaacagcttcaagcctttatggatgaatcaacccagtgcttccagaaagtctctgtgcagcttgggaagcggagcatgcagcaactggacccctcaccagctaggaagctgcttaagctgcagctccagaaccccccagctatccatgggtccggctcgggaagttgccaatag

SEQ ID NO: 24441 - DNA, 750 bp, Artificial Sequence
  Description of Artificial Sequence: Synthetic coding sequence
atgaccagcgtgacccggagcgagatcatcgacgagctgagccggagtatctcagtggacttagcagaatctaaacggctgggctgtcttctgctgtcaagcttccagttctctatacagaagcttgagccctttctgagagacacaaaagggttcagtcttgagtccttccgggccaaagcctctagcctcagcgaggaactgaagcattttgcagacggcctggagacagatggaactctccaaaagtgtttcgaggattccaatgggaaggcgtctgatttctcactggaggcctccgtggctgagatgaaggaatatatcaccaagttttcgctcgagaggcaaacttgggaccagctactgttgcattaccagcaggaggctaaggaaattttatccaggggttccactgaggctaagattacggaggtgaaggtggaacccatgacttacctcggatccagtcagaatgaggtccttaacaccaagcccgattatcaaaaaatcctgcagaatcagagtaaggtgttcgactgcatggagctcgtcatggatgaactccaggggagtgtaaagcagctgcaggcttttatggacgagtcaactcagtgtttccagaaagtttccgtacagctgggcaaacgatcaatgcaacaactcgatccctcccccgcgcgaaagttacttaagctccagctgcagaatccgcctgcgattcatggaagcggcagtggcagctgccagtag

SEQ ID NO: 24442 - DNA, 855 bp, Artificial Sequence
  Description of Artificial Sequence: Synthetic coding sequence
atgaccagcgtgacccggagcgagatcatcgacgagcagagcgcctcttatcaggatcgccgccagagctggagacgcgccagcatgaaggagacaaatcgaaggaagtctttgcatccaatccaccaagggattaccgaactctcacgatcaatttcagtcgacctcgctgagagcaagcgactcggatgcctattgctatcttctttccagtttagtattcagaagctggagccttttttacgtgacactaaaggtttttctctcgagtccttcagagccaaagccagtagcttgagcgaggagctgaaacatttcgctgacggcctggagaccgatggtacactccagaagtgcttcgaggattcgaacggtaaggctagtgatttctccttggaggcctcagtggcagagatgaaagagtatattaccaaattttcgcttgagcggcagacctgggatcagctccttctgcattaccagcaagaggccaaggaaatcctgtcccgcggttccacagaggctaaaattactgaagttaaagtagagccaatgacctacctgggttcatctcagaatgaagtgttgaacactaaacccgactatcagaaaatccttcaaaaccagtcaaaggtgttcgactgcatggagctggtcatggacgaattgcagggaagcgtgaaacagttacaggcttttatggatgagagcacacagtgcttccagaaagtgtccgttcagcttgggaaaagatccatgcagcaattggatcctagccccgctaggaaactgttaaaactccagcttcagaaccctccagccattcacggatcgggctccggtagttgtcaatag

SEQ ID NO: 24443 - DNA, 1071 bp, Artificial Sequence
  Description of Artificial Sequence: Synthetic coding sequence
atgaccagcgtgacccggagcgagatcatcgacgagaagggccccgtgatgtcgaaaactcatgaccaccaactggaatcttccctgagtcccgtcgaagtgtttgcgaaaactagcgccagccttgagatgaaccagggggtctctgaagagcggattcatctcggaagttctcctaagaaaggcggaaactgtgatcttagccatcaggaaagactgcagtctaagagcctgcacctgtcccctcaggagcaatcagcaagctaccaagatcggcggcagagttggaggcgtgcatccatgaaggaaacaaacaggcgcaagagtctccaccccattcaccagggcatcaccgagctgtccaggtcaatttccgtggaccttgccgaatcgaaacgtttaggctgcttgctcctgagttcctttcaatttagcatccagaaactggagcctttcctgcgagacacaaaaggattttccctcgagagtttccgggccaaagcctcaagcctcagtgaggagctgaagcactttgctgatggtctggaaactgacggcactctgcagaaatgctttgaggatagtaacggaaaagctagcgacttctcactggaagcctccgtggctgaaatgaaggaatacatcacgaaattctcactggagagacagacatgggatcagctcctgctccactaccagcaggaggccaaggagatactttcgcgcggaagtacagaagccaagatcactgaagtgaaggtcgagcctatgacttacctcgggagctctcaaaatgaggtgcttaacaccaaacccgattatcagaagattctgcaaaaccagtccaaggtgttcgactgcatggagttggtgatggacgagttgcagggcagtgtaaagcaacttcaagcattcatggatgagtctacacagtgttttcagaaggtctctgtgcagttagggaaacgctctatgcagcaactggatccatccccagcccgcaaactccttaaattgcaattgcagaacccgccggctattcatggaagtggaagcgggagctgtcagtag

SEQ ID NO: 24444 - DNA, 1071 bp, Artificial Sequence
  Description of Artificial Sequence: Synthetic coding sequence
atgaccagcgtgacccggagcgagatcatcgacgagaagggccccgtgatgtcaaaaacccacgatcaccaactagagagctcactgtcccccgtcgaggtatttgccaaaacaagtgcttctctggagatgaatcaaggagtctcagaagaaaggatccatttgggaagcagccctaagaagggcgggaattgcgatctgtcccaccaggaacggctgcagtcaaagagtttgcacctctcccctcaggagcagtcagcctcgtaccaggaccgccgccagagttggagacgagctagcatgaaggagactaaccgtagaaagagcctgcaccctattcatcaaggtattacggaactgtcgaggtcaatcagcgtggatctggccgaaagcaaacgactagggtgcctcctgctgtcttcctttcaattcagcatccagaagctggagccattcctgagagatactaaaggtttttcactcgaaagtttccgcgctaaagcctcttccctctccgaggagttgaagcacttcgctgatgggttggaaactgacggcactctgcagaaatgcttcgaagatagcaatggaaaggcatctgacttcagtctggaggcatcagtggctgaaatgaaagaatacatcaccaagttttcattggaacgccagacttgggatcagctcctactccattaccagcaggaagccaaagagatcctgtctaggggctctactgaagcaaagatcaccgaagtcaaagtcgagcctatgacctacctagggtccagtcagaacgaggtcctgaatacgaaacctgactaccagaagatacttcagaaccaatctaaggtgtttgattgcatggagctcgtgatggacgagcttcagggcagtgtgaagcagctgcaggccttcatggatgagagcactcagtgcttccaaaaggtttccgtccagctaggcaagcggtcgatgcaacagctggaccctagccctgcccgcaaattactgaaactgcagctgcaaaaccctcccgctattcatggctcaggctctggatcttgccaatag

SEQ ID NO: 24445 - DNA, 1617 bp, Artificial Sequence
  Description of Artificial Sequence: Synthetic coding sequence
atggccgccgccgccagcgtgaccggccgggtgacctgggccgcctcaccgatgcgtagcctcggtttagggaggaggctgtcacttccaggaccaaggttggacgccgtcactgctgccgtaaatcccagtttgagtgatcatggcaatggactgggaagggggacgcgtggcagcggatgctctggtggcagtctcgtagcagattggggtggtggggctgccgccgctgcagcagtggcactcgctctggccccagccctgagtactatgcggcgaggtagctccgagtcagagctagctgctaggtgggaggcggaagcagtggccgctgctaaggctgccgcgaaggccgaggctgaagccactgctgaaacagtcgccgaacaggttcgggtggacgctggcgccgctggagaaccggagtgtaaagccggggaggaacaacccaaagttctcgcacccgcgcctgcccagccatccgccgccgaagagggcaacactcaggtgctgcaacgccctccgccgacgctgccacccagtaagcccaaacccgtgcaaggactgtgtccccacgggaagccacgcgacaaaggaaggtcatgtaagcgaagcagcggccacggcagtggtgaaaatgggtctcagcgtccggtaaccgtggactcttcaaaggcacggactagcctggacgctcttaaaatcagtataaggcagctgaagtggaaggagtttcctttcgggcggcgacttccttgcgatatttactggcacggagtgagtttccacgacaacgacatcttttcaggtcaggtgaacaagtttcccgggatgacagagatggtgagaaaaattaccctctctagagccgtgaggacgatgcagaacctttttcccgaagaatataacttttacccccgctcttggattctgcccgacgaattccaactgttcgtggcacaggttcagatggtgaaggacgacgatccctcttggaagcctaccttcatcgttaagcctgatggaggttgccagggggatggaatctacctcataaaggatcccagcgatatcagattggccggcaccctccagtcccgtccagctgtcgtgcaggagtatatatgcaagcctctcctgattgacaaactcaagtttgacattagactttatgtcctgctaaagagcctagacccgctcgaaatctacatcgccaaagatggtttgtctcggttttgtaccgaaccctatcaggaaccgacacctaaaaatctgcacagaatattcatgcacctcaccaactacagcctaaacattcatagcggcaactttattcacagcgactctgcatcaaccggcagcaagaggaccttttcatccatcctctgcaggctaagctctaaaggggtcgacatcaagaaggtgtggtctgacatcatttccgtcgtgattaagacagtgatcgctcttactcccgagctcaaggtgttctatcaatcagatattccgacaggcaggcccgggccaacatgtttccaggtgactattgcctcttcacaacctgcctttccagctctaacgggactgaaaagagctctgtggctgcgtgttgggtag

SEQ ID NO: 24446 - DNA, 1356 bp, Artificial Sequence
  Description of Artificial Sequence: Synthetic coding sequence
atgaccgagatggtgcggaagatcaccctgagccgggccgtgcggaccatgcaaaatctctttcctgaggaatatatatgtaagcccctgctgattgataaattgaaattcgatatccgtttgtatgtgctgctaaaaagcttagaccctttggagatttatattgcgaaagatggcctgagcaggttttgtacagagccttatcaggaacctacaccaaagaatctacatcgcatctttatgcatctcaccaactattctttgaatatacattctggcaactttattcactctgacagtgcctcaaccgggtctaaacggaccttttctagtatcctatgccggctctcttcaaagggggtggacattaaaaaggtatggagcgacataatctctgttgtgattaaaacagtcattgcccttactccggaactgaaagttttctaccagtctgacattcctactgggcggcccggtcctacctgttttcagatattagggttcgatattctgctgatgaagaatctgaaacccattttgcttgaggtaaacgccaatcccagcatgcgaatagaacacgaacacgaactgtcgcctggcgtattcgagaacgtgccaagtttggtggatgaagaggtgaaagttgcggtgattagggacaccctgagactcatggatcctctgaaaaagaagagggagaaccagagccagcaattggaaaaacccttcgcaggaaaagaagatgccctcgatggcgaactgacatcagcgccagactgcaatgccaatcccgaagcacacctcccatctatctgtctgaaacaagtattccctaagtatgccaagcagttcaactaccttcgcctcgtcgatcggatggcaaatctttttattcgcttcttggggataaaggggaccatgaagctgggcccgactggctttaggacgtttatcaggtcctgcaaactcagcagctcctccctgagcatggctgctgttgatattctctatatcgacattacccgtagatggaatagtatgacactggaccagagggactcaggcatgtgcctgcaggcattcgtggaagccttcttcttcctggcacagcgcaaattcaagatgctccccttgcacgagcaggttgcgtctctcatcgatctgtgcgagtatcatctttccctgctcgacgaaaaaagattggtctgtggccgtggagtgcccagtggcgggaggccgccccaccgggggcctccgcaggagccaagtccaagcgctcagcctgccggcgacaaccctcctccacgcactagttgtgcaaataaactgagccacccacgccataccctatcctag

SEQ ID NO: 24447 - DNA, 1644 bp, Artificial Sequence
  Description of Artificial Sequence: Synthetic coding sequence
atgaaggtggtgaagagcgccgagcactacaccgagaccgccctggacgagatccggctgctgaagtccgttaggaatagcgacccaaatgaccctaaccgcgagatggttgtacaacttctggacgattttaagatctccggagtgaatgggacgcatatttgtatggtcttcgaggtgctcggtcatcacctccttaaatggattattaaatctaattaccaaggcctgcccttgccctgtgttaaaaagatcatccagcaagtcctacagggcctggactatctccacaccaagtgcagaataatccatactgacatcaaacctgagaacatcctgttaagcgttaatgaacagtacatccgcaggttagctgctgaagccacagagtggcagaggagcggtgcaccccccccctcagggtcagcagtaagcacagcgcctcagcccaaaccggccgacaagatgtcgaagaataaaaaaaaaaaactcaagaaaaagcagaaacgccaggccgagcttctggaaaagcgaatgcaggaaatcgaggaaatggagaaggagtctgggcccggtcagaaacgcccaaataagcaggaagaatcagagtcacccgtcgagaggcccctaaaggagaatccgccaaacaagatgacccaggaaaaactggaggagtcctcaacaatcggacaggaccagacactgatggaaagggataccgaaggcggagcggcagagatcaactgtaacggagtgattgaagttattaactacactcagaactctaataacgagaccctgcgccacaaggaagacttgcacaatgcaaatgattgcgatgtccagaatcttaaccaggagtcctcattcctgagtagccaaaatggcgatagcagtacctctcaagaaactgactcatgtacaccaatcacaagtgaagtctctgacactatggtgtgtcagagctcctccactgtggggcagagtttctctgagcagcacatctctcagctccaggagtctataagggccgaaatcccatgtgaggatgagcaggaacaggagcacaatggaccactagataacaagggcaagtctacagctggaaacttcctggtcaacccacttgagccaaagaatgcagaaaagctgaaggtcaagatcgcagatcttgggaacgcttgttggcataagcactttactgaggacatccagaccaggcaatataggtccctggaggtcctgatcggttccggttacaataccccagccgacatctggtcaaccgcctgcatggcttttgaactggcaacaggtgactatctctttgagcctcactcgggggaggaatatacccgggatgaagatcatattgtgcatattatcgagcttattggaagaatccccagacggttttccctcagtggaaaatactcacaggacttcttcagccaccggggagacttgaagcatatcaccaagctcaaaccatggggtctctttgaggtactcgtggagaagtacgaatggagtcaggaggaggcggctggtttcaccgactttctcctgccaatgctggagttgatccctgagaaacgggccacagctgctgagtgtctgaggcatccatggctcaattcatag

SEQ ID NO: 24448 - DNA, 1968 bp, Artificial Sequence
  Description of Artificial Sequence: Synthetic coding sequence
atggagcggaaggtgctggccctgcaggcccggaagaagcggaccaaagcaaaaaaggataaggcacagcgcaagtccgagacacagcatcgaggttcagctcctcattccgaatccgacctgcctgaacaagaagaggaaatcttgggatccgacgatgacgagcaggaggacccaaacgattactgcaagggaggataccacctggtcaagataggcgacttattcaacgggcgatatcacgtcatccgtaagctcggttgggggcactttagcaccgtgtggttgtcctgggatatccaaggaaaaaaatttgtagcaatgaaagtcgtgaaaagtgccgagcattacacagaaaccgccctagatgaaatccgactgcttaaaagcgtccgaaactctgacccaaatgatccaaatagggagatggtcgtgcagctgctggacgattttaagatttccggagttaatggaacccatatctgtatggtgtttgaagtcctgggccaccatttgctaaaatggattatcaaatccaactaccagggtctgcctcttccatgcgtcaaaaagatcattcagcaggtgctccagggcctggactacctccacaccaagtgcaggattattcacaccgacatcaaacctgaaaatatcctcctctccgtaaacgagcagtacatacggcggcttgcggcagaagctaccgagtggcaacgcagcggtgccccccccccttctgggtctgccgtaagtactgccccccaaccaaagccagcagacaagatgtctaaaaacaagaagaaaaagctaaagaagaaacagaagagacaagcggagttactggagaaacgcatgcaggaaatcgaggagatggagaaggagagcggccccggacagaagagacctaacaaacaggaagagtctgagtccccggtagagcgtcccttgaaggaaaaccctccaaacaagatgacccaggagaaattggaggagtcatccacaattggtcaggaccagaccctcatggagagagatacagaaggcggggcggctgagataaactgtaatggtgtgatagaggtcattaattatactcagaattccaacaacgagaccctgagacataaagaggatctgcacaatgcaaatgactgtgatgtgcagaacctaaaccaagaaagttcttttttgagcagtcaaaatggagactcatctacaagtcaggaaacagattcttgcacaccgattacctccgaagtcagcgataccatggtttgtcagagctccagcaccgtgggacagagctttagtgaacagcacatttcacagctacaggagtctatccgagctgagataccctgtgaagacgagcaagagcaggagcataacggtcccttagacaataagggcaaaagcactgccggaaattttcttgtgaatccacttgagccaaagaatgccgagaagctgaaagtgaaaatcgcggatctgggtaatgcctgctgggtccataagcactttaccgaggacatccagacacgacagtataggagcttagaagtcctgattggatccgggtataataccccggccgatatctggtctactgcttgcatggcctttgagttggccactggagactacttgttcgagcctcactctggtgaagagtatactcgagatgaagatcacatcgcgcttatcatcgagctcctcggtaaagtgccccgcaagctgatcgtcgccggtaagtattcgaaagagtttttcaccaaaaaaggggacctgaagcatattacaaaactgaagccatgggggctgtttgaagtgctggtggaaaagtatgaatggtctcaagaggaggccgctggttttaccgattttctgctgcctatgctagagctaatccctgagaagcgcgcgaccgctgccgagtgtctccggcacccatggctgaactcttag

SEQ ID NO: 24449 - DNA, 864 bp, Artificial Sequence
  Description of Artificial Sequence: Synthetic coding sequence
atggccgccagcctgtggatgggcgacctggagccctacatggacgagaacttcatttctagagcctttgccacaatgggggaaaccgtgatgagtgttaagattatccgtaatcgcctgactggtattcccgccggatactgtttcgttgagtttgccgatcttgcaaccgccgaaaaatgcctacacaaaatcaacggcaagccacttcccggtgctacccccgccaagcggttcaagctgaattacgcaacttatgggaagcagccggacaattctcctgagtattccctttttgttggagacctcacaccagacgtcgatgacggtatgctttacgagttcttcgttaaagtctatcctagctgtaggggtggtaaggttgttctggatcagacaggcgtgagtaagggatatggctttgtcaaatttactgacgagcttgagcagaaacgtgctttgacagagtgccagggcgcagtaggcctgggctcaaaaccagttcgtctcagcgtggctatcccaaaggccagcagagttaagccggtcgagtactcccagatgtactcatacagctacaaccagtattaccagcagtaccagaactactatgctcaatggggatacgaccagaacacaggcagctactcttacagctacccccaatatggctacacccagagcacaatgcagacctatgaggaggtaggtgacgatgcattagaagatcctatgcctcagttggatgttacagaagctaacaaagagtttatggagcaaagtgaagagctgtacgatgcgctgatggactgccattggcaaccattggataccgtcagctccgagataccggccatgatgtag

SEQ ID NO: 24450 - DNA, 438 bp, Artificial Sequence
  Description of Artificial Sequence: Synthetic coding sequence
atggccgagcggaacgaggaccaccacctgcaggtgctgaaggagagcgaggttctgttgcaggcaaaaagagccgagttggagaagcttaagtcccaggttaccagccagcagcaggagatggccgtgctcgacaggcagcttggtcacaaaaaggaggaacttcatctgctgcaagggagcatggtgcaggctaaagctgacctccaggaggctctgagactcggagagacagaggtgacagagaaatgtaaccacatccgcgaggtcaagagtcttctggaagagctgagtttccagaagggtgagcttaacgtccagatttctgagcggaaaacccagttaactctgatcaagcaagaaatcgagaaagaggaggaaaacctccaggtcgttttacgccaaatgtccaaacataaaacggccttcctgcaatag

SEQ ID NO: 24451 - DNA, 3024 bp, Artificial Sequence
  Description of Artificial Sequence: Synthetic coding sequence
atgcagcacctgaagagcaagaagcgggaggagcggtggatgcgggccagtaagagacagagtgagaaagagatggaggagctgcatcataatattgatgacttgctgcaggagaaaaaaagccttgaatgcgaagtggaagagctgcaccgaaccgtccaaaaacgtcagcaacagaaagacttcattgacggaaacgttgaatcactgatgaccgagctggaaatcgagaaaagtctaaagcatcatgaggacattgttgacgaaattgagtgtatcgaaaaaacacttctgaaacgcaggagtgaacttcgagaggcagatagactcctggctgaagctgagtctgagcttagctgcactaaagagaaagtctgccttctcgtggtatggggagtgagtagcgtgtggaccaagaatgcagtggaaaagtttactgacgccaagaggtctctgctgcagacagagtctgacgctgaagaactggaacggagggcgcaggagaccgccgttaatctggtaaaggctgaccagcagctccgaagccttcaggctgatgcaaaagacctagaacaacataagatcaaacaggaagagattctgaaagaaattaacaagattgtcgctgccaaggatagcgattttcagtgcctttcaaagaagaaagagaagttaacagaggaattacaaaagctccagaaggacattgaaatggcagaacggaatgaggaccatcaccttcaggtccttaaggaatctgaggtgctcttgcaggctaagagagctgaactggagaagctgaagagtcaggtcacaagccagcagcaggagatggcagttctggacagacagctgggtcataaaaaggaggagctccacctgttgcagggtagcatggtccaggccaaggccgatcttcaagaagcactgaggttgggcgagaccgaagtcacagaaaagtgtaatcatattagggaagtgaagtccctccttgaggagctcagttttcagaaaggtgaactgaacgtgcagatttcagaacgcaagacccaattgactctgattaaacaggagattgaaaaggaagaggaaaacctccaagtagttttgcggcagatgagcaaacataagactgagttaaaaaatatcctggacatgttacagctcgagaaccacgaactccaggggctcaaactccagcacgatcagcgagtgtctgaactggagaaaacacaggtggcagtcctggaagaaaaactggagctagagaacctgcagcagatttcccagcagcagaaaggcgaaattgaatggcagaagcaactgctcgagcgcgacaagagagaaattgagcgaatgacagccgagtctcgcgctctacagagttgcgtcgagtgtctgtctaaggaaaaagaggaccttcaggagaagtgtgatatctgggagaagaaactcgctcagacaaagagggtgctggcggccgcagaggagaacagcaaaatggagcaatcaaatctggagaaactggaactgaacgttaggaaactccagcaggaactagaccagctgaaccgagataaactgagcctgcacaatgacatttctgccatgcagcagcagctccaggaaaaacgcgaggcggtgaactctctgcaggaggaactggcaaacgtccaggaccatctgaatcttgctaagcaggatttgcttcacaccactaagcatcaagatgtactcttgagtgagcaaacacgactccagaaagatatcagcgaatgggcaaatcgctttgaggactgccagaaggaggaggaaacaaagcagcagcagctccaggtcctccagaatgagattgaggagaacaaattaaagcttgtacagcaagaaatgatgttccagcgactgcagaaagagagagaaagtgaggagtcgaagttggaaacaagcaaagtgacacttaaagagcagcagcaccaactcgagaaagaactcacggatcagaagagcaaactggaccaggtcttgtcaaaagtcctggctgccgaagaacgggtgaggactttacaggaagaagagcgctggtgcgaaagcctggagaagaccctctcacagaccaagagacaactcagcgagagagagcaacagctggtagaaaaaagcggcgagttgttggctttgcagaaggaagcggactcaatgcgggctgatttctctttactgcggaaccagttcctgaccgagagaaagaaggcagaaaagcaagtcgcgtccctgaaggaggcgctgaaaatccagcggtcgcagcttgaaaaaaatttgcttgaacagaagcaagagaacagctgcatccaaaaagaaatggccacaatcgagctggtagcccaggataatcatgagcgggctagacgacttatgaaggaactgaaccagatgcagtacgaatatacagaactgaaaaagcagatggcaaaccagaaggatctggaacgcagacagatggagatttctgatgccatgagaaccttgaagtctgaagtgaaagatgagattcgtactagtttgaagaatctgaaccaattcctaccagaactgccagctgacctcgaggcgatccttgagagaaacgaaaaccttgaaggcgaattagaaagcctcaaggagaacctgccctttacaatgaacgaggggccatttgaagagaagctcaacttcagccaggtccatatcatggacgaacactggcgcggggaagctctgcgggagaagttgaggcatagagaggatcgactgaaggcccaacttaggcactgcatgtccaaacaggccgaggttctgatcaagggcaaacgtcagacagaggggaccttgcattccttgcgccgtcaagtggacgcactgggtgagctggtgactagcacctctgccgactccgcatcatcgccatccctatcccagctggaatcttcactgactgaggacagccagctcggccaaaatcaggagaagaacgccagcgccaggtag

SEQ ID NO: 24452 - DNA, 2985 bp, Artificial Sequence
  Description of Artificial Sequence: Synthetic coding sequence
atgaaggcccagaagagcggcaaggagcagcagctggacatcatgaacaagcaatatcagcagcttgaatctcggctggatgaaatcctgtcccgcattgccaaagaaacagaagagatcaaagatttggaagagcagcttaccgaaggccagatcgcggctaacgaagccctgaagaaggacctcgaaggagtaattagcggactccaagagtacctaggcactattaagggccaggccacccaagcacagaatgagtgtcgaaagctgcgcgacgagaaagagacccttctgcagaggctaacagaggtggagcaggaacgcgatcaactggaaatcgtggcaatggatgcagaaaacatgcggaaggaacttgcagagttggagagcgccctacaggagcaacatgaggtcaatgcaagtctccagcagactcaaggggacctcagcgcctacgaggcagagctggaggcgagactgaacctgcgagacgccgaggccaatcagctcaaagaggagctggaaaaggtgacacgactcacacaactggaacagagcgcactacaggccgaactcgaaaaggagcgccaggctcttaaaaacgccttgggaaaggcccagttctctgaggaaaaggaacaagagaactctgagctacatgctaaacttaagcatttgcaggacgacaacaaccttcttaaacagcaacttaaagatttccaaaatcatctgaaccacgtggtggacggactggtacgcccagaggaagtcgccgctagggtggacgagctgcgaagaaagcttaagcttggtaccggagagatgaatattcacagccccagtgatgtgctcgggaagagccttgcggacttgcaaaaacagttctcagagattttggcgagatctaagtgggagcgcgacgaggcccaagtcagggagaggaaattgcaagaagaaatggcacttcagcaggagaagctggctacaggccaggaggaatttaggcaggcatgcgagcgcgccctggaggcccggatgaacttcgacaaaagacagcatgaggctagaatccagcagatggagaatgagatacactaccttcaggaaaatctgaaatccatggaggagatccagggcctgaccgacttacagcttcaggaagctgacgaggagaaagaaagaattctagcgcagttacgcgaactcgagaaaaaaaagaaactggaagacgccaagtcccaggagcaagtgttcggtctggataaggagctcaaaaagctgaaaaaggctgtggcaacttccgacaaactcgcaaccgccgaacttacaatcgcgaaagatcagttaaaatcactgcacggaacagtcatgaaaattaaccaggaaagagccgaggaattgcaggaggccgagaggttctcgaggaaagctgcccaggcggctcgagatctgacccgggccgaggccgagatagaactgctacagaatctccttcgccagaagggagagcaattccgcctggaaatggaaaaaacaggcgtgggaaccggagcaaatagccaggtgttggagattgaaaagctgaacgagaccatggagcgccagcgcactgagatcgcacgtttacagaacgttctcgacctgacaggatctgacaacaagggcggcttcgagaatgtcctggaggaaatcgctgagctgcgacgagaggtgtcatatcagaacgattacataagttccatggccgatccctttaaacgacgtggatattggtactttatgcctccccccccctccagcaaggtgtcctcgcacagctctcaagctacaaaagatagcggggtcgggctgaaatattccgcatccacccccgtccgcaagccgcgcccgggacagcaggacggaaaggaaggaagccagccaccgcctgccagcggttattgggtctacagtcccattagatctggactgcacaagctttttcccagccgcgacgcggactccggtggggacagccaggaagaatccgaacttgatgaccaggaagaaccaccgttcgtgcctccgcccgggtatatgatgtacacagttctccctgacggttcgcctgttccgcagggaatggccctgtacgctcctcccccccccttacccaataattcccggcctctgaccccgggcaccgtagtttatgggccaccgccagctggagcacctatggtgtatggcccccccccccctaatttctcaattcccttcattcctatgggcgtgctgcattgcaatgtgcccgaacaccacaacttagagaacgaagtaagcagactggaagatatcatgcagcatctgaagtccaaaaaaagggaggaacggtggatgcgtgcctcgaagaggcagagcgaaaaagaaatggaagaactgcatcataacatcgatgacctgctccaagaaaaaaaaagcctcgaatgcgaagttgaagaacttcataggacagtgcagaagcgtcagcagcaaaaagatttcatcgacggaaacgtcgagagcctgatgaccgagctcgagatagagaagtccctgaagcatcatgaggatatcgtcgatgaaattgagtgcattgaaaagacattacttaaacggcggtctgagcttcgggaagcggatcgactgctggccgaagctgagagtgaactctcttgcaccaaggagaaaacgaaaaatgccgtagaaaaattcaccgatgccaagcgctctctgctccaaacagagtcagacgcggaagagcttgagaggcgggcacaagagactgcagtgaatctcgtgaaagctgaccagcagctgaggagtcttcaggcggacgcgaaagacctggagcaacacaagatcaagcaagaggaaatcttgaaagagatcaacaaaattgttgcagccaaagactcagatttccaatgtctctctaagaaaaaggagaaactgaccgaagaatag

SEQ ID NO: 24453 - DNA, 5322 bp, Artificial Sequence
  Description of Artificial Sequence: Synthetic coding sequence
atgaaggcccagaagagcggcaaggagcagcagctggacatcatgaataagcagtatcaacagctagaatctcgccttgatgagattctgtctaggattgccaaagagacagaagagatcaaggatctcgaagaacagctgactgaaggccagatcgcagctaacgaggcactgaaaaaagatctggaaggcgtgatttcagggctccaagagtacttaggtactatcaaaggacaagcaacacaggctcagaacgagtgtagaaaactccgcgacgagaaggaaaccctgcttcaaaggctgaccgaagttgaacaagaacgggaccagctggagattgttgccatggatgccgagaacatgcggaaggaactcgcagagctggagtctgcactgcaagaacagcatgaggtgaatgcgtcattacagcagacacagggtgatctttccgcctacgaggcggaacttgaggctagactgaacctccgcgacgccgaggccaaccagctcaaggaagaactcgagaaggtgactcggcttacacagctggaacaaagtgctctacaggctgagctggaaaaggaacggcaagctttgaaaaacgccctcgggaaggctcaattcagcgaggagaaggaacaagaaaactccgaattgcacgccaaattaaagcacctacaggacgacaataacctgctcaagcagcagttaaaggatttccagaaccatcttaaccacgtggtcgacggcttggtaaggccggaggaggtagccgcaagagtggacgaactgagacgcaagctgaagcttggaaccggcgaaatgaacattcactctccctctgatgtactggggaaaagcctggccgacctgcaaaaacagttttccgagatactggctcggagtaaatgggagagggacgaagcacaggtgagggaaaggaagctgcaagaggaaatggccctgcagcaagagaagctggctactggtcaggaagaatttcggcaggcctgcgagagagcattggaggctagaatgaactttgataagcgacagcacgaagcacgtatccagcagatggaaaatgagatccactatcttcaggagaatctgaagagtatggaggagatccaaggactgacagacctccaactccaggaagccgacgaggaaaaagaacgaatcctggcccagcttcgagagctggagaagaagaaaaagcttgaggatgcaaaatcacaggaacaggtgttcgggttggacaaggagctgaaaaagcttaaaaaggctgtggctacttccgacaaacttgctactgccgaactgaccattgccaaggaccagctgaagtccttgcacggcacagtgatgaaaatcaaccaggagagggccgaagaactgcaggaggctgagcgcttcagtcgtaaagccgcccaagcagcccgggacctgaccagagccgaagccgaaattgagctgctgcagaacctgctaagacagaaaggcgaacagttccgactcgagatggaaaaaaccggcgtggggaccggcgcgaattcccaggtcctagagattgagaaactgaatgagaccatggagcgccagaggacagaaatcgcccgcctgcagaatgtcttggacctgactggtagcgacaataaggggggttttgaaaacgtcctggaggaaatcgccgaacttcggcgggaggtctcttatcagaacgactatatttcatctatggccgatcctttcaagcgtcgcggctattggtattttatgcccccacccccctcgtcaaaagtctcaagccatagcagtcaggccaccaaggatagtggggttggacttaaatactccgcctccactcccgttagaaagcccagacctggacaacaagatgggaaggaaggatctcagccaccacccgcatctgggtactgggtttattcgcctatcagatctggcctgcacaagctatttccctctagggatgccgatagcgggggcgactcccaagaggagtctgagctggatgatcaggaagaaccgcccttcgtacccccgcccgggtacatgatgtatacagtgttgccagatggatctcctgtgcctcaggggatggctctttatgccccaccacctcccctgcctaacaattcgcgtccgcttactcccggaacagttgtttacggacctccaccagcaggagctccaatggtctacggccctcccccccctaacttttccatcccattcatcccaatgggcgttctgcactgcaacgttcctgaacatcataatctagagaatgaagtgtccaggctcgaagatattatgcaacacctgaaaagtaaaaagagggaagagcgctggatgagagccagcaagcgccagtctgagaaggaaatggaagaactccatcacaatatcgatgacctgctgcaggagaagaagagccttgaatgtgaggtcgaagagctccataggactgtccagaagagacagcagcagaaggattttattgatggtaacgtggagagcctgatgaccgagcttgagatcgaaaaaagcctgaaacaccacgaagatatcgtggacgagatagagtgtatcgaaaagacattgctcaaacggaggtcagaactgcgggaggctgatcggctgctggccgaagctgagtccgaactctcctgcacgaaggaaaagaccaagaacgccgtagagaagttcacagacgcaaaacgatctcttctacagacggagagtgacgctgaggaactggagcgaagggctcaagagactgcggtgaacctggtgaaagctgatcagcaactacgcagcctgcaagcggacgctaaggacctggaacagcacaagataaagcaggaagagatattgaaagaaatcaataagattgttgccgcgaaggacagcgactttcagtgtttgtcaaagaaaaaggagaagctgaccgaggaactgcagaagctgcagaaggatattgaaatggccgaaagaaacgaagaccatcatctccaggtgctcaaagaatcagaagtactccttcaggctaagcgagccgagcttgagaagctgaagagccaggtgacaagtcagcagcaggagatggctgtcctggataggcagcttggccacaagaaggaagagttgcacctgctgcaaggaagcatggtgcaagccaaagcggaccttcaggaggcacttcggctcggcgaaacagaagtgacggaaaagtgcaatcacattagagaggtgaagtccttgttggaagaactatcttttcagaaaggcgagctgaatgtgcagattagtgaacgaaaaacccagcttaccctgatcaagcaggaaatcgaaaaggaggaagagaatttacaggtggtcctgagacaaatgagcaaacataagacagagctgaagaacatcctcgacatgcttcagttagagaatcatgagctgcagggacttaagctgcaacatgaccagcgggtaagcgagctcgaaaaaacacaggtagccgtcctagaggagaaactcgaacttgaaaacctccaacaaatctcccaacagcagaaaggtgagatcgaatggcagaaacagttgctggaaagagataaacgagaaatagagcgtatgaccgccgagagcagggcactgcagagttgtgttgaatgtctcagcaaagagaaggaggacctgcaggagaaatgtgatatctgggagaagaagcttgcccagaccaagcgcgtgctcgccgctgcagaagaaaattctaaaatggagcagtccaacctggagaagcttgagttgaacgtcaggaaactgcagcaagaactggaccagcttaacagagacaagctcagtctgcataacgacattagtgccatgcagcagcagctgcaggaaaagcgcgaggcggtgaactccttgcaggaggagctcgccaacgtgcaggatcacctgaacctggctaaacaggacctcctgcatacgaccaagcaccaggatgtacttcttagcgagcagactcgcctacaaaaggacatctcggagtgggccaatagattcgaagactgccaaaaagaggaagaaaccaaacagcagcagttgcaggtactgcagaatgagattgaggagaacaaactgaagctggtccagcaagagatgatgtttcagaggctacagaaggagagagagtccgaggagagcaagctagaaacatccaaggtgactctgaaagaacaacaacaccaactggagaaagagctaactgaccagaagagcaagctggaccaggtcctgtccaaggttctagctgctgaagaaagggtccgtacgctccaggaagaagagagatggtgtgagagcctggagaaaactttaagccagacaaaaagacagctcagcgaacgggagcaacaactggtcgagaaaagcggggagcttttggcactgcagaaggaagctgattccatgcgagccgatttcagcctgctgaggaatcagttccttactgagcgcaagaaggccgagaagcaggtcgccagtttgaaggaagccttaaagattcagagaagccagctggaaaaaaacttgctggagcagaagcaggagaacagctgtatccaaaaggagatggccacaatcgagctggtggcccaggataaccatgagcgcgccagaaggctgatgaaagagttaaaccagatgcagtatgaatatactgaactaaaaaagcaaatggcaaaccagaaggacttggagaggaggcagatggagatctctgatgccatgaggaccctgaagtccgaggtcaaggatgagatcaggacctctctgaaaaacctcaaccagttcctgccagagctcccggctgatttagaagccatccttgaacgcaatgaaaacctggaaggtgaactggagtctctgaaggagaatctgccctttactatgaacgaaggacccttcgaagaaaagctcaatttttcacaggttcacatcatggacgaacactggagaggcgaggcacttagggaaaaactccgccaccgtgaagacagactaaaagctcaattaaggcattgtatgtccaaacaggcagaagtcctcatcaaaggtaagcgtcagacagagggaacacttcattccctgcgacgacaggtggacgcactcggcgagttagtcacatcaacgagcgcggatagcgcctcgagcccaagtctgtctcagctggagtcttcactgacagaggatagccagctgggccagaaccaggagaaaaatgcctccgcccgatag

SEQ ID NO: 24454 - DNA, 2487 bp, Artificial Sequence
  Description of Artificial Sequence: Synthetic coding sequence
atggagaagcagaagcaggagatcgccggcaagcagaaggagatcaaggatctgcagatcgcaattgacagtcttgactctaaggatcccaagcacagtcacatgaaggctcagaagagcggcaaagagcagcagctggacattatgaataagcagtaccaacagctggaaagcaggctggacgaaattctcagtcgaattgccaaggagacagaagagattaaagacctggaggaacagctgacggaaggccagatcgctgccaatgaagctctcaagaaggacctggagggtgttattagtggactgcaggagtatttggggacgatcaagggacaggctactcaggcccagaacgaatgccgcaagcttagagacgaaaaggagaccctcctccaacgtctgactgaggttgaacaagagcgggaccagttggaaatcgtcgccatggatgctgaaaacatgcgtaaggagttggctgagctcgaatcagcgctccaggagcagcatgaagtgaatgcctccctacagcaaacacagggtgaccttagcgcttacgaagcagaactcgaggcccgcctgaatctaagggacgctgaggcaaatcaattaaaagaggagctcgagaaggttacccgactgacgcaacttgaacaaagcgcactccaagctgaattggagaaagagcgccaggcgttaaagaacgcactgggaaaggcacagttctccgaggagaaagagcaagaaaactctgagttgcatgccaagctgaagcacctgcaagatgataataacttgctgaaacagcagctgaaagactttcagaatcatctaaaccatgtggtggacggactcgttaggccggaagaggtggccgcacgcgtagacgagttgcgcaggaagctgaagctgggcactggagagatgaacattcatagtccttctgacgtactcggcaagtctctggcagatctgcaaaagcagttttcagaaatcctcgccaggtccaagtgggagcgagacgaagcccaggtgcgggaacgaaagctgcaggaggaaatggcactgcagcaggaaaaactggctacaggccaggaagagtttcgccaggcctgtgaacgcgcactcgaagctagaatgaactttgacaagagacagcacgaagcccggattcaacaaatggaaaatgagattcattacctgcaagagaacctgaagtcgatggaagaaattcagggccttaccgacctgcaactgcaggaggctgacgaggaaaaggaacggatcctggcccagctcagagaattggaaaagaaaaagaaactcgaggacgctaaatcccaagaacaggtgtttggcctagacaaggagttgaaaaaacttaagaaagctgtggccacgagcgataaactagcgactgctgagcttactatcgccaaagaccaactcaaaagcctgcacggaaccgtgatgaagattaaccaggagcgcgccgaagagctgcaggaggcagagcggttttctcgcaaggcagctcaggcagcccgggatttgacccgggctgaagcagagatagagcttcttcaaaatctcttgagacagaagggggaacagttccgcctggaaatggaaaaaacaggggtaggtacaggtgctaacagtcaggttttagagattgaaaaacttaacgagaccatggagagacaacggacggaaattgcgcgcctccagaatgtcctggacctgactggaagtgataacaaggggggattcgaaaacgtgctggaagagatcgcagagctccggcgtgaggtctcatatcagaatgactacatctcctcaatggccgatcccttcaagcgccgagggtactggtattttatgccccctccaccctcttctaaggtgagttcccattcctcccaggccaccaaggacagcggagtcggcctcaaatattctgcctctactcctgtgagaaagcccaggcctggccaacaagatggcaaggaaggcagccagcctccccctgcttccggatactgggtgtacagcccgatcaggtctgggcttcacaagctatttccttcaagagatgccgattctggaggggattcacaggaagagagcgaactggatgaccaggaggagcccccttttgtccctccgcccgggtatatgatgtataccgtgctgcctgacgggtcgcctgtcccccagggcatggcactttatgcccctcctccccccttgccaaataactctaggccgctgacccctggcacggtcgtgtatgggcccccccctgctggcgcgcccatggtctacggccccccgcccccgaatttttccatccccttcatcccaatgggggtgttgcactgcaacgttcctgagcaccacaacctggtgagcggcaaaacctacaactctctgagcactctgcttccctgggtcacggacaaagttatatacttaatgtcctag

SEQ ID NO: 24455 - DNA, 6978 bp, Artificial Sequence
  Description of Artificial Sequence: Synthetic coding sequence
atgaagaagggcagccagcagaagatcttcagcaaggccaagatcccgtcatcttctcacagccctatcccgtcttctatgagcaatatgaggtcacggtcactgtcacctttaatcggatcggagaccttaccttttcactccggcgggcaatggtgcgagcaggtggagatcgctgacgagaataacatgttgctggattaccaggatcacaagggcgcagactcccacgctggcgtgcggtacatcactgaagctttgatcaaaaagctgaccaaacaagataacctcgccctcatcaagagcttgaatctgtcactgtccaaggacggcggaaagaaattcaaatacatagagaatctggagaaatgtgtcaagttggaggtactaaacctatcatacaatctgatcggaaaaatcgagaagctggacaaactgctgaagctccgtgagttgaacctgtcttataataagatctccaagatcgagggtattgagaatatgtgcaacctgcagaaactgaacctggccgggaacgagatcgaacatattccggtctggctcggaaaaaaactgaagtcattgcgagtgctcaacctaaaaggaaacaagattagttccctgcaggacatttcaaagctgaagcccctgcaagacctcatcagcttgattctggtagagaaccccgtggtcactttaccacactacttgcagttcacaatctttcatctccgttccctggaaagcttagaaggccagcccgtcacaacacaagacagacaggaggcctttgaacgatttagcctggaggaggtggaaaggctcgaacgggatctggagaaaaagatgatcgaaacagaagaactgaagagcaaacagacccgctttctagaggaaataaagaaccaggataagctcaacaaatccctgaaggaagaggcaatgttgcagaaacagtcatgtgaggaactcaagtctgacttaaacacaaaaaacgaactcctaaagcagaagacgatcgaactgactcgggcttgtcagaaacagtacgagttagagcaggagcttgccttttacaagatcgacgccaaattcgagccactcaactattaccccagcgagtacgcagaaattgataaagcccccgacgagtctccctacataggaaagagcaggtacaagcgcaacatgtttgccactgagagttatatcattgactctgctcaggcagtacagatcaagaaaatggaacccgacgaacagctgcggaacgaccatatgaacttacggggacatacaccactcgacacacaactggaagataaggagaagaagatctctgcagcccagacacgtttaagcgagttgcatgatgaaatcgaaaaggctgagcaacagatcctgcgcgccactgaagagtttaagcagctggaggaagcaatacagctgaagaaaatttcggaggccggtaaggatctcctatacaagcaactcagcggcagactgcagctggttaacaagctgaggcaagaggccctagacctggaactgcaaatggaaaagcaaaaacaggagatcgccggaaagcaaaaggagatcaaagacctacagatcgcaatcgactctctggattcaaaagaccctaaacacagccacatgaaagctcagaaaagcggaaaggagcagcaacttgatattatgaataaacaataccagcagctcgaaagccggctcgacgaaattctgagcagaatcgccaaggaaactgaagagatcaaggacctcgaggagcagctgacggaaggccaaatcgccgccaacgaagccttgaaaaaagacctcgagggcgtaatttccggtcttcaggagtacttgggtaccattaagggccaagcgacacaggcccaaaatgaatgtagaaaactgagggacgaaaaagaaacgctgctacagaggttaacagaggtggagcaggagagggaccagctggaaatcgtcgccatggacgctgagaatatgaggaaggaactggccgaactggagtctgctctccaggagcagcacgaagttaatgcaagtctccagcagacacagggggatctttcggcctacgaagctgagctcgaggcccgcctgaacttaagggacgctgaagccaaccagcttaaggaagaactggaaaaggttacccgcctcacacaactggagcagagtgccctgcaggcggagttagaaaaagaacggcaagctctgaaaaacgctttgggcaaagctcagttttccgaggaaaaagagcaggagaacagtgaactgcacgccaagctcaaacacctacaggacgacaacaatcttttgaaacaacagctaaaggattttcagaatcaccttaaccatgtagtcgacggccttgtaagaccagaagaagtggcagccagggtggatgagttgaggaggaaactgaagcttggaaccggggaaatgaatatccatagcccatcagacgtcctgggtaaaagccttgccgacctgcagaagcagttttcggagatactggctaggagcaagtgggagcgcgatgaagcccaggtccgcgaacgcaagttgcaggaagagatggccctgcagcaggaaaagttggcaaccggacaggaggaatttaggcaggcctgtgagagagctctcgaagccagaatgaactttgacaagcgtcagcatgaagctaggatccagcaaatggaaaatgagatccactatctccaggaaaacctcaagtctatggaggagatccaggggctcacagacttgcagctgcaggaggcagatgaagaaaaagagcgtatcctggcccagctgagagaattggagaagaaaaaaaagctggaagacgctaaatcacaggagcaggtgttcggcctcgataaagagctcaagaagctgaagaaggctgtcgcaacttctgataagctggcaaccgctgagctgaccatcgcgaaggaccaactgaaaagtcttcacggaacagtcatgaaaatcaaccaagagcgcgccgaagagctgcaagaggcagagcgatttagtcgcaaagctgcccaggcagcacgggacttaactcgcgccgaagccgagattgaactattacagaacctgctgagacagaagggtgaacagtttcgactagaaatggagaagaccggcgttggcacaggcgcaaattcacaggttttagagatcgagaaacttaatgagaccatggagaggcagagaacggaaatcgctcgtttgcagaacgtcttggatctgacggggtccgataataaaggtggcttcgaaaacgtgctcgaagagatcgctgaattgagaagggaggtgtcctaccaaaacgactacatcagcagcatggccgatccatttaagcgccgcggctattggtacttcatgcctccaccaccctccagcaaggtgtcttcccatagtagccaggcaacaaaagactccggggttggtctcaaatactcagcgtcaactcccgtgaggaagcccaggccaggacagcaagatgggaaggagggctctcagcctccacctgcctcaggttactgggtatatagtcccatccgctcgggactgcataaactgtttccctcacgtgatgccgacagcggcggcgactcacaggaggagtctgagctggacgaccaggaggagcctccttttgtaccaccccctggctacatgatgtacaccgttctccccgatgggtcccctgtgcctcaggggatggccctttacgctccacccccacctcttcctaataactctcggcccctaactccaggaaccgttgtgtacggccccccccctgccggtgccccgatggtctatggaccaccccctcccaacttttctattccctttatacctatgggtgtgttgcactgtaacgtcccagagcaccataatttggagaatgaagtgtctagactggaagatatcatgcagcacctaaagagcaaaaagagagaggaacgatggatgcgagctagtaagcggcagagcgaaaaggagatggaagaattgcaccacaacattgacgacctgctgcaggagaaaaagtcactggagtgtgaggtagaagaactccacagaacagtccagaaaaggcaacaacaaaaagatttcatagatggaaatgtcgagtctctgatgactgagctggagatcgagaagtcccttaagcaccatgaagacatagttgatgagatcgagtgtattgagaagaccttgcttaagaggagatcagaactccgggaagcggacaggttgctggccgaggctgaaagcgaactgtcctgcacaaaagaaaagacaaaaaatgctgtggagaaattcacagatgctaagcggtccctgttacagaccgagtcggatgccgaagaactcgagagacgcgctcaggagactgccgtcaatttggtgaaagcggatcagcagcttcggtcgctccaggccgatgccaaagacttggagcagcacaaaattaaacaggaagaaattctcaaggagatcaataagatcgtagcagccaaagattccgatttccagtgtctctctaagaaaaaggagaaacttaccgaagagttgcagaaactgcaaaaagatattgagatggcggaacggaacgaggaccaccacctacaggtgctgaaagagagtgaagtacttctgcaagcaaagagggccgagctggagaagctgaagagtcaggttacttcccagcagcaggaaatggccgtccttgacagacagcttggacacaaaaaggaggagctgcatcttctgcagggatccatggtgcaggctaaagccgatcttcaggaagccttacgcctgggagagacagaggtcacagagaagtgtaatcacattagggaggtcaagtccctactcgaggagctgtcctttcagaaaggcgagttaaacgtccagattagcgaaagaaagacccagctcacactgatcaagcaagagatagagaaggaggaagaaaacctgcaggtggttctgagacagatgagtaaacataagaccgaattgaaaaacatactggatatgctgcagttggagaatcacgagctccagggccttaagctgcaacacgaccaacgcgtgtccgagctcgaaaaaacgcaggtcgccgtgttggaagaaaagcttgaattagaaaacctacaacaaatttctcagcagcaaaagggtgagattgaatggcagaaacagctgctggaaagggataagcgcgagattgaacgcatgacagcagaatcccgagcgctccagtcatgcgttgagtgccttagcaaagaaaaggaagacctgcaagaaaagtgcgacatatgggaaaagaagctggctcagaccaagcgagtgctcgcggccgctgaggaaaatagtaaaatggagcagtccaacctggagaagctggagctgaacgtgcgtaagcttcaacaggagctggatcagctgaatcgggataagcttagtctgcataacgatatctcagccatgcagcagcagctgcaggaaaaacgggaagcagtaaactctctgcaggaggagctagcaaatgtccaggatcacctgaatctagccaagcaagacctcttgcacacaacaaaacatcaggacgtgctgctgagcgaacagacccggctccagaaagatatttccgagtgggccaaccgctttgaagactgtcagaaagaagaggaaactaaacagcagcagctacaggttcttcagaatgagattgaggagaacaaactgaagctggtgcagcaggaaatgatgttccagaggctgcagaaggaacgtgaatccgaggagagcaagctggagactagtaaggtgacactgaaagaacagcagcatcagcttgagaaggagctgaccgaccagaaatccaagctcgaccaggtgctgagtaaagttctcgccgccgaagagcgagtgagaacactgcaggaagaggaaaggtggtgtgagtccctggagaagaccctgtcccaaactaaaaggcagttgtccgaacgggaacagcagcttgtcgagaaaagcggcgaactgttggccctgcagaaagaagccgatagcatgcgggctgatttttccttgctgcgaaaccagttccttactgagagaaagaaggctgagaaacaggtggcctctttgaaggaggcattgaagatccaacggtcgcagctggaaaagaacctgctggagcagaaacaagagaacagctgtatccaaaaggagatggcaacaatcgaactggttgcccaggacaatcatgaaagagcgcggagactgatgaaggagttaaaccaaatgcaatatgagtacacagagctgaaaaaacagatggccaatcagaaggacttggagaggcggcagatggaaatctcagacgctatgagaaccctcaagagtgaggtgaaagacgaaattcggacgtctctgaaaaacctgaatcagtttctgcctgaattgcctgcggatctggaggccatactagaaaggaatgagaacttggagggcgagttggaaagtctgaaagagaatctgccctttacgatgaatgagggtcccttcgaagaaaaactgaatttctctcaggtccacatcatggacgagcactggaggggagaggcactccgtgagaaactaaggcacagagaagatcgtctcaaagcacagttacgccattgcatgtctaagcaagcagaggtgttaatcaagggaaagcgccagaccgagggcactctgcacagcctgagaagacaggtggatgcccttggcgagttagtgaccagcacctctgctgactcggcatcatctccatccttgtcacagctggaatcttctctgacggaggactcacaacttggccagaaccaggaaaaaaatgccagcgctcgatag

SEQ ID NO: 24456 - DNA, 1359 bp, Artificial Sequence
  Description of Artificial Sequence: Synthetic coding sequence
atgaagaagggcagccagcagaagatcttcagcaaggccaagatcccttcctcatcacatagtcccatccctagctctatgtcaaacatgcgaagtcgaagtttgagtccattgatcggctccgaaactctccctttccattccggaggccaatggtgtgaacaggtcgagatcgcggacgaaaacaacatgctgctcgactatcaggatcataaaggagctgatagccacgcgggtgtgcggtatatcacagaggcccttattaagaagctgaccaaacaggacaatttggccctgatcaagtctctaaatctatccctgtcaaaagatggaggaaagaaatttaagtacatcgaaaacctggagaaatgtgttaaactcgaggtgcttaatttgtcatataacctcattgggaagattgagaaactagacaagctattaaaacttcgtgagcttaacctctcctataataaaatctctaaaatagagggaatcgaaaatatgtgcaatctccaaaagctgaatctggccggaaacgaaatcgagcacattcctgtttggctgggcaagaaacttaaatctttacgggtcctgaacctgaagggtaacaaaatatcctctttgcaggatatctccaaactgaaacccttgcaggacctgatctctctcatcttggtcgaaaatcctgtcgtgaccctgccacattatctacagttcaccatcttccacttgagatctttagagagtttggagggacagcccgttactacacaggacaggcaagaagcgttcgagcgtttcagccttgaggaggttgaacgactcgaaagagacctggaaaagaagatgattgaaaccgaagagctgaaatctaagcagaccaggttcctcgaggagattaaaaatcaggataagctgaacaaaagtctgaaggaggaggcaatgctgcagaagcagtcatgcgaagagctcaagtccgatttaaataccaaaaatgaattgctgaagcagaagaccatcgagctgacccgtgcttgtcaaaagcaatacgagttggagcaggagctcgccttttataagattgacgcaaagtttgaacctctgaattactacccatcggaatacgcagagatcgataaagccccagatgagtctccgtatatcggcaaatctcggtacaagaggaacatgtttgcaaccgagtcctacattatcgacagtgcacaagcagttcaaatcaaaaagatggaaccagacgagcagttgcgcaatgatcatatgaatctgcgtgggcacacacccctggatacacagttggaggaccacaagttagattatcagaattgcatgatgaaatag

SEQ ID NO: 24457 - DNA, 1053 bp, Artificial Sequence
  Description of Artificial Sequence: Synthetic coding sequence
atgtgctgcgacagcgacttcgtggcccggaacaagagccaggactctgggattgcggagatggaagaactgcccgtgccgcacaatatcaagatcagcaacatcacatgtgactctttcaaaatctcttgggaaatggatagtaagagtaaagatcgaattacgcattactttattgatttgaataaaaaggagaataagaatagcaacaagtttaagcataaagatgtacctacaaagctggtagcaaaagccgtcccgctaccaatgacggtgaggggtcattggttcctgtcccctcgcacggaatataccgtggcagtgcagactgcttccaaacaagtggacggagattatgtggtgtccgagtggagtgagatcatagaattctgcaccgctgactactcaaaggtgcacctgacacagctgctggagaaagcagaagtcatagcgggccgaatgctgaagttctcagttttttaccgcaatcagcataaggaatatttcgactacgtgcgagaacaccatgggaacgccatgcagccaagcgttaaggacaattctggctcacacggatcgccaatctccggaaagctggaagggatcttttttagctgttccaccgagttcaataccggaaaacccccacaggattccccatatggcagataccggtttgaaatcgcggccgaaaagctgttcaatccgaacacaaacctgtatttcggtgatttttactgcatgtacaccgcctatcattatgtgattctggtgatagcacccgttgggtccccaggggatgaattttgtaagcagcgactgccccagctgaacagcaaagataacaagtttttaacctgtacagaagaagatggcgtgctggtgtatcaccacgctcaggatgtgatcctagaggtcatttacacggacccggtggatctgtccgtaggtacagtggccgagataaccggtcaccagctgatgagcctctctactgctaatgccaagaaggatccctcttgtaaaacctgtaacatctctgtcggtcggtag

SEQ ID NO: 24458 - DNA, 1131 bp, Artificial Sequence
  Description of Artificial Sequence: Synthetic coding sequence
atggaggtgccccggctggaccacgccctgaacagccccaccagcccatgtgaggaagttatcaagaacctgtcactggaagcgatccagttgtgcgatcgtgatggtaataaatctcaggacagcggcatcgctgaaatggaagagctgccagtaccccataacattaagattagtaatattacttgtgactcgttcaaaatttcctgggagatggactccaaatctaaggacaggattactcattacttcatcgatctgaacaagaaggagaataagaattctaataagtttaagcacaaggatgtgccaactaaacttgttgccaaagccgtgcccctgccgatgacagttcgagggcattggttcctgagccctaggacggaatacaccgtcgctgtgcagacagcttccaagcaggtggatggagactatgtcgtgagcgagtggtcagagatcatcgaattctgtacagctgattattcaaaagtacatctaacgcaacttctggagaaggccgaggtcatcgctggccgaatgcttaaattctccgtgttctaccggaatcagcacaaggagtactttgactacgtccgtgaacatcacggtaatgctatgcagccctctgtgaaggacaattctggttctcacggatcccccatttccggcaaactagagggcatattcttctcttgctcaaccgagtttaatactggtaaaccacctcaagactccccctacgggaggtatcggttcgaaatcgccgctgaaaagctgttcaatcccaataccaatttgtattttggtgacttttattgcatgtacaccgcctaccattacgtcattctggttattgctcccgtgggatcaccgggcgatgaattctgtaagcagaggttgccgcagctgaattccaaagacaataagttcctaacatgcacagaagaggacggagtactggtataccaccatgcgcaagatgtcattctcgaagtcatctacactgatccagtggacctatccgtgggaactgtggcagaaattaccggacaccagctgatgtctctaagcacagctaatgccaaaaaagatccctcctgcaaaacctgcaacatcagcgttggccgctag

SEQ ID NO: 24459 - DNA, 1263 bp, Artificial Sequence
  Description of Artificial Sequence: Synthetic coding sequence
atgctgaaggccgtgatcctgatcggcggcccccagaagggcaccaggttcagaccgttgagttttgaagttcccaaaccattatttccggtcgcaggcgtgccaatgatccagcaccacatcgaggcctgtgctcaggtcccaggtatgcaggagatactcctgattggcttttatcaacctgacgagccacttactcagttcctcgaagctgctcagcaggagttcaatttgcccgtacggtacttgcaggagtttgcccctctcggtactggggggggtctgtatcatttcagggaccagattctggccggctcccccgaggcattttttgtcctcaacgcagatgtgtgctcagattttccactgagcgccatgctcgaggcacatcggcgacagcgccatccgttcctcctgttgggaactacggccaacagaacccagagcttgaactacgggtgtattgtggagaacccacagactcacgaggttctacactatgtggagaaacctagtacattcatcagtgatatcatcaattgcggcatctacctctttagccccgaagccttaaaacctttgcgagacgtgtttcagcggaaccagcaggatggccagctggaggacagtccaggattgtggccgggggctgggacaattaggctggaacaggacgtgttctctgctctggccggccaggggcaaatctacgtccatctgacagacggcatttggtcgcagattaaatccgccggatcagccctttatgccagtcgactatacctgagtaggtaccaagacacccatcccgaacgcctggccaagcacacacctggcggaccatggattcgaggcaacgtgtacattcaccctaccgccaaagtggctccctctgccgtacttggcccaaacgtgtcaatagggaaaggagtgacagtcggggagggcgtgcggcttagagagtctatcgtcctccacggggccacactccaggaacatacgtgtgtgctgcacagcatcgttggatggggttcaaccgtaggaaggtgggcccgggtggagggcacaccgagtgatcccaaccctaacgatccccgggctcggatggacagcgaatctctatttaaggatggcaaacttctgcctgcgatcacgatattgggctgccgcgtgaggatacccgctgaggtactcatactgaactccatcgtgttaccgcacaaagagctttccaggtcattcactaatcagattattctgtag

SEQ ID NO: 24460 - DNA, 411 bp, Artificial Sequence
  Description of Artificial Sequence: Synthetic coding sequence
gaccccctgagctggctgagcggcccctggggccaggtgcccgccggcatctgcccacctagacaccgcggctggtaccacttccgtgaccagatactggccggttcccccgaggccttcttcgttcttaatgccgacgtgtgtagcgattttcctctctctgccatgctggaagcgcaccggcgacaacgtcatccatttcttctgctggggacaactgcaaatcgtacgcagtcccttaactatggttgtatagtcgagaaccctcagactcacgaagtcctccattatgtggaaaagcccagtacattcatttcagacatcataaattgcggcatctacctgttttctcctgaagctctcaaaccgctgcgggatgtgttccaacggaaccaacaggacggtcagtag

SEQ ID NO: 24461 - DNA, 1365 bp, Artificial Sequence
  Description of Artificial Sequence: Synthetic coding sequence
atggagcggaaggacttcgagacctggctggacaacatcagcgtgaccttcctctctctgaccgacttgcagaagaacgagaccttggatcacctcatatctctctctggagcagtacaactccgccatctctcgaataatcttgaaactctgctcaaaagagatttcctgaaactgctccctctggaacttagtttctacctgttaaaatggctcgaccctcagaccctcctcacttgctgcctggttagcaagcagtggaataaggttatttccgcttgtactgaagtgtggcagacagcttgcaagaacctcggttggcagatcgatgattccgtgcaggatgcacttcactggaagaaagtgtatctgaaagcaatactgaggatgaagcagttagaggaccacgaggcctttgaaaccagtagccttatcggccattctgcccgcgtatatgccctgtactacaaagatggtctgctgtgtaccggatccgacgatctgtctgctaaactgtgggatgtttccaccggccaatgcgtgtacgggattcaaactcacacatgcgctgccgtgaagtttgacgagcagaagctcgttactggcagcttcgataatacagtggcttgttgggaatggtcatcaggcgcccggacacagcactttcgtgggcacaccggcgccgtcttttccgtagactataatgacgagttggatatccttgtcagcggatccgctgacttcactgttaaggtgtgggctctcagcgctggaacgtgcctaaacactctgactggccacaccgagtgggtgactaaggtggtgttgcagaagtgtaaggtgaagtcccttttgcattctccgggtgactatattctgttgagcgccgacaagtacgaaataaagatatggcctattggcagggaaattaactgcaagtgccttaaaacgctctcagtgagtgaggacagatcaatctgtcttcagccaagacttcactttgacggaaagtacatcgtttgcagcagcgccctggggttgtaccagtgggacttcgcctcttatgacattctacgggtcatcaaaactcctgaaattgccaatctggcgttgctgggctttggagacatcttcgctctgttgtttgacaaccgctacctgtatattatggatctgcggactgaatcgctgatctcccgatggccattgcccgaatacagaaagagcaaaagagggtcctcttttctggctggcgaagcaagctggctaaacggcttggatgggcacaacgatacaggattggtgtttgctacatctatgccagaccactccatccacctggtgctgtggaaggagcacggctag

SEQ ID NO: 24462 - DNA, 372 bp, Artificial Sequence
  Description of Artificial Sequence: Synthetic coding sequence
atggaggccgccgagaccgaggccgaggccgccgccctggaggtgctggccgaagtcgcgggcatcttagagcctgtcggcctccaagaagaggccgaactgcctgcaaagattctggtggaatttgtcgtggactcgcaaaagaaagacaagctgctgtgcagccagctccaagtagccgatttcctccaaaacatcttggcccaagaacgcccttggtgcgtgctccagggctgctggtctacaacttgctggcgatgcaagttcgccatgacttcgtggagaaccgcagcctggaggaagatcctggagaaggcctctgacttcccacatcttccaacaataatcactggaaaaaccgtcaattcgtag

SEQ ID NO: 24463 - DNA, 834 bp, Artificial Sequence
  Description of Artificial Sequence: Synthetic coding sequence
atggaggccgccgagaccgaggccgaggccgccgccctggaggtgctagccgaagtcgcgggaatcctcgagccagtgggtcttcaggaggaagccgaactaccagcaaagatcctggtggaattcgtggttgacagtcaaaaaaaagacaaacttctgtgctctcagctgcaagtggccgactttcttcaaaacatactcgctcaggaggataccgcaaagggattagaccccctggctagtgaagataccagtagacaaaaagcaattgccgccaaggaacagtggaaggagcttaaggccacgtacagagagcacgtcgaagccataaagatagggctgaccaaggccttaacccagatggaggaggcccagcgcaaaaggacacaactcagagaggcctttgagcagctgcaagcgaaaaaacagatggccatggaaaaacgccgggcggtgcagaatcagtggcaactgcagcaggagaaacacttacagcacctggctgaggtttctgccgaggtgcgggaacgaaagacagggactcagcaagagctcgatcgcgtgttccagaagctcgggaacctgaagcaacaggcagaacaggaaagagataagctgcagaggtatcagacctttttacagctactctatacactccagggtaaactgctctttcctgaggctgaggccgaagctgaaaacctccccgatgataagcctcaacagcccacaagacctcaggagcagtctactggcgacacaatggggcgcgatccaggtgtgtctttcaaggcagtgggcctgcagcccgccggagacgtgaacctgccgtag

SEQ ID NO: 24464 - DNA, 1713 bp, Artificial Sequence
  Description of Artificial Sequence: Synthetic coding sequence
atgagcagcatcggcgagggcatcgacttcagccaggagcggcagaagatttccggcctccgaaccttagagcagtccgtgggcgagtggctcgagtctattggcttacagcagtatgaaagtaagctgctgttgaacggctttgatgatgtacacttcctcgggtccaatgtgatggaggagcaggatctccgagacatcggtatctccgatccgcagcacaggcgcaagctgttgcaggcagcgcgctccctcccgaaggtcaaagcccttggttacgatggcaattcacctccttccgtgccctcttggttagatagcctaggtttgcaagattacgtgcattcattcctgagcagcggatattccagcatagacactgtgaaaaatctgtgggaattggaattggtcaatgtactgaaagtacagctcctggggcatagaaagcgcatcattgcgagtcttgctgatagaccttacgaggaaccccctcagaagcctcctaggttctcccagctgaggtgccaggacctcctgtcccagacctcatcccccctgagtcagaacgactcatgtacagggaggagcgctgacctgcttctaccacccggcgatacagggcgaaggcggcatgattcactgcacgatcccgcggccccaagcagggctgagcgcttccgaatacaggaggaacacagggaagcaaagctgactctgcgaccaccgtctctggctgcgccctacgcacctgtccaatcgtggcagcaccagccagagaagctgatctttgagtcatgtgggtacgaagccaattacctcgggagcatgttgatcaaagacctgaggggaaccgagagcacccaagatgcgtgtgctaaaatgcggaagtctactgaacacatgaagaaaatcccgactattatcctctctattacttacaagggcgtgaagttcattgatgcctcaaacaagaacgtgattgccgagcacgagatcaggaatatttcctgcgctgcgcaggaccccgaagacctgtgcactttcgcctacatcaccaaggatctacaaacaagccaccattattgtcacgtcttctccactgttgatgtaaacctcacctacgagataatcctgactctcggtcaagcctttgaggttgcatatcagctggctctgcaggctcaaaaaagcagggccaccggcgcttctgcggccgagatgatcgagactaagtctagcaagcctgtccctaagcctagggtgggagttcggaagtcagctgtccccctgccccccgactcccgatgttgctattgccatacttgtacgacgcacagaccctcgtatctccctcttcccagcgtgagccccggggttaagctcgagcctccggatatggatcaagacgctcagtcgcacgcaagtgtgtcctgggtggtcgaccccaagcccgattccaaacggagcctgtccacaaaccacacaaggctggagctcgtctgctgcagccaacccgagaacgagctggtgagtacaatcagtggcgataaaccaaaatccttcctcgagcctctgctgttcgtaatgccaaccaccgcctacaatcataattgtccggagtggcgcagtcaaaaggatggcggctgttcaaccagtgagtgtcctcaccatctttgcctcgaaaagcctggggtgctgtcattggaaatgtag

SEQ ID NO: 24465 - DNA, 1785 bp, Artificial Sequence
  Description of Artificial Sequence: Synthetic coding sequence
atggagagcaaccacaagagcggcgacggcctgagcggcacccagaaagaggctgctctcagagctctcgtacaaaggaccggctactccctcgttcaagagaacggtcagcggaaatacggaggaccccctccaggctgggacgcagctccccccgaacggggctgcgagattttcatcggaaagctcccaagagacctcttcgaggatgagctgatccccttgtgtgaaaagattggaaagatctatgagatgaggatgatgatggacttcaacgggaacaaccgcggatacgcttttgtaacatttagtaataaggtagaagctaaaaatgccataaaacagctcaacaactacgagattcggaatgggagactcctcggagtatgcgccagcgtcgacaattgtaggctgttcgttggaggtattcctaaaaccaagaagcgggaagagatcctgtcggaaatgaaaaaggtgaccgaaggcgtcgtggatgtcatcgtctacccttctgccgccgacaaaacgaaaaatagggggttcgccttcgtggagtatgagtctcatcgtgctgcagcgatggcgcggaggaagctacttccaggtcgaatccagttgtgggggcatggcattgctgtggactgggcagaacccgaggtggaggtggacgaggatactatgagcagcgtcaagattctttacgtccgtaatttaatgttgagtacttcagaggaaatgattgagaaggaatttaataacatcaaacccggggccgtggagcgagttaaaaaaatacgggactatgcattcgtgcatttttcaaacagggaggacgctgtcgaagcaatgaaagctctgaacggcaaagtgctggatgggtctcccatcgaggtcacattggcaaagccggtggacaaggatagttacgtgaggtatacaaggggcaccggcggcaggggtaccatgctgcagggggagtacacctacagtctcggtcaggtttatgatcccaccaccacttatttgggtgccccagtgttttatgccccccagacgtacgctgccatcccatcgctgcacttcccagctaccaaaggacacttatcaaaccgcgctatcatccgcgctccgtctgtccgcgaaatttatatgaatgtaccggtcggagcggccggcgtgcggggcttgggcggccgaggctacctagcctatacgggactggggagaggttaccaggtcaagggggacaaacgggaggacaaactttatgatatactgcccgggatggagttaacccctatgaaccctgtgacgttgaaaccacaggggatcaagctcgctccacagattctcgaagagatctgccagaagaacaactgggggcagcctgtgtatcagctccattcagccattggccaagaccaaaggcagctttttttatacaagatcactatcccggccctggccagccagaaccctgcaattcatccattcactccgcccaaactgagcgccttcgtggatgaagctaaaacttacgccgccgaatacacacttcagaccctcggcatccccaccgatggcggcgacgggaccatggcaaccgcggccgctgctgcaacggcatttcccgggtacgcagtaccaaatgcaaccgctcccgttagcgctgcccagctaaagcaggcagtgaccctggggcaagacctggcagcttatacgacttacgaggtgtacccaaccttcgccgtgactgcccggggggacggctatgggactttctag

SEQ ID NO: 24466 - DNA, 1785 bp, Artificial Sequence
  Description of Artificial Sequence: Synthetic coding sequence
atggaggccgtgtgcctgggcacctgccccgagcccgaggccagcatgtccacggctatccccggcctgaagaaaggcaacaacgccctacagtcaataattctgcagacacttcttgagaaagagaatggacaacgcaagtatgggggaccgcccccaggctgggacgccgctccacctgaacgcggctgcgaaatcttcatcggaaagctgccgagagatttgttcgaggacgagcttatacctctgtgcgagaagatcggcaaaatctatgagatgcggatgatgatggatttcaatggaaataacaggggatatgcctttgttacattcagcaataaggtcgaggcgaaaaacgctattaagcagttaaacaattacgaaatccggaacggtaggctgttgggtgtgtgcgcatctgttgacaattgcagactgtttgtggggggaattcccaaaaccaagaaacgcgaggagattctgagtgagatgaaaaaagttaccgagggggttgtggatgtgatagtgtacccgagcgccgctgacaagacaaagaacagagggtttgcttttgtagaatatgagagccaccgtgcagctgccatggcgaggaggaagctgctccccggccgtatccagttgtggggacacggcatagccgttgattgggcagaacccgaagtggaagtggatgaagataccatgtcatcggttaaaatcctgtacgtgcggaatctaatgctgtccacatccgaggaaatgatcgaaaaggagtttaacaacattaaacctggagcggtcgaacgtgtgaaaaagattcgggactatgcctttgtacacttttccaaccgcgaagacgcggttgaagctatgaaggccctcaatggtaaggtcctcgacggtagccctatcgaggtcactcttgcaaaaccagtggataaagactcttacgttcgttatacacgaggtactggcggccggggtaccatgcttcagggggagtatacttatagcttagggcaggtatacgaccctacaaccacttacctgggcgcccccgtgttctacgctccacaaacctacgctgctattcctagcctgcacttccctgctactaagggtcacctctctaacagagcaataattagagctccctccgtcagaggcgctgcgggcgtgagaggactaggagggcgtggctacctggcttacacaggactcgggaggggctaccaggtcaaaggcgacaagcgggaagataaactgtacgatatcttgcctggcatggagttaacccccatgaacccagtgaccctaaaaccccagggaataaagctggctccgcagatccttgaggaaatatgtcaaaagaataattggggtcaacctgtgtatcagctccactctgcaatcgggcaggaccaacgtcagctctttctatataagatcacaatcccagcactggcctcacagaatcccgctatacacccctttaccccacccaagctctccgcttttgtggatgaagccaaaacatatgcggccgaatatacattgcaaacactcggaatccccactgatgggggtgacgggactatggcgacagccgccgccgccgcaaccgcctttcctggttacgccgtgcctaacgcgactgctccagtgtcagcggcccagctgaagcaggcggtcactttagggcaagatctggccgcatatacaacatacgaggtgtacccaaccttcgctgttaccgctcggggagacgggtacggcaccttttag

SEQ ID NO: 24467 - DNA, 1761 bp, Artificial Sequence
  Description of Artificial Sequence: Synthetic coding sequence
atggagagcaaccacaagagcggcgacggcctgagcggcacccagaaagaagctgctctgcgtgcgctggtgcagcgtacaggttattcactggtgcaagagaatggccagcggaagtatggaggcccaccccccgggtgggacgctgctcctcctgagagaggatgcgagatttttatcgggaaactccctcgtgatctgttcgaggacgaactaatccccctgtgtgaaaagatcggtaagatctatgagatgagaatgatgatggacttcaacggaaacaataggggatatgcatttgtcacattctccaataaggtggaggccaaaaacgccattaaacagctgaacaattatgagataagaaacggtagactcctgggagtttgcgctagtgtggacaactgtcgcctgttcgtcggtgggattcccaagacaaaaaaacgcgaagaaatcctctccgagatgaagaaggtgactgaaggagtagtggatgtgatagtgtacccttcggcggcagacaagacaaagaatagagggtttgccttcgtagaatacgagtcccacagggctgccgcaatggcacgaaggaagctactccctggcaggattcagctgtggggacacgggattgcagtggattgggcagagccagaagtggaagtggatgaggacaccatgtcttcggtcaaaattctctatgtgcgaaatctcatgctttccacttccgaggagatgatcgagaaggagttcaataatattaagcccggagcagtcgagagagtgaagaaaattcgggactatgcttttgtgcacttctctaaccgagaggacgcagtggaggctatgaaggcgctgaacgggaaggtactcgatgggagccccatcgaagttacgctcgctaagccagtggataaagattcctacgtcaggtacacgagaggcaccgggggacgaggcacaatgctgcagggggagtacacctacagcctgggtcaggtgtatgatccaactaccacctatctgggcgcccccgtcttctatgccccccaaacctacgccgctattccatctctgcacttccccgctactaaagggcacctgagcaatagggccattattagagcaccgagcgttagaggcgcagctggagtccggggacttgggggacgtgggtatcttgcctacacagggttagggaggggctatcaggtgaagggcgacaagcgggaagacaaactgtatgacatcctgcctgggatggagttgacaccgatgaatccagtcaccctgaaacctcaggggataaagctggcgccacagatcctggaagaaatttgccagaagaacaactggggtcagcctgtctaccagctgcactccgctattgggcaggatcaacggcaattattcctgtacaaaattaccatccctgctctggcttctcaaaaccctgccatccaccccttcacccccccaaaacttagcgcattcgtcgacgaggccaaaacctacgcagctgaatacaccctacagaccttagggattccaacggacggaggagatggtactatggctaccgcagccgctgctgctactgcgtttcctgggtatgcagtgcccaatgctactgcacccgtctcagccgcccagctgaagcaggctgtgaccctgggccaagatctggcagcatatacaacttacgaggtgtatccaactttcgccgtgaccgcccgcggtgatggctatggtacattttag

SEQ ID NO: 24468 - DNA, 1761 bp, Artificial Sequence
  Description of Artificial Sequence: Synthetic coding sequence
atggagagcaaccacaagagcggcgacggcctgagcggcacccagaaagaggctgctctgagagcccttgtccagcgtaccgggtatagtctggtgcaggaaaatggacagagaaagtacggcggccccccccccggctgggatgctgcacccccagaacgggggtgcgaaatcttcattgggaagctgccgcgtgatctttttgaggatgagctgatacctctgtgcgagaagataggtaagatctatgaaatgcggatgatgatggatttcaacggcaataatcgcggctacgcattcgtgaccttctctaacaaagttgaagctaagaatgctatcaagcagctgaacaactacgaaatccggaatggccggctgctgggggtgtgcgcatcagtggacaattgcaggctttttgtcggggggattcccaaaaccaaaaagcgcgaggagattctgagcgagatgaaaaaggtgaccgaaggagttgtggatgtgattgtttatccttcggctgccgacaaaaccaagaatagagggtttgcattcgtcgagtacgagtcccacagggccgcggccatggcccgccggaaattactgccaggtcggatacagctgtggggccacggtattgcagtggattgggcagagccagaggttgaagttgatgaagacacaatgtcatctgttaagattctgtatgttcggaacctgatgttgagtacaagtgaggagatgatcgagaaagagtttaacaacattaagccaggtgccgttgaaagggtgaagaagattcgcgattacgccttcgtgcatttctccaaccgggaggatgccgtcgaggcaatgaaggcactgaacgggaaggtactggacggctcacctattgaggtgaccctagccaagcctgtcgacaaggacagttacgttcgctacacccggggcactggtggccgcggaaccatgctgcagggcgagtacacatactctctagggcaggtctatgaccctactacaacgtacctgggggcacctgtattttacgcccctcagacatacgcggcaataccatcactgcactttcccgctactaagggacacctcagtaatcgggccattattcgcgctccctcagtgcggggagcggccggggtccgcgggctgggcgggcgggggtaccttgcctataccgggctggggcgtggttaccaagtaaagggcgataagagagaggacaaactatacgacattctgcctggcatggagctcacaccgatgaatcccgtcaccctgaaaccccaaggcatcaagctggccccccagatcttagaggagatctgccagaagaacaactgggggcagcccgtgtatcagttacactctgccattggtcaggatcagagacagctcttcctttataaaatcaccatcccagccctggcttctcaaaatccagctattcatcctttcacacccccaaaattgagcgcattcgtggacgaggccaaaacttatgctgccgagtacactctgcagacacttgggattccaactgatggtggcgatggcacgatggccacagcagcagccgcagctaccgcgttccccggctacgctgtcccaaacgccacagcccctgtttcagccgcccagctgaagcaagccgtgactctgggccaggacttagctgcctacactacatatgaagtgtatcctacctttgcagtcactgctcgcggcgatgggtacggaacattctag

SEQ ID NO: 24469 - DNA, 1542 bp, Artificial Sequence
  Description of Artificial Sequence: Synthetic coding sequence
atgcagcggaccttcgcctggctgctggaccgggtgcagcacctgggggcccccgtgacactgagagcgagctacctcgaaatttacaatgagcaggttagggatttactgtccttgggcagcccacgcccattgcctgttcggtggaacaaaaccaggggattttatgtagaacagctcagggtcgttgagtttggctcccttgaggcattgatggagctgcttcaaaccggcctctcccgccgccggaattccgctcacacccttaaccaggcgtctagccggtctcacgcccttttgaccctgtatatttccagacagacagctcagcagatgccatctgttgacccgggtgaaccgccagtcgggggcaaactctgctttgtggacctcgctggatctgagaaggtcgcggccaccggaagtaggggggaactgatgttggaggctaacagcatcaaccgctcccttctggcacttgggcattgcatatcactgcttctcgacccgcagcgcaagcagagccacattccttttcgggacagcaagttaaccaagcttcttgcggattccctcggaggcagaggtgtgactcttatggttgcctgtgtgtctccttctgctcaatgcttgcccgagaccctgagtacccttcggtatgcaagcagagcacaacgcgtgaccacaaggccccaagcccccaagtcacccgtcgccaagcagcctcagaggttagagacagagatgctccagttgcaggaagaaaataggcggcttcaattccagctggaccagatggactgcaaagcatctgggcttagcggcgctagagtcgcatgggcccagaggaacctctatgggatgctgcaggaatttatgttggaaaacgagaggctgcggaaagaaaagtcccagctgcagaattccagagacctggcacaaaacgaacagaggatcctggcgcagcaggtgcatgcactggagaggcgtctgttaagcgcttgctaccaccaccaacaggggccgggactgactcccccatgcccctgcttaatggctccggctcctccctgtcacgcccttccacctctgtactcatgcccctgttgccacatctgcccactctgtcgagtgcccctcgcccactgggcatgcctgccaggcgaacaccacctccctcaggtcttagatcccgaagcttctggcgggaggcctcctagtgccagacctcccccttgggcccctccatgcagccccggaagcgcaaagtgcccccgcgaacgaagccattcagactggacccaaactcgcgttctagctgagatgcttacggaggaggaggtcgtcccttcagcaccccctctgccagtccgcccaccaaagacctctccaggtctgcgcgggggggcaggtgtccctaatttagcccaaagactggaggcactgcgcgaccagattggatcaagcctgagacgtgggcgtagtcaaccaccctgcagtgaaggcgccaggagcccagggcaggtactgccaccacattag

SEQ ID NO: 24470 - DNA, 786 bp, Artificial Sequence
  Description of Artificial Sequence: Synthetic coding sequence
atggtgaagggcgagaagggccccaagggcaagaagatcaccctgaaagtggcccgaaattgtatcaaaatcaccttcgatggaaaaaagcgattggacctttctaaaatgggaatcaccacattccctaaatgcatactgaggctatccgacatggacgagttggatctgagtcgcaacttaatccggaagattccggatagcatcagtaagtttcagaacctccggtggctggacctgcatagtaattatatcgacaagctccccgagtccattggacagatgacgtctcttctgtaccttaatgtctccaataatcgccttacctctaacggactaccagttgagttgaaacagctcaagaacatcagagcggtgaacctcggactcaaccatctggacagtgtgcctaccaccctaggggccttgaaagagctgcacgaagtgggactgcacgacaatttgctgaataacattcctgtaagtattagcaaactccctaaactgaaaaagttgaatataaaaagaaacccattcccaaagcccggcgagtctgagatctttatcgacagcattcggaggctggaaaatctgtatgtggtggaagagaaggacttatgtgctgcctgcttgaggaagtgccagaacgcacgggacaatctgaaccgaataaaaaacatggctaccaccacaccacgtaaaactatattcccaaatctcatttcaccaaactcgatggcaaaagattcttgggaagactggagaataagactgacctcttcctag

SEQ ID NO: 24471 - DNA, 1770 bp, Artificial Sequence
  Description of Artificial Sequence: Synthetic coding sequence
atggccagcagccagcgggacatggaggactgggtgcaggccatcagaagggtgatttgggctccactaggagggggcaccgcccgtcgcagccatgcccatcccctggaacctctgccccctggtatcttcggacagaggctggaggaaactgtccatcacgaaaggaagtacggaccacggctcgcacctttacttgttgaacaatgcgtggactttattagggaaagagggcttaccgaggagggcctgtttcgcatgccgggacaggctaatctggtgcgggacctgcaggacagttttgactgcggcgagaagccactctttgacagcaccaccgacgtgcatacagtggcatcattgctgaaactgtatctgagagagctaccagagccggtcgtccctttcgcacggtacgaagatttcttaagctgtgcacagttgttgacaaaggacgagggagagggcaccctcgagcttgcgaaacaggtctctaacctgccacaggccaattataatcttctgagatacatatgcaagtttctggatgaagtgcaggcctattcgaatgtgaacaaaatgagcgtgcagaacctggctactgtgtttggtcccaacattcttcgccctcaagtcgaagatccggtcaccatcatggaggggacgtctctcgttcaacacctcatgacagtacttattcggaaacattcccagcttttcactgcccctgtgccagaaggacctacgagcccacggggaggactccagtgtgccgtcggctggggttccgaagaagtaactagggattctcaaggtgagcctggagggccaggattaccagctcatcgtacctctagtctcgatggcgcggcagtggcagtgctgtctcgcacagctccgacggggcctggatcccgttgcagccccggaaaaaaggttcagaccttgcctagctggaagtccagttttaggcaacctaggagtctgagtggttcaccaaagggtggaggctcaagtctggaggttccgattatcagctctgggggaaattggctcatgaacggcctgagctcacttcggggacaccgccgggcgtcaagtggtgaccggctgaaggattccggaagcgtccagcggctcagcacttatgacaacgtccctgctcctggattagtgccaggcatcccttccgtggcatccatggcgtggagcggcgcctcaagttcagagagctccgtgggaggtagcttaagcagctgcacagcttgccgcgcatctgacagttccgcaaggtctagcctccacacagactgggctcttgagccctctccactaccatcttccagcgaggaccccaaatccctggatttggaccattctatggacgaggcaggggccggggcctcgaacagtgagccttctgagccggattcacccactcgtgagcatgcccggagatcagaggcactgcaggggctggtgaccgagcttagagctgaactttgcagacaaaggactgaatatgagcgtagcgttaaaagaatagaagagggttccgcggacttgcgcaaaagaatgtctagactagaagaggagttggatcaagaaaaaaagaagtacatcatgctggagatcaagcttcgcaattccgagcgcgcccgagaagatgccgagaggaggaatcagctgttgcagcgtgagatggaagaattttttagtacactcggtagcctcacagtaggagcaaagggagccagggcccctaaatag

SEQ ID NO: 24472 - DNA, 1209 bp, Artificial Sequence
  Description of Artificial Sequence: Synthetic coding sequence
atgagcgccgagggcgccgagcccggccccggcagcggcagcggccctggacctggacccctttgccccgagcacggtcaagccctctcctggttctgcggcagtgagcggcgccccgtctgtgccgcctgcgccggcctgggaggccggtgccggggacaccggatcaggagggccgaggaacgcgctgaggaactgagaaataagatcgtcgaccaatgtgagaggctgcagctgcagtccgctgcaataacgaagtacgtagcagacgttctccccgggaagaaccagcgcgccgtttccatggccagcgccgcccgggaactggtgatacaaagactctctctcgtacgctcactgtgtgaaagtgaggaacagcggctgctggagcaggtacacggcgaagaagaacgagcgcaccagagtattctgacccagcgtgtgcattgggccgaggccctccagaaacttgacactattcggaccggacttgtaggaatgctgacccatctggacgacctgcagcttattcagaaggaacaggagatcttcgaaaggaccgaggaagccgagggcatactggacccgcaggagagcgagatgctgaatttcaatgagaaatgtacgcgcagccctctcctgactcagctatgggcgactgccgtgctaggttccctgagtggtactgaggacatccgaattgacgaacggacagtttccccattccttcagctgtcggatgatcggaagacactgactttctccaccaaaaaaagcaaagcatgcgctgacgggcctgagagatttgatcactggcctaacgcacttgccgccacttctttccagaatggcctccacgcttggatggtgaacgtccaaaactcttgcgcttataaggtgggcgtagcctctgggcatctgcctcggaaaggcagcggatctgattgccggttaggtcacaacgctttttcttgggttttcagtaggtacgaccaggagttccggttcagccacaatggccagcatgagcctcttgggctgcttcggggacccgctcagttgggagtggtcctggatctgcaggttcaggagcttctgttttacgagccggctagcggtaccgtgctgtgcgcacatcacgtaagctttcctggaccattgttccccgtctttgccgtagcagaccaaacaatttcgattgtgcggtag

SEQ ID NO: 24473 - DNA, 258 bp, Artificial Sequence
  Description of Artificial Sequence: Synthetic coding sequence
atgctgcggcggaagcccacccggctggagctgaagctggacgacatcgaagaattcgaaaatatccggaaagacctcgagacaagaaagaagcagaaggaagatgtagaagtggtaggagggtcagacggagagggagccataggtttatcgtctgatccaaagagtagagagcagatgatcaacgatcggatcgggtacaaacctcagcccaagcctaataatcgttccagccaatttggtagtctcgagttctag

SEQ ID NO: 24474 - DNA, 744 bp, Artificial Sequence
  Description of Artificial Sequence: Synthetic coding sequence
atgctgagcgacggctgcggcagcgaggagaagatcagcgtgccctcttgttacggcggcattggcgctccggtgtctcggcaagttcctgcctcccatgactcagagctgatggctttcatgacacgtaaactgtgggatctagagcagcaggttaaggcccagacggacgagatcctctctaaagaccaaaagattgccgccttggaggacctggtacagactctcagaccccaccccgcagaagccacattacagaggcaggaggagttggaaaccatgtgcgtgcaactacagcggcaggtgagggagatggagagattcctgtcagattacggactgcagtgggtgggagaaccaatggaccaggaggattctgaatctaagaccgtgagtgagcacggcgaaagagattggatgacggcaaagaaattttggaagccaggggattctcttgctccaccggaggtggacttcgacagattacttgcaagcctacaggacctgtcagagctggtggtcgaaggcgacactcaggtcacccctgtgccaggtggggcgaggctgagaacactggaacccatcccgttgaagctgtataggaacggaattatgatgtttgatggtcctttccaacctttttatgacccatctacccagcgctgcctgagagacattttggacggcttcttcccatccgaactccagcgcctatatcctaatggggtcccttttaaagtgtag

SEQ ID NO: 24475 - DNA, 1464 bp, Artificial Sequence
  Description of Artificial Sequence: Synthetic coding sequence
atgagcagccccctggccagcctgagcaagacccggaaggtgcccctcccgtctgaaccgatgaatccaggcagaaggggtatccgtatctacggggatgttcccgctagccatgacagcgaactcatggcttttatgaccagaaagctgtgggacttggaacagcaagtaaaagcacagaccgacgagattcttagtaaggaccaaaaaatcgccgcactagaagacttagttcaaaccttgcgcccacacccagccgaagccactctgcaaaggcaggaggagctcgagacaatgtgcgtgcagcttcagagacaagtgcgtgaaatggagagatttttgtcggattacggactccaatgggtgggagagcccatggaccaggaggattcagagtccaagactgtgagtgaacacggagagcgcgactggatgactgcgaaaaagttttggaaaccaggcgattctttagcccctccggaagtcgatttcgatcgactcctagccagcctccaggatctgagcgagctcgtagtggagggcgatacccaggtcaccccagtgcccgggggtgctcgtttgaggacgcttgagccgatccccttgaagctgtatagaaacgggattatgatgtttgatggaccattccagcctttctatgaccccagtacccagcggtgtctcagagatattctggacggcttcttccctagcgagcttcagcgtctctaccctaacggagtgcccttcaaggtttccgacttaaggaatcaagtctacctcgaagatggccttgacccattcccaggcgagggcagagttgttgggcgacagctgatgcacaaagccctggaccgcgtcgaggagcatcccggaagccgaatgacggccgagaagttcctgaatcgcctccctaagttcgtaattcggcaaggcgaggttatagacattagaggtcccattcgcgataccctgcagaactgctgccctcttcctgcccggatccaagagatcgttgtggaaacccccaccctcgccgctgagcgagaacggtctcaagaatcccccaatacacccgcacccccactctctatgctgagaatcaaatcagagaatggcgagcaggccttcctcctgatgatgcagcctgacaacactattggcgacgtaagggccctgcttgctcaagccagggtaatggatgcatccgcttttgagattttttcaactttcccccccaccctgtatcaggacgatacactcaccttacaggctgccgggctcgtgcctaaagcagcactgttacttcgcgcgcgccgggctcccaaaagctctctcaagttctcaccaggaccatgtcctgggccagggcccggcccctctccaggtccaggaccaggaccctcccccggccctggacccggacccagcccttgcccgggccccagcccatcaccccaatag

SEQ ID NO: 24476 - DNA, 1020 bp, Artificial Sequence
  Description of Artificial Sequence: Synthetic coding sequence
atgtggaccgcccggggccccttccggcgggaccggtggagcagcgaggatgaggaggctgcggggcccagccaggctctctctccactactgtccgacacacggaaaatcgtttcagagggcgaactggaccagctggcacagattcggcctctgatcttcaattttcacgagcagacggctatcaaggattgcctgaagattcttgaagagaagacagccgcgtacgacatcatgcaggagtttatggcgttagaactgaagaacctgcccggcgaatttaatagcgggaatcagccttcaaatcgggagaagaacaggtatagagatatcctgccgtatgattcaacacgggtgccactagggaaaagtaaggactacattaacgccagttacatacggatagttaattgtggagaggagtatttctatatcgctacccagggaccactcctgagcacaatagatgacttctggcagatggtgctagaaaataacagcaatgtgatagccatgatcacaagagaaatcgagggagggattattaagtgttatcactattggcccatcagcctcaagaagcccctggaactgaaacatttccgggtcttcctcgagaattatcaaatactgcagtactttattatccgaatgttccaggtggtagaaaagagcaccggaacaagccactcagtcaaacagctgcagtttaccaaatggccggaccatggaaccccagccagcgctgattcctttataaaatatataaggtatgcccgaaagtcccaccttactggtcctatggtagttcattgttccgccggtatcgggcggaccggggtgttcctgtgtgtagacgtggtcttctgtgctatagtgaaaaactgcagttttaacatcatggatattgtggcccagatgcgcgaacagcgctctggcatggtacagacaaaagaacagtatcacttctgctatgatattgtgctggaagtactcaggaaactgctgacgctggattag

SEQ ID NO: 24477 - DNA, 1563 bp, Artificial Sequence
  Description of Artificial Sequence: Synthetic coding sequence
atgagcagccccctggccagcctgagcaagacccggaaggtgcccctgccgagcgagcctatgaaccccggccgccgcggcatccgcatttacggcgacgaggatgaggtggacatgctgagtgacgggtgtggaagtgaagaaaagatttccgtcccaagctgttacggcgggataggtgcgcctgtgtcacgtcaggtgcctgcatctcatgatagcgagctcatggcctttatgacccggaaattgtgggacttggaacagcaggtgaaagcccagactgacgagatactgtcaaaagaccaaaaaattgccgccctggaggacctggtgcagactttgaggccccatcccgcagaggctaccctccagcgtcaggaggaactggaaactatgtgcgtacaactgcaacgacaagtgcgcgagatggagagatttctctcggattatggtctccagtgggtcggcgagcccatggaccaggaggattcagaatccaagaccgtttccgaacacggggaaagagactggatgaccgccaagaagttctggaagccaggtgactccctggctcctcccgaggtggactttgatcggctcctggcatcactgcaagacttgagcgagctcgtcgttgagggggacacgcaggtcacgcccgtgcctggcggcgcgcgccttcgcacattagaacctatcccgctcaagctgtacaggaatggaattatgatgttcgacggtccttttcaaccattctatgacccttccacccagcggtgcctgcgagacatcctagacgggtttttcccctcagaactgcagaggctgtatcctaatggtgttccctttaaggtctctgacctgcgtaatcaagtttacctggaagacggccttgatccgtttccaggtgagggtcgagtagtgggcaggcagctaatgcacaaggcattggacagggtggaagagcatccaggaagcaggatgacagccgagaagtttctgaatcgcctgccaaaattcgtcattcgccagggcgaagtgattgatatcagggggccaatccgggatacccttcaaaactgttgtccgctgcccgcccggatccaggagatcgtagtcgaaacccccaccctcgctgcggagagagagcggagccaggaaagccccaacactcccgcaccgcccttgagcatgctgcgaatcaagtccgagaacggtgaacaagccttcctgctaatgatgcagcccgacaataccattggcgatgtaagagccctgctggcacaggcaagggtgatggacgcaagtgccttcgaaattttctctaccttccccccaacgctctaccaagacgacaccctgacactgcaagctgcaggcctagtgccaaaagccgcactcctgcttagagccaggagggcacccaagagttcactcaaattctcccctggtccgtgtcctggacccggaccgggcccaagccccgggcccggtcctggcccaagtccagggcccggcccagggccctcaccttgcccgggcccatcccctagtccccaatag

SEQ ID NO: 24478 - DNA, 1563 bp, Artificial Sequence
  Description of Artificial Sequence: Synthetic coding sequence
atgagcagccccctggccagcctgagcaagacccggaaggtgcccctcccttccgagcccatgaatccagggcgtcgagggatcagaatatacggggacgaagacgaagtggatatgctcagtgacgggtgtggatctgaggaaaaaatctcagtgcccagctgttatggaggaatcggcgcacctgtttcgcggcaggtgcctgcctctcacgattcagaacttatggctttcatgaccagaaaactatgggaccttgagcagcaggtcaaagcccagaccgatgaaatcctcagcaaggaccagaagattgcagcgttggaggacctggtgcagaccctgcgtcctcacccagctgaggccaccctccagcgtcaggaggagctcgagactatgtgcgtgcagctgcagcgacaggtgagggaaatggaacgtttcttgtcagattatgggctgcaatgggtgggcgagcccatggatcaggaggattccgaatccaagaccgtcagcgaacacggcgagcgggattggatgaccgctaaaaaattttggaagcccggagatagtctggctccgccggaagttgatttcgacagattattagcttcgttgcaggacttgagtgaactagttgtcgagggtgacacgcaggtgacaccagttcctgggggggcccggctccgcaccctggagcctatacctctcaagctctatcgaaacggaatcatgatgttcgatggccccttccagccattttatgaccctagcactcagcgctgcctccgcgacatcctagacggattctttccgtccgagctccagcggctctatccaaatggagtccccttcaaggtatcggatttaaggaaccaagtctatctggaggatggcctggatccttttcctggtgaggggagggtcgtcggccgtcagttgatgcataaagctcttgatagagtagaagaacaccctggctcgagaatgaccgcagaaaaattccttaatcggctccctaagtttgtgatccgccaaggggaagtcatcgatattcggggtccgattagggatactctgcagaattgctgccctttacctgcccggatccaggaaatcgtggttgaaacccctactctcgcagccgaacgcgagcgatcccaggagagccctaacacaccagctccacctctgtcaatgctgcgaatcaagagtgagaatggcgagcaagcttttctcttgatgatgcaacctgacaataccatcggagatgttagggctctgctggcccaggcccgagtcatggatgcaagcgctttcgaaatattttcgacgtttcctccaaccctgtaccaggatgatacattgaccttgcaggccgccgggcttgtgccaaaagccgctctactgctacgggccagaagagcgcctaagagtagcctgaaattctcaccaggtccatgtccaggccctggaccgggtccatcccctggaccgggtccaggaccttctcctggtcccggaccaggcccctccccctgccctggcccaagcccgtctcctcagtag

SEQ ID NO: 24479 - DNA, 834 bp, Artificial Sequence
  Description of Artificial Sequence: Synthetic coding sequence
atgttcgacggccccttccagcccttctacgaccccagcacccagcgatgtctgagagacattttagacgggttctttccctcagagttacaaagattatatccaaacggcgtgcccttcaaggtgtctgatctgcgcaaccaagtataccttgaggatggcctggaccccttccccggagagggcagagtcgtgggtcggcagttaatgcacaaggccctcgatagagtagaagaacatccagggtctagaatgacagccgagaaattcctgaatcgcttgccgaagttcgtgatccggcaaggggaggtgattgatattcggggaccaatcagggatactctacagaactgctgtccgctgcctgcacggatccaggaaatcgtggtcgagacccccactctggcagctgagcgagagaggtctcaagagagccctaacacccccgctcctccactgtctatgcttaggatcaaaagcgagaatggcgagcaggcgttcctgctgatgatgcaacctgataacacgattggcgatgtgcgcgcgctattagcccaggctcgtgtaatggacgctagtgccttcgagattttctctactttccctccaactctgtatcaggatgacaccctgactctgcaagccgcgggcttggtcccaaaagcagctcttctactgcgtgccagacgcgcacccaagagtagcttgaagttctcaccgggaccatgcccgggccctgggccagggcccagccctggcccaggtcccggcccttcgccaggccccggccccggcccatccccttgccccggaccctctccatctcctcaatag

SEQ ID NO: 24480 - DNA, 1314 bp, Artificial Sequence
  Description of Artificial Sequence: Synthetic coding sequence
atggccggcggcccccccaaggccctgcccagcaccggcccccactcgctaagagatatgcctcacccactcgctggcagctcgagcgaggaggctgtagggggcgatagcactccttcccccgacctgctgatggctcggtcgttcggagataaagatctcatcttgcccaatggcgggactccagccggcacttcttccccagcttcgtcaagctctctactgaataggctgcaactggatgacgatatcgatggcgagacccgggatttatttgtgattgtggacgatcctaaaaagcacgtctgcactatggaaacatacatcacataccgtataaccacaaaatctactcgcgtggaatttgatctgcctgagtatagtgttcgtcgccgctatcaggactttgattggctgcggtcaaaactggaggagtcacagcctactcatcttataccgccacttcctgaaaagtttgtcgtgaagggagtcgtagatcgatttagcgaagaatttgtggagaccaggcgcaaggctctcgacaagttcctcaagcgcataacagaccaccccgtgctcagctttaacgagcattttaacatttttcttaccgcgaaggatctaaacgcgtacaagaagcagggcatcgctctcttgacgagaatgggcgaatccgtaaaacacgtgactggcggttataaactcaggacaaggcctttggagttcgcggccatcggagattatctcgacactttcgccctgaagctcggcactatcgaccgaatagcacagcgcatcatcaaagaagaaatcgagtatcttgtggaacttcgcgagtatggtcccgtctactccacgtggagcgccttggaaggtgagctggctgagcccctggagggtgtgtcagcctgcatcgggaactgtagcacggcactggaggagctgacagacgacatgaccgaagactttcttccggtgctgagagaatatatactttattcggattccatgaagtcagtactcaaaaagcgcgatcaggttcaggcggagtatgaggcaaaactagaagcggtcgccctccggaaagaagatagacctaaggtcccggccgacgtggagaagtgtcaggaccgcatggaatgcttcaatgccgacctgaaagccgatatggagaggtggcagaacaacaaaagacaggacttccgccaacttcttatgggaatggcggataaaaatatccagtactatgaaaaatgcctgatggcctgggagtctattatccccctgctacaggagaaacaggaggccaaatag

SEQ ID NO: 24481 - DNA, 1263 bp, Artificial Sequence
  Description of Artificial Sequence: Synthetic coding sequence
atgagcagcccccgggacttccgggccgagcccgtgaacgactacgagggcaacgacagtgaagctgaggacctcaactttcgggagaccctgcccagcagctctcaggaaaacaccccaaggtcaaaggtgtttgaaaacaaagtgaatagcgagaaagtcaagctgagcttgcgcaatttccctcacaacgactacgaagacgtctttgaagaaccgtccgaatctgggtccgatccatcaatgtggacagctcgtggtccttttaggcgggatcggtggagctccgaagacgaggaagcagcaggcccttctcaggcactgagcccactgctttctgatacccgcaaaattgtctcagagggagaactagatcagctggcccagattaggccgctgatcttcaattttcacgaacagacagcaattaaagattgccttaagattttagaggagaaaaccgccgcatatgatattatgcaggagtttatggctctagagctcaagaacctgccaggtgaatttaattccggcaaccagcctagtaatcgggagaaaaacaggtacagagatatcctgccctacgacagtacacgcgttccactggggaaaagcaaagactacataaacgcaagctacattcggatcgtgaactgtggagaggagtacttttatattgctacccaaggaccactgctttccacaatcgacgatttttggcagatggttctggaaaataacagcaatgtgattgctatgatcacacgcgagatcgaaggcggaattattaaatgttatcactactggcccattagcctgaaaaaaccactggagttgaagcattttagggtcttcctagaaaattaccaaattctgcaatactttatcatacgcatgtttcaagtcgtggaaaaatctactgggacttctcacagcgtaaagcagctgcaatttacgaaatggcctgatcatggaacccctgcctctgccgatagcttcatcaagtacattaggtacgcaagaaagtctcacctgactgggccgatggtagtacattgcagtgccgggatcgggagaaccggagtgtttctctgcgttgatgtggtgttctgcgccattgtgaaaaactgtagcttcaatatcatggatattgtggcccagatgagggagcagcgctccggcatggtccagacaaaggaacagtatcacttctgttacgatattgtgctggaggtcctcaggaaactgctgacacttgactag

SEQ ID NO: 24482 - DNA, 837 bp, Artificial Sequence
  Description of Artificial Sequence: Synthetic coding sequence
atgagcagcccccgggacttccgggccgagcccgtgaacgactacgagggaaacgattcagaggccgaagatctaaacttcagagaaaccctgccctcctcctcccaagagaacacacctagatctaaggtctttgagaataaagtcaatagtgaaaaggttaagctttctctgcgaaactttccacacaatgactacgaggacgtgtttgaggagccctctgagagcggctctgaccctagcatgtggacagccaggggcccattccgccgggatagatggagcagtgaggacgaggaggcggctggcccctcccaggcgttatcccccttgcttagtgatacacgcaaaattgtgtccgaaggggaactggaccagttggcgcagattcgacctctgatctttaatttccatgaacaaactgcaattaaagattgcctgaaaattctggaagaaaaaaccgcagcgtacgatatcatgcaagagttcatgacaggaacttctcatagcgttaaacagttgcaattcacaaaatggcccgatcatggtaccccagcatccgcagattccttcatcaagtacataaggtacgctagaaagtcccaccttacaggacctatggtggtccattgtagcgcaggcatcgggagaactggagtgtttctttgtgttgatgttgttttttgcgccatcgtgaagaattgttctttcaacattatggacatcgtcgcccagatgcgagaacaacgatcaggcatggtccaaaccaaagagcagtaccacttctgctatgatattgtgttggaagtcctcagaaaactgctgaccttggactag

SEQ ID NO: 24483 - DNA, 681 bp, Artificial Sequence
  Description of Artificial Sequence: Synthetic coding sequence
atgagcagcccccgggacttccgggccgagcccgtgaacgactacgagggtaacgactctgaggcagaagacttaaacttccgtgagacacttccgtcctcttcacaggagaataccccgcggagcaaggtctttgaaaataaggtaaattcagaaaaagtgaagcttagcctgcgcaacttcccccataacgactacgaggatgtgtttgaagaaccatctgagagcggcagcgatcccagcatgtggactgctcgggggcctttccgtagagatcgatggtccagcgaggatgaagaggccgccggcccctcccaggcgttatcacctttgctgagtgatacaaggaaaattgtttcagaaggcgagctggaccaattggcccaaataaggccgctgattttcaactttcatgaacagaccgccatcaaggactgcctcaagattttagaggagaagacggcggcttacgacattatgcaggaatttatggctctagagctcaagaatctgccaggggagtttaatagcggaaaccagccttcaaatcgcgaaaagaatagatatcgcgacatcctcccatttcaacaccatggctactcaggccccaacgagcggacgaccttctggcacggttcaaatgagggtgccgtgagtctgctgctgaggtactgcgcttag

SEQ ID NO: 24484 - DNA, 681 bp, Artificial Sequence
  Description of Artificial Sequence: Synthetic coding sequence
atgcaccagacctgcgtgcggctggagcgggaggccagcgcccggcccagtcctggaccagtcctccccccacgacccctgccaagccacacggaacttcaaattagggagggacccaaacgcacaatccgggccgcagccgagggtgccccttgcgtgggacgcgtgaggtgcgcgcctggcaatagggggggaagagagggggcgagcggcgtcaggggaggcgtcgcccaggttcctccccgcctgccggccccccccattggacccgagcgtgacgatctggctgggggcgctggtcgtaagcctctaccgagtaccgccgcggcaagcagcccggggtccgccgccgccgcaacagcagccttatgcccgccggccagactatctacgccttccatgagtggcctgcgggtttactccacatccgtgacagggagccgtgaaatcaagagccaacagtctgaagtgacgcggattctggatggtaagagaattcagtatcagcttgtggatataagccaggacaacgctcttcgcgacgagatgcgggcgttggccggcaacccaaaggctaccccaccccagattgtcaatggggatcagtactgcggcgattatgaattgttcgttgaggctgtcgaacaaaacactctgcaggaattccttaagctcgcctag

SEQ ID NO: 24485 - DNA, 1518 bp, Artificial Sequence
  Description of Artificial Sequence: Synthetic coding sequence
atggaccccggcaacgagaacagcgccaccgaggccgccgccatcatcgacctggacccagattttgagcctcagtcaaggccacgaagctgcacttggcccctgccacgtccggagattgccaatcaaccatctgagcccccagaggtggagcccgatctcggtgagaaagtacataccgaaggccgcagcgagcctatcctcctcccctctagacttccagaacccgcaggcggaccacagcctggcattctgggtgctgtgacggggccacggaagggtgggtcaaggagaaacgcatggggaaatcagtcttacgctgagctgatatcacaggcaattgagagcgcccctgaaaaaagactgaccctcgcgcagatttacgaatggatggtgaggaccgtgccttatttcaaggacaagggcgacagtaactcatcagcgggatggaagaacagcatccggcacaacctgagtttgcattccaagttcattaaagtgcacaatgaggcaactggcaaatctagctggtggatgctgaatcccgagggcgggaaatctggaaaagctccacggaggcgtgcagcgtccatggattcaagcagcaagctgctgagaggccgctctaaggctcccaaaaagaaaccgtccgtcttacctgctcctccagaaggtgcaaccccaaccagccccgtcggtcatttcgccaagtggtctgggtctccctgctcccgcaacagagaggaggctgacatgtggaccaccttccgtcctcgctcttcgtcgaacgcctcatctgtcagtacaaggctgtcccctctgagacccgagagcgaggtactcgcagaagagatacccgcctcagtaagctcctatgcgggaggcgtgccaccaaccctgaatgagggcctcgagcttttagacgggctgaacttgaccagcagccacagcctactgtcccgatcggggctgagcggctttagtctccagcaccctggagtgactggccccctgcacacatattctagttccttgttcagccctgcagagggccccctctccgcaggggagggttgtttttccagcagtcaggcactggaggccctgctcacttcagatacccctccgcccccggcagatgtccttatgacccaggtggaccccatcctgtcccaggcgcccaccctgctcctgctcgggggcctcccctcctcatctaagctggcgaccggggtaggcctgtgccctaagccactggaggcccccgggccatcttcgctggtgcccacgctgtctatgattgcaccccctcccgtgatggcatccgctcctatccctaaagccttgggaaccccggtactgactccacccacagaagctgccagccaagataggatgcctcaggacctggatctcgatatgtatatggagaacctcgagtgtgatatggacaacatcatttctgatcttatggatgagggagaaggcctggactttaacttcgaacctgatccctag

SEQ ID NO: 24486 - DNA, 1062 bp, Artificial Sequence
  Description of Artificial Sequence: Synthetic coding sequence
atggactacaagagcagcctgatccaggacggcaaccccatggagaacctggagaaacaactcatatgcccaatatgtctcgagatgtttactaaacccgtggtcatattaccttgtcagcacaacctgtgtaggaaatgcgccaacgacatcttccaggccgcaaacccctactggactagtcgcggaagctccgtctccatgagtgggggacgctttcgctgtcccacctgccggcacgaggtgataatggacaggcatggcgtctacgggttgcaacgcaatctgctcgtggagaacatcatcgatatctacaaacaggagtgctcatccaggcctttacagaagggttcccatcctatgtgtaaagagcacgaggatgaaaaaatcaacatctattgtcttacctgtgaggtgcctacgtgcagcatgtgcaaagtgtttggtattcacaaagcttgtgaagtggcgcccctgcagagtgtttttcaaggacaaaagactgagctgaataattgcatctctatgctggtggcaggaaacgatcgagtccaaacaataatcacccagctggaggacagcagaagggttaccaaggaaaactcccaccaggttaaggaggaactctcacagaagtttgataccctgtatgccattctggacgagaagaaatcagaactactgcagcgcatcacccaggaacaggagaagaaactgtctttcatcgaggccttgatccagcaataccaagaacagctggataagtccaccaagctcgtggagaccgccatccagagcctcgacgagcctggaggggccacattcctgcttacagcaaaacagctgatcaagtcgatcgtcgaggcctccaaaggttgtcagctgggaaagactgaacagggatttgagaatatggacttcttcacgctggatctggaacatatcgccgatgcattaagagcaatcgacttcggaacagatgaagaagaagaggagttcatcgaggaggaggaccaggaggaggaggagagcactgagggcaaagaggaaggacatcagtag

SEQ ID NO: 24487 - DNA, 1179 bp, Artificial Sequence
  Description of Artificial Sequence: Synthetic coding sequence
atgggcgtgaaccagagcgtgggcttcccccccgtgaccggcccccatctcgttggctgtggcgacgtgatggagggccaaaacctgcagggatcattttttcgccttttctacccctgccagaaagcagaggaaacaatggagcagccactgtggattccccgctatgaatactgcacaggcttagcagagtacctgcaattcaataaaaggtgcggcggattacttttcaacctcgccgtcggatcctgtcggttacccgtgagttggaacgggcccttcaaaacgaaggattccggctatcccttaatcattttcagtcacggtttgggggcattcaggactttgtactcagccttttgcatggaactcgcttccaggggctttgtggtggccgtgccagagcatcgggaccgcagtgccgccaccacttatttttgcaagcaagctcccgaagagaatcaacccacaaatgaaagtctgcaagaggagtggatcccgttccgccgagtcgaggaaggtgagaaggagtttcatgtgcgtaacccccaggttcatcagagagtgtctgaatgcctcagagtgcttaagatccttcaagaggtgacagcgggtcaaactgtgttcaacatcctgcccggaggtcttgacctgatgaccttgaaagggaatatcgacatgtccagagtggccgtgatgggacatagctttggaggagccacagctatactagcccttgccaaggaaacccaattccgctgtgccgtggccctggatgcatggatgtttcctttggaacgagatttttaccctaaggccaggggccccgtgtttttcattaatacagaaaaattccagacaatggagtccgtgaacttaatgaaaaagatttgtgcacaacacgagcagtcccggattattaccgttctcgggagcgttcaccgctcccagaccgacttcgccttcgtcactgggaatctgattggcaagtttttttccactgaaactagagggagtctcgatccatacgagggacaggaggttatggttagagcaatgctggcgtttctgcagaagcatctggatctcaaggaggactacaatcagtggaataacttaatcgaggggattgggcccagcttgactcccggtgctccccaccacctgagctcactgtag

SEQ ID NO: 24488 - DNA, 1179 bp, Artificial Sequence
  Description of Artificial Sequence: Synthetic coding sequence
atgggcgtgaaccagagcgtgggcttcccccccgtgaccggcccccatctcgtaggctgcggcgatgtgatggaaggccagaatcttcaaggaagttttttccgtctgttctatccctgccaaaaagccgaagagaccatggaacagcctctttggatccctcgatatgagtattgcactggcctcgctgaataccttcagtttaataagcgatgtggcggactcctgtttaacctggccgtggggtcttgtcgcttaccagtgagctggaatggaccattcaagacgaaagacagcggataccccctcatcattttcagccacggtctgggagcatttcgcactctttactccgcgttttgcatggaacttgccagtaggggttttgtggtggcagttccggagcacagagatcggtctgcagccacgacttatttttgcaagcaggcaccagaagagaaccagcctacgaatgaatcactccaggaagaatggattccattcagacgcgtggaggaaggcgagaaggagttccatgtgcgaaatccgcaggtgcatcagcgggtgtccgagtgcctcagagtgcttaagattctgcaggaagtgacagccggacagaccgtgtttaatatcctccccgggggcctcgatctgatgacgttgaaaggaaacatagacatgagtcgcgtggctgtgatggggcattcctttggtggtgccaccgcgattctcgctcttgcgaaggaaacccagtttcgttgtgccgtcgcgctggacgcctggatgttccctctggagcgagatttctacccaaaggcccggggacctgtgttttttattaacacagagaaattccaaaccatggaaagcgtaaacctgatgaaaaagatctgtgcgcagcacgagcaaagccgtataataacagttctcggatcggtgcatcgatcacaaacagacttcgctttcgtcaccgggaacttaatcggcaaatttttttccacagagacccgtgggtccctcgacccttatgaggggcaagaggtgatggttagagctatgctggcattcctgcagaaacatctcgatctaaaggaggattataatcaatggaataacctgatcgaggggatcggcccttccctgacaccaggggctccacaccacctctcctcactatag

SEQ ID NO: 24489 - DNA, 213 bp, Artificial Sequence
  Description of Artificial Sequence: Synthetic coding sequence
atggtgcggaccaagacctggaccctgaagaagcacttcgtgggctaccctaccaattccgatttcgagcttaagacggccgaactgccccctctaaaaaacggagaagtcctgttagaggcactcttcctgactgtagacccttacatgcgggtcgctgccaagaggttgaaagagggtgacacgatgatgggtcagcaggtggcaaaatag

SEQ ID NO: 24490 - DNA, 213 bp, Artificial Sequence
  Description of Artificial Sequence: Synthetic coding sequence
atggtgcggaccaagacctggaccctgaagaagcacttcgtgggctatcctacaaattccgacttcgagctgaaaacagctgaactgccccctttaaagaacggtgaggtgttactggaagcactgtttcttaccgttgatccatacatgagggtggctgccaaaagactcaaggaaggcgacacaatgatggggcagcaggtcgccaagtag

SEQ ID NO: 24491 - DNA, 534 bp, Artificial Sequence
  Description of Artificial Sequence: Synthetic coding sequence
atgcccggcctgaccgcctacttcggcctgctggagatctgcggcgtgaaggggggcgaaacagtcatggtcaacgcagccgcgggagcggtcgggtcagtcgtaggccaaatagctaagctgaaggggtgcaaggttgtgggggctgtaggctcagacgaaaaagtggcttacctccagaagcttggctttgacgtggtttttaactataagactgtcgagagtcttgaggaaacactcaagaaagcatcgccagatggatatgattgttattttgacaatgtgggaggagagttctcgaatacagtgattggacagatgaagaagtttggaaggatcgccatctgcggcgccattagtacttacaataggacggggccactaccccctgggccccctcctgagattgtcatctatcaagaactgcgaatggaagcctttgtggtgtaccggtggcagggtgatgcccgacaaaaagctctcaaggatctcctcaaatgggtcttggagttgccatacttcgtgatcgattag

SEQ ID NO: 24492 - DNA, 1263 bp, Artificial Sequence
  Description of Artificial Sequence: Synthetic coding sequence
atgagcagcccccgggacttccgggccgagcccgtgaacgactacgaagggaatgacagcgaggcggaggacttaaatttcagggagaccctgccttcatctagccaagagaatacaccaagatccaaggtgtttgaaaataaagtcaactctgaaaaagtcaagctctctctcagaaacttcccacacaatgactacgaggacgtgttcgaggagcccagtgagtctggttccgacccaagcatgtggacagcacggggaccgtttcgccgagataggtggtcttctgaagatgaagaggctgctgggccctctcaggccctatctcccctgcttagcgacacaagaaaaattgtgagcgaaggcgaactggaccagctcgcacagattcgacctctaatcttcaacttccacgagcagacagcaattaaagactgtctaaaaattctggaggaaaaaactgcggcttacgacattatgcaagagttcatggctcttgaactcaagaatctgcccggagaatttaatagtggcaatcaacccagtaaccgggagaagaatagatacagagacatcctcccttacgactcaacccgggtgccgctcggaaaatcgaaggactatataaacgccagttatattcgcattgtaaactgcggagaggaatatttctacatcgcgacacagggacctctgctaagcaccatcgacgatttttggcagatggtgctggaaaacaattcaaatgtaatcgcaatgatcacaagggaaatcgaaggcggtattatcaaatgttatcattattggccgatctccttaaaaaagcccttggagctgaagcacttccgtgtcttcctcgagaactatcagattctgcagtacttcattattcgcatgtttcaagttgtggaaaaatccaccggaacttcgcatagtgttaaacagctccagttcacaaagtggcctgaccacggtaccccagcaagcgcggattcattcatcaagtatattagatacgccaggaagagccacctgacgggccctatggtggtccactgttctgcaggaataggaagaaccggtgtcttcctgtgtgtggacgtggtcttctgtgcgatcgtcaagaactgttcattcaatattatggatattgtggcgcagatgagagagcagaggtctggaatggtccagaccaaggagcagtatcatttctgctatgacattgtgctcgaggtcctccggaagctattaacgcttgactag

SEQ ID NO: 24493 - DNA, 837 bp, Artificial Sequence
  Description of Artificial Sequence: Synthetic coding sequence
atgagcagcccccgggacttccgggccgagcccgtgaacgactacgaagggaatgattctgaggctgaggatctgaacttccgggaaacgttgccctcatcctctcaagagaacaccccaaggtctaaagtgtttgaaaataaggtgaactccgagaaagtgaaactaagcctcagaaacttcccccacaacgattacgaggacgtgtttgaggagccttccgagtctggcagcgatccatccatgtggacagcacgaggaccattccggagggatcgatggtctagcgaagacgaggaggcagcaggcccgtcccaggcactgagcccactccttagcgacacacggaagattgtctctgagggagagctggaccagctcgcccagatcagaccactcatcttcaattttcacgagcagactgctattaaagactgcctcaaaattctggaagaaaagactgccgcttatgatatcatgcaggaatttatgacaggcactagccatagcgtcaaacagttgcagttcacaaagtggcccgaccatggtacacctgccagcgctgactccttcatcaagtacatccggtacgcgcggaagtctcatctcaccggtccaatggtggttcactgctctgccgggatcggacggaccggcgtatttctttgcgtggacgtggtattctgcgccatcgtgaagaattgctcctttaacatcatggacatcgttgcccaaatgcgtgagcagaggagcggcatggtccagacaaaagaacagtatcatttctgctacgatatcgttctggaagttttacgaaaactgttgactcttgactag

SEQ ID NO: 24494 - DNA, 681 bp, Artificial Sequence
  Description of Artificial Sequence: Synthetic coding sequence
atgagcagcccccgggacttccgggccgagcccgtgaacgactacgaggggaatgatagcgaagcagaagacctgaatttcagggagacactgccctcttcctcccaagagaacacaccacggtcgaaagtattcgaaaataaggttaactctgagaaggtcaagctgagcctgagaaacttcccccataatgactatgaagatgtctttgaagaacccagcgaatccggctcagatccttccatgtggacggcccggggaccctttcgtcgggacagatggagctccgaagacgaggaagcggcgggtccttctcaagcgttaagtccactcctgtcagacacccgcaagatcgtctccgaaggcgagcttgaccagctggcacaaatccgtcccttgatctttaatttccatgaacagactgccatcaaggactgcctgaagattctggaggaaaagacagccgcgtatgacatcatgcaggaatttatggcgctcgagttgaaaaacttaccaggcgagttcaacagtggcaatcagccaagcaaccgggagaagaaccgctatagggacatccttcctttccaacatcacggctattcagggcctaacgagcggactactttttggcacggcagtaacgaaggagctgtgtcactgctgctgcggtactgcgcatag

SEQ ID NO: 24495 - DNA, 789 bp, Artificial Sequence
  Description of Artificial Sequence: Synthetic coding sequence
atgagccggtacctgcggccccccaacaccagcctgttcgtgcggaacgttgccgatgacactcggagcgaggacctgagacgggagttcggtcgctatggccctatcgtggacgtttacgtgccactggatttctacacaaggcgcccccgcggttttgcctacgtccagttcgaggacgtgagagacgcggaggacgcgctccataacctggacaggaagtggatttgcggtagacaaatagaaatacagttcgcacagggagatcgaaagaccccaaaccaaatgaaggctaaggagggacgtaacgtatattcatcttcacgctatgatgattacgacagatacaggcgttcaaggagtcgtagctacgagaggcgaagaagccgctctcgcagcttcgattacaattatcggcgttcctacagtcctcgaaattcccggcctacaggcagacccaggaggagtagatcccacagcgataatgataggttcaagcaccgtaatcgatccttcagtcggtcaaagagcaattctcgctccagatctaaaagccaacctaagaaagagatgaaagcgaagagtcggtccaggtcggcctcccatacaaaaaccaggggtacctctaagacagacagcaaaacacactataagtcgggctcccgctacgaaaaagagtccaggaaaaaggagcctcccaggagcaagagccagtcaagaagtcagagtcgttcccggagtaagagcagatctagatcctggacatcacctaaatccagcgggcattag

SEQ ID NO: 24496 - DNA, 522 bp, Artificial Sequence
  Description of Artificial Sequence: Synthetic coding sequence
atgagccggtacctgcggccccccaacaccagcctgttcgtgcggaacgtggcggatgacaccaggagcgaggacctgcggagagagtttgggcgctatggaccgattgtggatgtgtatgtccccctagacttctatacacgccggccacgggggtttgcctatgtgcagttcgaagatgtgcgcgacgccgaggacgccttacacaatctggatagaaagtggatctgtggtcggcagattgaaatccagttcgcacaaggggacagaaagaccccaaaccagatgaaagccaaggagggccgaaacgtctacagtagcagtcgatatgatgactacgatcgctaccgtagaagccgctctcgatcctacgaacgtaggaggtcaaggtcacgttcttttgactacaactacagacggagctactctccccgtaactcacggcctaccgggcggcccagaaggtcgaggtcacactccgataacgactctcaggtgtcaaaaaagaagaacgaaagatag

SEQ ID NO: 24497 - DNA, 669 bp, Artificial Sequence
  Description of Artificial Sequence: Synthetic coding sequence
atgagcgccttcggccacgacgaggcctggatggaggccggcggctttggccttgaggcggctgaaaggactgaatatcagtctctatgcaagagcaagctcctgttcctaggtgagcagtctgtggggaaaacctcaatcatctccaggttcatgtacaattcttttggttgcgcatgccaggcaaccgtggggattgattttctgtccaaaacgatgtacttggaggaccagatcgtccagcttcaactctgggatacagcagggcaggagcggttccactcccttatcccaagttatatcagagatagtacaatcgctgtagtggtatacgacataacaaatatcaactcttttaaggagacagataagtgggtggagcatgtccgagcggaaaggggcgatgacgtagtgatcatgctgctgggcaacaaaattgatctggataacaaacgacaggtcaccgctgagcaaggtgaagaaaaaagccggaacctgaacgtgatgtttatagaaactagtgctaaaaccggttacaacgtgaaaaaactgttcaggagggttgcttctgctttactcagcacacgaacttcacctccccccaaagaaggcacagtggagattgagctagaaagctttgaggagtccgggaataggtcctactgttag

SEQ ID NO: 24498 - DNA, 348 bp, Artificial Sequence
  Description of Artificial Sequence: Synthetic coding sequence
atggtgcagatcatcaaggacaccaacgagttcaagaccttcctgaccgccgcaggacataagttggcagtagtgcagttcagctctaagcgatgtgggccctgcaagcgtatgtttcccgtatttcacgcaatgagtgttaagtaccaaaacgttttttttgcgaacgtcgacgtaaataactcgcccgagttagccgagacatgccatataaaaaccattccaacttttcagatgttcaagaagagtcaaaaagtcactctgtttagtcggattaagcgcatcatctgctgctacaggagcgggttcatgagcaacctgtgtctcgccgacgatgggaacgaatag

SEQ ID NO: 24499 - DNA, 384 bp, Artificial Sequence
  Description of Artificial Sequence: Synthetic coding sequence
atggtgcagatcatcaaggacaccaacgagttcaagaccttcctgactgcagccggccataagcttgccgttgtgcagttctcatctaagcgctgcggcccctgcaagcggatgtttcctgtgtttcacgctatgagtgtaaaatatcagaacgtattttttgctaacgtggacgtgaacaattcacccgaattagccgagacatgccatattaaaactatcccaacgttccaaatgttcaagaagagccaaaaggtgaccttgttcagccgcatcaagcggatcatctgctgctacagaagtggcttcatgtctaacctcatcttcgagttctgcggagctgacgcaaagaagctcgaagcaaagacccaggagttgatgtag

SEQ ID NO: 24500 - DNA, 1767 bp, Artificial Sequence
  Description of Artificial Sequence: Synthetic coding sequence
atgcaccggagcgcccccagccagaccaccaagcggagccggagccccttctccaccacccgacgttcgtgggatgatagcgagtcttccggaacaaatctgaatattgacaacgaggattatagcaggtacccacctcgcgagtatcgggcttcggggagccgacgggggatggcatacgggcatattgactcctatggcgccgacgacagtgaagaggagggcgctggccctgttgaacggccaccggttagaggtaaaacaggaaagtttaaagatgataagctgtatgatcctgagaagggcgcacggagcctcgctgggcccccccctcacttttcatccttttcgcgcgacgtgcgagaggagagggataaactcgatcccgtccccgctgcacggtgttcggcgagtagagccgatttcctaccccaaagtagcgtcgcctcccagagctcaagcgagggcaagcttgccactaagggcgattcttccgagagggaaagacgcgagcaaaatttgccagctaggcccagtcgagcgccggtttccatttgtggaggcggcgaaaataccagtaaatctgccgaagagcctgtggtcaggccaaaaattaggaacttggcctctcctaactgcgttaaacccaagatctttttcgatacagatgatgacgatgatatgccacattctacgtcgcgatggcgcgatacagccaacgataatgaaggccatagcgacggactagccaggcgcgggcgcggggagtcaagttccgggtatccggaaccgaaatacccagaagataaaagggaggctcgctcagatcaggtgaaacctgagaaggtcccgagacggagacgcactatggccgatcccgatttttggacccatagcgatgattactacaagtactgcgacgaggactcagactcggataaggaatggatcgcagcacttcggaggaaataccgctcacgggagcagaccctaagctcatccggagaatcttgggagaccctacccggcaaggaagagcgggagcctccacaggcgaaggtgagtgcttcaacaggcacttctcctggccccggcgcttccgcaagtgctggagcaggtgccggggctagtgcaggatcaaatggttcaaattacctagaggaagtccgagaaccttcgttgcaggaggagcaagctagcctggaagaaggcgaaatcccctggctccagtaccacgaaaatgattctagtagcgagggagacaatgatagcggccacgagctgatgcagccgggagtatttatgcttgatggcaataacaacctggaggacgatagttccgtctctgaagatctggaggttgattggagcctgtttgatggcttcgctgacgggctcggtgtcgctgaagctatatcttacgtggacccccagtttcttacttatatggctctggaagaaagactggctcaggccatggagactgcccttgctcatcttgagtctctggccgttgatgtggaggtagctaacccacctgccagcaaggagtctatcgacgccctaccggagatcctagtgacagaagatcatggggccgtgggacaggagatgtgttgccccatctgttgcagtgagtatgtgaagggcgaggtcgcaaccgagttgccatgtcaccattacttccacaaaccctgcgtcagcatatggctccagaagtctggaacgtgtccagtgtgtcgctgcatgtttccgcctcctctctag

SEQ ID NO: 24501 - DNA, 612 bp, Artificial Sequence
  Description of Artificial Sequence: Synthetic coding sequence
atgcccgagcagttcagcgtggccgagttcctggccgtgaccgccgaggatttatccagccctgccggcgccgctgctttcgcagccaaaatgcctaggtatcggggggctgcactggctagggaggagatactcgaaggggaccaggccatactccagagaattaagaaggcagtcagagcgatccattcctccggattgggtcacgtggagaatgaggagcaatatagggaggctgtagagtcactgggtaattcacatttgtcccaaaactctcatgaactgtctacaggctttctcaatctggctgtgttcactagggaggtggctgctctcttcaagaacctgatccagaacctgaataatattgtgtccttcccccttgatagcctaatgaagggtcagctgcgcgacgggaggcaagatagcaaaaagcagttggagaaggcctggaaagactatgaggctaaaatggccaagcttgagaaggaacgtgaccgggcacgtgtgaccggcgggatcccggcctggaacttgggcatccctgccaagccacatcccacactgaaaagggcttctgagtcgccacaagctcccccagacccggcctag

SEQ ID NO: 24502 - DNA, 1932 bp, Artificial Sequence
  Description of Artificial Sequence: Synthetic coding sequence
atgggccaggagagcagcaagcccgtgtggcccaaccccaccggcgggtatcagtccaataccgggcgcagatacgggcggagacacgcctatgtttccttcaggcccccgactagccagcgggaacgtatcgccagccagcgtaagactaactcagaggtgcccatgcacagatccgcccctagccagaccaccaagcggtcccgcagccccttctccacaactagaagatcctgggacgattctgaaagctcgggaacgaatctcaacatagataacgaagattacagtaggtaccccccccgggaataccgggcatccgggtcacgtaggggaatggcatatggccatattgatagctatggggcagatgattcagaagaagagggagccgggccagttgagcgtccacctgttaggggtaaaaccggaaagtttaaggatgacaaattatacgatcctgagaagggcgctcggtccctggccgggcctccgcctcatttttctagtttcagccgcgacgtgcgagaagaacgggacaaactggacccagtcccagcagcaagatgtagtgctagtcgagccgattttctgcctcaatctagtgtggccagccaatcatcgtctgagggaaaactggccacaaaaggagactcctccgagcgcgaacgaagggaacagaatctcccagccagaccctctagggccccggtgtctatttgcgggggaggggaaaatacttctaagtctgcggaagaaccagtggtgaggccgaaaatccgcaacctggctagtccaaactgtgttaagccaaaaattttctttgataccgacgacgacgatgacatgccgcattcgacgtcccgctggagggacactgccaatgacaacgaaggacatagtgacgggttggctagacgaggaaggggggaaagctccagcggatacccggagcctaaataccccgaggacaaacgggaagctcgaagcgatcaagtgaagccggaaaaggtccctcgccgccgacggacaatggcagacccagacttttggacacacagtgatgattattacaaatattgtgacgaggattccgactccgataaagagtggatcgccgctttaagacggaaataccgatccagagagcagacgctctcttcttctggagagtcatgggagacactgccaggcaaagaggaaagagagcctccgcaggcaaaagtatctgcttcaaccggaacttcccctggaccaggcgctagcgcaagcgcaggagccggagccggggctagtgccggctccaacggctccaactacctcgaagaagtgagggaacccagcttacaggaggaacaggcctccttggaagaaggtgaaatcccgtggctacagtatcacgaaaatgatagttcttcagagggggacaatgactctggccacgagttaatgcagccaggagtttttatgctcgacggcaacaacaacctcgaggatgatagctcagtctccgaggacttggaagtcgactggtctctgttcgacggctttgcagatggtctgggcgttgctgaggcaatatcgtatgtggatccccagtttctgacatacatggcactggaggaaaggctcgcccaagccatggagacagcgctggcacacctggagagcttggcagtcgatgtggaggtggcaaaccctccggcaagcaaggaatctatcgatgccctgcctgagatactggttacggaagatcatggtgctgtcgggcaagaaatgtgctgtcctatctgttgcagcgaatatgtgaagggcgaagtggcaactgagttgccttgtcatcactacttccacaaaccatgcgtgtctatttggcttcagaagtctgggacatgccccgtctgccgctgtatgttccccccaccgctgtag

SEQ ID NO: 24503 - DNA, 1368 bp, Artificial Sequence
  Description of Artificial Sequence: Synthetic coding sequence
atgggccaggagagcagcaagcccgtgtggcccaaccccaccggcgggtaccagtcaaatactgggcgtcgctatggccggcggcatgcgtacgttagttttaggccgcccacatcacagagagagcgaattgcatctcaaaggaaaaccaactctgaagtgccaatgcaccgctcggctccaagccagacgacaaagagaagccgaagcccattttcaaccactagaagaagctgggacgattctgaaagcagtgggactaatttgaatatcgacaatgaagattacagtagtacaagtaggtggcgggacaccgccaacgacaacgagggtcactcagatggcttggcgcggcgtggccgaggcgagagctcaagcgggtaccccgaacctaaatacccggaagataaacgagaggctaggtccgaccaggttaagccggagaaggtgcctcggaggagacgcactatggcagaccccgacttttggacgcactccgacgactattacaagtattgtgatgaggatagtgacagcgataaggagtggatcgccgcactgagacggaagtaccggagcagggaacagactttgagcagctcaggggaatcctgggaaaccctgccaggtaaggaagaacgggagcctccccaagccaaagtctcagcttcaactgggacctcacctggacctggcgcatcagccagcgccggcgctggtgcaggggcgtcggccggtagcaacggcagcaattacctggaagaagtgagagagccaagcttgcaagaggaacaggcctctttggaggagggagagatcccctggctgcaatatcacgagaatgattcgagcagcgagggggacaacgactcaggtcatgaactgatgcaacccggtgtctttatgctggacgggaataacaatctggaagatgattcctcagtttctgaagaccttgaggtggattggagcttgtttgatggttttgctgatggacttggcgtggccgaagctatcagctacgtggaccctcagtttttaacctacatggccttggaggagcggttagcccaggcaatggagacggcgcttgcacacctggaaagcttggctgtggacgtggaggtggctaaccctcccgcgagtaaagaatccattgacgccttacccgagatcctcgttaccgaggatcatggggcggttggacaggagatgtgctgtcccatttgctgcagcgaatacgtgaaaggagaggttgcaacagaactgccatgtcaccactacttccacaagccctgcgtgtcaatttggttacagaagtcggggacctgccctgtatgccggtgcatgtttcctcctccgctctag

SEQ ID NO: 24504 - DNA, 390 bp, Artificial Sequence
  Description of Artificial Sequence: Synthetic coding sequence
atggccgagctgatccagaagaagctgcagggcgaggtggagaagtaccagcagctccagaaggaccttagtaaatccatgtccgggagacagaagcttgaggcccagcttaccgaaaacaatatcgtaaaggaggaactcgcgctgctcgacgggagcaacgtggtgttcaaactgctgggaccagtgctggtgaagcaggaactgggcgaggcccgagctaccgtgggtaagaggctggactacattaccgccgagatcaagaggtatgagtcccaactaagggatctcgaacggcaaagtgaacaacaaagagagacactggcccagctgcaacaagagtttcaaagagctcaagcagccaaagccggagcgccaggcaaggcatag

SEQ ID NO: 24505 - DNA, 390 bp, Artificial Sequence
  Description of Artificial Sequence: Synthetic coding sequence
atggccgagctgatccagaagaagctgcagggcgaggtggagaagtaccagcagttgcagaaagatttatccaagtccatgtctggacgacagaagctggaggcccagctgaccgaaaacaacatcgtaaaagaggagctggccctgttggacggatctaacgtggtttttaaacttctcggccccgtactggtgaaacaggagcttggggaggccagggcaacagtcggaaagagattggactatattacagccgaaatcaagcgctatgaatctcagcttagggatcttgagcggcaatcagaacaacagcgggaaaccctcgcccagcttcagcaggagttccagagggcacaggcagctaaagccggggcacccggaaaagcatag

SEQ ID NO: 24506 - DNA, 390 bp, Artificial Sequence
  Description of Artificial Sequence: Synthetic coding sequence
atggccgagctgatccagaagaagctgcagggcgaggtggagaagtatcaacaacttcagaaggatctctcaaaaagtatgagtggcagacagaaacttgaagcacagctcaccgagaataatatcgtgaaggaggagcttgccctgttggatggctctaacgtggtgttcaagctgctcgggccggttctcgtaaagcaagagctgggtgaggctagggcaactgtcgggaagagactcgactatataacagctgagattaagcgttacgaatcacaactgagggatctggaacgccaatcagagcaacagcgagagactctggcccagctccagcaggagttccaacgagcccaggctgctaaggccggggctcctggaaaggcttag

SEQ ID NO: 24507 - DNA, 1512 bp, Artificial Sequence
  Description of Artificial Sequence: Synthetic coding sequence
atgaagtgcgagcactgcacccggaaggagtgcagcaagaagaccaagactgatgatcaggagaatgtgtcagcagatgccccctcacctgcacaagaaaacggcgagaaaggcgagtttcataagcttgccgacgcaaaaattttcctttccgattgcttagcttgtgattcttgcatgaccgccgaggaaggcgtccaactcagccagcagaatgcgaaagatttctttcgggttctgaacctcaacaagaagtgtgacacttctaagcataaggttcttgtggtatctgtctgcccccagtccttaccttactttgctgccaaatttaaccttagtgtgaccgacgcaagcaggaggttatgtgggtttctcaagagcctgggagtccattacgttttcgatactactattgccgctgactttagtatcctggagtcccagaaagaatttgtgcgccggtacagacagcattccgaggaggaacggaccctacccatgctaacttccgcttgtccgggctgggttagatatgctgaaagagtgttgggtcgccccattactgcacacctgtgcactgccaaaagtccacaacaggttatgggcagcctggtgaaggattacttcgcacggcagcagaacctttcccctgagaagatattccatgtaattgtggcaccctgttacgacaagaagctcgaggctttgcaggagagcctgccacccgccctgcacgggtccaggggcgctgactgcgtgctcaccagcggaaaagtgctaatatcctggtggtgtacgccggtcattacagcaacccaggaggccgccgctcgagagagcctggagccagggcgccaacgactgcagagggataaaattgcaccacttgactccagcctcggcggggggggggagattgcccagattatggaacagggagatttgagcgtgagagatgccgccgtcgacacccttttcggggatctaaaggaggacaaagtaacaaggcatgatggcgctagctctgatgggcatcttgcacatatttttaggcacgcggccaaggagcttttcaatgaggatgttgaggaagtgacatatcgcgctctgcggaacaaggattttcaagaagtgacgctggaaaaaaatggcgaagtggtgctacgattcgcagccgcttatggtttcaggaacattcagaatatgatactaaagctgaagaaggggaaattccctttccattttgtcgaggtactggcttgcgccgggggctgcctcaatgggaggggacaggcacagactcccgacggccatgcagataaggctttgctgaggcagatggagggtatttacgcggatatacctgtccgcaggccggagtcctccgcacacgtgcaggagctttaccaggagtggcttgagggcatcaacagcccaaaagcacgggaggtgctgcacaccacataccaatcccaagaaagaggaactcatagcttagacataaagtggtag

SEQ ID NO: 24508 - DNA, 348 bp, Artificial Sequence
  Description of Artificial Sequence: Synthetic coding sequence
atggccaccgagcccgaggccgccgagcccgtggtgcccagcctggtggatcgctattttactagatggtacaagcccgacgtgaaagggaagttttgtgaggatcactgtatactccagcactccaaccgcatctgcgtgataacactggctgaatcacatcctgtcctgcagtccggcaaaaccattaaaagtatatcgtatcaaatcagcacaaactgttcgagactgcagaacaaggtttctggcaagtttaagcgcaggataatatacctggagaaggttgaagacgtgatcaaacgaaagatgatgccactgagcctggggctccatctaccacactcatag

SEQ ID NO: 24509 - DNA, 1566 bp, Artificial Sequence
  Description of Artificial Sequence: Synthetic coding sequence
atgaacgtgagcctgagccagaagaccgtgaagatccaccggctgtttcccatgctcgcttttagtgagccttatgagttcgtaagtctggaatggttacagaagtggctcgatgaatccactcctacaaagccaatcgataaccacgcatgcttgtgctcccacgacaaactccaccctgataagattagtattatgaagcggattagcgagtatgccgccgacattttctacagtagatacggtggcggcccccggctaaccgtgaaagccctgtgtaaagagtgcgtggtcgagcggtgtcgtattctcaggcttaagaatcagttaaatgaggactacaaaacagtgaataacctccttaaggccgccgtgaaaggcgacggattttgggtggggaaatctagtttgcgctcatggaggcaactggccttggaacagctcgacgagcaggatggcgacgctgagcagtccaacggaaagatgaacggctctaccctgaacaaagatgaatcgaaagaggagcgtaaagaagaggaagaattgaatttcaacgaagatatcttgtgtccacacggggaactctgcatcagcgagaatgaacgccgcctggtgtccaaggaggcctggtctaagctgcaacagtactttccaaaggcgccagaattcccttcttacaaagaatgctgtagccagtgtaaaatccttgagcgggaaggggaggagaacgaggcattacacaaaatgatcgcgaacgagcagaagacatcgttgcccaaccttttccaggacaagaacaggccctgcctatcgaattggcccgaggacaccgatgtgctgtatatagtgtctcagttcttcgttgaagagtggcgaaaattcgtacgcaagcctacaaggtgtagccctgtctccagtgttggaaactctgctctgctctgcccacacggtgggctgatgttcactttcgcttctatgaccaaggaggatagcaagttgattgcactgatatggccatctgaatggcagatgatccagaaacttttcgtggttgaccacgttatcaagattacacgaatcgaggtgggagacgtcaatccgtcagagacgcagtatatttccgagcccaaactttgcccggagtgccgagaggggctgctatgccagcagcagcgtgatctccgggagtatactcaagccacaatatacgtgcataaagtcgtggataataaaaaggtcatgaaagatagcgccccggagcttaatgttagctcctctgagaccgaagaggacaaggaagaggcgaagcccgatggcgaaaaagatcccgacttcaatcagattatgcatgccttcagcgtggccccctttgaccagaacttgtcaattgatggaaaaattctgagcgacgactgcgcaacactcggcactcttggggttatccctgagagcgtcattctcctgaaggcagatgaacccatcgctgactatgctgccatggatgatgtcatgcaggtgtgcatgccggaagaaggctttaaaggcaccgggctcctggggcactag

SEQ ID NO: 24510 - DNA, 984 bp, Artificial Sequence
  Description of Artificial Sequence: Synthetic coding sequence
atgaccgccgtgggcgccgagcggctgaccagcgtgcgggcctggttgagttgctgcggcgcatgtgtctgcgtatttcttttcctttgcttatgtgtgttccctttaagagtgcacgtgcatgtatggggcggggaatgtagggttgacatagcagtttttgtgagtaagcacatgattgttgcactgatgcatgttactggtgcagcagggctcttgcggttatgcgtgcgggcctgtgtctgcatgcgggtctgcgcaaccgcacacatgtacagggtggataaatcttttacaagcagacgtagtgtgtggcggagtgatggccaaaaccagcactttcctcaggcactggatctctcacgggttaatttggtgccctcctatactccttccctgtatcccaaaaatactgacctcttcgaaatgatcgaaaagatgcagggtagcaggatggatgagcagcgatgcagctttccgccccccttgaagaccgaagaggactacatcccttaccctagtgtccacgaggttttaggtcgggaaggccccttccccctgatcctgctacctcagtttggcgggtattggatcgaggggaccaatcatgagatcaccagtattcctgagaccgaacccctccagtcccccactaccaaggtgaagctggaatgtaaccctaccgcacgtatctaccgaaaacacttccttggaaaggagcattttaactactacagccttgatgccgcgctgggacacctcgtcttcagcttgaaatatgacgtgatcggggaccaggaacacttgcgacttctgctgcggacaaaatgcaggacataccacgacgtgatcccaatctcatgcctgacagagttcccaaacgttgttcaaatggccaaattggtttgcgaagacgtgaatgtggatcgcttttaccctgtcctttaccctaaggtgtggcttgatctggggactgcccattag

SEQ ID NO: 24511 - DNA, 2079 bp, Artificial Sequence
  Description of Artificial Sequence: Synthetic coding sequence
atgatcgagaagatgcagggcagccggatggacgagcagcggtgctccttccctccacccctgaagaccgaggaagattacattccctacccaagcgtacatgaggtccttggcagagagggcccctttcctctcatattgcttccacagttcggcggctactggattgaaggaaccaaccatgagatcacgtccatacccgaaacagaacccctacagtccccaactaccaaggttaaactggagtgcaaccctaccgcgcggatatatcgcaagcattttctcggaaaagaacacttcaactattacagtcttgatgccgccctggggcatctggtgttttcattgaagtacgacgtgatcggggaccaagagcacctgagactactgctgaggaccaagtgccggacctatcacgacgtgattccaatctcatgtctcacagagttccctaatgtggtccagatggccaagttagtctgtgaggacgtgaatgttgatcgcttttacccagtgctgtaccctaaagcctctcgactgatcgtgacatttgatgagcatgtgatcagcaacaattttaaattcggagtgatctaccagaagctgggacaaacctcagaagaggagctcttctctacaaacgaagaatctccagcctttgtagaattcttggagttcctcgggcagaaagtcaagcttcaggactttaagggtttccggggcgggctagacgtgacgcatggacagacagggacggaatcggtgtactgcaacttccggaataaggaaatcatgttccacgtcagcaccaagcttccctatacggagggagacgcacagcagctgcagcgcaagaggcatataggaaatgatatcgttgccgtagtgttccaggacgaaaacactccattcgtgcccgatatgatagcctccaactttctgcacgcttacgtggtcgtgcaggctgagggcgggggcccagatgggcccctctacaaggtctctgtgaccgctagagatgatgttccgtttttcggacccccactgccagatcctgcggtttttaggaagggccctgagtttcaggagtttctgttgacgaaacttataaatgcagagtacgcatgctataaagctgaaaaatttgccaagcttgaggagagaacccgcgctgccctccttgagactttgtacgaggaactgcatatccactcgcagagcatgatgggcctgggtggtgacgaggacaagatggagaacggttcaggagggggcggatttttcgagagtttcaaaagagtcatcaggagcagatcacaatccatggatgctatggggctatccaacaagaaacccaacaccgtgtcaacctcccactccgggtcattcgcccctaataaccccgatcttgcgaaagccgccggcatcagtctgcttatacccgggaaaagcgcctccaggtttggtcgtagaggatctgctatcggcattggaactgttgaggaagtggtagtcagaggagcagccgggtcaggaggctgccttcacgctttatttagtgcccgcagccaagacggcggccacataggcgatgtcgcccccttaccacccggccaagcacctggcagagccggatggtccggcggatcttcggacggcactcagcacctcctctggggactgagcctcattgtgcctgggaagtcccccacgagaaagaagtctggcccatttggatcccgccggagctccgccataggaatcgaaaacatacaagaggttcaagaaaaacgggagagccctccagcagggcagaagaccccagactctggccacgtctcccaggaaccaaaatccgagaatagctcaacacagagctcgcccgaaatgcccactactaagaatcgagccgaaacggccgcccagagagcagaggccctgaagttgcccctgctagttcagtgtcaacagctgagacagcgaggagggggggatggaggctgcgggcggcgcggtcaccgccctggcgagcgcgttattctaaggaatacacctcaggccggcctgctgcatctctag

SEQ ID NO: 24512 - DNA, 2085 bp, Artificial Sequence
  Description of Artificial Sequence: Synthetic coding sequence
atggcccagctgcggcccgccgtgccccccggccggccccggcggggcagcctcccagccggggcttcctggcagaatacggacttattcgaaatgatcgagaaaatgcaaggaagtaggatggacgaacagagatgctcttttcctccacccctcaaaaccgaggaggactacattccctatccatccgtacatgaagtcctcggccgagagggtcccttccccttgatattattgcctcaatttgggggctattggattgagggcacaaaccacgagattacctcgattcctgagaccgagccactgcagtctcctacaactaaggtgaagctggaatgtaatcctacggcccggatctataggaagcatttcctggggaaggaacacttcaactactatagcctcgatgcagcccttggacacctggtgttttcattgaaatacgacgtgattggcgatcaggaacatctgagactgctgctccgcaccaagtgcaggacttaccacgatgtgatcccaataagctgtcttaccgagttcccaaatgtggtgcagatggccaaacttgtctgtgaggacgtgaatgttgatcgattctatcccgtgctgtatcccaaggcatctcgccttattgtgacttttgacgagcacgtcatttctaataatttcaagttcggggtcatttaccagaagctgggacagacgagcgaagaggaactcttctcaaccaacgaggagagcccggcattcgtggagttcctcgaattccttggccagaaagttaaactgcaggacttcaagggttttcgcgggggtctggatgtgactcatggccagaccggaactgagtcggtgtactgcaactttagaaataaggagattatgtttcacgtgtctacaaagctgccatacactgaaggggatgctcagcagctacagagaaaaagacacattgggaacgacatcgtagctgttgtcttccaggatgaaaacaccccgtttgtgccagacatgatcgcaagcaactttctacacgcctacgtcgtggtccaggctgagggaggggggcctgatggccccctctacaaagtgtccgtgaccgcccgtgatgatgttccattcttcggtcctcccctgcccgaccctgccgtgtttagaaaaggcccagaatttcaagagttccttcttactaaactgataaacgccgaatatgcctgctataaagctgagaaattcgcaaagctcgaggaaaggaccagggcagccttattggaaaccctttatgaagagctccacatccatagtcagtccatgatgggtctcggcggcgacgaggataaaatggaaaacggatccggcggaggtggatttttcgagtcttttaaaagagtcatcagaagccggtcacagtccatggatgctatgggcctctctaataagaagccaaatacagtcagcactagtcattccgggagtttcgcgcctaacaatcccgacctggcaaaggcggcaggcatatcgttaatagtgccaggcaagtctccaacccggaagaagagtggtcccttcggttccaggagaagctctgccattggaatcgagaatatccaggaagtccaggaaaagcgagaaagtccgcccgcgggacagaagaccccggacagtggtcacgtgtcgcaggaacctaaatccgagaattcaagcacccagtcatctcctgaaatgcccacaacgaagaatcgggctgagacggccgcccagagagctgaggctttgaaagacttttcaaggagctctagctccgcctctagctttgcgtctgtggtcgaggagacagagggagtggacggtgaagacactggcttagaatctgtgagctcatcgggtactccacataagcgagactcgttcatctacagtacttggctggaagatagtgtatctaccaccagtggcggctccagtccagggccaagtcgaagtccccaccccgatgccggaaaactcggcgaccccgcgtgtcccgagatcaagatccaactcgaggcctccgagcagcatatgccccaactcgggtgctag

SEQ ID NO: 24513 - DNA, 2082 bp, Artificial Sequence
  Description of Artificial Sequence: Synthetic coding sequence
atggcccagctgcggcccgccgtgccccccggccggccccggcggggaagcctgcctgccggggccagttggcagaatacagatctgtttgagatgatagagaaaatgcagggttctcgtatggacgaacagagatgttcttttccaccgcccctgaaaacggaagaggattacatcccatatccttctgtccatgaggttctgggccgagagggcccctttccactgatcctcctaccccagtttgggggttattggattgagggcacaaatcacgagatcacatcgatcccggaaacagagcccctccagagtcctacgacaaaagttaagctggagtgcaatcctaccgctaggatctatcgcaagcatttcttgggcaaagagcatttcaattattattcactggacgcagccctgggacaccttgtgttcagcctgaagtatgatgtgataggcgaccaggaacacctccggttgcttttacggacaaaatgcagaacctatcacgacgtgattccaatttcctgtctgacggagtttccaaacgtggtgcagatggcgaagctggtctgcgaggatgtcaatgtggatcggttttacccggtactgtatcccaaagcgtcccgcctcatcgtgacgtttgatgaacacgtcattagcaacaatttcaagttcggcgttatttaccagaaactgggacagacaagcgaagaggaactgttctccaccaatgaggaatcaccagccttcgttgagtttcttgaatttctggggcagaaggtgaagctgcaggattttaaagggtttcggggagggctggatgtcacccacggacagaccggcacggaatctgtgtattgtaactttaggaacaaggagatcatgttccacgtttccactaagctgccttacaccgaaggcgacgcccagcttcagagaaagcggcacattggtaacgacatcgtagccgttgtgtttcaagatgagaacactcccttcgtacccgacatgatagctagcaacttcctgcacgcctacgtggtggtgcaagctgaaggcggaggtccagacgggcctctctacaaggtatccgttactgctagagatgacgtcccttttttcgggcctcctctgcctgacccagctgtgtttcgaaaagggccagagtttcaagagtttttgctgaccaagcttatcaacgccgaatatgcatgctacaaggccgagaagtttgctaaattggaagaacgcactcgcgctgcgctcctggagacgctgtacgaagaactccatatccactcccaatcaatgatgggattgggaggtgacgaagacaagatggaaaacggatccggaggcggaggattcttcgaaagctttaaaagagtgatccggtcaaggtcacagtccatggatgccatgggattaagcaataagaagcccaatacagtcagcacgtcgcactctggctcctttgcacccaacaaccctgatcttgcaaaggccgcaggcatcagcctcatcgttccgggcaagagccctaccagaaaaaagtctggccccttcggcagcagaagaagtagcgcaattgggatcgagaatattcaggaagtccaggaaaagagggagagcccccccgcaggtcagaagacccccgattccggacacgttagccaggagcccaaatccgagaactccagcacccagagcagtcctgaaatgccaaccaccaagaacagagcagaaactgcggctcaacgagcagaggccttgaaagactttagtcgctcttccagttctgcatcttccttcgcgtccgtcgtggaggaaacagaaggcgtcgacggtgaggatacaggactcgaatctgtgtcgtcgtcagggactccacataagcgcgacagcttcatttattctacctggctcgaggatagcgtgtcaactacatcaggggggagtagtcccgggccttcacgctctccacatcctgatgccggcaagttgggcgatcctgcatgtcctgagataaaaatccagctcgaagcgtctgagcagcacatgccccagctgggatgctag

SEQ ID NO: 24514 - DNA, 1992 bp, Artificial Sequence
  Description of Artificial Sequence: Synthetic coding sequence
atgatcgagaagatgcagggcagccggatggacgagcagcggtgctcattcccaccccctctgaagaccgaggaggattacataccatacccctctgtgcatgaagtactcggacgggagggaccatttccccttatactgctcccccaatttggtggctactggatcgagggcacgaaccacgaaattactagcatccccgaaactgaacctctccagtccccaaccaccaaagtaaagttagagtgcaatccaaccgcaagaatttatcgcaagcacttcctcggaaaggaacactttaactattatagcctcgatgccgctctgggtcatctggttttttcgttgaagtacgatgtgattggagatcaggagcatctgcgcttgttgctgagaaccaagtgcagaacataccacgatgtgatcccaatctcttgtctgacagagtttcccaacgtggtgcagatggccaagctagtatgcgaagacgttaacgttgataggttttacccagtgctgtatcccaaggcctcccggctcatagtgacctttgatgaacatgtaatttctaataactttaagttcggggttatctaccagaagctgggacagacgtcggaggaggagctattttcgaccaatgaggagtctccagctttcgtagaattcctggagttcctcggacagaaagttaagctccaggactttaaaggctttcgaggggggctcgatgtcacccacggacagaccgggaccgagtctgtgtattgcaacttcaggaataaggaaatcatgttccatgtgagcactaagctcccctatacggagggggatgctcaacagctacagagaaaacggcatattgggaatgatatcgtagcagtggtattccaggacgaaaatacacccttcgtaccggacatgattgcgtcaaatttccttcatgcatatgtggtggtgcaagcggagggcggcggtcccgacggtcccctttataaagttagcgtcacggcccgggacgatgtgcctttcttcggtcctcccctccctgatcctgcagtattccgtaagggaccggaattccaggagttccttcttaccaagttaatcaacgccgaatatgcctgctacaaagccgagaagttcgccaagcttgaggaacgtacgcgtgctgcattgctggagacactgtacgaagagcttcatatacattcacagagtatgatgggactgggcggtgatgaagataaaatggagaatggctctggggggggcggtttcttcgagtccttcaagcgtgtgattcgctcacggtcccagtctatggacgcgatggggctgagcaataagaagcccaataccgtctctacttcccactctggcagttttgcgcccaataaccccgacctcgctaaggccgctggcatctccttgattgttccaggcaaatcccctactaggaagaagtctggaccattcggatcccgccgtagcagtgccattgggatcgaaaatattcaggaggttcaggaaaagagagagtcccccccagccggacaaaaaacaccagattcagggcacgtttctcaggagccgaaatccgagaactcatctacgcagagcagcccagagatgcctaccactaaaaacagagccgaaaccgctgcgcagagagctgaagccctaaaggacttcagccgttcttcctcttcggctagtagtttcgcatccgtcgtggaagaaaccgagggcgtagacggagaagacacaggtctagagagtgtttcctcatcaggcacacctcataaacgggactcctttatctacagcacctggctggaggattctgtaagcacgaccagtggcggtagttctccaggtcctagccgtagtcctcatccagatgcaggtaagctcggagaccccgcttgccccgagataaaaattcagttggaggcatctgagcagcatatgcctcaactggggtgttag

SEQ ID NO: 24515 - DNA, 744 bp, Artificial Sequence
  Description of Artificial Sequence: Synthetic coding sequence
atgctggtgctgcggagcgccctgacccgggccctggccagccggactctcgcccctcaaatgtgttccagcttcgctactggccctcgacagtacgacggaattttctatgaattccgcagttactatttaaagcccagtaagatgaatgaattcctcgaaaacttcgagaagaatgcgcatctaaggacagcacatagcgagttagtgggctattggtcagtggaattcggggggagaatgaacactgtgtttcatatctggaagtacgataacttcgctcacagaactgaagtcaggaaggccttggcgaaagataaagagtggcaggagcagttcttgattcccaatttggccctaattgacaagcaggaatccgagatcacttacctggtgccttggtgcaaactggagaagcctcctaaagaaggggtgtacgagctagctacattccagatgaagcccggagggcccgccctgtggggggatgcttttaagcgcgcagtgcacgctcatgtcaacctcggatacacaaagttggtgggagtgtttcatacggaatatggggcattgaatagagtgcacgtgctttggtggaacgagtccgctgattcccgggccgctggccgtcataagtcacacgaggatccacgcgtggtggctgccgtcagagagtctgtgaattacttggtgtcccagcaaaatatgctactcattccaacaagtttttccccactcaaatag

SEQ ID NO: 24516 - DNA, 3594 bp, Artificial Sequence
  Description of Artificial Sequence: Synthetic coding sequence
atgcacatcaagagcatcatcctggagggcttcaagagctacgcccagagaacagaagtgaatgggttcgatccactgtttaacgcgattaccggactgaatgggagtggcaagtccaatatactcgactcaatttgtttcctgctgggaattagtaatctctctcaggttcgggcctcaaacttgcaggacctggtgtataaaaacggacaggctggtatcactaaagctagcgtttccattactttcgataactcagataaaaagcagtcccccctcggatttgaagtgcacgatgaaatcacggtaacacgtcaggtggtgatcggcggaagaaacaaatatctcatcaacggtgtgaacgccaacaacacacgtgtgcaggacctcttctgcagcgtcgggttgaacgtcaataacccgcatttccttattatgcaagggagaattacaaaggttctgaacatgaagcctcctgagattctgagtatgattgaagaggcagccggcactaggatgtacgaatacaaaaagattgccgcccagaaaacaatcgagaagaaggaggccaagttgaaagagattaaaaccattcttgaagaggaaatcacacccaccattcagaagctcaaggaggaacgatccagctatctggaataccagaaggtgatgagggagattgaacacctgtcgcgtttgtacattgcctaccaattcttgttggctgaggacactaaagtgcggagtgccgaggaactgaaagagatgcaggataaagtcatcaagctgcaggaagagctgtctgagaatgataaaaagattaaagcactgaaccacgagatagaagagctagagaagagaaaggataaagaaactggcgggattttacgaagccttgaggatgccctcgcagaagcccagcgagtgaacacgaaatctcaatctgccttcgacttgaagaaaaagaaccttgcttgcgaggaaagcaaaaggaaggaacttgaaaagaacatggttgaggatagcaaaaccctggccgctaaagagaaagaagtgaagaaaataactgatggactgcacgccctgcaagaggccagcaacaaggatgcagaagccttggccgcggcccaacaacatttcaatgctgtgagtgcgggtctttccagcaatgaggacggtgcggaagctactcttgctggtcaaatgatggcgtgcaaaaacgatatcagtaaagcgcagactgaggcaaagcaggcccagatgaagttgaagcatgcccaacaggaactgaagaacaaacaagccgaagtgaaaaaaatggattcggggtatcggaaagatcaggaggctcttgaagcagtgaaacggctgaaagaaaagctggaggcggagatgaagaagctaaattatgaagagaataaagaagagtctctgctcgaaaaacggcgtcaactgagccgggatattggtaggcttaaagaaacatatgaagctcttctagctcggtttcccaacctgcgtttcgcctacaaagaccccgaaaaaaattggaacagaaattgtgtaaaggggttggtggcaagcctcatcagcgtgaaagatacctccgcaacaaccgcgctcgaactcgtggcaggagagagactgtataacgtcgttgtcgatacagaagtgacagggaaaaagttgctcgaaaggggcgaactcaaacgccgatataccataatcccactcaataagattagtgcccgctgtattgccccagagacccttagggtcgcacagaacctagtcggtccggacaatgtgcatgttgccctatcattggttgaatacaaacccgagctgcagaaagccatggagttcgttttcggcaccacattcgtgtgtgacaatatggacaacgccaaaaaagtggcttttgataaaagaattatgacacgcaccgtgacgctcgggggggatgtctttgaccctcatggtaccctttctggcggggcaaggtcccaggccgccagcattctcaccaaattccaagaattgaaagacgtgcaggacgagctacgtattaaggaaaatgagctgcgggccctggaggaagagctggcaggcctgaagaatacagccgaaaagtaccgccagctgaaacagcagtgggagatgaaaaccgaagaagccgacctgttgcagaccaagctgcaacagagctcataccacaagcaacaggaggagttggacgccctgaagaaaaccattgaggagagcgaagagacactcaaaaacacaaaggagattcagcggaaggcggaggagaaatatgaggttttagagaataagatgaagaacgcagaagccgaacgagaacgcgagttgaaagatgcacaaaagaaactcgattgtgctaaaaccaaggcagacgcatcatctaaaaagatgaaagaaaaacagcaggaggtcgaggccataaccctagaactagaggagctgaagagagaacatacctcttataagcaacagctggaggccgtcaacgaagcaataaagagctacgagtcgcagatcgaagtaatggcagctgaggttgccaaaaataaagaatccgtcaacaaagcacaggaggaggtgacaaaacagaaagaagtgattacagcacaagacaccgtgattaaggcaaaatacgccgaagtggctaaacacaaagagcagaataacgactcacagctcaagattaaagaactggatcataatattagcaagcataaacgcgaagccgaagatggtgccgccaaagtgtctaagatgctcaaggattatgactggattaacgccgagcgacacttgtttgggcaacccaattccgcatacgactttaagactaataacccaaaagaagccggccagcggttgcaaaagctgcaggaaatgaaagagaaactcggcagaaatgttaacatgagggccatgaatgttctcactgaagccgaggagcggtataacgacctgatgaagaaaaagagaattgtagagaatgacaaatccaaaattctcaccaccatcgaggatctagatcagaagaaaaaccaagccctaaatattgcctggcagaaggtcaacaaggattttggtagcatctttagcaccttactccctggagccaacgcaatgttggcccctccagaaggtcagactgtgcttgatggtttagagtttaaggtggcgctaggaaacacatggaaggagaacctcactgagctctcaggcggccagcggagcttggtggcactatcactgatactaagtatgctcctgttcaagccagctcccatttacattctggacgaagtggatgcagctctggacctgtcgcacacgcagaacatcggacaaatgctgaggactcattttactcatagtcaatttatcgtagtctctctgaaggaaggaatgtttaacaacgcgaacgtgctgtttaaaacgaagtttgtcgatggagtatcgaccgttgcccgatttacgcagtgtcaaaatggcaagatttcaaaggaagccaagtccaaagccaaaccccctaagggcgcccacgtcgaggtatag

SEQ ID NO: 24517 - DNA, 3594 bp, Artificial Sequence
  Description of Artificial Sequence: Synthetic coding sequence
atgcacatcaagagcatcatcctggagggcttcaagagctacgcccagaggacagaagtgaacggcttcgatcccctctttaatgccataacaggcctaaacggttccgggaagtcaaatatcctcgattcaatttgtttcttacttgggatctcaaacttgtctcaggtgcgggcctccaatttacaggatctggtgtacaaaaacggacaggcaggaataaccaaagctagcgttagtattactttcgacaacagtgataagaagcagtcccccttgggcttcgaggtacatgacgagattactgtgacccgccaagtagtgattggcggtcggaacaagtacctcatcaatggggtgaacgccaataatactagagtgcaggatttgttttgctccgtaggcctgaacgtcaataatccccactttctcatcatgcaagggaggatcactaaagttctgaatatgaagcctccggagattctcagtatgatagaagaagcagctgggacacgaatgtacgaatataagaagatcgctgcccagaagacaatcgaaaaaaaggaagccaagttaaaagagatcaagacaatcttagaggaagagattacaccgacaatccaaaaactgaaagaagaacgctcatcttatctggaataccagaaggttatgcgcgagattgaacatctgtcgaggctgtatatcgcataccaatttctgttggccgaagatacaaaagtacggagcgccgaggagcttaaagaaatgcaggataaggtcattaaactgcaggaggagttaagcgagaacgacaaaaagataaaagccctgaatcacgagatcgaggagctcgaaaaacggaaagataaagaaacaggcggcatcctgcgcagtttagaggatgccctcgcagaggcccagcgggttaacaccaaatctcagtcagctttcgaccttaagaagaagaatctggcatgtgaagaaagcaaaagaaaggagctggagaaaaatatggtggaggactcaaagactctcgctgccaaggaaaaggaggtcaagaaaattacggacggcttacacgcactgcaagaggccagcaataaggacgcagaggccctggctgcggcacaacagcacttcaatgctgtgagcgccgggctgtcctcaaatgaagatggtgccgaagccaccttggcaggccagatgatggcctgcaaaaacgatatctccaaagcacaaaccgaagcaaaacaggcccagatgaagttgaaacatgcccagcaagaactgaaaaacaagcaggcggaggtaaaaaagatggactctggctatagaaaggaccaggaagctctggaagcagtgaaacggctcaaagagaagctcgaggcagaaatgaagaaactcaactatgaggagaacaaagaagagtctttgcttgagaaacgcagacagctcagccgcgatataggtcgcttaaaggagacatacgaagctctgctggctcggttccctaaccttcgcttcgcgtacaaggatcccgaaaagaattggaacagaaattgtgtgaaggggctcgttgctagcctgattagcgtaaaggatacttccgccaccacagccctggaactggtagctggcgagaggctgtacaatgtcgtggtagataccgaggttactggcaagaagttgctggagcgtggtgaactgaagcgcaggtacactataattccacttaataaaatatctgcccggtgtattgcccccgagacacttagggtcgcgcaaaatctggtgggaccggacaacgttcacgttgctctctcactcgtggaatacaagcctgagttgcagaaagcaatggagtttgtgttcggcacaaccttcgtctgcgataacatggacaacgctaagaaggtcgcatttgataagagaattatgacccgaaccgttaccctcggcggggatgtgtttgatccccacggaacgctgtctgggggagccaggagccaggccgcctccattcttacaaaattccaggagctgaaggacgtccaggatgagttgagaattaaagaaaacgaactgcgggcactggaggaagagttggccggactaaagaacacggcagagaagtatcgacagttgaagcagcagtgggagatgaagaccgaggaagccgacctgctccaaaccaagctccaacagtctagttaccataaacagcaggaagaactagacgccttgaaaaagaccattgaagaatctgaggagacactaaaaaacaccaaagagatccagcgcaaagccgaggaaaagtatgaggttctggagaataagatgaagaatgccgaagctgagcgcgaacgagagctgaaagacgcccagaagaagctcgactgcgcaaagaccaaggccgacgcgagttccaagaagatgaaggagaaacaacaggaggtggaggctataactctggagttggaagaactcaaaagggagcacacctcctataagcagcaactcgaggccgttaatgaagccataaagtcttacgaatctcaaatcgaagttatggcagcagaagtcgctaaaaacaaggagtcagttaataaagcccaggaggaagtaaccaaacagaaggaggtgattaccgcgcaggatactgtcatcaaggcgaaatacgcagaggtggctaagcacaaggagcagaacaacgattcccagctaaagattaaggaactggatcataacattagcaaacacaagagggaggccgaggacggggctgccaaagtgtcaaagatgcttaaggactatgactggattaatgctgagcgacatctgttcgggcagccaaacagcgcctatgatttcaagaccaacaaccctaaggaagctggacagcggttgcagaagctacaggaaatgaaggagaagttgggcagaaacgtgaatatgcgagccatgaatgtgctcacggaagcagaggagagatacaacgatctcatgaaaaagaagcgcatcgttgagaatgataagagtaaaattctgaccaccatcgaagatcttgaccaaaaaaagaaccaggccctgaacattgcctggcaaaaggtcaacaaggacttcgggagcattttctccactttactgccaggcgcaaatgccatgctcgccccgccagagggacagacagtgttggacggactggaattcaaggtggcactgggtaacacatggaaggagaatttgacagaactctcagggggacaacgctcattggtcgccctcagcctcatcttgtcaatgctcctgttcaaaccagcccctatttatatcctggatgaggtagatgctgctctcgacctgtcacatacccagaatatcggccagatgcttcgaactcatttcactcacagccaatttatcgttgtctccttaaaggagggaatgtttaacaacgctaacgtcctgtttaaaactaaatttgtggatggtgtatctacagtggccagattcacgcaatgccagaatggcaaaatttcaaaggaagcaaagtcaaaagccaagcctcccaagggcgcccatgttgaggtctag

SEQ ID NO: 24518 - DNA, 1047 bp, Artificial Sequence
  Description of Artificial Sequence: Synthetic coding sequence
atgagcctgccccggttccagcgggtgaacttcggcccctacgacaattacataccggtgtctgagctctcaaaaaagtcatggaatcagcagcattttgcgctgctgtttcccaagccccagcggcccggcaccaaacgcagatctaaaccttctcaaatccgcgacaacacagtttctattatcgacgaggagcaactgcgcggcgacagacgtcagcccttatggatgtatcgctcattgatgcgaatttccgaacgcccctctgtgtacctagcagcccggagacagcctctcaaaccgacacgcacagtggaagtcgattcgaaggctgcagaaattggcaaaaagggtgaggacaaaacgacacagaaagatacaacggactccgagtcggaactgaaacagggcaaaaaagactccaaaaaaggtaaggacattgagaaaggaaaagaagagaagcttgatgctaagaaagattccaaaaagggaaagaaggacgctgagaaaggcaaggattccgcaactgaatctgaggacgaaaagggtggcgccaaaaaagataacaaaaaagacaaaaaagacagcaataagggtaaggactcagccacagagtccgagggggagaagggggggactgagaaggactccaagaagggaaaaaaagatagcaagaaaggcaaagattccgcaatcgagctacaggctgtcaaagctgacgagaaaaaggatgaagatgggaaaaaggatgccaacaagggagacgaatcgaaagatgccaagaaggatgctaaggagattaaaaaagggaagaaagacaagaagaaacctagctctaccgactcggatagcaaggacgacgttaaaaaggagtctaaaaaagacgcaacaaaagacgcaaagaaagttgccaagaaggacacagaaaaagagtcggccgactccaagaaagacgccaagaagaacgccaaaaaggatgcaaagaaggacgctaagaaaaatgcaaaaaaggatgagaaaaaggatgccaagaagaagggcaaatag

SEQ ID NO: 24519 - DNA, 1515 bp, Artificial Sequence
  Description of Artificial Sequence: Synthetic coding sequence
atgaacagccagccccagacccggagccccttcttccagcggccccaaatccagcccccacgtgccaccataccgaactctagcccttccatacgtccgggagcccagacgcctacagctgtttaccaggccaatcaacatattatgatggtcaaccatctgcccatgccctacccagttccccaaggccctcagtattgcattccgcaatacagacattcaggtccaccctacgtgggccccccgcagcagtacccagtgcagccacccgggccgggcccattctaccctgggccgggaccaggggattttcccaatgcatacggtacaccgttctacccttcgcagcctgtgtatcagtccgcgcctattatcgtgcctacccagcaacaaccaccccctgctaagagggagaaaaaaaccatcagaattagagatccaaatcaaggaggtaaggatatcactgaggagattatgtccggagggggcagcagaaatccgacaccacccataggaagacctaccagcacaccaacccccccccaacagctgccctcgcaggtgccggagcattccccagtggtctacggcaccgtagaatccgcacatctggcagctagtactcctgtcactgccgctagcgaccagaaacaggaggagaagcccaaacctgatccggtgttaaagagcccttccccagttctgagattggtactgtcaggcgagaaaaaggagcaggaaggacagacttcagaaacaacggccatcgtgtcaatagcagagctgcctctcccaccctcccctaccaccgtttcttccgtagcaagaagcactattgccgcacctacctcttccgccctttcttctcagcccatttttaccacagctattgacgaccggtgcgagctgtcatcaccaagagaggataccattccaatcccaagtttgaccagctgcaccgaaaccagtgaccccctcccaaccaatgagaatgacgacgacatctgcaagaaaccttgtagcgtggcacctaatgacatcccactcgtttctagtactaacctcataaacgaaatcaatggggtaagcgaaaagctctccgcaacagaaagtattgtggaaatcgtgaaacaggaagtgctccctctgacactcgagcttgagatcctggagaaccctccggaagaaatgaaactcgagtgcatcccagcacctatcaccccaagcaccgtcccctccttcccccccaccccgcccacccccccagccagccccccccacactcccgtgatcgtaccagccgcagccacaactgtgtcatcgcctagtgcggccattacagtgcagcgggttctcgaagaggatgagtccatcagaacttgtttgtcagaggatgccaaggaaatccagaacaagatcgaggtggaagctgacgggcagactgaggaaattttggattcacagaatctcaactcccggcgcagtcctgtgcccgagacctctaatgaatgctag

SEQ ID NO: 24520 - DNA, 744 bp, Artificial Sequence
  Description of Artificial Sequence: Synthetic coding sequence
atgctgaagttcctggtgtggttcctgcagtggtgcgtgtgcgtgctcgtccagcctgccaaagagcttcttcactgcctcaagatgcaaatgcgcatctcaaaatacacgaagtgcctgcaggcccagattgcaattaccgtgcccaaaacctggaagaaacctaaggatagaacacgtacgacagaggaaatgctagaggccgaactcgagctgaaggccgaagaagagctgagcattgacaaagtactcgagagcgagcaagacaaaatgtcccaggggtttcaccccgagcgggatccttcggacctcaagaaagtgaaggccgtggaggaaaatggagaagaggctgagcctgtgcgcaacggagcggagtccgtgagcgaaggagaggggattgatgctaatagcggatctactgattccagcggggacggagtgactttccccttcaagccagagtcctggaaaccaaccgatacagagggcaaaaagcagtacgacagagaatttctgctcgactttcagtttatgcctgcatgcatccagaagcccgaaggactcccacccattagcgatgtcgtattggataaaattaatcagcccaaactccctatgcgcacactggaccctcgcattctaccccgcggcccggatttcacccctgcttttgcagacttcggcagacagacacccggtggcagaggcgtaccagtgagtgcttcatcactgcagctaacctag

SEQ ID NO: 24521 - DNA, 3918 bp, Artificial Sequence
  Description of Artificial Sequence: Synthetic coding sequence
atgaacagccagccccagacccggagccccttcttccagcggccccagattcagcccccccgcgccaccatacccaattcctctccctcaatcaggcccggcgcccaaacccccactgccgtgtaccaagcgaatcagcacatcatgatggtgaatcacctgccaatgccgtatcccgtccctcagggtcctcagtactgcatccctcagtatagacacagtgggccgccgtacgtcggccctcctcagcagtacccagtccagccccccggcccaggccccttttatcccggcccaggtccgggcgatttcccaaacgcttacggcacacccttttacccatcccaacccgtgtatcaaagcgctcccattatcgtcccaacccagcaacaacccccaccggctaagcgggaaaaaaagacaattagaattcgagaccctaatcaaggaggcaaggacatcacggaggaaattatgagcggtggaggcagccgcaatcctacacctcctattggcagacccactagcacccctacgcctccgcagcagttgccatcacaggtgccagaacattctcccgtcgtatacgggactgtggagtctgctcacctagctgcctcaacacccgtcacagctgctagcgaccaaaaacaggctcagattgctatcaccgtcccaaaaacctggaaaaaacctaaggataggactcggaccaccgaggagatgctcgaagctgaacttgagctgaaggcagaggaggaactaagcatcgataaggttctggaatccgaacaagataaaatgtcacaaggctttcatcctgagcgggatccgagcgatctcaagaaggtgaaagcggtggaggagaacggcgaagaggcagaacctgtgcggaacggtgcagaatcggtgtccgagggcgaaggcattgacgcaaactctggctccacggacagctctggcgacggcgtgacttttccattcaagccggaatcctggaaacccacagacacggagggaaagaagcagtacgacagagaattcctgctggacttccaattcatgcccgcctgcattcagaaacccgaaggcctgccacctatcagcgatgtcgtgctggacaaaatcaatcaaccaaagctgcccatgagaaccttggatcccagaattctccctcgagggccagactttacgccggcatttgctgacttcgggagacagacaccagggggccggggagtgccattgttgaacgtgggctcgaggagatcacaacccggacagcgtcgagaacccagaaaaatcattaccgtgtcagttaaggaggatgtgcacttaaaaaaggccgagaacgcttggaaaccttcacagaagagagacagtcaggccgacgaccccgagaatattaagacccaagagttgtttcggaaggttcggagtatcctgaataaactgacaccacagatgttcaatcaactgatgaagcaggtgtcaggtctgacagtggacacggaggagagactcaaaggcgtaattgacctggtgttcgagaaggccatcgacgagccttcctttagcgtcgcatacgccaacatgtgccgatgcttggtgacacttaaggtccctatggcagataaaccagggaacacagtaaatttcaggaaactgctattgaaccgatgccaaaaggagtttgaaaaagacaaagcagacgacgatgtctttgaaaaaaaacagaaagagcttgaggcagctagtgcaccagaagagcgtactcgcttgcacgatgagctggaggaggccaaggataaggcacgaagaaggagtatcggaaatattaagttcataggcgagctttttaaattgaagatgctcaccgaagcaatcatgcacgattgcgtggtaaagctgctgaagaaccatgatgaagagagcctcgagtgcctgtgccgcctcctgaccaccattgggaaggatctggatttcgaaaaggctaagccccgaatggaccagtatttcaaccagatggaaaaaatcgtgaaagagcgcaagacctcttcccgcattcgtttcatgttacaggacgtgatcgatttaaggctgtgcaattgggtctcacgaagggctgaccaaggccctaagaccatcgaacaaatacacaaggaggcaaagatcgaagaacaggaggagcagcggaaagtgcagcaactgatgaccaaggagaagcggcggcctggtgttcagcgcgtggatgagggcggatggaataccgtgcagggcgcaaaaaattctcgcgtactggatccgtctaagttcctgaaaatcaccaaacccaccattgatgagaagatacaactggtgcctaaagctcagctcggcagctggggcaaaggtagcagcggcggagccaaggcatccgaaacggacgccttgaggtcatcagcgtcaagcctgaaccgcttttcagctcttcagcctccagcgccatcgggatctacccctagtactccggtcgaatttgactctaggcgcacgctcacatcacgtgggtcaatggggcgcgaaaaaaatgataagcctctgcctagcgcaaccgctcgccctaacacttttatgcgtggtggctctagcaaggacctactggataaccagagtcaggaggaacaacgtagggagatgttggaaactgtcaaacaactgaccggcggggtggacgtggaaaggaactctactgaggccgaaaggaataagactcgagagtctgccaaaccagagatttccgccatgtcagctcatgataaggctgccctgtcagaagaagagttggagagaaagtcaaagagcatcatagatgagttcttacatataaacgatttcaaggaggcaatgcagtgcgttgaggaattaaatgcccagggactgctgcacgtatttgtgcgggtcggcgtagaatcaacactcgaacgtagtcagattacacgcgatcacatgggccaattactctaccagctagtgcagagcgaaaagttgtccaaacaggacttctttaaggggtttagcgagactctggagttggctgatgatatggctatcgatattccccacatttggctctaccttgccgagctggtgacgcccatgctgaaagaaggcggcatttctatgcgggagctgactatcgaattttcaaagcctctgctaccagttggtcgggccggcgtgctgctctccgaaatcctgcatcttctgtgcaaacaaatgtcacacaaaaaagtgggtgcactatggcgggaggctgacctgtcatggaaggatttccttcccgaaggcgaagatgtacataattttctgctagaacagaagcttgacttcatcgaatcggactccccgtgttcttcagaggcgctttccaaaaaggagctttctgccgaggagctctataagaggctggagaagttgatcatcgaggataaggcaaatgatgaacagattttcgactgggtagaagccaatctggatgagatacaaatgtcatcacccaccttcttgcgcgccctcatgaccgccgtgtgcaaggccgcaattattgcggatagctcgacattccgggttgacaccgccgtgattaagcaaagagtgcccatccttctgaaatatctggacagcgacacagagaaggagctccaggccctgtatgcactccaggcttccatcgtcaaactggatcagcccgctaatcttctacgcatgttcttcgattgcttgtatgatgaggaggtgatctcagaagatgccttctataagtgggaatcatctaaggacccagccgagcagaacggaaagggcgtggccttaaaaagtgtaacagcgttctttacttggttgcgggaagccgaggaagaatccgaagacaattag

SEQ ID NO: 24522 - DNA, 4776 bp, Artificial Sequence
  Description of Artificial Sequence: Synthetic coding sequence
atgaacagccagccccagacccggagccccggcggcttccggcccattcagttctttcaaagaccccagatccaacccccaagagctaccatccctaactcctccccatccatccggccgggtgcccagaccccgaccgccgtgtatcaggctaaccaacatattatgatggtcaaccacctacctatgccgtatccggtgccacaggggccccagtactgtatcccacaatacagacactcgggacctccttacgtcgggcccccccagcaataccctgtgcagccaccgggccctggacccttctaccccggtcccggtcccggtgactttccaaatgcatatgggactccattctacccttcacagcccgtttatcagtccgcccccatcatcgttccaacccaacagcagccccctccagctaagcgcgagaaaaagacaattagaatacgcgacccaaaccagggggggaaggatattaccgaggagattatgagcggagggggtagcagaaatccaaccccccccatcgggcgccccacaagcacaccgacccccccccagctcccatcacaagtgccagagcacagcccagtcgtatatggcacggtggagagcgcccacttagccgcctccaccccagtcactgccgccagtgaccaaaagcaagaagagaagcctaaacccgatcccgtcctgaagagcccgtctcccgtgctccgactcgtgctctccggggagaaaaaggagcaggagggacagacatctgagaccacggccattgtgtccattgccgaactcccgctgccaccctctccaacaacagtgtcatccgtcgctaggtctaccattgctgccccaacctctagtgctctgtcatcccagcccatcttcaccacggcgatcgatgaccggtgtgaactgtcctcccccagagaggatactattccaatcccatcgctgacctcatgtaccgagaccagcgaccccttaccgacaaatgagaatgacgacgacatttgtaaaaaaccctgttccgtagctcctaatgatattcccctcgtgtccagtacaaacctcattaacgagattaacggcgtctcagaaaagctcagtgctacagagtctattgttgagatcgtgaaacaagaggtgcttccacttacgttagagctggagattctggagaaccccccagaagagatgaagcttgagtgtattcctgcaccaattacaccttcaactgttccctcttttcccccaaccccccccaccccgccagcctccccaccccataccccagttatcgtgcccgccgctgccacgactgtgtcttccccttctgctgcgataaccgtgcaacgtgtgctcgaagaggacgaaagcatccgcacatgcctgagcgaagatgctaaggaaatccagaacaaaattgaagtcgaggccgatggacagaccgaagagatactagattcgcagaacctgaactctcggagaagccctgtgccagctcagatcgcaatcacagttcctaaaacatggaagaagcccaaggacaggaccaggacgacagaggagatgctcgaagcggagctggaactgaaagcggaagaagagctgagtatcgataaagtgctcgaatccgagcaagataaaatgtcacaaggattccatccagaaagggatccatccgatctgaagaaagtgaaagccgtcgaagagaatggagaggaggccgaacccgttcgtaacggagccgagagcgtgagcgagggagaaggaattgacgccaactcagggagcactgatagcagtggggacggcgtgaccttcccctttaaacctgagtcgtggaagccaacggatacggaaggcaagaaacaatacgacagagagttcctgctggattttcagtttatgcctgcatgtattcagaagcccgaagggctgccccctatttcagacgttgtcctggacaagataaaccaacctaagctcccaatgcgcacacttgacccgcgaatcctgcccagggggcctgatttcacacccgctttcgccgattttgggaggcagacgcctggtggccgcggagtgcccctgcttaatgtggggtcacgcagatctcagcctggccagagacgagagccacgcaagattattacagtgagtgtcaaggaggacgtgcacttaaagaaggcagaaaacgcctggaagccaagtcaaaagagagatagccaggcggacgacccagaaaatataaagactcaggagttattccggaaggtgcgctccatcttgaataagctcaccccacagatgtttaatcaattgatgaagcaagtcagcggtctgacagtggacacggaagagcgcctgaagggcgtgatcgatcttgtcttcgaaaaagccatcgacgagccttcgttttcagttgcctatgccaacatgtgtaggtgtcttgttaccctcaaggtgcctatggcagacaaacccggtaacacggtcaatttccgcaagctgttgctgaatcgctgtcagaaggagtttgagaaggataaggcggacgatgacgtgtttgagaaaaagcagaaggaactagaagctgcctctgcccctgaagagaggacccgcctgcatgacgagctggaagaggccaaggacaaggccagaagaagaagcatcggaaacatcaaattcatcggagagctcttcaagctgaaaatgctgaccgaggctataatgcatgattgcgtggtgaaactgttgaaaaaccatgatgaagagtcgctggagtgtctgtgccggctcttaaccacaattggcaaagacctggactttgaaaaagctaagccaaggatggaccagtatttcaatcagatggaaaaaattgtgaaagagaggaagacaagctcaaggataaggtttatgctccaagatgttatcgacctgcggttatgtaattgggtgtctaggcgcgccgaccagggacccaaaaccattgaacaaatccataaagaagcaaagatagaagagcaggaggagcagcgcaaggttcaacagctaatgacaaaggagaaacggcgtccaggggtccaacgggtcgacgaaggcgggtggaacaccgtacagggggcaaagaactcaagggttctggaccccagcaagttcttaaaaattacgaaacctaccatcgacgaaaaaatacagcttgttcccaaagcacaactaggctcttgggggaaggggtctagcggtggagccaaagcctccgagacagatgccctccgttcaagtgcctcatcactcaatcgcttcagcgccctgcagccaccagccccgagcgggagcacccctagtacaccggtcgaattcgatagcagacgaactctcacaagcagagggtctatggggcgcgaaaagaatgacaaacccctgccttcagctacggctagacctaatacattcatgagaggcggctccagcaaagacctcctggataatcagtcacaggaagaacagcgccgggaaatgctcgagacagtcaagcagctgactggtggagtggatgtcgagcgaaattcaacggaggccgagcggaataagacacgtgagtctgcgaaaccggaaatctccgcaatgtcggcccacgataaagcagctttatctgaggaggagctggagagaaagtcgaaaagcataattgatgagttcctgcatataaacgactttaaggaggctatgcagtgtgttgaggaattgaacgcacaggggcttctccacgttttcgtgcgtgttggggtggagtcaaccttggaaaggtcgcaaattactcgcgaccatatgggccagttactttatcagctggttcagtccgaaaagctgtcgaaacaggacttctttaaaggattcagcgagaccttggaacttgccgatgatatggccatagatattccccacatttggctgtatctagccgaattagtgaccccgatgttgaaagagggcggcatctccatgagagaactgactattgagtttagtaagcctctgctgcctgtgggtcgcgctggcgtcctgttatctgaaattctgcatctcctctgcaaacagatgagtcacaaaaaagttggagctctgtggcgtgaggccgatctttcgtggaaggactttctgcctgagggagaagacgtgcacaactttttactggaacaaaaactggattttatcgaatcagactcaccctgtagctccgaggctctatcaaagaaagaactgagtgctgaggaactttacaagcgactggagaaattgataattgaagacaaggcaaacgatgagcaaatctttgattgggtggaggccaacttagacgagattcagatgtcctcaccgacattcttgagagccctgatgaccgctgtctgcaaagccgctataatcgcggacagcagcactttccgtgtggacacagccgtcattaagcaaagagtccccattctgttgaaatatctggacagcgatacagaaaaagaactgcaagccctgtatgcactgcaagccagtattgtgaagctggaccaaccggccaacctcttgcgcatgtttttcgattgcctgtacgatgaggaagtcatctccgaggatgccttctataagtgggagtcaagcaaggatcccgccgagcagaatggaaagggagtggccctcaagagtgtgacggctttttttacatggctgagagaggctgaggaagaaagcgaggacaattag

SEQ ID NO: 24523 - DNA, 1002 bp, Artificial Sequence
  Description of Artificial Sequence: Synthetic coding sequence
atgagcggcgacgagatgatcttcgaccccaccatgagcaagaagaaaaagaagaaaaagaagccatttatgctcgatgaggagggagacacccagaccgaagaaacccagccctcagaaacaaaagaggtggagcccgagcccaccgaggataaggatcttgaggccgacgaggaagacacacgaaaaaaagacgcctccgacgatctggatgaccttaatttctttaaccaaaagaagaagaaaaagaaaaccaagaagatctttgacatcgacgaggccgaggagggggtaaaagacctgaaaatcgagagtgacgtgcaggaaccgactgaaccagaggatgacctagatatcatgctgggcaataagaagaagaaaaaaaaaaatgtcaaatttccagatgaagacgaaatacttgagaaggatgaggctcttgaggatgaagacaacaagaaggacgacgggatctctttttccaaccaaaccgggcccgcctgggcagggtccgagagggattacacatacgaggaactcctcaacagagtcttcaacatcatgcgtgagaaaaatcctgacatggtggccggagaaaagcgcaagttcgtcatgaaaccccctcaggtggtgagggtgggaactaaaaaaacatcctttgtgaactttactgacatctgtaaactactacatcgccagcccaagcatctgctggccttcttgttggctgagttaggaacaagcggaagcattgatggaaacaatcagctcgtgattaaggggcgatttcagcagaagcaaatcgagaacgtgttgcgcaggtacatcaaggagtacgtcacttgccacacctgtaggtctccagacaccatactccagaaagacactagactttacttcctccagtgcgagacatgccactcaagatgctctgttgcttctatcaagacagggtttcaggctgtgacaggtaagcgagcccagttgagggctaaagcaaattag

SEQ ID NO: 24524 - DNA, 2619 bp, Artificial Sequence
  Description of Artificial Sequence: Synthetic coding sequence
atgggcgagggcggcctgccccccgccttccagctgctgctgcgggcatgcgaccaaggcgatactgagactgcccggcggctgcttgaacccggtgcagccgagcccgccgaaagaggggccgaaccagaggccggagcggaaccagccggcgctgaagttgccgggcccggggctgcagccgccggcgcagtgggggcgcctgtgcccgtggattgctctgacgaggccggaaatactgccctgcagttcgcagccgctggcgggcatgagccactggtccgcttcctgctgcgccgtggggcttccgttaatagcagaaatcattacggctggagcgccctcatgcaggccgcacggtttggccacgtgtcggtcgctcatttactgctggaccacggcgctgacgtcaatgcacagaaccggctaggagctagcgtccttactgtggcctctaggggaggccatttgggcgtggtcaaactgctccttgaagccggagccttcgtcgaccaccatcaccccagtggcgaacagttaggactggggggcagcagggacgagccactggacatcaccgccctgatggccgcaattcagcacggccacgaggccgtagtcagactgttaatggaatggggggccgatcctaatcacgccgccaggaccgtcggatggtccccactcatgctcgctgctctgactggccgcctgggagtggcgcagcaactagtcgaaaagggggccaacccggaccacctttctgttctggaaaagactgctttcgaagtcgctcttgattgcaaacaccgcgaccttgtggactacctggaccccctcacaacagtgaggcctaagaccgacgaagaaaagaggcggcccgatatttttcacgccctaaagatggggaacttccaattagttaaggagattgcggatgaagatccatctcacgtcaatttggtaaacggagacggcgctacccccctgatgcttgctgcagtcaccgggcagctagccctggttcagctgctcgtggagcggcacgctgatgtggacaagcaggattcagtgcatgggtggacagctcttatgcaggccacatatcatggcaacaaagaaattgtgaagtacctgctcaaccagggggcagacgtaacactccgtgcaaaaaatggatacacagcctttgacctcgttatgttactgaacgaccccgacactgagctggttagactgctcgcttctgtctgtatgcaggtcaacaaggataagggtagaccgtctcaccagcctcccctgccccatagcaaagtgcgccagccgtggtctatacccgtgttgccagacgataaaggcggactgaaatcttggtggaatcgaatgtccaaccgttttaggaaactgaagttaatgcaaacactacctagaggactctcaagtaatcagcctctgccattttctgatgagccagagcctgctcttgactctaccatgcgggcagctccccaagataaaacatcccgatcagcgctaccagatgctgcgccagtcaccaaggataatgggccggggagcactaggggggaaaaggaggacacactgctgacaactatgttacggaacggagccccactcacccgcttaccgagcgacaaactcaaagcagtaataccacccttcctgccgccctcaagtttcgagctttggtccagcgatcggagccgcacgcgccacaacggaaaagcagatcccatgaagacggcactacctcagcgggccagtcggggccaccccgtcggaggcgggggcaccgatacaacgccggtgcgccctgtgaagttcccctcactgcctcgcagcccagctagcagtgctaattcaggcaactttaaccacagtcctcatagctccggcggttctagcggggtgggcgtgagtcggcacggtggagaattgctcaatagaagcggcggctcaattgataatgttcttagccagattgcagctcaaagaaagaaagcggcggggctgctggaacagaaaccaagccaccgatctagccctgtgggcccagcccccggatcctcccctagcgagttgcctgccagcccagcagggggctcagcccccgtggggaagcagaaactggaaacgtcaaagcggcccccatctggtacgagtaccaccagcaaatctacaagtccaacactcacccccagcccctctcctaaaggtcataccgccgagtcttcagtttcgtcctcgagctcccaccgccagagtaagtcaagcgggggttctagttcgggtaccattaccgacgaagacgaactcacagggatactgaaaaaactatcactggagaaataccagccaatatttgaggagcaagaggtggacatggaggcattcctcactctcacagacggcgatcttaaagagctgggcattaaaactgatgggtcgcggcaacagatattggcggcgatctccgaactgaacgcaggcaagggtagggagcggcagattctgcaggagacaattcacaactttcacagctccttcgagtcgtcagcctcaaacacccgagcaccgggcaactcaccgtgcgcctag

SEQ ID NO: 24525 - DNA, 483 bp, Artificial Sequence
  Description of Artificial Sequence: Synthetic coding sequence
atggaggccgagcggccccaggaggaggaggacggcgagcagggcccccctcaagacgaagaggggtggccccctcctaattccaccaccaggccttggcggagcgcccctccatctccaccgcccccaggcaccagacataccgcactcgggccccggtccgcaagtctattgtcgctgcagacagagctgctgctggatctcgtagcggaggctcagtcccggaggctggaggagcagcgcgccacgttctataccccccaaaacccttctagcctcgcgcccgccccccttcgtcctcttgaggacagggagcagttgtacagtaccatcctctcccatcagtgccagcgcatggaggcacagagaagtgagcctcccctgcctccaggggggcaggaactgttagagcttctgctccgagtccagggcggggggcgcatggaggagcagcgaagtcgcccaccgacccacacgtgttag

SEQ ID NO: 24526 - DNA, 483 bp, Artificial Sequence
  Description of Artificial Sequence: Synthetic coding sequence
atggaggccgagcggccccaggaggaggaggacggcgagcagggcccccctcaggacgaggagggctggccccctcctaactctacaacccgaccctggcggagcgcccctccttctccacctcctcccgggacacgtcacacagctctgggacctcgctccgcttccctgctgagtctgcagacggaattactcctagacctggtggcagaagctcaaagcaggaggcttgaagaacaaagagctactttttataccccacagaatcctagctctctggcccccgcacccctccgcccactcgaggatagagaacagctttacagcacaatcctctctcaccagtgccaaaggatggaggcccaaaggtcagagccaccgctaccaccaggcgggcaggaactgctggagctgctcttacgcgtgcaggggggtggaaggatggaggagcagaggtcaaggccaccgacgcacacatgctag

SEQ ID NO: 24527 - DNA, 2790 bp, Artificial Sequence
  Description of Artificial Sequence: Synthetic coding sequence
atgcagggcctgcccgacccccccagccagcggggcatcatcccccgggcctttgagcacgtattcgagtctgtgcaatgtgctgagaacacaaagtttctcgtccgggcgtcatacctggaaatctataacgaagatgttagagatctgttgggagcagataccaagcaaaaactggaactcaaagaacatccagaaaaaggagtctatgtgaaggggctcagcatgcatactgtgcactctgtagcacaatgcgaacacatcatggagactggctggaaaaaccgctcagtgggttataccctgatgaacaaagacagtagtagatcccactctatcttcactatttcaatcgagatgtctgcggtggacgagcggggaaaagatcatcttcgagcgggcaagctgaatctggtggatctcgccggaagtgagcgccaatctaagactggcgcaaccggcgaaaggctcaaggaagccactaagataaatctgtccttgtccgcgctgggtaacgtcatcagtgctctggttgacgggagatgcaagcacgtaccatacagagacagcaaactgacccgtcttctacaggattctctaggagggaatacgaaaaccctcatggtagcctgtctctcacctgccgataacaactatgacgagacattgtccacactgaggtatgccaaccgagccaaaaacattcgcaacaagccccggattaacgaagatccaaaagatgcattactgagggagtatcaggaagaaataaaaaaacttaaagctatcctgacccagcagatgagtccttcgtccctgtctgccttgctgtcacggcaagttcccccagaccctgtgcaagtcgaggagaaactgcttccacagccagtgatccagcacgatgtagaggcagaaaagcaactgatccgggaagagtatgaagagagactggcccgcctcaaagccgactataaagcagaacaggaatctcgtgcgagactggaagaagacatcacagcaatgcgcaatagctacgatgtgcgtttgtcaacactggaggaaaacctgcggaaggaaaccgaggccgttttgcaagtgggcgtattgtacaaagccgaggtcatgagtcgggccgaattcgctagcagtgcagagtatccccccgcctttcaatacgagaccgtcgttaagcccaaggtcttctccactaccgacaccctgccgtccgacgatgtttctaaaacacaggtgtctagtaggttcgcagagttacccaaggtggagccatctaagtcagaaatttccctcggatcttcggagtcaagcagtctggaggagaccagtgtctctgaggcattcccggggcccgaagagccttcaaacgtagaggttagtatgcccacggaggagtctagatctcgctacttcttggatgaatgcctaggtcaggaggccgccggtcatctcctgggagagcagaactaccttccccaggaggaacctcaggaagtaccactacagggactgctcggtttacaggatccattcgccgaagtcgaggctaaactggcccggttatcttctacagtggccagaaccgatgccccccaagctgacgtcccaaaggtccctgtgcaagtacctgctcccacagaccttcttgaaccctccgacgctaggccggaggctgaggcagctgatgacttcccacctcggccggaggttgacttggcctccgaggtggccctcgaggttgtgagaactgctgaacctggtgtatggttagaagcccaagctcctgtcgccctggtggcccaaccagagcctcttcctgctacagcaggggtgaaacgggaatcagtggggatggaggttgccgtcctcacagatgacccactgcccgtcgtggatcaacagcaggtactagctagactccagctcctcgagcagcaggtcgtcggaggagagcaggctaagaataaagacctgaaagaaaagcataagcggaggaaacggtacgccgatgagcggagaaagcagctggtggccgcgcttcagaatagtgacgaagactccggcgattgggtactactgaacgtgtacgacagcatacaggaagaagtgagggccaagagtaaactgctggaaaagatgcaacgtaagcttagagccgctgaggtggaaatcaaggacctgcaatccgagttccagttggagaagatagattatctggccacaatccgtcgtcaagaaagagattccatgttgctccagcagctgctggagcaggtccagcctttaattcgcagagactgtaactacagcaatctggagaaaatcctgcgagagtcatgttgggacgaggacaatggcttttggaaaatccctcaccctgtgatcacaaaaacctccctgcccgtggccgtctcaaccgggccccagaacaagcctgcccggaaaacaagcgcagccgataatggcgagccaaatatggaggacgatagatatcgacttatgctcagtcggtcaaatagtgaaaatatcgcttcgaattactttcgaagcaaaagagctagccagatactcagtaccgatgccaggaagtccctaacccaccataacagcccccctggcctttcctgtccactctccaataattctgccataccccccacgcaggcaccggaaatgccccaaccgcgtccctttagacttgagtcattggatattcccttcacaaaagccaagcgtaaaaagtcaaaatcaaatttcggttctgagcctctgtag

SEQ ID NO: 24528 - DNA, 426 bp, Artificial Sequence
  Description of Artificial Sequence: Synthetic coding sequence
atgaacaagcacgtgctgaagatccagaaggagctggaggaggccaaggaaaaactggcgaggcagcataagcgccgaagtgatgacgacgaccgatcgtcggatcgtaaagacggcgtcctcgaagagcagatcgagcggcttcaggagaaggtggaaagtgctcagagtgagcaaaaaaacctgttcctcgtgattttccagagatttattatgatactaacggaacatttagtccgatgtgaaacagacggaacttctgttctcactccttggtataaaaattgcattgaacggctccagcagattttccttcaggtgtgcggtgaacttcggctgggcaacaacaccattctgtcccacaaagacttttctctgaagaagatacttgtgaaattcgtcagacggttgtactccacctgctag

SEQ ID NO: 24529 - DNA, 2373 bp, Artificial Sequence
  Description of Artificial Sequence: Synthetic coding sequence
atgagccggcggcggcacagcgacgagaacgacggcggccagccccacaaacgcagaaaaacgtccgatgctaacgagaccgaggaccatcttgaaagcctcatctgcaaggttggagaaaaatcagcttgctcccttgagtcaaacctggagggtcttgccggagtcctagaggctgaccttcctaactacaaatcaaaaatactccgcctcctttgcaccgtggcgaggctgctccccgaaaagttgacgatctacactacactggtgggcctgctgaatgcgcgcaactacaatttcggcggagagttcgtggaagcaatgatccgccagcttaaagagtccctgaaggccaacaattataatgaagccgtttatttagtgagatttctgagcgaccttgtgaactgtcatgtcatagcagccccatcaatggtggccatgttcgagaacttcgttagcgttacacaggaggaggacgtgcctcaagtgcggagagactggtatgtatacgctttcctttcttctctgccttgggtggggaaggagctttatgaaaaaaaggatgctgagatggataggatctttgccaatacagagagctatttaaaacggcgccaaaaaactcatgttcccatgcttcaggtgtggacagccgacaagccccatccccaggaagagtacctagactgtctctgggcccaaattcagaaacttaagaaagaccggtggcaagagcgacacatcctcagaccttaccttgcattcgatagcattctctgcgaggcattgcaacataacctccctcccttcacaccaccaccccacaccgaagatagcgtgtatcctatgcctagggttatatttaggatgttcgattatacagacgatcctgagggacccgtaatgcctggcagccactccgtcgagaggttcgtgattgaagaaaaccttcactgcataattaagagccactggaaagagcgcaagacatgtgctgcacagctggtcagctacccgggaaagaacaaaatccctctgaactatcacatcgtggaggtgatatttgcggaactcttccagttaccggctcccccccacattgacgtcatgtacactacccttctgattgaattgtgtaagttgcagcccggcagtctcccccaagtgcttgcacaggcaacagagatgttgtatatgaggttggataccatgaatacaacatgtgtggacagattcatcaactggtttagccaccatctctccaatttccagttccgatggtcttgggaggactggagcgactgcctgagtcaggaccccgaaagtcctaagcccaagttcgtccgtgaagtcctcgaaaaatgcatgcgtctttcctatcaccagcgaattttagacatcgtgccgccaacgttttcagccctgtgtcctgcaaatccaacttgcatctataagtacggcgatgaatcttcgaatagcctgcctggacactcagtggctctgtgcctagccgtggctttcaaatctaaagctaccaatgatgagattttctcaatattaaaagacgtccccaacccaaatcaggatgacgacgatgatgagggattcagctttaatcccctcaagattgaagtttttgtacagacgctgcttcaccttgccgctaaatcgttctctcattcattctctgccctcgcgaaatttcacgaggtctttaaaacactggccgaatcagatgagggaaaattacacgtcctcagggttatgttcgaggtctggcgcaatcacccacagatgatcgctgtgctggttgacaagatgatccggacccaaatcgtcgattgtgcggcagtggccaactggatcttctcatctgaactgagcagggattttactaggctgttcgtctgggagatcctccactcaaccatacgcaagatgaataaacacgtccttaagattcaaaaggagctggaagaggcaaaggaaaagctggccagacagcataaaaggaggagcgacgacgacgaccgcagctcggaccgaaaggatggagtgctggaggagcagattgagcgtctgcaggaaaaggtcgaatccgctcagtcagagcagaaaaacttgttcttggtgatcttccagcggttcataatgatcttgacagagcacctggtgaggtgtgagactgatgggacgtctgttcttacaccatggtacaaaaactgtatagaacggctccagcagatcttcctccagcatcatcagatcatacagcaatacatggtgacgctggagaatcttctgttcactgcagaactggacccacatattctcgctgttttccaacagttctgcgccctgcaggcatag

SEQ ID NO: 24530 - DNA, 699 bp, Artificial Sequence
  Description of Artificial Sequence: Synthetic coding sequence
atgagccaggtgctgagcatcctgggcatgcacaccctgatgagcaaccagcagtattaccaggctctgtctagctcaagcataatgaataaagagggtctgaactccgtgattaaacctacccagtataagccggtcccggacgaggagcctaatagtacagacgttgaggagaccctggagcgcatcaaaaataatgatcccaaactggaagaggtgaacttgaacaatatcaggaacattcccatcccaacattgaaagcttatgccgaggcccttaaggagaactcctacgtgaaaaaattttccattgtggggacccgctccaatgaccctgtcgcatacgccctggctgagatgctgaaggaaaataaggtgctcaaaacacttaacgtcgagagcaattttatatcaggggcaggtatcttaagactggtggaagcacttccctataatacttcacttgtcgagatgaaaattgataatcagagccaacctcttgggaataaggtggaaatggagatagtaagtatgctggagaagaacgctaccctcctgaagtttgggtatcacttcacccaacagggaccacgtctccgagcttccaatgctatgatgaacaataacgatttggtgcggaagagaaggctggccgatctgaccggccccatcatcccaaagtgccgaagtggcgtgtag

SEQ ID NO: 24531 - DNA, 2403 bp, Artificial Sequence
  Description of Artificial Sequence: Synthetic coding sequence
atgagcagcctgggcgccagcttcgtgcagatcaagttcgacgacctgcagttctttgaaaactgtggtggcggatcgttcggcagtgtttatcgggctaagtggatctcccaggacaaagaggtagccgtcaagaagctcctaaagattgaaaaggaagccgagattctatcggtactgtcgcacagaaatattattcagttttacggcgtgatcttagaacctccaaactacggcatagtgaccgaatacgcctccctgggaagcctatacgactacatcaattctaatagaagcgaggagatggacatggaccacatcatgacttgggccaccgacgtggctaaaggtatgcattatctgcacatggaggcccccgtaaaggtgattcaccgtgacttaaagtcacggaacgtagtcatagctgcggatggagtgctgaaaatttgcgacttcggcgcatcccgatttcacaaccacactactcatatgtcacttgtggggacgtttccctggatggccccagaagttatccaatcgctacctgtgtcagagacatgtgacacctactcatatggggttgtcctgtgggaaatgctcactagggaggttccattcaagggtctggaggggctccaggtggcttggctcgtggtggagaaaaacgaacggctcacgataccaagctcctgtccccggtccttcgcagagcttcttcaccagtgttgggaagccgacgctaagaaacgccccagtttcaaacagattatcagcatcctggagtctatgagtaatgataccagcctgcctgacaagtgtaattcctttctgcacaacaaggccgagtggaggtgtgaaatcgaggccactctagagcgcctgaagaagttggaaagagacctgagctttaaggagcaagaattgaaggagcgagagagacgactgaaaatgtgggagcagaaactgacggagcagtctaacactccactgcttccgtccttcgagatcggcgcttggacagaggatgacgtttattgctgggtccagcagcttgttaggaagggcgattcctctgctgagatgtctgtgtacgccagcttatttaaggagaacaacattacaggcaaaaggttgctgctgctggaggaggaggatttgaaggatatgggcatcgtgtccaaggggcacattatccactttaagtccgcaattgagaagctgactcacgattacatcaatctgtttcactttccaccactgataaaggacagcggcggggagcctgaggagaatgaagagaagatagttaatctggaacttgtgtttggtttccaccttaaacctggaacgggacctcaggactgcaagtggaaaatgtacatggaaatggacggcgatgagattgccataacatacattaaggacgtgactttcaacacaaatttgccggatgctgagatcctgaagatgactaagcctcctttcgttatggaaaaatggatagtgggcattgccaaatctcagaccgtggagtgcaccgttacttacgaatccgatgtgagaaccccaaagagcaccaaacacgttcatagtattcagtggagcaggaccaagccacaggatgaagtgaaagcggttcagctagccatccagaccctgttcacaaattcagatggaaacccgggcagccgaagtgactcatcggctgactgtcaatggctggataccctgaggatgcgtcagatcgcctcaaatacgagcctgcagcggtcgcaatccaacccgatcctgggttccccctttttttcccacttcgatgggcaggattcttacgctgccgcggtgaggagaccccaagttccaatcaaataccagcagatcacaccggtcaaccagtctcggtcaagctctcccacgcagtatggactcacgaagaatttctccagcctgcacctgaacagccgggactccggctttagcagtgggaacacagatacatctagtgagcggggtcgctattcggaccgcagcagaaacaagtacggcagagggtcaattagtctaaactcatcgccacggggtaggtactcggggaaatctcagcactcgacacctagtagaggccgctatcctggcaaattctaccgggtttcacagtctgccctgaaccctcatcagtcacccgattttaaacgctcccctcgcgatctgcaccagccgaataccattcctggcatgcccctgcaccccgagactgatagtcgggcatctgaagaggacagcaaagtctctgaaggagggtggactaaggtcgaatacagaaaaaaaccacatagacctagtcccgccaagactaataaggaacgcgctaggggtgatcaccggggatggcggaacttctag

SEQ ID NO: 24532 - DNA, 1071 bp, Artificial Sequence
  Description of Artificial Sequence: Synthetic coding sequence
atgcggcggttcctgcggcccggccacgaccccgtgcgggagcggcttaagcgagatctgtttcagtttaacaagacggtagagcatggctttcctcaccagcccagtgccctcggctacagccctagtctacgaatcctcgcaataggcacacggagcggcgcaattaaactctatggcgcgcccggggtggagttcatgggattacaccaggaaaacaacgccgtgacccagatccatttgcttcccgggcaatgtcagctggttacactgctggacgataactcactgcacttgtggagcttaaaagtgaagggcggcgcaagcgagctgcaggaagacgagtcatttacccttcgcggacccccaggcgctgccccttccgccacgcagatcaccgtcgttctgccacactctagctgtgaactcctatacctgggcaccgaaagcgggaatgtcttcgtagttcaacttcccgcttttagggctctggaggacagaacaatcagctccgacgctgtcttgcagcggttgcccgaggaagccagacaccgacgggtttttgagatggtggaggctctgcaagaacatcctcgggatcccaatcagatcttgattggttatagcagaggcttagtggtgatttgggatctacaaggcagccgagttctgtatcactttctgtcctcacagcagctggagaatatctggtggcagagagatggtagactgcttgtttcatgccacagcgatggctcttattgtcagtggcctgtctccagcgaagcccaacaacccgagcccctccggtccttggtgccttatggcccattcccatgtaaagcaattacaagaattctctggctcaccactagacaggggcttccctttacaatttttcagggagggatgcctcgagcctcatacggggatagacattgtatttccgtgatacacgacggacagcaaaccgccttcgactttaccagccgagtcattgggtttacagtgcttaccgaggcggaccctgccgctagtcggcgggcctccggtgtaggcgctcaggggtag

SEQ ID NO: 24533 - DNA, 2526 bp, Artificial Sequence
  Description of Artificial Sequence: Synthetic coding sequence
atgggcgcccgggccgccggcaccagcagcggcggcggcccccggccttgcctggccagggggctgtctgccagcccgttcccagccaaacagcagcatccgcaggccggggcctcgcccgccgagctgcagcagcgcgcatattacagagcccgacaggatgctgcatcccagccagggctgggcttcctgatttccccctcaagttgttcctcctgggggccagggtcatttacaaggtcgtgtggttatcctactctctgcagttcatggatcagtaaaagggagccaggggaactctctggcgtgtggacgagcgcttggcgaacccacgccgctttcacaggatcccaggacctgtgtctgtacaaaggtctcgggtctatatacgaagacaaaactgcattgagcctactcggattaggtgaagaaacgaatgaggaagacgaagaagagtctgataatcagagtgtgcatagctccagtgaacccttgcggaacctccatttggacatcggtgccctgggcggggattttgagtacgaggagtccctgcgcacaagccagcctgaagaaaagaaggacgtcagcctcgattccgacgctgctggcccgcccaccccctgcaagcccagctctcctggggcggactcgtctctgtcttccgccgtggggaagggtcgccagggctcaggtgctcgtccaggcctgccagaaaaagaagagaacgagaaaagcgaaccaaaaatctgtaggaacctggtgacccccaaagccgaccccaccggctctgagcctgccaaagcgtctgagaaagaggccccggaagatactgtggacgccggcgaagaagggagtcgaagagaggaagccgccaaggagcctaaaaaaaaagcctctgcactagaggagggcagcagcgatgctagtcaggaactggagatcagcgagcacatgaaggagccccagctctccgacagcatcgcctccgatcctaagtccttccacggcttagattttggatttcgaagccgaattagcgaacatcttcttgacgtggacgtgctaagcccagtgttgggaggagcatgtcggcaggcacagcaaccgctgggaatcgaggataaggacgatagccagagtagtcaggatgaactccagtctaaacagtctaaaggactggaagagcgctatcaccggctgtcaccgccactgccccatgaagaacgggcacagagtcctcctcggagcctcgctactgaggaggaaccacctcagggtccagagggtcagcccgagtggaaggaagcagaggagctgggggaagattccgccgcttctttaagcctgcaactaagtttacaacgcaggtcaacagaacccgttgctcctcctgaacaactgtcagaggctgcattgaaggcgatggaggaggccgtggcgcaagttcttgagcaggaccagcgacatcttctggagagcaaacaggaaaagatgcagcaactaagggaaaagctatgtcaggaagaagaagaggaaatcctgaggctgcatcagcaaaaagaacagtccctgtcttccctgagagagagactgcagaaagcaatagaggaagaggaagcccgcatgcgagaagaggaaagccagcgcctttcttggctccgcgcacaggtacagagtagtactcaggctgatgaggatcagatccgcgccgagcaggaggccagcctacagaaactccgggaagaactcgaatcacagcagaaagctgaaagagccagcttggaacaaaagaatcgccagatgctcgaacagctcaaggaggaaatcgaggcttctgaaaaaagcgaacaggcggcactgaacgccgccaaggagaaggcactccagcagctcagagagcagctcgaaggagaaaggaaagaggccgtcgcaaccctggagaaagagcactcagcagagctggagagactatgcagcagcctcgaggctaagcatcgagaagtagtatccagcctgcagaagaagatccaggaggcccaacaaaaagaagaggcacagctgcaaaagtgtctagggcaggtggaacatagggttcaccagaagagttaccatgtggctggttacgagcatgaactgtcttccctcctgcgcgaaaagcggcaagaagttgaaggcgagcacgagcgtcgcctggataaaatgaaagaggaacatcaacaggttatggcaaaagcccgggaacagtatgaggccgaagagaggaagcaacgcgccgagctgctaggacacctgaccggcgagctggagcgtctgcagagggctcacgagcgggagctggaaaccgttcgccaggagcagcacaagcgattggaagacttgaggcgacgtcaccgtgagcaggaacgcaaacttcaggacctcgagttggacttggagaccagggccaaggatgttaaggcaaggctggccctgctggaagtacaagtccgcgacctccaagaatcccttacgtctgaaagttag

SEQ ID NO: 24534 - DNA, 1053 bp, Artificial Sequence
  Description of Artificial Sequence: Synthetic coding sequence
atgatccggggcttcgaggcccccatggccgagaaccccccccccccgcctccacccgtcattttttgtcacgactcccccaaaagagtcctagtgagtgtgatccgcactaccccaatcaagccaacttgcgggggcggcggggaacccgaacctcccccaccactaattcctacttccccaggcttctccgactttatggtctacccatggcggtggggagagaacgcacacaacgtcactctcagccctggcgccgccggagcagcagcgtccgcagctttgcccgctgccgcagccgccgagcactcgggcttgcgcggtaggggagcaccgccccccgcggctagcgcatctgctgcagcttcaggaggggaggacgaagaggaggcctcgagccctgacagcggtcatcttaaagacgggatccgccgtggccgccctcgagccgataccgtccgggatcttataaatgagggagagcattcgtcaagcaggatacggtgcaatatctgcaatagagtattcccccgagagaaatccttgcaggctcacaaaaggacccatacgggcgagagaccctacttgtgtgactacccggattgtggaaaggctttcgtgcagagtggtcagcttaagacccatcagcgcctgcatactggcgaaaaaccctttgtgtgttctgagaacggctgcctatcacgatttacccatgcgaaccggcattgccccaagcatccctacgcgaggctcaaaagagaagagcctacggacactctatccaagcaccaggccgctgataacaaagcggcagccgaatggcttgcaagatactgggaaatgcgggagcagaggactcccacactgaagggcaagttagttcagaaagcagaccaggagcagcaagaccccctggaatatctgcagagtgacgaggaggacgatgaaaaaaggggcgcccagaggaggcttcaggaacagcgggaacggttacacggcgccctggccttgatcgagctggctaatctgacaggggcccctttgcgtcagtag

SEQ ID NO: 24535 - DNA, 1137 bp, Artificial Sequence
  Description of Artificial Sequence: Synthetic coding sequence
atgaacatgatctggcggaacagcatcagctgcctgcggctgggcaaggtgccgcatcgctaccagagtggctatcacccagttgcacctttaggctcccgcatccttacagatcccgctaaagtgtttgaacataacatgtgggatcatatgcagtggtccaaggaggaagaggctgccgcccgtaaaaaggtgaaggagaacagcgctgtgagagttttactggaggaacaagtaaaatatgaaagggaggcctctaagtactgggatacattctataagatccataaaaataaatttttcaaagaccgcaactggttgcttagggagttcccagaaatcctgcccgtcgatcaaaagcccgaagaaaaggctcgcgagtcgagctgggaccacgtcaagactagcgccactaacagattttcacgaatgcactgccctactgtgcccgacgagaagaaccactatgaaaagagctcagggagctctgagggccaaagcaaaaccgagtccgacttttccaacctggattccgaaaaacacaagaaggggcctatggagactggcttgtttcccgggtctaacgcgacattcagaatactggaagtcggctgcggagcaggtaactcagtctttcccattttaaataccttggaaaacagtccagagtcttttttatactgttgcgacttcgcctcaggagccgtggagctagtaaagtctcactcttcctacagagcaacccagtgtttcgcttttgtccacgatgtgtgcgatgatggcctgccctaccccttcccggatgggatccttgacgtcatcttgctggttttcgtgctttcatccatccaccccgatcgcatgcagggggttgtgaaccggctgagcaagctcctcaagcctggcgggatgctcctctttcgggactatgggcgttacgacaaaactcagctgaggttcaagaaggggcattgccttagcgaaaacttttatgtacgtggtgacgggactcgcgcttacttctttaccaagggagaagttcactctatgttctgcaaggcgagtctggatgaaaagcagaaccttgttgataggcgcctccaggtgaatcgaaagaagcaggtcaaaatgcactag

SEQ ID NO: 24536 - DNA, 1797 bp, Artificial Sequence
  Description of Artificial Sequence: Synthetic coding sequence
atgggcctgcgggccagccggcccagcaagctgacctggaagaagtgggccaccaccgcggcgtcaaactcctgctcccgctccgtttcgtcatgtcgtaggtgtactggtggccgcctcatgaaggaaccctggcggcggccttcctcttctatttgctacacctccagaagttccacaatcaagttctcttcaaataagtttaaaacgctgtcggtgctcctgagccacttgcacctcttccggctccatgttaaaatttcacagccttcactgccaatcagcagccgtggcgcagcatcatccagccaatttcagggcctccccagcagatcagcgatttttcagcagcagcccgagaactgcagttctcccccaaatgtggccctcacatgcctgggcatgcagcagcctgcccagtcccagcaggtgaccatccaggtgcaggaaccggtagacatgctgtcaaatatgcctggtaccgcagccgggtcctccggcaggggcatttccataagtccgtcggcaggacagatgcaaatgcaacaccggacaaacctgatggccactttgtcctacgggcaccgcccgttgtcaaagcagctgagcgctgattcagcggaggcccactctgcccaccagcaacccccccactataccacaagcgccttgcagcaggcactgctgagccccaccccacctgactacacgagacaccaacaggtgccacacattcttcagggacttctgagtcccaggcactcacttacaggtcattcagatattcgcctccccccaacagaattcgcccagctcattaaacgccagcagcagcagcgccagcaacaacagcaacagcagcaacaacaggaataccaggaactgttccggcatatgaaccagggggacgccggaagcttagccccgtctctcggaggacagagtatgacggagcgacaggccctcagttaccaaaacgccgattcctatcaccatcatacgagccctcagcacttgctgcagattcgggcacaggaatgtgtctcccaggcctcctctcccacaccccctcatggctacgctcaccagcctgcactaatgcacagcgagtctatggaggaagattgttcttgcgagggcgcaaaagacgggttccaagattcgaagtcttcctcaaccctgaccaagggctgtcacgattctcctttgctgttgagcactggcggtcccggggaccctgagtccctgctgggcacggtttcacacgcacaagagttaggcattcacccttatggacaccagcctacagctgctttcagcaagaataaagtgccgtctagggaacctgtcatcggcaactgcatggacagatcaagccccggtcaagcggtggagctgcctgatcataacgggctagggtatcccgcgcggccttcggtgcacgaacatcaccggccccgcgctctgcagcgacatcacaccatacagaacagtgatgacgcttatgtccagttagacaatctgccaggaatgtcactggttgctggcaaagcactgtcaagcgcacggatgagcgatgcagtcttgagtcagtcaagcttaatgggcagccagcagtttcaggacggagagaatgaggagtgcggcgcgtccctaggcgggcatgagcaccctgacctgtcagacgggagtcagcacctgaacagttcctgctatccgtctacatgcattacagacatccttttaagttacaagcatccggaagtatccttctcaatggagcaggccggtgtgtag

SEQ ID NO: 24537 - DNA, 3966 bp, Artificial Sequence
  Description of Artificial Sequence: Synthetic coding sequence
atggccgccgccgccgccagcggcgccggcggcgccgccggcgccggcaccggcggcgccggcccagccggccgacttcttcctcctcctgctcctggctctcctgcagctcctgccgccgtaagtccagcggcaggccagcctagacctcctgcaccggcgagcagaggacccatgcccgcaaggattggatattacgagatcgataggaccattggaaagggtaatttcgcggtggtcaaacgcgccacccacttggtgactaaggccaaagtagccatcaaaatcatcgacaagacgcagctggatgaagaaaacctcaagaagatctttcgagaggtgcagattatgaaaatgctgtgccacccccatattataagattgtatcaggtgatggagaccgagagaatgatttacttggtgacagagtacgcgtcaggcggggagatctttgaccacctggtagctcatggcagaatggccgaaaaagaagccaggcgcaaattcaagcagatcgtcaccgccgtgtacttttgtcactgccggaacatcgtacatcgcgacctgaaggccgaaaatctgttgctggatgctaacctgaacatcaaaatcgcagatttcgggttttcaaacctgtttactccaggccagctgctcaaaacatggtgcggaagtccaccttatgccgccccagaactgtttgagggtaaagaatatgatgggcctaaggtggatatatggtccttaggcgtggtgctgtatgtcctggtgtgtggcgccctcccattcgacggctccaccttgcagaatctcagagccagagttctgtccggcaagttccggattcccttttttatgagcaccgaatgtgagcacctgattaggcatatgctcgtcctcgatcccaacaagagactaagtatggaacaaatctgtaagcataagtggatgaagctgggggatgccgacccaaacttcgacaggctcatcgcggaatgtcaacagctgaaagaggaacggcaggtcgatcccctcaacgaggatgtccttttggctatggaggatatgggtctggataaagagcagactctacaaagcctgagaagcgatgcgtacgaccactacagcgccatctacagtctactgtgcgatcggcacaaacgtcataagactttgagactgggggccttgccgtcaatgcctagagcgctggcctttcaggcacctgtcaacattcaggctgagcaggccggaacagctatgaacataagcgtcccccaagtgcagctgattaaccccgaaaatcagatcgtggagcctgatggcacactcaacctcgattcagacgaaggggaggagcctagtcctgaggcactcgtacgctacctctccatgagaagacatacagtgggtgtcgccgacccgcgaactgaggtgatggaggacctgcaaaaattgctaccgggattccccggggtgaacccccaggcacccttcctgcaggtggcaccaaacgtaaactttatgcataacttgctgcctatgcagaacctgcaacccactgggcagctcgaatataaggagcagtctctgctacagccccctacattgcaactgctgaacggtatgggaccccttgggagacgggcgagcgatggaggagctaacattcaactgcatgcacaacagctgctcaagaggcccagggggccctctccactggtcaccatgacccctgccgtacccgcagttactcccgtggatgaagagtcaagcgatggcgagcccgaccaggaggcagtccagtctagcacatataaagactccaataccttgcaccttccaacagagaggttttcacccgtgaggcgcttttctgacggagctgcatccatacaagcattcaaggcccacctggaaaagatgggtaacaattcatcaattaaacagctgcagcaagagtgcgaacagctgcagaagatgtatggggggcagattgacgaaaggacactcgagaagacacagcagcagcatatgctgtatcagcaggagcagcatcatcagatcctccagcagcagattcaggattcaatatgtcctccacagccttcaccacctcttcaggctgcgtgtgagaatcagccagctctgctgactcaccagctgcaaagattaaggatccagccctcgtcccctcctccaaatcacccaaataatcacctgttcaggcagccatccaattcgcccccccctatgagctctgcgatgatacagccacacggagcggcaagctcttcacagtttcagggtctgccttcaaggagcgccatcttccagcaacagcctgagaactgctcaagcccccccaacgtcgcgctcacatgtctgggcatgcagcagccagcacaatctcagcaggtaacaattcaagtccaggagcccgtggatatgttgagtaacatgccaggaactgccgcaggatcatccggtagagggattagtataagcccaagcgccggccagatgcaaatgcaacaccggacaaacctgatggccactcttagctacggccatcgcccactcagtaaacaactttcagcagactccgctgaggcacattcactgaacgtgaaccgattctcccccgccaattacgatcaggcccatttacacccccacctcttttctgatcagtctaggggatcaccttcttcttattcccccagcacaggtgtgggcttctcacctactcaggcccttaaggtgccacctttagatcaattcccaaccttccctccatcagcgcaccaacagcccccccattacacaacctctgctctccagcaagctctgttgagtcctactccccccgattacacacgccaccaacaggtccctcatattctccaaggcctgctcagcccccgacattccctgactgggcactcagacatcagactgcctcccacggaattcgcacagctgatcaagaggcaacagcagcaaaggcagcagcaacagcagcaacagcagcagcaggaataccaggaactctttcggcacatgaaccagggagacgctgggtcactcgcaccatcactcggaggccaaagcatgacagaacgacaggcgctttcttaccagaacgccgacagctatcatcaccacacctctccgcaacatttgctgcagattagggcacaggagtgcgtgagtcaggcatcaagccctaccccaccacacggatacgcccaccaaccggctctgatgcactccgagagcatggaggaagattgttcatgtgagggtgctaaggacggttttcaggactcgaagagttcctccacattgaccaaaggttgccacgattcaccactgctgctcagcactggggggccaggggaccccgagtccctccttggcactgtgagtcacgctcaggagctgggcatacatccttatggacatcagcccactgcagcgttttcgaaaaataaggtccctagcagggagcctgtgattggcaactgtatggaccgaagctcaccgggacaggctgttgaactcccagatcataacgggctgggttaccccgcccgaccctctgtacatgaacaccaccgcccccgcgctctgcagagacatcacaccattcagaattccgatgacgcctacgtacagctggataacttgcctggaatgagcctggtcgccggaaaagccctgagctccgccagaatgagcgacgctgtgttgtcccagagcagcctgatgggatcacaacaattccaggatggcgagaatgaggagtgtggcgccagcctgggcgggcacgaacatcctgacctctccgacggctcccagcacttgaattccagctgttatcccagcacgtgcatcaccgacattctgctgtcctataagcatcctgaagtctcattctccatggagcaagctggcgtgtag

SEQ ID NO: 24538 - DNA, 1569 bp, Artificial Sequence
  Description of Artificial Sequence: Synthetic coding sequence
atgccccggaagaaggccgccgccgccgcctgggaggagcccagcagtggcaatggtacggccagagcaggacccaggaaaagggggggtcccgcaggaaggaagcgtgagcggccagagcgatgcagttctagctccggcggcggctcatccggagatgaagacggactcgaacttgacggcgcaccagggggtggaaaaagagccgcgagaccggccaccgctggtaaggctggtggcgccgcagtcgtaatcacggagcccgagcacaccaaggaaagggtgaagctcgaaggctctaaatgcaaaggccagctgcttatcttcggggccaccaactgggatctaatcggacgcaaagaagtgccaaagcagcaagccgcgtacaggaacctgggccagaatctgtggggaccccatcgttacggatgtttagctggagtgcgggtgagaacggttgtgagtgggtcttgcgcagcacactccctcctgattactacagaaggtaagctgtggagttggggaaggaacgaaaaaggacagctggggcatggagatactaaacgggtggaggcccctcgactgattgagggcctgtctcatgaagtgattgtgtctgccgcatgcggccgcaatcatacactcgcccttacagagacaggctcagtgtttgcattcggggagaataaaatggggcaactcgggctgggcaaccagactgacgccgtcccatccccagctcagattatgtataatggtcagccaatcaccaagatggcatgcggtgcagaatttagtatgattatggactgtaagggtaatttgtactcctttggatgtccagagtacggtcaacttggacacaatagcgatgggaaattcatagctagagcccagcgcatcgagtacgactgtgagctcgtcccgcgacgcgtggcaatcttcatcgaaaaaacgaaggatgggcagatcctgcctgtccccaacgtggtggtccgggatgtcgcctgcggagctaatcatacccttgtcttagactcacagaagcgggtcttcagctggggcttcggcggctacggcagacttggccacgcagaacagaaggacgagatggtgcccagactggtgaagctattcgacttcccgggccggggggcctcccaaatttacgccggctacacctgcagttttgcagtctctgaggttggcggccttttcttctggggtgctacaaacacatctcgcgaaagtacgatgtaccccaaggctgtgcaggacttatgcggctggcgcataagatctcttgcttgcgggaagagcagcattatagtggcagcagacgagagcacaatcagttggggaccttcgccaacttttggggagctagggtatggtgaccacaaaccaaagagcagcaccgccgcacaggaagtcaaaacccttgatggaatcttctcagagcaggtggccatggggtattcacattcccttgtcatagcccgagatgaaagcgagacagaaaaggaaaaaatcaaaaaattaccagagtacaatcctcgcactctgtag

SEQ ID NO: 24539 - DNA, 1569 bp, Artificial Sequence
  Description of Artificial Sequence: Synthetic coding sequence
atgccccggaagaaggccgccgccgccgcctgggaggagcccagcagcggaaacggcactgcccgcgcagggcccaggaaaagaggaggcccagcgggaagaaaacgcgagcgacccgagaggtgttcaagcagctcgggcggcggaagcagcggagatgaggatgggctcgagctggatggagcacccggtggtggtaaacgggcagctcgacctgcgaccgctggtaaggcaggcggcgcagcagttgtgattaccgagcctgagcacacaaaagaaagggttaaactggagggctctaaatgtaaggggcagttactcatcttcggcgccacaaattgggacctcatcggccgcaaggaggtgccaaagcagcaggccgcttataggaacttagggcagaatctgtggggaccccaccgatacggatgcctggcgggggtgagagtccgcactgtggtatcaggatcctgcgccgcacatagcttgctcatcacaacagaggggaaactgtggtcatggggtcgcaacgagaagggccaacttgggcatggcgacacaaagagagtcgaggccccaagactgattgagggactgtcccacgaggtgatcgtttctgctgcctgcggtagaaaccacaccctcgccttaacagagactggttcggtatttgcattcggggaaaataaaatggggcaactggggctgggtaatcagacggatgcagtgcctagccccgcccagatcatgtacaatgggcagcccatcactaagatggcttgtggcgcggaattttccatgataatggactgtaaagggaacctttacagcttcggatgcccagaatatgggcagctgggacacaattctgacggaaagtttatcgctcgcgcccaacgaatcgagtatgactgcgaactcgtgccccggcgcgtggcaatattcattgaaaagacaaaggacgggcagatattgcctgtgccaaatgtcgtggtgagagacgtcgcctgcggcgcaaaccatacactcgtgttagacagtcaaaaaagagtctttagctggggctttggtgggtacgggagactcggacatgcagagcaaaaagacgagatggtccctcgattagtaaagttgtttgatttccccggtcgtggggccagccaaatttatgccggctacacatgctcattcgccgtgtcagaggttgggggactctttttctggggtgccacaaacaccagtagagaatcaacaatgtaccctaaagcggtgcaggatttatgcgggtggcgaattagaagcctggcctgtgggaaaagttctatcatcgttgccgccgatgaatctactattagctggggacccagccccactttcggagagctgggctatggcgaccacaagccgaaaagcagcacagcggcccaggaggtgaaaaccctggacggaattttctctgaacaggtcgccatgggctactcccattcattggtcatcgcaagggatgaaagtgagacggagaaggagaaaatcaaaaaactccccgagtataaccctcgcaccctgtag

SEQ ID NO: 24540 - DNA, 552 bp, Artificial Sequence
  Description of Artificial Sequence: Synthetic coding sequence
atgaccgaccagacctactgcgaccggctggtgcaggacaccccctttctcacaggacacgggcggctatccgagcaacaggtcgataggataattctgcaactcaataggtactatccacagatattgacgaataaggaagcagagaaattccgtaacccgaaagcatctctcagggttcggttgtgcgacctgctgagccatctccagcgctccggagagagagattgtcaagagttttatagggctttgtatatccacgcacaaccactccacagccggctcccctctcgccacgccctgcagaactcagattgcaccgaattggactccgggtcacagagcggagagctttctaacaggggtcctatgagttttctcgccgggctaggattggcagtcgggctcgcgctccttctctattgctaccctcccgatccaaagggacttcccggcacgcgccgcgtgctgggattctctcccgtgatcatcgaccgtcatgtttcccgctatttactagcgttcctggctgacgacctcggaggcctttag

SEQ ID NO: 24541 - DNA, 492 bp, Artificial Sequence
  Description of Artificial Sequence: Synthetic coding sequence
atgctggacctgctggacatcgagggcctgtaccccctgtacaaccgggtggagagatatttggaagagttcccagaggagcgcaagacactgcagattgacggaccatatgacgaggcattttaccaaaagttgctggacctgagcacagaggatgacggaacagtggctttcgccctgaccaaggtgcagcagtaccgagtcgcgatgactgccaaagattgtagtattatgatcgcactgagcccttgtctccaggatgccagctccgaccaacggccggtggtgccgtcctctcgatcccgattcgccttcagtgtgtcagtgctggatctcgatcttaaaccatatgaatctattccacaccaatacaagctggacgggaaaatcgtgaactactatagtaagactgtgcgggccaaagacaatgccgtcatgtctacccggtttaaagagtccgaggactgcacgttagttttgcataaggtgtag

SEQ ID NO: 24542 - DNA, 777 bp, Artificial Sequence
  Description of Artificial Sequence: Synthetic coding sequence
atggcccggccccccgtgcccggcagcgtggtggtgcccaactggcatgagagcgcagagggcaaagagtacctcgcttgcatcttaaggaaaaacaggcgcagggtctttggtctgctggaacggcctgtactgttgccacctgtgagtattgacacagcatcatacaaaatcttcgtatctggaaagtccggcgtgggtaagaccgcactcgtcgcaaagcttgccggactcgaagtgcccgtggtgcatcacgaaacaaccggcatccaaacaacagtggtgttctggcccgccaaactccaggcgtcctcccgggtggtgatgttccgatttgaattttgggactgtggagagtccgctctcaagaagtttgaccacatgctgctggcttgtatggagaataccgacgcttttctctttttgttttcttttactgatagagcgtcatttgaagatttgccgggccagctcgccagaatcgccggcgaagctccaggtgtggtgcgcatggttatagggtctaagttcgatcagtacatgcatactgacgtgcctgagagggacctgacagcattcagacaggcgtgggaactcccactgttaagggtcaaaagcgtgccggggaggcgactggcggacggacgcaccctagacggccgggccgggctggcagacgtagcccatatattaaacgggctggcggaacaattatggcaccaagatcaggtggcagccggtctgctccctaatccaccggagtctgcacctgaatag

SEQ ID NO: 24543 - DNA, 333 bp, Artificial Sequence
  Description of Artificial Sequence: Synthetic coding sequence
atggccgacaaggtgctgaaggagaagcggaagcagttcatccggtcagttggggaagggaccattaacggtctgttaggagagctgctggagacacgggtgctcagtcaggaggagattgagattgtgaagtgtgagaatgcgactgtgatggataaggcgcgagcattgcttgacagcgtgattagaaagggggcgcctgcttgtcagatttgtatcacttacatttgcgaggaagattcccacttagcaggcactctcgggctgtccgcaggacccacaagtggcaaccatttaaccacacaagattctcagatcgtgctgccgtcctag

SEQ ID NO: 24544 - DNA, 924 bp, Artificial Sequence
  Description of Artificial Sequence: Synthetic coding sequence
atggagcccagcagcctggagctgcccgccgacaccgtgcagcggatcgctgctgagctgaagtgccaccccactgacgagcgggtggcgcttcatttggatgaagaagataagctaaggcattttagggagtgtttttacatccccaagatccaggatctgcctcccgttgacctgtcactggtgaataaagatgaaaatgctatttatttcttgggtaacagccttgggcttcagccgaaaatggtgaagacttacctcgaggaagagttggataaatgggcgaaaatcgccgcgtatggccatgaggtgggcaaaaggccttggatcactggtgatgaaagtattgtggggctgatgaaggacatcgtaggtgcgaatgaaaaagagattgccctgatgaacgctttgaccgtcaatctgcacctcctgatgctttctttcttcaaaccgacgccaaaacggtacaaaatcttacttgaggcaaaggcttttccgtcagatcactacgcaatagagtcccagctgcagctgcacgggctaaatatcgaggaatcaatgcgcatgatcaaaccgcgtgagggcgaggagacactgcggatcgaagacatactcgaggtgatcgagaaagaaggcgacagcatagcagtgatcctgttcagcggggtgcatttttacaccggccagcatttcaacatcccagccatcacaaaggctgggcaagctaaggggtgttacgtagggttcgacttagcccacgctgttggcaatgtcgaattgtacctccacgactggggtgtggatttcgcctgttggtgtagctataagtatctaaacgcaggtgcgggcggcatcgccggcgcgtttattcacgagaagcatgctcacacaatcaaacctgcgcgtagtgaatttttcaactag

SEQ ID NO: 24545 - DNA, 3060 bp, Artificial Sequence
  Description of Artificial Sequence: Synthetic coding sequence
atggagcccggcgaggtgaaggaccggatcctggagaacatcagcctgtcagtgaagaaactgcaaagctactttgcggcatgcgaagatgaaatccctgccatccggaatcacgacaaagtgctgcagagactgtgcgaacacttagatcatgcactcttatacggactccaggacctgagcagcggctattgggtgctcgttgtgcacttcacccgccgggaggccattaaacagatcgaagtgttacagcatgtggccaccaacctgggcagaagccgcgcttggctatatctggccctaaatgagaattcactcgaatcttacctgcgcctgttccaagagaatctgggattactccataagtattacgtaaagaatgctttggtttgctcgcatgaccacctgactctctttttgactctcgtgtccggattggagttcattaggttcgaattagacctcgacgctccttacctggacctggccccatacatgcccgattattacaagccacaatacctgctggatttcgaggaccgcctaccatcttccgtgcatggaagcgactcactgagcctgaacagtttcaattccgtcacatcaaccaacctggagtgggatgattctgcgatagccccgtcctctgaagactacgactttggcgacgttttcccagcagtgcccagcgtgccaagtacggactgggaggatggagatctgaccgacaccgtatccggtccacgctcaacagcttccgacctgacgtctagcaaagctagtactcggagtcccacacaacggcaaaatccctttaacgaggagccagcagagaccgtctcctcaagtgacaccaccccagtccataccacctcccaggaaaaggaagaagctcaggctctggatccaccagatgcctgcacggaactggaggttatcagggtcaccaaaaaaaaaaagattggcaagaaaaaaaaatccagaagtgacgaggaagcctccccgctgcatcccgcttgctctcagaaaaaatgtgctaagcagggggacggcgacagcagaaacggctctccctcactgggacgggattctcctgacactatgctggcgtcacctcaggaagagggggagggtccttcaagtaccacagagtctagcgaacgctccgaaccaggcctgctgattcccgagatgaaggatacttctatggaaagactcggacagcctctctctaaggtgatcgaccagctgaatggccaactggacccttctacgtggtgttcccgtgccgagccgcccgatcaaagcttccggactgggtctccgggggacgcccccgagcgccctcccctgtgtgactttagcgagggactgtccgcaccgatggacttttaccgctttactgttgagagcccctccaccgttacatctgggggggggcatcacgacccagccgggttgggccagcctctgcatgtgccaagctcccctgaagccgctggacaggaggaggaagggggtggaggagaaggacaaaccccgagacctctggaggacaccacaagagaggcacaagaactcgaggcacagctgagtcttgttagagaagggcccgtatcagagcctgagcccggcacacaagaagtcctttgccaactcaaacgtgaccagccttcaccttgtctgagttctgccgaggattcaggcgtcgacgaaggacagggatccccttccgagatggtgcactcctctgagttcagagtggataacaatcacctactactcctaatgattcatgtttttagggagaatgaggagcagttgtttaagatgatcaggatgtcaaccggtcatatggagggaaatctgcaactgctgtatgtgcttctgacggactgttacgtgtacctgctgaggaagggtgcaacagaaaagccatacctggtggaagaggcagtgagctacaatgaactcgattatgttagtgtcggcttggaccagcagactgtgaagctggtatgcaccaaccgtcgaaagcagtttctgcttgataccgccgatgtcgccttggccgagttttttctcgcttcactgaagagtgcaatgataaaaggctgtagagagcccccctacccctcgatccttaccgatgccaccatggagaagctggccctggctaagttcgtagctcaggaatccaaatgcgaggcttctgccgtaaccgttcgcttttacggactagtacactgggaggatccaacagacgagtccttgggaccaaccccctgtcactgttccccccctgaaggcaccattaccaaggaaggtatgctgcactacaaggctgggaccagctatctgggcaaggagcactggaagacttgctttgtggtcctgtctaatggaatcctatatcagtacccagatcgcaccgacgtgattcccttgttgagtgtaaacatgggcggcgagcagtgcggagggtgtcgcagagcaaacaccaccgacaggccccatgccttccaggttattctgtcggacaggccgtgtctggagctctcggccgagagcgaagcagagatggccgaatggatgcagcacctttgccaggctgtttctaaaggggtgatacctcagggcgtggccccttctccttgcattccttgttgtctggtcctcacagacgatcggctttttacttgtcacgaggattgccagactagttttttccgttctctgggtaccgccaaactgggagacatatcagccgtgagcacggaacctgggaaggaatattgcgttctggaattcagtcaggacagccaacagcttctcccaccgtgggtcatctatcttagttgtacctctgaattggaccgccttctgtccgcactcaattcgggctggaaaaccatttaccaggtagacttgcctcacacggccatccaggaagcctctaacaagaagaaatttgaagatgcattgtccttaattcatagcgcctggcagcgttccgattccctgtgccgtggccgcgcctcacgtgatccctggtgctag

SEQ ID NO: 24546 - DNA, 318 bp, Artificial Sequence
  Description of Artificial Sequence: Synthetic coding sequence
atgaagcccttcgaggacgccctgaagaaccagcccctgggccccgtgctgtccaaggctgccagcgtcgagtgcataagcccagtgtccccccgggctcctgatgccaaaatgctggaggagttgcaggcagagacatggtaccaaggggagatgtcccgcaaagaggcagaaggactgttggagaaagatggcgattttctcgtgagaaaaagcaccactaatccaggcagttttgtgttgacgggcatgcacaatggtcaagccaagcacttgctcttagttgatcccgaaggtacccgctcaaactcatattag

SEQ ID NO: 24547 - DNA, 318 bp, Artificial Sequence
  Description of Artificial Sequence: Synthetic coding sequence
atgaagcccttcgaggacgccctgaagaaccagcccctgggccccgtgctgtctaaggcagcatcggtcgagtgcatcagccctgtctccccaagagcaccagatgccaagatgttggaagagctacaggctgaaacttggtaccaaggggagatgtctcgcaaagaggcggagggcctgctcgagaaagacggtgacttccttgtgcggaagtcaacaactaatcctggcagctttgtgttaaccggtatgcacaatggtcaggccaagcacctgctcctcgtggacccagagggcacaagatctaattcttattag

SEQ ID NO: 24548 - DNA, 1785 bp, Artificial Sequence
  Description of Artificial Sequence: Synthetic coding sequence
atgctgccccggaccaagtacaaccggttccggaacgacagcgtgacaagtgtagacgatctgctccacagtctgtcggtgagcgggggcgggggcaaagtttcagcagctagggcaactcctgccgcggctccgtatttggtaagtggcgaggctctccggaaggcacccgatgatggtcccggctcactgggccatctactgcataaggtgtcccacttgaaactgagctcctcaggcttaagagggctctcctcagccgcccgagagcgggcgggtgccaggctgtctggatcttgctccgcgccaagtctcgcagctcctgacggcagcgctccgagcgccccacgtgctcccgccatgagtgccgcccgcaaagggagacctggagacgagccgctgccgaggcccccaagaggagcacctcacgcatcagatcaagtcttggggcccggagttacctatgttgtcaaataccttgggtgcattgaggtgcttcgaagcatgcgcagtcttgacttttcaaccaggacacagattacgcgcgaagcaatttctagagtctgtgaggcggtgccgggagccaagggggcatttaaaaagcggaagccaccgtcaaagatgctgagcagcatattggggaagagtaacctgcagttcgctggcatgagtatctcccttactatcagcactgcaagcttgaacctacggacaccggattcaaaacaaataatcgctaaccaccacatgcggtcaatctctttcgcctctgggggtgatcccgacaccacagactacgtggcatacgtcgcaaaagatcccgttaaccgcagggcatgtcatatcctggagtgctgtgatggactggctcaggatgtgattggatctattggtcaggcttttgaattgaggttcaaacagtatctgcagtgtcctacaaagatccccgcactccatgaccgcatgcagtctctggatgagccctggaccgaggaggagggggacgggagcgaccacccctactataactcgataccaagtaagatgcctccccccggaggctttctggacaccagattaaagcctcgtccacacgcgccagataccgcgcagtttgccgggaaggaacagacttattaccaaggccggcacttgggtgacacatttggcgaggactggcaacagacacccctgcgtcaggggagttcagacatctacagcacgcctgagggcaagctacacgtggcaccgaccggagaagccccgacatacgtcaacacccagcaaatccctccccaggcttggcccgcagccgtttcctccgccgagtcttcccccaggaaagacctgttcgacatgaaacctttcgaagacgctcttaaaaaccagccccttggtcccgtcttatcgaaggctgctagcgttgaatgtatctcaccagtgtcccctcgggcccctgacgcgaagatgctcgaggagctgcaggccgaaacctggtaccagggcgagatgtcccgtaaagaagcagagggactactcgaaaaggacggggatttcctggtaaggaagtccactaccaatcccggaagttttgtcctcactggaatgcacaatggtcaggccaagcatttgctgctcgtggaccccgagggaacaattcggactaaggatcgggtttttgacagcatttcgcatctgataaaccaccaccttgaaagctctctgcctattgtctctgccgggtccgagctttgcctgcagcagcctgtcgaaagaaagcaatag

SEQ ID NO: 24549 - DNA, 693 bp, Artificial Sequence
  Description of Artificial Sequence: Synthetic coding sequence
atgaacaccctgatggacgtgctgcggcaccggcccggctgggtggaggttaaggatgagggagagtgggacttctattggtgcgacgtttcatggttgagggagaattttgatcatacctatatggacgagcatgtgaggattagtcatttccggaatcactatgaactcactagaaaaaattacatggtgaaaaacttaaaaagattcaggaagcagctggagagagaagccggaaaattagaggctgccaagtgcgatttcttcccaaaaacatttgaaatgccatgcgaatatcatctcttcgtcgaggagttcagaaaaaacccaggaatcacgtggattatgaagcccgacacccggtctagcgatgaccagaaggatgacatcccagtggagaattacgtcgcacagcggtatattgagaacccgtatcttatcgggggccgaaagtttgatttaagagtctacgtcctcgttatgagctatatccccctccgcgcatggctgtatcgcgatggctttgcccgtttctcgaacacaagattcacgctcaacagtatcgacgaccagtacgtacatttgacgaatgttgcggtccagaagactagcccggactatcatcccaaaaaagtggcgcctggaggacagtgtgtgcccattactgacagccagcagcccggaaggctgtag

SEQ ID NO: 24550 - DNA, 1068 bp, Artificial Sequence
  Description of Artificial Sequence: Synthetic coding sequence
atgaacaccctgatggacgtgctgcggcaccggcccggctgggtggaagtgaaagacgaaggagaatgggacttctattggtgcgatgtgagctggctgcgggagaatttcgaccacacctacatggatgagcatgtgaggatctcacactttcgcaatcattacgaactgacccggaagaactacatggtgaaaaacctgaagagattccgaaagcagctggaacgggaggccggcaaactcgaagcagctaagtgcgatttcttccctaaaacattcgagatgccctgcgaataccatctgtttgttgaagagtttcgtaagaacccgggaatcacttggatcatgaagcccgatacaaggtcttctgatgaccagaaagacgacattccggttgagaactacgttgcccagcgatatatcgagaatccgtacctaataggagggaggaagttcgatctgcgggtgtacgttctggtcatgagctatattcccctccgtgcttggctgtatcgagatgggttcgctcgctttagcaacacacggttcacactgaatagtatcgatgaccagtacgtccatctcacgaacgttgcagttcagaagacaagcccagattatcaccccaagaagggatgtaaatggaccctgcaaagattccgccagtatttggccagcaagcacggaccagaagccgtggaaactctattccgggacatagataatattttcgtgaaaagcttgcagtctgtgcaaaaagtgatcatcagcgataaacattgctttgagctctacgggtatgatatcttgattgaccaggatttgaaaccatggcttctggaggtcaatgcttccccatcgttaaccgcgtcgtcccaggaggattacgaacttaagacctgcctccttgaagatacactccatgtcgttgacatggaggcacgcctgcgtcagcggagcgaggagacaaccgaagctgccctgctgctgccaagttcctcagaggaatcttttcaattaattccctcctgccaagaggaaatcagcctctcccgcccttgcgtctag

SEQ ID NO: 24551 - DNA, 840 bp, Artificial Sequence
  Description of Artificial Sequence: Synthetic coding sequence
atgagccggcccaagaaccagaactacaagggccacggcctgagcaaaggaaaagagcgggagcagcgggcatcaataagattcaaaacaacacttatgaacaccctgatggatgtcttaagacatcgaccgggctgggtggaggtgaaggatgagggcgaatgggatttttattggtgcgacgtgtcttggctccgcgagaattttgatcacacatacatggatgagcacgtgaggatttctcattttaggaatcattatgaacttacccgcaagaactatatggtgaagaatctcaaacgatttcgtaagcagctggagcgtgaggctgggaaactggaagcggctaaatgcgactttttccctaaaacctttgaaatgccctgcgagtaccacctattcgtggaggagttcagaaagaacccaggcattacgtggataatgaagccggttgcccggtcccagggaaaaggaatttttctcttccgccgcctaaaggacatagtggactggcgaaaggacacccgtagctcagacgaccaaaaagacgacatccccgtggagaattacgtcgcccaacgttatattgaaaacccctacttgatcggaggccgaaaatttgatctccgcgtatacgtcctggtgatgagcatgttcacgtcaccaacctggctgtgcaaaaagcatttgcctaccacaactcagaggagagcggcttctggaaggtgctcagcttctggctccacctggagacctaatacggggcccaggcagtggcgacattcttccggaacatcaactacttctctgagcaaagcctgccgtgtgtgccgacgatag

SEQ ID NO: 24552 - DNA, 1116 bp, Artificial Sequence
  Description of Artificial Sequence: Synthetic coding sequence
atgagccggcccaagaaccagaactacaagggccacggcctgagcaaaggcaaagagagggaacaaagggcctccattaggtttaaaaccaccctcatgaacactctgatggacgtgctgcgacatagacccggttgggtggaggtgaaagatgaaggggagtgggacttttattggtgtgacgttagctggctacgagagaacctggaaagggaggcaggtaagcttgaggctgctaagtgcgatttctttcccaaaacgtttgagatgccatgtgaataccacctgttcgtggaggagttccggaaaaatcctgggatcacttggatcatgaaacccgttgcgagatcacagggaaaagggatcttcctgttccgtagactcaaagacatcgtggactggcggaaggacacacgctccagtgatgatcagaaagacgacattcctgtagaaaactacgtggctcagcgctacattgaaaatccttacctaatcgggggccggaagttcgacttgcgcgtgtatgtcctggtaatgagctatatcccattgcgtgcttggctctacagagatgggttcgctcgcttctctaatacccgattcactctgaattccattgatgaccagtacgtgcatttaaccaacgtggccgtgcaaaagaccagtcccgactaccatcctaagaaactacacccaaccgtaggacccctgtgcatccatagccctgaaaacggtagcttaagcgtgactccatggccttgggatgctcatatgggctgcaagtggacactccaacgattccggcagtacctggccagcaagcatggaccggaggctgtcgagacactgtttcgcgatatcgataacatcttcgtgaagagcctgcagtccgtgcagaaggtgatcatctctgataagcactgcttcgaactctatgggtacgatattctaatagaccaggatttaaagccttggctgcttgaggtcaatgctagtccatccctaaccgcgagcagccaggaggactacgagttaaaaacctgcctgctggaggacacactccacgtggtggacatggaagcatccttcagtcccatcattcccgcggaggtgtag

SEQ ID NO: 24553 - DNA, 1320 bp, Artificial Sequence
  Description of Artificial Sequence: Synthetic coding sequence
atggtgcccagccgggaggccctgctgggccccggcaccaccgccattaggtgtcccaagaagcttcaaaatcagaattataagggacacgggctgtcaaaaggcaaagagcgagaacagcgcgcctcaatcaggttcaagaccacactgatgaacactctcatggatgtgcttcgccataggccagggtgggtagaggtgaaggacgagggtgaatgggatttctactggtgtgatgtcagctggctgagagaaaatttcgatcacacctacatggatgagcatgttaggattagccactttaggaaccactatgagcttacacggaagaattacatggtcaaaaatctgaagaggtttcggaaacagctcgaacgagaggccggtaagttagaggccgctaagtgtgacttctttccaaaaacatttgagatgccctgtgaataccacctttttgtggaggaatttcggaaaaatccaggaatcacatggattatgaagcccgtggcccgatcccagggcaagggtatattcctatttcggcggctgaaagacatcgttgattggcggaaggatacaagatcctctgatgatcagaaggacgatattcctgtggagaactatgtggctcagagatatattgagaacccgtatttaattggagggcgcaaattcgatctgagggtttatgtgctcgtgatgagtgtatttgcggagtgtctcctgtggtcaggacatagaaggcaagacgtgcatttgactaatgttgccgtgcagaagacttctccagactaccacccaaaaaagggctgcaagtggaccctgcagcgattcagacagtacctggcttctaagcacgggcctgaggctgtagagactctcttccgggatatcgataacatttttgtgaaaagtttgcaatccgtccagaaagtgattataagtgacaagcactgtttcgaactgtacggctacgatattctgatcgaccaggatctgaaaccctggctcctggaagtgaacgcgtccccctctctcaccgctagctcccaggaggactatgagctcaagacatgtctgctagaggacacccttcatgtggtcgacatggaggccaggcttacaggacgggaaaagagagttggggggttcgatctgatgtggaacgatggccctgtgtcccgcgaggaaggtgcgccagacctgtctgggatgggcaatttcgtgacaaatacgcatctgggatgtgtgaatgaccgcaaaaagcagcttagacagctattttgctcactacaggttcagaagaaggcttcctcgtag

SEQ ID NO: 24554 - DNA, 501 bp, Artificial Sequence
  Description of Artificial Sequence: Synthetic coding sequence
atgaaggagatgctggccaaggacctggaggagagccagggcggcaagtcctccgaagtgctttccgcaacggaactccgggtgcagttagcccagaaggagcaggaactcgctagggcaaaggaagcattgcaggccatgaaggcagaccgtaagcgcctgaaaggcgaaaaaaccgatcttgtgagccagatgcagcaactctatgctacacttgagagccgagaggaacagcttcgtgacttcattcgtaattatgagcagcatcgcaaggagtctgaggatgccgttaaggccctcgcgaaagaaaaagacttgcttgaaagagagaagtgggaactccgtaggcaggctaaagaagcgaccgaccatgccactgctctgcgaagccagcttgatctgaaggataaccggatgaaggaactggaggctgagctagccatggccaaacagtcactggccactttgactaaggacgtcccaaagcggcacagcctctag

SEQ ID NO: 24555 - DNA, 2328 bp, Artificial Sequence
  Description of Artificial Sequence: Synthetic coding sequence
atgatggaggacaacaagcagctggccctgcggatcgacggcgccgtccaaagcgcatctcaagaggtcacaaacctgagggctgagctgaccgcaaccaaccgtcggctagccgaactaagtggcggcgggggccccgggccggggcctggcgctgccgcgagcgcctctgctgctggcgattcagccgccactaatatggaaaaccctcagctcggggctcaggtgttattgagagaagaagtgagtcgcttgcaggaggaggtccatctcttgcgccagatgaaggagatgctggcaaaagatctagaggagtcacaaggcggtaaatcctcagaggtgctctctgccaccgagctgagagttcaactcgcccagaaagagcaggagctggcacgcgccaaggaggctctgcaggccatgaaagccgaccggaagcgcctgaagggagaaaagaccgacctggtcagtcagatgcagcaactttatgccactctggagtctagagaagagcagctgcgagatttcatccgcaattacgagcagcaccggaaagaatctgaggacgcggtgaaggctcttgccaaggagaaggacctgctggaacgcgaaaagtgggaactaaggaggcaggcaaaggaagcaacagatcacgctacagcattgcgcagccagcttgatctcaaggacaaccgcatgaaagaattggaggccgaactggctatggccaagcagtcgctggccaccctgaccaaggatgtccctaaacgtcattccttggctatgcccggtgaaactgtgctaaatggaaatcaggagtgggttgttcaggcagatctcccccttacagcggccatccggcagagccagcagacactctaccactctcatccccctcatccagctgaccgccaggccgttagagtttccccctgtcacagcaggcaaccatctgtgattagcgacgccagcgccgccgaaggtgaccgaagcagtactccatctgacataaacagcccccggcatcggactcactccctctgtaatggcgactcccccgggccggtgcaaaagaacctgcacaatcctatcgtacagagtctggaagacctcgaagaccagaagaggaagaaaaaaaaggagaagatgggctttggcagcatctctcgagtatttgcccgtgggaaacagcggaaaagcctggatccaggactgtttgatgattctgactctcaatgcagtcccaccagacaatctctctctctgagcgaaggcgaagagcagatggatcggctccagcaagtggaactggtgaggactacgccaatgtcccactggaaagctgggaccgttcaagcatggcttgaggttgtaatggcaatgcccatgtacgtaaaggcatgcaccgaaaatgtaaagtctggtaaagtcctgctttctctgtcggatgaagatctgcaattaggcttaggagtgtgctcttcgctccatcgccggaagctgcggctggcgatcgaggattacagagacgccgaggctggacggtccctttccaaggcagctgagttggatcaccattgggtagcaaaggcttggctgaacgacataggtctatcacagtacagccaagcattccaaaaccatctcgtagacggaaggatgctgaacagtttgatgaaacgggacctcgaaaaacatctcaatgtgtctaaaaaatttcatcaggtgtccatcctgctgggaatcgaactgctctatcaggtcaatttttctcgagaagcattgcaggagaggagagcacggtgcgaaacccagaatattgatcctgtagtttggacgaaccagcgtgttctcaagtgggttcgtgacattgacttaaaagaatatgccgataatctcaccaacagcggggtgcatggggccgtgctggtgcttgagcccacctttaacgcagaggcaatggcgaccgctcttggcataccatctggaaagcacatactccgtcggcaccttgctgaggaaatgagtgcggtattccacccggcaaactctacgggtattcgagaagccgaacggttcggtacaccccccggccgggcttcaagcgtgacgagagccgggaaagaggaaaactcctcggggctcaagtacaaagctggaaggcttcctctaggcaagatcggacgggggttttctagtaaagaccccgatttccacgatgattatgggagccttcagaatgaggattgcggagatgatgatccccagagtcggctggagcagtgtagactggagggttacaactccctcgaagtgaccaacgtttag

SEQ ID NO: 24556 - DNA, 861 bp, Artificial Sequence
  Description of Artificial Sequence: Synthetic coding sequence
atgtacagcctggaccggatcttcgccggcttccggacccggagccaaatgctgttaggacacatagaggaacaggataaggtgctccattgtcagttcagcgataactcagatgacgaggaatcagagggccaggaaaagtctggtactagatgccggtcacggtcttggatccaaaagccagactctgtgtgttctctagtggaactctccgatacacaggatgagacccagaaatccgacctcgagaatgaggacctaaagatcgattgtctgcaggagtcacaggagctcaacctgcaaaagctgaagaactcagaaaggattcttactgaggctaaacaaaagatgagagaactgacaatcaatatcaagatgaaggaagatttgatcaaggagttgatcaagaccgggaatgacgcaaagagcgtatccaagcaatatagcttaaaggtaactaaacttgaacacgacgccgagcaggccaaagtggagctgatagagacccagaaacaacttcaggagcttgagaataaggacctgtccgacgttgctatgaaagtcaaacttcagaaagagtttaggaagaagatggatgcagccaagctccgggtgcaagtccttcaaaagaagcaacaagatagcaagaaactggcctccctatcaattcagaatgaaaagagagccaatgagttggaacaatctgttgaccatatgaaataccagaaaatacagctccagcgcaagctccgcgaggagaatgagaagcgtaaacagctcgatgccgttatcaagcgggaccagcagaaaatcaaagtgattttgtcctacatacctgctaaatacaatatgaagtgctag

SEQ ID NO: 24557 - DNA, 1662 bp, Artificial Sequence
  Description of Artificial Sequence: Synthetic coding sequence
atgaacaagaacaccagcaccgtggtgagccccagcctgctggagaaagaccctgcttttcaaatgattaccattgctaaagagactggactggggcttaaagtgctgggaggcataaataggaacgaaggtcctcttgtgtacattcaggagattatccccggcggggactgctacaaggacggacgcctcaagccaggagaccagctggtctccgttaataaagaatctatgatcggggtgagtttcgaagaagctaaaagcattatcaccggtgcaaagttgcgcctggaaagcgcctgggaaattgcctttattcggcagaagtccgacaatattcagcccgaaaatctgtcttgtacctccctgatcgaggcttccggtgagtatggtccccaggcatcaacactctcactgttttcgagccctcccgagatcctgatacctaagacaagctccactcccaagactaacaatgatattctgtccagctgtgaaatcaagacaggatacaacaagacagtccaaattccaatcacctccgagaacagcacagtgggtctgtcaaacaccgatgttgcgtccgcctggactgagaactacggcctccaggagaagatcagcctgaatccaagcgtccgatttaaagccgagaaattagagatggcattgaattatctcggaatacagcccacgaaagaacagcatcaggcactgcggcagcaggtgcaggcagacagcaagggcaccgtctcctttggggatttcgtccaggtcgcacgtaatctgttttgtcttcagctggacgaggtgaatgtgggcgctcacgaaatctccaatatcttagatagccagttactcccttgcgacagcagcgaagccgacgaaatggaacgcctgaaatgtgaacgagatgacgcgcttaaggaagtaaacacattgaaggaaaagttgcttgaaagcgataagcagcggaaacagctgaccgaggaattacagaacgtcaaacaggaagctaaggccgtcgttgaagagaccagagctttgagatctagaatccatctggccgaggctgctcagaggcaggcgcacggaatggagatggattacgaagaagttatccgcctcctcgaagcaaaaattaccgaattgaaagctcaattggccgactattctgatcagaacaaagaatccgtacaagacctcaagaaacgaataatggtgctcgattgtcagctacgtaagagcgaaatggcacggaagacattcgaggcgagcacagagaagctccttcactttgtggaggccattcaagaggttttttctgacaactccacccccctgagcaacctgtctgagagaagggctgtgctggcttcgcaaacgagcttaactcccctgggtcgaaatgggcgatccattcccgcaactctcgccctggaatccaaggaactggtgaaatccgtgcgggcactcctggacatggactgcttaccctacggttgggaggaggcctacactgccgatggaatcaaatatttcatcaaccacgttacacaaacaaccagctggattcacccggtgatgtcggtactgaatctatctaggagcgaggaaaatgaagaagattgcagccgtgagctgcccaatcagaaatcctag

SEQ ID NO: 24558 - DNA, 564 bp, Artificial Sequence
  Description of Artificial Sequence: Synthetic coding sequence
atggccgcccccggcgccctgctggtgatgggcgtgagcggcagcgggaagagcaccgttggtgccttgctagcttctgagctgggctggaagttttatgacgcagacgactatcatccagaggaaaaccggcgtaaaatggggaagggtattcccctcaatgatcaggatcgcattccctggctttgtaaccttcacgatattctgctccgcgatgtggcgagcggccaaagagtcgtcttggcctgttcggcgttaaagaaaacctatcgggacattctaacccagggcaaggatggagtagcccttaaatgcgaagaaagtgggaaggaagccaagcaggccgagatgcagctcctggtggttcacctgtctggaagttttgaggtcattagcggcagactgctgaaaagggaggggcacttcatgcctcctgaattactgcagagccagttcgaaactctagaaccccctgccgcaccagaaaacttcattcagatatccgttgataagaacgtgagcgaaattatcgctactataatggagaccctcaaaatgaaatag

SEQ ID NO: 24559 - DNA, 1134 bp, Artificial Sequence
  Description of Artificial Sequence: Synthetic coding sequence
atggccaccatccccgactggaagctgcagctgctggcccggcggcgccaggaagaagcgtctgtacgggggcgcgagaaggccgaaagagagcgtctcagtcagatgcccgcgtggaaaagaggactgctcgaaagaagacgggccaagctgggcctgtccccaggcgagccaagtcccgtgttgggtactgtggaagcaggtcctcctgatcccgatgaatctgccgtcttgctggaggccattggcccagtgcatcagaatcgattcattagacaagagagacagcaacagcagcagcagcagcagaggagtgaagaactcctggcagaacgcaagcccggtcccctggaggccagggaacgcagaccctcaccaggggaaatgcgtgaccagagccctaaaggcagggagagtagagaggagcgcctgagtcccagagagacaagagagaggcgcttgggcataggaggcgcacaggaattgagtctgcgcccactggaggcacgcgattggaggcagagtccgggggaagtcggggatcggtcatctaggcttagcgaagcttggaagtggagactgtcgcccggggaaacgccggaacgatccctccgcttagccgagagtcgggagcagtcacctcggcgcaaggaggttgagtctcgattgtcccctggcgagtctgcttatcagaaactaggtctgaccgaggcgcacaaatggagacccgacagtagagaaagccaggaacagtctttagtgcagttagaagctaccgaatggcgcctgcggtctggcgaagagcgccaggattacagcgaagaatgcggtaggaaagaagagtggcctgtgcccggcgtggcacccaaagagaccgcggagctgagcgagacactgacaagagaagctcagggaaacagttctgccggagtggaagcagctgagcaaaggcctgtggaggacggtgagcggggcatgaagccaactgaaggatggaagtggacgctgatcatgagcctggccggaaaaggcaaccagcacctggtcacgtgcttcccccatcccgtgagtggtgggcgagctaattgtccgatttctactctgatccagagcccctggtgtggttggggatag

SEQ ID NO: 24560 - DNA, 2223 bp, Artificial Sequence
  Description of Artificial Sequence: Synthetic coding sequence
atggaggccgacggcgacggcgaggagctggcccggctgcggagcgttttcgcagcttgcgacgctaaccgcagcggccgtctggaaagagaagaattccgggcactttgcaccgaactccgggtcaggcctgctgacgcagaggccgtgtttcagagactggacgccgaccgagatggggccataaccttccaagagttcgcgagagggtttctcggatccctgcgcgggggccgtcggcgcgattggggacccctcgatccagctcccgccgtctcggaggccgggcctgaaacccatgactctgaggaggacgaaggcgacgaggacgcagccgccgcccttgcaaccagttgcggccccgccagtccgggccgagcctggcaggacttccaagccaggctgggggatgaggcaaagtttattccacgcgaagagcaggtgtctacgctgtatcagaacattaacctcgtggaaccccggctgattcaaccgtatgagcacgtgatcaaaaattttatccgagagattcgattgcagtccaccgaaatggagaacctagccatcgcggtgaaacgtgcacaagataaagcggctatgcaactttcggagcttgaagaagaaatggaccagcggattcaagccgccgagcacaagacacgcaaagacgagaaacggaaggcggaagaggccctttctgacttgagacgccaatacgagacagaagtgggagacctgcaggtgactatcaagaagctgcgaaaattagaggaacaatccaagagggtttctcaaaaggaagatgtggccgcccttaagaaacaaatctacgacctgtcgatggaaaatcagaaggttaaaaaggatctcttagaagcccagacaaatattgcatttctgcagagcgagctggatgccctcaaatccgattatgcagatcagtcactgaatacagagcgcgatctggaaataattcgcgcttataccgaggatagaaattccctggagcggcagatcgaaatcctacaaactgccaacagaaagctgcatgactccaatgatggtttaagaagtgctttggagaatagctattccaagttcaatcgtagcctccacattaataatatctcaccaggcaatactatttcccgaagtagtccgaaattcatcggccacagtccacagccactgggatacgaccgaagcagcagatcttcctatgtggatgaggattgcgatagcctggccctctgtgatccactgcagaggaccaactgcgaagtcgattctctgcctgaatcctgctttgacagtggcctctctactctcagggacccaaacgagtacgatagcgaagtggaatataagcaccagcgaggcttccagcggtcccatggcgtgcaggaaagtttcggcggtgatgcgtcggataccgatgtccccgatataagagacgaggaaacatttggcctcgaggatgtggcgagcgtacttgattggaagcctcagggttccgtctccgaggggtctatcgtttccagttctaggaagcctattagtgccctatccccccagaccgatctcgtggacgacaacgcaaagtccttttcttctcagaaggcatacaagattgtgctggccggggacgcagccgtgggtaaatcaagttttctgatgcgactgtgtaagaatgagttccgagagaatatctccgccaccctaggggtggacttccaaatgaagacactcatcgtggatggtgagaggacagtgctgcaattatgggataccgccgggcaagagcggttccgctctattgctaagtcctactttcgtaaggcagacggtgtacttttgttgtacgacgttacatgtgagaaatctttcttgaacattagggagtgggttgacatgatcgaggacgctgcccacgagaccgtgcccattatgcttgttggcaataaagcggacatccgagacactgctgcaacggaggggcaaaaatgcgtgccgggacacttcggtgagaagttggccatgacctatggagccttgttttgtgagacgtccgccaaagatggcagtaacatcgtagaggccgtactgcatctagcgagggaggttaaaaaacgcacggacaaggatgattcacggtccattaccaacctgaccggcacgaacagtaagaagagccctcagatgaaaaactgctgcaatgggtag

SEQ ID NO: 24561 - DNA, 4125 bp, Artificial Sequence
  Description of Artificial Sequence: Synthetic coding sequence
atggaggagaacgagagccagaagtgcgagccctgcctgccctacagtgccgacagacgtcagatgcaggagcagggcaagggcaacctgcatgtcacatctccagaggacgccgagtgccgaagaaccaaggaacgcctttccaatggaaattcccgaggatccgtgagcaagagtagcagaaacattccaaggagacataccctcgggggtccacggtcttctaaagagattctgggaatgcagacctcagagatggacagaaagcgggaggccttcctggagcatctgaagcagaaatatccgcatcatgctagcgctattatggggcatcaggagaggcttagggatcagactcgcagtcccaaactgtcccattccccacagcctccgtccctgggtgacccagtggagcatctctcggaaacatccgctgactctctcgaagccatgagtgaaggtgatgcccccacgcctttttctcgaggcagccgtaccagggccagtttgccagtcgtccgatccacgaatcagactaaggagcggtcactgggtgtcctgtatttgcagtatggggatgaaacaaaacagctcagaatgcctaacgaaattaccagcgcagataccattcgcgccctgtttgtgtcagcttttccccaacagctcaccatgaagatgctggagtctccttctgtagccatttatattaaggacgaatctcgtaatgtttactacgagcttaacgatgttcggaatatccaggatcggtccctgctgaaagtctataacaaagaccccgcccacgcatttaaccacacacctaagaccatgaatggcgacatgagaatgcagagagaactagtgtatgccaggggagatggacccggagcaccacggcccgggtcgaccgcccatccaccacacgccattccaaactccccaccgagtacacccgtgcctcatagcatgcccccatccccaagtcgtataccctatgggggcacacgctcaatggtggtgcccggaaacgccaccatacctcgcgataggattagcagcctaccagtgagtcgcccaatctctcctagcccttccgcaatccttgaaaggagagatgtgaagcccgatgaggacatgtcaggtaaaaatattgctatgtaccgcaatgaagggttctatgccgacccatacctttaccacgaaggccgtatgtcaatcgcaagctcacatggcggccacccactggacgtacccgaccatataattgcttatcatcgcactgcaatccgatccgccagtgcttactgcaatccgagcatgcaggcagaaatgcacatggagcagtccctgtacaggcagaagtccaggaagtatccggattcccacctgcctaccttggggagcaaaacacctcctgcttcacctcatcgggttagcgacctgagaatgatagatatgcacgctcactacaacgcccatggccccccacacaccatgcaacccgacagagcctccccaagtcgtcaggcattcaagaaggagccaggcactctggtttacatcgagaagcctaggagcgctgcaggcttgagcagtctggtggatcttggtccacctttgatggagaagcaggtgtttgcatactctacagccacaatcccaaaagacagggaaacttccgaaaagatgatgaaaacaacggccaatcgcaatcacacagattcagccgggacaccacacgtatcaggcggcaagatgctatccgctctggagtctactgtgcccccctctcagcctccccccgttggaaccagtgcaatacacatgtcccttttggaaatgcggcgttcggtggcggaactgcgactgcagctgcagcagatgaggcagctccagctccaaaatcaagagctgttacgagcgatgatgaaaaaggctgagttggagatttccgggaaagtaatggaaaccatgaaaaggctggaggacccagttcaaagacaaagagttctcgtcgaacaagaacgccagaagtacctgcacgaggaggaaaaaattgtcaagaagctgtgcgagctggaagattttgtggaggacctgaagaaggattccaccgcagcctctcgacttgtcactctgaaggacgtggaggatggcgcctttctgctgaggcaagttggggaggcagtcgccacacttaagggagaattccccactctccagaacaaaatgagggccatcttgcgcatcgaggtagaggccgtgaggttcctgaaggaagagcctcacaagttggacagtctcttaaagcgggtgcggagcatgaccgatgtgctcacaatgcttaggaggcatgtaactgatggcctcctgaaggggacagacgcggcccaagcagcccagtatatggctatggagaaggccacagcagccgaagtgcttaaatcgcaggaagaggctgcacatacatcaggccagcctttccactcaactggcgccccgggggatgccaaatcagaggtggttcccctctctggcatgatggtgaggcacgcacaatcttctcctgtggtcatccagccaagccaacacagcgtggcactcctgaatccagctcagaacctccctcacgtcgcatcttccccggccgtcccccaggaagccacttccactctgcaaatgagccaggctccacaatcaccacagatacccatgaatgggtcggctatgcagtcgctgttcatagaagagattcactcggtgtcagccaagaatagggcagtctctattgagaaggccgaaaaaaagtgggaagaaaagaggcagaatctggaccattataacggaaaggagttcgagaagcttttggaggaggcgcaggccaacataatgaaatcaattccaaatctcgaaatgccaccagctacagggccattgcctcgcggggacgctccggtagacaaagttgaactgagtgacagtcccaactcagagcaggaccttgaaaaactcggaggaaagagcccgcctcctccgccccctccgcccagacggtcttacctcccaggaagcggactgacgacaactaggtctggagacgtggtttataccggaagaaaagagaacattacagctaaagcttcctcggaagatgccggaccaagtccacaaaccagggctacgaagtacccggccgaggagccagcatctgcctggaccccatccccgccgcccgtcacaactagttcctccaaggacgaggaggaggaggaggaagagggagacaagatcatggctgagttgcaggcattccaaaagtgcagtttcatggacgttaactctaattctcacgcagagccatcgcgggcagactcccacgttaaggatacaaggagcggcgccacagttcctcctaaagagaagaagaaccttgagttctttcacgaggacgtgaggaaatctgatgttgagtacgagaatgggcctcagatggaatttcagaagggatcctcaggagccccccaaacttccagaatgcctgtgcccatgtcagcgaagaatcgaccgggtacgttggacaagccaggaaagcagagcaagctgcaggacccacgacagtatcgccaagccaacggcagtgcgaagaagtcaggcggggacttcaagcccacttccccatctttgccagcatcaaagattcccgccctgtccccgtcttctggaaaaagctcatccttgccttcttcttctggtgattcctccaatctgccaaacccccccgccactaaaccctctatagcaagcaatcctctgagcccacagactgggcctccagcacactccgctagcctgattccctccgtttccaacggctccctgaaatttcaaagcttaacacacactggaaagggacatcatctgtcattcagtccacagtctcagaatggacgtgcaccaccacctctgtccttcagctcatctcctccatctcctgctagtagtgtctccctaaatcaaggggcaaaaggcacgaggaccattcacacacccagcctcacaagctacaaggctcagaatggcagtagttccaaggctactcccagtaccgcaaaggaaacatcttag

SEQ ID NO: 24562 - DNA, 5832 bp, Artificial Sequence
  Description of Artificial Sequence: Synthetic coding sequence
atggaggagaacgagagccagaagtgcgagccctgcctgccctactctgccgaccggcgccagatgcaggagcagggaaagggtaacctgcacgtaacatctccagaggatgccgaatgtcggcgtacgaaggagcgattgtccaatggcaatagtcgggggtccgtcagcaaatcttccaggaacataccgcggcgtcacaccctgggcggacccagatcctcaaaggagatcctgggcatgcagacatccgaaatggatcggaaacgggaagctttcctcgagcatctcaagcagaaatacccccatcatgcatctgccataatggggcatcaggagcgtctgagggatcagaccagatctccaaaattgagtcactcaccccaacccccttcactgggagaccccgtggaacacctgagtgaaacctcggccgactctctcgaggcaatgtcagagggagacgctcctactccatttagccggggctctagaacacgagcgagtctgccagtcgtgaggtccacaaatcagaccaaagagcgttcccttggtgttctctatctgcaatatggagacgagacaaagcagctgcgcatgccgaacgaaatcactagcgcagacactattagggctctgtttgtttcagccttcccccaacagctcacaatgaaaatgttggaaagcccttccgtcgctatttacatcaaggacgaatcacgaaacgtctattacgaacttaacgatgtcagaaatattcaggacaggtccttactgaaggtatataacaaagaccctgcacatgcgttcaaccacaccccaaagacaatgaatggggacatgagaatgcagcgagaacttgtttacgctagaggcgatggcccaggcgctccccggcctgggtcaactgcacatcccccacacgccattcccaactcaccaccgtcaacacctgtcccccactctatgcccccttcccctagccgtattccctacggaggtacacggtccatggtggttccagggaacgccactatcccgcgggaccggatcagcagcctccccgtatctcggcctatttcaccctcgccatcggctatcctcgagcgccgcgatgtcaaaccggatgaagacatgtctgggaaaaacatcgctatgtaccgaaatgagggattctacgcagatccatacctgtatcatgagggaaggatgagcattgcctcatctcacggcggacatcctctggacgtcccagaccacataatagcgtaccaccggacagctatacggagtgcctcggcatactgtaacccctctatgcaggcagagatgcacatggagcagtccctgtaccgacaaaaatccaggaagtatccagactctcacttgcccactttggggtcaaagacaccccccgccagccctcaccgtgtctccgacctgagaatgatagatatgcacgctcattacaacgcccatgggccgccacacactatgcagccagaccgggcctctcctagccgccaggcttttaaaaaagagccggggaccctcgtctacattgagaagccgagatccgcagctgggctctcctcactggtcgacttggggccaccgctgatggagaagcaggtattcgcgtattccaccgccaccatccccaaggatagggagactcgcgagcggatgcaggcgatggaaaagcagatagcgtctttaacaggactggtccaaagcgccctattcaagggccctattacttcttattcaaaagatgcatcatctgagaagatgatgaagaccacagcaaaccggaatcatacagattcagctggaaccccgcacgtcagcggaggtaaaatgctgtctgccctcgagagcaccgttccaccgagccagccccctcctgtgggcacctcagccatacacatgagtctgctggagatgcgtagaagtgttgcagagctgcgccttcaattgcaacagatgaggcagctgcagctccagaaccaggagcttcttcgagcaatgatgaagaaggccgagttggagatctctgggaaggtgatggaaacgatgaaacgtctggaggacccagtacaaagacaacgagtgctggtcgaacaggagaggcagaagtacctgcatgaagaagaaaagattgtcaagaagctctgtgaactcgaagatttcgtcgaagacctcaaaaaagatagcaccgctgcgagtcgcctggtcacactgaaggatgttgaggacggggctttcctgctgcgacaagtcggggaggcggtggccaccctgaagggggaattccctacactgcaaaataagatgagagccatcctgagaatcgaggttgaggccgtcagatttctgaaagaagagcctcacaagttagacagtctgctgaagcgcgtgcgttccatgactgacgtgttgaccatgctcagacgacatgttacagacggcctgttaaaaggcaccgacgccgcccaggccgcccagtacatggctatggaaaaggcaacggctgccgaagttctgaaaagccaggaagaggcagctcatacatccgggcaacctttccatagcactggggctccaggagatgctaaaagcgaggtagttccactatctggcatgatggtgaggcacgcccaaagctcaccggtggttatccagcccagccaacactcagtggccttgctgaacccagcccagaacctgccccacgttgcgtcatcaccggctgttcctcaagaagcgacgtcaacgttgcagatgtctcaggcccctcagagtcctcagattcccatgaacgggagcgccatgcagagcctgtttattgaggagattcacagtgtgtctgctaagaatagagcagtgtcaatcgaaaaagcggagaagaagtgggaggaaaaaagacagaatctcgaccactacaatggcaaagaattcgagaaactactcgaggaagcacaggcgaacatcatgaagagtatccccaacctcgagatgccaccggccacagggccattgccccgcggggacgctccagtggataaagttgaattgagcgaagattcgcccaactccgaacaggatttggagaagcttggcggcaaaagccctcctccacccccgccaccccctaggcgatcttatcttcccggctctggtctcaccactactcgctctggcgacgtggtgtacacaggccgcaaggaaaacatcacagcaaaagcctcctctgaggacgctgggccctctccacagacacgggctaccaaatatccggccgaggagccagctagcgcttggactccgtcgcccccccctgttaccacatcatcgtctaaggatgaggaggaagaggaggaagagggggataaaattatggctgagctgcaggcgttccagaaatgttccttcatggatgtgaattccaacagtcatgcagagcccagccgcgctgactcacatgtgaaagataccagatccggggccactgtacccccaaaagaaaagaagaatcttgaattctttcatgaagatgtgaggaaatccgatgtcgagtatgagaatgggccacagatggaattccagaaggtgaccactggagccgtgcgaccttctgatccacctaagtgggaacgtggcatggagaactcaatttctgacgcaagccgaacctcagagtataagaccgaaattatcatgaaagaaaattccatctcaaatatgtcacttctgcgagattccagaaattatagtcaggagacagtccccaaagcctcatttggattctcgggcatatctcctttagaggacgagataaacaagggctctaagatttctggtctccagtactccattcctgatacagaaaaccagacccttaactacgggaagacgaaggagatggagaaacagaacaccgacaagtgtcacgtctcttcccacacaaggttgactgaatccagtgtgcatgattttaagaccgaggaccaagaggtgataaccaccgactttgggcaggtggtgctgcggcccaaggaggcaaggcacgccaacgtgaacccaaacgaggatggcgagtccagctcctctagtccgactgaagaaaacgctgctacagacaacatagcctttatgattactgagacaaccgtgcaagttttgtcgtctggagaggtgcatgacatcgtttcccagaagggggaggacatacagacagtcaatatcgacgcgcgcaaggagatgacccctcgccaagagggaacagacaacgaagaccccgtcgtgtgcctggataaaaaacctgtaattattattttcgacgaacccatggacattagaagcgcctacaaaagactgtccacgatcttcgaagaatgtgacgaggaattagagcggatgatgatggaggagaaaatcgaagaggaagaagaagaggagaatggcgattccgtcgtccagaacaacaacacctcacagatgtcccacaaaaaggtggcccccggaaatctcaggacggggcagcaggtggaaacgaaatcccagcctcacagcctagctactgagacacgaaatcccggcggtcaggagatgaacagaactgagctcaacaaatttagccatgtggactctccgaacagcgagtgcaaaggagaggatgccacagacgaccagttcgaatctcctaaaaagaagtttaaatttaaatttcctaaaaagcagctggccgcccttacccaggccataagaactggcaccaagacaggcaagaaaaccttgcaagtggttgtgtatgaagaggaagaagaagacggcacgctgaagcagcacaaggaggctaagcgatttgaaatagcccgctcccagcctgaagatacccccgagaacacagtgcgacgccaggagcagccgtcaattgaatctacgtctcccataagtcgcaccgacgagatccgtaagaatacgtacagaacactcgatagccttgaacagactatcaagcagctggaaaacacaatttctgagatgagtccaaaagccctcgtggacactagttgtagctctaaccgggacagcgttgcctcttcatcacatatagctcaagaggcttctcccagacccctcctggtgcccgacgaaggccccacagcactcgaaccacccactagcattccctctgcatcccgcaaaggctcctctggtgcccctcagacaagtagaatgcctgtgcccatgagtgccaaaaatcgccctggcacgctcgataaacctgggaaacagtcaaagctacaggatcctcgacagtatcgacaagcaaacggcagcgccaagaagtcagggggggacttcaagcccacgtcaccctctttgcctgctagtaaaatccccgctcttagcccctcctccgggaagtcctcctcactgccatcttccagtggggacagctccaacctgccgaaccctcccgccactaaaccgtccatcgcctctaatcccctgagcccccagaccggtccccccgctcattcggcaagcctgatccctagtgttagtaacggtagcctgaagtttcagtccttaacccatactgggaaaggtcatcacctctcgttttcaccacaatcgcagaacggccgggcgcccccgcctctaagttttagctctagcccacccagcccagcctctagtgtatctctgaaccagggcgctaaggggactcggacaattcacactccaagtttgacctcctataaagcacaaaatggctcttcctcaaaagcaaccccgagtacagctaaagagaccagttag

SEQ ID NO: 24563 - DNA, 3795 bp, Artificial Sequence
  Description of Artificial Sequence: Synthetic coding sequence
atgcagaccagcgagatggaccggaagcgggaggccttcctggagcacctcaagcaaaagtatcctcatcatgcctccgccatcatgggccaccaggaacgcctccgcgaccaaactcggtcacccaagctgtcccattcgccccagccaccgagtctgggcgaccccgtggagcatctgagtgaaacctctgccgattccctcgaagccatgtcagagggcgatgcccccacaccattctctcgagggagccgtacccgtgcttctttacccgtggttcggtccacaaatcagaccaaagagcggagccttggagtactgtacctgcagtatggggacgaaactaagcagctccggatgccaaatgagattacatctgcagatactatacgtgctctcttcgtgagtgcgttcccccaacagctcaccatgaaaatgctcgaatctccttctgtagccatttacattaaggacgagagcaggaatgtgtattatgagctgaatgacgtaagaaacattcaggaccgctcattgttaaaagtttacaacaaggaccctgcccacgcattcaatcatacacctaagaccatgaacggcgacatgaggatgcagagggagctcgtctacgcacggggcgacggacccggtgcgccacgccccgggtccactgcacatcctccacacgccattccgaactcccccccatcaaccccagtgccacattccatgccaccctccccctcacggataccctacgggggcacacgaagcatggtagtgcctggaaacgccactattcctcgggaccgtattagctctcttcccgtatctaggccaatctcaccttccccaagtgcaattctggaacgcagagacgttaagcctgatgaggacatgtctggtaagaatattgctatgtatagaaatgaaggattttacgctgacccctacttgtaccatgagggaaggatgagcatagccagcagtcatggtggccatcccctggatgttccggaccatattatcgcatatcaccgaaccgccatcaggagcgccagtgcctattgcaatccaagcatgcaggccgagatgcacatggagcagtcactgtatagacagaagagtcggaaatacccggattcccacttacccacccttggatccaaaactccacctgccagtccccaccgtgtgtcagacttgcgtatgattgatatgcacgcccactacaacgcccacggccctccacatacgatgcaaccggatagggcaagcccaagtcgccaggcgtttaagaaagagccgggtacattagtctatattgagaagcctagaagtgcggccgggcttagcagcttggtcgacttgggcccccctctgatggagaaacaggtgtttgcctatagcaccgcaactattcctaaggaccgggagacacgagaaaggatgcaggccatggagaaacagattgcctcactaacagggctggtacaaagcgctttattcaaaggccccatcacctcctatagcaaagatgccagtagtgagaagatgatgaaaaccacagccaatcgcaaccatacagactcggctggcaccccacacgttagcggcgggaagatgctatctgccttggagtctactgtgcccccaagtcagcctccacctgttggcacctcagcgatacacatgtccctgctagagatgcggcggtcagtagcggagctgcggctccagctgcagcaaatgcgacaattgcagttacaaaaccaagaattgttgcgtgccatgatgaaaaaagccgaattagaaataagtggaaaggtcatggaaactatgaagcgtttagaagatccggtccagagacagcgagtacttgtagaacaggaaagacaaaagtatctacacgaagaggagaagattgtgaaaaagctgtgtgaactcgaggattttgtggaggaccttaagaaggactccaccgcagcaagcaggcttgtcaccttaaaagacgtcgaggacggagccttcctgctgcgacaggtgggcgaggccgtggccactctcaagggagagttcccaaccctgcagaacaagatgcgtgccattcttcgtatcgaggtcgaggccgtgagattcctgaaggaggagccgcacaagcttgattccttgttgaaacgtgtcagaagcatgaccgacgtcctaacaatgcttaggcgtcacgttactgatgggctgctgaaaggcaccgacgccgcacaagctgctcagtatatggccatggaaaaggccacagcggcagaagtgcttaaatcacaggaggaagcagctcacacgagtgggcaacccttccattccaccggtgccccgggagacgccaagagtgaggtggtccccttatcaggaatgatggtccggcacgcccaatcatcacccgttgtcatccaacctagccagcattctgtagctttgctgaatcctgcccaaaatttgccgcatgtcgcctcaagtccagccgtgccccaggaagcgacatctacattgcagatgagccaggcgccacagtcccctcagatcccgatgaatgggtctgctatgcagtctttgtttattgaggaaatccattcagtcagcgcgaaaaacagagctgtgtcgattgaaaaggccgagaagaagtgggaagagaaacgccaaaatctggaccattacaatggcaaggagttcgagaagctgcttgaagaggctcaggccaatattatgaagagcattccaaaccttgagatgccgcctgctacaggcccactgcctcggggcgacgctcctgtggacaaggtcgaattaagtgaagacagtcctaactctgagcaagacctggaaaaactgggaggtaagtcgcctcctccaccccccccacccccgcgccgctcctacctccccggcagcggcctgacaacaaccagatctggggacgtagtgtacactggccggaaagagaacatcaccgctaaagcttcgtcagaggacgccgggcccagcccccaaactcgcgcaaccaaatatcctgccgaagagcccgcctctgcctggacccccagccctccaccagtgactacatcctcctcaaaagacgaggaagaggaggaggaagagggtgataaaatcatggccgagctccagggcagtagcggcgcgcctcagacctccaggatgcctgttcccatgtctgccaaaaaccgccctggaacacttgacaaacctgggaagcagtcaaaactccaagatcccaggcagtaccggcaggccaatggatcagccaaaaaaagcggaggcgacttcaagccaacgagcccttccctcccggccagtaaaatccccgctctatccccaagctcagggaagagctcgtcattgccatcctctagcggggatagcagtaacctcccaaaccccccggcaacaaagccctccattgcatccaatcccctgagccctcagaccggtccacctgcccactcagcgagtctgatccctagcgtaagcaacgggtcccttaagttccagagtctcactcatactggaaaaggccatcacctgtcttttagccctcagtctcagaatggcagagcaccgcctcctctgagtttctcttccagccccccaagtccggctagtagcgtctcgctgaatcagggtgccaaagggactcgaaccatccatacaccatctctgacctcatacaaagctcagaacggctcctcctctaaagcaaccccctccacggcaaaggaaacctcttag

SEQ ID NO: 24564 - DNA, 531 bp, Artificial Sequence
  Description of Artificial Sequence: Synthetic coding sequence
atgggctgctgcggctgcagcggcggctgcggcagcggctgcggcggatgtgggagcggttctggtggctgtggcagcggctgtgggggatgcggaagttcttgttgcgtgccaatctgttgctgcaaacctgtgtgttgctgcgtccctgcctgttcgtgctcctcatgcggaagctgtggtggcagcaagggagggtgtgggtcgtgtggtagttctaaaggcggctgtggatcctgcgggtgtagccagtccaattgttgcaagccatgctgttcatcctccggttgtggatcattttgttgtcagtcctcttgcagcaaaccatgttgctgccagtcgagctgctgccagagctcatgctgtaaaccctgctgttgccagagctcttgctgccagagtagctgctttaaaccctgttgctgtcaatcctcatgttgcgtgcctgtatgctgccagtctagctgctgcaagccttgctgcagtcagtcctcctgttgcgtgccaatctgctgccagtacaagatatag

SEQ ID NO: 24565 - DNA, 513 bp, Artificial Sequence
  Description of Artificial Sequence: Synthetic coding sequence
atgggctgctgcggctgcagcggcggctgcggcagcggctgcggcgggtgcggttcaggctgtggaggatgtgggagcggatgcggtgggtacggcagcggctgcggaggttgtggaagttcctgttgcgtgccagtttgctgctgtaagccggtgtgctgttgtgttcctgcttgctcctgtagcagctgtgggtcttgcggaggaagcaagggcgactgcggctgcggcagctgtggcggatcgaaagggggttgtggaagttgtggctgcagtcaatgcaactgctgcaagccatgctgttgcagctccggctgtggcagctgttgccagtcttcatgctgcaacccctgctgttgccagtcgtcttgctgtgtgcccgtgtgctgtcaaagttcgtgctgcaagccttgttgctgccaaagctcctgctgcgtgccatcttcctgctgccgttcttgctgttcgaagagctcttgttgcgtgcctatctgttgccaatataaaatttag

SEQ ID NO: 24566 - DNA, 2169 bp, Artificial Sequence
  Description of Artificial Sequence: Synthetic coding sequence
atgatcgacagcgtgaagctgcggcgggacagcgccgccgacttcttcagtcactacgaatacctctgcgccctccagaactcagtgccattacctgcggtgcgggcctgtttgcgggagggtgtactggacttcaatgctgatcgtctacgcggcgttgattgggcccctctcctgagtacgctgaaaataaataaagatctaccactggtcagcatcaagtccttcttccagccttggctgggtgacactgggagcgatatgaacaagttctgcaggtctcgtgtgccggccattcggtataaagacgtgacctttcaactgtgcaaggccctcaagggctgcttgtcaataagctccgtgctgaagaatcttgagcttaacggtctgatactccgcgagagagatcttaccattctggcaaagggactgaacaagagcgcatctcttgtacacttgtccctcgctaactgcccaatcggagatggaggcttggagatcatttgtcagggcatcaaatcctcaatcaccctgaagaccgtgaattttacaggatgcaatctgacctggcaaggtgctgaccacatggccaagattctgaaatatcagactatgcgccggcatgaagagacttgggcagaaagtctgagataccgccgccccgacctggattgcatggccggactgcgaagaatcaccctaaactgcaacactctgattggggatttaggagcttgcgcttttgccgattcgctgtctgaggatttgtggctgcgtgccctagacctccagcagtgcggacttacgaacgagggagctaaggcgttgttggaagctctcgagactaacacgacactggtggtgctcgatatccgcaagaaccctctcatcgatcatagtatgatgaaggcagtgattaaaaaagtgctgcaaaatgggcggtccgctaagtccgagtaccaatggatcacttccccatcggtcaaagagccatctaaaactgccaagcagaagaggaggacgattatcctggggtccggccataagggtaaggctactatcaggattgttggcctggccaccaaaaagccagtcagcagtggacgcaagcattcccttggcaaagagtattacgcccctgctccactccctccaggcgtgtccggtttcttgccctggagaaccgccgaacgggccaagcgacatcgcggctttcccctgattaaaacacgggatatttgcaaccagctccagcaaccagggttcccagttaccgtcactgtagaatcgccttcctcctcagaagtagaagaggtggacgattcgtccgagtcagtccacgaagtgccggaaaagacctccattgaacaggaggctttacaggagaagctcgaagagtgtctaaagcagcttaaagaagagcgagtcatccggttgaaggttgataagcgggtgagcgaactagagcacgaaaatgctcagttaaggaacatcaatttttccctgtccgaggcgttgcacgctcagtccttaactaatatgatcctcgacgacgaaggcgttctgggctctatcgagaattctttccagaaatttcacgctttcttggatctgctgaaggatgcaggacttgggcagctggcgacaatggctggcatcgatcaatcagattttcagttgttgggccatccccaaatgacatccaccgtgtctaatcctccgaaggaagaaaagaaggccctggaggatgagaagcctgagccaaagcagaatgctcttggacagatgcagaatattcaggtgagcatttgtatgcagagcgcctataatgaagggacattgatgaagttccagaagattaccggggacgcccgtatcccactgcccctggactcgttccctgtgccggtatcgactccagaaggcttaggcacatctagcaataatctcggtgtaccagccaccgaacaaagacaggagtctttcgaaggattcattgctcggatgtgcagcccgtcgcctgatgccaccagcggcaccggatcccagcggaaagaagaggaactgtctagaaactcgaggtccagctcagaaaagaaaactaagacgggagaatacacgaaaaagcattcagataaacagcacccaggcaaagatctccactcctag

SEQ ID NO: 24567 - DNA, 1122 bp, Artificial Sequence
  Description of Artificial Sequence: Synthetic coding sequence
atggccctgaacgtggcccccgtgcgggacaccaagtggctgaccctggaggtctgcaggcagtttcagagaggcacctgtagtagatcagatgaggagtgcaagtttgctcaccccccaaagtcgtgccaagtcgagaatggccgcgtgatagcatgttttgattctctaaagggccgatgtagtcgtgagaattgtaagtatctccacccaccgacacatcttaagacacagctcgagatcaacggaaggaataatctgatccagcagaagacagccgccgccatgttggctcagcaaatgcagttcatgttccctggcactccattgcatccagttcctacgttccctgtcggaccagctattgggaccaatacagctattagtttcgctccttatttagcacctgtcactccgggtgtcggcctcgtgcctacagagatcctacccaccacacccgtcattgttcctggctccccgccggtaaccgtgccagggtctacagccacccagaagttacttagaaccgacaagctggaagtttgcagagaatttcaacgaggaaactgcgcaagaggcgaaaccgattgtcgtttcgcacatcccgctgattctactatgatcgatacatctgataacacggtgaccgtatgtatggattacataaaaggccggtgtatgagagagaagtgcaagtatttccaccccccggcccacctgcaggccaagattaaagccgcccaacatcaagctaaccaggctgcggtcgcagcccaagccgcagccgcagctgcaactgtcatggctttcccccctggtgcgctgcacccactacccaagcggcaggcactggagaagtcaaatggcacaagtgccgtatttaacccttcagtgctgcattaccaacaagctcttacaagcgcccaactgcagcagcacgctgcatttatcccaactgggagcgtgctgtgtatgactccagctacgagcatagacaattccgagataatctcaagaaatggtatggagtgtcaggaatctgctctacgcataaccaagcactgctactgtacctactaccccgtaagcagtagcattgagttgccacaaacagcgtgttag

SEQ ID NO: 24568 - DNA, 321 bp, Artificial Sequence
  Description of Artificial Sequence: Synthetic coding sequence
atgacccagagcaccgccaaggccatgaagcggcccctggaggccaccgtcgacttggcttttccgccaggggccctgcacccgctgccaaagcgtcaagcgctcgagaagtcaaacggaactagtgcggtgttcaaccctagtgtactacattaccaacaagcactcacctcagcgcagctgcagcagcacgccgcctttattccgactgtgcctatgatgcactctgcgacaagcgcaactgtgagtgccgcaacaacacctgccacttcagtaccgttcgccgccacagccaccgccaatcaactggtgtactcgtag

SEQ ID NO: 24569 - DNA, 915 bp, Artificial Sequence
  Description of Artificial Sequence: Synthetic coding sequence
atggccaagatcgagaagaacgcccccaccatggagaagaagcccgagctgtttaacattatggaagtcgatggggttccaacgttaattttgtccaaggaatggtgggagaaggtgtgtaactttcaggccaaacccgacgatttgatactagccacctaccccaaaagcgggactacatggatgcatgagattctggacatgattttgaacgatggtgacgttgagaagtgtaaacgagcccagacccttgaccgtcacgccttcttggaactgaagtttccccacaaggagaagcccgatctggagttcgtgctggaaatgtctagcccacagctgataaaaacacatttaccaagccaccttatcccaccttcaatctggaaggagaactgcaaaatcgtttatgtggctaggaacccaaaagattgtctagtctcctactatcattttcatagaatggcttccttcatgcctgatccccagaatctggaggaattctacgagaagttcatgtcagggaaagtggttgggggctcctggtttgaccacgtgaagggctggtgggctgccaaagacatgcatcgcatcttgtatctattctacgaagatattaagaaaaaccccaagcacgagatccacaaggtgctggagttcctggagaaaacctggagtggcgacgtaatcaataagattgtgcaccatactagcttcgatgtaatgaaggacaatcctatggcgaaccacacggccgtgcctgcccatatctttaaccactccatctccaagttcatgcggaagggcatgcctggagactggaaaaaccatttcactgtggcgctaaatgaaaactttgataaacattacgagaagaagatggcggggtctactcttaacttttgtctcgagatctag

SEQ ID NO: 24570 - DNA, 1188 bp, Artificial Sequence
  Description of Artificial Sequence: Synthetic coding sequence
atggccagcgccgccagcgtgaccagcctggccgacgaggtgaactgtccgatctgccagggcacgttgagggagccagtaacgattgactgtgggcataacttctgtagggcctgcctgacacgctactgcgagataccgggacccgatctggaggaatccccaacatgcccactgtgtaaagagccatttaggccagggtccttccgcccaaactggcaactggctaacgtggtggagaacatcgagaggcttcagctcgtgagcacattggggctcggcgaggaagatgtgtgtcaggagcatggcgaaaagatctactttttctgcgaagatgacgaaatgcagctctgcgtggtttgccgggaggccggggagcatgccacccacacaatgagatttttggaggacgccgcagccccatatcgcgagcagattcataagtgtctcaagtgtctcagaaaggagagggaagagatccaggaaatacagtctagagaaaataaaagaatgcaagtactgcttactcaggtatcaaccaaacggcagcaagtgattagcgagttcgcgcaccttcgaaaatttcttgaggagcagcagtccatcctcttagcgcagctggaatcacaggacggggatattctgaggcaacgagatgaattcgacctgctggtcgccggcgaaatatgtagattttctgctttgatagaagagttggaggaaaaaaacgagcgcccagccagagagctcctcactgatattagatccactctcattaggtgcgaaactcgtaagtgtcggaagcccgtggccgtgtcacccgaattaggacagcgaatccgcgactttccacaacaggctctgcccctccagagggagatgaagatgttcctggagaagctatgctttgagctggattacgagccggctcacatttcgcttgacccccagacctctcatccaaaacttttactgtcggaggatcaccagagggcccaattctcctacaagtggcagaactcgccagataatcctcagcggtttgaccgggccacctgcgtcctcgcgcataccggtattactggaggtcgccacacgtgggtttggatggcccgggtgcccggagattccggttgttgtcagttttgtagcccaccatcagtcctgggaactgaggtggctgcctag

SEQ ID NO: 24571 - DNA, 1446 bp, Artificial Sequence
  Description of Artificial Sequence: Synthetic coding sequence
atggccagcgccgccagcgtgaccagcctggccgacgaggtgaactgccccatttgccaaggaaccctgcgcgaaccagtgactattgactgtggacacaatttttgtagggcctgcctgacacgctattgcgaaatccctgggcccgacctcgaggaatctcctacctgtccactctgtaaggagccattccgccccggctccttccgacctaactggcaattagccaatgtagtggagaacattgagaggctgcagcttgtctccacactcggactgggcgaggaggatgtgtgccaagagcatggcgagaagatatacttcttctgcgaggacgatgagatgcaattatgcgtcgtgtgcagggaagccggggagcacgccactcatacaatgagatttttagaggatgcagcagctccctatagggaacagatccataagtgcttaaaatgccttagaaaggagcgggaggaaattcaggaaatacaatcgagggaaaataaacgcatgcaggtcctcctcacacaagtttcaacgaaacgccagcaagtcatttccgagttcgcccaccttagaaagtttctggaggagcagcaaagcatcctactcgctcagctggagagccaagacggcgacatcctcagacagagggacgaattcgacctgctcgtggcaggtgagatctgcaggttttccgccttgattgaggaactggaggagaagaacgagaggcctgcgcgagaactcctcacagacatccgttcaacgttgattcgctgcgaaaccaggaagtgtcggaagccggtggccgtctctcccgaactgggtcagcggatccgggactttccccaacaggccctgccactgcagcgcgaaatgaaaatgttcctggagaacctacccaatcacttggtgatacccacagcccatatcagcttagatccacagacctctcacccaaagctcctcttgtctgaagatcaccaacgcgcacagtttagctataaatggcagaatagtcccgacaatcctcaacgctttgaccgcgccacctgtgtcctggcccacactggtataaccggcggccgtcatacatgggtggtctctatagacctggcacacggaggaagttgcacagtgggtgttgttagcgaagacgtccagcgaaagggtgagttgaggcttcggccagaggaaggagtctgggcagttcgcctggcctggggtttcgtctccgctctagggtcctttcctaccagactcacattgaaggagcaacctcgacaggtgagagtcagtctggactacgaagtgggatgggtgaccttcacaaatgccgtgactagggagcccatttatacatttaccgcatcgttcactagaaaggtaattcccttcttcgggctttgggggagggggagcagcttcagtctgagctcttag

SEQ ID NO: 24572 - DNA, 2604 bp, Artificial Sequence
  Description of Artificial Sequence: Synthetic coding sequence
atgcaggccgaggccgccgactggttcagcagcatgcccttccagaagcacgtgtactaccccctggcatctggaccagagggacctgacgtggctgtggccgctgccgccgctggcgcggcttcaatggcctgtgctccaccgtctgccgctagcgggcctctgccctttttccagttcagaccacgcttagagtctgttgattggcgtcgactgtctgcaatcgatgtggacaaggtcgcgggcgctgtcgacgtgctgacccttcaggaaaacatcatgaatattacattttgtaagttagaggatgaaaagtgcccccattgccagtccggcgtggatcccgtgttactcaaactgatcagactcgctcaatttacaattgagtacctgttacactcccaggaattcctaaccagccagttgcacactttagaggagagactgcgcttgtcccactgcgacggtgagcagtccaagaaattactaaccaagcaggctggcgagatcaagacactgaaggaggagtgtaaaagaagaaagaagatgatctcaacccaacagctgatgatagaagccaaggccaactattaccagtgccacttctgcgataaagcctttatgaaccaggcctttctacagtcacatatccagcgcagacacactgaagagaactcccacttcgaataccagaagaacgcccaaatcgaaaagctgcgcagtgaaatcgtggtgctcaaagaggaactacagctgacacgttctgagttggaggccgcgcaccacgcttctgccgtacgtttcagtaaggaatacgagatgcagaagaccaaggaggaggatttcctaaaattgttcgaccgctggaaggaggaagaaaaggagaagttggttgacgagatggagaaagttaaggaaatgttcatgaaagagtttaaggagcttactagcaagaactctgccttggaataccaactgtctgaaatccaaaaaagtaacatgcagatcaaaagtaacatagggacattaaaagacgcacatgaatttaaagaggatcgatcaccatacccccaagactttcacaatgtaatgcaactcctcgactctcaagaatccaaatggaccgcgcgagtccaagccattcaccaggagcacaaaaaagaaaagggacgactactcagccacatagagaagctgcgcacgtccatgattgatgatctcaacgcaagcaatgttttttacaagaaaaggatagaggagcttggtcagagactccaagaacagaatgagctgattattacacagaggcagcagatcaaggactttacctgcaacccgctgaactctatttccgagcctaagggtaatccactggcatggcaagccttcgagtctcagcccgctgccccagcagtaccaatgaacgcccctgcactccataccctggagactaagagctcattgcccatggtccatgagcaagctttctcgagccacatactagagcctattgaggaactttccgaggaagaaaaagggagagaaaacgagcagaaacttaacaacaacaaaatgcacctgcgcaaggctctcaagtccaactctagtctcacgaaagggttacgtacaatggtggagcaaaacctgatggaaaaacttgagaccttggggataaacgctgacattaggggaatttctagcgatcagctgcaccgcgtgctcaaaagcgttgaatcagagagacacaaacaagagagggagattcccaacttccatcagatccgcgagttcctggagcaccaagtgtcatgcaaaattgaagagaaggcgttgttgagcagcgaccagtgttcagtatctcagatggacactctgagcaccggagaagtgccgaagatgatacagctacctagtaagaatcgacagctcattcggcagaaagctgtctcaacagaccggacgtccgttcctaagattaagaaaaatgtcatggaggacccgtttccaaggaagtcctcgactatcacgactcctcctttctcatccgaggaagaacaagaagacgacgatttgatacgtgcctacgcttctccaggccctctgccagtacctccaccacagaacaaaggctccttcggaaagaatactgtcaaatctgatgcggacggcacagagggtagcgagatcgaggacacagacgatagcccaaagcctgccggtgtcgcagtgaaaactcccactgaaaaagtcgaaaagatgtttccccacagaaagaacgttaacaagccagtcggcggaaccaacgtgcctgaaatgtttatcaagaaggaagagttgcaggagttgaagtgcgccgacgtggaggacgaggactgggatatctccagcttggaggaggaaatttcccttggcaaaaagtccgggaaggaacagaaggaacctcccccagccaagaacgaaccgcatttcgctcatgttctgaacgcttggggtgcatttaacccaaaaggcccaaagggcgagggactccaggagaatgaatcctccacactgaaatcctctctcgtaaccgtcaccgactggtctgatacatctgacgtgtag

SEQ ID NO: 24573 - DNA, 279 bp, Artificial Sequence
  Description of Artificial Sequence: Synthetic coding sequence
atggccaccccccccaagcggcgggccgtggaggccaccggcgagaaggtgctacgctacgaaaccttcatctccgacgtgttgcagcgggacctgcggaaggtgctggatcaccgggataaagtctatgagcagctcgctaaatatctgcaacttcgaaatgtgatcgagcggttgcaggttaaaacaatgggtctaggaaccatttttttggtatgtgtgggcaaggggggtaaatgggaagagcgtcttcagacgcagccttgccaccttacatag

SEQ ID NO: 24574 - DNA, 2532 bp, Artificial Sequence
  Description of Artificial Sequence: Synthetic coding sequence
atggccgtggaggacagcaccctgcaggtggtggtgcgggtgcggccgccgacgcccagagagctggactcccagcggaggcccgtggtgcaagtcgtggacgagcgcgttttggtgttcaatcccgaagaacccgatggcggttttccggggctcaagtggggcgggacccatgacggacccaagaagaaggggaaagatctcacattcgtgttcgatcgtgtgttcggtgaagccgcaacgcagcaggacgtctttcaacacactactcattcagtgctcgacagttttctccaaggttataactgtagcgtcttcgcctatggagccactggagctgggaagacccacaccatgctcggtcgcgaaggcgatccaggcatcatgtacctgaccactgtcgagttgtaccgccgcttggaggcgcgccaacaagagaagcattttgaggtcctgatcagctatcaggaggtctacaacgagcagatccacgacctgctggagccaaagggtcctctggccatccgggaggatccagataaaggtgtggtcgtccaggggctgtcatttcaccaacccgcaagcgcagagcagctactggaaatcctgactcggggtaatcgaaacaggacgcagcatcctaccgacgcaaatgccacctcctccaggtcccatgcgattttccagatcttcgtaaaacagcaggaccgcgtgcctggcctcacccaggcagtgcaggtggctaagatgtctcttatcgatctggccggctcggagcgtgctagtagtacccacgctaagggtgagcggcttagagagggggcgaatataaataggtccctcttggccctcattaacgtcctgaacgcccttgctgacgcaaaaggccgaaagacacatgtgccatacagggactccaagctgacccgcctcttgaaggactcgctcggcggcaattgtcgtactgtgatgattgcagcgatatccccctcatcgctaacctacgaggatacatacaatactcttaaatacgccgacagagccaaggagatccgcctctctctgaaatcaaatgtcaccagtctggattgtcacatctctcagtacgccaccatctgccagcaacttcaggctgaagtcgcagcccttcgtaagaagctccaggtttacgaggggggcggccagcctccgcctcaggatctccctgggagtcctaagagtggtcccccccctgaacacctgccttctagcccgctcccacctcaccctccctcgcagccctgtactccggagctgcctgccgggccaagagccctccaggaggagagcctcggcatggaggcacaggtggagagggccatggagggaaactcaagtgaccaggagcaatcaccagaagacgaagatgagggacctgccgaggaggtgcccacccagatgccagagcagaaccctactcatgccctcccggaaagcccccgtctcacattgcagccgaaacctgtggtgggccatttctctgcccgcgagctcgatggcgatcgtagcaagcagttagccctgaaagtgttatgtgtggctcagcgccagtattctctattacaagctgccaacctactgacgccagatatgatcaccgagttcgagaccctgcagcagctggtgcaggaggagaaaattgagcccggggcagaggctctgagaacgagcggacttgctaggggggccccacttgcacaggaactgtgcagcgaatccattcccgtgccttctcccctgtgtcccgaaccacccggatatacaggccctgtgactaggaccatggcccgcagactgtccgggcccctgcataccctcggaataccccccggacctaactgcaccccagctcaaggctctcgctggcccatggagaagaagagaaggcggccctcagctctcgaagcagattcgcccatggcccccaagaggggaaccaaacggcagagacagtcatttctgccttgcctgaggagggggtcattgcccgacacccaaccttcacagggtccttctacccccaaaggcgagcgtgcttcaagcccatgtcattccccccgcgtctgtccagccactgtgattaaaagccgcgtgccgctgggcccctccgcaatgcaaaactgttctacacccctggcgcttcccaccagggacctaaacgcaacttttgatcttagcgaggaaccgccttccaagccgagctttcacgagtgcatcggttgggataaaatccctcaggaactgagccggctggatcagcctttcattcccagggccccagttcccttgttcactatgaagggccctaagcctacttctagtctgcctgggacgagcgcctgcaagaaaaagcgcgtcgcctccagttcagttagtcacggccgctcccgaatcgcaaggcttccttcatcaaccttgaagcgccctggtccattgtatagccaggtaactggcacacgtgacagagattcactcgggcacggtggaaggtag

SEQ ID NO: 24575 - DNA, 561 bp, Artificial Sequence
  Description of Artificial Sequence: Synthetic coding sequence
atggagcccccccggggcccccccgccaacggcgccgagcccagcagagccgtggggaccgtgaaggtatacctcccgaacaagcagcggacagtggtgacagtgcgagacggaatgtccgtgtatgactcactcgataaggccttgaaggtcagaggcctcaatcaggattgctgcgtcgtctatcgccttattaaagggcggaagaccgtcacagcttgggacaccgcaatcgcccccctggatggagaggaacttattgtggaggtactcgaagatgttcccctaacgatgcataacttcgtgagaaaaactttcttttcattagctttttgtgacttctgcctgaagtttctttttcatgggtttagatgccagacctgtggttacaagttccaccaacattgttcgagcaaagtccctaccgtctgtgttgatatgtctacaaatcgccagcagttctatcacagcgtccaggacctctctggagggagcagacaacacgaagcaccttccaatcgccccttaaatgagttgctaacaccccagggccccagatag

SEQ ID NO: 24576 - DNA, 1821 bp, Artificial Sequence
  Description of Artificial Sequence: Synthetic coding sequence
atggagcccccccggggcccccccgccaacggcgccgagcccagccgcgccgtgggaacagttaaggtctatctccctaataaacagagaaccgtggttaccgtccgggatggaatgagtgtatacgacagcctcgataaggcccttaaagtccggggacttaaccaggattgttgcgtggtgtatagactcatcaaaggcaggaagacagtgaccgcctgggatacagccatcgctcccctggacggagaggaattaatcgtggaggtattggaagacgtacctttgactatgcataactttgtacgcaagacttttttttctctcgccttctgcgacttttgcctgaagtttctgttccatggtttcaggtgtcagacatgtggttacaaatttcatcagcattgtagcagtaaggtgcccacagtgtgcgtcgatatgagtaccaatcgccagcagttctatcattccgtgcaggacttgtccggtggctccagacagcatgaggctccgagtaaccggcctttgaacgagttgctgactccccagggaccttcacctcggacacaacattgtgatccagagcactttccgttccctgcacctgctaatgcccctcttcaacgaatccggtctacttctaccccaaatgtccatatggtatccacaaccgcccctatggactctaacctgatccaactgaccgggcagtccttttcaacagatgcggcagggtcacgcggtgggtccgacgggacacctcgcggctcaccgagtcctgcgtccgtgagtagcgggcgcaaatctccacacagtaaaagtcctgcggagcaaagggagaggaagtcactggcggatgataaaaaaaaggtaaaaaacctcggatatcgtgatagcggctactactgggaagtgccacctagtgaggtacagctgctgaaaaggatcggcaccggctcctttgggacagtatttcgggggaggtggcatggggacgtcgctgtgaaagtgctcaaagtgagccagcccacagctgaacaggcacaagccttcaagaacgagatgcaggttttgcgcaaaacaagacacgtgaacatactgctgtttatgggtttcatgactcgacctgggttcgccatcataacacagtggtgcgaggggagtagcttgtaccaccacctgcacgttgccgacactcgcttcgacatggtacaactcattgacgtcgcccggcagaccgcacagggaatggactacctccacgcgaaaaacattatccaccgagacctaaagagcaataatatttttcttcatgagggcctgacagtgaagattggcgactttggactggcaaccgtcaagaccagatggtccggcgcccaaccgttggagcagcccagcggcagcgtgctctggatggccgcggaggtgattcggatgcaagaccctaatccttacagctttcagagtgatgtctacgcatatggtgtagtcctctacgagttaatgaccggctctctgccgtattctcacatcggttgccgcgaccagattattttcatggttggccggggatacctcagccctgacctgtcaaaaatctctagcaactgccccaaggctatgcgcaggctcctctctgattgtctcaagttccaaagggaagagcggccactctttccacagatactggccactatagaacttctccaacggtccctgccaaagattgaaaggagtgccagcgagccttctctgcacaggactcaggcagatgagctgccagcctgtttgctgtccgctgcccgcttggtgccctag

SEQ ID NO: 24577 - DNA, 3036 bp, Artificial Sequence
  Description of Artificial Sequence: Synthetic coding sequence
atggtgagcagcgaccggcccgtgagcctggaggacgaggtgagccactctatgaaagaaatgatcggcggctgctgtgtctgctctgacgagagggggtgggcagagaatccgttggtatactgtgatggccacggttgcagtgtggccgtgcatcaggcttgctacggcatcgtccaggtcccaaccggaccctggttctgccggaaatgcgagtcccaggagagagcagcaagagtccggtgcgaactgtgtccacacaaggacggtgctcttaaacgcacggataatggaggctgggctcatgtggtctgtgcactctatattcccgaagtgcagtttgctaacgtgtcaaccatggaaccgatagttctgcagagcgttccacatgaccggtataacaaaacctgctatatctgcgacgagcaggggcgggagtcaaaggccgctactggcgcctgtatgacatgcaataaacatggatgcagacaggctttccacgtgacttgcgcccaattcgcgggcctcttatgtgaagaggaaggaaacggcgcagacaatgtccagtactgtggatactgtaagtatcacttctctaagttaaaaaaaagcaagcgagggagcaacagatcctacgaccagtccctgtcagactcgtcttcccattcccaagataaacaccacgagaaagaaaaaaaaaagtataaggaaaaggataagcataagcagaagcacaagaaacaacccgagccctcacctgctctggtaccttccctgactgtcaccacagaaaagacttacacctctacttcaaataactccatctccggtagccttaagcgcctggaggatacgactgctagatttacaaatgcaaatttccaggaggtgtcagcccatacctccagcggcaaagacgtttctgagaccagggggtcagaaggtaaagggaaaaagagctcagcccatagtagtggccaaagagggcgaaagccgggcggcggaagaaatcccgggactacagtcagcgcagctagtccatttccccagggctccttcagtggcaccccgggctcagttaagtctagttccggcagcagcgtacagtcaccccaggatttcctgagtttcacggactcagaccttaggaacgactcctattcccactcccagcagagcagtgccactaaggacgtgcataaaggagagtctggatcccaagaagggggcgtgaactctttctcaacccttatcggcttgccaagcactagtgccgtcactagccaaccaaagagcttcgaaaacagtccaggtgacctcggcaactcgtcgctgcccaccgctggttataagagggcgcagacctccggtatcgaggaggaaactgtcaaagagaagaagcgtaagggcaacaaacagtcaaaacacggtcctggcagacctaaaggtaacaagaatcaggagaatgtaagtcatctgagcgtttctagtgcgagtcctaccagttccgtggccagtgctgctggctcgatcacttccagctctttgcagaagtcgcccactcttctacgcaatgggtcattgcagagtctgagcgtgggaagcagcccagtggggagcgaaatttcaatgcagtaccgacacgatggcgcatgccctaccaccaccttctcagaactgctgaatgctatccacaatggcatctacaactcaaatgatgttgctgtctcgttcccgaatgtggtcagtggctccgggagctccacccctgtgtcctcctctcatctgccacaacagtcatctggccatttacagcaggtgggagctctctcaccttcagccgtgtcgagcgctgcccctgctgtggcaactacacaagctaataccctgtcaggaagtagcttgtcgcaggctccttcccatatgtacgggaatcgttccaattctagcatggccgccttgattgcacaatctgaaaacaatcagacagatcaggaccttggagataactctagaaacctcgtggggcgcgggagctctccccggggatccttgtcacccagaagccctgttagttctctccagatccggtacgaccagccagggaattcttctttggaaaacttgcctccggttgctgcatcaatagaacagctgttagagcggcagtggagtgaaggccaacagttcctcttagagcaaggaacccccagcgacatcctcggtatgctgaagtccctgcatcagcttcaagtcgagaatcggaggctggaggagcagattaagaacctgacagccaagaaggagcgactccagctgctcaacgctcagctgagcgtgcccttccccactatcacggctaacccctccccgagtcatcagatacatactttctccgcacagacagcccctactacagacagcctcaattccagtaagtctccccacattggcaattcatttctgccagataactccctacccgtcctcaatcaagatcttaccagcagcggacaaagtacgtcctcctcctccgcgctgtcaaccccaccgccagccgggcaatccccagcccaacagggaagtggagtctcaggcgtccaacaggtgaatggcgtgaccgtcggagctctagcatccggcatgcagcctgtgacctccacgatcccggcagtcagtgccgtggggggcattatcggggcactgcctggaaatcagctggctattaatggtatcgtcggggccctgaatggcgtgatgcagacccccgttacaatgtcccagaatcccacccctctgacgcataccactgtccctcccaacgctactcacccaatgcctgctaccttaactaactctgccagcggcttgggcctcttaagcgatcagcagaggcagattttaatccaccagcaacagtttcagcagctactgaatagccagcagctcacacctgttcatagacatccccattttacacaattaccaccgactcatttttcaccttccatggagatcatgcaggtccggaagtag

SEQ ID NO: 24578 - DNA, 3084 bp, Artificial Sequence
  Description of Artificial Sequence: Synthetic coding sequence
atggtgagcagcgaccggcccgtgagcctggaggacgaggtgagccactcgatgaaagaaatgatcggaggctgttgcgtgtgctccgatgagaggggttgggccgaaaacccccttgtatactgcgatggccacgggtgctccgtcgccgtgcaccaagcgtgttatggaatcgtgcaggtcccgactggtccttggttctgcaggaagtgcgagagccaggagcgtgctgcccgggtgcggtgtgaattgtgtccgcacaaggatggcgctttaaagaggaccgacaatgggggatgggcccacgtggtatgcgccctgtatatacccgaggtgcagttcgccaatgtttctaccatggagccaatcgtgctgcagagtgtcccgcatgatagatacaacaagacctgctatatttgtgacgaacaaggaagggagtctaaagcggcaacaggggcctgtatgacatgcaataaacacggttgtcgacaggccttccatgtgacttgtgcccaatttgcagggctcctgtgcgaggaagagggcaacggggctgataacgtgcagtattgcggatattgcaagtaccatttttctaagctaaaaaagtctaagcgcggttccaatcgctcttatgaccagagcctgagcgactcgagtagtcacagccaagataaacatcacgagaaggagaagaaaaagtataaagaaaaagataagcacaagcagaaacacaagaagcagcccgagccaagccccgcactcgtcccttcgctcacagtaactactgagaaaacgtataccagcactagcaataactccataagcggctctcttaagcggctcgaggatacaacagctcgattcactaacgccaatttccaggaagttagcgctcacactagttccggaaaagacgtcagtgaaacgagaggcagcgaaggcaaaggaaagaagtcttccgcgcacagttccggccaacgtggtaggaaaccgggcggtggtcggaatcctggcaccacagtctctgccgcctccccattcccccagggatccttttccggcacccccggatcggtgaaatctagcagtggctcttctgtgcagtctccacaagacttcctcagtttcaccgattctgatttgcggaatgatagctacagccatagtcagcagagctctgccaccaaagacgttcacaagggagaatcagggtcccaggagggtggtgtaaactctttctctaccctgatagggctacccagcaccagtgcagtcacttcacagcccaagtcctttgagaattcaccgggagatctcggcaactcatcattgccgacagcagggtataaaagagcgcagaccagcggtatcgaggaagaaactgtaaaggagaaaaaacggaagggtaataaacagtcgaaacatggcccgggaaggccaaagggcaataaaaaccaggagaatgtcagtcatctgtctgtcagcagcgcatcacccacgtctagtgtagcatcggctgcaggtagtatcacatcgagctctctccaaaagtctcctaccctacttcgcaatggaagtctgcagtccctgtcagttggatctagcccagttggtagcgagatatcaatgcagtaccgccacgacggtgcctgtcctaccaccacatttagcgagctgttgaatgcaatccacaatgataggggagacagctcaaccctgacgaagcaagaactgaagttcatcggaatttataacagcaacgatgtggccgtgtcattccctaatgtggtgagtggatcaggaagttccactcctgtgtccagcagccatcttccacagcagagcagtggccacttgcagcaggtgggagccctctcaccctcagctgtaagcagtgctgctcccgcagtcgccacaacgcaggctaacaccctctccggatcttccttatctcaagcacctagtcacatgtacgggaatagatctaactccagcatggccgccctaattgcccagagcgaaaacaaccaaacggatcaggatctaggggataacagtcgaaatctggtcggcagggggtcatctccccggggctcactctccccccggtcacctgtgagctctttgcagataaggtacgatcaacccggcaattccagcttggaaaatctacctcccgtcgctgccagcatcgagcaactgctggaacggcagtggtcggagggacagcagttccttttggaacaaggcacgcctagtgatattttaggtatgctaaagtcactccaccagctacaagtcgaaaaccgacgactcgaagagcaaattaagaatctaacagccaaaaaggagagactgcaactcttgaacgcccagttgtctgttccgttccccactatcacagccaatccaagtccttcgcaccagatacacacattttcggcccagacagctccaaccaccgattccctgaattctagcaaatctcctcatattgggaactcattcctccccgataatagtctccctgtgcttaatcaggatttgacttcttcgggtcagagtacctctagttcatctgcgctgagtactcccccacccgccgggcagtctcccgcacaacagggcagtggagtgtcaggagtccaacaggtgaacggcgtgacagtcggtgccctggcaagcgggatgcagcccgtcacttctactatccctgctgtgtcggccgtgggcggaatcatcggggcgctgcccggaaatcaactggcaattaacgggatcgtcggagcactgaatggcgtgatgcagacccctgtgaccatgtctcagaaccctactccgctcacacataccactgtgcctcccaacgcaacccaccccatgcctgcaacactgacaaatagcgcttcagggcttgggctcctatccgatcagcaacgccaaatcttgattcatcagcagcagtttcagcaactcctgaactctcaacaactgactccagtccacaggcatccacactttacacagctgcccccaacacatttttctccctccatggaaataatgcaggtccgcaagtag

SEQ ID NO: 24579 - DNA, 567 bp, Artificial Sequence
  Description of Artificial Sequence: Synthetic coding sequence
atgaccgcccccagctgcgccttccccgtgcagttccggcagccctccgtgtccggcctctctcagattaccaagagcctctacataagcaacggagtagcagcgaataataagcttatgctatcatctaatcagattaccatggtgattaacgtcagcgttgaggtggtgaacacactttatgaggacatccagtacatgcaggtaccggttgctgattctcccaactctcggttatgcgacttctttgatcctatcgcagatcatatccatagtgtcgagatgaaacagggacgaaccttgctgcactgtgccgctggagtgtccagatctgccgcattgtgtttggcctatctgatgaagtatcatgcaatgtccctcctcgacgcccacacttggactaagtcttgccggccaatcatccgacccaacagcggtttctgggagcaactcattcactacgagtttcagctatttggcaagaatacagtgcacatggttagcagtccagtgggaatgattccggacatctatgaaaaggaagtccgcctgatgatcccactgtag

SEQ ID NO: 24580 - DNA, 381 bp, Artificial Sequence
  Description of Artificial Sequence: Synthetic coding sequence
atggtgagcagcgaccggcccgtgagcctggaggacgaggtgagccatagcatgaaggaaatgattgggggttgctgcgtttgttccgacgagcgaggctgggccgagaaccccctggtttactgcgatggccatgggtgtagcgtagcggtgcaccaagcctgctacggtatcgttcaggtcccaactggaccctggttttgtcgcaaatgcgagtcccaagaacgcgccgcgagagtcgccgagtcaagaagcgtggctcaggccaaggtacagtggtgcgacttgtctccacttcagcccctgctgcctggattcaaacgcttctcctgcctcagcctgccaaacggaatgcagtttctcctcgtgagcctcatctag

SEQ ID NO: 24581 - DNA, 540 bp, Artificial Sequence
  Description of Artificial Sequence: Synthetic coding sequence
atggtgagcagcgaccggcccgtgagcctggaggacgaggtgagccacagtatgaaggagatgataggcggatgctgcgtatgctcagatgaacgaggctgggccgagaatcctctcgtgtactgcgacgggcacggctgttctgtggctgtgcaccaagcttgttacgggatcgttcaagtgccgaccggaccctggttttgcagaaaatgtgagagccaggaacgcgccgctcgtgtaatggtttgcaactcctgctggctggcgtcgagcgagaacgtgacaccaggctatattgagcatcactgtgcatgtgctagccctcatccccgatgcctggtgagcaatgtgcctccagtgagtggagccctgatgcattgcttctgggcatgcctgactacagccgctttcttcgggcctcagtcttttactacatgccatatgagcttcttggtgtctcgagacattctgttttatatttatggcttcatgccattcatcagcgtggtgatctggcgcttcaagaaagagcgatggtag

SEQ ID NO: 24582 - DNA, 540 bp, Artificial Sequence
  Description of Artificial Sequence: Synthetic coding sequence
atgggcctgatcttcgccaagctgtggagcctgttctgcaaccaggagcataaagtcatcatagtaggccttgacaacgccgggaagaccacaatcctataccaattcctcatgaacgaggtggtccacacatcgcctacaatcggctccaatgtcgaagagatcgtggtcaagaacactcactttcttatgtgggatatcggtggtcaggaatccttgcggtccagttggaatacttactattccaacaccgagttcatcatcctggtcgtggacagcattgatagggaacgacttgccatcactaaggaagaactgtataggatgcttgcccatgaagatctgcggaaagctgccgtgttgattttcgctaacaaacaggacatgaaagggtgcatgaccgccgccgagatcagtaaatacttgacattgtcctccattaaagaccatccatggcacatccagagctgctgcgcactgaccggcgagggactttgccaagggctggaatggatgactagcagaattggggtgagatag

SEQ ID NO: 24583 - DNA, 3345 bp, Artificial Sequence
  Description of Artificial Sequence: Synthetic coding sequence
atgagccagacccaggactacgagtgccggagccacaacgtggaccttccggaatctcgaattcccggaagtaatacaagactggagtgggtagaaatcatcgaaccacggactagggagagaatgtacgccaatcttgtgaccggcgaatgcgtgtgggaccccccagcgggagtgagaatcaagcgcacatctgaaaatcaatggtgggagctcttcgatccaaatacctcccgcttttactactacaacgcctccacgcagcgtactgtgtggcaccgtccccagggatgtgacatcatccctctggcaaagttgcagaccctgaaacagaatacagagagcccaagggcttccgcagagtcatccccggggagaggatccagcgtatcccgagaaggttccacttcctcctccttggagcccgaaccagataccgagaaagctcaagagctccctgcgcgggctggccgtccagccgcctttggcacggtcaaggaggattcaggtagcagtagcccccctggggtgttcctggagaaagattacgagatctacagagattattcggccgatggacagctacttcactaccggacaagcagcctacgatggaattctggagctaaagaaaggatgctcatcaaagtcgccgatagggagcccagcttcttagccgcgcagggaaacggctatgcgccggacggcccgccaggtgtacgaagtaggagaccttcgggtagccagcactccccttctcttcagacctttgctccggaggctgatggtaccatattcttccccgagcgtcgcccttcaccctttctcaaacgggccgagttgcccgggagctcaagtccactattggcccagccaaggaagccgtccggcgactcacagccaagcagtccgcggtacggctacgagccgcccctttatgaggagccgcctgttgagtaccaggctcccatttacgacgagcccccaatggacgtgcagttcgaggctggcggcggctaccaagctggatcccctcagagatcacctggcagaaaacccagacccttcctccaacccaataagcagggtcccccgagcccgtgccagcagctggtgctcacaaaacaaaaatgtcccgagaggtttctctccttggagtactccccagctggcaaggaatatgtgagacagttggtgtatgttgagcaggctggctcttccccgaagctgagggcgggacctcgtcataagtacgcccccaaccctggaggcggcagttactccttacagccatcaccgtgccttctccgtgatcagcggctgggcgtgaagagtggagattattcgaccatggagggacccgagctccggcattctcaaccaccaacgcctctgccacaagctcaggaagacgctatgtcttggtcttctcaacaggacaccctgagcagcaccggctactcacccgggacccgaaagagaaagtcaaggaagccctccttgtgccaggctacatctgccacccctacagaagggccaggggatctgctggtggaacagccgctcgctgaggagcagcccccctgcggcacttctctggccccggttaaacgggccgaaggagaggccgagggggcgcgcggggctgctgaaccctttctcgcacaagcacggctcgcgtgggaagcacagcaggcgcatttccatatgaagcagcggtccagttgggacagccagcaggatggatctggctatgagtccgacggcgctctccctctacccatgccgggacctgtagtgagagccttctcggaggacgaagctctcgcacaacaggagaaccgccactggcgacgtgggacattcgagaagctgggcttcccccagattcttctagaaaagagcgtatccgtgcagaccaacctagcgagcccagagccatacctccatccaagtcagtcagaagatcttgccgcctgtgcccagtttgagtcttcacggcagtcgaggtccggagttcccagttcttcatgcgttttcccaaccttcaccctgcgcaaaccatcttccgaaacggacatcgaaaactgggcctcaaagcactttaataagcacacacaggggttattccgaaggaaagtcagcatcgctaacatgctggcttggagctccgaatccataaaaaagccaatgatcgttacttctgacagacacgttaagaaagaggcctgcgagctgtttaagttgatccagatgtacatgggtgatcgcagggcaaaggctgacccactgcatgtggctctcgaagttgccactaagggctggtccgttcaggggctacgggatgaactgtacattcaactgtgccggcagacgactgaaaactttagactggagtctctcgctagagggtgggagctgatggccatctgcctggccttttttccccctactcccaagttccacagttatctcgagggctatatctaccgacacatggatccggtcaacgacaccaaagttacgcagcacattaaggagctgctggaaaggaacacaaagaagaagtctaaactgaggaaaaagcccaagccctatgtggaagaaccggacggggtggccataagcacttacgccaaatactgttaccataagttacagaaggcagcactgaccggcgctaagaagggactgaaaaaaccaaacgtcgaggagatccgtcatgcaaaaaacgcagttttctcaccctcaatgtttgggtctgcactgcaggaagtcatgggcatgcagcgggagaggtaccctgagagacaactcccctgggtgcagactcgcttgagtgaagaggtcctggctcttaatggtgaccaaacggagggaatctttagggttccaggcgatatagatgaggttaacgccctgaagctgcaggtggaccagtggaaggtacctacaggcctggaggacccccacgtaccagcctcactcttaaaactctggtaccgcgagttggaggagccgttaattcctcatgagttttacgaacagtgtatagcacactacgattctcctgaagccgcagtggcagtggtccatgctctcccccgtatcaacagaatggttctatgttacctgattcgcttcctccaggtgtttgtgcagccagcgaacgtggctgtgactaagatggatgttagtaacctggctatggtgatggcgcctaattgcttaagatgccagtcggacgaccctagagtgatcttcgagaataccagaaaagagatgtcattcctccgtgttttaatccagcacctggacacatcctttatggagggtgttctctag

SEQ ID NO: 24584 - DNA, 822 bp, Artificial Sequence
  Description of Artificial Sequence: Synthetic coding sequence
atgggccagaaggtgaccggcggcatcaagaccgtggacatgcgggatcctacgtacagaccacttaagcaggagctgcagggcttggattactgcaaaccaactcgactggacctactgcttgacatgccacctgtgagctatgacgtccagttgctgcacagctggaacaacaatgataggagcctcaatgtgtttgtaaaagaagatgataaactgatcttccaccggcacccggtggcccagtccaccgatgcgatccgagggaaagtgggatataccagagggctgcacgtctggcagatcacttgggccatgagacagagggggacccacgcagtcgttggggtagctaccgcagacgcccctctgcacagcgtggggtatactactttagttggaaacaatcatgaatcctgggggtgggacctcggacggaatcgattgtatcatgatggtaagaatcagccatctaagacatatcctgcttttttagagccagacgagacgttcatcgtgcccgacagcttcttggtggccctagatatggatgacggaactctgagtttcattgtcgatggtcagtacatgggcgtagcttttcggggccttaaagggaaaaagctttacccagttgtgtccgctgtttggggccactgtgagattaggatgaggtaccttaacgggctggatcccgagcctcttcccctcatggatctatgtcgtagaagtgttagacttgcactcggacgtgaacgtttgggggaaatccatacattgcccctcccggcttccctgaaagcgtatctgctgtaccagtag

SEQ ID NO: 24585 - DNA, 3633 bp, Artificial Sequence
  Description of Artificial Sequence: Synthetic coding sequence
atgccccggggcgaggcccccggccccggccggcggggcgccaaggatgaagccctgggcgaggagtctggggagcggtggagccccgagtttcatttgcaacggaagctggctgattcttcccattcagagcagcaggatagaaatagggtctctgaggagctgatcatggtcgtgcaagagatgaaaaagtacttcccctccgaacggcggaataaaccgagcaccttggatgcacttaactatgctctccgctgcgttcatagtgttcaggctaattccgagttcttccaaatactgagccagaatggggccccacaagctgatgtgtcgatgtactctctcgaggagctggcaactattgcctcggaacatactagcaagaatacagatacatttgtggcagtgttcagtttcttaagtggaagactggttcatatctcggaacaggccgctctgattcttaaccggaagaaggacgtgctagcctcatcccactttgttgacctgctcgcgccccaggatatgagggttttctatgctcatacagctagggcccaacttccattttggaacaactggacccagagggcagcagcaaggtacgagtgtgcgccagtgaagccttttttttgccggatccgcgggggggaagatcggaaacaggaaaaatgccatagcccattcagaatcattccctatctcatccatgtgcaccaccctgcccagccggagctggagagcgagccatgttgtctgactgtcgtcgagaagattcatagtggatatgaggctcctcgtattcctgtaaacaaacggattttcaccaccacccacacccccgggtgtgtgtttttggaggtggacgagaaggctgtgcccctgctgggctatttgccccaagaccttatcggaacaagtatccttagctaccttcatccagaagacagatccctgatggtggccatccaccagaaagtattgaagtacgccgggcacccacctttcgaacactccccaatccgtttttgtactcagaatggggactacattatcctagatagctcttggtcatcttttgtaaatccctggtcgcggaagatatccttcatcataggtaggcataaggtgcgcacttcccctctcaatgaggacgttttcgccacaaagatcaaaaagatgaatgataacgataaggatatcacggagcttcaggagcagatttacaaactgctgcttcagcctgtgcatgtgagcgtctcctctggctacggctcactgggttcctctggaagtcaggagcagctcgtgtccatcgcgtcttcgagtgaggcctcaggccatcgagtagaggagactaaggcggaacagatgacactccaacaagtgtatgcatccgtaaacaaaataaagaacctcgggcagcagctttacatcgaaagcatgacaaagtcctctttcaaaccagtgacaggaaccagaacagaacccaatggaggcggcgagtctgccaatggcgggggcgagtgcaagaccttcacttcattccatcaaacactcaagaataactccgtatatacagaaccctgcgaggacttacgaaacgacgagcactctcccagttatcagcagataaactgcattgattctgttatcagatacctgaaatcttacaacattcctgctctgaaacgtaaatgtatcagctgtaccaataccactagctcgagcagcgaggaggacaagcaaaaccacaaggccgacgatgttcaggccctccaagctggtctgcagatcccagccattcctaagagcgaaatgcctaccaacggacgctccattgatactggcggcggggctccacagattttgagcactgccatgctctccctgggaagcgggatcagtcagtgcggatattcctctactatagtgcatgttccgccacctgaaacagcccgcgatgccactctcttctgcgagccatggacattaaatatgcagcccgcccccttaaccagtgaggaatttaaacacgtcgggctcacggccgcagtgctgagtgcacatacccagaaggaggagcagaattatgtggataaattcagagaaaagatcctgagctctccctattcctcctaccttcagcaggaaagccggagcaaagctaagtatagttacttccagggcgactccacttccaagcaaactagatccgctggatgcaggaaagggaagcacaaacgtaagaagcttcccgaaccccctgattcctcatcctcaaacaccgggtctggcccacggaggggcgcacaccagaatgctcagccttgttgtccttctgcagccagctctccccacacttcaagtcccaccttcccaccagctgcaatggttcccagccaggcaccatacctggtgccggcctttcctctccctgctgcgacttcccctggacgggagtacgccgcccccgggacagcgcccgagggcctccacgggctcccgctgtccgaggggctccaaccgtaccctgcgtttccttttccctacttagacacattcatgacagtgttcctgccagatccccctgtttgtccactcttgagcccttcttttctcccttgcccttttctgggagcaactgccagctcagccatctcccccagtatgagctcagcaatgtcaccaactttggatccacctcctagtgtaaccagccagagacgcgaagaggaaaaatgggaagcccagtcagaagggcatccattcatcaccagccgttcctctagccctctgcagctgaaccttctgcaggaggagatgccccgcccatctgagtctcccgatcagatgaggaggaatacctgcccccagacagagtaccagtgcgtcactgggaacaacgggtcggaaagctcccccgccactaccggcgccctgtctacgggttccccaccaagggagaacccatcccatcctacagcttcagccctgtccaccggttccccacctatgaaaaaccccagccatccaacagccagtgcattatccaccgggagtccccctatgaagaacccatcccatcccactgcgtctacactgtctatgggccttcccccatccaggacaccaagccaccctactgctacagtcctctctactggtagcccaccatcagaaagcccgagtagaaccggctccgctgcatcaggatcatcagattccagtatttacttaacgtccagtgtatacagcagcaagatttctcagaatggtcaacagagccaggacgtccagaagaaagaaaccttcccgaatgtggccgaggagcctatctggcgaatgatccgacagacgccagaacgcatactgatgacataccaggtgccggagagagtgaaggaggtggtgctgaaagaggacttggaaaagttggagtccatgcgccagcagcagcctcagttctcccacggtcaaaaggaagagcttgcaaaagtgtacaattggatccagtcgcaaaccgtgacccaggagattgatattcaggcatgtgtgacatgcgagaatgaggattctgccgatggtgcagccacgtcatgcgggcaggtcttggtggaagatagctgttag

SEQ ID NO: 24586 - DNA, 1137 bp, Artificial Sequence
  Description of Artificial Sequence: Synthetic coding sequence
atgccccggggcgaggcccccggccccggccggcggggcgccaaggatgaggcccttggcgaggaatcgggagagagatggagtcctgaattccatctgcaacgcaagcttgccgactcctcgcactcagagcaacaggacaggaatcgcgtgtccgaagaactcattatggtggtgcaggaaatgaagaaatacttcccatcagaacgacgcaataagccaagcaccttagacgctctgaattacgcactaagatgcgtgcatagtgttcaggccaattcagagttttttcaaattctaagtcagaacggggcaccgcaagccgatgttagtatgtattccctggaagagctggccactatcgctagcgaacatacttcaaaaaataccgatacattcgtggcagtgttcagcttcctctccggacggttggtccacatttccgaacaggcagcactgattctgaaccgaaaaaaggacgtcttagcttcaagccatttcgtcgacctgctcgctccacaggacatgagagtgttctatgcacacaccgcgagagctcagctgcctttctggaataattggactcagcgcgcggctaggtacgaatgcgcccccgtcaagccatttttctgtcgtattagggggggggaggatagaaagcaagaaaagtgtcactcccctttcagaatcatcccttacctcattcacgtgcatcaccctgcacagcccgagctagaaagcgagccatgttgtttaacagtagtcgagaagattcatagtggatacgaagcgcctcggatccccgtgaacaaacgcattttcactacaacccacaccccaggctgtgtgttccttgaggtcgacgaaaaggccgtccccctcctgggatatttgccccaggatctgatcgggacctcaattctcagttacttacatcctgaagataggagtctcatggtagccattcatcaaaaagtgctgaaatatgctgggcacccacccttcgaacattcgccaattcggttttgcactcagaacggtgactatatcatcttagatagcagctggtcatctttcgtgaacccctggagtcggaagatctccttcattattggtcgacacaaagtgcgcacatag

SEQ ID NO: 24587 - DNA, 1794 bp, Artificial Sequence
  Description of Artificial Sequence: Synthetic coding sequence
atggagcggcccgcccccctggccgtgctgcccttcagcgaccccgcccatgcactgtccctgctccggggcctgagccagctgagagcagaaagaaaattcctggacgtgacgctcgaagctgccgggggccgcgacttccccgcccatcgagctgtgctggctgctgctagtccttatttccgtgctatgtttgctggccagctgagggagtctcgggccgaacgggtgagattgcacggggtaccgccggacatgctgcagctgcttctggacttcagttacactggacgcgttgctgtaagcggtgacaatgcagaacccttactgcgagccgccgacctcctccagttccctgcagtcaaggaggcctgcggggcctttctccagcagcaacttgacctcgccaattgtttagatatgcaggacttcgccgaggcctttagctgttctggactggccagtgctgcccagaggtttatactgagacacgttggcgagctcggcgctgaacaactcgagcgcctgccattggcccgactgttaaggtatttgagggacgacggattgtgtgttcctaaggaggaagcagcctaccagttggctttaaggtgggtgcgagccgatccgccgcgccgggccgctcattggccgcaactcctggaggcagttcgcttgccattcgttagaagattttacttgctggctcatgtggaggccgagcctttggttgcccgatgccctccatgtctgcgcctgctgcgggaggcgagggattttcaagcggcgcgctatgaccgacacgatagagggccctgtcctcgtatgagacccaggcccagcacgggcctcgcagaaatcctcgttctggttggtgggtgcgaccaggactgtgacgaactggttaccgtggattgctataacccccaaactggccagtggagatacctggcagagtttcctgatcatctgggggggggatattccatcgtggccctgggcaacgatatttacgtaactggcggcagcgatggttcccgcctgtatgactgcgtgtggaggtataatagctcggtcaacgagtgggcagaggtcgcacctatgttgaaggctagagagtatcactccagctccgtgctggatgggctgctgtacgtggtggctgcagattccaccgagcggtacgatcacacaaccgacagttgggaggctctgcagccaatgacttatcccatggataattgttccacaacggcatgtagagggagactctacgccatcggctcactcgcaggcaaagagactatggtcatgcagtgctatgaccccgatacagatctgtggtcactggtagactgtggacagctgccgccttggagcttcgcccccaagacagccacacttaacgggctaatgtactttgtccgagatgacagtgccgaggttgacgtgtataaccccacaaggaacgaatgggataagattccttccatgaaccaggtacacgtaggcggttcacttgcggtactaggcggcaagctgtacgtatctggcggctacgataataccttcgaattatccgacgtagttgaagcctacgacccagagacccgagcctggtctgttgtcggtaggctgcctgaaccgactttctggcacggatccgtctcgattttcagacagtttatgcctcaaaccttcagtggaggtaggggctttgagctggatagcgggagtgatgatatggatcccgggaggcctcgccctcctagggacccagatgagctgcactag

SEQ ID NO: 24588 - DNA, 1620 bp, Artificial Sequence
  Description of Artificial Sequence: Synthetic coding sequence
atggagcggcccgcccccctggccgtgctgcccttcagcgaccccgcacatgctttgagtctgcttcgggggctgagtcagctgagagccgaacggaaatttctcgacgtgactctcgaggccgctggaggcagggactttccggctcatagggctgttttagctgctgccagcccttatttccgcgccatgtttgctggccagctgagagagtcaagggctgagagggtccggctacacggagtaccacctgatatgctgcagcttctgctggacttctcatataccggtcgcgtggctgtctctggcgataatgctgagccacttttgagggcagccgacctccttcagttccctgcagtgaaggaggcttgtggcgctttcctgcagcagcagttagacttggccaattgcctcgacatgcaagacttcgcagaggccttctcctgcagcgggctcgcaagtgccgcacagcgcttcattttacgtcacgtcggcgagctaggggctgagcagttggaacgtctgcctttggctagactgctgcggtatcttagagacgatggcctgtgtgttcctaaagaggaggctgcctaccagctggccctgcgttgggtgcgcgctgatccccccaggcgggctgctcactggcctcaactattagaggccgttaggctgccatttgtgcgtcggttttatctgcttgcccacgttgaggccgaacctctggtcgccagatgcccgccctgcctcagactcctgcgggaggcccgcgacttccaggccgcacgatatgatagacacgatcgaggcccgtgccctcgcatgaggcctcggccctcaacaggtttagccgaaattctggtcctcgttggcggttgtgatcaggattgcgatgaactggtcaccgtcgactgctataacccccagacaggtcagtggcggtatttggccgagttcccagaccacctgggaggcgggtattccatagtcgctttgggcaacgacatctacgtcaccggaggctcagacggttcccggttgtatgactgtgtgtggagatataactcctccgtgaacgagtgggctgaagtcgctcccatgctaaaagctagagagtatcattctagtagcgtcttggacgggttgctctacgtggtcgctgcggattcgacagaaagatatgaccatactaccgattcttgggaagccctgcaacctatgacttatcccatggataattgttctaccaccgcatgccgcggtagactgtacgcgatcggatcccttgccggcaaggaaactatggtgatgcagtgctacgatcccgacaccgacctttggtccctcgttgattgtggtcagctcccgccatggtccttcgcacccaagaccgcgactctgaacggcctcatgtacttcgttcgggacgatagcgcggaggttgacgtctataacccaacgcggaacgaatgggacaaaatcccgagcatgaaccaggtgaatttccaggcaggacagcattggaaacatcgcctggtattaatcctccagcctaaatgtcatagggacgaatgtctcggcagtacggccatgatgggggggtcgcatttgaattag

SEQ ID NO: 24589 - DNA, 2067 bp, Artificial Sequence
  Description of Artificial Sequence: Synthetic coding sequence
atggacggcagcttcgtgcagcacagcgtgcgggtgctgcaggagctgaataaacagcgcgaaaaaggacagtactgtgacgcgactttggacgtgggcggtctcgtgttcaaagcccactggagcgtgctggcctgttgtagtcacttttttcagtctctttacggcgacggctccggcggctctgtagtgctgcccgctggctttgcagagatcttcggcttgctcctggatttcttttacactgggcacctggccctgactagtggcaaccgcgatcaggtcctcttagcggctcgcgagctaagagtgcctgaagcggtagaactgtgtcaatctttcaagccgaaaacgagcgtgggacaagctgcaggtggccagtccggactcggtccacccgcgtctcagaatgtcaattctcacgtgaaagagccagcggggctggaggaagaggaggtgagccgcaccctgggcctggtacctcgcgaccaggaacctcgaggaagccactcccctcagcgcccccagctgcactcacctgcacagtctgagggtccttcatcactgtgtggcaagctgaaacaagccttgaagccatgtcccctcgaggataaaaagcctgaggattgtaaggttcctccacggcctctagaggcggagggcgcgcagcttcaagggggatctaatgaatgggaggttgtcgtgcaagtggaagatgatggcgatggagactacatgagtgagccggaagccgtgcttaccaggaggaaatcaaacgttatcagaaagccttgtgccgctgaacctgcgctgagtgctgggtctctggccgctgagcctgcagagaacaggaaaggcactgctgtgcctgtggaatgcccgacctgccataaaaagttcctaagcaaatactacctcaaagtgcataataggaaacatacaggcgaaaaaccatttgagtgcccaaagtgcggtaaatgttacttccgaaaggagaatctcttggagcacgaggctcgaaactgcatgaaccgttctgaacaggtcttcacttgctccgtttgtcaggagaccttcagaaggagaatggagctacgtgtacatatggtgtcccatactggggaaatgccctataagtgctcttcatgtagtcagcaatttatgcaaaagaaggaccttcaaagccacatgattaagttgcatggggcaccaaagccacacgcctgcccaacgtgtgccaagtgcttcctgagccgaacagaactgcagctccacgaggcgttcaagcacaggggcgaaaagttgtttgtgtgcgaggaatgcggacacagggccagttcacgaaacggtctacaaatgcacattaaagcgaagcatagaaatgagcgcccacatgtatgtgagttttgcagccatgccttcacccaaaaggcaaatctgaacatgcaccttaggacgcataccggagagaaacccttccagtgtcatctgtgcggaaaaacatttaggacacaagcttccctggataaacataaccggacgcatacaggagaaagaccttttagctgtgagttctgcgagcaaaggttcaccgaaaagggacctctgctccgacacgtggctagcagacatcaagagggaaggccacacttttgccagatttgcggcaagacattcaaggccgtggagcagctccgcgtccacgtgcggaggcataagggtgtgagaaagttcgaatgtacggaatgcggttacaaattcacacgccaagctcacctgcgtcgacacatggagatccacgacagagttgagaattataacccgcgtcaacggaaactacgaaatctgatcatcgaagatgagaagatggtcgtcgtggccctccagcctccagccgagctggaggtgggcagtgcagaagttatagttgagtctctcgcacagggcgggctggccagtcagttacccggccagagactgtgcgccgaagagtcattcacaggtccgggggtcctggagccctcactgatcatcactgccgcggtcccggaagactgtgacacctag

SEQ ID NO: 24590 - DNA, 525 bp, Artificial Sequence
  Description of Artificial Sequence: Synthetic coding sequence
atgacccactgctgcagcccctgctgccagcccacctgctgccggaccacttgttgccggacaacatgttggaaacccacgacagttactacttgttcatcaaccccctgttgtcagcccgcctgttgcgttagctcttgctgccaaccctgttgccgccccacctgctgccagaacacctgttgcaggaccacatgctgccagccgacctgcgtgacctcatgctgccaaccctcgtgctgttctactccatgctgccagcctacctgttgtggctcctcatgttgcggccagactagttgtggctcctcttgcggacagagctccagctgcgcccccgtgtattgtagacgcacttgctactatcctacaaccgtatgcctgcctggctgcctgaaccagagttgcggatccaactgttgtcagccttgttgccgcccggcgtgctgtgaaactacatgctgcagaaccacgtgcttccaaccaacctgtgtgagttcttgttgtcaaccaagttgttgttag

SEQ ID NO: 24591 - DNA, 597 bp, Artificial Sequence
  Description of Artificial Sequence: Synthetic coding sequence
atggtgagcagctgctgcggcagcgtgtgcagcgaccagggctgcagccaggacctctgccaggagacctgttgccgcccgtcgtgctgccagacaacttgctgccgcactacttgttaccggccctcttgctgcgtatcctcatgttgcagaccacagtgctgccagagcgtctgttgccaacctacatgttgccgcccccccaggtgctgcatctcctcgtgctgcaggccaagctgttgtatgagtagctgctgcaaaccacaatgctgtcagtctgtctgttgtcaacctacaacaacatgttgtcaccctcgttgctgcatctcctcctgctgccggccatcttgctgcgtgtcctcatgctgcaagcctcagtgttgtcagtcagtgtgctgtcagcccaattgctgtaggccctcttgcagtattagcagctgttgcaggccatcatgttgtgaatcctcatgttgccgaccttgttgttgcgtccgcccagtgtgtggtagggtgagttgtcataccacgtgctacaggcctacttgcgtgatatcttcttgtcctaggccattgtgttgcgcctcatcctgctgctag

SEQ ID NO: 24592 - DNA, 1296 bp, Artificial Sequence
  Description of Artificial Sequence: Synthetic coding sequence
atgaccagcgactgcagcagcacccactgcagccccgagagctgcgggacagccagcgggtgcgctcccgcttcatcatgttctgtcgaaaccgcctgtctcccgggaacctgcgctacatcaagatgtcaaaccccgagcttcctcagtcggtctcgcggcttaacaggctgcctgctgccctgctacttcaccgggtcgtgcaactctccctgcctggtgggaaactgtgcctggtgtgaggatggagtgtttacttctaacgaaaaagagacaatgcagttcctgaatgatagactcgcgtcatacctggagaaagttcggtctctggaagagacgaatgccgagctggaaagccgtatccaggagcagtgcgaacaggatatacctatggtgtgccctgactaccagcgctattttaatacaatcgaggacttacaacagaagatcctgtgcaccaaggccgagaattctcggctcgccgtgcagcttgacaactgtaaactggctaccgatgatttcaaaagcaaatacgaatccgaactgtctctgaggcaactccttgaagccgacatctctagcttacacggcattcttgaagagttgactctgtgcaaaagtgaccttgaggctcatgtggagagtctgaaggaggacttgctttgcctgaaaaagaaccatgaggaggaggtgaacctgctacgggaacagctgggcgaccgattgtcagtagaacttgacaccgcccccacactggacttgaacagggtgctggacgaaatgcgttgtcagtgtgagactgtgctcgctaacaaccggagagaggccgaagaatggctcgccgtgcaaaccgaggaactgaaccagcagcagttgagcagtgccgaacaattacagggctgccaaatggagattctcgagctcaagcggactgcctcggcgctcgaaatcgagttgcaagcacagcagagtctcaccgagagtcttgaatgcacagtggccgagacagaggcacagtactcatctcagcttgcgcagatccagtgcctgatcgacaacttagagaaccagttggccgaaattcgctgtgacctggagaggcagaaccaggagtatcaagtgctcctcgacgtaaaggcccgcctggaaggcgaaatcaatacctactgggggctcctggactccgaagactcacgccttagctgttctccctgttctaccacttgcactagctccaatacctgtgagccatgctctgcttatgtgatctgtacggttgaaaactgttgtttatag

SEQ ID NO: 24593 - DNA, 1047 bp, Artificial Sequence
  Description of Artificial Sequence: Synthetic coding sequence
atggccggcagcctgcccccctgcgtggtggactgcggcaccggctataccaaactaggatacgccgggaacaccgagcctcagtttatcattccctcttgcatcgccattagggaatcagcaaaagtggtggatcaagcacagaggcgggtgcttcggggcgttgatgacttggacttctttattggcgacgaggctattgacaagcccacctacgccaccaaatggccaattcgccacggtattatcgaggactgggaccttatggagcggtttatggaacaagtcgtgtttaagtatctcagagctgaacccgaggaccattacttcttgatgaccgagcctcccctgaatactcccgaaaatcgagaatacctggccgaaatcatgtttgagagttttaacgtacccggcttgtacatcgctgtacaagccgtcctggcgctcgcagcaagctggaccagtaggcaggtgggagaaagaacattaactgggatcgtcattgactccggcgatggtgtaacacacgtaatcccagtcgctgaagggtacgtgatcgggtcatgcattaagcatatacccatagctggcagggacatcacctatttcatccagcagttgttgagagaacgagaggtagggatacccccagagcagtccctcgagacagctaaggcgatcaaggaaaagtattgttacatttgtcccgatatcgtgaaggaatttgccaagtatgacgtggatcctcggaagtggataaagcagtatacgggaatcaacgccattaaccagaagaaatttgtcatcgacgtgggatacgagaggttcctgggtccggaaatcttctttcaccccgagtttgctaaccccgatttcatggaaagtatatcggacgtggtagacgaagtaatccaaaactgcccgattgatgtgcggagacccctgtacaaacccgaattcttccaagtgtgtcataccaagaaggattacgaagaatatggcccgtctatttgtaggcataatcccgtctttggcgtcatgtcatag

SEQ ID NO: 24594 - DNA, 273 bp, Artificial Sequence
  Description of Artificial Sequence: Synthetic coding sequence
atggacaacatgagcccccggctgcgggccttcctgagcgagcccattggggagaaagacgtctgttgggtcgacggcatttctcacgagctggctattaaccttgttactaaaggcattaataaagcatatattctccttggtcagtttctgctgatgcacaagaacgaggcggaatttcaacgatggttgatctgctgtttcggtgcaacagagtgtgaagcacagcaaactagccattgccttaaggaatggtgtgcttgctttctgtag

SEQ ID NO: 24595 - DNA, 249 bp, Artificial Sequence
  Description of Artificial Sequence: Synthetic coding sequence
atggccagcagcagcggcgccggcgccgccgccgccgccgccgccgccaatctaaacgccgtgagggaaaccatggacgtgctgttggagattagtcgcatactcaacaccggccttgatatggagaccctgtccatatgtgttaggctttgcgaacagggaattaatccagaagctctttccagtgtgatcaaggaactacgcaaagcaacagaggcattgaaagcagcagagaacatgacctcctag

SEQ ID NO: 24596 - DNA, 3732 bp, Artificial Sequence
  Description of Artificial Sequence: Synthetic coding sequence
atggagacccgggccgccgagaacaccgccatcttcatgtgcaagtgctgtaatttattcagccccaaccagagcgaacttctaagtcacgtgagtgagaaacatatggaagagggggtgaacgtcgatgaaattatcatccctctgaggcccctctccaccccggaaccgccgaattcttccaaaaccggagacgagttcctcgtgatgaaacggaagaggggcaggccgaaaggctcaacaaagaagtcaagcactgaggaagagcttgccgagaatattgtgtccccaactgaggattcccctctcgcaccagaggaaggcaattccttacctcctagttctcttgagtgctcaaaatgttgccgaaaattttcgaacactcgccagctgaggaagcatatatgcataatagtgctcaatctcggtgaggaagaaggcgaagcaggcaacgagagcgatctggaactggaaaaaaagtgtaaagaagacgaccgcgagaaagcatccaagcggccgaggagtcaaaagaccgagaaagtccagaagatttccggaaaggaggcacgtcagttatccggcgcaaagaagcccatcatctcggtagtgctgaccgctcacgaagccattcctggtgccacaaagatcgtgcccgtagaggctgggccaccggaaacaggagctacaaactccgagacaacatcagctgacctggtgcctcgccgcggctatcaagagtacgctatacaacaaactccatatgagcaacccatgaagagttcgagactgggacccacacagctcaagatcttcacgtgcgagtattgcaacaaagtgttcaagttcaaacattccctccaggcccacttgagaatccacacgaacgaaaaaccatataaatgtccccagtgctcctacgcatccgctataaaagcaaatctgaatgtgcacctaaggaagcacacaggtgaaaagtttgcatgtgattattgctcattcacatgcctctcgaaggggcatttgaaagtgcacatagagcgagtgcacaagaaaattaaacaacactgccggttttgcaaaaagaagtattctgacgtgaagaacctgatcaaacacatacgagacgcccatgacccccaagacaagaaggtcaaggaggcattagacgagttatgcttgatgacaagggaaggcaaaagacagcttctgtacgattgtcatatctgtgagaggaaatttaagaacgagttggaccgagacaggcatatgctggtccacggcgataagtggcccttcgcctgtgaactgtgcggccacggagccacaaagtatcaggctttggaattgcacgtgagaaagcacccttttgtctacgtgtgcgctgtttgtagaaagaagtttgtgtcttcaattagactgcgaacccatatcaaggaggttcacggcgcagctcaggaagcgctcgtcttcacgtccagcattaaccaatcattctgcctcttggagccaggcggtgacattcaacaggaggctctgggcgaccaactgcagttggtggaagaggaattcgcgctccaaggtgtgaacgccttgaaagaggaggcctgtcccggcgacacgcagctcgaagagggaagaaaggagcccgaggcacctggggagatgccggcacctgcggttcacttggctagcccccaagctgaatccaccgctctgccgccttgcgaactagaaaccacagttgtgagttccagcgacctgcactcccaagaagtggttagcgacgattttcttctgaaaaatgatacctccagcgctgaagctcatgccgcccctgaaaaaccacctgatatgcaacacagaagttcagttcagacgcagggggaagttatcaccctcctgctgagcaaggcccagtcagcaggtagtgaccaggaatctcacggcgctcagtctccactgggggaaggtcagaacatggccgtgttgagcgcaggcgaccctgacccaagtcgctgcctcaggtccaaccctgctgaggcttccgacttgctgcccccggtcgcaggtggtggcgatactattacccatcagcccgatagctgtaaggctgccccagagcatcgttccggcattaccgcattcatgaaggtgctcaatagcttgcagaagaaacagatgaatacgtcactttgcgaacgaatcaggaaagtgtacggcgatctcgagtgcgagtattgtggtaagctcttttggtatcaagttcattttgacatgcatgtgcgcacacacacacgagagcacctttactactgctcacagtgccactattcatcaattactaagaactgtctgaaacgacacgtaattcaaaagcactctaatatcctgctgaagtgccccactgacggatgtgattacagcacaccagacaaatataagcttcaagcccacctgaaggttcataccgccctggacaaacggagctatagttgcccagtctgtgagaaaagctttagcgaagatcgcctcattaagtctcacattaagacaaaccaccccgaggtttcaatgagtaccatctctgaagtgctcggccgcagggtccagctgaaaggactgatagggaaacgcgctatgaagtgtccttactgcgacttttattttatgaaaaatggaagcgacctccagcgccacatttgggcacacgagggtgtgaagccgttcaagtgttctctctgcgagtacgccacgcgtagtaagagcaacttgaaagcccacatgaatagacattccaccgagaagacgcacctctgcgatatgtgcggcaagaaatttaagagcaaaggcactctcaagagccacaaactccttcatacggcggatgggaaacagttcaaatgcaccgtctgcgactataccgctgctcaaaaaccccaacttttgaggcatatggagcagcacgtgtccttcaagccattcaggtgtgcccactgtcattactcatgcaatatctctgggtcgctgaagcgacattacaacaggaagcatcccaacgaggaatatgcaaatgttggtaccggcgaactggccgctgaggtgttgatccagcagggcggcctgaagtgccccgtgtgctcatttgtgtacggcactaaatgggaattcaataggcatctgaagaacaaacacggactaaaggtagtggaaatcgatggggatcctaaatgggaaacagcgacagaagcccccgaagagcccagtactcagtacttgcatatcacagaggcagaagaagacgtgcagggtacccaggcggccgttgcagccctgcaggatctgaggtacacgtccgaatcaggggatcgactggaccccacggcggttaatattttgcaacaaattattgagctgggagccgaaacacacgacgccacagcactagcctcagtagttgctatggctcctggaacagttacggtcgtgaagcaagtgactgaagaagagccgagctcaaaccataccgtcatgattcaggaaaccgttcaacaggcatccgtggagttggctgaacagcaccatctcgtcgtctcctccgatgatgtggaaggtatcgagactgtgaccgtctacacccagggaggagaagcaagtgaatttatagtttatgtgcaggaagcaatgcagccagtagaggaacaggccgtggagcagccagcgcaggaattatag

SEQ ID NO: 24597 - DNA, 2274 bp, Artificial Sequence
  Description of Artificial Sequence: Synthetic coding sequence
atggccctgggcgaggagaaggccgaggccgaggccagcgaggacaccaaggcccagtcatatggcagaggaagctgtcgggaacgagagctggacatccctggcccgatgtctggagagcagcctccgaggctggaggctgagggcgggctcatcagtcctgtgtggggcgctgaggggataccggcccctacatgttggattggaacagaccctggggggccctcccgtgctcaccagccccaggcgtcggacgccaacagagagcctgtggcagaacggagcgagcccgccctctccggacttcctccagcaactatgggaagcggagacctgctgctaagcggcgagtcccaggtggagaagactaaactgagcagctctgaagagtttcctcaaacgctcagcctgcccaggacgactaccatctgttccgggcatgatgcagacactgaagacgacccaagtcttgcagacctgccacaggcactggacctgtctcagcagccacactctagcgggctctcttgcctaagccagtggaaatccgtactgtccccagggtcagctgcccagcccagctcctgttccattagcgctagtagtaccggctcgtcactgcagggccaccaggagcgtgccgaacctcgcggcggatccctggcaaaagtctccagcagccttgagcccgtcgttccccaagagccgtcctctgtagtgggactcgggcctcgacctcagtggagtccacaaccagtcttctccggaggggatgcttcgggtctcggccgcagacgattgtccttccaggctgagtattgggcctgcgtgctgcccgactcacttccaccgtcgcctgatcgccactcaccattgtggaatccaaacaaggagtatgaggatctgttggactacacctacccactgcgccccggccctcaattgcctaagcacctcgactcaagggtgcccgccgatccggtgctacaagacagtggcgtggatttagacagtttctcggtctccccagcgagtaccctgaagagccccacaaacgtgagtcccaactgtcctcccgctgaagcgaccgcacttcccttctccggcccccgcgagccatctctcaaacagtggccgtctcgagtcccacaaaaacagggagggatgggattggcttcttggagtcagctggctagcactccccgtgctcccggctcccgcgatgcccgctgggaacgtcgtgaacccgccttgcgtggggccaaggacaggctgaccataggcaaacatctggatatgggaagcccgcagcttcgtacaagggatcgtggctggccatctccccggcctgagcgagagaaaagaacatcccagagcgctagaagaccaacctgtaccgagtcccgatggaagagtgaagaggaggtcgagtccgacgatgaatacctagcgctcccagcacgccttacccaagtgagttctctggtgtcttacctgggatccatttccactcttgttactcttcccacaggggatatcaaaggacagagcccacttgaggtgtcagactcagatggcccagccagtttcccaagttcctcatctcagtctcagcttcctcctggagcggccctacaagggagtggagaccccgaaggccaaaacccctgctttctgcgatcattcgtgagagcacacgattccgccggagaaggatctctaggcagttctcaggccttgggcgtcagcagcggattgctcaagacaagaccctcgctccctgcaaggctagaccggtggcctttttccgatccagacgtggaggggcaactccctagaaagggaggcgagcagggtaaggaatctctcgtgcagtgcgttaagacattctgttgtcagctggaggaactgatttgctggctttacaatgtcgctgatgtgacagaccacggcaccgccgctaggtccaacctcacctccctgaagagctcactgcagctgtacagacaattcaagaaagacattgacgaacatcagagtctgactgaatctgtcctgcagaagggggagatcctgctgcaatgcctgctggagaataccccagtgttggaggacgtacttggccggatcgctaaacagagcggcgaattggaatcccatgccgatcgtttatatgacagcatcctggcttctctcgatatgctggctggctgcaccctcataccagacaagaagcctatggcggccatggagcatccctgtgaaggcgtgtag

SEQ ID NO: 24598 - DNA, 540 bp, Artificial Sequence
  Description of Artificial Sequence: Synthetic coding sequence
atgaaccccagcatgaagcagaagcaggaggagatcaaggagaacatcaagaattcctccgtccctaggcgcacacttaagatgatacaacccagtgccagcggtagcctggtaggccgggaaaacgaattgtccgcagggttgtctaaacggaaacaccgaaacgaccacctcacatccactacttcgagtcccggggtgattgttccagagagttccgaaaataagaatctaggtggagtcacacaggagagctttgatctcatgattaaggagaacccatcttctcaatactggaaagaagtggccgagaagagacgcaaggcgctttacgaggctctcaaagagaatgaaaaattgcataaagaaatcgagcaaaaggataatgagattgcgcgcctcaaaaaggagaacaaggagttggctgaagtcgcagagcatgtgcagtatatggccgaattgattgaaaggctgaacggagaacccctggataatttcgagtctctggataaccaggagttcgactctgaggaagaatag

SEQ ID NO: 24599 - DNA, 309 bp, Artificial Sequence
  Description of Artificial Sequence: Synthetic coding sequence
atgaaccccagcatgaagcagaagcaggaggagatcaaggagaacatcaagaactcatcggttccccgtaggactctgaaaatgattcaacctagcgccagcggcagcctcgtgggccgggaaaacgaactgtcagcagggctgtctaaaagaaagcataggaacgaccacctgacaagcactacttcttctcctggggtcatcgtcccagaatcctctgaaaataaaaatttagggggagtgacccaggagtctttcgacctaatgatcaaagagaaccctagcagccagtactggaaggaggtgtag

SEQ ID NO: 24600 - DNA, 2259 bp, Artificial Sequence
  Description of Artificial Sequence: Synthetic coding sequence
atggccgagcccgccagcgtgaccgtgaccttcgacgacgtggccttgtatttttccgagcaggaatgggaaatcctcgagaaatggcagaagcagatgtataagcaggaaatgaaaactaactacgagacccttgactcacttggctacgctttttctaagcctgatctgattacctggatggagcagggcagaatgctgttgattagtgaacagggatgcttagataaaactcgtcgcacaacaagcccccccacagatgaacagctgaatatgaaaaacactggcaaactcctgtgcttcgacgatgagggcactcccagaacgaaggaggaggactgcagactcaatggtcctcagaagcaggatttatgcgccgccttgcggggcaaagaacggaaaattctgctcgcccagacagctacttttcagtcgccatctctgagggagacggaaattttaaataagaaggtaagtatcaccgcctacgatccagacaagaaggacctgcgccacaagccccgggaaacccccggcaggcttgagatcccaactgggccaagatgttatagttgctatgtctgccggaaggtttttcaagttcggcgagacctcctcaaacataagaggagccactctaaatcgcagctgtgcagataccctaagtataagaacagttctagaggcaagtctgagctccgtcggacacaacgcctgctgtgccagaaaaaaagatttcaatgctcagaatgcgagaaatcttatttccttaagggatccctggttactcatcaagtggtccatactgggcaaagaccatacccttgtccagaatgcgacaaaacctttcgatatagagcaaatctgaaaaaacatttatgcctgcatcgtggggagagacccttttgttgtggcgaatgcggaagggccttcgtgcagcagtgtgaacttaccgagcacctccggcttcactctggcgaaaagccattccagtgtccccagtgcgaccgctgcttccgcctcaagcggggcatgaaagtgcacctaacgcagcattccggaaagcggcctttccactgccctgagtgcggcaggagcttcagccggaaggcggccctcaaaacgcaccagcgtacccactccgaagagaagcctttcagctgcggagaatgcggcagaaagttcatctataagatcaagttggatgagcacattagggtgcacacaggtgagaagccgttcagttgccctgagtgtaacaaaagctttcgactgaagaggagcctgaaggcgcacggcctccagcacatcggtaagcggccctttcaatgccccgaatgttcacgaggcttcttttggcgcaatgcaatgagagcgcaccagaggctgcactccgaacagaaacctttcccctgcgctgaatgcggcaaacggtttacacgaccaagtaagctcgcatgtcatacacgggtgcatgacaggcagaaggaattcccatgcggagagtgcaaaaagacattcagtcaacagtctaggctgacacaacacctgaaggtgcatactactgagaaaccttttagctgcgcagagtgcggccgttctttccgccgacgtgcccacttgacagagcatacaaggctgcactccggtgaagagccctttcagtgccccgagtgcgataaatcgttttcatggaaagcatcaatgaaattccatcaacgcatgcatcgtgatgaaaagccctttgcttgtggggagtgtgacaaaacatacacccaccagagccagctgactgagcatctgcgccttcatagcggagaaaaaccctaccagtgtcctgagtgtgaaaagacattccggctgaaaggcaaccttaaatcccacttgctccagcactctggacaaaaaccattctcttgtgtgatgtgtggaaagtcatttacgcagcagtaccgccttaccgagcacataagggtgcatagcggcgagaagccctttcagtgcccagaatgtgacaaatcgtactgcattaggggatcgctcaaggttcacttgtacaaacactctggtgaacgcccatttcagtgtccagagtgtggcaaaggcttcctgcagaagcgatctcttaaagcgcatctgtgcctccattctggcgaaagaccttttagttgcgacgaatgtggccgcagttttacatatgttggtgccctgaaaacccatatagctgtccatgcaaaagagaagcctagcagcttatag

SEQ ID NO: 24601 - DNA, 1935 bp, Artificial Sequence
  Description of Artificial Sequence: Synthetic coding sequence
atgttcctgacctacatggagaccgtgaccaaggagctggtgagctggatgagaggccacgagtcaagcgttttctctatctctgtccatgcaagcggcaagtatgccattactacaagttctgatactgcgcagctgtgggatctcgatacctttcagcgcaaacgaaagctaaatattcgccaaagcgtggggattcagaaagtgttctttctcccccttagcaatacaatactatcatgtttcaaagataacagtattttcgcctgggaatgtgacacattattctgcaaatatcaactgccagctccgcccgagtcatcgtctatcctttataaggtttttgcggtgacccgggacggccggatccttgccgcgggcgggaaaagcaatcatctccacttgtggtgtctggaagctagacagttgttcagaataatacagatgcctacaaaagtccgagcaatacggcacttagaattcttaccagacagttttgacgctggatccaatcaagttttgggcgtcctctcacaggacgggataatgcgctttattaatatgcagacctgcaaacttttgtttgagataggctctttggatgaggggatttctagtagcgctatcagcccccacggtcgctacatagcatccatcatggaaaatggatctctgaatatttattcggttcaggctcttacacaagaaattaataagcctccaccccccctggtgaaggtcattgaagacctgcccaaaaacaaactctcctcctctgacctgaaaatgaaggtcacctcaggacgggttcagcagcccgctaagagccgagaaagcaagatgcagacacggattctcaagcaggacttgacgggtgatttcgagagcaagaagaacgaattgccagacggcttgaataagaaacgcctccaaatcctgttaaaaggttacggggagtaccccactaagtacaggatgttcatctggcgatccctgcttcagcttcctgagaatcatactgcatttagcaccctgatcgacaaggggacgcatgtcgcgtttctcaatctacagaagaagtaccctatcaaaagtaggaagttgttacgagtgctgcagcggacactgtccgcgcttgcccattggagcgtgatcttctcagatacgccttatctgccactcctggcttttcccttcgtcaaactctttcagaataaccaactgatctgcttcgaagtgattgcaacattgattattaattggtgccagcattggtttgagtactttcctaaccctccaattaacatccttagcatgatagaaaacgtccttgccttccacgacaaagaactgctgcagcatttcattgatcatgacattacatcccaactgtacgcctggcccttgctggagactgtgtttagcgaggtcttaacccgggaagagtggctcaagctgttcgacaacatattcagcaatcacccttcatttctgctgatgactgtcgtggcctacaatatctgtagtcgaacaccactgctgtcttgtaatcttaaggacgacttcgaattcttcttccaccacagaaacaatctggatatcaacgtggtgatccggcaggtgtaccacctaatggaaaccacacctactgacatccatccagatagcatgctgaatgtgtttgtggcactgacaaagggccagtatccagtgtttaaccaatacccgaagttcatcgttgactaccaaacacaggagagggaacgcattagaaatgatgagctggactatttgcgagagcgtcagctgaaaatttgtaaacttaaatcaacctccaaagagctcaagatgaagctgggaacgagaaatagatcctgtttcgtgaagcttaagaaacaggaggaaaagtgttcctataaacgacgccggaagtag

SEQ ID NO: 24602 - DNA, 735 bp, Artificial Sequence
  Description of Artificial Sequence: Synthetic coding sequence
atgccccacaagatcggcttcgtggtggtgagcagcagcggccacgaggacggcttctctgcgagggagctcatgattcatgctcccactgtatcagggtggagatccccacgtttttgccagttcccccaggagattgtccttcagatggtggaaaggtgcaggatacgcaagctccagttattggcccaccaatacatgattagttccaagattgagttctacataagcgaaagtcttccagagtattttgcaccctaccaagcagaacgcttccgtaggctgggatacgtatccttgtgcgataacgaaaaaacagggtgcaaggcccgggaactgaagagcgtctacgtcgatgctgttggccaatttctgaagctgatttttcatcagaatcacgtgaataagtacaatatctataatcaggtagctctcgtcgctatcaatattattggggaccctgccgatttctctgatgagagcaacacagccagccgagaaaaattgatagatcactacctcgggcataacagtgaagatcccgctcttgagggaacttacgcttctagtgtgcgcactgggggcgagagcacatttggcgagctcaagggacctgcagttccttccagcgttaccctctcagtcctgggaacctctcttggacagtggtttccatgccaccttcccgcagtggacgataacgaaggcacgccgtttcagaggtgcctcgtatag

SEQ ID NO: 24603 - DNA, 2778 bp, Artificial Sequence
  Description of Artificial Sequence: Synthetic coding sequence
atgccccacaagatcggcttcgtggtggtgagcagcagcggccacgaagacgggttctctgctagagaactgatgatccatgcgcctaccgtgtccggctggaggtctccaaggttctgtcaattcccccaggagattgtcctccagatggtggaacggtgccgtatccggaaacttcagctgttagcccaccaatatatgattagctctaagattgaattttacatttcggagtccctgccagagtatttcgctccctatcaggccgaaaggttcaggcgtctcgggtatgtctctctttgtgataacgaaaagactggctgcaaggcaagggaactgaagagcgtttacgtcgatgcggtaggacaattcctgaaactgatattccatcagaatcacgttaacaagtacaacatctacaatcaggtcgcgctggtggcaataaatattatcggagaccctgctgatttttctgacgagtctaataccgcctcccgagagaaactcattgatcactatctcgggcataatagcgaagaccccgctctggagggaacgtacgccagaaaaagcgattacatttctcccctcgacgacctcgcattcgacatgtatcaggatccggaagtggcacaaatcatccgaaaactcgatgaacgaaaacgggaggcagtccagaaggagcggtatgactacgccaaaaagctgaagcaggccattgctgacctgcagaaggtaggcgaacggctcggtcggtatgaagtggagaaaagatgcgctgtggagaaagaggattacgatttagccaaagaaaaaaagcaacagatggaacagtaccgcgctgaagtttacgaacagcttgagctgcacagtctgctggacgctgaactgatgcggagaccctttgatctgccattgcagccattagcacgttcaggctccccttgccatcagaagcctatgccttcactgccacagttggaagaaaggggcactgagaatcagttcgccgagccattcttacaggagaagccttcttcttactcgttgactatctccccccaacacagtgcagtcgaccctttgctgcccgccacagatcctcatcccaagataaatgctgaatcattaccctatgatgagcgccccttgccagctattcgaaagcactatggagaggctgtcgtggaacccgagatgtctaacgccgatatctcagatgccaggcgtggcggtatgctaggcgagcccgagcctctcaccgagaaggcactgcgggaagcttcatctgcaatagacgtgctcggcgagacattggtcgcagaagcttattgtaaaacttggtcttaccgcgaggatgccctgctcgccttaagtaagaagttgatggagatgcccgttggtacacctaaagaagaccttaaaaataccctgagagcttctgtcttccttgtcaggcgggctattaaagacatcgtgactagcgtgtttcaggcctcactgaaacttcttaaaatgattatcacacagtatataccgaagcacaaactgagcaagttggaaactgcccattgtgttgagagaaccatccccgtgctgctgacacggacaggtgatagtagcgctcgtctaagggtcactgccgcaaattttattcaggagatggcattatttaaggaggtgaaaagcttgcaaatcattcctagctaccttgtacagccactgaaagccaactcatcagtgcatctcgctatgtctcagatgggccttctggcgcgactgctcaaggacttggggacagggtccagtggtttcaccattgacaacgttatgaagttttcagtatctgcccttgagcacagagtgtacgaagttcgggaaactgcagtcagaatcattttagacatgtatcgacaacaccaagcatccatcttagaatatttgcctcctgatgacagcaacacacggcgaaatattctatacaaaaccatttttgagggtttcgcaaagatcgacgggagggctacagatgcagagatgcgtgcccggagaaaagcggctacggaagaagccgaaaaacagaaaaaggaggaaataaaagccctgcagggccagctggctgcgcttaaagagattcaggcagaggttcaggagaaggaaagcgacgcagtgaaaccaaaaaaccaagatatccagggaggtaaggccgctccagccgaggccttagggattcccgacgagcactacttggacaacctctgtatcttttgtggagagcggagcgagtcattcactgaagaaggactcgatcttcattactggaaacactgcctcatgttaacccgctgcgatcactgcaagcaggtagtggaaatatccagcttaaccgagcatctgttgaccgagtgcgacaagaaggacgggttcgggaagtgctaccgttgctctgaggcagttttcaaggaagagctgccgaggcatataaagcacaaggattgcaacccagccaagccagaaaagctggcgaatagatgccccctgtgtcatgagaacttcagccctggcgaggaagcctggaaggctcacctgatggggcccgcgggctgcaccatgaaccttcgcaagacccacattctgcaaaaggcccctgcactgcagccagggaaatcgtctgctgtcgccgcgtccggtcccctgggcagtaaggccgggtccaagataccgaccccaaaggggggcctgtcaaaatcgtcttctagaacatacgctaagcgctag

SEQ ID NO: 24604 - DNA, 2145 bp, Artificial Sequence
  Description of Artificial Sequence: Synthetic coding sequence
atggcccgggccggcagctgcggcggcgccgccgccggcgccggcaggcctgaaccttgggaactgagcctcgaggaggtccttaaggcctacgagcagccattaaatgaagagcaagcctgggcggtgtgttttcagggctgcagagggctgcggggctctccaggtcgccggcttagagacaccggagatctgttgctccgtggcgacggttcagtgggtgcaagagaacccgaggcagcagagccggctaccatggtggttcctctagcctcgagcgaagctcaaactgtgcagtcgcttggctttgccatctatagagccttagattgggggctagacgaatctgaggagcgagagctatcgccccagctggagcgcctgatagatttaatggcaaacaacgacagcgaggacagtggatgcggtgctgcagatgaggggtatggcgggcccgaggaggaggaggaagcagaaggagtcccacgaagcgtccgcacttttgcacaggctatgagactgtgcgcggccaggctgacagatcccagaggtgctcaagcacattaccaagccgtgtgtcgcgcgctcttcgtcgagactctggaactgcgcgcctttctcgctcgagttcgggaagccaaagagatgcttcagaaactccgggaagacgagccccatctcgagacacctagagcagagctggatagtctgggccacaccgattgggcacggctgtgggtgcagctgatgcgagagcttcgccggggtgtaaaattgaagaaggtgcaggaacaagagttcaacccactcccaacagagtttcagttaactccattcgagatgctcatgcaggatattagagctcgcaactacaaactcaggaaagtgatggtggacggcgacattccaccccgcgtcaaaaaggatgcacacgagctgatcctggatttcattaggagtcggcctcccctgaagcaagtgtctgaacggcggctgagaccactgccaccaaagcagcgatccctgcacgagaagatattggaggaaatcaagcaagagaggcggctgcgtcctgtgcgcggtgaggggtgggcagctcggggatttgggtcactgccatgcattttgaacgcatgttctggggatgcgaagagtacctcatgtattaatctctctgtcacagatgccggcgggtctgctcaaagaccacgaccccgggtcctgttgaaagccccgaccctcgccgaaatggaggagatgaacacatctgaagaggaggaatccccctgtggggaagtgacgttaaaaagggacagatctttctccgaacacgatctcgctcagctgcggtccgaggtggcctccggactgcagagcgccacccacccgccgggcggcaccgaacccccaagaccacgcgcaggaagcgcccacgtttggaggccgggcagcagggaccagggtacatgtcccgcgtccgttagcgaccccagccacccattactgtcaaaccgagggtcatctggagatcgaccagaggctagcatgacgcctgatgccaagcacctgtggctcgaattttcacaccctgtcgaatccctcgccctgaccgtggaggaggttatggacgtccggcgggtgctggttaaggcagaaatggaaaaatttctgcagaacaaagaactgttttcttccctgaagaaaggtaaaatttgctgttgctgccgagcaaagtttcctctgttctcatggccgcctagctgcttattctgtaaaagggctgtttgcacatcttgctctattaaaatgaagatgccttcgaagaagttcggccacatccccgtctacactctggggtttgaaagtccacagcgagttagcgcggccaagaccgccccaatccagcggagggacatcttccaaagcctgcagggtccccaatggcaatcggttgaagaagcttttccacacatttatagtcatggttgtgtgcttaaggatgtgtgctcagagtgtaccagttttgtcgctgacgtggtcagatcttcccggaagagcgtggatgtgctcaatacaaccccccgacgctcacgacaaacacagagtttgtacatacctaacacgcgcacgcttgactttaaatag

SEQ ID NO: 24605 - DNA, 1308 bp, Artificial Sequence
  Description of Artificial Sequence: Synthetic coding sequence
atgaacttcagcgaggtgttcaagctgagcagcctgctgtgcaagttctccccagatggtaagtatttagcaagctgtgtgcagtacaggctggtggtgagggatgtgaataccttacagatccttcagctttacacctgtttagatcagatccagcatattgagtggtcggccgacagtctgttcatcctgtgcgccatgtataaacgtggcttggtacaagtttggtccttggaacagcctgagtggcactgcaaaatcgacgaaggcagtgcgggtctggttgcaagttgttggagtcccgacggaagacatatccttaacacgaccgaattccacctccggatcaccgtctggtcactgtgcacgaagtctgtgagttacattaaatatcccaaagcctgtctgcagggcatcacatttacaagagatggtagatatatggctttggctgagagaagagactgtaaagattacgtgtctatctttgtgtgtagcgattggcagttattacggcactttgacaccgacacgcaggatcttaccggaattgaatgggcccccaacggttgcgtcctggccgtgtgggatacatgcttagagtacaaaattttactctatagtctggatggacgcctactgtccacctactcagcttatgagtggtctctgggtatcaagtccgttgcctggtcgcccagctctcaatttctggctgtcgggtcttatgatggaaaggtgcgcatattgaatcacgtaacatggaaaatgataacagagttcgggcacccggctgcaataaacgacccgaagatcgttgtctacaaggaagccgagaagtctcctcagctgggtctgggctgcctctcctttcccccaccaagggccggagccgggcctttgccctcaagcgagagcaagtacgagattgcaagcgtgcccgtaagcctgcagactttgaagccagtaacagatcgggccaatccaaagattggtataggaatgctcgcattcagtcccgacagttattttcttgccacaagaaatgataacatcccgaacgctgtatgggtttgggacatacagaagctacgtttgtttgcggtgcttgaacagttaagccctgttcgagcctttcagtgggacccccagcaaccacgcctggcaatttgcaccggagggtcacgcctgtatctgtggtctcctgccggttgcatgtcagtgcaggtgccaggagagggcaaacacatccccgaggcgaccgatgtggctgcactactgtgcgcagtgtggcaccatacgggctag

SEQ ID NO: 24606 - DNA, 819 bp, Artificial Sequence
  Description of Artificial Sequence: Synthetic coding sequence
atgctgcagctgcgggacagcgtggacagcgccggcaccagccccactgctgtactcgcagctggggaggaggttggagccggaggagggcccggaggcgggagaccaggagcaggcaccccactgcgacaaacactctggcctttatctattcacgaccctaccaggagagctcgggtgaaggaatactttgtcttccgtccgggaagcattgaacaggccgttgaagagattcgagtggtggtcaggccagtggaggatggggaaatccagggcgtgtggttgctcaccgaggtagatcactggaataacgagaaggaaaggctggtgctcgtgactgaacaatccctgttgatttgtaaatacgattttatttccctgcagtgccaacaggtagttaggatcgcgctcaacgcggtggataccattagctatggagagtttcaattcccaccaaaatctctgaataagagggaaggcttcggaataagaatccagtgggacaagcaatcgcggccttcattcatcaatcgatggaacccctggagtaccaatgttccctatgccacatttactgagcaccccatggctggggctgacgagaaaaccgcttccctgtgccagctggagagctttaaggctctcctgatccaggctgtgaaaaaggcgcagaaagagtcccctttaccaggacaagccaatggagtcctgattttggaaagacccctgttgattgagacctatgtgggactgatgagctttatcaataacgaagctaaactcggctatagtatgacaagaggtaaaatcggcttctag

SEQ ID NO: 24607 - DNA, 870 bp, Artificial Sequence
  Description of Artificial Sequence: Synthetic coding sequence
atgtggcccttccccagccggagcctgttccccccccccacccaggcctggttacagaccgtgtcctccgatcctgaagcccaggggtggggagcatggaacgagaccaaagaaattcttggtcctgaaggcggtgaggggaaggaggagaaagaagaggaggaggatgccgaagaagaccaagacggtgacgcaggtttcctgctcagcctgctggagcaagaaaacttagcagaatgccctctccccgatcaagagctcgaagccataaaaatgaaggtctgcgcaatggagcaagctgaggggacacctcgtccacctggcgtccagcagcaagccgaggaagaggagggcacagcagctgggcagttgttgtctccagagacagtcggctgccccctcagtggaactcccgaagagaaagttgaggccgatcaccgtagcgtttacgtggggaatgtcgattatggcggctctgctgaagagctggaagcgcatttctcccgctgtggcgaggtgcatagggtgacaattttgtgcgacaagttctccggccacccaaagggttatgcttatatcgagttcgccaccaaaggctcagttcaagctgctgtcgaactggaccagtctctttttcgaggaagggtgattaaagttctgcctaagcgaacgaacttccccggcatctcaagtaccgacagaggtggtctgcgcggacatcctggaagtagaggggcgcccttcccacattctggattgcagggccgtcctagactgaggccacaaggacaaaaccggacccctgccgccctgactccactgtgggcccgtcctctgccctgggttgtggtatctcacgtgattaagtag

SEQ ID NO: 24608 - DNA, 1266 bp, Artificial Sequence
  Description of Artificial Sequence: Synthetic coding sequence
atgttcgagatcctgaccagcgagttcagctaccagcacagcctgtcaatcctcgtcgaagaatttctccagtcaaaggagcttagggctaccgtgactcaaatggagcaccaccacctgttctcaaacattctggacgtcctaggcgcgtctcagcggtttttcgaagacctggagcagaggcacaaggctcaagtgctggtcgaagatatcagtgacatcctggaggagcacgccgaaaaacacttccatccatatatagcgtactgtagcaacgaagtgtatcaacagaggaccctgcagaagcttatttcttctaacgccgctttccgagaagctctgcgcgaaattgagagacgacccgcttgtgggggacttcctatgctgagttttcttatactgccaatgcagagagttacaaggctgccactcctgatggacacattgtgtctgaagactcagggacactctgaacggtataaggccgcatcgcgggccctgaaagctatatcaaaattagtcagacagtgcaacgagggcgcacataggatggagcgcatggaacagatgtataccctccatacacagctcgacttctccaaggttaagagtttgccgctcattagcgcttctcgctggctgttaaagaggggcgaactttttttggtggaggagaccggacttttccgaaaaatcgcctctcgtccaacatgctatttatttctgttcaacgacgtgctggttgtaacaaagaaaaagagtgaggagagttatatggtacaggactatgctcagatgaaccacattcaggtggaaaagatcgaaccgtccgagctgccacttcctggcgggggtaatcggtcaagtagtgtgccccacccgttccaggttaccttgctgcgtaattcagaaggacggcaggagcaattgctcctttcttctgatagcgcgtccgatcgcgcacggtggatcgtggctctcacacacagcgagcgccagtggcagggtctgagctccaagggtgatcttcctcaggtggagatcacaaaggctttctttgcgaagcaggctgatgaggtgacactgcaacaggccgatgtcgtgttggtgctgcaacaggaggatggatggttatatggggaaagactacgcgacggtgaaacgggatggttccctgaagacttcgcaagattcattacctctagagtagcagttgagggcaacgttaggcggatggagaggctccgggtggagaccgacgtctag

SEQ ID NO: 24609 - DNA, 1266 bp, Artificial Sequence
  Description of Artificial Sequence: Synthetic coding sequence
atgttcgagatcctgaccagcgagttcagctaccagcacagcctgtccatcctagtggaagaattcctgcagtcaaaagaattgagggcaaccgtgacccagatggaacaccatcacctgtttagcaatattctcgacgtactaggtgcaagtcagagatttttcgaagatttggaacaaagacataaggcgcaggtcctggtggaagacatcagcgacatcctcgaggaacacgccgaaaagcacttccacccttacattgcatattgttctaacgaggtgtaccagcaacgaaccctgcagaaattgatctcttcaaatgcggccttcagagaggcgttgagagagattgagcgccgccctgcctgtggaggtctgcccatgctgagtttcttgattctgcctatgcagagagtcaccagactaccgctcctgatggatacactgtgccttaagacacagggacatagcgaacggtacaaggcagcttctcgcgcactgaaggccatatccaaactggtcaggcaatgtaatgaaggcgcccatcggatggagaggatggaacagatgtatactttgcacacccaactggacttctcaaaagtaaaaagccttcccctgatcagcgcatctcgttggttactcaagcggggagaactgtttctggttgaagaaaccgggctgttcagaaaaattgcctctcgaccgacctgctacctttttctctttaatgacgtcctggtggtgaccaaaaaaaagtcagaggaaagctatatggtgcaggactacgcgcagatgaatcacatccaggtcgaaaagatagagccctccgaactccccttgcctggtggcggtaatcggtcctccagcgtgccccacccgtttcaagtgaccctcctcagaaacagcgaaggcaggcaggagcagttgctcttgagcagtgattccgccagcgaccgagcccgctggattgtggctcttactcattcagaacgccaatggcaaggcctgagctcaaaaggcgaccttccgcaggtggagatcaccaaagctttcttcgcaaaacaggcagacgaggtcaccttgcagcaggccgatgtggtgctggtgctgcagcaagaagacggctggctgtacggcgagagattacgcgacggagagaccggatggttcccggaggacttcgcaagattcatcacatccagggtggcggtcgaaggtaatgtgcgtcgtatggagaggttacgcgtggaaactgacgtgtag

SEQ ID NO: 24610 - DNA, 2130 bp, Artificial Sequence
  Description of Artificial Sequence: Synthetic coding sequence
atggcccagcggcacagcgacagcagcctggaggagaagctgctgggacatcgattccacagcgaactccgactggacgccggcgggaaccctgcatccgggctgcccatggtacgcggtagcccgagggtgagagacgacgctgcctttcagccacaggtccccgcccctccccaaccccggccgcctggccatgaggaaccatggcccattgtgttgagcacagaaagcccggctgctctgaaactaggcacccaacagctcatccctaagagcttagctgtcgccagtaaggctaaaaccccagcacgccaccagtcatttggcgccgccgtactgagtcgtgaggccgctagaagggacccaaagttgttaccagccccctccttctcactcgacgatatggatgtcgataaagaccctggcggaatgctacgaaggaatttacgaaatcagtcctaccgcgccgccatgaaggggctgggcaagcctgggggccagggtgacgctatccagctgagtccgaaactgcaggcactcgcggaagaaccctcccagccacacacccggtcacctgctaagaacaagaaaaccctgggccggaaaagaggccacaaaggatcctttaaagacgacccacagctttatcaggagatccaggaaagggggcttaatacttctcaggagtcagacgatgatatcttggacgagagtagctcacccgagggaacccagaaggtagacgccacaatagtggttaaatcatacaggcccgcccaggtgacctggtcccagctgccagaggtcgtggagctagggatcctggatcagctttctacagaagagcggaagcgccaggaagctatgttcgaaattctcacaagcgagttttcctatcagcacagtttgtcaatcttagtcgaggaattcctgcagtccaaagaactgagagccactgtgacccagatggagcatcatcacctgttctccaacatcctggatgtactgggtgccagccagcgcttttttgaggatctggagcagagacataaagcacaggtgctggtggaagacatatcagatattctggaagaacacgcggagaagcatttccatccgtatatcgcatactgctccaacgaggtatatcaacagcgcacattgcagaaactgatatctagcaacgctgctttcagagaagcactgagagagattgaacggcgccccgcttgtggggggctaccaatgctcagtttcctcattttgccaatgcagagggtcacccgcctgccacttctcatggacacgctatgcttgaagacacaaggccattccgagcgctataaggcagctagccgagcgctgaaagctatttcgaaactggtgagacagtgcaacgaaggggcacatagaatggagcggatggagcagatgtacacgctgcatactcaactggacttctccaaggtaaagagcctcccactgatttctgcgtcacgctggctactgaagaggggcgaactcttccttgtggaagagactggtcttttccggaagatcgcatcccgccctacttgctacttattcctgtttaacgacgtgcttgtcgtaacaaagaagaagtccgaagaaagctatatggtccaggactatgcccagatgaaccatatacaggtggaaaagattgagccttccgagctccccctgcctggcggtggtaatcgcagctcctcagtgccccaccctttccaggtcacacttctgcgcaattctgaagggagacaggaacagctgcttctttctagcgatagtgcctcagatagagcccgttggattgtggccctcacccactcagaaagacaatggcaagggctgtcatctaagggcgatttaccgcaagtcgaaattaccaaagcattcttcgccaaacaggccgacgaggtgacgttgcaacaggctgatgtggtcctggtgctgcagcaggaggacgggtggctgtacggtgagagactgcgggacggtgagactgggtggttccccgaggactttgcaaggtttattacttcccgcgtggcagtggaagggaatgtccgccgcatggagcgactgcgcgtggaaactgatgtctag

SEQ ID NO: 24611 - DNA, 1287 bp, Artificial Sequence
  Description of Artificial Sequence: Synthetic coding sequence
atggtgtggcaggtgctggagggcctgagccaggacagcgccaagcggctgcgcttcgtagcaggggtcatctttgtggacgagggagccgcttgcggacagagtctcgaggaaagaagtaagacccttgctgaggtgaaacctatcctgcaggcgacgggattcccttggcacgtggtggctttagaagaggtgttttcactacctccctcagttctctggtgtagcgcacaggaactagtgggtagcgagggagcctataaagctgctgttgattcttttctgcaacagcagcatgtcttaggggcaggcggaggccctgggccgactcagggcgaggagcagcccccccagccccctctcgatccgcaaaatctggccaggccacctgcccccgcccagactgaagccttatcacagctgttctgcagtgtcagaaccttgaccgcaaaagaggaacttctccagactctgaggactcatctcatacttcatatggcccgcgcccacggatactcaaaagttatgactggtgactcttgcactcgcttagccatcaagttaatgacaaacctcgccttagggcggggagcattcctagcctgggacacaggcttttccgatgagcggcacggcgatgtggtcgttgttagaccaatgagagaccacacactgaaggaggtcgccttctacaaccgcctgttcagcgtgccttccgtgttcacccctgctgtggacacaaaagctcccgagaaagcatcaattcataggctgatggaagcgtttatcttgcgacttcagacccagttccctagtaccgtgtccactgtctacaggactagcgagaaactcgtgaagggcccaagggatggacctgcagcgggagactccggaccccgctgtttgctgtgtatgtgcgcactggatgtggatgccgccgacagcgccactgcttttggtgcccagacatcatcgcgcctgagtcagatgcaatcacctatacccctcactgagaccagaactccccctggcccttgctgttctcctggcgtgggatgggcccagcgatgtggacagggagcgtgcaggcgcgaggacccacaggcctgtatcgaagagcagctgtgctactcctgtcgtgtcaacatgaaagaccttccttcccttgacccactgccgccatacatactcgctgaggctcagctccggacacagagagcctgggggcttcaggagattcgtgactgtctgatcgaagattcagacgacgaagccggacaaagttag

SEQ ID NO: 24612 - DNA, 417 bp, Artificial Sequence
  Description of Artificial Sequence: Synthetic coding sequence
atgggcgagcaggccgacggcaaggacagcatcgcccggcaggtggcacccgaatctcactggcccgagctccgcgttcttatattggtcgtgagcgcagagaagaaacttactggatccacagtgggcatgagagctagcgtggaaacttccccactgcttagatttagggcggagtccgtggtgcctgcccacggaggagatgggcctctgcacccgggagcccgtttacctcagctcagacctgctgaccatgaaggccaacagccagtccccaggcaccttccccggcatctgcctccatccctaacgagtatgcctagccccggcgcttcgtctacttggtgtaccgcctctactcctaccacaggcaccccccgatggagaacacctctgactcgtgcccctatgccctag

SEQ ID NO: 24613 - DNA, 597 bp, Artificial Sequence
  Description of Artificial Sequence: Synthetic coding sequence
atgagcaccgtggacctggcccgggtgggcgcctgcatcctgaagcatgccgtcacaggtgaggctgtggaactgcgctcattatggagagagcatgcctgtgtggtggcaggattgcgtcgatttggctgtgtcgtgtgccgatggatcgctcaggacctgtcttctctcgcaggcctgttagaccagcatggagtgagattagtcggtgtcggtcctgaggcgcttgggctgcaggagttcctggacggcgattattttgccggcgaactgtacttggatgaaagtaagcagctgtataaggagctgggttttaaacggtacaattcgctatctattcttccagcagccttagggaagccagtgcgggacgtggccgcaaaggcaaaggccgtgggaatccagggcaatctgtctggtgacctgttacagagcggtggcctactcgtcgtttccaagggaggcgataaagtgttgctccacttcgtccagaagagtcccggagattatgtgccgaaagagcacatccttcaggtgctgggcataagcgccgaggtttgcgcttccgatccaccacaatgcgaccgagaggtttag

SEQ ID NO: 24614 - DNA, 642 bp, Artificial Sequence
  Description of Artificial Sequence: Synthetic coding sequence
tgaagccgggagcggggcagccggagcgaggagcccggcgccggcaaccgagagtccggcagcagggagcctggtctggcggccgctgcaatgagtactgtcgacttggcacgcgtaggggcctgcattttaaagcacgccgtcaccggagaggctgtggaactgcgtagtctgtggcgggagcatgcttgcgtggtagccggcctccggcgttttggttgcgtagtctgccgttggatcgcccaggacctcagttctttggccggcctattggatcagcacggcgtcagattagtcggtgtgggacctgaagccctggggctgcaggagtttttggatggcgactactttgctggtgagttgtacctcgacgaaagtaaacagctctacaaggagttggggtttaagcgatacaattccttgtccattttgcctgccgccttagggaagcccgttagagacgtggccgccaaagctaaagccgtgggcattcaggggaatcttagcggggatctgctgcagagcggcggactattagtcgtaagcaaggaggttcctaggaggctgcgacctcagggcgcccaccccgccggaccaggccacctgtgcggcgggctctgtcaaaggccagcctcagtttag

SEQ ID NO: 24615 - DNA, 2553 bp, Artificial Sequence
  Description of Artificial Sequence: Synthetic coding sequence
atggccgaggtggaggccgtgcagctgaaggaggagggcaaccggcacttccaattacaggactacaaggctgcaactaactcttatagtcaggctctgaaactgaccaaggacaaggcgcttcttgccaccttatatcgcaatcgggccgcctgtgggctcaagactgaatcatacgttcaggccgcatcagatgcttccagggccatagacattaacagcagcgacatcaaagccttatatagaaggtgtcaggctctcgagcacctgggcaaacttgaccaggcttttaaggatgtgcaacggtgcgccacccttgaaccccggaaccagaattttcaagagatgctgagacggcttaacacatcaatccaggaaaagttacgggtgcaattcagcactgattcccgcgttcagaagatgttcgaaattttgctggacgagaattctgaagccgataagagggaaaaggcagcgaacaatctgattgtcctgggcagagaggaagctggggctgaaaaaatttttcaaaacaacggcgtggcgcttctgctacaactgctcgacaccaaaaagcccgagttggtgctggccgccgtcaggaccctgtctggcatgtgtagcggccaccaggccagagctaccgtgattctgcacgccgtgaggattgatagaatttgtagcttgatggctgtcgaaaacgaagaaatgtcccttgctgtctgtaacctgctacaagctataattgactctctgagcggcgaggataagagggagcaccgcggaaaggaagaagcacttgtgttggataccaagaaggatctcaagcagataacctcccacctgttggatatgcttgtgtctaagaaggtttcagggcagggaagggaccaggcactcaatctgcttaataagaacgtgcctcggaaggacctcgccatccatgacaacagccgtaccatttatgttgtcgataatggactgcggaaaatactaaaggtggtgggtcaggttcctgatttaccatcctgcctccctcttacagacaatacgcggatgttggcgtcgatcctgataaataaactgtatgatgacctaaggtgcgatccagagcgtgatcatttcaggaaaatctgtgaagagtatatcactggcaagttcgaccctcaagatatggacaagaacctaaacgccattcagaccgtatcgggcattcttcagggacctttcgatctgggtaatcagcttttaggactaaaaggcgtgatggaaatgatggtggcactgtgtggctcggagcgagaaactgaccagctggttgccgtcgaagctttgatccacgccagtaccaaattatccagagcgacatttatcatcacaaatggcgtctcactcttgaaacagatctataaaactaccaaaaatgagaaaattaagatcaggactctggttacaagtgataagacaatcctttacagcgtagccactaccctggtgaattgtaccaattcttatgacgtgaaagaggtgatcccagaactggtgcaattggccaagttcagcaagcagcatgtgcccgaagagcaccccaaagataagaaagattttatcgatatgagagtgaagaggctcctgaaggcaggagttattagcgccctggcatgcatggtcaaggctgactctgcgatcctgaccgatcagactaaggagctgcttgcacgcgtgttcttagctctgtgcgataatccaaaggatcggggtaccatcgtggcccagggcggtggaaaggccctcatccccctggccctggaaggcacagatgtcggaaaggtaaaagcggcccatgccctggcaaaaatcgcggctgttagcaacccggatatcgctttccctggcgagagagtctacgaggtcgttcgtcccctggtcaggctccttgatacccaaagggatggattgcaaaattacgaggcgctattaggccttactaatctgagcgggaggtcagacaaattaagacagaaaatatttaaggaacgcgcactgcctgatatcgagaattacatgttcgaaaaccatgatcaactgagacaagcggccacagaatgtatgtgtaacatggtcctgcacaaggaagtccaggaaagattcttggctgacggaaatgaccgcctgaaattagtggttctgctgtgtggtgaggatgacgataaggttcagaatgccgccgccggagctcttgccatgctgaccgctgctcacaagaaattgtgcctaaagatgacacaggtcacaacacagtggctggagattctacagagactatgtctccacgaccagctttctgtgcagcatcggggactggtcatagcatacaaccttctcgcagcagacgctgagctcgcgaaaaaactcgtcgaaagcgagttgctggagattctgaccgtggtggggaagcaggagcctgatgagaagaaggccgaggtcgtgcagacggctagggaatgccttattaaatgcatggactatggcttcataaaacctgtctcgtag

SEQ ID NO: 24616 - DNA, 552 bp, Artificial Sequence
  Description of Artificial Sequence: Synthetic coding sequence
atgatgcagatctgcgacacctacaaccagaagcacagcctgttcaatgcaatgaaccgatttataggcgcagttaataacatggaccagactgtgatggtgccttccttactccgtgatgtccccctcgccgacccagggctggataacgacgttggcgtcgaagttggcgggtcaggtggttgtctcgaggaacgaacacccccagtccctgattccggaagtgcaaacgggtccttttttgctccctccagggatatgtacagtcactacgtgctgctgaaaagcatacgtaatgatatcgaatggggcgtgttgcatcagcccccccctcccgcaggctctgaggagggctctgcctggaagtccaaggatattcttgtggacctcggacacctcgagggcgctgacgctggcgaggaggacttagagcagcagtttcactatcacctgagaggactacacactgtgcttagcaagctgacgagaaaagctaacatcctcactaatagatacaagcaggaaattggcttcggaaactggggtcactag

SEQ ID NO: 24617 - DNA, 366 bp, Artificial Sequence
  Description of Artificial Sequence: Synthetic coding sequence
atgttcaacaagtgcagcttccacagcagcatctaccggcccgccgcagacaacagtgcaagcagcttatgtgcgatcatctgtttcctgaatttggtgattgagtgtgatctggagaccaacagcgaaattaataaattgatcatttaccttttctcacaaaataatagaatacggttctctaaactgttgctgaagatcctgttttatatcagcatattctcatatcctgagctcatgtgcgaacagtatgtcacttttattaagcccggaatccactacggccaagtatctaagaagcacattatctactcgacattcctgagcaagaacttcaagtttcagctgctcagagtgtgctggtag

SEQ ID NO: 24618 - DNA, 972 bp, Artificial Sequence
  Description of Artificial Sequence: Synthetic coding sequence
atggagagccgggtggccgacgccggcaccggcgagaccgcccgggcagcgggtggcagtcctgccgtcgggtgcaccacccgcggacccgtggtttcagcccccctcggagcagcgagatggaaactgttgcgacaagtgctgaaacagaagcatctggatgactgtcttagacatgtttcagtccgtcgctttgaaagcttcaacctgttctccgttaccgagggaaaggaacgggaaactgaggaggaagtaggggcctgggtgcagtatacctcaatcttctgtccagagtacagcatctctctccgacacaacagcgggtcgctgaacgtcgaagacgtgctgacatcttttgataatacgggcaatgtctgcatctggccaagtgaggaggtgctcgcatattactgcctcaagcataacaacattttcagggctcttgcggtctgcgaactgggaggaggcatgacctgccttgccgggttgatggttgctatttccgccgacgtgaaagaggtgctcttaaccgatgggaatgagaaagctatccgaaacgtgcaggacatcattacaaggaatcagaaagctggtgtcttcaaaacccagaagatctcaagctgcgtactccggtgggataatgagacagatgtgagccagctggaggggcatttcgatatagtgatgtgtgccgactgtctgttcctggaccagtaccgtgcttccctggtcgacgcaatcaagaggcttctccagccccgaggaaaggcaatggtgtttgccccgcggcgcggtaataccctgaaccagttttgcaatcttgctgaaaaggccggcttctgcatccaaaggcacgagaattacgacgagcacatcagtaacttccacagcaagctaaagaaagaaaatcctgatatatacgaggagaacttgcactaccccctgctactgatcttaaccaaacatggatag

SEQ ID NO: 24619 - DNA, 3120 bp, Artificial Sequence
  Description of Artificial Sequence: Synthetic coding sequence
atggccgtgcagctggtgcccgacagcgccctgggcctgctgatgatgacggaagggcgtaggtgccaggtccacttgctggacgaccgcaaactggagttgctggtgcagcctaagctcctagccaaggagctcctggacctggttgcaagtcactttaatcttaaagaaaaggaatatttcggaatcgctttcactgatgagaccggccaccttaattggctgcagctagacaggcgggtgctggaacatgacttcccaaaaaaatccggcccagtggtcctatatttctgtgttcgcttttatatcgaatccatcagttacttgaaggacaacgcaaccattgagcttttctttctgaacgccaagagttgtatctataaggagcttatagacgtggattctgaggttgtcttcgaactggcttcatatatcctgcaagaagccaagggcgacttctcttcaaatgaggtcgtccgttccgatctcaaaaagctgcctgccctgccaacccaggccctgaaggagcatcccagtctcgcctactgcgaggaccgagtaatcgagcactataaaaaactgaacggacagaccagagggcaggcaatcgtgaactatatgtcaatcgtcgagagtctgccaacatacggcgtgcactactatgcagtgaaggacaagcaagggatcccctggtggttgggactatcatataaggggatttttcaatatgactatcatgataaagttaagccacgcaaaatttttcaatggcgccagttggagaatctgtattttcgggagaaaaagttcagcgtagaagtgcacgacccccgtcgggcaagtgtgacgaggcggacgttcggtcattctgggattgcagtccacacatggtatgcctgtcccgccttaatcaaatccatttgggctatggcaatcagccagcaccagttttaccttgatcgcaagcagtccaagtctaagattcatgcagcacgctctttgagtgaaattgccattgatctcaccgagactggcacgctgaaaacctccaagcttgctaacatgggctccaaaggaaagatcattagtggatcatccggaagcctgctgtcttccgggagtcaggaatccgactcaagccagtcagcaaaaaaggacatgttggctgccctgaagagtaggcaagaagctttagaagaaacccttcgtcaacggctggaggaacttaagaaattgtgtctgagggaagctgaactaaccgggaaattgcccgtggagtacccattggatcctggagaggaacccccgatcgtacggcgccggatcggtactgcttttaagttggacgaacaaaagattttgcccaaaggggaagaggctgagctggaacggctcgagcgagagtttgcaatccagtctcagattacagaagccgcgcgacgccttgcatccgatccgaatgtgagcaagaagctgaagaagcagcggaagacttcttacctcaacgccctgaaaaaacttcaggagattgaaaacgccattaacgaaaacagaattaaatctgggaagaagccgacacagcgggcctcacttataattgatgatggcaacatcgccagcgaggactccagcctgtccgatgctctggtcttggaagacgaggatagccaagtaacaagtactatcagtcctttacatagccctcataaaggacttccaccacgcccccctagtcataatcgaccccccccaccacagagcctggagggtcttaggcagatgcactaccaccggaatgattacgacaagagccccatcaagccaaagatgtggtcagagtcctctctcgatgagccctatgaaaaggtcaaaaagcgctccagccactcacactcgtccagccacaagaggttcccctctaccgggagctgtgccgaggcgggcggaggaagcaacagtctgcagaacagcccaattagggggctgccacattggaactcgcagagctccatgccctctacgccggacctgcgggtgcgaagtccacactatgtccactcgacccgtagtgtggatataagccccacaaggctgcatagcttagcactccactttaggcataggtcatcttctttggagtcacagggcaagttattgggctcggagaatgacaccggatctcctgacttttatactcccagaacccggtcaagcaatggttccgacccgatggatgactgctccagttgcacctcacacagctctagcgaacattactatccggcgcagatgaacgctaattattcgacactggccgaggattccccttctaaggctcggcaaagacagcgacaaaggcagagggccgccggcgctctcggatcagcctccagcggcagcatgcctaaccttgcagccaggggcggtgctgggggggcaggcggggccggggggggcgtatatctgcactcacagtctcagcccagcagccagtaccgcatcaaagaataccctctttatattgagggaggagcaactccagtcgtggtgaggtctttagagagcgatcaggaaggccactacagtgtgaaagcgcagttcaaaacatcaaacagttacaccgccggcggtttattcaaggaatcatggcggggcggcggcggcgatgagggtgataccggaaggctaactccttcacgctcccagatccttcgtacaccatcactcggccgcgaaggagcccacgataaaggcgccgggcgcgccgcagtgtccgatgaacttcggcagtggtaccagcgaagtacagcatctcacaaggagcactcccgcctctcccacacatcctctacctcaagcgactctggcagccagtattcaacaagcagtcagtctacatttgtagcacatagccgcgtgaccagaatgccccagatgtgtaaggctacttctgccgcgctgccacagtcacaacgttccagcacccctagttctgagatcggtgccaccccccccagcagcccacaccatatactgacctggcagacaggcgaggctacagaaaactcacccatcttggacggatccgaatcgcccccacaccagagcaccgatgaatag

SEQ ID NO: 24620 - DNA, 390 bp, Artificial Sequence
  Description of Artificial Sequence: Synthetic coding sequence
atgtaccggcagcggttcctgtacagcctgtaccggcacacccactgggtgcggtgtgccaagttttcccccgacggtaggctgattgtgtcgtgcagcgaggacaaaacgatcaaaatatgggatactacgaataaacagtgcgtgaataacttctctgactcagttggagacttgtctctcctgtttcattttcaaaaagtggaatcttatctgcaccaggaggttcagacgcataggagctactacgggggcttgacactcatgaactgcattgtgaaggttcttccaaaggaaatcagcaaggattatatcctcatccaccatcatatctttctgatctctactcaggagcatcacattcccatgcgaaagaagcttagactctag

SEQ ID NO: 24621 - DNA, 2178 bp, Artificial Sequence
  Description of Artificial Sequence: Synthetic coding sequence
atgcaccccgagcccagcgagcccgccaccggcggcgccgccgagctcgactgcgctcaggaaccaggagtggaggagtcagccggagatcacggtagcgccggccgaggaggttgcaaggaggaaattaacgaccccaaagagatctgcgtcggaagttcagatacttcatatcattcccaacagaaacaaagcggggacaacggcagtggcggccactttgcccaccccagggaggaccgcgaagaccggggccctcgtatgaccaaaagctctctacagaagctgtgcaagcagcacaagctgtatataacccctgccctcaacgacactctgtatctgcatttcaaaggttttgaccgaattgagaatctggaggagtacacaggattgaggtgcctgtggcttcagtcgaacgggattcagaagatcgagaatctagaggcacagactgagctgcgctgcctgtttctccaaatgaacttgcttcggaagattgagaatctcgagccgctgcagaagctcgatgccctgaacctgtcgaacaactacatcaagacaatcgagaacctgtcatgcctcccagtcctcaatacacttcagatggctcacaaccacctggaaactgtcgaggatatccaacatttgcaagaatgtctcaggctgtgcgtactggacctgtcacacaataaactgtccgatccagaaatcctgagcatactggagtcgatgcccgatctgcgcgtcttaaatctaatgggtaatcccgtaatcagacagataccaaattaccggcgcactgtaactgtcagactgaagcacctgacttatttagatgatcggccagtatttccgaaggatcgggcctgcgccgaggcttgggctcgcggtgggtatgccgccgagaaagaagaaaggcagcagtgggagtctcgcgagagaaagaagatcactgatagcatcgaagcactcgctatgatcaagcagcgggccgaggagcggaagcgccaaagggagagtcaagaaaggggggagatgaccagcagcgatgacggggaaaacgtgcccgcctctgcagaagggaaagaggagcctccaggagaccgggaaacacggcaaaagatggaactgttcgtgaaggagtcctttgaagcgaaagatgagctctgccccgagaagcccagcggggaagaacctccagtggaagcaaaacgcgaggacggcggaccagagcccgagggaactttaccggccgagaccctactgcttagtagtccagttgaagtaaagggcgaagatggtgatggagagccagaagggaccctgcctgccgaggcaccacccccgccacccccagtggaggttaaaggcgaggatggggatcaggaacccgaaggcacgcttcccgctgaaactttgctgttgtcaccacctgtgaaagttaaaggcgaagatggcgacagagaacccgaggggactttgccggcagaagcaccaccaccaccccccttgggcgccgctcgcgaggagcccactccccaggcagttgcaacagaaggagtttttgtgactgaacttgacgggacacggactgaagatctcgaaaccatcaggctggaaaccaaggaaactttctgtatcgacgatctgcctgacttggaggacgatgatgagacaggaaagagcctcgaagaccagaacatgtgctttccgaagatcgaagtcatctcttccctgtcagatgactcagaccccgaactggattacacatcccttcctgtcctggagaacctacctacagatacactcagtaacatcttcgccgtgtccaaagacaccagcaaagcagcccgggtcccattcacggacatctttaaaaaagaagccaaacgggacctggagatccgcaaacaggatactaaaagcccgcggcccttaatccaggagctctcagatgaggatcctagtggacagctcctgatgcctcctacctgccagagggacgctgcaccattaactagtagcggtgaccgtgactcagattttcttgcggctagctccccggtgccaaccgaaagcgccgccacccctccagaaacctgtgtcggagtggcacaaccctcccaggctttgcccacgtgggacctgacggcttttcctgccccaaaggccagttag

SEQ ID NO: 24622 - DNA, 957 bp, Artificial Sequence
  Description of Artificial Sequence: Synthetic coding sequence
tgaggcatcaacggcagcgagggcgacggcgccgagatcgccgagaaatttgtgttctttattggaagtaaaaacggcggtaagacaactataatccttaggtgcctggacagggacgaacctccaaaacctaccctggcacttgaatacacatatggccggagagcaaaaggacacaacacacccaaagacatcgcccacttttgggagctgggcgggggaacttcactcctggatctgatttctatccctattacgggtgatactctgagaacattcagcctggtcctggtgttagatctgtcaaagcctaacgacctatggcccactatggaaaatctgctgcaggctacaaagtcacacgttgacaaggtaatcatgaagcttggcaagacgaatgctaaagccgtgtccgagatgcgccagaaaatttggaacaatatgcccaaagatcatcccgatcacgaacttatagaccctttcccagtgcccctggtcatcattggttcaaagtacgacgtgtttcaggatttcgaatcagaaaagcgtaaggtaatttgcaaaaccctgcggttcgtcgctcactattacggcgcgagtcttatgtttacctcaaaaagcgaagctcttctgttaaagatacggggggtcattaatcaactcgctttcggcatcgataaaagtaaaagcatttgcgtcgaccagaacaagcctctgtttataactgctgggttagacagcttcggccaaatcgggtcgccgcccgtcccagagaacgacatcgggaagctgcatgcacatagccctatggagctgtggaagaaggtctacgaaaagctttttcctcccaaatctattaatactctcaaagatattaaggacccagcaagggacccacaatacgctgaaaatgaggtggatgaaatgcgcattcagaaggatctggtgttatcctag

SEQ ID NO: 24623 - DNA, 2559 bp, Artificial Sequence
  Description of Artificial Sequence: Synthetic coding sequence
atggaggccctgggccccggcggcgaccgggccagccccgccagctctacctcatcgctggacctctggcacctgtcaatgcgggctgactcagcctattcctctttctccgcggcaagcggaggtcctgagccgaggacccaaagccccggaaccgacttactgccatatttggattgggattatgtgagagtcgtgtgggggggcccggggcccgcacccccagatgcagcgctttgcacttccccgcgcccaagacccgcagtagctgcaagaagcggccctcagcccactgaggtgcccggaaccccaggccccctgaaccgccaggctaccccactcctctacgccctggctgcagaggctgaggctgctgcccaggcagcggagccaccatccccccccgcttctagggctgcttaccggcagagactgcagggagctcagaggagagtcttgcgcgagacatcgttccaacgtaaagaacttcgtatgagtctgccagcccgcctgcgacccactgtgccggccaggccccctgccacccatcctagatcagcttcccttagccatccaggcggcgagggggagccagctcgctctagggcaccagctcccggcacggccggccggggacccttggccaaccagcagagaaaatggtgtttcagcgaacctggcaagctggaccgagttggccgtggcgggggacctgctcgggagtgcttgggggaggcctgcagtagcagcggactgccaggcccagagccattggagtttcagcacccagcactcgccaagttcgaagaccacgaggtgggatggcttcctgaaacacagccccagggctccatgaacctggattccgggagtctgaagctgggcgacgctttccggccggcgagccgctccaggtcggcttctggcgaggtgttagggtcctgggggggttcgggcggaactattcccattgtgcaggcagtcccacaaggggcagaaactcctcgacctttatttcagacaaaactgtcccgcttcctcccccagaaggaggctgctgtgatgtatccagccgagctgcctcagtcttcaccagcggacagtgaacaacgggttagcgaaacatgcatcgtgcctgcatggctgccaagccttccggatgaggtgtttctcgaggaggctcctctcgtgagaatgaggagtcccccggatcctcatgctagccagggacctccagcaagcgtccatgcttccgatcagccctatgggactgggctgggccagaggactggtcaggtcacagtccccactgagtaccctttgcacgaatgccccggaaccgccggcgccgacgattgctggcaaggggtgaacggctctgtgggaatatcacggcccacctcccacacaccgactggcactgccaatgacaatattccgaccatcgaccctacaggactgacaaccaatccaccaacggcagcagagtcagatctgctcaagccagtgcccgccgatgctcttgggctttccggcaacgatactcccggtccaagccacaataccgccctagcccgggggacgggacaaccagggtccagacccacatggcccagccagtgcctggaagaactcgtgcaggagctggcgcgacttgatcctagcttgtgtgatcccctggccagtcagcccagccctgaaccacctctggggttactggatggacttattccactggcggaagtgagggcagccatgaggcccgcgtgtggcgaggccggcgaggaggccgctagcactttcgaaccagggtcatatcagttttctttcacgcagctcctccccgccccaagggaagagactaggttagagaacccagcaacacaccccgttttggatcagccatgcggccagggactgcctgcacccaataatagcatacagggcaagaaggtcgagctcgccgccagactccaaaagatgcttcaggatcttcataccgaacaggagcgcctgcagggcgaggcccaggcatgggcccggagacaggccgcactggaagctgctgttagacaggcttgcgctccgcaggaactggagcgtttctcgagatttatggctgaccttgagcgggtactcggcctcttgctcctgttggggtcacgacttgctcgggtccgaagagcccttgccagagctgcgtccgattccgaccccgatgaacaagcaagtctcttgcaacgcctgaggctgctgcagaggcaggaagaagacgcaaaggaactcaaggaacatgttgcccggcgagagcgtgcagtccgggaggtgctggttagagcccttccagtagaagagcttagagtgtattgcgccttgctggccggcaaggctgctgtgcttgcacaacagcgaaatctggacgagagaatcagactgctgcaggatcagctggacgccattcgcgatgaccttggacaccacgcgccatcccccagccctgccaggccccccggcacatgtcctccagttcagccgccattcccccttctcctcacatag

SEQ ID NO: 24624 - DNA, 1776 bp, Artificial Sequence
  Description of Artificial Sequence: Synthetic coding sequence
atggcccagggcagcgtgagcttcaacgacgtgaccgtggacttcactcaggaagagtggcagcatttggatcatgcccaaaagactctgtacatggacgttatgctggaaaattattgccacctcattagtgtggggtgtcacatgacaaaaccggacgttattctcaaacttgagagaggcgaggagccatggacttcgtttgctggacacacgtgtctggaagaaaattggaaggccgaggactttctggtgaaatttaaagaacatcaagaaaagtactcccgcagcgtggtctccattaatcataaaaaattggtcaaagaaaaatccaagatatacgaaaagacctttacccttggaaaaaaccccgttaattcgaagaacctaccacccgagtatgatacacatggccgcatattaaaaaatgtatctgagctgattatctcaaacttaaatcctgctcgaaagaggctgagcgaatacaacggttatggcaaatctctactgtctaccaagcaagagacaacccatccagaagtcaaatcccacaaccaaagtgcccgggcattctcacataatgaagtgctaatgcagtatcaaaaaacggaaactccggcccaatccttcggttacaacgattgtgaaaaatcctttctgcagagaggcggccttattacacattcacgcccatataaaggggaaaatccttctgtgtacaataagaaaaggcgcgccactaacatagagaagaagcatacgtgcaatgagtgtgggaagtcattctgccgtaaatccgtcttgatcctccatcagggaatccactcagaggagaaaccctatcagtgccaccagtgcggaaacgcgtttcgcaggaagagctacctgatcgatcaccagcgaactcatacaggcgaaaagccctatgagtgtaatgattgcggcaagtccttccgccagaagaccactctgtctttacaccagagaatccatactggcgagaagccgtacatctgcaaagagtgcggtaagtctttccatcagaaggccaaccttaccgtgcatcaaaggacccacacaggagagaaaccctatatctgcaatgagtgtggtaaatcattctcacaaaaaacaactttggcacttcatgaaaaaacacataacgaggaaaagccctacatttgcagcgaatgcggcaagtctttcagacagaagacaactctggtggctcaccaacggacccacacgggcgagaaatcctatgaatgtccgcactgtgggaaagccttccggatgaaaagctacttgatcgaccaccataggacacacacaggggaaaagccttacgagtgcaatgagtgtggaaaatcgttcagccagaaaacaaatcttaatctccaccaacgcattcacaccggcgaaaagccctacgtttgcaatgagtgcgggaagtcattcagacaaaaggccaccttgacagttcaccagaaaatccacaccggccaaaagtcttatgagtgtccacagtgtggtaaggcattctcgaggaaatcctacctcattcaccaccagagaacgcataccggagaaaaaccttacaaatgttctgagtgcggaaagtgtttccgtcaaaagaccaacctgattgtacaccagcggactcatactggcgagaagccttatgtttgtaacgagtgtggaaaaagtttcagttacaagaggaaccttatcgtccaccagagaacccacaaaggcgagaatatcgaaatgcagtag

SEQ ID NO: 24625 - DNA, 2934 bp, Artificial Sequence
  Description of Artificial Sequence: Synthetic coding sequence
atgggctggaagcccagcgaggcccggggccagagccagagcttccaggcctcaggactgcagcctcggtctctgaaggccgctagacgcgcaaccggaaggccagaccggtctcgcgccgcaagaccaactatggacccaagcgctcaccgatcgagggctgctccccccaatatggatcctgacccccaggccggcgtccaggttggtatgcgtgtggtacgcggcgttgactggaagtgggggcagcaagacgggggggaggggggggttgggactgtggtggagctgggtcgtcatggaagcccctctacaccagataggacagtcgttgtgcaatgggatcagggcactcgtactaattacagggccggctaccagggggctcacgatttgttattatacgacaatgcacagatcggcgtgaggcatccaaacatcatttgtgattgttgcaagaagcacggccttcggggtatgcggtggaaatgtagggtctgcctcgattatgacctgtgtacacagtgctatatgcacaataaacatgagctggcgcacgcgtttgaccgctacgaaaccgcccactccagaccagtgactctgagtcctagacagggcctccccaggatacccttgaggggtatctttcagggcgcgaaggtggtacgggggccagactgggagtggggatcccaggatggcggagaagggaaaccaggacgcgtcgtggacatcaggggatgggacgtggaaaccggcagatcagtggcgtctgtgacttgggcagacggaaccacgaatgtgtatcgggtgggccacaagggtaaggtggatttgaaatgtgttggggaagcggcgggaggtttctactataaagatcacctgccacgacttgggaagccggcggagttgcagagacgggtttctgcagacagtcagccctttcagcatggagataaggtcaagtgtctccttgatacggacgtcttacgcgaaatgcaggaaggtcatggaggctggaacccccgcatggccgaacatcatagtttctgggtaggtgacgtggttcgcgtgattggcgacctggataccgtgaagagactccaggctgggcacggcgagtggactgacgacatggccccagccctgggcagggtaggcaaggtggtcaaagtgttcggagacggcaacctcagggtggccgtggcgggccagagatggaccttctctcccagttgcctcgtagcctataggccagaagaagacgctaacctcgacgtggctgagcgcgcccgagaaaacaagagtagcctgtctgtggcattagacaaactgcgggcccagaaaagcgatcccgagcatcctgggaggcttgtggtcgaggtagccctcggcaacgcagcgcgtgccctggatcttctgaggcggaggcccgagcaagtggatactaaaaaccaggggcgtaccgccctgcaggttgccgcatacctcggacaagttgaactgataagactgttgctgcaggcgcgggccggagtggatttacccgatgatgagggtaacaccgcgctccactatgcagccctgggcaaccaacccgaggcaacgagggttctgttatctgccggatgcagagctgacgccataaattcaacccagagcactgctctccatgtggccgtccagcggggctttctggaggtcgtgcgggctctgtgtgaacgcggttgtgacgtcaacctgcccgacgctcattctgatactcctcttcattcagctatttctgccggcaccggcgcaagcggcatcgtcgaagtcctcactgaagttcctaatatcgacgtgacagcgaccaactctcaaggatttaccctgcttcaccacgcaagtctcaagggccacgcccttgccgtgagaaaaatactcgccagggccaggcagctggtcgatgcaaagaaggaagatggtttcaccgcgctgcacctggcagctcttaataatcacagagaggtggcccaaatacttatcagggagggcaggtgcgacgtgaacgtgcgaaacaggaagctccagagccccctccaccttgcggttcaacaggcacatgtgggactggtgccattgctggtagatgccggttgttcagtgaacgccgaggatgaagaaggagataccgccctgcacgttgcccttcagcgtcaccagctgctgcccctagtggccgatggggctgggggcgatccagggcctctgcagctgctgtctcgtctccaggcgtctggcctccctggaagtgccgagctaaccgtcggcgccgccgtagcttgtttcctcgccttagaaggcgccgacgtcagctacacaaatcacaggggccgatcccctttggatctggctgcagagggcagggtcctcaaggctctccaggggtgcgcccaaagatttcgagaaagacaagccggagggggcgctgcgccaggcccacgccagactttggggaccccaaacaccgtcacaaacctgcatgtaggcgccgcgcccggcccagaggctgccgaatgcctagtttgctcagagcttgccctgctcgttttattctctccatgccaacatagaaccgtttgcgaggaatgcgccaggcgtatgaagaagtgtatcaggtgccaagttgttgtcagcaaaaaattgaggccagacggatccgaggttgcctcagctgcccccgctcctggtccccccaggcagttagtagaggagttgcaatcccggtataggcagatggaggagcgcattacctgcccaatctgcatcgatagccatattagactggtgttccaatgtggacatggagcctgcgccccttgtggatctgccttgagcgcttgtccaatatgccggcagcctattagggacagaatccagatattcgtgtag

SEQ ID NO: 24626 - DNA, 2262 bp, Artificial Sequence
  Description of Artificial Sequence: Synthetic coding sequence
atggaccccgacccccaggccggcgtgcaggtgggcatgcgggtggtccgtggcgtcgattggaagtggggccaacaggatggcggcgagggtggggtcggcacagttgttgagctggggagacatgggagcccaagcacgcctgatcgcactgtagtcgtgcagtgggaccagggcacacgcaccaattaccgcgccggctaccaaggcgcgcatgacctccttctctatgataacgctcagataggggtgcgccaccctaacatcatatgcgattgttgcaagaaacatgggcttcgcggcatgcgctggaaatgtagagtttgtctggactacgacttgtgtacacagtgttatatgcacaataaacatgaactggctcatgctttcgacaggtatgaaaccgcacattctcgccccgttacgttgtccccacgccaggggctcccaagaattcctcttaggggcattttccaaggagccaaggtggtgcgggggcccgactgggagtggggatcgcaagacggcaagcccgcggagctgcaaaggagggtgagcgctgacagtcaaccttttcagcacggtgataaagtcaagtgtctgctcgacacagacgtattacgggagatgcaggagggccacgggggctggaacccgcggatggcggaattcattgggcaaacaggcacagtgcacaggatcacggatagaggcgatgttcgggtgcagtttaaccacgagactcgctggacatttcacccgggcgctctgactaaacatcactccttttgggtcggcgacgtagtgagagttatcggcgacctcgatacagtaaagcgtcttcaggctggacacggtgaatggacggacgatatggcaccggctctaggccgcgtaggaaaggtggttaaagtgttcggggacggaaatcttcgtgtagctgtagccgggcagagatggacctttagcccttcttgcctggtggcttacagacctgaggaggatgccaatctcgacgtggctgagcgagccagggagaataagagctccctgtccgtcgctttagacaagctgagggctcagaagtcggatcccgagcatcctggcaggctggttgtcgaggtggctctaggcaacgccgctcgcgccttggacctgctccgacgccgaccagagcaggtggacacaaaaaatcagggacggacagccttacaggtcgccgcgtacctgggacaggtcgaacttattcgactcttgttgcaagctagggcaggagttgacctccctgatgacgaagggaacaccgctctacattatgccgcgcttggcaaccaaccagaagcgactagggtgctgctgtccgcggggtgccgggccgatgccataaattccacccagagcacggcactgcacgtggctgtgcagagaggcttcctcgaagtcgttcgggccctctgtgagcggggctgcgacgtgaacttgccggacgctcacagtgatacacctctgcatagcgctatatccgcaggcacgggagcctctggtattgtcgaggttctgactgaggttcccaacattgatgtaaccgcaactaacagccaaggtttcaccctactgcaccacgcctctcttaagggacacgcactcgctgttcgcaaaatcctggcccgcgccagacagctcgtggacgccaagaaagaggatggctttaccgccttgcacttggccgcgctgaataaccatagggaagtcgctcagattctcatcagggaggggagatgtgatgttaacgtgcgaaatagaaaattgcagagccctctgcatctagctgtgcaacaggctcacgtcggtcttgtgcccctactggttgacgccggttgctccgttaacgcagaagacgaggaaggagacacagccctgcacgttgctctccaacggcaccagctgttaccactggtggccgatggcgccggtggcgaccctggcccccttcagttactctcgcggctgcaggcttctgggctgccaggctcggccgagctgacagtgggcgccgcggttgcttgcttcctggctctggagggagcagatgtgtcctatacgaatcacagagggcgttccccattagatctggcagccgaggggcgggtcctcaaagccctccaaggctgtgcccagaggtttagggtgagggcgcaggacgaggaagtgcaccaggtgcctggggggcgacagcaagaaacagcccctaggcggctgtag

SEQ ID NO: 24627 - DNA, 1161 bp, Artificial Sequence
  Description of Artificial Sequence: Synthetic coding sequence
atgggcaaggactactacaagatcctgggcatccccagcggcgccaatgaggacgagattaagaaagcttaccgaaagatggcactaaagtaccaccccgataagaataaggagcccaatgccgaggaaaagttcaaggagattgctgaagcgtacgacgtactctccgatccaaaaaaacgggggctttacgatcagtacggcgaagagggccttaagaccggcggcggaacatccggcggcagttccggttccttccactacacctttcacggagatccacatgcaacattcgcttccttcttcgggggaagcaatcctttcgatatcttctttgcctcgtctaggtctacaagacctttctccggtttcgacccggatgacatggatgtggatgaagacgaagaccccttcggtgcatttgggagattcggctttaacgggcttagcagagggcccaggagggcccccgaaccattgtatccacgtcgaaaggttcaggacccccccgttgtgcacgaactgcgggtaagccttgaggagatctatcacggcagcactaagagaatgaagataacgaggaggcggctgaaccctgatggtcgcacggtcagaaccgaggacaaaatcctgcacattgttattaagcgggggtggaaagaaggaaccaaaatcacctttcctaaggaaggggacgcgactcctgataacattccagccgatatcgtgtttgttctcaaagacaaaccgcacgctcactttcggagagatggaaccaacgtgctctattccgctctaattagtctgaaagaggctctctgcggctgcactgttaatattccaaccatagacggccgtgttattccactcccctgcaacgatgtgatcaagcctgggacggtcaagcgcctgcggggagaggggcttccctttcctaaggtgcctactcaacgcggagatctgatcgttgaatttaaggtgcggtttcctgataggttgacaccacaaacacggcagatcctaaaacaacagtatccacaacacagtcttcactccatgtgtacccagctcgacgtacattggactctggccaccttcagcaagatgcagaaaaaggcgaccgggttccaagaaaacgtacctgttcctgacccattctag

SEQ ID NO: 24628 - DNA, 1008 bp, Artificial Sequence
  Description of Artificial Sequence: Synthetic coding sequence
atgctgggcagcggcttcaaggccgagcggctgcgggtgaacctgcggctggttatcaacagacttaagctgctcgaaaaaaagaaaactgagctggcccaaaaggcccgcaaggaaatcgctgattatctggccgccggcaaagacgaaagagcccggataagagtggagcatattattagagaagactacctggtggaagctatggaaatcttggaactgtactgtgatctcctgctggctcgttttggcctaattcagtcaatgaaagaacttgactcaggcttagccgagtctgttagcacactgatttgggctgcaccaagactgcagtctgaagtggctgagctcaagattgtggctgaccagctgtgcgcgaaatactcgaaggagtacggaaagctgtgcagaacaaatcagattggcaccgttaatgaccgcctgatgcataagttgtcagtggaggctcccccaaagatccttgttgagcgatacctcatagagattgctaagaattacaacgttccctacgaaccagatagtgtggtgatggcggaagcaccacccggagtggagactgatctgatcgacgttggcttcacagacgatgttaagaaaggtggaccaggacgaggcggatcgggcgggttcactgcccctgtgggaggtcctgatggtactgtgcctatgcccatgcccatgcccatgcccatgcccagtgccaatacaccattctcgtatcctctgccaaaaggaccggtggatgacatcaacgcagataagaacatcagctccgcgcagatcgtcggtccaggacctaagcccgaagcctctgccaagctccccagcagacctgcggacaattacgataactttgtcttgcccgagctcccctccgttccggatacactaccaactgcctccgctggagcatccacaagtgcctcagaagatattgattttgatgatctctccaggaggtttgaagagctgaaaaagaaaacatag

SEQ ID NO: 24629 - DNA, 1101 bp, Artificial Sequence
  Description of Artificial Sequence: Synthetic coding sequence
atgctgggcagcggcttcaaggccgagcggctgcgggtgaacctgagactcgtgatcaatcgactgaaattactagagaagaaaaagactgagttggctcaaaaagcccgcaaggaaattgccgactaccttgctgccggcaaggacgagcgggcacgcatacgggtggaacacatcatcagggaagactacctcgttgaggcaatggagattctagagctatactgcgatttgctgttggctcgttttgggctgatccaatccatgaaggaactcgattccggcctcgcagaatctgtgagtaccctaatttgggccgcaccaaggctccagtccgaggtagccgagctgaagattgtagctgaccagctatgtgcgaagtactctaaggaatacggtaaactctgtcggaccaatcagatcggaacggttaatgaccgcttgatgcataagctctcggtcgaggccccaccgaagatcctcgttgagcggtacttaattgaaatagcgaagaactataacgttccatacgagccggatagtgtcgtgatggccgaggccccaccaggggtggaaaccgacctgattgatgtgggctttaccgatgacgtgaagaaaggcgggcccgggcggggcggatctggaggattcaccgcgcccgtaggagggcccgacgggactgtgcctatgccaatgcctatgcctatgccaatgccctcagctaacacccctttctcctacccgctcccaaaggggccatcagactttaacggactgcccatggggacttatcaggctttccctaatatacaccccccacaaatccctgctactcctccctcatacgagtcggtggatgacattaatgctgataagaacatctcctccgcccagatcgtgggtcctggtcccaaacccgaggccagcgctaaattgccatcccggcccgcagacaattacgacaacttcgttctacccgaattgcctagtgtgccggacacccttccgacggcctccgcgggggcctccacttccgcatcagaggatatcgactttgatgacctaagtcgtcggtttgaagaactgaaaaaaaagacgtag

SEQ ID NO: 24630 - DNA, 948 bp, Artificial Sequence
  Description of Artificial Sequence: Synthetic coding sequence
atggagaagtacgagaagctggccaagaccggcgagggcagctacggcgtggtgttcaagtgtagaaataaaacgagcggtcaggtcgtggcggttaagaaatttgtggagtccgaggatgatcccgtcgtgaaaaagatagccctgagagaaattagaatgctgaagcagttaaagcaccccaacttggtgaacctcatcgaggtttttagaaggaagagaaaaatgcaccttgtgttcgagtactgtgatcatactttattgaatgagctggagaggaatcccaacggggtggcggatggggtcattaagtctgtactctggcagaccctgcaggcattaaatttttgtcacatccacaattgcatccaccgggatattaaacctgagaacattttaatcaccaaacagggtattattaaaatctgtgacttcggtttcgctcaaattctgatacccggcgatgcttatactgactatgtggccactagatggtaccgggcccccgagctgttagtgggcgacacgcaatacggcagctctgttgatatttgggcgatcgggtgcgtgttcgctgaactgcttacagggcagcccctatggcccgggaagagcgatgtggatcagctttatctgatcattagaacccttgggaagctgatcccacgccatcagtctatttttaaaagcaacggctttttccatggtatctctatcccagaacccgaggatatggaaactctggaggagaaatttagcgacgtgcatccggttgcgctgaactttatgaaagggtgtcttaaaatgaaccctgacgatcgcctaacgtgttcccaacttctggaatcttcatactttgacagcttccaggaggcacagatcaaaaggaaggctaggaatgagggaaggaataggcgacgccagcaagtgctgcctctaaaatcttag

SEQ ID NO: 24631 - DNA, 948 bp, Artificial Sequence
  Description of Artificial Sequence: Synthetic coding sequence
atggccaacgaccccctggagggcttccacgaggtgaacctggcctctccaacctcccctgacctgcttggagtttatgagtcaggaacacaggagcagaccacaagtcctagcgtgatttataggccccacccttctgccctctcatccgtgcctattcaggccaatgctttagacgtctcagaacttccaacacagcctgtttactcttcccctaggcggttgaattgtgcagagatctcttcaatttctttccacgtaaccgaccctgccccctgctcaacctcgggtgtcactgctggccttacgaaactcacaacaaggaaggacaactacaatgcggagcgggagttcttacaaggcgccaccatcactgaggcctgcgatggatccgacgacatattcgggctctctacagattctttgagccggttgcgttcaccttcggtgctggaggtgcgggagaagggctacgaacgactaaaggaggaattggctaaagctcagcgagagctcaaactaaaggatgaggagtgcgagagactatctaaggttagagatcagcttgggcaggaactcgaggagctgacggccagtctgttcgaggaagcccataagatggtaagggaggccaacattaagcaggcaactgcggagaaacagttgaaggaggcccaggggaaaattgatgtgttgcaggccgaagtggcagctctgaagacactggtgcttagcagcagccctacctctcctactcaggaaccattgccaggcgggaaaactccctttaaaaagggccataccaggaacaagtctacctcctcagctatgagcgggtcacatcaggatttgtctgttattcaacccatcgtcaaggattgcaaggaggtgacacatcaggggctgagccccctcacgttactgatacttgtcagttcacatcattag

SEQ ID NO: 24632 - DNA, 1074 bp, Artificial Sequence
  Description of Artificial Sequence: Synthetic coding sequence
atggcccgggagaacggcgagagcagcagcagctggaagaagcaggcagaagacatcaaaaaaattttcgagttcaaggaaacattgggaaccggcgccttcagtgaggtcgttctcgccgaagaaaaagctactggcaagctgtttgccgtgaaatgtatccccaagaaagctctgaaaggaaaggaatcctcaatcgaaaatgaaattgcagtgttgagaaagattaagcacgagaacattgtggcccttgaggatatctatgaaagccctaaccatttatatctagttatgcagctggtgtccgggggcgagctttttgacagaatcgtcgaaaagggtttttataccgagaaagacgctagcaccctgatccgacaggttttggatgcagtttattacttgcacagaatgggcatcgttcaccgggacttaaaaccggaaaatctgctgtactactcgcaggacgaggagagtaaaattatgatatctgactttggcctctctaagatggagggcaagggagacgtcatgtccaccgcatgcggaactcctgggtatgtggccccagaagtcctggcccagaaaccctacagtaaagccgtggactgttggtcaataggagttatcgcttacatattgttgtgtggctaccccccgttctacgatgagaacgactctaagctgttcgagcagatcctcaaggcagagtacgaatttgacagcccctattgggacgatatatctgactctgcaaaagattttatccgtaacttgatggagaaagaccctaataaaaggtacacttgtgaacaggccgctcggcacccctggatcgctggagatactgcactgaacaagaacatccacgagagtgtgagcgcacagatcaggaagaacttcgccaaatctaagtggagacaggccttcaacgccaccgcagtggtgcgacacatgcggaagcttcatctaggatcatctctggattctagcaacgcctcagtcagttcaagtctctccctcgcgtcccagaaggactgtgcgtacgtagctaagccagaatccctgtcctag

SEQ ID NO: 24633 - DNA, 1158 bp, Artificial Sequence
  Description of Artificial Sequence: Synthetic coding sequence
atggcccgggagaacggcgagagcagcagcagctggaagaagcaggccgaggatatcaaaaaaattttcgagttcaaggaaacccttggcaccggagccttcagtgaagtggtgctcgccgaagaaaaggcaactggaaagctgtttgctgtgaagtgcattccgaagaaggctctcaaaggcaaggagagttcaatcgagaatgaaatcgctgtgctcaggaaaatcaaacacgaaaacattgtggcgttggaagatatctatgagtcccctaatcacctgtacctagtcatgcagttggtgagtggaggagagctatttgataggattgtggagaagggtttctacaccgaaaaagacgcttccacactgattcggcaggtattagacgcagtctactatctgcacagaatgggaattgtacatagagatctaaagccagagaatttgctgtattattcccaagacgaagagtctaagatcatgatctcagactttggactcagtaagatggagggaaaaggcgatgtaatgagtactgcctgcgggacaccaggctacgtggcaccagaggtgttggcccagaagccatactccaaggccgtagactgctggtctattggtgttattgcctacattttgctctgcggctaccccccattttacgatgaaaacgactcaaaattgtttgagcagatcctcaaagccgagtatgagtttgactcaccctactgggatgatattagcgattctgccaaagactttatccggaatctgatggagaaggatcccaacaagaggtatacttgtgagcaagccgccagacacccatggatcgcaggcgacaccgccctgaataaaaatatacatgaatcagtttctgcacagatcaggaaaaacttcgcaaaatccaagtggcggcaagcatttaatgcaacagccgtcgttcgacacatgcgaaagctgcacctcgggagttcccttgattcaagcaatgcctctgtgagcagctctctgtcactagcaagccagaaggattgcttggcacctagcacgctctgtagttttatcagttcttcttccggcgtttctggcgtgggcgccgaaagacgacctaggccaaccaccgtgacagcagtgcatagcgggagcaagtag

SEQ ID NO: 24634 - DNA, 888 bp, Artificial Sequence
  Description of Artificial Sequence: Synthetic coding sequence
atgaagaaggagcacgtgctgcactgccagttcagcgcctggtacccatttttccggggtgtgactatcaagtcagtgatcctgcctctgccccagaacgtgaaagattacctgctcgacgatggaactcttgtagttagcggacgtgacgacccaccaacgcatagccagcctgactcggacgacgaggcggaagaaatccagtggagtgatgacgagaacaccgctacactgaccgccccagaatttcctgaattcgccaccaaggttcaggaggccatcaattcgctagggggaagcgtgttcccgaagctgaactggtccgctccaagggatgcctactggatagccatgaactcctcactaaagtgcaagacccttagcgacatcttcctgctttttaagagcagcgactttatcaccagggattttacccagccattcattcactgtactgatgatagccctgacccttgcatcgagtacgagttagtcttaaggaaatggtgcgaactcataccaggagcagaattccggtgctttgtgaaggaaaataagctgatcgtggtgttcgatatatatagggactcccgtggaaaggtttggctgatcgactttaatccttttggagaagtgactgactcactgctgtttacctgggaggaactaatcagcgaaaacaacctgaatggtgacttcagcgaggtggatgctcaggagcaggactcccccgcctttcgctgtacgaattctgaggtgacagtgcagccatctccatatctttcttaccggttgcctaaagatttcgtggacctatcaacaggggaggacgcccataagctcattgacttcttgaagttaaagcgcaaccaacaggaggatgactag

SEQ ID NO: 24635 - DNA, 3273 bp, Artificial Sequence
  Description of Artificial Sequence: Synthetic coding sequence
atggagcagcccaagggcgtggactggaccgtgatcatcctgacctgtcagtacaaagattccgtgcaggtctttcagcgcgagctcgaggtccgccaaaaacgcgaacagattcctgctggaaccttactgcttgctgtggaggaccccgagaagcgcgttgggtcggggggtgcaacactgaacgcattactcgtggccgctgagcacctaagcgctcgagcaggattcacttggatttgcgtaggcgtgagtttatggattaggggctgccaccccccgggccgtctacctgaggcttccgtgcaccgagctttcccgctgctccaggtagtgacgtctgatgtcctacacagtgcgtggattctcatcctgcatatgggaagagacttcccgtttgacgactgtggccgtgcgttcacctgcttgccagtggaaaatccggaagctccagttgaagcactagtttgcaatttagactgtcttctggatatcatgacataccgacttggccccggctcacctccaggggtttgggtatgctctacggatatgctccttagcgtcccggcgaatccgggcatttcgtgggattccttcagaggagcgagggtaattgctttaccaggcagtcctgcttatgcccaaaatcacggcgtgtacctgactgacccccagggcctggtactggacatctattatcaaggtaccgaggcagaaatccaaaggtgtgtacgccccgacggtcgagtacccttagtctcaggtgtggtcttcttttcagtggagaccgccgagcgtctgttggcaacgcatgtttcccctccacttgacgcttgcacctacctggggcttgatagcggggcaaggcccgtgcagctgagtttgttcttcgacatacttcattgcatggccgagaatgtgacaagagaggactttctagtgggccgcccccctgaattagggcaaggcgatgcagatgttgctggttacctgcaaagcgcccgtgctcagttgtggcgggaacttagagatcaaccgctaacgatggcctatgtcagttcagggagctactcttacatgacatcgagtgcgtctgagtttttgttgtctctgacgctgccgggtgccccaggagctcagatagtacactctcaggtcgaagaacagcagctgctggccgctggctcttctgtggtgtcttgcctgttggagggtccagtccagctgggccctgggtctgttctgcagcactgccacttgcaaggccccattcatattggggctggttgccttgtcactggactggacacagcccacagcaaggccctccatggcagagaactgagggatctggtactccagggacatcatactcggctgcacggcagccccggtcatgcattcactctggtaggcaggctggactcttgggagcggcaaggcgcaggaacatatctaaatgtaccatggagcgagttctttaaacgcaccggcgttcgtgcctgggatctatgggacccggaaacattaccggccgaatattgcttaccgtctgctcggctgttcccagttctgcatcccagccgggaacttggtcctcaggatctactctggatgttggaccaccaagaggacgggggcgaagccctgcgggcttggagagccagctggcggctttcctgggagcagctgcagccatgcttagatcgggccgcgaccctggccagtcggcgagaccttttttttcgacaggccctgcacaaagccaggcatgtgctggaggcgcgtcaagatctctccctcagaccactgatttgggcggctgtgagggaagggtgtcccgggcctctgctcgcgaccctggatcaggtggcagccggtgcaggagaccccggggtggctgctagggcactggcctgtgtggcggacgtgttgggatgtatggcagagggacgaggaggcctgagaagcggaccagctgccaaccctgagtggatgcgtccgttctcctatctcgagtgcggcgacctggccgctggtgtggaagcattggctcaggagagggataagtggctgtcaagacccgcactgctggtgcgggccgctagacactatgagggagcaggtcagattttgatccgacaggctgttatgtcagctcagcattttgtgtcgacagagcaggtcgagctgcccgggcctgggcagtgggttgtcgctgagtgcccagctcgtgttgacttcagcggcggatggtctgacacacccccgctcgcttatgagttgggaggagcagttctcggactcgctgtgcgtgtggatgggcgacgacctataggggccagggcccgaaggatccctgagccggaattatggttagctgtgggccctcgacaggatgaaatgactgtcaagatagtttgccgctgcctggcagatctgcgcgactactgtcaaccccatgctccaggcgctcttttgaaggcagctttcatctgtgcgggaatcgttcatgtgcacagtgaactgcagttaagtaccagcagcatcctggccggcacagcactggccgctctgcagcgtgcagcgggaagagtcgtcggaacggaggctctcatacatgccgtcctccatctcgaacaggtgcttaccactgggggcggatggcaggatcaggtgggcgggcttatgcctggcatcaaggtagggcgtagccgtgcccagctccctttaaaggtagaggttgaggaggtaactgttccggaaggctttgtccagaagcttaacgaccatctgttactcgtgtataccggaaagactcgcctcgcaagaaatctgctgcaggacgtgttgagaagctggtacgctaggctcccggcagttgttcaaaacgctcatagcttggtgcggcagactgaagagtgtgccgaaggctttcggcagggctccctgccactgctgggtcagtgcttaacaagctattgggagcagaaaaagctgatggcacctggatgtgaaccgctcaccgttaggcgtatgatggacgtgcttgctccacatgtgcatggccagtccttggcgggagctggaggcggtgggttcctgtacctcctaactaaggaaccacaacagaaggaggcccttgaggccgtgctcgcgaaaacggaaggcctaggcaactacagcattcatctggttgaggtggacactcagggtctgtctctgaagctgctcggaacagaggcctctacatgttgcccatttccttag

SEQ ID NO: 24636 - DNA, 318 bp, Artificial Sequence
  Description of Artificial Sequence: Synthetic coding sequence
atgctggagctggcccaggaccggctgcagttcgagaccgtggaggtaagcgagccctctatgctgcagaagatcttgaccacccggcgccgggaaactggaggtaacgaacctctgccagtgccaacacttcagcaccaccttgcgcctcctgccgaagcccgtaaggtccccagtgctagccaggtccaggcaatcaagtgcttcctcagtaaatgctggtctttaaacattagtaccaaggaatatgcatatcttaaaggcactgtgttattcaatcccggcaaagggaaggagaacgattgtaaccatcattag

SEQ ID NO: 24637 - DNA, 1413 bp, Artificial Sequence
  Description of Artificial Sequence: Synthetic coding sequence
atggccggcgagaaccaccagtggcagggcagcatcctgtacaacatgctgatgtcagccaagcagaccagagctgcaccagaggccccagagactcggctagtggaccagtgctggggatgtagttgcggcgacgagccaggagtgggcagggagggcttactgggcggcagaaatgttgccctgctgtatcggtgttgtttctgcgggaaagatcaccctagacagggtagtatactgtatagtatgcttacatcagccaagcagacatacgctgcacctaaagctcccgaagctaccttgggcccatgttggggctgttcatgtggaagcgaccccggtgtggggcgtgctggcctacccggggggcggcccgtggctctactgtatcgatgctgcttttgcggcgaggatcacccccgccaaggctccatcctttacagcctcttgacttctagcaagcagacccacgtagctccagcagcaccagaagcacgtccagggggcgcctggtgggataggtcttacttcgcccagcggcctggcggtaaggaggccctacccggtggacgcgccactgcccttctgtacagatgctgtttttgcggggaagatcaccctcagcagggctccactttgtactgtgtgcctacgtccaccaaccaagctcaggcggcaccagaagaaaggcctagagctccgtggtgggatacatccagcggcgccctaaggcctgtagctctgaagagcccacaggtggtgtgcgaggcggccagcgctggcctcctcaaaacacttcgcttcgtcaagtatcttccctgctttcaggttttgccactcgatcagcagttggttctcgtgcggaattgctgggcttctctgctgatgctggaacttgcccaggatagactacaattcgaaactgtagaggtgagtgagccgtccatgctccagaagatactcacaacccggcggagagaaacgggaggaaatgaaccacttccagtgcccaccttgcagcaccaccttgccccaccagcggaggcccgaaaggtcccatcagcatcccaggtccaagccattaaatgttttctttctaaatgctggtcactgaacatctccactaaagaatacgcatacctgaagggtactgttctgttcaatcccgatgtcccagggcttcagtgtgtcaagtacatacaggggctgcagtggggaactcagcagattctgagcgagcacaccaggatgactcaccagggaccacacgatcggtttatagaactgaactcaacactgtttctccttcgctttatcaacgctaacgtgattgctgagttgttctttcggccaattatcggaaccgtgtctatggatgatatgatgctggaaatgctttgtacaaaaatctag

SEQ ID NO: 24638 - DNA, 2028 bp, Artificial Sequence
  Description of Artificial Sequence: Synthetic coding sequence
atgctgcgggccaccgccccctgctggttcccccccggctaccccgaggcgaagaaggtcgcagaagaagcagccctggaggcctccagacatttaggaggcgaacagtcccaagccggggcacctgaaggatccaaaatgctccgtgctaccgcgccttgttggttcagacccggttaccctgaagcaaagaaggttgcaaaggaagcagcacccgaagcatcccgacacctgggagccgaacagtctccagctggagcgcctgaaggttcaaagatgctgagggccactgctccatgctggttcccaccaggataccctgaggcgaagaaagtagccgaggaggcagccctggaggcaccagagttccccctccctagccatcagccggcccagagttttggcctctgggtgccccaaatgcataaacaggcctctgccttcgtagacattcaggctgagcctcagaatagaggccctgcagtgccccctgcctggccaaagatggtgaccgagtcctgttacttccctgcgcagcgaggaagtgcttgccgcttaccggctgcacctcgcctgactgagcgaccttctggggtacgaattagcgcccctcgtaagaggaagacaatcgctcactcctcaagcccatgtctcgtgacgggatatactgacgccaaaagaactcgggttgcatcatccagccagcgaagcagaggaagcaaagtaggaaggcagccggggaaaacaagaaaccggagtggcatggcgtgtaaaaccaccgctaccacaagctccaaacgtattgtcaggagagcatcattgccctcattatcgttgaagaaacccatcatccttagaagttcgggctgtcaggtgcccactgtgctgcggcggggctatctgcagcttttcaccgaagagtgtctgaagttttgtgcctccaagcaggaggctgaggaaaaagccctgaacgaagagaaggtggcatatgattgctctccaaacaagaaccggtacctcaacgtggtcctaaataccttgaaaagactgaaaggactcacaccatccagtatgccgggcctgagtagggccgccctctattcccgcctccaggaatttctgctcacacaggatcaacttaaggagaacgggtacccctttccgcatccagagaggcccggtggcgctgtactgttcaccgggcagggcaaagggcctggtgactcatcttgcagagtatgctgtcgatgcggcacagagtacctagtatcctcctctggcagatgcgtgcgggaccagctgtgttactaccactggggtcgcgtcagatcctctcaggtcgctggggggcgcgtgagccagtatacatgttgtgctgccgcacccgggtctgttggttgtcaagtggccaagcaacatgtaagagacggtagaaaagagagtctcgacggcttcgtggaaacattcaaaaaggaactttcgcgcgacgcataccctggtatttacgctctggattgcgaaatgtgctatactacccacgggctggagctcaccagagttacggtggtcgacgccgatatgagggtggtgtatgatacttttgtgaagcccgacaacgagatcgtggattataacaccagatttagtggggttacggaggctgatgttgccaaaacctctatcaccctaccccaagtccaagccatcttgctcagctttttctccgcccagacgattcttataggacacagtctggaatcagacctcctcgccctgaaactgatacatagtaccgtggtagacacagcagtgctgttcccccattacctgggatttccttacaagagatccctgcgaaatttagccgcggattacctcgcccaaattattcaggattctcaagatggtcacaattcttcggaagacgccagtgcatgcctgcagttggtgatgtggaaggtgagacagagggcacagatacagcctcgccatcgcagtgcctcacccgccgcgcttgcgtgcccctag

SEQ ID NO: 24639 - DNA, 711 bp, Artificial Sequence
  Description of Artificial Sequence: Synthetic coding sequence
atgcacaccacccagaaggacaccacctacaccaagatcttcgtggggggtctcccctaccacaccaccgacgccagtcttaggaagtatttcgaggtcttcggcgagattgaggaagccgttgtgattacagacagacaaacaggcaagagccgcggatatggattcgtcaccatggctgatagagcagccgctgaacgagcatgtaaggaccccaatcctattatagatggccggaaggctaatgtgaatctggcgtatttaggggctaagccccgtattatgcaacccggatttgcttttggcgtccagcagttgcacccggctctgattcaaaggccgttcggcattcccgcccactacgtgtacccacaagcgtttgttcagcctggcgtggtgataccccacgtacagcctactgccgcggcagcatctactacaccctatatcgattacacaggtgctgcttacgctcaatatagtgccgctgcagcagctgccgctgctgcagctgcatacgaccagtacccctatgccgcatcacccgctgctgccggatacgtgacggcaggaggctacggttacgcagtccagcagcctattaccgctgccgctcccgggaccgctgccgctgccgccgcagccgccgctgcagcagccgcctttggacagtatcaacctcagcagcttcaaacggacaggatgcagtag

SEQ ID NO: 24640 - DNA, 4389 bp, Artificial Sequence
  Description of Artificial Sequence: Synthetic coding sequence
atggcccccgtgcacggcgacgacagcctgagcgacagcggcagcttcgtgtcaagtcgcgccagaagggaaaagaagtccaaaaaaggtaggcaagaggctctggagaggcttaagaaagccaaagctggcgaaaaatataaatatgaggtggaagactttactggtgtttacgaggaagtcgacgaggaacagtatagtaaacttgtgcaagccaggcaggatgatgattggatcgtggacgatgatgggattgggtacgtagaagacggcagagagatttttgacgatgacctagaggatgacgcactcgatgccgacgagaagggaaaagacggtaaggcaagaaataaggacaagcggaacgttaagaaacttgccgttacaaaacctaataatatcaagagcatgttcatcgcttgtgctgggaagaaaacggcggataaggccgttgatctgtccaaagatgggctcctgggcgatattctacaagacctcaacaccgagaccccccaaattactcctccgccagtgatgatactcaagaagaaaaggagcattggcgcctcacccaatcccttcagtgtgcacaccgctactgcagtgccctctgggaaaatcgcctccccagtaagcaggaaggaaccccctttaacgccggttccactcaagcgcgccgagttcgccggcgacgacgttcaagtggaatcgaccgaagaagagcaggaatcgggagccatggaattcgaggacggtgactttgacgaacccatggaagtcgaggaggtagacctggaaccgatggccgctaaagcctgggacaaagagtctgagcctgcagaagaagtgaagcaggaggcggattctggcaagggaactgtgagttatctcggctccttcctccccgatgtttcctgttgggatatcgatcaggagggcgactcctccttttcagtgcaggaagtacaggtcgattcgagccatctgcccctggtcaagggagctgacgaggaacaggtgtttcatttttactggctggatgcgtacgaggatcaatataatcagccaggagtcgttttcctcttcgggaaagtctggatagagtctgcagaaacacatgtgtcctgctgcgtcatggtcaaaaatatcgaacgcactctgtactttttaccgagggagatgaaaatcgacctgaacaccggaaaggagaccggcacccccatcagtatgaaggatgtctacgaagaattcgacgagaagatcgcaactaagtataaaatcatgaagttcaaaagcaagccagtggagaagaactacgccttcgaaatcccagatgtgcccgaaaagagcgaatatctagaagtgaaatacagcgcggaaatgccacaactgccacaggacctcaaaggcgagacttttagccatgtgttcgggacaaataccagctcgctcgaactgttcttgatgaatcggaaaatcaagggaccatgttggctggaggtgaaaagcccccagctactgaaccagcccgtgagctggtgtaaagtggaagccatggctctaaaaccagatctcgtgaacgtgataaaagacgtgtccccaccccctttggtagtgatggcattttctatgaaaacaatgcaaaatgctaagaaccaccagaatgagattattgccatggcagccctggtacatcacagctttgcgctagacaaagcagctcccaaaccaccctttcagagccatttttgtgtagttagtaaacccaaagattgtatctttccctatgcttttaaggaggtgatcgaaaagaagaacgtgaaagtcgaagtggccgccacggagcggacgctcctgggattcttcctcgccaaggtccacaagatcgatccagatatcatagtaggacataatatatacggctttgagctggaagtactgctccaacgcattaatgtgtgtaaagctcctcactggtcgaaaatcggtaggctaaaaagatctaacatgcctaaactcgggggcagatccggttttggcgaacgtaacgctacgtgtgggcgaatgatctgtgacgtcgaaattagcgctaaggagctcatccgatgcaaatcatatcaccttagcgagctcgtccagcagatcttaaaaacagaaagggttgtgattcctatggagaatattcagaacatgtattcagagtcttcccaactgctgtatctgctggagcacacttggaaggacgctaagttcatcctccagattatgtgcgagcttaacgtcctaccactggcactgcagattacaaatattgccggaaacatcatgagccggacacttatgggcggccgatccgagcggaatgaatttctcctgctgcacgccttttacgagaataattatattgtccctgacaagcaaattttccgtaagccccagcagaagctgggagacgaagacgaggaaatcgacggcgatacaaataaatataaaaaaggcagaaaaaaggctgcatatgcaggcggcttggtactggatcctaaagttggattctacgataaatttatcctcctgctcgacttcaacagcctatatccttccataatccaggagtttaatatctgcttcaccactgttcagcgggtggcatctgaggcacagaaggtgaccgaggatggtgaacaggagcagattcctgagctgcccgacccatcactcgaaatgggaatcctccctcgagagatcagaaaattggtggaacgcaggaaacaggttaagcagctgatgaagcagcaggatctgaaccccgacctgattctgcaatatgatataagacagaaggctctgaagttgaccgccaacagcatgtatggctgcctgggcttcagctattcgagattttatgcaaagcccctggcagcgctggttacatataagggacgggaaatactgatgcacactaaggaaatggtgcagaagatgaacttagaagtgatatatggagacactgactctatcatgatcaatacaaactccacaaatctggaagaagtattcaaattggggaacaaagtgaaaagtgaggtgaacaagctgtataaacttttagaaatcgacatcgacggcgttttcaaatctttacttttgcttaagaagaagaagtatgctgctctggtggttgaaccaactagcgatggaaattacgtaaccaaacaggaacttaagggtctcgatattgtcagacgggattggtgcgatttggcaaaagacactggcaattttgtcattggccagatactttcagaccaaagcagggacactattgtggaaaacattcaaaagaggttgatagagataggggaaaacgtgctcaatggttcagtgccagtgagccaatttgagattaataaagcactcacaaaggacccacaggactatcccgataaaaaaagcttgccccatgtccatgtcgcgctttggatcaatagccagggtgggcgaaaggtgaaagcgggtgacactgttagctacgttatttgtcaggacggctctaacctaactgcttcacaacgcgcttatgcccccgagcagctacaaaagcaggacaatctgaccattgatacacaatactacttagcccaacagatacaccccgtcgtcgctagaatctgtgagccgatcgatggaatcgacgccgtccttatcgcaacttggttgggcctggacccaacgcagttcagagtccatcactaccataaggacgaggaaaacgatgccctgctgggtggccccgcccagttgaccgatgaagagaagtacagagactgtgagcggttcaagtgtccttgtcccacttgcggtaccgagaatatttacgacaatgtattcgacggaagcggcacagacatggagccctctctgtatcgctgtagcaatatcgattgtaaggcctcgccactgaccttcaccgtgcagctgtcaaacaagctgatcatggacatcaggcggttcattaagaaatactatgatgggtggctcatatgtgaggaacccacgtgtcgcaacagaacacggcatctgccgctccagttcagtcgcactggccccctgtgcccagcctgtatgaaggctaccctccaacctgaatacagcgacaagtccctctatacccagctatgcttctacagatacatttttgacgccgagtgcgcactggaaaagctgaccaccgaccacgaaaaagataaactgaaaaaacagttcttcaccccaaaggtgctgcaggattaccggaaacttaagaacaccgcagaacagttcctcagccggagtgggtatagtgaggttaatttgtctaagctgtttgccgggtgcgccgtgaaaagttag

SEQ ID NO: 24641 - DNA, 2673 bp, Artificial Sequence
  Description of Artificial Sequence: Synthetic coding sequence
atgagcgccaacaacagcccccccagcgcccagaagagcgtgctgcccacagcaattcccgctgtccttcccgccgcaagcccttgctcctcccctaagacaggcctgtccgcccgcctgtctaatggatccttcagtgcccctagcttgaccaattctcggggatccgtgcatactgtctcattcttactgcagatcggtttgacacgagaaagcgtgaccatcgaggctcaagaattatccctgagcgccgtgaaggacctggtctgcagcatagtataccagaagttcccagaatgcggcttctttggcatgtacgacaagatcctcctgtttaggcatgacatgaattctgagaatattctccagctcattacctccgctgacgaaatccacgaaggcgatcttgtggaggtcgtcctttctgctctcgcaacagtcgaagactttcaaatccggccgcatacactgtacgtacattcgtataaagctcctacattctgcgactattgcggggaaatgttatggggccttgtgcgacaggggctaaagtgtgagggatgtggactgaattaccacaaaaggtgcgccttcaagatcccgaacaattgcagcggggtgagaaagagacggttgagcaacgtgagtcttccaggccccgggttatccgtgccccggccattgcagccggaatacgtcgccctgcctagtgaagagagccacgttcaccaggaaccctccaaaaggatcccctcttggagcgggaggccaatttggatggagaagatggtgatgtgtcgggtgaaagtcccacatactttcgctgtgcattcatatactagaccaactatttgccagtattgtaagcgacttttgaagggactctttcggcaaggtatgcaatgcaaagactgtaagtttaattgtcacaaacggtgcgcctccaaggtgccgagggattgtctgggcgaagtgacctttaatggagagccctccagcttggggactgacactgatattccaatggatatcgacaataacgatatcaatagcgactcatcgcggggtttagatgataccgaggagccatcacctccggaagataagatgttttttctggacccatccgatctagatgttgaaagggatgaggaagccgttaagaccattagcccctctacatcgaacaatattcccctgatgcgcgtagtccaaagcatcaagcatacaaagaggaagtcttctactatggttaaagagggttggatggttcactacacgtcacgcgacaacttgcggaaacgtcattattggcgtctggatagcaaatgcctcacactgtttcagaatgaatccggctcaaaatattataaagaaattccgctttctgaaattctgaggattagtagccccagagatttcacaaacatttcgcaggggagtaatccccactgcttcgagatcatcaccgataccatggtttattttgttggcgagaataatggggacagcagccacaacccagtcttggctgccactggtgttggcctggacgtggcccaaagctgggaaaaagcaattagacaggctctcatgccagtcaccccacaggcctccgtctgcaccagtcccggtcagggaaaagaccacaaagatctgtcaaccagcatttccgtgagtaactgtcaaatccaggaaaatgtggatatcagcaccgtgtaccagatattcgctgacgaggtgctgggttccgggcagtttgggattgtgtacgggggaaagcataggaaaactggcagggacgtggcgattaaggtaattgataagatgcggttccccactaaacaggagtcacagctgagaaatgaggttgccatactgcagaacttacatcaccctgggatcgtcaaccttgaatgcatgttcgaaactccagaaagggtgtttgtggttatggagaaactgcacggggacatgctcgagatgatcctcagctcagaaaaaagtaggctgccagagcggattacgaaattcatggtcacacagattctggtcgcactgcgcaatctgcactttaaaaacatcgtccactgcgatttgaaaccagaaaatgttttgctcgcttctgccgagccgttcccccaagttaaactgtgtgattttggttttgcccgcataattggcgagaaatcctttagaagaagtgttgtcgggacacccgcctacctggcgccagaggttctacgctccaaaggatacaatcgtagtctcgatatgtggagtgtcggtgtaatcatctatgtcagtttgtccgggactttcccattcaacgaggatgaagatataaacgaccagatccaaaacgctgccttcatgtatccccccaacccctggcgcgagatctcaggtgaggcaatcgatctcataaacaacctgctccaggtcaagatgcggaaaagatacagtgtggacaaatctctctcgcacccctggctgcaggattatcagacgtggctggatcttcgggaatttgagaccagaattggcgaacggtatatcacgcacgagtcagatgacgctagatgggagattcacgcctacacccacaatcttgtttatcccaagcactttatcatggcacccaatccagatgacatggaagaagacccctag

SEQ ID NO: 24642 - DNA, 4407 bp, Artificial Sequence
  Description of Artificial Sequence: Synthetic coding sequence
atggcccccgtgcacggcgacgactgcgagatcggcgccagcgccttgtctgatagcggatccttcgtgtcttccagggccagacgcgaaaagaaatccaaaaaaggacgccaggaggccttggagcgactcaagaaggccaaggcaggcgaaaaatataaatatgaagtggaggacttcacaggagtctatgaagaggtggacgaggaacagtactctaagcttgtgcaggcaagacaggacgacgattggattgtggacgatgatggcatcggttacgtcgaagacggtcgcgaaatttttgacgacgatctggaggatgatgcacttgacgctgacgagaaaggaaaagatggcaaggcccgaaacaaagacaagagaaatgtgaagaagttggcggtgacaaaaccaaataatattaagtcaatgtttattgcctgtgccggcaagaagacagccgataaggccgtagacttgtccaaagacgggcttctgggagatatactccaggatcttaacaccgagacacctcagatcaccccaccacctgtgatgattctgaaaaagaagagatcaatcggagcgtctcccaatccattctcagtacataccgcaacagccgtaccttcaggcaagattgcctcccctgttagcaggaaagagcctccactgaccccagttcctctcaaaagggccgaattcgccggagatgatgtgcaagtcgagtcaaccgaggaggagcaggagtcaggcgccatggagttcgaggacggcgatttcgatgagcccatggaggtagaagaggtcgatttagagccgatggctgctaaagcttgggacaaagagagcgagcccgcagaggaggtcaagcaggaggctgactctggcaagggaacagtgagttacctcggtagcttcctccctgatgtgagctgctgggacatcgatcaagagggtgacagtagctttagcgttcaggaggtacaagtcgactcttcacacttaccactggtcaagggagcagatgaggaacaggtgttccatttttattggttggacgcttacgaggatcaatacaatcagccgggggtcgtgttcctattcggcaaggtttggatcgaaagtgccgaaacccacgtgtcatgttgcgttatggtgaaaaacatcgagaggaccctttacttcttgcccagggaaatgaaaattgatctcaataccggtaaagagacgggaactccaatctcaatgaaagacgtgtatgaggaatttgatgaaaagatcgcaacaaagtacaagattatgaaattcaagtccaagcctgtagaaaaaaattacgccttcgagatccctgacgtgcccgaaaaatcagagtatctggaagtaaaatattccgcagaaatgccgcagttgcctcaggacttaaagggtgagacattttctcacgtttttggaactaatacgtcaagcctcgagctcttcctgatgaatcgcaaaatcaaaggcccgtgttggcttgaggtcaagagccctcaactcctgaaccagcctgtctcctggtgcaaggtggaggccatggctctcaaacccgatctggtgaatgttatcaaggatgtcagcccgccgccccttgtggtgatggctttctcgatgaagacaatgcaaaatgccaaaaatcaccagaacgagatcatcgctatggctgcacttgtacaccacagtttcgccctggataaagccgcgcccaaaccacctttccaaagtcatttctgcgttgtgagtaagccaaaagattgtatttttccgtacgcctttaaagaggttatcgaaaagaagaatgtgaaagtcgaggtagctgctaccgagcgaacactgctgggcttctttttggcgaaggtgcacaagattgatccggacattattgtgggtcacaatatttatggtttcgagttagaggtcctgctgcagagaataaacgtgtgcaaggcccctcactggtctaaaattggtcgcctaaaaagatcaaacatgcccaaactgggggggcggagcggctttggggagcgtaacgctacctgcggcaggatgatctgcgatgtagaaatcagcgcaaaggaactcattcggtgtaagtcttatcatctctcagagttggttcaacaaatcttgaaaaccgaacgcgtcgtgattccaatggagaatatccagaacatgtactccgagagttcacagctactgtatctgcttgagcacacctggaaagatgcaaagttcatcctgcaaatcatgtgcgagctgaatgtcctgcctctggcgctccaaatcaccaatatcgcaggtaacatcatgtctcggaccctgatgggcgggaggagtgagaggaatgaatttctcctgctgcacgccttctacgaaaataattatatcgtgccggacaagcagattttccggaaaccacaacaaaagcttggggatgaagatgaagaaatcgatggagatacaaacaaatacaaaaaagggcgtaaaaaagcggcttatgcaggagggctggtgctggatccaaaggtgggattctacgacaagttcattctgctgttggacttcaactcactgtatcctagcatcatacaggagtttaacatttgttttaccacggtccagcgcgtagccagtgaggcacagaaggtcactgaggatggggagcaggagcagatccccgagctccccgacccttccctggagatgggcatactcccccgcgagattaggaaactggtcgaaaggaggaaacaggtgaagcaactgatgaaacagcaggacctcaacccagacctaatccttcagtacgatattagacaaaaggccctgaagcttactgccaattcaatgtatggatgtttgggcttctcttactcaagattctatgctaagccactagccgctctcgtaacttacaaaggacgggaaatcctcatgcatacgaaggaaatggtacagaagatgaatcttgaggtaatttatggtgatacagattctatcatgattaatacaaatagcaccaatttggaggaggttttcaaactgggcaataaagtaaagtcagaggtgaataagttatataagctgctcgagattgatattgatggagtattcaagagcctgcttttactgaaaaaaaaaaaatacgcagccctcgttgttgaacctacctccgatggcaactatgtgaccaaacaggaactcaagggacttgatatcgtacggcgggattggtgcgatctggcgaaggataccggcaacttcgtgattgggcagattttgtctgaccaatcacgggataccattgtggaaaatatccaaaaaaggttgatcgaaattggcgaaaatgtgctcaacgggtcggtgccagtgagtcagttcgagataaataaggcattgacaaaggaccctcaggactaccctgacaaaaaatctttaccacatgttcatgtggcactgtggattaactcccaaggaggaagaaaggtgaaagcaggtgatacggtaagttatgtgatctgccaggacggatccaatctgacagcaagtcagcgggcatacgcacctgagcaactgcagaagcaggataacttgactatcgacacccaatattacctcgcccagcagatccaccctgtggtggcccgtatctgtgaaccaatcgatgggattgacgcagtgctgattgctacctggttagggctggatccaacacaattcagagtacatcattaccacaaggacgaagagaatgacgctctgcttggtggaccggcccagttgacagatgaagagaagtatcgggactgcgaaagattcaaatgtccgtgtcccacctgtggaaccgagaacatctatgataacgtgtttgacggaagcggtaccgacatggagccaagcctataccggtgctcaaacatcgactgcaaagcaagtccactgacatttactgtgcagctgagcaataagttgatcatggatatccggaggttcatcaagaagtactatgacggctggctgatttgtgaggagcctacatgcaggaatcgcacgaggcacctgcctcttcaattctcgcgaaccggccccctttgccccgcctgcatgaaagccactctgcaaccagagtacagcgacaagtccttatacacccagctgtgtttttacagatatatcttcgacgctgaatgtgctctggagaagctgaccacggatcacgagaaggacaagctgaagaagcagttttttacacctaaagtgctgcaggattacagaaagttgaagaacactgctgaacagtttctgtctcggtctggctatagcgaggtcaacctaagcaagctgttcgccggctgcgccgtaaagtcttag

SEQ ID NO: 24643 - DNA, 399 bp, Artificial Sequence
  Description of Artificial Sequence: Synthetic coding sequence
atggtggagcccttcctgggcacctggaagctggtgagcagcgagaatttcgaagactacatgaaagaattgggagtgaactttgcagcccgcaatatggccggcctcgtcaaaccaaccgtgactatatctgtcgacggaaaaatgatgaccattcggacagagtccagcttccaggacacgaaaattagcttcaaactaggcgaggagttcgatgaaacaacagccgacaacagaaaggtgaagtccactataacacttgagaatggtagtatgatccacgtgcaaaaatggcttggcaaggagacgactatcaaacggaagatcgttgatgagaagatggttgtcgagtgcaagatgaacaacattgtttccacacgtatctatgaaaaagtctag

SEQ ID NO: 24644 - DNA, 555 bp, Artificial Sequence
  Description of Artificial Sequence: Synthetic coding sequence
atggaccggggcgagcagggcctgctgcggaccgaccccgtgcccgaggaaggcgaggacgttgctgccactattagtgctactgagacactctctgaagaggaacaggaagaactgagacgggagctagcaaaagtggaggaggagatccagacccttagtcaagtcctggccgctaaggagaaacatttggccgagatcaaacggaagctaggtatcaacagtctccaggaattgaaacagaatatcgccaaagggtggcaggatgttactgctacaagcgcatacaagaagactagcgaaacactcagccaggctggacaaaaagcatcggccgccttttcctccgttggttctgtcatcaccaagaaactcgaggacgtaaaaaacagccctacctttaaaagctttgaggagaaggtggaaaaccttaagtccaaggtgggcggtacaaagccagctggtggtgacttcggtgaggtcctgaatagcgcagcgaacgcttcagccaccactaccgaaccactacctgagaagactcaggagagtttatag

SEQ ID NO: 24645 - DNA, 675 bp, Artificial Sequence
  Description of Artificial Sequence: Synthetic coding sequence
atggactgccgggagatggacctgtacgaggactaccagagccccttcgacttcgacgcgggcgtgaataaatcctatctatacttgagcccatccggtaattcctccccgccgggatctccaactctgcagaagtttggtttgctgcggacagatcccgtgcccgaggagggcgaggacgtggctgcaaccattagtgcgacggagactttgtccgaggaggagcaggaagagctccggagggagctggccaaggtggaagaagaaatacagactttatctcaagtgctggctgcgaaggaaaagcatttggcagagattaaaagaaaactgggcattaacagtctacaggaactgaaacaaaatatagctaaaggttggcaagacgtcactgccacgagcgcgtataaaaagactagtgaaaccctctctcaagccgggcagaaagcttccgctgccttctcgtcagtcggcagcgtcatcactaagaagcttgaggatgtgaagaattcccccaccttcaaatcctttgaggaaaaggtggagaatttaaagagcaaggtcggtgggaccaaacccgcaggaggcgatttcggggaagtcttgaactcagccgcaaacgcttccgccaccacaacggaaccactgcctgagaaaacacaggaatccttgtag

SEQ ID NO: 24646 - DNA, 285 bp, Artificial Sequence
  Description of Artificial Sequence: Synthetic coding sequence
ccccgggccgcccggagccggggccccgccgtgagccggccccgggcacctcgacccgagctcactaccgaagccggcgagcccgcccgccggtgcgtcccgccctacgaacaccggccaggcatgcagtgcgccgtgactacccccccccccagctattacccatatcctaatctgagatgggacacctcacattttaaaaagtctggtggaccacaaagaaacaattatgtgattcatcccgagttcgtaagcgaaacttaccccgattatcgatgttggtag

SEQ ID NO: 24647 - DNA, 1110 bp, Artificial Sequence
  Description of Artificial Sequence: Synthetic coding sequence
atgcccgtggtgaccaccgacgccgagagcgagaccggcatccccaagtccctgagcaacgagcctccctcagagaccatggaggagatcgagcacacctgtccacagcctcgcctcaccctgacagcccccgctcctttcgctgacgagactaactgtcagtgtcaggcgcctcatgaaaagctcacaatagcccaggctcgactgggcacacctgcagaccgcccagtgcgagtgtacgcagatggcatctttgacctgtttcatagtggccatgcacgcgcgctgatgcaggctaagaccctgttccctaacagctaccttttggtcggcgtgtgttcagatgatcttactcataagtttaaagggttcaccgtcatgaacgaagccgagcgctatgaagccctaaggcattgtagatacgtggatgaggtgatccgagatgcaccatggacgcttactcctgaatttctcgaaaaacacaaaatcgattttgttgcgcacgatgacattccctattcatctgcaggctccgatgatgtttacaaacatatcaaggaggcaggcatgttcgttcccactcagaggaccgagggcatctccaccagcgatattattacccgtatcgtgcgggactacgacgtatacgctaggcggaaccttcagaggggctacaccgccaaggaactgaatgtaagtttcatcaatgagaagcgataccgatttcagaatcaggtcgacaaaatgaaagaaaaagtcaaaaatgtggaggaaaggtcaaaggagttcgtgaatagagttgaggagaagtcccacgatctgatccaaaagtgggaagagaagtctcgcgagttcatcggaaacttcctcgagctctttgggcccgatggcgcttggaaacagatgttccaagaaaggtcatcgaggatgctgcaggccctttcgccaaagcaatctccagtgagctcccccacccggagtaggtccccctctcgcagtccaagtccaactttttcttggctaccgctgaagacatccccacccagcagtccaaaggccgcctctgcctctatttcatcaatgtccgaaggggacgaggatgaaaaatag

SEQ ID NO: 24648 - DNA, 1056 bp, Artificial Sequence
  Description of Artificial Sequence: Synthetic coding sequence
atggtgggccaccaggagtgcatcatggaggaggacaaccgggccccgcagctgtggagaaagacattaacggctccagccccttttgcagacgagacaaactgtcagtgccaggccccccacgagaagctgaccattgcccaggctaggctcggcacacctgcagaccggccagtgcgcgtgtacgcggacgggatctttgatttgtttcacagtggccacgctagggccctgatgcaagctaagactctgtttcctaactcctacctcctggtgggcgtgtgttccgacgacctgactcacaagttcaagggctttacagtgatgaatgaagcagaaagatatgaagccttacggcactgcaggtacgtggatgaggtcatcagggatgctccatggaccttaacaccggaattcctcgagaagcataagatcgatttcgtggctcacgatgacatcccctacagctccgcagggtctgacgatgtctacaagcatatcaaagaagctggtatgttcgtcccaacgcagaggactgagggaatcagcaccagcgacatcattactaggattgtgagagactacgatgtgtatgctaggcgtaacctgcagcgaggttatactgcgaaggagctgaatgtgtcttttataaacgaaaagcgatacagatttcagaatcaagtcgacaagatgaaggaaaaagtgaaaaacgtggaggaaaggtcaaaagagtttgtgaacagagttgaggaaaaatcacatgatctaatccagaaatgggaggaaaagagcagagaattcattgggaacttcttagagctcttcggcccagatggcgcctggaagcagatgtttcaggagcgatcctctagaatgttgcaggcgctgagcccaaagcagtctcccgtgtcctctcccacacgctcgcgatcgccctcccgatcacctagtcccaccttttcttggctgccacttaaaacttcaccaccgtcttcacctaaggctgccagtgcctcaatctctagcatgtcggagggcgacgaagatgagaaatag

SEQ ID NO: 24649 - DNA, 600 bp, Artificial Sequence
  Description of Artificial Sequence: Synthetic coding sequence
atggccgacaagagcaagttcatcgagtacatcgacgaggccctggagaagtccaaggagactgccctaagccacctcttcttcacgtaccagggtatcccctacccaatcaccatgtgcacgtcagaaacattccaagcattagatacctttgaagccagacacgatgatattgtgctcgcttcctaccccaagtgtggttccaattggattctgcatatcgtctctgaactgatttacgctgtctcaaagaaaaaatataagtatcctgaatttccagtgctggaatgtggcgactccgaaaagtaccagaacttagcagccggcattaagcagatcgctgagttcttggggttcttcctgaccggcgagcaaattcagactatctctgtgcagtctacctttcaggcaatgcgtgcgaagtcacaggatacccacggggccgttggcccctttttattcaggaagggggaggtgggggattggaaaaacctgttctctgagatccagaatcaggagatggacgagaagttcaaggagtgtctggcgggtacaagtctgggcgcaaagctgaagtacgaatcttactgccagggttag

SEQ ID NO: 24650 - DNA, 1527 bp, Artificial Sequence
  Description of Artificial Sequence: Synthetic coding sequence
atgcggtgccccaagagcgccgtgaccatgcggaacgaggagctgttgctaagtaacggcacagccaacaagatgaacggagccctggatcattcggatcagcctgatcccgatgcaataaagatgtttgtgggccagatccctagatcatggtcagaaaaagagctgaaggagctgttcgagccttatggtgcggtatatcagatcaacgttttgcgcgatcgctcccagaaccctccacaatccaaaggatgctgcttcgtcactttctacactcggaaagccgccctggaggcccagaatgccctccacaacatcaaaacactgcctggcatgcaccatcccatccagatgaaacctgctgactccgagaaaagcaacgcagtcgaggaccggaagctgttcatcggcatggtgtccaagaagtgcaacgagaatgacattagggtaatgttctccccgtttggtcaaattgaagagtgtcggattcttcgtggcccagacggtttgtcaagagggtgcgccttcgtgacctttagtacaagggctatggctcagaatgcgataaaggccatgcaccaatcccaaaccatggagggatgcagcagtccgatagtggtgaaattcgctgacacccagaaggacaaagaacagaggcgcctgcagcagcagctcgcgcaacaaatgcagcaattgaataccgcgacctggggtaatctgacagggctgggaggactgacacctcagtatctagctctcctccagcaagccaccagcagctcaaacctgggggcattctctggtatccagcagatggcaggcatgaatgccctacaactccagaatctggccacgcttgcagccgctgctgctgcggctcagaccagcgccactagtactaatgctaaccctttgtcaacaacttcgtccgccttgggcgccctgacctcacctgttgccgccagcactcccaattcaacggccggtgctgccatgaactctctgacatcgctcggtacactgcaaggccttgctggcgcaacagttggcctgaacaacatcaatgcactggcagggatggccgcactcaacggcggcctgggcgctacaggcctgactaacgggactgcaggtactatggatgcccttacccaggcatactcaggaatacagcaatacgccgcagctgcactgccaaccctgtattcccagtcactcctgcaacagcaatcagccgccggctctcagaaggagggcccagagggggctaacttattcatttaccacctgccccaggagtttggcgatcaggacattctgcagatgttcatgccattcggaaatgtgatcagcgccaaagtgtttatagacaaacagacgaacctatccaagtgtttcgggtttgtgagctacgacaaccccgtaagtgcacaggccgcaatccaggctatgaacgggttccagattggaatgaaacggctgaaggtgcagctcaagagatccaaaaatgattccaaaccatactag

SEQ ID NO: 24651 - DNA, 1215 bp, Artificial Sequence
  Description of Artificial Sequence: Synthetic coding sequence
atgggcagcagccaggaggagggcctgcggtgccagcccagccagcccgatcacgacgctgatgggcattgcggccccgatctcgaaggagccgagcgagccagtgctacacccggcccccctgggctcctgaatagccacaggcccgcagacagcgatgacacgaacgccgccggtcctagcgcagcgttgttggaagggctcctgcttggtggtggaaaaccatcgccacactctacgaggccagggcccttcttctacatcggtggctctaatggtgctaccatcatcagtagctattgtaagagcaaagggtggcagcggattcacgattctcggagggatgactacacactgaagtggtgcgaagtcaagtcgcgggactcttatggctcattccgcgaaggcgagcagctgctgtatcagttaccgaacaataagctcctgaccacaaagattggccttctgagtacactccggggcagagcaagggcaatgtcaaaagccagcaaagtacccgggggggtgcaggctagactggagaaagacgctgctgcccccgcccttgaggacctcccgtggacctctcctgggtatcttcggccccaacgtgtgctgcggatggaagaattcttccctgagacatatcgtctcgatctcaagcatgaacgggaggctttcttcacactcttcgacgaaacccagatctggatttgtaagcctacagcatcgaatcagggcaagggaatttttctgctgcgaaatcaggaggaggttgctgccctccaagccaagacaaggagtatggaggatgatcccatccaccataaaaccccattccgagggccacaagctagggtcgttcaacgctacatacaaaacccacttctggtggatgggcgcaaattcgacgtccggtcctacctcctcattgcatgtaccaccccttatatgatttttttcggtcacgggtatgcgcgcctgactctgagcttatatgaccctcattccagtgacttgggtgggcacctgaccaatcaattcatgcaaaagaaatccccgctgtacatgttactgaaagaacacaccgtctggagtatggagcacctaaataggtacatcagcgacaccttctggaaggcccggggactggctaaggactgggtgttcaccactctcaaggtgaggccactctgtccccccgtgtgggagtag

SEQ ID NO: 24652 - DNA, 2022 bp, Artificial Sequence
  Description of Artificial Sequence: Synthetic coding sequence
atggaccacagctgcacccggttcatccaccggcggggcccccccacccggaccagagcgggtttcaaacggggtaagcggccacgaattcagcagagacccagagcccgcgtgagcggaaccattcctgcgagtaggctccatcccgctcctgccagtcaaccgggaccgtgtcctgctccggggcactgcccagtgggcccagcccatgagaggcctatgggctcgtcccaagaagaggggctcagatgtcaaccgagccagccagaccacgatgctgacggacactgtggccctgacctggagggagcggagcgggcctccgccacacccggacccccgggtcttttgaactcccacaggcccgccgactccgatgacaccaatgcagccggcccctctgccgccctgctggaggggctgctcctgggcggtggcaaaccctcaccacattctactcgtcccggaccattcttctatattggcggctccaacggtgctaccattatttcttcctattgcaaatccaaggggtggcagaggatccatgactcacggcgcgatgattacaccttaaaatggtgcgaagtgaagagccgcgactcgtatggctcgtttcgcgaaggtgagcagttgctttatcagttaccaaacaacaaactgctgacgactaagattggcctgctatccacgctcagaggacgggcgagagctatgtccaaggcttcgaaagtgccaggcggggttcaagctagattggagaaggacgcagccgcgcctgcgctggaagacctcccttggaccagtcccggctatctccggcctcagcgggtactgcgaatggaagaattcttccccgagacctaccggctggacctgaaacatgagagagaagctttctttaccctgtttgacgaaacccagatatggatttgtaagcctacagcctccaaccaaggcaaaggcatctttcttcttagaaatcaggaggaggtcgctgccctgcaagcgaaaactaggtctatggaggatgatcctatccaccataaaaccccattccgcgggccccaggctcgggtggtgcaacgatatatccagaaccccctgcttgttgatggccgcaaattcgacgtgcgaagttatttacttatcgcgtgcactacaccttatatgatcttttttgggcatggctacgcccgtctaaccctctcactgtatgatccacactcctcagacctcggtggccatctcacgaatcagtttatgcagaaaaagtccccactgtatatgctgctgaaggagcacacggtatggtccatggaacatctcaatagatacattagcgataccttctggaaagcgcgtggcttggccaaggattgggtgtttacaaccttgaagaaacgaatgcaacagattatggcccactgctttctcgccgcaaaacctaagctagactgcaaacttggatatttcgacttgatcggctgcgattttttgattgatgacaattttaaggtgtggctactcgagatgaacagtaaccctgctttacatacgaactgtgaggtactgaaggaagtgataccgggtgtggttatagagaccttggacctagtcttggaaacttttcgcaagagtctgagggggcagaaaatgctgcccctcctatcacagcgacgctttgttttgcttcataatggagaagctgatccacggcctcacctaggcgggtcctgcagtctgaggcgctggcctccactgcctaccaggcaagccaaatcttcaggtccaccgatgccgcatgcccctgaccagccaggagcacggaggccagcacccccacccctggtccctcaacgaccgagaccaccagggcccgacctggatagcgcacacgacggtgaaccccaggctccgggaacagaacagtcaggcacaggtaaccgacaccctgcacaggagccatcaccaggcaccgccaaggaagagcgcgaagaacccgaaaatgcccgaccatag

SEQ ID NO: 24653 - DNA, 2022 bp, Artificial Sequence
  Description of Artificial Sequence: Synthetic coding sequence
atggaccacagctgcacccggttcatccaccggcggggcccccccaccaggacgcgggccggctttaaacggggtaaacggccgaggatccagcagcgcccgagggcccgggtgtcaggtaccataccagctagtagactccatcctgctcctgcctcccagccgggaccttgcccggcccccgggcactgccctgttgggcctgcccatgaacgccccatgggctctagtcaggaggagggactccggtgtcaaccaagtcagcccgatcacgacgcagacggccattgcggccctgacctggaaggagctgaaagagcctccgcaactcccggacctcccggcttgttgaactcacacaggcctgcggattcagacgacactaatgccgcaggcccttcagcagccctgttggagggtttgctgctaggtggggggaagccctcaccccattctaccagacctgggccatttttctacattggaggctctaatggcgctaccatcattagctcctattgcaagtccaagggctggcagcgaatccacgactctcgtcgagatgattacactctcaaatggtgcgaggtcaaaagcagggacagctatggcagtttcagggagggcgaacagctgctgtaccaattacccaataacaaactcttgaccactaagattggtcttctctcaacattgagaggcagagcgcgggctatgtcaaaagcttctaaagtccccggtggagtgcaagcccgcctcgaaaaagatgcagccgcacccgccctcgaggacctgccttggaccagcccgggctatctaaggccccagagggtgctccgcatggaagagtttttcccggagacctatagactagacctcaagcacgagcgggaagctttctttacactgtttgatgagacccagatatggatatgcaagcccactgccagcaaccagggaaaagggatattcttgctgcggaaccaggaggaagttgcagctctccaggcaaaaacacggtccatggaagatgatcctatacaccacaaaacgccctttcggggcccacaggcccgcgtcgtgcagcgctacatacagaatccactgttggttgacggccgcaaattcgacgtccgcagctacttgctcatagcctgtacaacaccttatatgattttttttgggcacggttatgcacgcctcaccctttctctctatgacccacacagctctgacttgggcggtcacctgacgaatcaattcatgcagaaaaaatcacctttatatatgctgctgaaagaacatacagtgtggtctatggagcatctgaaccggtacatcagtgataccttttggaaggccagaggactcgcaaaagattgggtctttaccaccctcaaaaagagaatgcagcagatcatggcacactgctttctggcggccaagccaaagttggattgtaagctgggctacttcgatctgatcgggtgtgacttcctcattgatgataatttcaaagtgtggctacttgaaatgaactcgaatcccgcgttgcatacgaattgcgaggtcctgaaggaggtcattcccggcgtcgtcatagagacactcgatttggtccttgagacattcaggaagtcattgaggggacagaagatgctgccactgttgagccagaggaggttcgtgctcttgcacaacggcgaggctgatccccgcccccacttaggtggttcctgtagtttgaggaggtggccacccctccccacaaggcaggccaaaagctcagggcctccaatgccgcatgctcccgatcaacccggagcccgccgacctgcccctcctccactcgtacctcagcgacctcggcctcctggccctgacctggatagcgcacacgacggagaaccccaagcccccgggaccgaacagtctggcacaggaaataggcaccccgcccaggagccatccccaggaacagctaaggaagagcgcgaagaacctgagaatgctcgaccctag

SEQ ID NO: 24654 - DNA, 393 bp, Artificial Sequence
  Description of Artificial Sequence: Synthetic coding sequence
atgaccgaggacagccagcggaacttccggagcgtgtactacgagaaagtcgggtttaggggcgtggaagagaaaaaatccctagaaatactgctaaaagacgataggcttgataccgaaaagctgtgcaccttctctcagagatttcccttaccatccatgtacagggcgttggtgtggaaagttctgctggggattttgccaccacaccacgagagtcacgcaaaagtgatgatgtatcgaaaagagcaatacctggacgtactccatgccctgaaggtcgttaggtttgtctctgacgcaaccccgcaggcagaagtgtatctccgcatgtaccagctggagtcagggaagttgcccaggagcccaagctttccattagaaccagactag

SEQ ID NO: 24655 - DNA, 882 bp, Artificial Sequence
  Description of Artificial Sequence: Synthetic coding sequence
atgaccgaggacagccagcggaacttccggagcgtgtactacgagaaggtgggattccgaggggtcgaagaaaagaagagcctagaaattcttcttaaagacgatcgccttgatactgaaaagttgtgtaccttctctcaaagattccctcttccttccatgtacagggccctggtatggaaagtgcttctgggtattctccccccacatcacgagagtcatgcaaaggtcatgatgtataggaaggagcaatacttagatgtattgcatgccttaaaggtggtcaggttcgtcagcgatgctacccctcaggcagaagtgtatttgcgcatgtaccagctcgagagcgggaagcttccccggagtccgtcctttccactagagcctgatgacgaggtcttcctggccatcgccaaagccatggaggagatggtggaggatagcgtagattgttactggattacacggcgattcgtaaatcaactgaacaccaaataccgggactctcttccacagttgccaaaggctttcgaacagtatcttaatcttgaggacgggaggttgctaacccacttgaggatgtgctcagccgcgccaaaattgccatatgacctttggtttaaacgatgcttcgcgggttgtctccctgaatctagcctacagagagtgtgggacaaggtagtcagtggatcttgtaaaattctggtgtttgtcgccgtggagatccttctgacatttaaaattaaagttatggccttgaatagcgccgagaaaatcacaaaattcctggaaaacatcccccaggacagctccgacgccatcgtaagcaaagccattgacttgtggcacaaacattgcggtactcctgttcactcttcctag

SEQ ID NO: 24656 - DNA, 801 bp, Artificial Sequence
  Description of Artificial Sequence: Synthetic coding sequence
atgaccgaggacagccagcggaacttccggagcgtgtactacgagaaagtggggtttcgcggagtggaggagaagaaatccctggaaatattactgaaggatgacagattgggaatactccctccccaccacgaaagccatgccaaggttatgatgtatagaaaagagcagtacctggacgtcctccacgctttgaaggtagtcaggttcgtgtctgacgcaacgcctcaggccgaggtttatctgagaatgtatcaacttgagagcggcaagttacctagatctcccagtttcccattggagcccgatgacgaggtgtttttggccatcgccaaagccatggaagagatggtggaggactcagtcgattgttactggatcacgcggcgcttcgtgaatcaactgaacacaaagtaccgggattcactgcctcagctgcccaaagctttcgagcagtatctgaacctagaggatgggcgcctacttacacacctgcgtatgtgcagcgcagccccaaagctaccatacgatctgtggtttaaaaggtgctttgccggatgccttccagagtcaagtcttcaacgcgtgtgggacaaagtagtctcaggcagctgcaagattctggtgtttgtagccgtagaaattctcctcactttcaaaataaaagtaatggcgttgaattccgctgagaaaattacaaagtttctcgagaacattcctcaggactcttccgatgcgattgtgagcaaggccatcgacctttggcataagcactgtggcactcccgttcatagctcttag

SEQ ID NO: 24657 - DNA, 3672 bp, Artificial Sequence
  Description of Artificial Sequence: Synthetic coding sequence
atgatgagcctgagcgtgcggccccagcggcggctgctgagcgccagagtcaatcgttcacagagcttcgcgggagtgctaggctctcacgaaaggggaccgtcactcagtttccgctcttttcctgtgtttagcccacctggtcctccgcgaaaaccgcctgctttatcgcgggtgtcacggatgttttcagtggcgcaccccgcagccaaggtgcctcagcctgaacggcttgatctcgtgtacacagccctgaaacgcggattgaccgcatatctcgaggtacaccaacaggagcaagagaagctccaggggcaaatccgggaatccaaacggaacagcagactcgggtttctgtatgatctggataagcaggtcaaatctattgagaggtttctaagacgcctggagtttcatgccagtaaaatcgatgaattgtacgaggcgtactgcgttcagaggcgactgcgagatggtgcgtataacatggtgagagcctacactacagggtctccagggtctcgcgaagcccgagactcactggcagaagccacccgggggcaccgcgagtataccgagtctatgtgccttctggaaagcgaattagaggcgcaactgggggaattccatctgcgcatgaagggactcgccggcttcgcccgcttgtgtgtgggggaccaatacgagatctgtatgaagtacggccgccagagatggaaattacggggccgcattgagggaagcggcaaacaagtctgggatagtgaagaaacaatcttcttgcccctgctgaccgaatttctgtctataaaagtcacagaactaaagggactggctaaccacgttgtagtcggctctgtgagttgtgaaactaaagatctgttcgctgcattgccacaggttgttgcagtcgatatcaacgatttagggactattaaactaagccttgaggtgacatggtcccccttcgataaagacgatcagcccagtgctgcctcctccgtgaataaggcctctaccgtgacgaagagattctcaacgtactcgcagtctccacctgatacgccatcactccgcgagcaggcattctacaacatgctgagacggcaggaggagttagaaaacggtacagcttggtccctgagtagtgagtcgtcggatgattcatcctcccctcagttgagcggtactgcacgccatagtcccgccccccgaccacttgttcagcaaccagaacctctccccatccaagtggcgtttcgacgcccggagactccctcgagtggccccctcgacgaggagggcgctgtggctcctgttctcgccaatgggcatgcaccatattcccggactctgagccacatctccgaggcatctgtagacgcagcgctggccgaagcttctgttgaagcagtcggacccgagtccctcgcgtggggaccgtctccgcctacacatcctgctcccacccacggtgagcatccctccccagtcccgccagctctggatccaggtcatagcgccacatcctccaccctggggactactggctcagtacctacctcaacggatccggccccatcggcacatcttgacagtgtccataagagcactgactctggtccatccgaacttccagggcctacccatacaaccactggaagcacatattcagctatcaccacaacccactccgctccttcgcccttaacccacacgacgacaggaagtacccacaagccaataatctccaccctcacaacaaccggtcccacactgaacattattggtcccgtgcagacaactactagccctactcatacaatgccatcccccactcacaccactgcttcccccacccatacatccacatctcccacacacactccaacctccccgacacacaagacctccatgagtccgcctaccacaacaagtcctaccccctctgggatgggattagtccagactgctactagccctactcaccccaccaccagtccaacacaccctacgacttctcccattctgattaacgttagccccagcacctccttagagttggcaacgctgtcgtcccctagcaaacactcagacccaactctgccaggtacagattccttaccttgttcccctccagtgtccaattcctacacccaggccgatcccatggcccctagaacacctcatccctcgccggcccattcatcgagaaaacccctgacaagcccagcccctgatcctagtgaatccaccgtacaaagcctctcacctactccttcccctcctacaccggctccccagcacagcgatctgtgcctggcaatggctgtccaaacaccagtgcccaccgcagccggtggaagcggagatcggtcccttgaggaagcccttggtgccctgatggccgccctggacgactatcgcggccaatttcccgagctgcaggggcttgagcaggaggtgacgagacttgagagccttcttatgcaacgacagggactgaccaggtcaagggcgagttctctcagtatcacggtcgagcacgcactggaaagtttctcttttctgaatgaggatgaggacgaggacaatgacgtcccaggtgatcggcctccctcttctcctgaggccggagccgaggacagcatcgatagcccatccgcacggcccctgtcaaccggctgcccagctcttgacgcagccctcgtgcgacacttataccactgcagccgcctattactcaagctcgggacgttcggaccactgcgatgtcaagaggcctgggcactggagcggcttttacgtgaggcaagggtcttagaagccgtatgcgagttttctcggcggtgggagatccctgcctcgagcgcccaggaggtggtacagtttagtgcatcccggccagggttcctgaccttttgggatcagtgcacagaacggctttcttgctttctgtgtcctgtcgagagggttttgcttactttttgtaaccaatacggagcccgactgtctctccgacagcccggcttagccgaagccgtgtgtgttaaatttctcgaagatgcgcttgggcagaagctgccaaggcgcccccaacccggacccggagaacagctaaccgtctttcagttctggtcctttgtcgagaccctggactctccaacaatggaagcatacgtaacagagaccgccgaagaagtcttactggtgagaaacctcaattcggacgatcaggccgtggttttgaaagcactccggctcgccccagagggacgccttcggcgagacgggttacgtgcactttcatctctactcgtgcacggaaacaacaaggtcatggctgctgtctccacccaattgcgaagtctaagcctgggaccaacgttccgagagcgcgcgctcctatgcttcctggatcaactggaagacgaggatgtgcagacaagagtcgctggttgcctggcacttgggtgcatcaaagccccagagggaattgagccccttgtttatctgtgtcaaaccgacacggaggcggttcgggaggctgcgcgacaatctctgcagcagtgcggagaagaaggacaatcggcccaccgccggctggaggaatctctggatgccctcccgaggattttcggccctggatctatggccagcacagcattttag

SEQ ID NO: 24658 - DNA, 123 bp, Artificial Sequence
  Description of Artificial Sequence: Synthetic coding sequence
atggccgacgaggagctggaggccctgcggcggcagcggctggccgagttgcaggctaaacatggtgaccccggtgatgctgcccaacaagaagcaaaacattcatccacggaggaaaaatag

SEQ ID NO: 24659 - DNA, 414 bp, Artificial Sequence
  Description of Artificial Sequence: Synthetic coding sequence
atgaagccccccgccgcccagggcagccccgccgccgccgccgccgcagcacccgcactggacagtgcagccgctgaagatctcagcgacgctctgtgtgaatttgacgcagtactggccgattttgcctctcctttccacgagaggcattttcattacgaagaacatctagagcgaatgaagcggaggtccagtgccagcgtttccgactcttcaggattctccgatagcgagagtgccgattcattatataggaattcattttcattttccgatgaaaagttaaatagccccacagacagtacacccgccctgctttcagcaacagtcacaccccagaaggccaagttgggcgatacaaaggagcttgaagcttttattgcagacctcgataagacattagcaagtatgtag

SEQ ID NO: 24660 - DNA, 1593 bp, Artificial Sequence
  Description of Artificial Sequence: Synthetic coding sequence
atgcccaacgtgctgctgccccccaaggagagcaacctgttcaagcgcatattgaaatgctacgaacagaaacaatacaagaacggactgaagttttgcaaaatgatcctgagtaatccgaagtttgcggagcatggagaaacccttgctatgaaaggcctaaccctcaactgccttggaaagaaagaagaggcatacgagttcgttcgaaagggcctgaggaatgacgtgaaatcccacgtctgctggcatgtgtacggattactgcaaaggagcgataagaagtatgatgaggctatcaaatgttatcggaatgcacttaagcttgataaggacaatctccaaatactaagagatctttctctattgcaaatccaaatgcgagacctggagggatatcgtgagacccgttaccagctgctgcagcttaggcctacccaacgcgccagttggattgggtatgctatcgcttatcatctcctgaaagactacgacatggctctcaagctccttgaggaattccgtcagacccagcaagtaccccccaataaaatcgactatgagtacagcgaattaattttataccagaatcaggtgatgcgggaagccgatcttctccaggagtcactggagcacatcgaaatgtatgagaagcagatctgtgacaagcttctggtagaagagattaaaggggaaattttgctaaaactcggccgcctaaaggaagcgtccgaagtgtttaagaatctcattgaccggaatgctgagaactggtgctactatgagggactcgagaaagcgctgcaaatcagtacccttgaggagcggctccaaatttacgaagagatttccaaacagcatcctaaagcgatcacgcccagaaggctgcctcttaccctggtgccgggagagaggttccgggagctgatggacaaatttctgcgggtgaacttttctaagggctgtccacctctgtttactactctcaaatcgttgtactacaataccgaaaaagtatccatcatccaggagttagttactaactacgaggcctctttgaagacttgtgattttttctctccatacgaaaacggagaaaaagagccacccaccactcttttgtgggttcagtacttcctcgcccagcacttcgataagctaggccaatattcacttgccctggattacatcaacgccgccatcgcctccactcctacactgattgaacttttctacatgaaggctaagatctacaagcacattggcaatctgaaggaggcagcaaagtggatggatgaagctcagtctctcgacacggcggatcgcttcataaactccaagtgcgccaagtacatgctacgcgcgaacatgataaaggaggcagaagagatgtgctctaagtttacacgagagggaacttccgccatggaaaatctcaatgagatgcagtgtatgtggtttcagaccgagtgtatctctgcctatcaaaggctaggtcgctatggtgatgcacttaaaaagtgccatgaagtcgaaaggcactccccttctacatggacaactggcggaaaagagccgcagatgcacccctag

SEQ ID NO: 24661 - DNA, 2595 bp, Artificial Sequence
  Description of Artificial Sequence: Synthetic coding sequence
atgcccaacgtgctgctgccccccaaggagagcaacctgttcaagaggatcctcaaatgttatgaacagaaacagtataagaacggcctgaaattctgtaaaatgatcctgagtaatcccaagtttgcagagcatggagaaacactggcgatgaaagggttgacactgaactgcctgggaaaaaaggaggaggcctatgaattcgtccggaaaggcctacgtaacgacgttaaaagccacgtatgttggcacgtttatggcctgctgcaaagaagcgacaagaagtatgacgaggccatcaaatgctacaggaatgctctcaagctggataaagacaatctgcagatccttcgagatctttccctgctacagatacagatgagggatttagaggggtaccgggagactcggtatcagctgcttcaactgcggccgacccaaagagccagttggattggctatgctatagcctatcatctgctgaaagactacgacatggccctcaagctccttgaagagttcagacagactcagcaggtccccccaaataagattgattacgagtacagcgagctgatcctgtatcagaaccaggtaatgcgcgaggccgacttgctgcaggagtctctcgaacatatcgagatgtacgagaaacagatttgtgacaagctgcttgtggaggaaataaaaggcgagatactgttaaagctcgggaggctcaaagaagctagcgaagtctttaaaaacctcatcgaccgcaatgccgagaactggtgttactacgaagggctggagaaggcactgcagatttcgaccctagaggagagactgcagatctatgaggagatcagcaagcaacatcccaaagccattacacctagaaggctcccactcaccctcgtgccaggggaacggttcagagagcttatggataaatttttaagagtgaatttttccaagggctgccccccattatttaccacgttgaagtctctttactataacacagagaaggtttcaattatccaggaacttgtcaccaactatgaagctagtctgaaaacctgcgatttcttcagcccttacgagaatggtgagaaagagcctcccaccaccctcctgtgggttcagtattttctggcgcaacacttcgacaaactggggcagtacagtctggccctggactacattaatgcggctatcgccagtaccccgacgctgatagaactattttacatgaaggccaaaatatataaacatattgggaatcttaaggaggcagccaaatggatggatgaggcacagagtcttgataccgccgatcggtttatcaatagcaagtgcgcaaagtacatgctgagggccaacatgataaaagaagcagaagagatgtgcagcaagtttacacgagagggcaccagtgccatggaaaacctgaatgagatgcaatgtatgtggttccagaccgagtgtatctctgcctatcagaggctagggaggtatggtgatgcactgaaaaagtgccatgaggttgaacggcacttttttgagataaccgacgatcaattcgattttcacacctactgcatgaggaaaatgacactgagagcctatgtggatctgctacgcttggaggatatccttcgacggcatgcattctacttcaaagccgcccggagcgccatagaaatctacctgaaactctatgacaatcctctgacaaatgaatctaagcagcaagaaattaacagtgaaaaccttagcgccaaggaactcaagaaaatgctgtctaaacaacggcgggcccaaaaaaaggctaagctggaggaggaacggaaacacgccgagagagaacgccagcagaagaatcaaaagaaaaagcgtgacgaggaggaagaagaggcatcaggcctcaaagaagagctgattcctgagaaattggaaagagtggagaatcctcttgaagaagcggtcaagttcctgattccactcaagaatcttgtggccgataatatcgacacccaccttctggccttcgaaatatacttcaggaaagggaagttccttctgatgctgcagtctgttaagcgggccttcgcaattaactctaataacccttggctacatgagtgtttgatcagattcagtaaatctgtatccaatcactcaaatctgcccgacattgtgtccaaagtgttgtcccaggagatgcagaagatattcgtgaaaaaagatctggaatcattcaatgaagattttcttaaaaggaatgctacgtcacttcagcacctgttatctggcgccaaaatgatgtacttcctcgataagtcccgccaggaaaaggctattgctatcgcgacgcgcctcgatgagactatcaaggataaggatgtaaaaacgcttattaaggtcagcgaagctctgctagatggcagcttcggcaattgcagcagtcagtacgaagagtaccggatggcctgccataacctgttgccttttacgagcgcgtttcttcccgccgtgaatgaagttgacaatccaaacgttgccctgaaccacaccgcaaattatgatgtgcttgccaacgaaatctag

SEQ ID NO: 24662 - DNA, 1668 bp, Artificial Sequence
  Description of Artificial Sequence: Synthetic coding sequence
atgcagagctgcgagagcagcggcgacagcgccgacgaccccctgagccgcgggctacgaaggagaggtcagccgcgggtggttgttatcggagcaggcctggccggactggccgccgctaaagcattgctggagcagggctttaccgatgtgaccgtcctagaggcctcatcccatatcggggggcgcgtgcagagtgtgaagttagggcatgcgacttttgaattaggagctacgtggattcatggatcgcacggtaacccaatttaccacctggccgaagccaacggcctcctggaggaaaccaccgatggtgaacgtagtgtgggccgcatcagcctatattccaaaaacggagttgcatgctatctcactaaccatggtagaaggatacccaaggatgtcgttgaagagttcagcgacctgtataatgaggtgtataatctgactcaggaattttttaggcacgataaacctgtgaacgcggaatcccagaacagtgtaggcgtcttcacgcgggaagaggtaagaaatcgaatccgtaacgatccagacgatcccgaggctacgaaaagattaaaactggccatgatccagcagtatcttaaagtggaatcttgcgaatcttctagccactcaatggatgaagtgtcactgagtgctttcggagagtggacagagattccaggagcacaccacatcatcccctctgggtttatgcgcgtggttgagctgctcgccgaagggatcccagcccacgtaattcagctagggaagcctgttcgctgcatccactgggaccaggcatccgctaggccgcgtggtccagagatcgagcccagaggagaaggggaccacaatcatgatactggcgagggtggacagggaggcgaggagcctcgagggggaagatgggacgaagacgaacagtggagcgtggtagtcgagtgcgaagattgcgagctgattcctgcagaccatgtgattgttacggtgtctttaggagtcctcaagcgacagtatacctcattcttccggcccggcctcccaactgaaaaagtggccgccattcacaggctcggcatcggcacaactgacaagattttcttggaatttgaagagcccttctggggacccgagtgcaacagcctgcagttcgtgtgggaagacgaggctgaaagccacaccttgacttacccgccggagctgtggtaccgcaagatctgcggattcgacgtactgtaccccccagaacgatacggacacgtactgtcaggatggatatgtggtgaagaggcactggtgatggaaaagtgcgacgacgaagcggtagcagaaatatgcaccgaaatgctgcgccagtttactggtaaccccaacatccctaagccacggcgtatcctgagatcagcctggggctccaacccttacttccggggttcttattcttatacacaggtgggctccagcggagctgatgtggaaaaattggcaaaaccactgccctatacagagtcctccaagacggcaccaatgcaggtgcttttttccggagaagccacccacaggaaatattatagcactacacacggggcactgctgtcagggcagagggaggcagctcggctcattgaaatgtaccgggatctctttcaacagggcacctag

SEQ ID NO: 24663 - DNA, 630 bp, Artificial Sequence
  Description of Artificial Sequence: Synthetic coding sequence
atggcccccgtgggcgtggagaagaagctgctgctgggccccaacggtccagccgtagccgccgctggagacctgacatcagaagaagaagagggacaatctctgtggagctctatcctgtccgaggtgagcactagggcgagatctaagcttccttccggaaaaaatatactagtgtttggcgaggatggcagcggcaaaactaccctaatgaccaagcttcagggggcggaacacgggaaaaaggggagaggcttggaatatctatacctttctgtccacgacgaggaccgggacgatcacactcggtgcaatgtgtggatactagacggagatttataccataaggggctcctgaaatttgcagtcagcgcagaatccctgccagagacactggtcatctttgtggctgatatgagccgtccctggacagtgatggaaagccttcagaaatgggcctctgtgctgcgagagcatattgataagatgaaaatcccccctgaaaagatgcgcgaactggaacgtaagttcgttaaggactttcaggattatatggagcctgaagaaggatgccaggaggggcccctgagcaaccgcgtcgaacaaatgcgacctcggaatcactggtag

SEQ ID NO: 24664 - DNA, 858 bp, Artificial Sequence
  Description of Artificial Sequence: Synthetic coding sequence
aactggaacctggccagctggaaccccagcaaccccgagtgcctgctgcttgtagtaaaagaattagtgcagcagtaccatcagtttcagtgcagtagactgcgtgaaagctctcggctgatgttcgaataccagacgttactggaggagccccaatacggagagaatatggaaatatacgcgggcaagaagaataactggacaggagagttctccgctagattcctgctcaaactgcctgtggacttcagcaatatccccacctacctcctcaaggatgtgaacgaagatcccggcgaggacgtggcgctgctctctgtttctttcgaggacactgaagcaacacaagtttatccaaaattatatctgagcccccgaatcgagcacgcacttggcgggagcagcgcgcttcatatcccggccttcccaggcggcggttgtctgattgattacgtcccccaagtttgtcacctgctcactaataaagtgcaatacgtgatccaaggttaccacaagaggagggagtatatcgccgcgttcctgagtcactttggcactggtgtagtggagtatgacgccgaaggctttaccaaactcaccctgttgctgatgtggaaggacttctgtttcctggtacacatcgacctaccactcttttttccaagagaccagcccaccctgacgttccagtcagtgtaccacttcaccaactccggccagctttattcacaggcccaaaagaattatccctacagtccccgctgggatgggaacgagatggctaagcgggccaaggcatactttaagaccttcgtgccacaatttcaagaggctgcgttcgccaatggaaaactatag

SEQ ID NO: 24665 - DNA, 1152 bp, Artificial Sequence
  Description of Artificial Sequence: Synthetic coding sequence
atgagccccgaggtggccctgaaccggatcagccccatgctgagccccttcatatccagcgtggtgcggaacggcaaagtaggcctagacgcaacaaattgccttagaattactgatctgaaaagcggctgtactagccttactcccggtccaaattgtgatagatttaagctgcatatcccctacgccggtgagactctgaagtgggatattatatttaatgctcagtatcctgagctgccaccagattttatctttggggaggatgcggaattcctccctgatccatcagcgctgcaaaatttagctagttggaatccctcgaatcccgaatgtttacttctggtagtgaaggagctcgtgcagcagtaccatcaattccagtgctctcgattgcgcgagtcttcccgacttatgttcgaataccagactttattggaagagccgcagtatggcgagaatatggagatatacgcggggaagaagaacaattggaccggcgaatttagcgcccgattcctgctcaagcttccagtggacttttcaaatatccccacctacctcctaaaggatgtcaatgaagaccctggggaagatgtcgcacttttgtctgtaagttttgaagacacggaggcaacccaggtttaccccaaattgtacctgtctccaaggattgaacatgcactgggaggcagcagcgcactgcatatcccggctttcccaggggggggctgcctgattgactatgtgccccaagtgtgccatctgctgacaaataaggtgcagtacgtgatccaggggtaccacaagcggagggagtatatcgcggccttcctttctcacttcgggaccggtgttgtggagtacgacgccgagggctttacaaagttaacactgctcctgatgtggaaagacttctgctttctagtgcacatagacctgcctctgttcttcccacgagatcagccaaccctgaccttccagtcagtgtaccactttaccaactcagggcagctgtatagccaggcacagaaaaattatccatacagccctcgctgggatggtaatgagatggccaagcgggctaaggcatacttcaagacatttgtgccccagtttcaggaggccgcgttcgctaatggcaaactgtag

SEQ ID NO: 24666 - DNA, 1131 bp, Artificial Sequence
  Description of Artificial Sequence: Synthetic coding sequence
atgagccccgaggtggccctgaaccggatcagccccatgctgagcccttttatctcttcagtggtgcgaaacggaaaagtggggcttgatgccacaaactgtcttagaattaccgatttgaagtctggctgcacctcactgactcccgggccgaattgtgataggtttaagctgcacatcccttatgcgggagagaccctcaaatgggacatcattttcaacgcccaatatcctgagctgccgcctgatttcatctttggggaagacgccgagttcctaccagacccgtctgccctgcagaatcttgccagttggaacccatctaaccccgagtgcctgctgctcgtggtgaaagagctcgtgcagcagtaccaccagttccagtgctcccgccttagggagtcgtctcgactgatgttcgaatatcaaactctgttagaggagccacagtacggagaaaatatggaaatctacgccgggaagaaaaacaactggaccggcgagtttagtgcccgctttctcctgaagctaccggtcgacttctcaaacattcctacctatttactcaaggatgtgaatgaggaccccggggaggatgtcgctctactttccgtctccttcgaggatactgaagctacccaggtttacccgaaactctatctctctccaaggatcgaacatgcgctcggcggatcttcagcattacacattcctgcgtttccggggggcggctgcttaattgactacgtaccccaggtgtgtcatctgttgaccaacaaagtgcagtacgtcatccaagggtaccacaagcggcgggagtacatcgctgcattcctgagccatttcggtaccggtgtagtggagtacgacgccgaaggattcacaaaactgacgttgctgttgatgtggaaagacttctgcttcttggtccacatcgacctgccgctattcttcccgcgcgaccagccaaccttgacctttcagtcagtgtaccacttcactaacagtggtcagctctatagtcaggcccagaaaaattacccctattccccgagatgggatggcaatgagatggcaaaacgggccaaacgggaaagtaacagagatggggaagagagcagctccgcctag

SEQ ID NO: 24667 - DNA, 312 bp, Artificial Sequence
  Description of Artificial Sequence: Synthetic coding sequence
atgatccgggccttccccaccaccaccccccggagcctgcacctgttcacatcctccacattcttggccagggcgttgcccggggcatttcccacaggagcgtgcgaagagcgactgtccgtgccggaatcaacgcccttcaccgcggttctgaagtttgccgccgaggagtttaaggttcccgctgctacatcagcgattatcactaatgacgggattggcataaacccagcccagactgcgggcaacgtgtttttgaaacacggtagcgagttgcgaattatccctcgagaccgggtgggctcctgctag

SEQ ID NO: 24668 - DNA, 1968 bp, Artificial Sequence
  Description of Artificial Sequence: Synthetic coding sequence
atggccacccccgtggtgaccaagaccgcctggaagctgcaggagattgtggcccacgccagcaatgtgtcctccttggtgctgggtaaggccagcggcaggctcctggccacgggcggtgacgactgtcgggtgaatctttggtccattaataaaccaaactgtattatgagtctcaccgggcatacctcaccagtagagtccgtgcggctgaacactccagaggagctgattgttgcgggctcccagtctggaagtatccgtgtgtgggacctggaggccgcaaaaatcctgcgcacactgatgggtcataaggccaatatatgctctctggattttcatccgtatggggaatttgtggcctcggggtctcaagacaccaatatcaaactttgggacattaggcgcaaaggctgtgtttttcggtatagagggcacagccaggccgtacggtgtctgaggttcagccccgatgggaagtggctggcctccgcggcagacgatcatacggtgaagctctgggatctcaccgcaggaaaaatgatgtccgaatttcctgggcacactggaccagttaatgtagtcgaattccaccccaatgagtacctgctcgccagcggcagcagcgatcgcaccatccgcttttgggatcttgaaaagttccaggtcgtcagctgcatagaaggcgagcccggccccgtgcggtccgtcttgttcaacccagatgggtgctgcttatattccgggtgtcaggattctctgcgcgtgtatggctgggagcccgagcgatgtttcgacgtcgttctggtcaattggggtaaggtagcagacctggcaatctgcaatgatcaactcatcggagtggcattttctcagtccaacgtgtcgagttatgtcgtggacctgacccgcgtaacaagaaccggcactgtagcacgagatcccgtgcaggatcacagacctctggcacagccgctacccaacccgagtgcgccactgaggagaatatacgaaaggcctagcactacatgttccaagccccagcgggtgaaacagaacagcgagtctgagagacgctcaccaagctccgaggatgaccgagatgagcgggaatccagggcagaaattcaaaacgctgaggattataatgagatctttcaacctaaaaactccatatcccgaacaccgcccagacgctccgaaccatttccggccccacctgaagatgatgcagcaacagctaaagaagccgccaagccatctcctgcaatggacgtccagttccctgtccccaacctggaggttctacctcggccacctgtggttgccagtacacctgctcctaaggctgagccggctataatacctgccacacggaacgagccaattgggttaaaggcctccgacttcctcccagccgtgaaaattccgcagcaagcggaactagtggatgaggacgccatgagtcagataagaaagggacatgataccatgtgtgtggtgttgactagcaggcataagaatttagacacggtgcgggctgtctggacaatgggggacatcaagacctctgtggactcagcagtagccattaacgatctgtctgtagttgtcgacctgcttaatattgtgaatcagaaggcgtccttatggaaactcgacctctgcacaacggtattaccccagatcgagaagttgttgcagagtaaatatgagtcttacgtgcagactggttgtacttcacttaaattgatccttcagcggtttctgcccttaatcacggatatgctggctgccccccccagcgtgggggtggatatttcacgcgaagagaggcttcacaaatgtaggctgtgctacaagcagctgaagtccatcagtgggctggtcaagagcaaaagtggcttgtcgggaaggcacggaagcacgttcagagagctccatcttcttatggcatccttagattag

SEQ ID NO: 24669 - DNA, 165 bp, Artificial Sequence
  Description of Artificial Sequence: Synthetic coding sequence
atgttcctgagcgccgtgttcttcgccaagagcaagagcaacgagaccaaatcgcccttgcgggggaaggagaaaaacactctgcccttaaacggcggtcttaaaatgactctgatctacaaagagaagactgaaggaggcgacaccgatagcgagatcttgtag

SEQ ID NO: 24670 - DNA, 2457 bp, Artificial Sequence
  Description of Artificial Sequence: Synthetic coding sequence
atgaagaagcagttcaaccggatgcggcagctggccaaccagaccgtgggtcgtgctgagaaaactgaggtgctgtcagaggatctgctacaggttgaaaagcggctagagctcgtgaagcaggtgagtcactctacacacaagaagctgactgcctgcttgcaaggacagcagggtgctgaagccgacaaacgttcgaagaaactgcctctgacaacgttagctcaatgtctgatggaaggaagtgccatactaggagatgacacactcctaggaaagatgttgaagctgtgcggcgagacagaagataagctcgcacaagaactgatccattttgagctgcaggtggagagggatgtgattgagccactcttcttactcgcagaagtcgaaatccccaacatccaaaagcagcgaaagcatctcgctaagttggtcctcgatatggactcctctaggactagatggcagcaaacttcaaagagttccggcctgtcttcctcactgcagcctgcaggagccaaggccgatgcattgagagaagagatggaggaggcagcaaatagggtggaaatttgtagagaccaactctcagcagacatgtactcattcgtggcaaaggagatcgattacgccaattactttcagacactgatagaggtccaggctgaatatcatagaaagtccctaacactcctccaagccgtccttccacagataaaggcgcagcaggaagcctgggttgaaaagccatccttcggaaagcccctcgaagaacacctcacaatctccgggagagaaatcgccttccctatcgaggcttgtgtgactatgctgctggaatgcgggatgcaggaggagggcctcttccgagtggcgccttccgcctcgaagctcaaaaagttgaaggcagccttggattgctgtgtcgtagacgttcaggagtatagtgccgatcctcacgctatcgctggggcactcaaaagctacctacgggagctgccagaacccctaatgacatttgagctctacgatgaatggattcaggcctccaacgtccaggaacaggataaaaagttgcaagctctctggaatgcatgcgaaaagctgcctaaagccaaccacaataacatccgctaccttatcaagttcctgagcaagctaagcgagtaccaggacgtgaacaagatgacaccctctaacatggccattgttctggggcccaacttactctggccgcaagcggaaggaaatatcaccgaaatgatgaccaccgtttccctccagatcgtgggcatcatagaacctattatccagcatgcggattggtttttccctggcgagattgaatttaacattactggaaattacgggtctcctgttcacgtgaaccataacgcaaattacagctcaatgcctagtccagacatggaccctgccgataggcggcagccagagcaggctcgacgaccgctaagcgtcgcgactgataacatgatgctggaattctataaaaaggatggcttgaggaagatccagtctatgggcgtccgagttatggatactaactgggttgcaagacgaggtagtagcgccggccggaaggtgagctgcgccccaccatctatgcagccccctgcaccccccgccgagctcgccgctcctctgcccagtcctcttcctgagcagccgttggactctcctgcggcaccagctctgagtcccagcggccttggactgcagcctgggcccgaaaggaccagtacaacaaaatccaaggagctcagcccaggcagcgcccaaaagggctctccggggtcaagccaaggcactgcatgcgcaggaacacagcccggtgcccagccaggcgcgcagcctggcgcctctcccagccctagtcaaccccctgccgaccagagtcctcataccctgcgaaaagtttctaagaagctagctcctataccacccaaggtgcctttcggtcaacctggagcaatggcagaccagtcagccggacagccttctcccgtatctttgtcccccacacctccttcaacgccctcaccatacgggctcagttaccctcagggctattcactagctagtgggcaactgagccctgccgcagctcccccactggcctcgccatccgttttcacaagcacactgtcaaagtctagacctactccgaaacccaggcaaaggccgacactcccccccccccagcccccaacagtgaacctgagcgcatcatcccctcagtcaaccgaggcaccgatgctggatggtatgagccccggggagtctatgagtaccgatttggtgcactttgatatcccttccattcatatcgaactgggcagcactctgcgcctgtctcccctggagcatatgaggaggcacagcgtgacagataagcgcgacagtgaggaggaatccgagtcaactgccctatag

SEQ ID NO: 24671 - DNA, 1014 bp, Artificial Sequence
  Description of Artificial Sequence: Synthetic coding sequence
atgaccaacaacagcggcagcaaggccgagctggtggtgggcggcaagtataaactagtccgtaaaattggctctggctcttttggagacgtttacctcggcatcactactactaatggcgaggacgttgccgtaaaactggagagccagaaggtgaagcacccgcaattgctctatgagtccaaactgtatacaatcctccaaggaggggtaggcatcccccacatgcactggtacgggcaggagaaagacaataatgtgctggtcatggacctgctcggccccagcctcgaggatctcttcaacttctgctctcgtaggtttacgatgaagacagttttgatgctggccgatcagatgatttcccgcattgagtatgtgcacactaagaatttccttcaccgagacataaagcccgataactttctcatgggaacaggtcgtcattgtaacaaactgtttttgattgactttgggttggccaagaagtacagggataaccgcacacgccagcacattccataccgtgaggacaagcacttgattggcaccgtcagatatgcctcaattaatgctcatctggggatagagcaaagtcgtagagacgacatggaaagtctaggctatgtattcatgtatttcaacaggacctctctcccgtggcagggtctccgagccatgactaaaaaacaaaagtatgagaaaatatccgagaagaaaatgagcacacctgtcgaggtcctgtgcaagggatttcccgcagagttcgccatgtacctgaactattgtcggggcctgaggttcgaagaggtgcccgattacatgtatttgcgacagctgtttaggatcctgtttaggacccttaatcaccagtacgattacacatttgattggaccatgttaaagcagaaggcggcgcagcaagcagcctcctcatctgggcagggccaacaggcacagactcagactgggaagcagacagagaaaaataaaaacaacgtaaaggataactag

SEQ ID NO: 24672 - DNA, 1608 bp, Artificial Sequence
  Description of Artificial Sequence: Synthetic coding sequence
atgagcgagggcgagagccagaccgtgctgagcagcggcagcgacccaaaagtggagagctcctcatccgcccctggcttgaccagcgtgtccccccccgtcacatccactacctctgctgcctcacccgaggaggaggaggagtctgaagatgagtcggagattttagaagagtccccctgtggcagatggcaaaagcggagagaggaggtgaatcaacggaacgtcccaggcatagattctgcctacttggcgatggacaccgaagagggagtagaagtggtttggaatgaagtgcagttttccgagcggaagaactacaaacttcaagaggagaaggtgagagctgtgtttgataacctaattcaactggagcacctgaacattgttaaattccataagtattgggctgacattaaagaaaacaaggccagggttatcttcataacagagtacatgagcagcgggtctctgaagcagttcttgaagaaaaccaaaaaaaaccataaaactatgaatgaaaaagcttggaagcggtggtgtacgcagatcctgtcagccctgtcctaccttcactcatgtgatcccccaattatccatggtaatctgacctgtgatacaatattcattcaacataacgggctcattaagatcgggagcgttgcccccgacacaatcaataatcacgtaaagacctgccgtgaggagcagaagaacctccacttcttcgcacccgaatacggcgaggtgaccaacgtgacaacggcggtggacatctattcctttggcatgtgtgcactggaaatggctgtgctcgaaatccaggggaatggcgagtcttcttacgtgccacaggaggcaatttcctctgcgattcaacttctcgaggaccctctgcagagggaattcattcagaagtgtctgcagagcgaaccagctcggagaccaaccgctagggagctgctattccatcccgccctgtttgaggttccctctttgaagctccttgcagctcactgtattgttgggcatcagcacatgatacctgaaaacgcccttgaggaaatcaccaagaatatggatactagtgctgtcctcgctgaaatcccggctggtcctgggagggaacctgtacagacactgtactctcaatctcctgctctggagctagataaatttttagaggatgtccggaatggcatctacccgctgacagcatttggccttccccgcccccagcagccacagcaggaagaagtgaccagccccgtggtgcctccttccgttaagacaccaacccctgagcctgccgaggttgaaaccaggaaggtcgtgctgatgcagtgtaacatcgagagcgtagaagaaggcgtgaagcatcatttgacgctgctcctgaaacttgaggataagttaaacagacacctgtcatgcgaccttatgcctaatgagaacatccctgagctggccgctgaactggtccagctgggattcattagtgaagcggatcagtctcggttgacctccctccttgaggaaacactcaacaaatttaacttcgcacgcaacagtaccttgaactcagcagccgtcaccgtgagcagctag

SEQ ID NO: 24673 - DNA, 2169 bp, Artificial Sequence
  Description of Artificial Sequence: Synthetic coding sequence
atggagaccagcgacatccagatcttctaccaggaggaccccgagtgccaaaatttgagcgaaaatagctgccccccatctgaggtcagtgacacgaacctgtattcgcccttcaagccaagaaactatcagctcgaactcgccctgccagcgatgaaaggcaagaacaccatcatctgcgccccgactggctgcggcaagacattcgtgtcccttctgatctgtgaacaccacctcaagaagttccctcagggccaaaaaggtaaagttgtctttttcgcaaaccagatcccggtctatgaacagcaaaaatccgtgttctccaaatactttgagagacatggctatagggtcactgggatctccggcgcgacagcagagaatgttcccgtagagcagatcgtcgagaacaacgatattattatattaaccccccagatcttggtgaataacctaaagaagggcactattccatcgctgagtatatttaccctcatgattttcgatgagtgtcacaatacttcaaaacagcatccttacaatatgatcatgttcaactacttagaccagaaactcggcggaagtagcggtccactcccccaggttattggcctcactgctagcgtcggggtgggggatgcaaagaatactgatgaagcactagattacatctgcaagttatgcgcctctttagatgcctctgttattgccactgtgaagcacaacctagaagagctcgaacaagttgtgtacaaaccccagaagttcttccgtaaggtagagtctcgcatcagcgacaagttcaagtacatcattgctcagctgatgagagatactgagtcccttgctaagaggatttgtaaagaccttgagaacctctctcagattcagaacagagagttcgggacacagaagtacgagcagtggattgtgacagttcaaaaagcttgtatggtgttccagatgcccgacaaagatgaagagtctagaatttgcaaagctttattcctctacacaagccatctccgcaaatacaatgacgcattaattatcagcgaacacgctcggatgaaggatgccctagattatcttaaagactttttcagtaatgtccgcgccgcagggttcgacgagatcgagcaggacctgacccagagatttgaggagaaacttcaggagctggagtcggtgtcccgggacccatccaatgagaacccgaagctggaagatctgtgcttcatactgcaggaggagtaccacttaaatccagagacaatcacaattctctttgtgaagaccagggcgctggttgacgccttgaagaattggatcgagggtaatcctaagctctctttcctgaaacccggaattctcaccggccggggaaaaaccaatcagaacacaggcatgacacttcctgcccagaagtgcatcttagatgccttcaaagcgagcggggatcacaatatccttatcgcaacctctgtcgctgacgagggaatcgatatcgcacagtgcaacttggttattctttatgaatacgtgggaaatgttatcaagatgattcagacacgcggtaggggtagggctcggggctcaaagtgttttttgttgactagtaatgcaggcgtcattgagaaagaacaaattaatatgtacaaagagaaaatgatgaatgactccatcttacggcttcagacttgggatgaagctgttttccgggaaaaaattctgcatatccagacccacgagaagttcatacgggactcgcaggagaagcctaagccagtgcctgacaaagagaacaaaaagctcctatgcaggaaatgtaaagccctggcttgctacactgcagacgtgagggtgatcgaggaatgccactacacagtgctgggcgatgcttttaaggaatgctttgtctctagaccacatcccaagccaaagcaatttagctcttttgagaagcgcgccaaaatcttctgcgccaggcagaactgttcccatgactgggggatccacgtgaagtacaagacttttgagatcccagttataaagattgagagctttgtggttgaagacattgcgacaggggttcaaacattgtacagcaagtggaaggatttccattttgagaaaatcccctttgacccagcagaaatgagtaaatag

SEQ ID NO: 24674 - DNA, 2643 bp, Artificial Sequence
  Description of Artificial Sequence: Synthetic coding sequence
atgaccaccgagcagcggcggagcctgcaggccttccaggactacatccggaagacactcgatccaacatatatcctcagctacatggcaccttggttcagggagggctattcaggactgtatgaggcgatcgagtcctgggactttaaaaagattgagaagctggaagaataccgcctactgttaaagcgactccagccagaatttaaaacccgcatcatccctacggatattatctccgacttgagcgagtgtcttattaaccaggagtgcgaagaaattttacagatctgtagtaccaagggaatgatggccggagccgagaaactggtggagtgcctgctgagaagtgacaaagagaattggcccaaaactcttaagttggccctggaaaaagagcgcaacaagttcagtgaactctggatagtggagaaaggaattaaggacgtggaaaccgaggacttagaggataagatggagaccagtgatattcagatcttttatcaggaggacccggaatgccaaaatctatctgagaattcatgtccaccttctgaggtgtccgacactaacctctatagcccgtttaaaccccgaaattaccagctggaactcgccctaccagcaatgaagggaaaaaacaccattatatgtgcccccacggggtgtggaaagacctttgtatccctgctgatctgtgaacatcatttaaagaaatttccacagggccaaaagggcaaggtggtgttctttgcgaaccagatccccgtttacgagcagcagaaaagcgtgttcagtaaatactttgagcggcacgggtacagggttactggcattagtggcgccaccgctgagaacgtgcccgtagaacagattgtggagaataacgatattataatacttaccccccaaatcctcgtcaataacctgaaaaagggaaccataccaagtctgtccatattcaccctaatgattttcgatgaatgtcacaacacctcaaaacagcatccgtacaacatgattatgtttaattacctcgatcagaagcttggcgggagctctggccctctgccacaggtgattggcctcacagctagtgtcggcgtgggcgatgcaaagaatacagatgaggccctggattatatctgtaagctatgtgcatccttggatgcctcggtgatagccacagtaaaacataacctcgaggaacttgaacaggtagtttacaagccacagaagtttttccggaaagtcgagagcagaatatcagataagttcaaatatataattgcacagctgatgagagacacagagagcctcgccaaacgcatctgcaaagatctcgaaaacctgtcacagattcagaaccgggagttcggcacacaaaaatatgagcagtggatcgtcaccgtgcaaaaggcttgcatggtgtttcagatgccagataaggacgaggaatcacgaatctgtaaggcccttttcctgtacacatcacacctgcgcaaatacaatgacgccctgattatcagcgagcatgcgaggatgaaggacgcactggactacctaaaagacttcttctccaacgtcagggccgctggcttcgacgagatcgagcaggatctgacacagcggttcgaggagaaactacaggaattagaatcggtgagccgtgacccatcaaatgagaatcctaaactcgaagacctctgttttatcctccaggaagagtaccatctgaacccggagacaatcacgattctctttgtcaagacccgcgcgctggtcgatgctctcaaaaactggatcgaaggcaaccctaagctgtcattcctgaaaccaggcatcctaactgggcggggaaaaacaaaccagaatacaggcatgacgctgcccgcgcaaaagtgtatcctcgatgctttcaaggcgagcggtgatcacaatattttaatcgccacctccgtggccgatgagggtatcgacatagcccagtgcaatcttgtgattctgtacgagtatgttgggaacgtgattaagatgatacagacaagaggcaggggcagagcgagaggcagcaaatgtttcctcttaactagcaacgcgggcgtgatcgaaaaggaacaaataaacatgtataaggagaagatgatgaatgattccatactacgcctccaaacttgggacgaagccgtatttcgtgagaagatcttgcacatacaaacccacgagaaatttattcgtgacagtcaagaaaaacccaagccagttccggataaagaaaataagaaacttctctgccgcaaatgcaaggcactagcttgctatacagcggacgttagggtgatcgaagaatgccactacaccgtgcttggagatgcattcaaggaatgctttgtcagtagaccccatccaaagccaaagcaatttagttcctttgagaagagagcaaagattttctgcgcacgccagaattgctcacatgactggggtatccacgttaagtataagaccttcgaaatacctgttataaaaatcgagagttttgtggtggaagacatcgccacaggggtgcaaaccttatactctaaatggaaagactttcactttgaaaaaatccccttcgacccagctgagatgtcaaaatag

SEQ ID NO: 24675 - DNA, 2778 bp, Artificial Sequence
  Description of Artificial Sequence: Synthetic coding sequence
atgaccaccgagcagcggcggagcctgcaggccttccaggactacattaggaagacattggaccctacctacattttgtcatatatggcaccgtggtttcgggaggaggaagtacaatacatccaagctgagaagaataataaaggacccatggaggccgccacactcttcttaaaattcctgctcgaattgcaggaggaaggatggtttcgaggttttctggatgcgctcgatcatgctggctattcaggcctgtatgaagccattgaaagctgggatttcaaaaaaatagagaaactagaggagtataggctactgcttaagcgcctgcagcccgaatttaaaacaagaataattccgacagacattatcagcgatctgagcgagtgcctgattaaccaggaatgcgaggagatccttcagatttgctcaacgaagggtatgatggcaggcgccgagaaactagtggaatgcctcctccgctcggacaaagaaaattggcctaaaacactaaaactcgccttagaaaaagagaggaacaagttttcagagctctggattgtggaaaagggcattaaggatgtcgagacggaggatttagaagataagatggagactagtgacattcagatcttctaccaagaagatccagaatgccaaaacctcagtgaaaattcatgtccaccatcggaagtgagtgatactaatttgtacagcccatttaagcctcggaactatcaactcgagttagctctgccagccatgaagggtaagaatacgatcatatgcgcacctacagggtgtggaaagacgttcgtttcccttttgatatgtgagcaccacctgaaaaagttcccgcagggccaaaaggggaaggtggtattctttgcaaaccaaatacccgtgtacgagcagcagaaatctgtgttctcaaagtattttgagagacatgggtaccgggttacaggcatttctggggctaccgccgagaacgtaccagttgagcagattgtcgagaacaacgacatcatcatactcacaccacaaatcctggtaaacaacctcaagaagggaacaattccctcactaagcatctttacactcatgattttcgacgagtgtcacaatacttccaaacagcacccttacaatatgatcatgtttaactacctagaccagaaattgggaggctcttctggcccactcccccaagtgattgggctgactgcaagtgtgggggtgggtgacgccaagaacaccgacgaagctctggattatatatgcaaactctgtgcctctctggatgccagcgtgatcgccactgtaaagcataatctcgaggaactggagcaggtcgtgtataagcctcagaaatttttcaggaaggtggaatcacgaataagcgacaagttcaagtacatcatcgcccagttgatgcgcgacactgagagcctcgcaaagcggatctgcaaggatttggaaaacctttcccagatacaaaatagagagttcggaactcagaagtacgaacagtggattgtaaccgtgcagaaagcctgcatggtctttcagatgccagacaaggatgaagagtcaagaatttgcaaagccttgttcctttatacatcacacctacgaaaatacaacgatgccctaatcatcagtgaacacgcgaggatgaaagacgcattggattacctcaaggacttcttctctaatgtcagagcagctggattcgacgaaattgagcaggatctgacacagcgttttgaggagaagctacaggaacttgagtcagtgagcagggatcctagtaacgagaatccaaagttggaggacctatgctttatcctccaagaggagtatcacctgaacccagaaaccataacaatacttttcgtcaagactagagccctcgtagatgcactgaagaactggattgagggtaacccaaagctgtctttccttaaacccggtattctgaccggacggggtaagaccaaccagaacacgggaatgaccctccctgcccagaaatgcatccttgacgctttcaaagcatctggggaccataatatattaatagcgaccagcgtcgcagacgaagggattgatatcgctcaatgtaacctcgttatactgtatgagtatgtcggaaatgtaatcaaaatgatccagacgaggggcagaggaagagcccgggggtctaaatgctttctactcacctccaatgctggtgtgatcgagaaagagcagatcaatatgtacaaggagaagatgatgaatgatagcattttgaggctccagacctgggatgaggccgtatttagggaaaaaatactgcatattcaaacccatgagaaattcattagagacagtcaggagaaacccaaacccgtgcccgataaggagaataaaaagctgctatgtcggaaatgtaaagcgctggcctgctacaccgccgatgtccgggtgatagaggagtgccattacacagttttgggagatgcttttaaagaatgctttgtgtctcggccacaccccaagcccaagcagttttcttcttttgagaagagagcaaagatcttttgcgccaggcaaaactgctcccatgactggggtattcacgtcaaatataaaacttttgaaatccctgttattaaaattgagtccttcgtggttgaagacattgctaccggagtgcagacattatattcaaagtggaaagacttccacttcgagaagatccccttcgatccagcagagatgtccaagtag

SEQ ID NO: 24676 - DNA, 987 bp, Artificial Sequence
  Description of Artificial Sequence: Synthetic coding sequence
atggacggcgaggacatccccgacttcagcagcctgaaggaggagacagcatactggaaggagctctcactcaagtacaaacagtccttccaagaggcgagggacgagctggtagaatttcaagaaggctcccgagagctcgaagctgaactagaagctcagctcgtgcaggccgagcagaggaaccgggaccttcaggcagacaaccaaaggctcaaatatgaggtggaggccctcaaagagaaattggagcaccaatacgcccagtcttataaacaggtaagcgttttagaggatgaccttagtcagactcgtgctatcaaggagcaactccacaaatacgtccgggagctggagcaggctaacgacgatctggaacgggctaagcgcgcgaccatagtgagtctcgaggacttcgaacagagactgaaccaagctatcgaacgcaacgccttcttagaaagcgagttagacgagaaagagagcctcctcgtgtccgtgcagcgactgaaggacgaggcgcgagatcttcgacaggagctggcagtgagggagagacagcaggaagtgaccaggaaatcagccccatccagcccaacattggactgtgagaagatggacagtgcggtccaggccagccttagcctgcccgctacccctgttgggaagggcactgagaataccttccctagccccaaggctataccaaacggtttcgggacaagcccacttacaccttctgcccgaatctctgccctcaacatagtcggcgacttgctgcggaaggttggggccctggaatctaaactggccgcgtgccggaactttgccaaggatcaggcatcccggaagtcgtacatcagcgggaatgtaaattgcggggtgctcaatggaaatggtactaaattttcaagaagcggacacacgtcctttttcgacaaaggacaggaaaaggtcatctttcccactctgttcatgggacagtag

SEQ ID NO: 24677 - DNA, 2898 bp, Artificial Sequence
  Description of Artificial Sequence: Synthetic coding sequence
atggccctgctgtgcggcctgggccaggtgaccctgcggatctgggtgagtctccctagccaatctgaaaatggcattggttttttggcggcccgcgctttccttaggagcggaggcatggaagccctgaccacccagcttggacccggcagggaaggctcatcctctccaaacagcaaacaggaattacagccatatagtgggtcttccgccttgaagcctaatcaggtgggggaaacctccctctacggggttccaattgttagtttggttattgatgggcaggagcggctgtgtcttgcacaaatcagcaacacgctgctgaagaattattcctataatgagatacacaatcggagggtggcactaggcataacttgcgtgcagtgcactcctgtacagctggagattcttagaagggccggggctatgcctatttccagccgaagatgcggtatgatcacgaaacgggaagcagagcgcctctgcaaatcttttctgggagagcacaaacctcccaaactgccggagaattttgccttcgatgttgtgcacgaatgcgcttggggaagcagaggcagcttcatccctgccaggtacaattccagtcgtgccaagtgtattaaatgtgggtactgctctatgtatttcagtcccaataagttcatcttccacagtcacaggactcctgatgcaaaatacacccagcccgacgcggcaaattttaatagctggcgccggcacctgaagctgagtgacaaatccgccactgatgaactgtcacatgcatgggaggacgtgaaagccatgttcaacggcggcacaaggaaacgcacattttccctgcaagggggaggcggagggggggcaaatgggggaagcggggggcaagggaagggcggagccggcggggggggcggcggggggccagggtgtggcgcagagatggcacctggaccccccccacataagagcctccgttgtggcgaggatgaagctgccggaccgccaggaccacctcctcctcatccacaacgagggttaggactcgctactggagcgtccggtcctgcgggccctggtggaccggggggcggagcaggtgtgcggtcatatcccgttatacctgtccctagcaaaggctttgggctcctccagaagctgcccccaccgctttttcctcatccctatggcttccccaccgcattcgggctttgccctaaaaaggatgatccggtactgggcgcaggcgaaccgaagggtggtcccggaacaggctcaggtggggggggagcagggaccggtggtggggccggaggaccaggagcatcgcaccttccaccaggcgcaggggccggacccggcggaggggcaatgttttggggtcatcaacccagtggtgccgccaaagatgcagccgccgtggccgccgccgcagccgctgcgaccgtatatcctactttccccatgttttggcccgcggccgggtctttaccagtgcctagctatcccgccgcacaaagtcaggcgaaagctgtggccgctgcagtagccgctgcagcagcggcggcagccgctgccgctgggagcggcgcgcccgagcctttggatggcgcggaaccggccaaagagtccggcttgggagccgaggagcggtgtccctccgccctttcacgtgggccacttgacgaggacggaacagatgaggccttacctccgcccctcgcaccactaccccccccacccccacctccagctaggaaaggcagctatgtcagtgcctttcgcccggtcgtgaaggatactgagtctattgccaaattgtacggatccgcccgggaggcttatggggccggccccgctcgtggcccaggtcctggagccggctcaggagggtacgtatcccctgacttcctatctgaaggctcctcaagttataactccgccagccccgatgttgataccgcagacgaaccagaagttgacgtagagagcaataggttccctgatgacgaggatgcgcaagaggagacagaaccatcggcacccagcgccggaggcggacccgacggcgagcaacccaccgggccgccatcagccacgtcatccggagcagacggtcctgctaactctccggacggcggatccccacgcccccggagaagacttggacccccgcccgccggacgaccagcctttggtgacttggctgcggaggatctcgtgaggcgccccgaacgctccccgccgtcgggcggggggggctatgaattgcgcgagccatgtggccccttaggaggcccagcgccagccaaagtgtttgctcccgagcgagacgaacatgtcaagagcgcggctgtggccttgggaccagcggcctcctacgtgtgtaccccagaagctcacgagcctgataaggaagataatcactcccctgccgacgatctggaaactaggaaatcctaccccgatcagagaagcattagtcagccctcccccgccaataccgaccgaggagaggatggcctcaccctggacgtcacaggcactcatctggtcgagaaagacatcgagaatttggcccgggaagagctgcagaaactactgctggagcagatggagctgcgcaagaagctggaacgagagtttcagtccctgaaggacaattttcaggaccagatgaaacgtgaactggcctatcgcgaggagatggtgcaacagttgcagatcgttagagatacactctgtaatgagctggaccaagaacggaaagcaaggtatgctatccaacaaaagctcaaggaggcccacgacgctctccaccatttcagttgtaaaatgttgactccaagacactgtacagggaattgctcattcaagccgcccctcctgccttag

SEQ ID NO: 24678 - DNA, 1803 bp, Artificial Sequence
  Description of Artificial Sequence: Synthetic coding sequence
atggccagcaaccacaagagcagcgccgcccggcccgtgagccggggcggcgtaggtctgacaggcaggcccccgtccggaatccggcccctgtccggaaatatccgggtcgctacagccatgcccccaggtactgctagaccgggctctagaggctgccctataggcaccggtggggttcttagtagccaaattaaagtggcacaccgcccagtaacccaacaaggattaactggtatgaagaccggcactaaaggccctcagcgccagatactggataaatcctattacctgggcttgctccgatccaaaatctccgagttaactacagaagtgaataaactccagaagggcatcgagatgtacaaccaagagaactccgtttacctctcctacgagaaacgggcagaaacactcgctgttgagattaaggaattgcagggacagctagccgactacaacatgctcgtggataaactgaacaccaacactgaaatggaggaggtcatgaacgactacaatatgctcaaggctcagaacgatagggaaactcagagtctggacgtgattttcacagaacgccaagctaaggagaaacagattcgcagcgtagaggaggagatcgaacaggaaaaacaagcaacagacgacatcatcaaaaacatgagttttgagaaccaggttaaatacctggaaatgaaaacaactaacgagaaactcctgcaagaactggataccttgcagcaacagttggactctcagaacatgaagaaagaatctctggaggccgaaattgctcattcacaggtcaaacaggaggccgtcctcctgcacgaaaagttatatgagcttgagtcccatcgcgatcagatgatcgccgaagacaagtcaattggctcacctatggaggaaagggagaaattgctgaagcagattaaggacgacaaccaggaaattgctagcatggagagacagctcacagatacaaaagaaaaaattaatcagtttatcgaggaaatcaggcagcttgatatggatctggaggagcatcagggggagatgaaccagaagtataaagaactcaaaaagcgtgaggaacatatggacacattcattgagacctttgaggagacaaaaaaccaggaactaaagcgtaaggcccagattgaggctaacatcgtggcactgctggagcattgttctagaaacatcaacaggatcgaacagatctcgagtatcacaaaccaggaactgaagatgatgcaagacgacctgaacttcaagtccaccgaggtacaaaagagccaaagcaccgcccaaaacctgacatccgatatacagcgccttcagctggacctccagaaaatggagttacttgaaagcaagatgaccgaagagcagcattcgctgaaatccaagattaagcaaatgacgaccgacctcgaaatctacaacgatctgccggctctgaagagttccggcgaggaaaaaatcaagaagctgcaccaggagcgaatgatactgtccacacaccgcaacgcctttaaaaagataatggaaaagcagaacatcgaatatgaggctctgaaaacccagttacaggagaacgaaacacactcccagctcaccaaccttgagaggaagtggcagcacctcgagcagaataattttgccatgaaggagtttattgcaacgaagagccaagagagcgattaccagccaatcaagaaaaatgtgacaaaacagatcgcagagtacaataaaaccattgtggatgccctccactctacaagcgggaactag

SEQ ID NO: 24679 - DNA, 582 bp, Artificial Sequence
  Description of Artificial Sequence: Synthetic coding sequence
atgctggtggccggcaacgaccgggtgcaggccgtgatcacccagatggaggaggtctgtcaaaccatagaggacaattctcgtcgccaaaaacagcttctgaatcaacgatttgaatccctgtgcgccgtgctcgaggaacggaaaggagagctcctccaggcactggccagggagcaagaggagaagcttcagagagtccgcggcctgattaggcagtacggggatcatctagaggctagtagtaagctggttgaatccgcaattcagtctatggaagaaccacagatggccttgtacctgcagcaagccaaagaattaatcaacaaagtaggcgcaatgagcaaagtggaactcgcgggtcggcccgaacccggctacgagtccatggagcaattcacggtacgggttgagcatgtggccgagatgctgagaaccattgacttccagccaggcgcctctggtgaggaggaggaggtggcccccgatggagaggaaggatctgcagggcctgaagaggagaggcccgacggccctctcggaccttacagtgcctacgtgtcgttgtgcggtgccccctag

SEQ ID NO: 24680 - DNA, 1077 bp, Artificial Sequence
  Description of Artificial Sequence: Synthetic coding sequence
atgaacttcaccgtgggcttcaagcccctgctgggcgacgcccacagcatggataacttggaaaagcaactgatttgtcctatatgtctcgaaatgttctcgaagccagtcgtcatcctcccctgccagcacaacctttgtagaaaatgcgccaacgacgtcttccaggcctcaaaccccctgtggcagtcaagggggtctacaaccgtcagttcaggtggccgattccggtgtccttcctgtaggcatgaagtcgtacttgacaggcatggagtttacggtttgcagcgcaatctcttggtcgaaaacattatcgatatatacaaacaggaatctagccgccccttgcactcgaaggcggagcagcacctgatgtgtgaagagcatgaggaagaaaaaataaacatctactgcctgagctgtgaggtccctacttgctccctttgtaaagtgttcggcgcacacaaagactgcgaggtagctcccctgcccaccatatacaaaagacagaaaagtgaacttagtgacggaatcgctatgcttgtcgccgggaacgatcgggtccaggccgtgattacccaaatggaagaagtgtgccagacgatcgaagataattcgcgaaggcagaagcagctgctgaaccagcgatttgagtctctctgtgccgtgcttgaggagagaaagggagagctcctgcaggccctggcaagggagcaggaagagaaacttcaacgagtccgcggactcatccgacagtacggagaccacttagaggcttcaagcaagctcgtggagtcggcaatacagtctatggaagagccccagatggcattatacttgcagcaggctaaggaactaatcaataaggtcggtgctatgtcaaaagtggagctcgctggccgacctgagcccggatatgagtcgatggaacaattcacagtcagagtcgaacacgtggccgagatgttgcggacaatcgatttccagcccggcgccagcggcgaggaagaggaagtcgcaccggatggggaagaggggtccgccggacccgaggaggaacggccggacggcccgtag

SEQ ID NO: 24681 - DNA, 756 bp, Artificial Sequence
  Description of Artificial Sequence: Synthetic coding sequence
atggccgccagcaccatgagcatctgcagcagcgcctgcaccgacagctggagggtcgtggactgccccgaaagctgctgtgagccgtgctgttgcgcccccgcccctagtctgacgctggtgtgcacgcccgtgtcctgcgtgagtagtccttgttgccagacagcctgtgagccatcagcatgtcagtcgggatacacatcaagctgtactaccccctgctatcagcagagctcctgtcagcccgactgttgcacatcaagcccttgtcagcaggcttgttgcgtcccagtgtgctgtgtgccggtatgttgcgtcccggtttgcaacaagcccgtttgttttgtccccacctgctctgaatcgtctcctagctgctgccagcagagctcctgtcagccaacatgttgcacatcctcaccttgccagcaggcctgttgcgttcccgtctgcagcaaaagcgtatgttatgtgcccgtctgtagcggcgccagtactagttgttgtcagcagagcagctgccagcctgcttgttgcactgcctcgtgttgccggcctagttccagtgtgtcattattgtgccaccccgtgtgtaaatccacttgttgcgtgccagtccccagttgcggtgcctccgcttcttcctgtcaaccctcttgctgcagaaccgcctcttgcgtgtctcttctgtgtaggcccgtttgctccagaccggcatgctactcgctgtgtagcggacagaagagtagctgttag

SEQ ID NO: 24682 - DNA, 1128 bp, Artificial Sequence
  Description of Artificial Sequence: Synthetic coding sequence
atggccgccagcaccatgagcgtgtgcagcagcgacctgagctacgggtctagggtgtgcctgccaggttcctgtgactcgtgttcagacagttggcaggtcgacgattgtcctgaaagttgctgtgagcctccttgctgcgccccctcttgttgcgcgcctgctccttgcctaagtctcgtctgcacaccagtgtccagagtatccagcccctgctgtcctgtgacatgtgagccctcaccctgtcagagtggttgcacatcctcttgcaccccttcttgttgccagcagagctcttgtcagcttgcctgttgcgcaagctctccttgtcaacaggcctgttgtatgccggtgtgctgcaagacagtgtgctgtaaaccagtttactgtgttcctgtatgttcaggagacagctcttgctgtcagcaaagctcctgccaatcggcctgctgcacctcatcaccttgtcagcaggcctgttgcgtgcccatatgctgtaaacccgtgtgctccgggatctctagctcgtgttgccagcagtcttcttgcgtaagttgtgtcagcagcccatgttgtcaggccgtgtgcgagccaagtccttgtcagtcgggatgcatttcgagctgtactcctagctgctgccagcagagcagctgccagcccgcctgttgcaccagctcaccctgtcagcaggcctgttgtgtgccggtgtgctgcaagccagtgtgctgcgtgccaacttgcagcgacgacagtggcagctgttgccagcccgcctgctgcactagctcccaatcccaacaaggatgttgtgtgccggtgtgttgcaagcctgtgtgttgcgtgccggtttgttccggcgctagttcctcttgttgtcagcaaagttcatgtcagcctgcttgctgcacaacctcctgctgcaggccttcctctagcgtttccctcctgtgccggcccgtttgccgccccacatgttgtgtcccagtgccgtcgtgctgtgcgccgacctcttcctgtcaagcatcttgttgcaggccggcaagctgcgtttctctgctgtgtcgccccgcgtgttcccgacccgcctgttgtggacccacttcaacacagaagagttcctgctag

SEQ ID NO: 24683 - DNA, 1587 bp, Artificial Sequence
  Description of Artificial Sequence: Synthetic coding sequence
atggccacccgggtggaggaggccgcccggggccggggcggcggcgctgaggaagcaacagaagcgggccgaggcggaaggcgccggagcccccgacagaagtttgaaatcgggactatggaagaagcggggatctgtgggcttggggtgaaggccgatatgctgtgtaatagccagagcaacgatatcctgcagcaccaagggagtaattgcggcggcacatctaacaaacattccttggaagaagacgaagggagcgactttatcactgagaacagaaatctggtctcaccagcctattgtacccaggaatcgagagaggaaattccaggcggcgaagcccggaccgatcctcctgatggacagcaagattccgagtgcaatagaaacaaagagaaaacgctgggtaaggaagttttgctgttgatgcaagcgttaaacactctgagtacccccgaggagaagctagctgccctgtgtaagaagtacgctgacttgctcgaagagagccgctctgtgcaaaaacagatgaagatcctccaaaaaaaacaggcccagatcgtcaaagaaaaagtgcatttacaatcagaacattctaaggcaatattggccaggagcaaattggaaagcctgtgtagagaattgcagcgccacaacaaaactctgaaggaggaaaacatgcagcaagcgagggaagaggaagagaggagaaaagaggccacagcccacttccagatcacgctgaacgaaattcaggcccagctggagcaacacgatattcacaacgctaagctgcgacaggaaaacatagagcttggggaaaaactaaagaaattaattgagcagtacgcattgagggaggagcacattgataaagttttcaagcacaaagaattgcaacaacagctcgtcgatgctaaactgcagcagactacccagctgattaaggaggcagacgagaaacatcaacgagaaagagaattcttgcttaaagaggccaccgaatcccggcacaagtacgaacaaatgaagcaacaggaagtgcaattgaagcagcagctctctttatatatggataagttcgaagagttccagactaccatggccaagagtaacgaactctttaccacctttaggcaggaaatggaaaagatgacaaaaaagatcaaaaaattagagaaggaaactatcatctggcggaccaaatgggagaacaataacaaagccctgttacagatggctgaggaaaagaccgtccgggacaaagagtataaggccctgcaaattaagcttgaacggttggaaaagctgtgcagggctttgcaaaccgaaaggaatgagctcaacgaaaaggtagaggtgctgaaggaacaggtatccatcaaagctgctataaaagcggctaatcgcgatctcgccacgcccgtgatgcaaccatgtactgctctggactctcataaggaactgaatactagttcaaagcgcgccctgggcgcacacttagaagcggaacctaagagccagagatccgccgtgcaaaagccaccatccaccgggtccgcccccgcgatcgagtctgtcgattag

SEQ ID NO: 24684 - DNA, 399 bp, Artificial Sequence
  Description of Artificial Sequence: Synthetic coding sequence
atgcgggccagcccctgcatcagccagcccgccgccagctggcaccctcggcccagcgccctgaggcctacagctggaagcggcccagacacccgcaccccaggcacagtcgaggacggtagtgctccctgccccgccttccgctctccagctgtttcaccttgcggggaggaaccttgttgttttcaaatttctcctgccgaggaaaccctggaacttggcaggctcgtctcccctggaaattgtgatacactctccccccgtgccgctgggttttatgcctgccacgtgcggagcctgatcccatgccgttccaccaagggccggtggcctctcactgcatccgcagcaggtctaagccggcacgctcagtgtggcccttctctcggattgggctag

SEQ ID NO: 24685 - DNA, 1944 bp, Artificial Sequence
  Description of Artificial Sequence: Synthetic coding sequence
atggccgagttccgggtgcgggtgagcaccggcgaggccttcggcgctgggacttgggataaagtctccgttagtattgtgggcacacgtggtgaatcccctccacttcccctggacaatctcgggaaggaatttacggcaggcgcggaggaggattttcaggttactctgcccgaggacgtaggtcgagtcctactgctccgcgtgcataaagcacctccagtgcttcccttgctaggtcccctggctcccgacgcctggttttgtcggtggttccaacttacacccccacggggcggacacctcctgttcccttgttatcagtggcttgaaggcgctggcacactagttctgcaggaggggactgcgaaagtcagctgggccgaccaccacccagtcctgcagcaacagagacaggaggaactgcaagcacggcaggagatgtaccagtggaaagcatacaaccccggatggccacactgtctggatgaaaagactgtggaagacctggagctcaacatcaagtattccacggctaaaaatgctaatttctacctccaagcaggcagtgcatttgccgaaatgaaaatcaaaggcctgctggacaggaagggactgtggcggtccctaaatgaaatgaaacggatctttaacttccgcaggacgcccgctgcagagcacgcttttgagcattggcaggaagacgcttttttcgcaagtcaattcctcaacggactcaatcccgtgctgatcaggcgttgtcactatctgcctaagaacttccccgtgacagacgccatggtggcaagtgtgctaggccccgggacttcgctccaagcggaactcgagaaagggtccttgttccttgttgatcatggcatcctttcgggcatccagactaatgtcataaatggtaagcctcaattttctgccgcaccaatgacgctgctctaccagagtccagggtgtggacccttgttgcccctggcaatccagttgtcacagactccaggccccaattcccccatctttttgccaaccgacgataagtgggactggcttctggccaagacctgggtcagaaacgcggagttttcttttcatgaagcactcactcacctgctgcactcccacttgctgccagaagtattcaccttagccaccctgaggcagttgccacactgtcacccactattcaagtctaccggaatcgggatagagggcttctctgaattaatccagcgcaatatgaagcagcttaattactcgttactctgcctgcccgaagatatcagaaccaggggagtggaggatattcccggatattactacagggatgatgggatgcagatatggggcgccgtcgagcgttttgtgagcgaaatcattggaatttattatccgtctgatgaatccgtgcaggacgacagagaattacaagcatgggtgagagagatcttctcaaagggctttctgaaccaggagtcctcgggaatcccatccagtctcgagactcgcgaagcccttgttcagtatgtgacaatggtgatattcacatgctctgccaagcacgccgccgttagtgcaggtcaattcgattcatgcgcatggatgcctaacttgccaccttccatgcagctgccccctccaacctcgaaagggctagccacttgcgagggatttatcgctaccctccctccagttaatgctacttgtgacgtgatcctcgctctctggctactgtctaaggagcccggggatcagcgacctcttggtacataccctgatgaacatttcacagaagaggcaccaagaaggagcatcgccacattccagtctcgcctggctcagatcagtagaggcatacaagagaggaatcagggcctggtactgccgtatacctatctcgatcccccactgatcgagaactctgtgtctatctag

SEQ ID NO: 24686 - DNA, 2031 bp, Artificial Sequence
  Description of Artificial Sequence: Synthetic coding sequence
atggccgagttccgggtgcgggtgagcaccggcgaggccttcggcgccggaacttgggacaaagtgtccgtatcaatcgtgggtacccgaggcgaaagcccaccgttgcctcttgacaacctcggcaaggagtttacagctggtgccgaagaggattttcaggttacactccctgaagatgttggaagagttttactgctccgcgttcataaggcccctcctgtgctcccactccttgggcccttagcaccagatgcatggttctgtcggtggtttcagctgacccctccccgaggtggtcacttactttttccctgttatcaatggcttgagggggctgggactctcgtcctgcaagaggggacggccaaggtgtcgtgggcggaccatcatcctgtgctacagcaacagaggcaggaggagctccaggcaagacaggaaatgtatcagtggaaagcctacaaccccggttggccccactgtctggacgagaaaacagtggaagaccttgagctgaacattaaatattctaccgcaaagaatgccaatttttatctccaagcaggctctgcgttcgcagagatgaagatcaaggggctgctggacaggaaaggcttgtggcggtcactgaacgaaatgaagagaatctttaatttccgcagaacacctgccgcagaacatgcatttgagcattggcaggaggatgcctttttcgcttcccagttcttaaatggactgaatcccgtgctgatacgccgctgccattacttgcctaagaattttcccgtcacagacgctatggtcgcatccgtgctgggaccagggacgagcctgcaggccgagttggagaagggctctctgttcctggtggaccacgggatcctctcaggcatccaaacgaacgttatcaacgggaaaccccaattctctgccgcacctatgacactgctataccagtctcctggatgcggtcctctgctgccactggccatacagctttcacagacgcccggacctaacagcccaattttcctccctacagatgataagtgggattggttgctggcaaagacgtgggttaggaacgcggagtttagctttcatgaggcactgacccaccttctccatagccacttgttgcctgaagtctttaccctggcaactcttcggcaactaccccattgtcatcccctcttcaagttgctgatcccccacacccggtacaccctgcacataaacacattagcacgcgagcttctcatcgtgcctggacaggtcgtggatcgctcaactgggattggcattgagggcttctccgagctgatccaacgcaacatgaaacaactgaattacagccttctctgcctcccggaagatatcaggacccggggcgtcgaggacatccccggctattactatcgcgatgacggcatgcagatttggggcgccgtcgaaagatttgtgtcggagatcatcgggatatactatccaagcgacgaaagtgtacaggatgacagggagcttcaggcatgggtgcgggagatctttagtaagggcttcctgaatcaagaatccagcgggatcccttcatcactggagaccagggaagccttggtacaatacgtcactatggtgatcttcacttgtagtgccaaacacgccgccgtgtctgctggtcagttcgattcctgtgcctggatgccaaatttgcctccgagcatgcaactgccaccgcctactagcaagggtctggccacctgcgaagggttcattgccaccctaccacccgtaaatgctacctgtgacgtcatactagccttgtggctcttgtctaaagaacccggcgatcagcgtcccctgggcacttatccagacgagcactttaccgaggaggctcctaggcggagtatcgcaacattccaatcgaggttggctcaaatcagccggggcatccaggagcgaaatcagggccttgtcctgccttacacataccttgatccccctcttattgagaattccgtgagtatttag

SEQ ID NO: 24687 - DNA, 1665 bp, Artificial Sequence
  Description of Artificial Sequence: Synthetic coding sequence
atggccaccagcgccgacagccccagcagccccctgggcgccgaggacttgctgtccgactcttctgaaccaccgggtctcaatcaggtttcctccgaagtcacatcccaactctatgcctccctgcgcttatcacgccaggcggaggctacagctagagcccagctttacctgcccagcacttcaccccctcatgaagggttggacggcttcgcccaggagctttctcgaagcctttcagtgggcctcgagaagaatttgaaaaagaaagatggttcaaagcacatctttgaaatggaaagcgttagaggtcagttgcaaactatgttacagacctcacgggataccgcgtacagagatcccttgattcctggggccggaagcgagaggcgggaggaggatagttttgactctgatagtacagcaaccctgctcaacactagacccctccaggacctcagcccctcatcgtccgcacaagcacttgaagagttgtttcctaggtacaccagtctgcggccaggcccccctctgaatccccccgactttcagggacttcgggatgcattggactccgagcatactaggagaaagcactgcgaacggcacatacagagtctccagactcgggtcctcgaactccagcagcagctcgccgtggctgtggcagctgataggaaaaaggacacaatgatagagcagctcgataaaacactcgcacgagttgttgaaggatggaatcgccacgaagcagagagaactgaggtgttgagggggctgcaggaggagcaccaagcggctgaactcacacgcagtaaacagcaggagaccgtgacccggctggagcagtctctttcagaggctatggaagccctgaaccgagaacaggagtccgccaggctccaacaacgggagcgagagacactggaggaggaaagacaggccttaacgttgcggctggaagcagagcagcagcggtgttgtgtgctccaggaggaaagggatgcagctagggccggccagttatcagagcaccgggagctggagacactcagagccgcactggaggaagagcgccaaacatgggcgcaacaagagcatcagctgaaggagcattatcaggcgctgcaggaggaatctcaggctcagctggaacgcgaaaaagagaagtctcagagagaagctcaggctgcctgggaaacccagcaccagttggctctggtgcagagtgaggtccgaaggctggaaggggaattagacaccgcccggagagaaagagacgcgctgcaactggaaatgtccctcgtccaggcccgttatgagagtcagaggattcagctcgagagcgaacttgctgtgcaactggagcagcgagtgactgagcgactggcccaggcccaagagtcttccctcagacaggccgcatcactgagagagcatcaccgtaaacagctgcaggacctgtccggtcagcatcaacaggaattagccagccaacttgctcagttcaaagtcgaaatggccgagcgtgaagagagacaacagcaggttgccgaggattacgaacttaggcttctcctgctggatccgccggcacctggtctgcgctctccgagacgaaggcgagggggatcgggcctttgccttccttggccgtggccttag

SEQ ID NO: 24688 - DNA, 2778 bp, Artificial Sequence
  Description of Artificial Sequence: Synthetic coding sequence
atggccaccagcgccgacagccccagcagccccctgggcgccgaggaccttttgtccgactcctcagagccccctgggctcaaccaggttagtagcgaagtgacttctcagttatacgcgagcttacgactcagcagacaggccgaagcaaccgcccgggcccagttatacctgccttccacgagccctccacacgagggactggatggatttgctcaggaattgagccgaagcctttccgttgggcttgaaaagaatctgaagaagaaggacggctcaaaacatatcttcgagatggagagcgtgagaggccaactgcaaacaatgctgcaaactagcagagacacagcatatagagatccgctgatacccggtgccggatccgaacgccgggaggaagactctttcgatagtgactctaccgccaccctgctgaacaccagacccttacaggatctatccccttcctcctctgcccaggccctggaagaattgtttcccagatatacctcccttagaccagggccccccctgaatccaccggattttcagggactcagagatgcccttgactccgagcacacccgaaggaaacactgcgaacggcacatccagtcgctccagacccgagtcctggagcttcagcaacagcttgcagttgcagtcgcagccgaccgtaaaaaagatacaatgattgagcagctggataagaccctggctagggtggtcgagggctggaatagacacgaggcggagcgcacggaggtactccgcggtctgcaggaggaacaccaggctgccgagttaacaagatctaaacaacaggaaacagtgactaggttggaacagtcactgtctgaagccatggaggcattaaatcgagagcaggaaagtgctagactccagcagagggagcgagaaaccttggaggaagagagacaggcgctgaccctgcggctggaagcagaacaacaacgttgttgtgtgctgcaggaggaacgcgacgctgctagagccggacagctgtcagagcacagggagttggaaacccttagagccgcactcgaggaagaacgccaaacgtgggcgcagcaggagcatcagcttaaggagcactatcaggccctgcaggaggaatcccaggcccagttagagcgcgagaaagagaagagtcagagagaagcccaggcagcgtgggaaactcagcatcaattggctctggtgcaatcggaagttaggagactggaaggagagttggacactgctcgcagggaaagagatgccttacaattagagatgagtctggtgcaggcccgctacgagagtcagaggattcaactcgaatctgagctcgcagtccaattggaacagagggtgacagaaagactcgcccaagctcaggaatcctccttgcggcaggccgcatcattacgggaacatcaccggaagcagctgcaggatctgtctggccagcaccagcaagagctcgcatcccagctggcacaattcaaggtggagatggctgagcgggaagagcgacagcagcaggtagctgaagattatgagctgcggctggcccgtgagcaggcacgggtatgcgagctgcagtccggaaatcagcagctcgaggagcagcgagtagaactggtcgaaaggctgcaggcaatgcttcaagcccattgggacgaggccaatcagctcctatctaccactcttcctccaccaaatccaccagctccacccgcaggcccttcttctccaggcccacaggagcccgagaaggaagagcggcgggtgtggactatgcccccaatggcagtggcactgaaacccgtcttgcagcagtccagagaagctagggatgaactgcccggtgcgcctccagtgctctgctcttctagcagtgatttgtccctgctactaggtccatcctttcagtcgcagcactctttccaacccctcgaaccaaagcctgatcttacaagcagcactgctggcgcattctctgctctgggagcctttcatccagatcatagggctgaacgtcctttcccagaagaagatccagggccagacggcgagggcctccttaagcagggattgcctcccgctcaattggaaggcctcaagaattttctgcaccaattgctagagacggtgccacagaataacgagaacccctctgtcgatcttctgccccctaagtcaggacccctaaccgtgccatcctgggaggaagctccccaggtgccacgaatccctccccccgtccacaagactaaagtaccgttggctatggcctcctctcttttccgggttccagaacccccatcaagtcacagccaaggatccggtccctcctccggcagtcccgaaagaggaggcgacggcctcacctttccacggcagctgatggaggtttctcaattgctacgcctctatcaagcccgtggttggggcgcactcccagctgaggacttgctattatatctgaaacgccttgaacactcagggtacaagcccgggagaaaagaggaggggttcagcgggtggaagttagattatggtgaatggagcggcacagatggcaggggcgataatgtgccccgccgcaacacagattcaaggttgggggaaatcccccggaaggagataccgtctcaggccgttcctagaagactggctacagcccccaagaccgaaaaaccgcctgcacgaaagaaatctggacatccagctccttctagtatgagatcccgcggcggtgtttggagatag

SEQ ID NO: 24689 - DNA, 2961 bp, Artificial Sequence
  Description of Artificial Sequence: Synthetic coding sequence
atgtacttctgctggggcgccgacagccgggagctgcagcggcggagaaccgccgggagccctggtgcagaactgctgcaggcagcctccggtgaaaggcacagcctccttcttttgaccaatcacagggtactcagttgtggcgacaactctcgcggccaactgggccgccggggagctcagagaggcgaattacctgagcctatccaggctcttgaaacgctgatagtagatctggtgagttgcggcaaagaacattcactggccgtttgccacaaaggccgcgtattcgcttggggggccggatctgaggggcagttaggcatcggggagttcaaagagatttccttcactcctaaaaaaatcatgacattaaacgatataaaaatcatacaggtctcctgcgggcactatcatagcttagcgctctccaaagattcacaagtcttctcctggggtaagaactcccacggacagttgggcttggggaaggagttcccttcacaagcttcaccacagagggtccgatccctggagggcattccccttgcccaggtggccgcaggtggagcgcacagcttcgctctcagcctctgtggaaccagtttcgggtggggtagtaactccgctggtcaattagccttatcagggagaaatgtgccagtgcagagcaacaagccactctccgtgggagcactgaaaaacctaggcgtggtctatatttcgtgtggagatgcccataccgctgttttaacacaagatggcaaagtgtttacttttggcgataatcggagcggacaactgggatacagccccactcccgaaaaacgaggtccccagctcgtggagagaattgatggactggtatcacagattgattgtggctcctatcatactctggcctatgtgcacactactggacaggtggtgtcctttggccatggcccatccgacacctctaagcctactcacccagaggcactgactgaaaacttcgacatctcttgcttgataagtgctgaggacttcgtggacgtccaggttaagcatatctttgccggcacatatgccaacttcgttactacacatcaggatacctcctcaacccgagcccctggaaagacattgccagaaatcagccggatatcccagtccatggccgagaagtggatcgccgtgaagagacgctcaacagagcacgagatggccaaatccgagattcggatgatcttctctagtcccgcgtgtctaaccgcgtcgttcctgaaaaaaagagggacgggtgagaccacctcaatcgatgtagacctcgagatggcaagagacacctttaagaaactgaccaaaaaggagtggatctcaagcatgattactacgtgccttgaggatgatctgttgcgcgctctgccgtgccacagtcctcaccaggaagcactctcggtgtttctcctattgccggagtgtccagtgatgcatgattcaaagaattggaaaaacctggtggttccttttgccaaagccgtctgcgagatgtccaaacagtcacttcaggtgcttaaaaagtgctgggcatttctgcaggagtcatctttgaaccctctcattcaaatgctgaaagcagctataatctctcaactgctccatcagacgaagactgagcaggatcactgcaatgttaaagccctgctcggtatgatgaaggagttgcacaaagtgaacaaagcgaattgtaggcttccagaaaatactttcaatattaatgagctgagcaaccttcttaacttttatattgacagggggcgccagctcttccgtgataatcacctcatgtccgagaaaaaagcatacatgctgatgcacgaaaccattctgcagaaaaaagatgaattccccccctccccccgtttcatcctccgggtacgcaggagccgcctcgtcaaagacgccctgcgtcagctctcccaggcagaggccactgatttttgtaaggtccttgtggtggaattcatcaatgagatctgcccggagagtggtggcgtctctagcgagtttttccattgtatgtttgaggagatgactaagccagaatacggcatgttcatgtatccggagatggggagttgcatgtggttccccgcaaagccaaagcccgagaagaagcgttattttttattcggaatgctttgcggactttctttgttcaaccttaacgtcgctaacctgccgttcccgctggccctttacaaaaaactgctcgaccagaaacccagcctggaggacttaaaagagctgtccccccggcttggaaagtcgcttcaggaggttctcgacgacgccgcagacgacatcggggatgcactgtgtattcgatttagcatccactgggaccaaaacgatgtggacttgatcccgaatggcatcagtatacccgtggatcagacgaataaacgggactacgtgtcgaagtacatagattacatcttcaacgtttctgtgaaagcggtgtatgaggaattccagaggggcttctaccgcgtctgtgagaaggagattctcagacacttttacccagaggagcttatgactgccattatcggcaacactgattacgactggaaacagttcgaacagaactcaaagtatgaacaaggctatcagaaatcacatccaaccatccagcttttctggaaggcatttcacaaacttaccttagacgaaaaaaagaaatttctgtttttcctcacaggtcgtgatagactccacgccagaggcatccaaaagatggaaattgtattccgctgccccgagacattctccgagcgtgatcatccaacttcgattacctgtcataacatccttagcctgccaaaatactccaccatggagcgcatggaagaggccctgcaagtggccattaataacaaccgcggatttgtgtctccaatgctgacacagtcgtag

SEQ ID NO: 24690 - DNA, 435 bp, Artificial Sequence
  Description of Artificial Sequence: Synthetic coding sequence
atgaccacccggcaggccaccaaggaccccctgctgcggggcgtgagccccacccctagtaaaatccctgtgagaagccagaagcggacaccgtttccaactgttacttcatgcgctgttgaccaggaaaatcaagacccacgaaggtgggtgcagaaaccccctctcaacatccagcggccgctcgtagacagcgcaggacccaggcctaaagcccggcatcaggctgagacgagtcagcgactggtcggaattagccagccccgcaacccacttgaggagttacgcccttcaccccggggacaaaatgttggtcccggacccccagcccagaccgtgctggtgcccgcaccgggcaagctttttgccctacgacgtagtccgttccccccagccaagtgccacctagctcggtgtcatgggctgtatttgtag

SEQ ID NO: 24691 - DNA, 327 bp, Artificial Sequence
  Description of Artificial Sequence: Synthetic coding sequence
atggccgacccccgggtgcggcagatcaagatcaagaccggcgtggtgaagagactggtgaaagaaaaagtcatgtacgagaaggaagcaaagcagcaagaggagaagatagagaaaatgagggcagaagacggcgagaattacgatattaagaaacaagccgaaatactccaggaatccagaatgatgatccccgattgccagagacgcctggaggccgcttacctggatctccaacgcatcctggagaatgagaaggacctcgaggaggccgaggaatacaaagaggcccgtttagttcttgattcggtcaaactggaggcttag

SEQ ID NO: 24692 - DNA, 1341 bp, Artificial Sequence
  Description of Artificial Sequence: Synthetic coding sequence
atgcgggagtgcctgagcatccacatcggccaggccggcatccagattggcgatgcctgctgggagctgtactgtctggagcacggtatccagcccaacggggtggttctggacacgcagcaagatcagttagaaaacgccaagatggaacacacgaatgcgtcttttgacacatttttttgcgagacgcgcgctggcaaacatgtcccaagggctctcttcgttgacctggagcctaccgttattgacggaatacgcactggtcagcaccgaagcctgttccaccccgaacagttgctgtctgggaaagaagacgctgccaacaactacgctagggggcggtacagcgtgggttccgaggtgatagatttagtgttggaacggacccgcaaattggccgaacaatgcggcggcctgcagggatttctgatttttcgcagttttggaggtgggacggggagtggattcacaagcttactgatggagcgtttgaccggcgagtactccagaaaaacgaaactggaattctccgtctaccccgccccacgcattagcacggcagtcgtggaaccctacaatagcgtgctcaccacgcattctacaaccgagcatacagactgcaccttcatggtagacaatgaggccgtgtacgacatttgccacagaaagcttggtgtcgagtgcccttctcacgctagcatcaatagacttgtggtccaagtggtctcttctattacagcctctctccgtttcgagggcccgcttaacgtagacttaattgagttccagaccaatctcgtgccttacccccgtattcactttcctatgactgccttcgctcctatcgtcagtgctgacaaggcttatcacgagcaattctccgtgagcgacataacaaccgcctgctttgagagcagcaatcagctggtcaaatgcgatcccaggttggggaagtatatggcatgctgtcttctgtacaggggagacgtggtgcctaaagaagttaatgcagccattgcggccacgaagagccgacattctgttcagttcgtggattggtgccctactggcttcaaagtgggaattaacaacaggccccctaccgtgatgcctgggggggatctggcaaaggtgcaccgcagtatttgtatgttgtccaataccacagcaattgttgaggcctgggctcgcctagatcacaagttcgatctgatgtatgcaaagcgagctttcctacactggtacctcagggagggcatggaagaagccgagttcctggaggcccgtgaggatctggctgctctggagagagactacgaggaggtagctcaatctttctag

SEQ ID NO: 24693 - DNA, 873 bp, Artificial Sequence
  Description of Artificial Sequence: Synthetic coding sequence
atgggcagcagcaagaaggtgaccctgagcgtgctgagccgggagcagagtgagggtgttggcgcccgcgtgcggaggtccattgggcgtccagagctgaagaatctagaccccttcctgctcttcgatgaattcaaaggcggccgccccggcggttttcctgaccacccacatagaggctttgagactgtatcataccttctggaggggggatctatggctcatgaggacttctgtggtcacaccggaaaaatgaatccaggtgacttgcagtggatgactgctggccgcgggattcttcatgccgagatgccttgttccgaagagcctgctcacggtctgcagctgtgggtaaaccttcggagctccgagaaaatggtggaaccacagtaccaggagttgaagagcgaggagatcccaaaaccatcaaaggacggagtgaccgtcgcagtgatcagcggcgaagcactgggaattaagtccaaggtatatactagaacgcctacactctacctggatttcaaattggatccaggtgcgaaacactcccaacccattcctaaaggttggacatcattcatttacaccattagtggggatgtgtacattggcccagacgacgctcaacagaagatagagccccatcacaccgccgtgctgggcgaaggagactccgtgcaggttgagaacaaggatcctaaacggtctcacttcgtgcttatagctggcgagcctctgcgagagcccgtaatacaacatggccctttcgtgatgaatacaaacgaggaaatcagtcaggccattctggacttcaggaatgctaagaacgggtttgagagagctaagacctggaaatctaagataggcaactag

SEQ ID NO: 24694 - DNA, 873 bp, Artificial Sequence
  Description of Artificial Sequence: Synthetic coding sequence
atgggcagcagcaagaaggtgaccctgagcgtgctgagccgggagcagtccgagggcgtgggggcccgcgtcaggcggagcatcggccggcctgagttgaagaacctggacccttttctgctcttcgacgagttcaaagggggccgtccgggtggcttccctgaccaccctcaccgtggttttgagactgtttcctatctcttggagggcggatctatggcacacgaggacttttgcgggcacacaggaaaaatgaatcccggcgacctgcaatggatgacagcagggaggggaattcttcatgcagagatgccttgcagtgaagaacccgcccacggactccagctgtgggtgaatctacgctcatctgaaaagatggtggaacctcagtaccaggagctgaagtctgaggagatccctaaaccttcaaaggacggcgtcactgtggccgttatcagcggagaagctctagggataaagtccaaagtgtacacaaggactccaactctgtacctcgacttcaaactggatcctggcgccaagcacagccagcccatacccaagggctggacatcttttatatacacaattagcggcgacgtgtatatcgggccagacgacgcacagcagaagatcgagcctcaccatactgccgttctgggagaaggcgattcagttcaagtagagaataaggatccgaagaggagtcacttcgtcctcattgctggcgagcccctgagagaaccagtgatccaacacgggcccttcgtcatgaacaccaatgaagagattagtcaggccatattggacttcagaaatgctaagaatggatttgagagggccaagacatggaaatctaaaattgggaattag

SEQ ID NO: 24695 - DNA, 1200 bp, Artificial Sequence
  Description of Artificial Sequence: Synthetic coding sequence
atggacttcttcagcagccacctgctggccgacagcagcagccccgcaacgaattcttcccataccgacgctcatgagatcctggtgagtgatttcctcgtcagtgacgagaacctgcagaagatggagaacgtgctcgacctgtggagtagcggactgaaaacgaacataatctcggaactaagtaaatggaggctcaatttcatagactggcatcgtatggaaatgagaaaggaaaaggagaagcatgccgcacacctgaagcagttgtgcaatcagattaatgagttaaaagaacttcaaaagacattcgaaatttcgatcggccggaaggatgaagtgattagctcattgtcgcatgcaattggcaaacagaaagaaaagattgaactcatgagaaccttcttccactggagaatcgggcacgtgcgcgcccgccaggacgtgtacgagggaaaactggcagaccaatattaccagagaacattgctgaagaaagtttggaaggtctggcggagtgtggtgcagaagcagtggaaagatgtcgttgagagagcgtgccaggcccgcgctgaggaagtttgtatacagatctcaaacgattatgaagcgaaagtggccatgctctcgggcgccctggaaaacgcaaaggccgagatccagcgcatgcagcatgaaaaagaacatttcgaggattccatgaagaaggcgttcatgcgtggagtctgcgcactcaatctggaggccatgactatcttccagaatcgtaacgacgccgggatcgatagcaccaataataagaaagaggagtatggtcctggtgtccaggggaaagagcattcagcccatttagaccccagcgcccctccaatgcctttgccggttaccagtccactcttaccaagcccgccggctgcagtgggtggcgcctcggccacagccgtgccaagcgctgccagtatgaccagcaccagagctgctagcgcttcttctgtgcacgttcccgtgagtgctctcggtgctggctccgccgcgactgctgcaagcgaagagatgcaaactatcccacaggccacggcagcgaagtaccccagaaccatccaccccgaatcttcaacttcagctagtcgctctttggggacaaggtctgcccacactcagtccctcacaagtgtgcactctattaaagtggtggattag

SEQ ID NO: 24696 - DNA, 729 bp, Artificial Sequence
  Description of Artificial Sequence: Synthetic coding sequence
atggccgccgtgaaggccagcaccagcaaggccacccggccctggtatagtcaccctgtgtatgcacgctactggcagcactaccatcaggcaatggcctggatgcagtcccatcacaacgcctatcgcaaggctgtcgaatcttgtttcaacttaccttggtatctcccgagtgccctgctgccccagtcatcctacgataatgaagccgcctaccctcaatctttctatgaccaccacgtcgcctggcaggactatccctgcagctcctcacactttcgccggtccggacagcacccccggtattcctcccgtatacaggcgtccaccaaggaggaccaagcactgtctaaagaagaagagatggagactgaatcagatgctgaggtcgaatgtgatctctctaatatggagatcacagaagaactcagacagtactttgctgagactgagcgccaccgggaggagcgccggcgtcaacagcagctggacgctgaacggcttgactcgtacgttaatgctgaccacgatctgtattgtaacacccgccggagcgtcgaagccccaacagagcgtccgggagaacgccggcaagccgagatgaagaggctatatggggacagtgccgccaagattcaggcaatggaggccgctgtgcagcttagtttcgataagcattgtgacagaaagcaaccgaaatattggccggtgatccctctgaagttctag

SEQ ID NO: 24697 - DNA, 1482 bp, Artificial Sequence
  Description of Artificial Sequence: Synthetic coding sequence
atggagcggagccccgacgtgagccccggccccagccggagcttcaaggaggaattactgtgtgccgtgtgttatgatcccttcagagacgctgtgacgctgcggtgcggacacaacttttgcagaggctgcgtgagccgttgctgggaggttcaggtcagccccacatgtccagtgtgtaaggaccgagctagccctgccgatctgaggacaaaccacactctcaataatttagtcgaaaagttgttgcgagaggaagcagagggagcaaggtggactagctatcggttttcccgtgtgtgcaggctgcatcgtggtcaattaagcttattttgtctggaggacaaggagcttctgtgctgctcatgccaggccgatccaaggcatcaaggacaccgagtccagcccgtgaaggacacggcgcatgacttccgggttcgcagtctgattgcagaggaacgccgaaattttttacctacccaccagtggatagttacaaaaacccgcctgcagacgtcttcgcccaacctgcagagccggaggcaggggcaggtgcaagagcatggggcttgtaccgccggagaagggcaggggctcctgggtcacgccgccctgctggatgctatggccgaggagacgaggcaaaaacagctgctggcagacgaaaaaatgaagcagctgaccgaggagaccgaggtgttagcccacgagattgaaaggttgcaaatggaaatgaaagaggatgacgtgagttttctgatgaaacacaaatcaagaaaacgccgtctcttctgcaccatggagcctgaaccagtccagcccggaatgcttatcgatgtatgcaagtatctcggatctctgcagtaccgcgtatggaagaagatgcttgcatccgtcgaatctgtgccgttttcttttgatcctaataccgccgccggctggctatcagtatccgatgacctgacaagtgtcaccaatcacggatacagagtacaggtggagaaccctgagagatttagctctgccccttgcctcctcggttctagggtattttcccaaggttcccacgcctgggaggtggccctcggcgggctccagtcatggcgcgtcggggtggttagagtacgacaggactctggggctgagggccactcccactcctgttatcatgacaccagatccggattctggtacgtctgccgaactcagggggtggagggcgaccattgtgtgactagcgaccccgctacttcccctctggtgctcgccatcccacgaagactccgggtggaactcgaatgcgaggagggggagctgtccttctacgacgctgagaggcactgccacctatacacctttcatgcaaggtttggagaggtgcgaccatacttttatctcggcggagctcgaggcgccggcccacccgaacctttaagaatatgtcctctgcacatctctgtaaaagaagagctcgacggatag

SEQ ID NO: 24698 - DNA, 1473 bp, Artificial Sequence
  Description of Artificial Sequence: Synthetic coding sequence
atgaacctggccgagatctgcgacaacgccaagaagggccgggagtacgctctgctcgggaattatgactccagtatggtttattatcagggagtcatgcagcagattcagaggcattgccaatccgttagggatcctgctattaaggggaagtggcaacaagtgcgccaggagctgcttgaggagtacgaacaggtgaagtcaattgtgtctacactcgagagcttcaaaatcgataaaccgccagatttcccagtgtcatgtcaagatgagccatttcgagatccagcggtgtggccccctcccgtcccagccgagcatagggcgcccccacagatccggaggcccaacagagaggttagaccattacgcaaagagatggctggagtaggcgctaggggtcctgttggacgcgcacaccccatctcaaagtcagaaaagccgtccaccagtcgggacaaggactaccgcgcacgcgggagagatgataaaggccgcaagaacatgcaagatggcgcatctgacggtgagatgccgaagttcgacggggctgggtacgataaagatctggttgaagcacttgaacgcgacattgtgtcacgaaacccctcaattcactgggacgatattgccgacctggaggaggcgaagaaacttcttcgggaagccgtggtgctgcctatgtggatgccggacttcttcaaggggatacgcaggccctggaaaggcgtactgatggtgggccctcccggtaccggcaagaccatgctggccaaagccgtggccacagaatgcggtacaacattttttaacgtgagctcctcaacactcacatccaagtacagaggcgaaagcgagaagctggtccggctgctgtttgaaatggctcgcttttatgctccgaccaccatatttattgacgaaattgactctatttgttctcgccggggcacctcagatgagcacgaagcatcccggcgggttaaatccgagttgctcattcagatggacggagtggggggcgctctcgagaacgatgacccctccaaaatggtcatggttctcgcagccacaaacttcccctgggatatcgacgaagctcttcgccgccgacttgaaaagagaatatacataccattgcccactgcaaagggccgggccgagctattgaagataaacctgcgggaagtggaactcgacccagatatccagctggaggacattgctgagaagattgagggctacagcggtgccgatataacaaacgtatgcagggacgcatccctgatggctatgaggcggagaataaatggactgagtcctgaggagatcagggccctgtccaaggaggaactacaaatgcccgtgacaaagggggacttcgaactggctctcaaaaagattgccaaaagtgtatcggctgccgacctggagaagtatgagaaatggatggtggagtttggaagtgcttag

SEQ ID NO: 24699 - DNA, 1473 bp, Artificial Sequence
  Description of Artificial Sequence: Synthetic coding sequence
atgaacctggccgagatctgcgacaacgccaagaagggccgggagtatgccctgctgggcaactatgattctagtatggtctactaccagggagtaatgcagcagatccagaggcattgccagtccgttagagacccggctatcaagggtaagtggcagcaggtgaggcaagagcttttagaggaatatgaacaagtgaaaagcatcgtatctacactagagagtttcaaaatcgataaacctcctgattttcctgtttcctgccaggacgagccattccgggatcccgccgtgtggcctccgccagtgccggccgaacatcgtgctccgcctcaaatcagacgccctaacagggaggtccggccccttcgcaaagaaatggcaggagtgggcgccagggggcccgtgggccgcgctcatcctatctcaaagagcgaaaaaccatctacatctagagataaagattatcgggcccggggcagggatgataagggccgaaaaaatatgcaggatggagcctctgacggggagatgccgaaattcgatggtgccggttacgacaaggacctcgtcgaggcgctcgagagagacattgtctccagaaacccttctatccactgggacgacatcgccgatctagaggaagcgaagaagctgctccgcgaggccgtcgtgctgccaatgtggatgcctgacttttttaagggcatccgacgaccatggaagggggttctgatggtggggccacccggtacaggtaaaacgatgctggccaaagcggtcgcaactgaatgcgggactacattcttcaatgtgagctcctctacactgacatccaagtatagaggggagagcgaaaaactggtaagactactgttcgagatggcaagattctacgcccccacaacaatatttatagatgagattgattccatatgcagtcgtcgcggaactagcgacgaacatgaagcatccaggcgcgtgaaatcggaactgctcattcagatggacggcgttggtggcgcgctggaaaacgatgacccatctaaaatggtcatggtcctggccgcaaccaactttccttgggatatcgacgaggccctgaggcggagattggaaaaaaggatctacataccgctgcccacagccaaaggtcgcgccgagctgttgaaaattaatctgcgcgaggtggagctggatccagatatacagctcgaggatatcgcagagaagatcgaaggttacagcggcgccgatataacgaacgtgtgccgggatgcttcacttatggctatgcgcagacggatcaatgggctctctcctgaggagataagggctctgtccaaagaggagctccagatgcctgtgactaagggagatttcgagctggccctgaagaaaattgccaaaagtgtctccgcagcggatctggaaaaatacgaaaagtggatggttgagttcggaagcgcttag

SEQ ID NO: 24700 - DNA, 1068 bp, Artificial Sequence
  Description of Artificial Sequence: Synthetic coding sequence
atggacttcatcttccacgagaagcaggagggcttcctgtgcgcccagcactgtctgaacaacctgctgcagggggagtatttttcacctgtggaactggccagcatcgcccaccaacttgatgaagaagagcgcatgaggatggccgagggaggtgtaacttccgaggagtatctggctttccttcagcagccatccgagaatatggacgacacgggattcttcagtattcaagtgatctcgaatgcactgaagttctggggactggagattatccattttaacaacccagagtatcagaaactggggatcgatcctattaatgaaaggagcttcatttgtaattacaaacagcattggtttacaattcgcaagttcgggaagcactggtttaatctgaattcactgttggccgggccagagctgatctctgacacgtgtctggctaacttccttgcccgactgcagcagcaagcatacagtgtctttgtggtgaaaggtgatctgcctgattgtgaagccgaccagttgctgcagatcatttcggtagaggagatggatacaccaaagctgaatggcaagaagctcgtgaaacagaaggagcatcgcgtctataagactgtgttagagaaagtgagtgaggaatctgacgaatccgggacatctgaccaggacgaggaggatttccagcgagctcttgaattaagtaggcaggagacaaatagagaggatgaacacctaagaagcaccatcgagctgtccatgcagggatcgtccggtaacacaagccaggatctacccaagacatcctgcgtcacaccagcatccgagcagcccaaaaaaatcaaagaagactacttcgagaagcaccagcaggaacagaagcagcagcaacagcaatctgatctgcctggacactcgtcctatctccacgagaggccaacaacaagtagccgggccattgaatccgacttgtctgatgacatttcggaggggaccgtgcaggctgcagtcgacaccatccttgagatcatgcgtaagaacctcaaaatcaagggtgagaagtag

SEQ ID NO: 24701 - DNA, 5910 bp, Artificial Sequence
  Description of Artificial Sequence: Synthetic coding sequence
atggccgcccggagcgcccccagctgccacctgcggctggagtgggtgtatggatacagaggacaccagtgtcgaaacaatttgtactacactgcagccaaagagatcgtgtacttcgtcgcaggcgtgggggtggtttatagtccacgggaacaccggcagaagttctacagaggccatagcgacgatattatatcgctggcccttcaccccgagagggtactggttgccaccggacaggttgggaaggaaccctacatttgcatttgggattcttacactgtgcagactatcagcgtgttgaaagacgtacatacccatgggatcgcctgtttagctttcgacctggacggacagcggctggtctccgtgggactcgacagcaaaaatgcagtgtgcgtgtgggactggaagcgcggaaaaatgctgtccatggctccgggccatactgatcggatcttcgacatatcttgggacctctatcagccaaacaagctcgtgtcttgcggggtcaagcacataaagttctggtcgctgtgcggcaacgccttaacacctaagcgaggagtgttcgggaaaaccggggacttacagactatactgtgtttggcctgtgcccgtgatgagctgacatatagtggggcgctaaacggcgatatctatgtctggaagggcatcaatctgatacggacgatacagggagcgcacgccgcgggtatctttagtatgaatgcatgtgaggaaggattcgcaactggcggacgggatggatgtatcaggttgtgggacctgactttcaagcccattaccgtgatcgacttacgggagactgaccaggggtataagggactttcagtaagatcagtctgctggcgcggggaccacatcctggtggggacgcaggattcagaaatctttgaaatcgttgttcaggagcgtaataaaccctttttgatcatgcagggccattgcgagggagaattgtgggcactggccgtccatcccactaagcccctggccgttacagggagtgacgacaggtcagtgcgtatctggtcgttagtggaccacgctttaattgctaggtgtaatatggaggagccgatcagatgtgctgccgtgaacgcggacgggatccacctggctctgggcatgaaggacggctcattcacagtcctcagagttcgggacatgactgaagtggtgcatatcaaagaccggaaagaagccatacatgagctgaaatattcccctgacggaacctatctggctgttggatgcaatgacagctcagtagatatatacggggtagcacaaagatacaagaaggtcggggagtgcctgggctctctgtcattcatcacccacttggactggagtagtgactctcgttacttgcagaccaacgacggtaatggcaagaggttgttctataggatgccagggggaaaggaggtcaccagcacagaggagattaagggggtgcactgggcctcatggacttgcgtttccggcttagaagtcaatgggatctggccaaaatactcggacattaatgatataaattcagtggatggcaactatattgggcaagtcctggtgactgccgacgactatggaattatcaaactgtttcgctacccgtgtctaaggaagggcgctaagtttagaaaatatattgggcatagcgctcatgtgaccaatgtgcgttggtcccacgattaccagtgggtcatatcaatcggcggcgccgatcatagtgtttttcaatggaaattcattcctgaaaggaagttgaaggacgctgtgcacatcgccccccaggagtcacttgccgactcacacagtgatgagagtgattcagatctgtccgacgttcctgagttagactccgagattgagcaggaaacccaacttacttacagaagacaagtctacaaggaggatctcccccagcttaaggagcaatgcaaggaaaagcagaagtcagctacttccaaaaggcgggaaagggcgcccggaaactccattcgcctgcactttgtccatggctaccgtgggtatgactgtagatcaaacctcttttatactcagatcggcgaaatcgtgtaccatgtcgcagccgtgggtgttatctacaaccgccagcaaaatactcagagattctacctgggacacgacgatgatatcttatgcctgactattcaccctctgaaggattatgtcgccaccggacaggtaggccgtgaccccagcatacacatatgggataccgagacaatcaaacccctcagcattctgaaagggcatcatcagtacggggtgagcgcagtcgatttttctgcggatggaaagaggctggcctcagtaggtatagatgattcgcataccgtcgtcctttgggattggaagaaaggggagaagctgtccattgcccgcggcagcaaggacaagatttttgtggtcaaaatgaacccttatgttccagacaaattgatcacagccgggataaaacatatgaagttctggagaaaggccggaggggggctcattggacgcaagggttacatcggcactttaggcaaaaatgacactatgatgtgcgccgtgtacggctggacagaggaaatggctttttcgggaacgtccacaggcgacgtgtgtatttggcgcgacatttttctggtcaagactgtgaaagctcacgacggtccagtcttttcaatgcacgccctggagaaaggctttgtgaccggagggaaagacggtattgtggccctgtgggacgactcattcgaacgctgcctgaaaacctacgcgatcaaacgggcggccctggctcctgggtccaaagggttgctgttggaagacaaccccagtatccgcgccatctctctaggacacggccacattctggtcggcactaagaacggcgaaatcctggaagtggataagtccggacccattacactactcgtacagggccatatggagggcgaagtttggggcctggcaacacatccttatctgcccatctgtgcaacagtctctgacgacaagacactcagaatttgggacttgtcaccttctcactgtatgctggccgtcagaaaactcaagaagggggggcgttgctgttgtttctctcccgatggcaaagctctggctgtgggactgaatgatgggagctttttgatggccaacgccgatacacttgaggacctggtgtcatttcatcatcgaaaggatatgatctccgacatcaggttttcccctggatctggaaagtatttggccgttgccagccatgatagtttcattgacatctataatgtgatgagttctaaaagggttggtatctgcaagggcgcgacatcatacattacacatattgattgggatattaggggcaagctcttgcaggtgaatacaggagcaaaagagcagctttttttcgaggcaccccggggcaagaagcagacgattccttcagttgaggtagagaagattgcgtgggcctcttggactagtgtgctggggctgtgttgtgaggggatttggccagtaattggcgaagttacggatgtaaccgcaagctgtttgacgtctgacaaaatggtgttagccactggtgatgatctcgggtttgtgaaactgttcaggtatcccacaaaaggcaagttcggaaagttcaaaagatacgtggctcacagcacccacgtcaccaacgtaagatggacctacgatgattcaatgctggttactctgggcggtactgacatgtcgttgatggtctggaccaatgaaatggaaggctatagagaaaaacgcccatgtgattccgaggagtctgacattgattctgaagaagatggagggtacgattctgacgtgactcgggagaatgaaattagctacacgataagagccctcagcacaaacattcgtcccatgttaggaatcaaaccgcatttgcagcagaaagagccttctattgatgagcgccctcctgtgtcacgcgcacctccccagccagaaaaactgcagacaaacaacgtggggaagaaaaagcgccctattgaagacctggtgttagagctgatatttgggtacaggggccgggattgcagaaataatgtgcattatctgaatgacggagacgatattatctaccatactgcttcagtcgggatactgcacaacgtggctacagggtctcaatctttctaccaggaacacaatgacgacattttgtgtctgaccgttaatcagcatcctaagttcattaacatcgtagcaacaggccaggtgggagatagcgctgatatgtctgccaccgctccatctattcacatctgggacgccatgaacaagcagaccctgtccatactgaggtgctaccattcgaaaggggtttgcagcgtctctttcagcgcaacaggaaagctgctgctaagtgtgggattggatcccgagcacacaatcaccatatggcggtggcaggaaggagcaaaaatcgcatctagggctggacacaatcagcggatctttgtagcagagttccgaccagatagtgatacacagttcgtgtctgtgggcgtgaaacacgtgaaattctggacgttggccggccgggctttactgagtaaaaagggtctgctctccactctggaggacgccagaatgcaaacgatgctggccattgcttttggagccaacaacctcacgttcaccggtacaatcagcggggacgtttgtgtttggaaggatcatattctgtgtaggatcgtcgccagagctcacaatggcccagtgtttgcaatgtataccactctaagagacggcttaatcgtcaccggcggcaaagagcggccatccaaggagggaggcgccgttaagttatgggaccaggaacttcggaggtgtcgcgcatttcgtttagaaaccggtcaggccaccgactgcgtgagaagcgtgtgtagggggaagggtaaaattctcgttggcacccgtaacgctgagatcatcgaagttggggaaaaaaatgccgcctgtaacattcttgtgaatggccacgtcgacggaccgatttggggccttgctacccatccatcaagagatttctttctgtccgcggctgaggatgggaccgtgagattgtgggatattgctgacaagaaaatgctgaacaaagtgaacttgggacacgctgcccgcaccgtgtgttacagccccgagggtgatatggtcgcaatcggtatgaagaacggcgaatttatcatcctcctggtgagcagtctgaaaatatggggcaaaaagcgtgataggcgctgcgccattcacgatatacgcttcagccccgactccagatacctggccgttggctcctccgaaaactcagtggatttttatgatcttacgctcggccccacattaaatcgtattagctactgcaaggatatcccgtccttcgtgatccagatggatttctccgctgactctagctacctccaagtttcctcaggctgctataagaggcatgtgtatgaagtcccttccgggaaacacctcatggaccatgcagctattgatcgaattacatgggcgacctggacatccatcctcggagatgaggtgcttggtatttggagtagacatgctgagaaggcggatgtgaactgcgcatgcgtgagccactctggaatctccctggtaaccggcgatgacttcgggatggttaagctgttcgattttccctgccccgagaagtttgcaaaacacaaaaggttccttggtcattcaccacacgttactaacatccggtttacttccggggacagacatgtggtgtcagctgggggtgacgactgctcgcttttcgtgtggaaatgcgtacacacgccgcactag

SEQ ID NO: 24702 - DNA, 1146 bp, Artificial Sequence
  Description of Artificial Sequence: Synthetic coding sequence
atgcccctgcaggtgagcgactacagctggcagcagaccaagaccgcggttttcctatccctgccactcaagggggtttgcgtcagggacaccgatgtgttctgcaccgagaattacttgaaagtgaacttcccccctttcttgttcgaagctttcctgtacgcgcctatcgatgatgagagcagtaaggccaagatcggaaatgataccattgtttttacactttataaaaaggaggctgcgatgtgggagacactctctgtgactggagttgataaggagatgatgcagcgcatccgggagaaaagcattctgcaggcacaagaacgtgcaaaagaggcaaccgaggcaaaagctgcagctaagcgtgaagaccagaagtatgctttgagcgtgatgatgaagatcgaggaggaggagcgtaagaagattgaggacatgaaggaaaatgagaggatcaaggccaccaaggcgttagaggcctggaaggaatatcagcgcaaagcggaagagcagaaaaaaatccaacgtgaggaaaagctgtgtcagaaagagaaacagattaaagaagaacgtaagaagattaagtacaaatcacttacgcgcaacctcgcaagtagaaacctcgccccaaagggacgcaacagtgaaaacattttcactgagaagctgaaagaagattcgatcccagccccaagatcagttggctccatcaaaatcaactttacgccccgtgtattccccactgcacttagagaatcccaggtcgccgaggaggaggaatggctgcacaagcaggctgaggctcgcagggcgatgaacaccgacatcgcggagctgtgtgaccttaaagaagaggagaagaatcctgaatggttgaaggataagggcaataaactgttcgccacagagaattacttggccgccataaacgcctacaacttggccattcgtttgaacaacaaaatgcccttgttgtacctgaaccgagctgcctgccacctgaaacttaagaatctccataaggccattgaggatagcagcaaggaattctgttccctagagggaatagagtgccaggcctctgaacccaagctcagccaccacataccttctgatctgcacgtgtacattcaaatggcgtag

SEQ ID NO: 24703 - DNA, 1344 bp, Artificial Sequence
  Description of Artificial Sequence: Synthetic coding sequence
atggccggcgccggcggcggcaacgacatccagtggtgcttcagccaggtgaaaggggccgtggatgacgacgtcgccgaagccgatatcatctctacagtggagtttaaccatagcggtgagctactcgccacaggagataagggtgggcgagtggttattttccagcaggagcaggaaaacaagattcagtcacactcccgcggagaatataatgtctactctacattccagagtcacgaaccagagttcgattacttgaaatctttggagatagaagaaaagatcaacaagattcgatggcttccacaaaagaatgctgcccaatttctgctaagcacaaatgacaagaccattaagctgtggaaaatcagcgagcgcgataagagaccggagggatataatctgaaggaggaagacgggcgctatcgcgatcccaccacggtaacgaccctccgcgtgcccgtgttccgtcccatggaccttatggtggaagcctcacccagacgaatttttgccaacgcccatacctaccacatcaatagtatatcaatcaactctgactacgaaacctacctctcggcagacgacttgagaataaacctgtggcacttggaaatcaccgatcgctctttcaacatcgtcgacatcaaacccgcaaatatggaagagctgacagaagtgattaccgctgcggagttccatcccaactcttgtaacactttcgtatattcttctagcaagggtacgataagactgtgcgatatgcgagcttctgccctctgcgataggcattctaagctgtttgaggaacccgaggacccctccaatcggtcttttttctcagagattatttcttcaatcagcgacgtcaagttcagccactcaggtcgttatatgatgaccagagactacctctcagttaaaatctgggatctcaacatggaaaatcgacccgtggaaacctatcaggtacatgaatacttacgctctaagctctgctctctgtacgagaatgattgcatattcgataagttcgagtgctgttggaatggttcagactccgtggtgatgaccggatcttacaacaatttttttcgaatgtttgatcgaaacaccaaacgagacattacactcgaagcttctcgagaaaataataaaccccgcaccgtcctgaagccccgaaaagtctgcgctagcggtaaacgcaaaaaggacgagatcagcgtggatagtctggatttcaacaaaaaaattctgcataccgcatggcaccccaaggagaacatcatcgctgttgcgaccacaaacaatttgtatatctttcaagataaagtcaattag

SEQ ID NO: 24704 - DNA, 1413 bp, Artificial Sequence
  Description of Artificial Sequence: Synthetic coding sequence
atggacctgcgggaccaggagctggtgaagatcgtgggcatccggtacgaggtggggccacccactttatgctgcctcaaattggcattcatcgaccccgcgaccgggaagctcatggacaagagtttcagtattagatatcacgacatgcctgacgtcatagacttcctagtgttgcggcaattttatgatgaagctcgccagaggaactggcagtcttgtgatcggtttcggagcattatcgatgacgcctggtggtttggtaccgtgctctcacaagaaccctaccaacctcagtaccctgatagccacttccaatgctacattgtccggtgggacaatacggagatagagaagctttcgccttgggacatggagccgatacccgataatgtggatccgccggaagagctgggagcctcaatcagtgtcacaaccgacgagttagagaaattgctgtataagccgcaggccggggaatgggggcagaagtcgagagatgaggaatgtgatcggatcatcagtggtattgatcagctcctcaatcttgatatagcagccgcatttgcagggcccgtggacctgtgcacttacccaaagtattgtacggtcgtcgcatatcccacagatttgtatacaatcaggatgcgacttgtcaatagattttacaggaggctaagtgcactggtatgggaagttcggtacattgagcataacgcccggacattcaatgaacctgaatccgtgattgcccggtccgccaagaaaattacagatcagttattaaaatttatcaaaaatcaacactgtacaaatatctctgagctctccaacacctcagagaatgatgagcagaacgccgaggacctcgatgacagcgacctgccgaaaacgtcgagcggtcgacgtagggattatcgtgatataatcgatacacctatggactttggcaccgttcgggagacacttgatgctggcaactatgacagccccctggagttctgtaaggacatccgactcatattctccaacgccaaagcatacacccctaataaacgctcaaaaatctactccatgacgctgcggctatctgctctgttcgaggaaaagatgaaaaaaatcagctcagacttcaagattgggcagaaatttaacgaaaagctccggagatcccagcgattcaagcaaaggcagaactgcaaaggcgattcacagcctaacaagtccattagaaaccttaaacccaaaagactgaagtctcaaaccaagatcatacctgaattagtcggaagccctacccagtccacctctagccgtaccgcatatctggggacacacaaaacttcggctggcatttcctctggagtgacctccggtttatttagattctcccgaattattaggaaggaatag

SEQ ID NO: 24705 - DNA, 516 bp, Artificial Sequence
  Description of Artificial Sequence: Synthetic coding sequence
atgtgcggccgggcccccccccccgagatcaccggccgggagcccgggtaccacttggtggagcaaagctgctggctgaagccactgcccagaaatttgggccactcactcttctggactgtttggaaaccgcgccccgtttcccaattggtggcccagcaggtgacccagcagtttgtgccaccaacccagagtaagaaggaaaaaaaggataaggtcgaaaaggagaagtctgagaaggaaacaacctcaaaaaaaaacagtcataagaagacccgccctaggctgaaaaatgtagaccgttccagcgcacagcatctcgaagttaccgtcggggacctcacagtgatcatcactgatttcaaagaaaagaccaaaagcccacctgcatccagcgccgcaagtgcggatcagcattcacagtcaggctccagctctgacaacaccgagaggggtatgtctagatcttctagccctcgcggcgaagcatccagcttgaatggcgaaagccattag

SEQ ID NO: 24706 - DNA, 417 bp, Artificial Sequence
  Description of Artificial Sequence: Synthetic coding sequence
atgggcgacaagaagagccccacccggaagccccggcccgtgagccagctagttgcccaacaggttacgcagcagtttgtcccacccactcagtctaagaaggagaagaaggataaggtggagaaggagaaatccgaaaaggagactacctccaagaaaaactcccataaaaaaacgcggcctcgactgaaaaacgtggacaggagctcagctcagcatttagaggtcaccgtgggtgacttaactgtcatcatcaccgacttcaaggaaaaaactaagtcgccccctgcctcttctgcggcctctgctgaccagcactcccagagtggcagctcctctgataatactgaacggggtatgagtaggagctcatcccccagaggcgaggcctcatctctgaatggcgaaagtcactag

SEQ ID NO: 24707 - DNA, 1047 bp, Artificial Sequence
  Description of Artificial Sequence: Synthetic coding sequence
atgggccactgctgctgcaagccctacaactgcctgcagtgcctggataagaccaacgaatccgccctcgtgaaagagaaggagctgtcgatagagctcgccaatattagagatgaggtcgcatttcatacggcaaagtgcgagaaacttcaaaaagaaaaagaagagctcgaacgccgtttcgaggacgaggttaagaggctggggtggcagcagcaggctgaactgcaggagctcgaggagcggctgcagctccagttcgaagctgagatggcccgtcttcaggaggagcacggtgaccagttattaagcattcgttgtcagcatcaggaacaagtggaggatctcactgcaagccacgacgccgcgttgctcgagatggaaaacaaccataccgtggcaataaccatcctacaagacgaccatgaccacaaggtgcaggagttgatgtccactcacgaactggagaaaaaagaacttgaagaaaattttgaaaagttaaggctgagcctgcaggatcaggtcgacaccttaacatttcagagccagtctctgcgggatagggcacgccgtttcgaggaggcgttgcgcaagaataccgaggaacagttggagattgctcttgcaccataccagcacttggaggaagacatgaagtccctcaagcaggtgttagaaatgaaaaatcagcagatacatgaacaggagaaaaaaattcttgaacttgaaaaactggcagagaaaaatatcatcctggaggaaaagatccaggttctacaacagcaaaacgaagatctcaaggcgaggattgatcagaacactgttgtcaccaggcaactctctgaggagaacgcaaacctgcaggaatacgtagagaaggagacacaggagaagaagcgcctttcacggactaatgaggagcttctctggaagctgcagacaggcgacccaacttcaccaatcaaactctcacctacctccccggtttacagaggctccagctccgggcccagttccccagccagggtgagcacaactccgcggtag

SEQ ID NO: 24708 - DNA, 2664 bp, Artificial Sequence
  Description of Artificial Sequence: Synthetic coding sequence
atgaacagcggcggcggcctgcccccccccagcgccgccgccagcccttcatcttccagcctggccgccgcagtggctgtcgtggcaccccctggtgtaggaggcgttcctggaggcgcagcggttggagtcaagctcaaatactgccggtactatgctaaggataaaacgtgcttttacggagaggagtgtcaattcctgcacgaagacccagccgcaggtgccgctcctgggttaggcttgcacagcaactctgtaccgttagccctggctggtgctcccgtggccggctttccccccggggccgtagcgggaggaggtgctggaccaccacccggacctaaaaaacctgaccttggcgatccaggaacaggcgccgccgcaggtgggggcggaagttcaggcgggctcgatggccctcgcctcgccatccctggtatggatggcggcgcgcttaccgatacatctttaaccgacagctacttcagcacctcatttatcggcgtcaacggctttggtagccccgtcgaaacaaaatatcccctgatgcagaggatgacaaacagctcatcctctcctagcctgctcaacgactctgcaaagccctatagtgctcatgaccccttaacctcgccagcttcgtctctattcaatgacttcggcgctctgaacatcagccagagaaggaagcctcggaagtatagacttggcatgttggaagaaaggctggtgcctatgggctctaaggcaaggaaagcaaaaaacccgatcggttgtttagcggatcgatgtaaatcaggggtgcccataaacatggtgtggtggaatcgcgtgactgagaacaatttgcaaaccccgaatcccaccgccagcgagtttattccgaaaggcgggagcacatctcgcctgtctaatgtttcacagagcaacatgtcagcattcagccaagtcttctctcaccccagcatgggttctcctgctacagctggcttagccccaggtatgtccctgtcggcaggtagcagcccgctgcacagtccaaaaattacacctcacactagtccagccccgagacggcgatcacacacccccaatccagcttcctatatggtcccctctagcgcatcaacttccgtcaacaatccggtgagccagactcctagttcggggcaggttatacaaaaagagactgtgggcggcaccacttatttctataccgatacgacccccgctcctttgaccgggatggtgttcccgaactatcatatataccctccaaccgcgcctcatgtcgcctatatgcagcctaaggctaatgccccaagcttcttcatggccgacgagcttaggcaggaattgattaatcggcacctgattactatggcacagatcgaccaggcagatatgccagctgtccccactgaggtggactcatatcatagcctgtttccgttggagcccctcccacctccaaatcgtatccagaagagttcgaattttgggtatatcacatcttgctataaggccgtcaattcaaaggatgacctgccttactgtttacgaagaatccacggattccgcctggtgaacactaaatgcatggtcctagtcgacatgtggaaaaagatccagcacagtaatatagtgacactgagagaggtctttacaaccaaggcctttgctgaaccaagcctggtgttcgcctatgactttcatgctggcggggaaacaatgatgagccggcacttcaacgaccccaacgcagacgcctatttcaccaagcggaagtggggtcaacacgagggaccgctccctcgccagcacgcgggactcctgcccgagagcttaatttgggcctacattgtccagctcagctccgctctgaggaccatccacacggcaggtctggcatgccgtgtgatggatcctaccaagatcctgataacaggcaaaactcgtctaagagtcaattgcgttggcgtgtttgacgtgctgacgtttgacaattcccagaataacaacccattggctctcatggcccagtaccagcaagccgacctgatcagtctcggcaaggtcgttttggctctggcctgcaactcacttgccggtatccaacgggagaacttacagaaggccatggaactcgtaacaatcaattacagctctgacctgaaaaacttaattctgtatctgctcaccgatcaaaatcgaatgcggagtgtcaacgatatcatgcccatgatcggagcaagattttatactcagctcgacgcagctcaaatgcgaaatgacgtcatcgaagaagacctagcaaaagaggtacagaatggccgtctattccggctgctggccaagttgggcaccattaatgaaagacccgaatttcagaaggaccctacatggagcgaaaccggggataggtatttgttgaagctctttcgtgaccatctgtttcaccaggttactgaggcaggagccccatggatagacttaagccacatcatatcatgtcttaacaaattggatgctggagttccggagaagatttcgctcatctcacgggacgagaagagcgtgcttgttgtgacgtattctgacctgaaaagatgcttcgaaaatacttttcaggagttgatcgccgctgccaacggccagttgtag

SEQ ID NO: 24709 - DNA, 1710 bp, Artificial Sequence
  Description of Artificial Sequence: Synthetic coding sequence
atggccaccctggtggtgaacaagctgggcgccggcgtggacagcgggcgccagggctcaagaggcacagctgtcgtgaaagtacttgagtgcggggtgtgtgaagacgtcttttcactccaaggcgataaagtgcccaggttactactctgtggccatacggtctgccatgattgcctcacgcggctgcccctgcacggtcgcgcaatcaggtgtccatttgatagacaggtcaccgacctgggcgattcgggggtatggggcctaaagaagaattttgcactgttagagctactggaaaggctgcaaaacgggcccatcggccagtatggtgccgcggaagagtccatcgggatatccggcgaaagcatcatccggtgtgacgaagacgaagctcacttggcctccgtgtactgtactgtctgtgccacgcacctatgtagcgagtgttcccaggtgacgcactctacaaaaactctcgccaagcataggagggtacctctggccgacaaaccccacgagaaaactatgtgctcccagcaccaggtgcacgctatagagtttgtttgtctggaggaggggtgtcagacatcacccttaatgtgttgtgtctgtaaagagtatgggaagcatcagggccacaagcacagtgtcctcgagcctgaggccaaccagatccgcgcttcaatcttagatatggcacattgcatacggactttcacagaagagatatctgattactctagaaaattagtgggaatcgtgcagcacatcgaaggcggagaacagatagtcgaagacggcataggcatggcccacaccgaacacgttcctggcactgccgaaaacgctaggtcttgtatccgtgcatatttctacgatctgcatgaaactctttgcagacaagaggagatggccctgtcagtggtagacgcgcacgtgagagaaaagctgatctggcttcggcagcaacaggaggacatgaccattttgttgtcggaggtgtccgccgcatgcctgcactgtgagaagactctgcagcaggacgactgtcgtgtggtcctggcaaagcaggaaataactcgtctgttagaaacattgcagaagcagcagcaacagtttaccgaggtggcagaccatatccagttggacgcctctatccccgtcaccttcactaaggacaacagagtgcatataggcccaaaaatggagatcagggttgtgacattaggactcgacggagccggcaagacaaccatcttgttcaaattgaagcaagacgaatttatgcagcctatacccacgatcggcttcaacgtcgaaacagtagaatacaagaacctgaagttcaccatctgggatgtgggcgggaagcacaaactaaggccgctgtggaagcattactaccttaatacacaggcagttgtgtttgtggtggattccagccaccgggataggatctcagaggctcattcagagttggctaagctgctcacagaaaaggagctcagggacgcgctcctgctcattttcgcaaataaacaagacgtagccggcgcattatcggtggaggagattacagagctgctgagcctacataaactttgttgtggaagaagctggtacatccagggctgcgacgccaggtcggtgttccaaattatttgtgatcagtacaccggcaaggaagtggtcacagagaaaggatag

SEQ ID NO: 24710 - DNA, 2061 bp, Artificial Sequence
  Description of Artificial Sequence: Synthetic coding sequence
atgggccggatccaccaggccatggtgaccagcctgaacgaggacaatgagtctgtaaccgtggaatggatagaaaatggcgacacgaagggcaaggaaatcgatcttgagtccatatttagcctaaatcctgacttagtgccagatgaggagattgaacccagccccgaaacacctccaccccccgccagctcagccaaggtaaataaaatcgttaagaaccgcagaaccgtagctagtatcaagaacgatccccccagccgtgataatagggtggttggtagcgctcgggcacggccctcacagttcccagagcagtcttccagcgcccagcaaaacggctccgtgtcagatataagccctgtgcaggctgcgaaaaaggagttcggccctccaagtcgtagaaaatcgaactgtgtgaaggaggtcgagaaactgcaggagaagagggaaaaacgcaggctacaacagcaagaactgcgcgagaaacgcgcacaggatgtggacgccacaaacccaaattatgaaatcatgtgcatgatcagagactttaggggatctctcgactaccgcccgctgactactgctgaccccattgatgagcatcgaatatgtgtttgcgtaaggaagcggcctctgaacaaaaaagaaacccagatgaaggacctcgatgtgataaccatcccatcaaaggacgtggtcatggttcatgagcctaagcaaaaggtggatttgacacgctacctagagaaccaaacttttaggttcgattacgcctttgacgatagtgcccctaacgagatggtgtaccgctttactgcgcggccacttgtggaaacaatcttcgagcgggggatggccacatgttttgcctatggacagaccggctcgggcaagacacatactatgggcggcgatttttcaggaaaaaatcaagactgttcaaaaggcatatacgctctggccgcccgcgacgtctttctgatgttgaagaagcctaattacaagaagttagagttgcaggtctatgcgacatttttcgaaatatatagcggaaaagtgttcgacctcctgaatcgtaaaacgaagctcagggtgctcgaagatggaaagcaacaggtacaggtggtggggctgcaagagcgcgaggtgaagtgtgtggaggacgtgcttaagctgatcgacatcgggaactcctgtaggacctcaggccagaccagcgcaaatgcccatagttcacgtagccacgcagtcttccaaatcatcttacgcaggaaaggaaagctgcacggtaagttctcccttatcgatctggcaggcaatgaaaggggcgcggacaccagtagcgcagatagacaaactcggctggaaggagccgagattaacaagagtctgctggccttgaaagaatgtatcagggccctgggtcgcaataaacctcacacaccttttagggccagtaagttaacccaggtgcttcgcgactcttttatcggagaaaactctaggacatgcatgattgccaccatttccccagggatggcttcatgcgaaaataccctaaatacgcttcgctacgctaatagggtgaaggaactcacggtggatcccacagccgccggtgatgttagacccattatgcatcacccccccaatcaaattgatgacctggaaacccagtggggcgtcggatcttcgccccagagggacgacttgaagctcttatgcgaacaaaacgaggaagaggtgagtccccagctgttcacctttcacgaggctgtgagtcagatggtggagatggaagaacaagtagtagaggaccacagagctgtttttcaggaaagcatcagatggctggaagacgagaaggcacttttagaaatgactgaggaggtggactatgacgtcgatagctatgctacacagctcgaggccatcctggaacaaaaaatagatatccttacagaactgcgcgacaaagtgaagtctttccgtgccgccctccaggaggaggagcaggccagtaagcaaattaatcctaaacgcccaagggccctttag

SEQ ID NO: 24711 - DNA, 618 bp, Artificial Sequence
  Description of Artificial Sequence: Synthetic coding sequence
atgagcgtggaccccatgacctacgaggcccagttcttcggcttcacaccacaaacctgtatgcttagaatctatatcgcattccaggactacctatttgaagtcatgcaggccgtggagcaggtaatattaaagaagttagacggcattccagattgtgacatcagtccagttcagatccgcaagtgtacagagaagttcttatgcttcatgaaaggtcattttgataatcttttctcaaagatggaacagctatttctgcagctcattctccggattcccagtaatatccttcttcctgaagataagtgcaaggaaaccccttacagcgaggaagatttccaacacctgcagaaggagattgagcagcttcaggaaaaatacaagaccgagctgtgcacaaagcaggcactccttgcagagctggaggaacagaagatcgtgcaggcgaagctgaagcagaccctcaccttctttgacgagctgcacaatgtgggcagagaccatgggacctcagactttagggagtctttggttagtttggtgcagaactccaggaaactacagaacatccgggacaacgtggaaaaggagtcgaaaaggctgaaaatcagttag

SEQ ID NO: 24712 - DNA, 1866 bp, Artificial Sequence
  Description of Artificial Sequence: Synthetic coding sequence
atggtgctgtgccccgtgatcggcaagctgctgcacaagcgggtggtcctcgcatccgccagccccaggagacaggagattctgtctaacgctggcctgaggttcgaagtggttccatccaaattcaaagaaaagttagacaaggcaagctttgctacaccttatggatacgccatggagaccgcaaagcaaaaggcgctggaagtcgctaaccggctctaccagaaggacctgcgggcacccgacgtggtcatcggtgcggacaccatagtcactgtgggcggattgatcctggaaaagccagtagacaaacaagatgcttacagaatgctttcacgactgagcggccgagagcattctgtgtttaccggcgtcgctatcgtgcattgcagctccaaggatcaccagttggacacccgggtgtccgagttctatgaggaaaccaaggtgaagttctcagaactgtctgaggagctgctttgggaatacgtacactcaggtgaacccatggacaaagctggcggctacggaatccaggccctcgggggaatgctagtcgaatcagttcatggtgacttcttaaacgtcgtgggctttcccctcaaccatttttgtaaacagctggtgaagctgtactaccctccaaggcccgaggatctacggcggtctgtaaagcacgattccatccctgcggccgatacattcgaagatctgtcagatgtggaaggaggcgggtctgaacccacgcagagagacgctggttctagggacgagaaagcggaagccggggaggcaggccaagccaccgccgaggcggaatgccaccgcacgcgagagaccctgcctccttttccaacccggctcttggaattgattgagggttttatgctgtctaagggactgttgacagcttgtaagttaaaggtgttcgatctgctgaaggacgaggctccacagaaagctgccgacattgcatctaaggtggacgcttccgcttgtgggatggagcgcctactggacatctgtgccgccatgggattgctggaaaaaacggagcagggctactctaacacggaaacggctaatgtctacctcgcaagcgatggcgaatattccctgcacggtttcatcatgcataataatgacctcacctggaatctgtttacttaccttgaattcgccatccgcgaaggcactaatcagcatcaccgagctctggggaagaaagctgaggacctattccaggatgcctattatcagagcccagaaactagactgcgatttatgagggctatgcatggaatgactaagttaactgcatgccaagtggccactgcttttaacctatcccgattctccagtgcctgtgatgtgggcggctgtacaggggccctggccagagagctagctcgtgaatatccaaggatgcaagtaaccgtgtttgacctgccggatataattgagctcgctgcacattttcaaccgccaggacctcaagcggtgcagatccacttcgcggcaggtgattttttcagggaccccctgccatcagccgagctgtacgtgctgtgtcgaattcttcatgattggcccgacgacaaggtgcacaagcttcttagtcgtgtggccgaatcatgcaagcccggggctggtctcctgctcgttgagacacttctggatgaggaaaaacgggtggctcagagagcacttatgcagtctttaaatatgctggttcagacagagggaaaggagagatcacttggcgaataccaatgtcttctggaactccacggcttccatcaagtccaggtggttcatctgggcggtgttctggatgcgatcttagccacgaaggtggctccatag

SEQ ID NO: 24713 - DNA, 2541 bp, Artificial Sequence
  Description of Artificial Sequence: Synthetic coding sequence
atgctgttcaccgtgagctgcagcaagatgagcagcatcgtggacagggacgatagttctatatttgacggccttgtggaggaggacgacaaggataaggcgaaacgggtctccagaaacaaaagcgagaaaaaacgccgcgatcaatttaacgtcttgatcaaggaactgggttcaatgctccccggaaacgccagaaaaatggacaaaagcactgtccttcagaagtcaatcgacttcttacgaaagcacaaagaaatcacagcccagagcgacgcttccgagattagacaagattggaaacctacattcttaagtaatgaggagttcacacagttaatgcttgaggcactggatggtttctttctggccatcatgacggatggctctattatctatgtcagtgagagtgtgacaagcctgctagaacacttgccttccgatctcgtcgatcagagcatattcaattttatcccagagggggagcacagtgaggtgtacaaaatattgtcaacacatcttcttgagtcagattccctaacacccgagtacctcaagagcaagaaccagctggagttttgttgtcacatgctgagaggcactattgaccctaaggagccttcaacctacgaatacgtaaagttcatcggcaatttcaagagtctgaactcagtgtcttcctcagctcacaatggcttcgaggggactattcaaaggacacatcgacccagctacgaagatcgtgtgtgcttcgtcgccacagttcggctcgccaccccacagtttattaaggagatgtgtactgtcgaagagcccaacgaagaattcacgtctagacacagtcttgagtggaaatttctgttccttgatcacagagcacctcccattataggatatctgcctttcgaagtgctgggcacctctggatacgattattatcatgtggatgatttggagaacctcgctaaatgtcatgagcatttgatgcaatacggtaagggaaagagctgctactaccgattccttaccaagggccagcagtggatctggctacagacacactactatataacctaccaccaatggaacagtcgccccgagtttatagtctgtacccacactgtggtttcttacgcagaggtgagagcagaacggcggagagagttgggaattgaggagagcctgccggaaaccgctgcagataaaagtcaggacagcggttccgataacaggattaacactgtcagtctcaaggaagctttagagcgctttgatcactctcctaccccttcagctagctcccggtcctccagaaagtcctcacacaccgccgtatcagacccgagcagtacccctacaaaaattccgaccgacacatccacccccccccgtcagcacttacccgcacatgagaaaatggtgcagcgaagatctagtttctcctctcagtccataaactcacaaagtgtgggaagttctctcactcagcctgtgatgtcccaggctacaaatctgcctatcccccagggaatgtcccagttccagttctcggcccagctgggagcaatgcagcacctgaaggaccagctcgagcaacgaaccagaatgattgaagctaatatacacagacagcaagaggaacttaggaagatacaggaacagctgcagatggttcatgggcaaggattgcagatgtttctgcagcagagcaatccaggtcttaatttcggcagcgtgcaactgtctagcggaaatagttcgaacatccagcagctcgcacccataaatatgcagggacaggtggtccctactaaccagatacaaagtggaatgaataccggccacatcggcacgacacagcatatgattcagcagcaaactctgcagtcaactagcactcagagccagcagaatgtgctatccggccacagtcaacagactagcttgccgtcccagacacagagcacccttactgccccattgtacaatacgatggtgatctcacagccagctgccggctccatggtgcagattccatcttcgatgccgcagaacagcacccagagcgccgcagtgacaactttcacccaggataggcagatacggttttcccaggggcaacagttggtgactaaactggttaccgcaccagtggcatgtggggccgttatggtccctagcacaatgcttatggggcaagtggtgaccgcgtacccaaccttcgcaacacagcagcagcagagccagacgcttagcgtgacccagcagcaacagcagcagtcatctcaagaacagcagttgactagtgtacagcaaccctctcaggcgcagctgacccagcctccacagcagtttctacagacgtcccggctgctgcacgggaatcccagtactcagttgatactcagcgctgctttcccactgcaacagtcaacctttccccagagccaccaccagcagcatcaatcacagcagcagcagcagctctcaaggcatagaaccgacagcctccccgacccatccaaggtgcagcctcaatag

SEQ ID NO: 24714 - DNA, 1818 bp, Artificial Sequence
  Description of Artificial Sequence: Synthetic coding sequence
atggtgctgtgccccgtgatcggcaagctgctgcacaagcgggtggtgttggccagtgcctctcccagacgccaagagatccttagtaacgctggtttgcgattcgaggtggtgcctagcaagtttaaggagaagctggacaaggcaagttttgccacaccttatggttacgctatggagaccgcaaaacagaaggcgctggaggtggctaacagactgtaccagacggtagggggccttatcttggagaagcctgttgacaaacaagatgcatacaggatgctctccaggcttagcggcagggaacacagcgtctttacgggcgtagccatagttcactgctcttccaaagatcaccagctcgatacccgggtttctgagttttacgaagagacaaaggtcaagttctccgaactgtctgaggagctcctgtgggaatatgttcactccggtgagcccatggataaagccggggggtacggtattcaagcccttggtggcatgctcgtggagtctgtccacggcgattttctgaacgtcgtgggctttccacttaaccatttttgtaagcagctggtgaagctgtattatcctccacggccagaggaccttagaagatcagtcaaacatgattcgattcctgccgctgataccttcgaggatcttagtgacgtggaaggcgggggcagtgagcccacccagcgcgacgcaggcagccgagatgaaaaggccgaggctggtgaagccggacaggctactgcggaagccgaatgtcacaggacccgtgagacgctccccccttttccaacccgcctcctagagttgatcgaggggttcatgttgtctaaagggctgctcactgcttgtaagcttaaggtattcgacctgctgaaagacgaagccccacagaaggctgcggatatcgctagtaaagtggacgcctctgcttgtggcatggaaaggctcctggacatctgcgcagcgatgggcctgctagagaaaactgaacaggggtactccaacaccgagacagccaatgtctacctggcatcagatggcgagtactccctgcacggattcattatgcacaacaatgatctgacgtggaatttatttacatatctcgagttcgcaatcagggaagggaccaaccagcaccaccgagcactgggcaagaaggcggaggacctgtttcaggacgcttactatcagagcccagagactaggttgagattcatgcgggccatgcacgggatgaccaagctgaccgcttgccaggtggcaaccgcttttaacctctcccgttttagtagcgcatgtgacgtcggaggttgtaccggtgcccttgccagggagctggcaagggagtacccccggatgcaggtgacagtctttgatctgcccgacatcatcgagctcgccgcacacttccagcccccaggacctcaggccgtgcagatccatttcgctgctggtgatttttttcgagaccccttgccttcggccgaactgtacgttctgtgtcggatcctgcacgactggcctgatgacaaggtgcacaagttactgtcgagagtcgccgaaagttgtaagccgggcgctggtctccttttagtggaaaccctgctggacgaggaaaagagggtcgcccaacgcgctctgatgcagtccctcaatatgctagtccagaccgaggggaaagaaagatctctgggagagtatcaatgcctgctggagctccatggctttcatcaggtccaggtggtccacttggggggcgttctggacgcaatcttagcaaccaaggtagcaccttag

SEQ ID NO: 24715 - DNA, 696 bp, Artificial Sequence
  Description of Artificial Sequence: Synthetic coding sequence
atgaccgtgggcaagagcagcaagatgctgcagcacatcgactaccgcatgaggtgcatcttgcaggatggtagaattttcatcgggaccttcaaggcatttgacaagcatatgaatttgatcctgtgcgactgcgatgagttccgcaaaatcaaaccgaagaactcaaaacaggccgagcgagaggagaaaagggtcttggggctggtgttattaaggggagaaaatctcgtttcgatgaccgttgaggggccacctcccaaggacacaggcatagcgcgcgtccccctggctggagcagccggaggccctggcattgggcgggctgctggaagggggattccagcaggggtgcccatgcctcaggcaccagctggattagccggccctgtgcgcggggttggtggcccctctcagcaagtgatgacccctcagggcagaggcactgtggccgccgccgccgcagccgcaaccgccagtattgctggcgcccccacacagtacccaccaggtcggggcggcccaccaccaccaatgggtagaggagcacccccacccgggatgatggggccccctcccgggatgcgacctccaatgggcccccccatgggaattcccccaggacggggaaccccaatggggatgccgccacctgggatgcgccctcccccacccggaatgaggggtttgctgtag

SEQ ID NO: 24716 - DNA, 855 bp, Artificial Sequence
  Description of Artificial Sequence: Synthetic coding sequence
atgtggcggggcctggccctggcccgggccatcggctgcgccgcccggggccgggggcagtgggcggtgcgcgccgctgactgcgcccaatccggacgccatccggggcccgccgtcgtgtgcggccggcggctcatttccgtgctcgagcagataaggcacttcgtgatgatgccggaaatcaatacaaaccatctggataaacagcaggtgcagctgctcgctgagatgtgcatattaatcgacgagaacgataataagataggagccgagactaagaagaattgtcacctgaacgagaatatcgagaagggattgctccatcgagccttttcagtattcctgtttaatactgagaacaaactgttactacagcaacgatcagacgctaagatcacatttccgggctgctttactaatacctgttgctcacatccgcttagcaatccggcagaattggaggagagcgatgctttgggcgtaaggagagctgctcagaggaggctcaaggcagagctcggaatacctctggaggaagtgccccccgaagagatcaactacctgacaaggatccactataaagcccagagcgatggaatatggggggagcacgagattgactacatcctgctggtgaggaaaaatgtcacactgaaccctgacccaaatgagattaaatcttactgctacgtctccaaggaggagctaaaagaactcctcaaaaaagcggccagtggagaaataaaaatcacaccctggtttaagataatcgctgccacattcctctttaagtggtgggataacctgaaccacctcaatcagttcgtggatcacgaaaaaatttacagaatgtag

SEQ ID NO: 24717 - DNA, 180 bp, Artificial Sequence
  Description of Artificial Sequence: Synthetic coding sequence
atgacccggggcaaccagcgggagctggcccggcagaagaacatgaaaaagcagtcagactccgtgaaggggaagcggcgggatgatggccttagtgccgccgcccgtaaacagagggatagcgaaatcatgcaacagaaacagaagaaggcaaatgagaagaaagaggaacctaagtag

SEQ ID NO: 24718 - DNA, 3039 bp, Artificial Sequence
  Description of Artificial Sequence: Synthetic coding sequence
atggaggagtacgagaagttctgcgagaagagcctggcccggatccaggaagcttcgctgtcaacagagtcgtttttgccagctcagtccgaaagcatttctttgattcgctttcacggcgtggccattctgtccccactactaaatatcgagaaacggaaggagatgcagcaagaaaagcagaaagccttagacgttgaggcaagaaaacaggttaaccggaagaaggcactgctaactcgcgtgcaggaaattctggacaacgttcaggtgagaaaggccccaaatgccagcgactttgatcagtgggagatggaaacagtgtattccaactccgaggttcgtaatttgaatgtccctgccacctttccaaatagtttcccttcccacactgagcatagcaccgccgccaagctggacaagattgcgggaattctaccactggataatgaagaccagtgtaagaccgacggcatagatctggcgcgagactctgagggtttcaactctcccaagcagtgtgattcttccaacatcagtcacgtggaaaacgaagccttccctaagacaagcagtgctactccacaagagaccctgatttcagacggtccttttagtgtgaatgaacagcaagaccttccattacttgctgaagttattcccgatccctatgtgatgtctctccagaacctgatgaagaaaagtaaagaatacatagaacgcgaacagtcccgtaggtccctccggggttccattaatcgcattgtcaacgaaagtcacctggacaaggagcacgatgccgtggaggttgcagattgcgtgaaggagaaaggtcagctgaccgggaaacattgcgttagcgttattcctgacaagccgtccctgaacaaaagtaacgtccttttgcagggtgcttctacacaggcctcctccatgagtatgcccgtgctcgcctcttttagtaaagtcgatatccccattaggacagggcaccccaccgtgcttgagtcgaattccgacttcaaagtaattccaaccttcgtgaccgaaaacaacgtgattaagtccttaactggtagctatgcaaagctcccttctcccgaaccatccatgtcgccgaagatgcaccgcaggagatctcgaacctccagcgcgtgtcacatactgataaacaacccgatcaacgcctgcgaattgagcccaaaaggcaaggaacaagctatggatttgatcattcaggacactgacgagaataccaacgtgcctgaaattatgcctaagttgcctactgacctggccggtgtttgctccagcaaggtatacgtgggtaagaacaccagtgaggtaaaggaggatgtggtgcttggaaaaagcaaccaggtgtgtcagtcctccggcaaccatttggagaataaagtgacccacgggctcgttacagtggaaggccagctgacaagtgatgagcggggagctcacataatgaactctacgtgcgcggccatgccgaagttacacgagccgtatgcctcatcccagtgtattgctagccccaacttcggtaccgtgagtgggctaaagcctgcctctatgctggagaaaaattgtagtcttcagacggagctgaataaatcgtatgatgtcaagaatcccagccctcttctgatgcagaatcagaatactcgtcagcagatggacaccccaatggtctcgtgcgggaacgagcagttcctagacaacagttttgagaaggtcaagagacgactggacttagacattgacgggctgcagaaagagaactgtccctatgtaataacctccgggattaccgagcaggagaggcaacacctccccgagaagagatatccaaaaggctccggatttgtcaacaaaaataagatgctggggacttcttctaaggagtcagaagagctacttaaatctaagatgctcgctttcgaggagatgcgtaagagactggaggaacaacacgcccagcagctgtcccttcttatcgcggaacaggagagggagcaggaaagactccagaaagagattgaagagcaggaaaaaatgctgaaggagaaaaaggcaatgacagctgaggccagtgagctagatattaataacgccgtcgagctggagtggcggaaaattagcgattcatctttgctggagactatgctgtcgcaggccgatagtctccacacctctaattcaaactcatcaggcttcacaaacagtgccatgcagtactcctttgtatccgcaaacgaggctcccttttacctgtggggatctagcacatctggactgacaaaactctctgtgactcggccttttggcagggctaaaactcggtggtcacaggtgtttagcttggaaatacaggcaaaatttaataagatcacagccgtagccaaaggatttctaaccagacggctcatgcagacggataagctgaagcagctgcggcagaccgtaaaagacactatggagttcatcagaagtttccaaagcgaagctccactgaaaagaggtatcgtttccgcgcaggacgcaagcctgcaggagagagtactagcccaactgagagccgctctctatggaattcacgacattttttttgtcatggacgcggccgagcgaatgtcgattttacatcacgaccgggaagttagaaaagaaaaaatgctgagacaaatggataagatgaaaagccctcgggtagccctgtccgctgcgacccagaaaagccttgaccgtaaaaagtatatgaaagcagctgagatgggaatgcccaacaaaaaattcctggtgaaacagaaccccagcgagacaagggtactccagcctaaccaaggacagaacgcacctgtacatagacttctgagcaggcaggggaccccaaagacctccgtgaagggcgtagtacagaatagacagaagccttcccaaagccgagtacccaacagggttccagtttctggcgtgtatgcagggaaaattcaacgcaagagacccaatgtcgccactatctag

SEQ ID NO: 24719 - DNA, 267 bp, Artificial Sequence
  Description of Artificial Sequence: Synthetic coding sequence
atggccagcgccagcgcccggggcaaccaggacaaggacgcccactttccccccccttcaaagcaatcactcctgttctgtccaaagagtaagctccatattcatcgcgcggagatctccaagataatgcgggagtgccaggaggagagcttctggaaaagggctctgcccttttccttggtgtcaatgctcgtgactcagggtttggtataccaggggtacctggcagccaattctagatttgggagtctgccaaaagtggcatag

SEQ ID NO: 24720 - DNA, 738 bp, Artificial Sequence
  Description of Artificial Sequence: Synthetic coding sequence
atgaacggccgggccgacttccgggagcccaacgccgaggtgccccgaccaataccccatatagggccagactacattcccacggaagaggagaggcgagtttttgccgagtgcaacgacgaatccttctggttcaggtccgtgcccttggcagcaactagcatgctcataacccagggtctgattagcaaagggatactgagctcccacccgaagtacggatcaatccctaaactgatactagcctgtattatggggtacttcgccggtaaattgagttatgtgaaaacctgtcaggagaaattcaaaaagctcgaaaatagtcctctgggcgaggctttaaggagtggtcaggccagacggagctctccccctggccactactatcagaaaagcaagtacgattctagcgtaagcgggcaaagttcctttgttacctcccccgctgccgacaatatcgaaatgctcccccattatgaaccaattccattctctagctcgatgaatgagtcagcacctaccggcattaccgaccacattgtgcaaggtcccgatccgaacttggaagaaagccccaagcgcaagaatatcacatacgaggagctgaggaacaagaatcgggagagctatgaagtgagccttacccagaagactgatcctagcgtccgcccaatgcacgagagggtccctaagaaggaagtgaaagtgaacaaatatggggacacttgggacgaatag

SEQ ID NO: 24721 - DNA, 1551 bp, Artificial Sequence
  Description of Artificial Sequence: Synthetic coding sequence
atgagctaccccgccgacgactacgagagcgaggccgcctacgacccctacgcctacccctcggactacgatatgcacacaggcgatcctaaacaggacctggcctatgagcggcaatatgagcagcagacataccaggtgattcccgaggtgatcaaaaatttcattcagtactttcataagaccgtaagtgatctcattgaccagaaagtctatgagctccaggccagtcgggtgtctagcgacgtcatcgatcagaaggtttacgaaatccaggacatttacgaaaacagctggacaaagctgacagaaagattcttcaaaaatacaccctggccagaggccgaggctatagcgccccaggttggtaacgacgcagtcttcctgattctgtacaaggagctgtactatcgtcacatctatgcaaaggtgtcctttcagagcttttctcaataccggtgtaagacagcaaaaaaaagcgaagaggagatagactttcttcggagtaatcccaaaatctggaacgtgcactcggtactgaacgtgttgcattccttagttgacaagagcaatataaaccgacagcttgaggtgtatacaagtgggggcgacccagaaagtgtggccggagaatatggtagacacagtctttataaaatgctcggctatttcagccttgtcgggttattgcgcctccactccctgctgggtgattattatcaagcaataaaagtgctcgaaaatatcgagctcaacaagaagtctatgtatagccgcgtgcctgagtgtcaggtgaccacatactactatgtcggctttgcttacttgatgatgagaaggtatcaggacgctattcgggtgttcgcgaacatcctgctgtatattcaacgaacaaaaagcatgtttcagagaaccacttataagtatgagatgattaacaagcaaaacgaacagatgcacgctctcctggcgatcgcgctgacgatgtaccccatgagaattgatgaatctatacatctccaactacgggagaagtatggcgataaaatgttaagaatgcagaagggggacccgcaggtatatgaggaactgttcagctactcttgtccaaaatttctatccccagtggtgccgaattacgataacgtgcaccccaattaccataaagagcccttcctacagcagctcaaggttttctcggacgaagtgcagcagcaggctcagctcagcacaatccgtagctttctcaagctgtacaccacaatgccggtggcaaagcttgcgggtttcctggaccttaccgaacaggaatttcggatacaactgctggtattcaaacataagatgaaaaaccttgtatggacctctggcatctctgctttagacggtgaatttcagtccgccagcgaggtcgacttttacatagacaaggatatgattcatattgccgacactaaggtggcaaggcgatatggggactttttcattcgccagatacacaagtttgaagaacttaatcggactctgaaaaagatgggacaacgcccctag

SEQ ID NO: 24722 - DNA, 2502 bp, Artificial Sequence
  Description of Artificial Sequence: Synthetic coding sequence
ctgagccggcgggtgccctgcgtgcggcggggctgccggccccccctacctcctctaccaggtagtcagtcccgcgcctggtccagggacagggaagcaccccttgatcctggccggccggctcaatccggaaggcggcctaccagtaggtctgtaagccacgcttgcagctggaacggtggctcattggatcccctggaggggacacctgcgctgttgaggagcgctgagcgcctcatgcggaaagtgaagaaactccgccttgacaaggaaaatactgggtcctggcggagcttcagccttaactctgagggtgcagaacgtatcacctcctacgactttcattctgagtcggggttgtttctttttcaagccagtaatagtttgtttcattgccgcgacgggggcaagaacggatttatggttagtccgatgaagccattggagattaaaacccagtgttctggtcctaggatggatcctaaaatttgtccagccgaccctgccttcttcagtttcattaataactccgacctatgggtggccaatattgagaccggtgaagaacgacgcctgactttttgtcaccaggggctcagcaatgtgctggatgatccaaaatcagcaggcgtcgcaacattcgtcatccaggaggagttcgataggtttacaggatattggtggtgccctacggcttcctgggagggcagcgaaggattaaagacactgcggattttgtatgaggaggtcgatgagagtgaggtcgaggtcattcatgttccaagtcccgctctggaggagcggaagacggattcttatcgctatcccaggacagggtccaaaaaccctaagatagcactgaagctggcagagttccagaccgactcccagggaaagattgtctccacccaggagaaggaacttgtgcagccttttagctccctgtttcctaaagtggaatacatcgcacgggcgggttggactcgggacggaaaatatgcctgggcaatgttcctcgacaggcctcagcagtggctgcaattggttctgctgcccccagccttattcataccctctaccgaaaacgaagagcaaaggttggcttcagctagagccgttccaaggaacgttcagccatacgtagtttatgaagaagtgacaaatgtgtggataaacgtgcatgatatattttacccttttcctcagtccgagggagaggacgaactctgttttctgagggctaatgaatgtaagaccggcttctgtcatctatacaaagtcacagctgtgctcaagtcacaaggttatgattggagcgagcctttttccccgggagaagacgaatttaaatgcccaatcaaggaggaaatcgccctgacatcaggagaatgggaggtgctagctcgccatggaagcaagatctgggtgaatgaggaaacaaagctcgtctattttcagggcacaaaagacactccactggaacaccatctgtacgtggtgagctacgaagccgccggggaaatcgtgcggttgaccacacccggtttttcccatagttgctctatgagccagaattttgatatgttcgttagtcactacagtagcgtgagtacacctccctgtgttcatgtctacaaactgtctggcccggacgatgatcctctgcacaagcagccccgattctgggcctccatgatggaggcagcttcatgcccccccgactatgtcccccctgaaatcttccactttcacacacgcagtgatgtcaggctgtacggcatgatttataaacctcacgcactccagccagggaagaagcatcccacagtgttgtttgtttacggcggtccacaggtgcagttagtgaacaatagtttcaaaggtataaaatatctccggcttaataccctggcttcactgggctatgctgtggtcgtcatagatgggagaggaagctgccagcgaggcctgaggtttgagggcgccctcaaaaatcagatgggtcaggtcgagatcgaggaccaggttgagggcctacagtttgtggcggaaaagtacggtttcattgacctgtctcgagtggccattcacgggtggagctatggcgggttcctgtctctgatgggcctaattcacaagccacaagtttttaaagtagccatcgcgggagctcctgttactgtgtggatggcatacgatactggatacacagaaaggtacatggatgtccccgaaaacaaccaacacggctacgaagctggtagcgtggccttgcacgtagagaaactgcctaatgagccgaacagattattgattctgcacgggttcctggacgaaaatgtgcattttttccatactaatttcctcgtttcacagctgatccgtgcaggcaagccataccagcttcagatttatcccaatgagcgacattccattcgatgtccggaatctggcgagcattacgaagtgaccctcctccacttcctgcaggagtatttgtag

SEQ ID NO: 24723 - DNA, 5073 bp, Artificial Sequence
  Description of Artificial Sequence: Synthetic coding sequence
atggactgcctgctggagctgagcgccaccgacaccaagatcgaggagtctagcagtcaatctttcgtcgcctcagaaaatcaagtgggtgcggcagagtctaagatcatggaaaagcggccagaagaagaatccgaagattcaaaaatggactcattcctggacatgcagcttacagaagatttagattccctaatacagaacgccttcgagaaacttaattcatcacccgacgatcaagtgtactctttcctgcccagccaggacgttaacagctttaacgattccagtgagtttattaatcccgacagtagcaacatgacgcccatcttttcgacacagaacatgaacctgaacggggagaacctcgagaactccgggagcactctgtctttgaaccctctgccatcccactcggtactcaacgagagcaaatgctttatcaaagacaatacacttgctttggagagcaactatccagaagactcactgttgagcagctctctgaatgtggcctctgattccatcgctggatgctcttccctgaaccagaagcaaaaggaacttcttgagtccgagtgcgtggaggcccagttttccgaagcccccgtggatcttgacgcatccgagccgcaggcgtgcctcaacctgcccggcctggacttaccgggtacgggcggggatcagaagagtacaagagtgagtgacgtgttcctgccttccgaggggtttaactttaaacctcacaagcaccccgaactgcctactaaaggcaaagatgttagctactgtcctgtcttagccccgcttcccctgctgctgccccctcccccaccgccccctatgtggaatccgatgatcccagccttcgatctgtttcaaggtaatcatggtttcgttgcccctgtagtcaccaccgcggcccattggcggagcgtcaactatacctttccgcccagtgtgatttcgcacacctcgccaacaaaggtctggcgtaataaagatgggaccagcgcatatcaagttcaggagactccagtctcccaggtggtgcgaaaaaaaaccagttatgtcgggctggtccttgttttactcagagggttacccggctcaggcaaatcattccttgcacggactctccaggaggataatcctagcggcgtgatcctgagcaccgacgattatttctatataaatggccaatatcagttcgacgtgaagtatctgggcgaagcccacgaatggaatcagaaccgggccaaagaggcttttgaaaaaaagatttcccctatcataatagataacaccaacctgcaggcctgggagatgaaaccttacgttgccctgtctcagaaacataagtataaagttctgtttcgcgaaccggatacctggtggaaatttaaaccaaaggagctggccaggcggaacattcacggtgtaagtaaggagaagattaccaggatgctggaacactaccagagattcgtgtcagtaccaataataatgagttcgagtgtgccagagaaaattgagaggattgaactttgcgcatacagctgcgaggaccgatccacgtcaccccgtgacgacgaggatatcattagtgagaaggaagagaatatcctaagcctaagcctaaagcatctcgagttcacggaggaaaagaaccttgacgtaacaaaggagaccatgttgcctgagaacgttgcttacctaagtaacgctgatttgaacaagcgccggaaggagataagcgacatgaaccccagcatccagtcagcactcatactcgaaacaccccatatgtacttttctgatagtgaaagcaagttacaagccacagataagtcagaaaatgagcaaatcgaaatggttgcggtcaaaggatattctaaaaccgatacagactccagtatggagagagtgtcccctagcacctgctgttccgaaaacaatcaggaggattgtgacctcgccaatagcgggcctctgcagaatgaaaaatcttccccaggcgagattgtagaggaacgagccacagttacgaagaaggcttttggtaaacaaaaaagcaaatctaccctcgaaaagttcccgaggcacgaactgtctaacttcgtgggggattggccggttgataaaacgattggacagcggacaaaacggaaccgcaaaaccgagaaaaccagtagtgtccagtccgacaagaagtataattacccacagagccacaaattagttaatagtgtctccgtgaacacagactgcgtgcagcaaaggggttcaccccatgaatctgtggaggatggtcgtaagtcacaatgtgacgatgcaagcgagccactgaactcatataaatacgacgcttacaaaaacatcgataaaaattcttttaatataatgggagactggcctagcagcgattctctcgcccagcgagaacatcgctcacggatgccgaagactggactttccgaaccgaacctcgagattggcaccaacgataaaatgaatgagatcagtctctccacagcacatgaggcgtgttgggggacctcaagccagaaattgaaaaccctgggttcatccaatctagggagctcagaaatgcttctttcagaaatgacatgcgagtctcagacttgtctgtcaaagaagtcccatgggcagcacacatctctgcctcttacattcaccaacagcgcacctaccgtgtccggcgtggttgagccacagacgctggccgagtgccaagagcagatgccaaaacgggatcccggcaaagaggtggggatgtgtacccagaccgagccacaagattttgcactgctttggaagatagagaaaaataagatctccatatccgactctatcaaagtactcaccggaaggttggatggattcaagccaaaggtattcaatatcaatacgaagagtgacgttcaggaagctataccctatcgggtcatgtatgataagagcacgtttgtcgaagaaagcgaactcacatcagcagatgagtcagagaatcttaatatcctgtgtaaactgtttggatcattctctctggaagctctgaaagatttgtacgagagatgtaataaggacattatctgggcgacctccctgctgcttgactcagagacaaaactgtgtgaggatacggaatttgaaaatttccagaagtcatgcgacgggagtcagatcggtcctttctctcttggtctcaacctaaaggaaatcatcagccaacgtggcacattggagaactctaactcaccagtgcccgaattctcccacggcatcgggatcagtaatgctgactcacagagcacatgcgatgctgagagggggaattccgagcaggccgagatgcgagcggtgacacctgagaaccatgaatccatgacctccatttttccatccgccgccgttggtcttaagaataataatgatattctgccaaactctcaggaagaattgctctacagctctaagcagagctttccaggcatcttgaaggccacaactcccaaagacatgtccgaaacagaaaaaaacttggtggtgaccgaaacaggcgacaatatacactctccaagtcacttctccgacatcttcaattttgtgtcatctaccagcaacctggaactcaacgaagagatttacttcaccgacagtctggaaattaaaagaaatgagaattttccaaaagactatgttaaattctctgacgaggaggagttcatgaacgaagatgagaaggagatgaaagagatcttaatggcggggtcctcactcagcgctggggtttccggcgaggacaaaacggaaatcctgaaccccacacccgcaatggctaaatcattgactatagactgcctggagctcgcgctgccccctgagctggccttccagctcaacgagctgtttggcccagtaggcatcgatagtggatcgctcaccgtggaggactgtgtagtgcacattgatctgaacttggccaaagtcatacatgagaagtggaaagagtccgtgatggaacgccaacgccaagaagaagtgtcttgtggtaaatttatgcaagatcccagcctggtggggcatacgggcttggacaatcccgaacaaaagagttcccagagaaccggaaaaaagttgctgaaaaccctgaccgcctcagaaatgttgccccttctcgaccattggaatacacaaacgaaaaaggtttcactgcgggagatcatgtctgaagaaatcgcgctgcaggaaaagcacaatctgaagcgggaaacactgatgtttgagaaggattgcgccacaaagctaaaggaaaaacagctttttaaaattttccctgctattaaccagaatttcctcgtggacatttttaaagatcataactactctctagaacatactgtacagttcctaaattgcgtgctggaaggcgaccccgttaagacggtggtcgcccaagaattcgtgcaccagaacgaaaacgtcacttcacatacaggccaaaaaagcaaggagaaaaaacccaaaaagctaaaggagacagaggaaactccctcggaacttagcttccaggacttcgaatatcccgactacgacgactacagggccgaggccttccttcatcagcaaaagagaatggaatgttactccaaagcaaaagaagcctacaggatcggcaagaaaaacgtggcaactttctacgctcaacagggtaccctgcacgaacagaaaatgaaagaggccaatcacttggccgccattgagatcttcgagaaggtgaatgcttcactcctgccacagaatgtgctggacctgcacggccttcacgtcgacgaagccctggagcacctgatgcgggtgttagaaaagaaaaccgaggagttcaagcagaacggcggaaagccgtacctgtccgtcatcaccggtcgcggcaaccatagtcagggcggtgtggccaggataaagcctgccgttataaagtatctcatctcacatagttttaggttctccgagataaaaccgggatgccttaaggtgatgcttaaatag

SEQ ID NO: 24724 - DNA, 477 bp, Artificial Sequence
  Description of Artificial Sequence: Synthetic coding sequence
atgggcagcggcagcagccggagcagccggaccctgcggcggcggaggagcccggagagcttgcctgccggaccaggcgctgcagcccttgaggggggtactcggagaagagtgcctgtcgctgccgctgaggtgcccggggctgcggctgaagaagctccagggcgagatcccagtccagtggccccccctgacggcagggatgaaacgcttagattactcgacgagctactggccgaatccgccgcctggggtccgcccgaaccagccccccgcaggcccgccagattgaggccaaccgctgtggcaggctctgccgtctgtgctgaacagagcactgagggtcaccctggatccgggaatgtgagcgaagctccggggtcgggcaggaagaagcctgaacgacccgccgcaataagctatgatcactctgaagaaggactcatggcaagcattgagagagagtactgccggtag

SEQ ID NO: 24725 - DNA, 738 bp, Artificial Sequence
  Description of Artificial Sequence: Synthetic coding sequence
atggagaagaccgagctgatccagaaggccaagctggccgagcaggcggagagatacgacgatatggcaacttgcatgaaagcggttacagagcagggagctgagctaagcaatgaagagagaaacctgctgtctgttgcttataagaatgtcgtgggaggtcgccgcagcgcctggcgtgtgatttctagcatcgaacaaaagaccgatacctccgacaagaaattacagctaataaaagactaccgcgagaaggtcgaatcagaactgcgctccatctgtaccaccgttctagaacttctggataagtatcttatcgccaatgcaacgaacccggaatctaaggtgttctatcttaagatgaaaggggactacttccggtatttagcagaggtggcctgcggcgatgacagaaaacagaccattgataactctcaaggcgcctaccaggaggctttcgacatcagtaagaaggagatgcaaccgacacaccccattagattgggacttgcgctcaatttctcagtgttttactatgagatcctgaacaacccggagctcgcctgcactctggccaaaaccgcttttgatgaagccattgccgagctggacacgctaaacgaagacagttataaggatagcacattaatcatgcagctgctgagggataacttgactctgtggactagcgatagtgccggggaagaatgcgatgcagcggaaggcgctgagaactag

SEQ ID NO: 24726 - DNA, 1014 bp, Artificial Sequence
  Description of Artificial Sequence: Synthetic coding sequence
atggagcagccctggcccccccccggcccctggagcctgccccgggcggagggcgaggcagaagaggaatctgattttgacgtcttcccaagtagccctcggtgcccacagctccctgggggaggtgcacagatgtattctcacggaatagaattagcttgccagaagcagaaggaattcgtaaaatccagtgtggcttgtaaatggaacttggcggaagcacagcaaaaacttggctccttagcgctgcataactccgaatctctcgatcaggagcatgctaaagcgcagactgctgtgagcgagcttcgccaacgggaggaggaatggcgccagaaggaagaggcactcgtccaaagagaaaaaatgtgcctatggtctaccgatgccatttccaaggatgtctttaacaaatctttcataaatcaagataaaaggaaagataccgaggacgaagataaatcggagagcttcatgcagaaatatgagcagaagatcaggcatttcggcatgctgtcaagatgggatgactcgcagaggtttctgtcagatcacccttatctggtctgtgaagaaacagctaaatacttgatcttatggtgtttccacctggaggcagagaagaaaggggccctgatggaacagattgctcaccaagccgtagtgatgcagttcataatggaaatggcgaagaattgcaacgtcgaccctcgggggtgctttaggttgttcttccagaaggcaaaggcagaagaggaggggtactttgaagcatttaagaatgaactggaagcgttcaagtcccgggtgcggctctacagtcagagccagtctttccagcccatgacggtgcagaaccacgtgccccatagcggagtgggctctatcggcctgctggaatccctgccacagaacccagattacctgcaatacagtataagtacagcgctgtgcagcctgaactccgtagtgcacaaggaagatgacgagcccaaaatgatggacaccgtgtag

SEQ ID NO: 24727 - DNA, 927 bp, Artificial Sequence
  Description of Artificial Sequence: Synthetic coding sequence
atggagcagccctggcccccccccggcccctggagcctgccccgggcagagggcgaggcagaggaggaatccgacttcgacgtcttccctagttcccctcgctgtccgcagttaccggggggaggcgcacagatgtacagccacgggatagaattggcctgtcaaaaacagaaagagttcgtgaaatcttcagtcgcctgtaaatggaatctggccgaagcccagcaaaaattaggctcactggctctgcacaactccgaatcgttagatcaggagcacgccaaggcccagacagctgtcagcgaactgcggcagcgtgaagaggagtggaggcagaaagaggaagccctggtgcagcgcgagaagatgtgtctttggagcactgatgctatctcgaaggatgtcttcaataaatccttcatcaatcaggacaaaaggaaagacactgaagatgaggataagtcagagtcgttcatgcagaagtatgaacagaagatccgccatttcggaatgctttctaggtgggatgattcccaacgattcctgtccgaccacccatacctcgtgtgcgaagagaccgccaagtacctgatactgtggtgtttccatcttgaggcagaaaaaaaaggtgctcttatggaacaaattgcccatcaagctgtggtgatgcagtttatcatggagatggctaagaactgtaacgtggatcccaggggctgctttcggctattcttccaaaaggccaaagcagaagaagagggatactttgaggcatttaagaacgagctggaagcctttaaatccagagtgcggctctattctcagagccaatccttccagcccatgacagtgcagaaccatgtacctcacagcggtgtgggcagcatcggcctgctagagagcctcccacaagccccaagattctag

SEQ ID NO: 24728 - DNA, 4227 bp, Artificial Sequence
  Description of Artificial Sequence: Synthetic coding sequence
atgtggagcctgaccgccagcgagggcgagagcaccaccgcccacttttttcttggtgccggcgacgaaggtttaggtacgcgaggtatcggtatgcggccggaggagagcgacagcgagctgttggaagatgaagaggatgaggtgcctccagagcctcagataattgttggaatttgtgcaatgacaaagaagtctaagtccaagccaatgactcagatccttgagaggctgtgtagattcgattaccttaccgtggttatcctgggtgaggatgtaattctgaacgagcccgtcgaaaattggcccagttgccactgccttatttcgtttcacagcaaaggcttcccactggacaaagccgtggcgtacagtaagctgagaaacccatttctgatcaacgacctggccatgcagtactatatccaagatagacgcgaagtttacagaattctgcaggaggagggtatcgatctgccaaggtatgccgtgttaaatcgggatccggcacggcccgaggaatgtaatctgattgagggggaggatcaagtggaagtgaatggcgccgtatttcctaagccctttgtggaaaaacccgtgtccgccgaagatcacaatgtttatatctattacccatcctccgctggtggcggcagccagcgtctgtttcgcaagatcggcagtcgttcctctgtttattctccggagagttctgttcgcaaaacaggctcttacatttacgaagagtttatgccgaccgacgggactgacgttaaggtctacacagtcggccctgactacgcacacgccgaggcccgtaaatccccagccttagatgggaaggtcgagcgcgattcagaagggaaagagatcaggtacccagtgatgctgaccgccatggagaagctcgttgcccggaaggtgtgtgtcgcctttaagcaaactgtctgcgggttcgatcttctacgcgcaaatggacattcttttgtgtgtgatgtgaatggcttcagcttcgtgaagaattctatgaaatactatgacgactgcgcaaagatcctgggcaacacaatcatgagggaactcgctccccagtttcagattccttggtctatccccaccgaggccgaagatatccccattgtgcccacaacttcaggcacgatgatggagctccggtgcgtgatcgccattatcagacacggagaccgcacaccaaagcagaagatgaagatggaagtcaagcacccaagatttttcgcactatttgagaaacatggtggatataagaccggcaaactgaaactgaagcgtcctgaacaactacaggaggtgctggacatcacacgcctgctcttagctgagctcgagaaagagccaggtggcgagattgaagagaagacagggaagctggaacagcttaaatccgtgttggaaatgtacgggcatttcagcggtattaacagaaaggtgcagctcacctattatccacatggggttaaagcaagcaatgaggggcaagacccgcaaagggagaccctcgcacccagtctcctgttagtcctcaagtgggggggtgagcttacaccggcaggtagggtgcaggcggaagagctaggaagggcattcagatgtatgtatcccggaggccagggggactatgccggattccccgggtgcggcttgctgcgcttacacagcacttttcggcatgatcttaagatctatgcttccgatgaagggcgggttcaaatgaccgctgccgcattcgcaaaagggctgttagcactggagggtgagctaacgcctatccttgtccagatggtgaagtctgcaaacatgaacgggctccttgattcagacggcgattcactgtcctcctgccagcacagagtgaaggcccgtctgcatcatatcctccagcaggacgcaccttttggccccgaagactacgaccaactcgctccaacacggtccactagcctgttaaacagcatgaccattattcagaacccggtaaaggtttgtgaccaggttttcgccctaatcgagaacctcacgcaccagataagagagcggatgcaagatcctcggtccgtggatctgcagctgtaccacagcgaaacactggagttgatgttgcagagatggtcaaagctggagcgagactttagacagaaatcaggtagatacgacatcagcaagatacccgacatttacgactgtgtgaagtacgacgtccagcacaacggctccctggggttgcaaggaaccgccgagctgctgcggttgtctaaagccttggcagatgtagtaattccacaggagtacgggattagccgcgaggagaaactcgagatagcggtgggcttttgtctgccactgctcaggaaaatcttgctcgacctgcagcgtacacacgaggacgagtctgtgaataagctccaccctctgtattcccgcggggtcctgagtcccgggaggcacgtgcggaccagactttacttcacttccgagtcacatgtgcattccctgctcagcgtatttcgttatggggggttacttgatgaaacacaggatgcacagtggcagcgagctctggactatctttccgctatctctgagctgaattatatgactcaaattgtgattatgctgtacgaggacaacacccaggatcccttgtcagaggagagatttcacgttgagctgcacttttcacccggggtaaagggcgtcgaagaagagggtagtgccccagctggttgcggctttcgacccgcctccagcgaaaacgaagaaatgaaaaccaaccaaggctctatggagaatttgtgccccgggaaggcctcggacgaacccgatcgggctctgcagactagtccacagcccccagagggacccggactgcctcgaaggtccccacttattcggaatcgcaaggcgggcagcatggaggtactgtccgagacatcatccagccggcctggcggttacagactgttttcgtcctcacgccctccgaccgaaatgaaacagtccggtctcggtagtcagtgtaccggccttttctctactaccgtcctgggaggcagtagcagtgcccctaatcttcaagactatgccagaagccatggtaagaaactgcctcccgcttctttgaagcatcgggatgggtttgaaggctgctcaatggtgcccaccatttatccactggagacgctgcataacgctttaagtctgcggcaggtgagtgaatttctgtctcgggtctgccaaaggcacactgacgcacaggcacaggccagtgcggcccttttcgacagtatgcattcaagtcaagcatctgataatccctttagtccaccccgtacgctgcatagcccacccctccagctccaacagaggagtgagaagcctccctggtattcgtcgggcccgtcatccacggtgagctctgccggccctagtagtccaacaaccgttgatggcaatagccaattcggcttcagcgatcagccgagtttgaattctcatgtcgccgaagaacaccaagggctgggcttgctccaggagactcccggctctggagctcaggagctgtccattgagggggagcaagaactcttcgaacccaaccagtcaccccaggtccccccaatggagactagccagccctatgaagaagtctcccagccctgtcaggaagtcccagacatatctcaaccttgtcaggacatttccgaggcattaagccagccttgccagaaggttcccgacatctctcaacaatgtcaggagaaccatgataacgggaaccacacctgccaagaggtacctcatatatcccagccttgccagaaatcgagtcagctgtgtcagaaggtcagtgaagaggtctgccagctgtgccttgagaactctgaagaagtgtcccaaccatgtcagggtgtgtccgtcgaagttggcaagttagtgcacaagtttcacgtcggcgtagggagcctggtccaggaaacgttagtggaggttggttcacccgcagaagaaattcctgaagaagttattcaaccctatcaggagttcagtgtcgaggttggcagactagcgcaggagacctcagcgatcaatctccttagccaaggcatcccggagattgataaaccaagtcaggaatttcccgaagaaattgatcttcaggcccaggaagttcctgaggaaatcaactag

SEQ ID NO: 24729 - DNA, 528 bp, Artificial Sequence
  Description of Artificial Sequence: Synthetic coding sequence
atgatcctgaacgtgctggagtacggcagccagcaggtggccgaccttacgctgaacttagacgactacatcgatgctgagcacctgggagacttccaccgcacctataagaacagcgaagagcttcgctcccggattgtgagcgggatcatcacaccaatccacgaacaatgggaaaaagccaatgtatcaagtccccaccgagaattcccccctgcaacggctcgcgaagtcgaccccctacgaatcccaccccaccacccccataccagtcggcagccaccctggtgtgatccactcggacccttcgttgtgggaggcgaagacctcgatcctttcggaccaagacggggaggcatgatcgtcgatccactccggtcaggctttccacgtgctctgattgacccaagttctggcctgcctaaccggttacccccaggcgcagtccccccaggtgcccgcttcgacccatttggcccaatagggacatccccccctgggccccgccccgacaggcgcggtcagtag

SEQ ID NO: 24730 - DNA, 552 bp, Artificial Sequence
  Description of Artificial Sequence: Synthetic coding sequence
atggccggcctggaggtgctgttcgccagcgccgcccccgccatcacttgcagacaggatgcgttggtgtgtttcttgcactgggaggtcgtcactcatggatacttcggcctgggtgtgggtgaccaacccggacccaatgataaaaagagtgagctgctgcctgcaggctggaataacaataaagacctttatgttctgcgatacgagtacaaggatggatccagaaaattgctggtcaaagccattaccgttgaaagtagcatgattttaaatgtgctcgagtacgggagccaacaggtcgctgaccttacactcaacttagatgattacatagatgctgagcatctcggcgattttcacaggacctataagaattctgaagaactgcgatcacggattgtgtccggcatcattactccaatccacgagcagtgggaaaaggccaacgtgagctctccccacagagaattcccacccgccactgcacgcgaagttgaccccctaaggatcccccctcaccacccacacacgtcgcgacagcccccttag

SEQ ID NO: 24731 - DNA, 888 bp, Artificial Sequence
  Description of Artificial Sequence: Synthetic coding sequence
atgcccgtgcacaccctgagccccggcgcccccagcgcccccgccctgccatgtaggctcaggacacgcgtacccggctacctgttaaggggccccgccgatgggggcgcgaggaagccatcagccgtcgaacgtttagaagccgataaggccaaatacgtaaagtcgcttcacgttgccaatactcgccaggaacccgtgcaacctctgttgagtaaacagcccctcttcagccccgagaccagaagaactgttctgacaccctcacggagagcgctcccaggaccgtgccgaaggcctcagcttgatctcgatattctgagtagtctgatagacctctgtgactcaccagtctctcccgccgaagcatccaggacccccggaagagctgagggtgctggtaggcctcccccagccactcctcccaggcctcctcccagcacctcagctgtgcgtcgggtggatgtaaggcctttgcctgcttccccggcccggccatgtcccagccccggccctgccgccgcaagcagccccgctaggccgccggggctccagcgatccaagtcagacctgagtgagcgatttagtagagcggctgccgatctggagcgttttttcaacttctgtggcttggaccctgaggaggcaaggggtcttggagtggcgcatctggccagagcttcttctgatattgtgtccctggcagggccaagcgcaggccccgggtcatctgaaggcgggtgtagcagacgttcctctgtgacagtggaggagcgcgcacgcgagcgggttccatatggcgtgagcgttgtcgagcgtaacgcaagggtaatcaaatggctttacgggctccggcaggcccgtgaatccccagcagctgagggctag

SEQ ID NO: 24732 - DNA, 888 bp, Artificial Sequence
  Description of Artificial Sequence: Synthetic coding sequence
atgcccgtgcacaccctgagccccggcgcccccagcgcccccgccctcccatgccggctgcgtactcgggtgccaggatacctcttaagggggcccgctgatgggggggcccgcaaaccttctgccgtcgaaaggttagaagctgacaaggcaaagtatgtaaaatctctgcacgtagccaacactagacaggagccagtgcagcctttactctctaaacagcctctgttctccccagagacaaggaggaccgtgttgactccctccaggagggccttacctggcccttgtcggagaccccagcttgacctggacattctgagttctctcatcgacctatgcgattctcctgtctcacccgctgaagcatcaagaacacccggaagagcagagggtgcaggtagaccgccgcccgctactccgccaaggccacccccttccacttccgcagtgagaagggtcgatgtcagacctcttcccgcttcacctgcaaggccttgccccagtccaggccctgcagccgcctcctcccccgctaggccacctggcctccaaagaagtaaaagcgaccttagcgaaagattttccagggccgctgctgatctggagcggttctttaatttttgcggcctcgatcccgaagaggctcgggggcttggagtggcccatctggcccgagcttctagcgatattgtgagcttggcaggacccagtgccggacctggctcttcagaaggcggatgcagccgccggagcagcgttaccgtggaagagcgcgctcgagaacgcgtgccctatggcgtgtcagttgtggagcggaacgcacgcgttataaaatggttgtacgggttacgtcaagctcgggagtcacccgctgccgagggttag

SEQ ID NO: 24733 - DNA, 414 bp, Artificial Sequence
  Description of Artificial Sequence: Synthetic coding sequence
atgggcctgcgggccggcggcaccctgggccgggccggcgccggcagaggcgccccggaggggcctggaccctccggcggagcccaggggggatcaatccactccgggcgtatcgcagccgtacataatgtgcccttatctgttttgatacggcccttaccttccgtgttagatcccgctaaagtgcagagtctggtggatactatacgcgaggatcccgacagtgtgcctccaatcgacgtactttggattaagggcgctcagggaggcgattatttttattctttcggtggctgccacagatatgctgcatatcagcaactccagcgcgagaccattcccgctaaactggtgcagagtacactttctgatttacgtgtatacctcggggcttcaactcccgacttgcagtag

SEQ ID NO: 24734 - DNA, 1731 bp, Artificial Sequence
  Description of Artificial Sequence: Synthetic coding sequence
atgaagtgccactacgaggccctgggcgtgcggcgggacgccagcgaggaggaactcaagaaggcctataggaaactggctttaaagtggcatcctgataagaatctagataacgctgcggaggccgcagagcagttcaagcttatccaggctgcatatgacgtgctatccgacccgcaggagagagcatggtacgataatcatagagaagcgctcctcaaaggcggatttgacggcgagtaccaggacgattccctggatctcctccgctatttcactgtcacctgctattcagggtatggggacgacgagaagggcttttatacagtctacagaaatgtctttgaaatgatcgcgaaagaagaattggagagcgtcctggaggaagaggtagatgatttccctacatttggggactcccagtctgactacgataccgtggtccaccccttctacgcctattggcagagtttctgcacccaaaaaaacttcgcctggaaggaggagtacgacactcgccaggccagtaacagatgggaaaagagggcgatggaaaaggaaaacaaaaaaattagagacaaggcaaggaaagagaagaacgaacttgtacgtcagctcgtagccttcatcagaaagcgagacaagcgagttcaagcacacagaaagctggtggaggagcagaatgcggagaaagccagaaaggccgaagaaatgaggaggcaacaaaaactgaaacaggcaaagcttgttgaacagtatagagaacagtcatggatgaccatggcaaatctggagaaagagctgcaggaaatggaggcccgttacgagaaggagtttggagatgggtccgatgaaaacgaaatggaggagcacgagttgaaagacgaagaggatggaaaagacagcgacgaagctgaggatgctgaactgtacgacgatctctactgcccggcatgcgacaagagctttaaaacggaaaaggctatgaaaaatcacgagaaaagtaagaagcaccgcgaaatggttgctctgctgaaacagcagctcgaggaagaagaggagaacttctcccgtcctcaaatcgatgagaatccattggacgataactccgaagaagaaatggaggatgctccaaagcaaaaattgtctaagaagcaaaaaaaaaaaaagcagaagcctgcccaggatgttccagggaaggattcttatctgcctgcagcacatttccagatggcttgggggaagaagtgcgtcctgggcgaacggcgggacggcgagtccgagcataagtgcgcaaagatgctgctggagaatcgacagaactacgacgacaattttaacgttaatgggccaggcgagggtgtgaaggtggacccagaggatacgaatctaaaccaggacagcgccaaagagctggaggactctccccaggaaaacgtgagtgttacagagatcatcaagccttgcgacgaccccaagagcgaggcgaaatccgtccctaagccgaagggaaagaaaaccaaggacatgaaaaaacccgtcagggtcccagcagaaccacaaacaatgagcgtcctcatctcttgtacaacttgtcacagtgagtttcccagtagaaacaaattattcgatcacctgaaagcaactggacacgctagagcgcccagtagtagctctctgaattcagccacatcgagccagagcaaaaaggagaaacgaaaaaatcgatag

SEQ ID NO: 24735 - DNA, 798 bp, Artificial Sequence
  Description of Artificial Sequence: Synthetic coding sequence
atgctggccctgaccgtgctggagacctgcgtgaagaactgcggccaccgctttcacgtgctggtggcatcacaggatttcgtcgagagtgtactcgtgcgaaccatccttcccaaaaataacccaccaacgatcgtgcacgacaaggtgttaaatctcatacaaagctgggccgatgcttttcggtcctctcccgacctgaccggcgtggttactatctatgaagatctgagaagaaaggggctggaatttcccatgaccgatctggatatgctgagtcccatccacacaccccagcgcactgtgtttaatagcgagactcagtccggccaagattcagtcggaactgactcttctcagcaagaagattccgggcaacatgccgctccccttcccgctcctcccatattaagcggtgacactcctattgcccctacgccggagcagatcgggaagcttagatcagagctggagatggtttccggaaatgtgcgcgtgatgtctgagatgcttacggagcttgtgccgacccaagctgagccagcagacctggagcttctccaagagctgaaccggacctgtcgggctatgcaacaacgggtgcttgaactgatcccccaaatcgctaatgagcagctaaccgaggagctgctgatcgtgaacgacaacctcaacaatgtgtttctccgtcatgaacgagacaggggactcaccgtgttacccaggcttgtatcaaactcctggcctcaggcagtgctgccaccatggcctccgaaggccctggtgctacaggcctag

SEQ ID NO: 24736 - DNA, 6273 bp, Artificial Sequence
  Description of Artificial Sequence: Synthetic coding sequence
atggacgaggtggagcaggaccagcacgaggcccggctgaaggagttgttcgattcctttgataccaccgggaccggtagcctgggacaggaggagctcacggacctgtgtcatatgctctcactggaggaagtagcccctgtgctccaacagactctgctgcaggacaatttacttgggcgagtgcatttcgatcaattcaaagaggccctcatcttaatcctgtccagaactctctcgaacgaagaacacttccaggagccagattgtagccttgaagctcagccaaaatatgttagggggggtaagcgctacggaagacgcagcctgcctgaatttcaggagtcggtagaggaatttccggaagtgactgtcattgaaccattggacgaagaagctaggccatcccacattccagccggagactgttccgagcactggaagacacaacgcagtgaggagtatgaggccgaagggcaattacggttttggaaccccgacgacctgaatgcgagtcagtctggatcgtccccacctcaggactggattgaggagaagcttcaggaggtctgcgaagaccttggcataacaagggacgggcatctcaacaggaagaaactagtgtctatctgtgagcagtatggcctccagaatgtggatggggaaatgttggaagaggttttccacaatctcgaccccgacggtaccatgtccgtggaggacttcttttatggactcttcaagaatggaaagtccctaaccccttccgctagcaccccttaccgacaacttaagaggcacttgagcatgcagtcctttgatgagtctgggcgcaggacaacaaccagctctgctatgacatcgactatcggttttagagtgttcagctgcctggacgacggaatgggtcacgccagtgtggaaagaattctggatacctggcaggaggaggggattgagaattctcaggaaattctgaaagctctggacttttccctcgacggaaatataaacctgactgagctgactctggccctcgagaacgagcttctggtcactaaaaatagtatacatcaagccgccttggcatcctttaaggctgaaatacgacacctcctcgagagagttgaccaggtggtcagggagaaggaaaagctgaggtccgatctggacaaagccgagaagctcaagagtctgatggcatccgaggtagatgaccatcacgctgcaatcgagcgaagaaatgaatacaatttgaggaagctggacgaagagtacaaggaacgaatcgccgcactgaaaaatgaactgcgaaaggaaagggaacagatcttgcagcaggcgggcaagcagagactggagttggagcaggagattgaaaaggcgaagacagaagagaattacatccgggaccggcttgccctaagtctcaaagaaaattcgagattggagaacgagctcctggaaaatgctgaaaaactggccgaatatgaaaaccttaccaataagctgcagagaaatctagagaacgtccttgccgagaagttcggtgatttggatccctcttcagccgagtttttcttgcaggaggagcggttaacccagatgcgcaatgagtacgagcggcagtgtagggtcttgcaggaccaggtggacgaactgcaatccgagttagaggagtacagggcacagggtagagtgcttaggctcccgctgaagaattcgcccagtgaggaggtggaagccaattcggggggaattgagccagagcacgggctcgggtcagaagaatgcaatcctcttaacatgagcattgaggctgaattggtgattgaacagatgaaagagcagcaccacagagatatctgttgtctgagactcgagctcgaagataaagtgcgccactatgagaagcagttggacgagaccgtagtcagctgtaaaaaggcgcaggagaacatgaagcagcgccatgagaatgagacacatactttagaaaaacagattagtgatctgaaaaacgagattgctgagcttcagggacaggcggctgtgttgaaggaagctcaccacgaagcaacgtgcagacatgaggaggagaaaaagcagctacaagtgaagctggaagaggagaagactcatctccaagagaagctgcggctacaacacgagatggagctgaaggccagattaacccaggctcaggcaagttttgagagggagcgtgagggactgcagtccagtgcatggactgaggagaaggtacgaggtcttacccaggaactggagcagttccaccaggagcaactgacatcgttagtcgagaagcacaccttagagaaagaggagctcaggaaagaattactcgaaaagcatcagagggagctccaagagggacgggagaaaatggagactgagtgtaaccgccgtaccagccaaatcgaagcccagtttcagtctgactgtcagaaggtgactgaacggtgcgagtccgcactgcagtctctagaaggcagatacaggcaggagcttaaagatctccaggaacagcagcgagaggagaaaagtcagtgggagtttgagaaagatgaattaacgcaggaatgcgccgaggcccaggagctgctcaaggaaaccctcaagagagaaaagacgacatcactggtgctgacacaggagcgggagatgttggagaaaacctataaggagcatctcaactcaatggtagtagagcgtcaacagctgctccaggacttggaagatcttcgcaacgtctctgagacccagcagtccctgctgtccgaccagatcctagagttgaagagctcccacaagagggagctgagagaaagggaagaggtgctatgccaagccggcgcctcggaacaacttgcatcccagaggctagaacggcttgagatggagcacgaccaagagaggcaggaaatgatgagcaagcttcttgccatggaaaacatccataaggccacgtgtgagaccgccgaccgcgagcgggctgaaatgagcacagaaatatcccgcctgcagagtaagattaaggagatgcagcaggcgaccagtcctctttcaatgctccagtctggatgccaggtaattggggaggaagaagttgaaggtgatggagcccttagcctgctccagcagggcgaacagttgctggaggaaaacggcgatgtgttgttaagcctgcagagggcccatgagcaggccgttaaagagaacgtgaaaatggcgactgaaattagtcgactgcaacagcgcctgcagaaactcgaaccgggattggtcatgtcatcctgccttgatgagcctgcaactgagtttttcgggaacactgcggagcagacagaacagttcctgcagcagaataggaccaagcaggtcgagggagtcacacgccggcacgtgttaagtgatctagaagatgacgaagtgagggatctcggctccaccggtactagttctgttcagcgccaggaggtcaaaatcgaggagtcagaggcctccgttgaagggttctctgagctcgagaactctgaggagacgcgaacagagtcctgggagttgaagaaccagatctctcagctccaggaacagctgatgatgctgtgcgctgactgcgacagagcctccgagaagaagcaggatttgctattcgatgtgagtgtgctgaagaagaagctgaaaatgctcgagcgcatacctgaggcaagccctaagtataaactcctgtacgaggacgtttcacgtgagaatgactgcctgcaggaggaactacggatgatggaaactaggtacgatgaggctttggagaataataaagaactgaccgctgaggtttttcggttgcaggacgagctcaagaagatggaagaggtcaccgagacttttctttccctcgaaaaatcttacgatgaagtaaaaattgaaaatgaaggtctcaatgtgcttgtgctaagattgcaaggcaagatcgaaaagctgcaagagtccgttgtacagcgctgtgactgctgcctgtgggaagcttcactcgaaaatcttgaaatagagccagatggaaacatcctccagctgaatcagacactggaggagtgcgtaccgcgagtgaggtcggtgcaccacgtcatcgaggagtgcaagcaggagaaccagtacctagagggtaatacccaactgctcgagaaagtcaaggcgcatgaaattgcttggttacatggcactatccagacccatcaggaaaggcctcgagtgcaaaatcaagtcatcctcgaagaaaacaccacacttctcggctttcaggacaagcattttcagcaccaagctacaatcgctgagctggagctggagaagaccaagttgcaggagctaaccagaaaattgaaagagcgagtgactatcctggtgaagcagaaagatgtactgtcacacggggaaaaggaggaagagctgaaggccatgatgcatgatctgcaaatcacctgctccgaaatgcaacagaaagtcgagttgctccgatacgagagcgaaaagctccaacaggagaattccattctgaggaacgagatcactaccttgaacgaagaggactcaatctctaacctgaagctgggcactttaaacggaagtcaggaggagatgtggcagaaaacggaaactgtgaagcaggagaacgccgctgtgcaaaagatggtggaaaaccttaagaaacagatttctgagctcaaaatcaagaatcaacagcttgaccttgaaaacacagaactatcgcagaagaatagccagaaccaggagaaattacaggaactgaaccagcgcctgactgaaatgctgtgtcagaaggaaaaggagccgggtaattcggcacttgaggagagagaacaggaaaagtttaacctaaaagaggagctcgagcgttgtaaggtccaatcatcaactctcgtgagtagtctggaagcagagctgtctgaggtgaagatacaaactcacatcgtgcagcaggaaaatcacttactgaaggacgaactggaaaagatgaagcaactgcataggtgtccagacctcagcgattttcaacagaagattagtagtgtcctatcttataatgagaaattgctcaaagagaaggaggccctgagcgaggaactgaattcgtgcgtcgataagcttgccaagtccagcctgcttgaacacaggattgcaacaatgaagcaggaacagaaaagctgggagcatcaaagcgcttccctcaaatcacaactggtcgcgtcccaagagaaggtgcagaacttagaggataccgtgcagaacgttaacctacagatgtctcgcatgaaaagcgatctccgggtgacccagcaggagaaggaggccctgaagcaagaggtcatgtccttacataaacagctgcagaacgctggggggaagtcttgggcaccagagatagcaacccacccttccggcttgcataaccagcaaaagcgtctgtcttgggacaaacttgatcatctaatgaatgaggagcagcaattactctggcaagagaacgaaaggctgcagactatggtacagaataccaaagccgagctaacccattcacgagaaaaggtccgccagcttgaatccaatctgctgcctaaacatcagaagcacctaaacccctccggtaccatgaatccgacggagcaggaaaagctgagcctgaagcgcgagtgtgatcaatttcagaaggagcagtcccccgccaacagaaaggtgtctcagatgaacagccttgagcaggagcttgagacgattcacctagagaatgaaggacttaagaaaaagcaggtgaaactggacgaacagcttatggagatgcaacacttaagatcgactgcaacacctagccctagtcctcatgcttgggacctccaactactccaacagcaggcctgtcccatggtgcccagggagcaattcctgcaactccaacgacagcttctgcaggctgagagaatcaatcagcatctgcaggaggagttggagaaccggactagtgagaccaacactcctcaggggaatcaggagcaactcgtgaccgtgatggaagagcgcatgatagaggtagaacagaaactgaaacttgtcaagaggctgttgcaggagaaggtgaaccagctgaaagagcaggtgtcattgccaggacacctttgttcacctacctcacactcttccttcaattcctcatttacctctctttactgccactag

SEQ ID NO: 24737 - DNA, 4134 bp, Artificial Sequence
  Description of Artificial Sequence: Synthetic coding sequence
atggacgaggtggagcaggaccagcacgaggcccggctgaaggagttgttcgatagttttgataccacaggaacgggcagtttagggcaggaagaactgactgatctctgtcatatgctgagtctagaggaagttgcgcccgtgttacagcagactctgcttcaggataacttgttgggccgcgttcacttcgaccaatttaaagaggcgttgattctgatcctgagtcgtacactgtcaaacgaggaacacttccaggagcccgactgttcactggaggcacagcccaaatatgtgaggggcgggaaaaggtatggaaggcgaagtctgccagaatttcaggaaagcgtagaggaatttcctgaggtgaccgtgattgaacctctggacgaggaggcccggcccagtcacatccccgccggcgactgttccgagcactggaaaactcaaaggtcggaggagtacgaggccgaggggcagctgcgcttctggaatccagatgatctgaatgctagccagagcggctcctccccacctcaggattggatagaagagaagttacaggaggtctgcgaagacttggggatcacacgcgatggccatttaaacagaaaaaaactggtgtctatttgtgagcagtacggtctgcagaatgtcgatggtgagatgctcgaggaggtgtttcacaatttagatcctgacggcaccatgtcagttgaggatttcttttacggactctttaagaacggtaagtcactcaccccgtcagcgtccacaccataccgacaactcaagagacatctttcaatgcagtcattcgacgagtcgggtcgacggacgacaacctcctcagccatgacctccaccattggatttagggtgtttagttgcctagatgatggcatgggccacgcctccgttgagcgcattctggatacatggcaggaggagggcatagaaaattctcaggagatattgaaagctctggacttttccttagacgggaacatcaatcttactgaactcacattggctctggagaacgagctgctcgtgaccaagaactccattcaccaagctgcgctcgccagcttcaaggctgaaatcaggcatctgctggaaagagtggaccaggttgttcgagaaaaggagaagcttaggtcggacctggataaagccgaaaaactgaaaagtctgatggcttctgaagtggatgatcatcacgccgccatcgagaggcgtaacgaatacaacctgcgaaagctcgacgaggagtacaaggaaaggatcgccgcattgaagaatgagctccggaaggagagggagcagatacttcaacaagccggcaagcagcgcctcgagctggagcaggaaatcgagaaggccaagacggaggaaaactacatacgcgataggctggctctgtcactgaaggagaactccaggctggaaaatgagctgcttgagaatgccgagaagctcgcagagtacgagaaccttaccaataagctccagcggaatctggaaaatgtgttagccgaaaagtttggggatcttgatccatcctcagcagagtttttcctccaagaggaacggctgacacagatgaggaacgaatacgagcgccagtgcagagtcctgcaggaccaggtcgatgagcttcaaagcgagttggaagagtaccgtgctcaaggcagggtgctccgattgccactaaagaacagcccatctgaagaagttgaggctaactctgggggcatcgagccagaacacggtttaggctccgaagaatgtaatcctctgaacatgagcattgaggccgagcttgtcatagaacagatgaaggaacaacatcaccgcgacatctgttgcttaaggttagaactggaggataaagtgcgccattatgagaagcaactagatgaaactgttgtctcttgtaaaaaagctcaagaaaatatgaaacagagacacgagaacgagacacacacactggagaagcaaataagcgatctgaagaatgaaatcgctgagctgcaaggtcaggcagccgtgcttaaggaggcccatcacgaggcgacatgccgccatgaggaggagaagaagcagctgcaggttaagctggaagaagagaaaacacacctgcaggagaagctgaggctgcaacatgaaatggagctgaaggccaggttgacccaggcccaagcatcttttgagcgagaaagagaagggctccagtcaagcgcgtggaccgaagagaaggtgcgcggcctgacccaggagctggagcaattccatcaggaacagctgactagtcttgtcgagaagcataccctggagaaggaggaattacgcaaggagctcctagaaaagcaccagcgagaattgcaggagggacggtacgagtccgagaagcttcagcaagaaaactctattcttcggaatgagatcacgactttaaatgaggaagattccatttctaacctgaagctcggcaccctgaacgggtctcaggaggagatgtggcagaagactgaaaccgtcaaacaggagaatgcggcggttcagaagatggtggagaatctcaaaaaacagatatctgagctgaagattaagaaccaacagctcgaccttgaaaacacagaattgagtcagaaaaactcgcagaatcaagagaagctgcaggagcttaatcaacgccttacagaaatgctgtgccagaaggagaaagagcccgggaacagcgccctggaggaaagggagcaggagaaattcaatctgaaagaggagctggagaggtgcaaagtgcagtcatcaacactggtgtcttcactcgaagccgaactgtcagaggtgaagatccagacccacatcgttcagcaggagaaccacctcctgaaggatgagcttgagaagatgaaacagctccaccgttgccctgatctttctgattttcagcagaagatatccagcgtcctgtcatacaacgagaaattgctgaaagagaaagaagcactgtcagaagaactcaattcttgtgtggacaagctggcaaagtcctcactgctggagcatcgcatcgcaactatgaagcaggaacagaaaagttgggaacaccaaagcgcgagtctcaaatctcaactggttgcatctcaggagaaagtccagaacttggaggatactgtgcagaatgttaaccttcagatgagtaggatgaagtcagacctgcgggtaacccaacaggaaaaagaagcactgaagcaggaggtcatgtctttacataagcaactccagaatgcaggtgggaagtcatgggcccctgaaatcgctacccaccctagtgggctgcacaaccagcagaagcgccttagctgggataaactcgatcatctgatgaatgaagagcagcagctgctgtggcaagagaacgagcgattgcagacaatggtacagaataccaaggccgaactcacccattcccgcgaaaaggttcgccagcttgagagcaacctgctgcccaagcaccagaaacacctgaaccctagcggaaccatgaaccctaccgaacaggagaagttgtctcttaaaagggaatgtgatcagttccagaaggagcagtccccggccaatcggaaagtgtcccagatgaacagtctcgagcaggagttagagactatccacttggagaatgagggtttgaagaagaaacaggtgaaacttgacgaacagctcatggagatgcagcacctgcgttccacagctactcccagcccctctccccacgcctgggacctccagttacttcagcagcaagcctgccccatggtgcccagggaacagtttttacagttgcagcgccaactgctgcaagccgagaggatcaaccaacatctccaggaagaactcgaaaatcgcacatccgaaactaacacgcctcaggggaatcaggaacagctcgtcaccgtcatggaggagcggatgatcgaagtcgagcagaaactcaaattggttaaacggctgctgcaggagaaagtgaaccagctgaaagaacaggtgtccctgccggggcacttgtgttcccctaccagccactcctcgttcaattccagcttcacttcactttactgtcactag

SEQ ID NO: 24738 - DNA, 3171 bp, Artificial Sequence
  Description of Artificial Sequence: Synthetic coding sequence
atggccaccggcaactacttcggcttcacccacagcggcgccgccgctgctgctgctgcagctcagtatagccagcagccagcaagtggggtggcctactctcaccccactacagtggctagctacactgttcatcaggctcctgtggccgcccacaccgtgaccgccgcgtatgctcccgctgccgccaccgtagcggtcgccaggccagcccctgtggctgtggctgctgctgctaccgcagccgcctatggtgggtaccctacagcccacacggctaccgactacggctatacgcagaggcaacaggaggccccccctccgcctccacccgccacaacccagaattatcaggattcctacagttacgtgagatcaacagcacccgccgtagcttacgactccaaacagtattaccagcagccaaccgccaccgcagccgccgtagcagccgccgcgcagccacagcctagtgtggcagagacgtactatcagactgcgcccaaagccggatattctcagggggcaactcaatacacccaagctcagcagacgcggcaggtgacagctattaaacccgccacaccatccccagcaactactaccttctctatctaccctgtgagttctacagtccagcccgtggccgcggctgcgacagtcgtgcccagctatacccagtcagcgacctatagcactaccgcagtgacctactctggcacctcttacagtggctatgaggcagccgtatatagcgccgcatcctcctactatcaacagcaacagcagcagcaaaagcaggcagctgctgccgcagccgctgccgcggcaactgccgcctggacaggcaccacatttacaaagaaggcgccattccagaacaagcaactgaagcctaaacaaccccccaaaccaccccaaatccactattgtgatgtgtgcaaaataagctgtgcaggccctcaaacatacaaagagcacctggagggccagaagcacaaaaagaaagaggcagctctgaaagcatcccagaatactagctcaagcaacagcagcaccagggggacccagaatcagcttaggtgcgaactatgcgacgtgagttgtactggcgccgatgcgtacgccgcacacattcgaggcgccaagcaccaaaaagtggtgaaactccacactaaattaggcaaacccattcccagtacggagcccaacgttgtttctcaagctaccagctccactgccgtcagcgcctctaagcccaccgcttcgcccagctccattgcagccaataactgtacggttaatacgagctctgtggctacaagcagcatgaaagggctgaccaccacagggaactccagccttaactccacttcaaatactaaagtgtctgctgtacctacaaatatggctgccaagaagacatctaccccgaagataaatttcgtcggggggaacaaattgcaatccaccgggaataaggccgaagacatcaaaggaaccgaatgcgtgaaatctaccccagtaactagcgctgtgcagattccggaagtcaaacaggacacagtttcggaaccagtgactcccgcatcgctcgctgctctccaatccgatgttcagcctgtgggccacgattatgtcgaagaagtgcggaatgatgagggtaaggtgatccgctttcactgcaagctctgtgaatgtagttttaacgaccctaatgccaaggagatgcacctgaagggccggaggcataggttgcagtacaaaaaaaaggttaaccctgatctgcaggtggaggtaaaaccatcgattagggcccgcaagatccaggaggaaaagatgcggaagcagatgcagaaagaggagtattggagaaggcgggaggaggaggaaaggtggagaatggagatgcggagatatgaggaggatatgtattggcgaagaatggaagaggaacagcaccactgggatgacagaagaagaatgcctgatggcggctatccccatggcccccccggcccccttggacttcttggcgtgaggccaggaatgcctccacagcctcagggtccagccccgctgcgacggcctgactccagtgatgaccggtacgtgatgactaaacacgccactatctaccctactgaagaagaactacaggccgtgcagaagatcgtctcaattaccgaacgtgccctgaaactggtaagtgacagcttgtccgagcacgagaagaataaaaataaggaaggggatgataagaaagaagggggtaaggacagggccctgaagggtgtgcttagggtgggagtgctcgctaaggggttacttctcaggggagaccgaaatgtgaatctagtgttactctgctccgagaaacccagcaagacacttctctctagaatcgccgaaaacttgccaaagcaactcgcggttatctctccggagaaatacgacattaaatgcgctgtgagtgaagcagccattatcttaaacagttgtgttgagcccaagatgcaggtaacgatcaccttgacgagtcccattatcagagaagagaatatgagggaaggggacgtcacatctgggatggtgaaggatccgcccgacgtgttggacagacaaaaatgtcttgatgcattagcagcccttaggcacgccaagtggttccagcaggcccgcgccaacggcctccaatcctgcgtcataataatccggatcttgcgggatctatgtcagagggtccctacttggtcggattttccatcttgggcaatggagctgttggtcgaaaaggcgatttcgtccgcctcaagccctcagtcaccgggggacgccctacggagggtttttgagtgtatttcctcaggtatcattctaaaaggcagcccgggcctcctggacccctgcgagaaagacccgtttgataccctcgcaactatgactgatcagcagcgcgaagatatcacaagcagcgcccagtttgctttgaggctactggcattccgccagatccataaagtgttgggcatggacccactgccacagatgtcccagcggttcaatattcacaataacagaaaaagacgcagggatagcgacggaatggacctgaagcttcgggggaaaaagacgaagaagatcatgattaccttcaaaaaatgtctttag

SEQ ID NO: 24739 - DNA, 390 bp, Artificial Sequence
  Description of Artificial Sequence: Synthetic coding sequence
atgggctgctgcggctgcagcggcggctgcggcagcggctgcggcggctgtgggtccggttgtgggggatgtggcagttcctgttgcgtgccaatctgctgctgtaagcccgtctgctgttgcgtgcctgcatgtagctgcacctcttgtggatcatgcggaggttccaaaggatgttgtggatcctgcggcggttctaaggggggatgtggaagttgcggaggatcaaagggcggctgcggtagttgtggatgctctcaatgcagttgctgcaagccgtgttattgctcttccggatgtggatcctcatgctgtcaaagtagctgttgcaagccttgttgttctcaggctagctgttgtgtgccaatctgttgtcagtgcaagatttag

SEQ ID NO: 24740 - DNA, 1344 bp, Artificial Sequence
  Description of Artificial Sequence: Synthetic coding sequence
atgcccatgcccaccgagggcacccccccccccctgagcggcacccccatccccgttcctgcatacttcaggcacgcggagccaggttttagccttaagcgcccaagagggctctcgcgtagcctgccccctccaccccctgccaagggatctataccaatatctcgattgtttcccccccgaactcctgggtggcaccagctgcagcctcggcgcgtttcttttcgtggggaggcctcagaaacactgcaaagcccaggctacgacccttcccgtcctgagagctttttccagcagagtttccaaaggctaagcaggctgggacacggctcttacggggaggtcttcaaagtgcggtctaaggaggacggccggttatatgctgtaaaacgatctatgtctccattccgcggaccaaaagatcgtgcgcgcaagttggcagaagtgggttctcacgagaaggtggggcagcatccttgctgcgtcagactggaacaggcctgggaggaaggcgggatactgtacctgcaaacagaactgtgcggccctagtctgcagcagcattgcgaggcttggggcgctagtctgccggaagctcaggtgtggggctacctgcgtgatactctcctggcgctggcgcatctgcactctcaaggattggttcatctggacgtgaagccagctaatatctttctgggacctaggggcagatgcaaacttggggatttcggcctcctggtggagctgggaaccgccggcgcaggggaggttcaggagggcgatccgcgatacatggcccccgaactcttgcaaggctcctatggcactgctgcagatgtgttcagcctaggactgactattctagaggtggcatgcaatatggaattgccacatggtggagaaggttggcaacaactgaggcagggctatttgccccctgagttcacagctgggctgtcatccgagctcagatctgttttagttatgatgttagaacccgatcccaagcttcgtgcgacggccgaggcacttctagctctgcctgtactccggcaaccccgggcctggggggtgctctggtgcatggcagccgaagcactctcaagaggatgggccttgtggcaggccctgctggcactgttgtgttggctctggcacggcctggctcaccccgcaagttggctccagcccttggggcctccggcgacccccccaggatctccaccatgtagcctgttgctcgattccagtcttagttccaattgggacgacgattccctcgggccttgtgtgctgaaacgtactgaaggtgctctcgaatgcagtcaaatggaggggctgtag

SEQ ID NO: 24741 - DNA, 1005 bp, Artificial Sequence
  Description of Artificial Sequence: Synthetic coding sequence
atgagcgccgccaaccccgagacccccaacagcaccatcagccgggaggcttcgacccagagtagctctgccgcggctagccaggggtgggtcctgcccgagggtaaaatagttcccaatactgtgttcgtaggcggtattgatgcccgaatggacgaaactgagatcgggtcttgctttggaagatacggctctgtaaaagaggtaaaaataattaccaaccgcaccggggtttcgaagggatacgggttcgtcagtttcgtaaatgacgtggacgtgcagaagatcgtggggtctcaaatccactttcatggaaagaaactgaaactggggcctgctattcgaaaacagaaactgtgcgcgcggcatgtgcagccaaggcctctcgtggtgaacccgcctcctcctccacagttccagaacgtgtggcggaatccgaatacagagacatatctccaaccccagatcactcccaaccctgtcactcaacatgtccaggcctatagtgcctatccccactcccctggccaggtaattactgggtgccagcttctggtgtataactatcaggagtatcctacatatcctgattcggccttccaagtgaccactggctaccagctcccagtgtacaattaccagcccttccccgcatatccccggagccccttccaggtgactgctggctatcagctgcccgtgtacaactaccaggcattccctgcttacccaaacagcccgtttcaggtggctacgggctaccagtttcccgtttacaattatcagccgtttcctgcatatccctcctccccatttcaggtcaccgccggctaccaactcccggtctacaattaccaggcttttccggcgtacccgaacagtcctttccaggtagccactggctaccagttccctgtctataattaccaggccttccccgcatacccaaattcccccgtgcaggtgaccacgggttaccagctaccagtgtacaactatcagtag

SEQ ID NO: 24742 - DNA, 1173 bp, Artificial Sequence
  Description of Artificial Sequence: Synthetic coding sequence
atgagcgccgccaaccccgagacccccaacagcaccatcagccgggaggcttcaacccaatcatcatctgccgctgccagccaggggtgggttttgccggagggtaagattgttcccaatacagttttcgtgggaggtatagacgccaggatggacgaaacagagattggttcctgctttggccggtacggttccgtgaaggaggttaaaatcatcaccaatcggacgggcgttagtaagggctacgggtttgttagtttcgtgaacgatgtggatgtgcaaaaaattgtagggtctcagatccattttcatggcaagaagctcaagctcggccccgctatcagaaaacaaaaattatgtgcccggcatgtgcagcctagacccttggtcgtaaaccccccaccaccaccacagttccagaatgtgtggaggaatcctaatactgagacataccttcagccacaaatcacaccaaaccctgtaactcagcatgtgcaagcctatagtgcctatccgcattctcccggccaggtcataaccggttgtcagctgcttgtctacaactatcaagagtatcccacttacccagatagtgcttttcaggtgaccactggttaccaattacccgtttacaattaccagccattccctgcttatcccaggagcccgttccaggtgactgccggctaccagcttccagtgtacaattatcaggcatttccggcttaccctaattccccctttcaggtagccaccggataccaatttccggtgtataattaccaaccatttcctgcatatccttcctctccttttcaggtgacagccggataccaattgccggtttacaattaccaagcctttcctgcctacccaaatagtcctgtccaggtcactaccgggtatcagcttcccgtatataactaccaggccttcccagcttatccaagcagtccatttcaggtgaccacgggctaccaactacctgtttacaactatcaggcctttcccgcataccccaactccgccgttcaggtgacgacagggtaccaatttcacgtctacaattaccaaatgccgccacagtgtcccgtgggcgagcaacggcggaacctgtggaccgaggcctataaatggtggtatctcgtctgtctgattcagcgaagggactag

SEQ ID NO: 24743 - DNA, 1173 bp, Artificial Sequence
  Description of Artificial Sequence: Synthetic coding sequence
atgagcgccgccaaccccgagacccccaacagcaccatcagccgggaggcctccacccaatcatcctcagccgcagcttctcaggggtgggtgctccccgagggcaaaatcgttcctaatacagtttttgtaggaggcatagacgcgaggatggatgaaaccgaaattggatcttgttttgggcgatatggcagtgttaaggaggtaaagatcatcacaaacaggacgggcgtgagtaaggggtatggttttgtttcattcgtgaacgacgtggacgtgcagaaaattgtcggtagtcagatccactttcatgggaaaaagcttaagttggggccggccatccgaaagcagaagctgtgtgccagacacgttcagccgagaccattggtggtcaatccccctcctcctccccagttccaaaacgtgtggagaaaccccaataccgagacatacctacaaccacaaattacccctaaccctgtaacacagcatgtgcaggcttactcggcatacccacactcccctggtcaggtgataactggctgccagctcctggtttataattaccaagagtaccccacttatccagactcagcttttcaggtcacgaccggataccagctgccagtttacaactaccagccatttcccgcttacccacggtccccattccaggtgacagccggataccagttgcccgtgtacaattatcaagctttccccgcctatcctaatagtccttttcaggtggctacagggtaccaattccccgtgtacaactaccaaccattccccgcctaccccagctctcccttccaggtaactgcaggctatcagctgcccgtgtacaactaccaggccttcccggcctacccgaattcacctgtccaggttacaactggttatcagttgccagtgtacaactaccaagctttccctgcctatcccagcagtccgttccaagtcactacagggtaccaattgcctgtatacaactaccaggcgtttccagcatacccgaatagcgctgttcaggttacaaccggatatcagtttcacgtgtataattaccaaatgccccctcagtgccctgtgggggaacagcgacggaacctgtggacagaagcgtataagtggtggtacctcgtgtgtctgatacagcggcgcgactag

SEQ ID NO: 24744 - DNA, 1101 bp, Artificial Sequence
  Description of Artificial Sequence: Synthetic coding sequence
atgagcgccgccaaccccgagacccccaacagcaccatcagccgggaggctagcactcaaagtagctcagccgctgcgagtcagggctgggtgctgccagaaggtaagatcgttccaaacaccgtctttgtgggagggattgatgctagaatggatgagacagaaatcggtagctgttttgggcggtatggctctgtgaaagaagtgaaaatcatcacaaatagaaccggtgtgagtaaggggtatggcttcgtgagcttcgttaacgacgtggatgtgcagaaaatagtgggctcccagatccactttcatggcaaaaagcttaaactggggcccgccatcaggaaacaaaagctatgcgcaaggcacgtgcagccgcgtccactggtcgtgaacccccctccacctcctcagttccagaacgtctggcgcaacccaaataccgagacatacctgcaaccccagattactcccaatccagtcacccaacacgtgcaggcatattccgcgtacccccactcccccggacaggtgatcaccggctgccagcttttggtctacaactaccaagagtatcccacttatcctgatagcgcattccaggtcacaacagggtatcagcttccagtctacaactaccagccgttccccgcatatccccgatctcctttccaggttacggcgggctaccagctgccagtctataattaccaagcttttcctgcttacccaaactctccctttcaagttgctaccgggtaccagttccccgtatacaactaccaaccctttccagcatatccctcctctccattccaggttacagcaggctaccaacttccagtgtacaactaccaggccttcccagcatatcccaattctccagtccaggtaacaactggttaccagctacccgtttataattaccaggccttcccagcttaccccaattctgcagtccaagtgacgacaggctaccaattccacgtgtataactaccaaatgcccccgcagtgtcctgttggcgagcagcgccgaaacctctggaccgaagcatacaagtggtggtatctggtgtgtctgatacagagaagagactag

SEQ ID NO: 24745 - DNA, 1149 bp, Artificial Sequence
  Description of Artificial Sequence: Synthetic coding sequence
atgagcgccgccaaccccgagacccccaacagcaccatcagccgggaggcgagtactcagagtagcagtgccgccgccagccagggctgggttttacctgaaggaaaaattgtaccaaacaccgtgttcgtcggcggtatcgacgcgaggatggatgagacggaaatcggcagctgttttgggagatatggaagtgttaaggaagtgaagatcataaccaacaggactggcgtgagcaagggctacggcttcgtgagtttcgtaaacgacgtggatgtgcaaaagatagtgggcagccagattcacttccatggcaagaagctcaagctgggtccagctatccgcaaacagaagctgtgcgcaagacacgtgcaaccacggccactcgtggtgaatccacctcctccaccccagttccaaaatgtttggagaaatcctaatacagaaacatacctccagccacaaatcaccccaaatcccgtgacgcagcacgtgcaggcctactccgcttacccccactcccctggccaggtcatcacaggttgccaattgttggtttacaattaccaagagtacccaacctaccccgattccgccttccaggttactactggataccagctgccggtctataattatcagccattccccgcatatccaagatcaccttttcaggtgacagccgggtatcagcttccagtgtacaattaccaggcctttcccgcttaccccaactcaccattccaggtggccaccggttatcagtttcccgtctacaattaccaaccatttcctgcatatccttccagcccctttcaggtcacagccggctatcagctgccagtgtataactaccaggcctttccagcctatccaaattcccctttccaggtcgccacgggctaccagttccccgtgtacaactaccaggcatttccagcgtatcccaacagccccgttcaggttaccacaggctaccagttgcccgtctacaactaccaggccttcccagcctaccccaactctccgttccaggtggccacaggatatcagttccctgtctataattaccaagctttcccagcatatcctaacagcccagtgcaggtgacaactggctatcagttgccagtctataattaccagtag

SEQ ID NO: 24746 - DNA, 1842 bp, Artificial Sequence
  Description of Artificial Sequence: Synthetic coding sequence
atgagcgccgccaaccccgagacccccaacagcaccatcagccgggaagctagcacacagagttcatcagcagctgcgagccagggctgggtgctgcccgagggtaagatagtacctaataccgtcttcgtgggagggatcgacgccaggatggacgaaaccgagataggaagttgtttcggcagatacggaagcgttaaggaggttaagatcattactaacaggacaggggtgagcaagggctatggcttcgtgtctttcgtcaatgacgtggacgtgcagaagatcgtgggcagtcagatccacttccatgggaaaaaactcaaactggggcctgctatcaggaaacagaaattatgtgccaggcacgtgcaacctcggcctctggtcgtgaatccccctccacctccccagtttcagaacgtgtggcgaaaccccaacaccgaaacctacctgcagccgcaaataacccccaatccggtcactcagcacgtgcagtccgccgcgaaccctgagactcctaatagtactattagccgcgaggcgagcacgcaatcaagcagtgctgctgcaagtcaggggtgggttctccccgagggtaagatcgtgccgaacacagtcttcgtcgggggaatcgatgcacgtatggacgagacagagataggatcctgtttcggaaggtacgggagtgtgaaggaagttaagatcatcactaatcggactggtgtgtctaagggctatggtttcgtgtcctttgtcaacgacgtagacgtacagaagatcgtgggctcccagatacatttccatggtaagaaactgaagttaggccctgcaatccggaaacagaagctgtgtgcaagacatgtgcagcctcgccccttagtagtgaacccgcccccgcccccacagttccagaatgtttggcgaaaccccaacactgagacttatctgcagcctcagatcacccccaacccagtgacccaacatgtgcaatccgctgccaaccccgaaacacctaatagcacgataagcagagaagccagcactcagagcagctccgcggccgcaagccaggggtgggtgctccccgaaggtaagatagtcccgaacactgtgttcgtgggcggcatcgatgcccgaatggatgaaacagaaatcgggtcatgctttggccgctacggaagtgtgaaagaggtgaagatcattacaaacagaactggggtcagcaagggttatggatttgtaagctttgtgaacgacgtagacgtgcagaaaattgtgggcagtcaaatccactttcatgggaaaaaactcaagcttggacctgctattagaaagcagaagctctgtgcccgccacgtgcaacctcgtcccctggtggtcaatcccccccccccaccccaatttcagaatgtctggaggaatccaaatacggaaacctacctccagcctcagataacacctaaccccgtcacccaacatgtccaggcttatagtgcctacccgcactctcctgggcaggtgatcactggatgccaactgctggtctacaactaccaggagtatcctacctatccggacagtgcattccaggttacaactggatatcagctccccgtgtacaattaccagcctttccctgcctacccccgcagcccatttcaggtgactgctgggtaccagctgccagtgtacaactaccaagctttcccggcctacccaaactcccctttccaagttgcgacaggctaccagtttccagtgtgtgagatttgcaaaatcctcgtgttgaagaatgcggccgcattcctgtgccattctaaggtcaaccgaagcatatag

SEQ ID NO: 24747 - DNA, 384 bp, Artificial Sequence
  Description of Artificial Sequence: Synthetic coding sequence
atgcggcccctggacatcgtggagctggccgagcccgaggaggtggaagtcttggagccagaagaagattttgaacagttcctgttaccagtcattaacgagatgagggaagacatcgcctcactgactagagaacatggcagagcctaccttcgaaatcgaagcaagctgtgggaaatggataacatgctgatacaaattaaaacacaggttgaagcatctgaagagtcagcattgaatcacttgcagaatcctggcgatgcagctgagggcagggccgccaaaagatgcgaaaaagccgaagagaaggcaaaagaaatcgccaagatggctgagatgctggtggaattggtgagacggattgaaaaatcagagtcctcctag

SEQ ID NO: 24748 - DNA, 537 bp, Artificial Sequence
  Description of Artificial Sequence: Synthetic coding sequence
atgatgcgggccatgaagccccccggcggcgagagcagcaacctgtttgggtcccccgaggaggccaccccttcctctagaccaaaccgcatggccagcaacatcttcggtccaaccgaggaaccccagaatattcctaaaaggaccaatccccccggagggaaggggtctggcatcttcgacgaatcaactcccgtacagacccgccagcacctcaatcctcctggagggaaaactagtgatatttttggttccccagtcactgccacttcccgcctcgcccacccaaacaaacctaaggatcatgtgttcctgtgtgaaggtgaggagccaaaaagcgaccttaaggccgctcgttcaataccggccggggccgagccaggtgagaaggggagcgccagaaaagccggacccgctaaggaacaagagcccatgcccaccgtcgactctcacgaaccacggcttgggccgagaccacgctcacacaacaaagtgcttaatcctccaggggggaagtctagtataagcttttactag

SEQ ID NO: 24749 - DNA, 657 bp, Artificial Sequence
  Description of Artificial Sequence: Synthetic coding sequence
atgttccaggtgcccgacagcgagggcggccgggccggcagccggaagtggcaactgctgactggtagtttggcttcgacgtctccctccctcctgtctgggcaagggccatgggctccgcttcagagggctatgaagccacctgggggcgagtcgtccaatcttttcggctcccctgaagaagcgactccaagctcccggccaaatcgcatggcatctaacatttttgggccgacggaagagccacaaaacattccgaagaggaccaacccacccggcggaaaaggatcaggcatctttgacgaaagtacaccggttcagacgaggcagcatcttaatccccccggtggcaaaacttctgatatatttggtagtcccgtgactgcaacatccaggttagcccacccaaacaagccgaaggatcacgtatttttgtgtgaaggggaggaacccaagtccgacctgaaagcggcgcgcagcatccctgcgggcgccgagccaggcgaaaagggcagtgctaggaaggccggacctgcaaaagagcaggaacccatgccaacagtggactcccatgagccgcgcttggggcccagaccacgatcacacaacaaggtgctcaacccacctgggggcaaatcctccatttccttctactag

SEQ ID NO: 24750 - DNA, 4866 bp, Artificial Sequence
  Description of Artificial Sequence: Synthetic coding sequence
atggccggcggccggggcgcccccggccggggccgggacgagccccccgagagctaccctcagagacaggaccatgagctccaggccttagaagccatatatggcgccgattttcaggatctgcgccccgacgcatgcgggcctgtgaaggagcccccagaaattaacctggtgctctaccctcaagggctcacaggcgaggaggtctacgtgaaagtagacctgcgtgtaaaatgccctcctacgtaccccgacgtggtgcctgagatcgagttaaagaatgccaaggggctgagtaatgagtccgtgaatttgttgaagtctaggctggaggagctggccaagaagcattgcggtgaggttatgatcttcgaactcgcctatcacgtgcaaagcttcctctctgaacataacaaaccacccccaaagagctttcatgaagagatgttagagagaagagcacaggaggaacagcaaaggttactggaagctaagcggaaggaggagcaggagcagcgcgagattcttcacgaaattcagcgtcgaaaggaggagatcaaggaggagaaaaagcgaaaagagatggctaagcaggagcgtctagaaatagcaagtctttcgaatcaggaccacacttcaaagaaggaccccggtggccatagaactgcagcaatattgcacgggggatctcccgacttcgtcggcaacgggaaacacagggccaactcatcaggccggtcccgtcgagaaagacagtattccgtctgcaatagcgaggattctcccggatcctgtgaaattctgtactttaacatgggctccccagaccagttaatggttcacaaaggaaaatgcataggatctgacgaacagctggggaagctagtgtataatgcccttgaaaccgcaaccgggggatttgtgctgctgtacgaatgggtgctccagtggcaaaagaagatggggccgttcttaacctcccaggaaaaagaaaagatcgacaagtgcaagaaacagattcaaggtaccgaaactgagtttaatagtctcgttaaactgagccacccaaacgtcgtgcggtatcttgcaatgaatttaaaagaacaggacgatagcatcgttgtggacatcttagtcgaacacatcagcggcgtgtctttggcagcccacctgtctcactcaggtcctattcctgtgcaccagctcagacgctataccgcccagttgttaagtggccttgactacctgcactctaattccgtcgtgcataaagttctgtccgcgagcaacgttctggtcgatgcggaggggactgttaaaattacagattacagcattagtaagagactggctgacatctgtaaagaggacgtgtttgaacagacacgggttaggttctctgataatgctctgccttacaaaactgggaaaaagggtgacgtgtggcgtctgggtctcttactgctgtccctctcacagggccaagaatgcggcgagtacccagtgactatcccgagcgatttgcccgcggatttccaagacttcctcaagaaatgtgtttgcttagatgacaaggagcgctggtcccctcagcaactgctgaaacatagcttcattaatccccagccgaaaatgccactcgtggagcagtctccggaagatagcgaggggcaggactacgtggagactgttattccatctaacagactcccatccgccgctttcttctctgagacacagagacagttctctcgctattttatagagttcgaggagcttcagctgctcggcaagggcgcctttggggcagtgatcaaggtgcagaataagcttgatggttgttgttatgccgtgaagcgtattccaataaaccctgcttcacgccagtttagacgtatcaagggtgaagtgaccctgctttctcgactgcatcatgagaatattgtgcggtattataacgcctggatagaaagacacgagagaccagccggtccaggtacacccccgcccgactcaggtcctcttgcaaaggacgacagagctgcccggggccagcctgcctccgacacggacggtctagactccgtggaggctgccgcacctcctccgatactgagctctagcgtagagtggtccacctcaggcgagcggagcgcgagtgcccggttccctgcgacagggcccggtagctcggatgatgaagacgacgatgaggatgagcacggcggcgtcttctctcagagcttcctgcccgcgtcagactctgagagcgatatcatattcgataacgaagatgagaatagtaagagccagaatcagatggagtattgcgagaaatctacgctcagagacactatcgatcagggcctctaccgtgacaccgtgcggttgtggaggcttttcagggagatactagatggcctggcttatattcacgaaaaaggaatgatacaccgcgatctgaaaccagtcaatatatttctggattcagatgaccatgtgaaaattggcgattttggcttggcaaccgatcatttggccttcagcgctgactctaaacaggacgaccagaccggcgatctgatcaagtccgatccgtctggccacttgacgggaatggtaggcaccgccctgtacgtgtcccctgaagttcaggggagcacaaaatcggcctacaatcaaaaggtcgacttgtttagcttgggcattatcttctttgagatgtcttaccaccctatggttactgcctctgagcggatctttgtccttaatcaactgcgagaccctacaagtcctaagttccctgaagacttcgacgatggtgagcatgctaagcaaaagtcagttatatcttggctgttgaaccatgatcccgcaaaaaggccaaccgccacggaactcctgaagtccgaactattgcctccacctcaaatggaggaaagtgagctgcacgaagtgctccaccacaccttgacaaatgtagatggcaaggcctatcggacaatgatggcacagatcttttcccagaggatttctcccgctattgactacacgtatgactcagatatcttgaaagggaacttctccattaggactgcaaagatgcagcagcacgtgtgcgagacaattatcaggatattcaagcgacacggggcggtgcagctttgtacacccctgttgctgccacggaacaggcagatttatgagcacaacgaagctgccctgttcatggaccactctggaatgctggttatgctgccttttgacttaagaattcctttcgcacgatacgtcgcaagaaataatatattgaacttaaaacgatactgtatcgaaagagtcttccggccccgcaagttggacaggtttcaccctaaagagctgctcgaatgcgcctttgacattgtcacctcaactactaattcctttctgcctaccgctgagattatatacacaatctacgagataatacaggaatttccagccctccaggaaaggaactacagcatttaccttaatcacacaatgttactcaaggctattctactgcactgcggcatccctgaggacaaattgtcacaggtttatatcattctttacgacgccgtgacagagaaactgactcgcagggaagtggaggcaaagttttgcaacctatccctatcctccaacagcctctgccggctgtacaagtttatagaacagaagggagatctgcaggacctgatgcccaccattaattccctaatcaaacagaagacgggaatagcccagcttgttaaatatggtctgaaggaccttgaggaagtggtgggactgttgaagaagctgggaataaaactccaggtgcttattaatctcggtcttgtgtacaaggtccagcagcacaatggtattattttccaattcgtagccttcatcaaacgacgccaaagagcggtcccggaaattctcgccgctggggggcggtatgatctcttgatcccccagtttcgaggtccccaggcacttggaccggttcctaccgctataggcgtgtcaatagcaatcgataagatttccgccgcagtgctgaacatggaggagtcggtgaccatctcgagctgcgatctccttgtggtgtctgtgggtcaaatgtcaatgagccgcgctatcaatctgactcagaaactatggaccgccggcataacagccgagataatgtacgactggtcccagagccaggaggagttgcaggaatactgtcggcaccacgaaattacatacgtcgcattagtttccgataaagagggcagccacgttaaagtgaagagctttgagaaggagaggcagacagagaagagagtcttggagaccgaattagtggaccatgtgctccaaaagctgagaaccaaggttaccgatgagaggaatggacgcgaggccagcgataatcttgctgtgcagaatttgaagggcagtttctctaacgcttcagggctgtttgagatccacggggctaccgtggttccaatcgtctcagtcctagctcccgaaaagttatcagcaagtacccgcaggcgatacgaaacgcaggtccagacgagactccagacaagcctggcaaatttgcatcagaaatctagcgagatagaaatcctggccgttgatctcccaaaggagaccatcctccagttcctgagcctagaatgggatgccgacgagcaggctttcaacacaacggtgaaacagctcttgtctcgactgcctaaacagcggtatctcaagctggtatgtgacgaaatctacaatatcaaagtggaaaaaaaggtgtcagtgttatttctatactcttacagagacgactattaccggatactgttttag

SEQ ID NO: 24751 - DNA, 2388 bp, Artificial Sequence
  Description of Artificial Sequence: Synthetic coding sequence
atgaagttcaccaacaccaaggtgcagatgatgcagaacgtgcacctggcgcctgagactgatgaggatgacctgtactcaggctacaacgattacaaccctatatatgatatagaggagcttgagaatgacgctgcctttcagcaggcggtaaggacatcccatggtagaagaccccccatcacagctaagatcagctccaccgctgtgacccggcctatcgctaccggctacgggagcaaaacttccttggcatccagcatcggtaggccaatgactggcgcgatccaggacggcgttacacgtcctatgaccgccgtgagggcagctggttttacaaaagccgccctcagaggatcagccttcgatcccttatcgcagagccggggcccagcttcccctttagaagccaaaaaaaaagactctcccgaggagaagatcaagcagttggaaaaggaggtcaacgaactggttgaggagtcttgcatcgcaaactcctgtggtgatctgaagctggcgctggaaaaagccaaagacgctggtagaaaagagagggtcctggtgaggcagagagaacaggtcaccacaccagaaaatatcaacctagacctgacatactccgtgctcttcaacctggcctctcaatacagcgtgaacgagatgtacgctgaggccttgaacacctaccaggtgatcgttaagaacaagatgtttagtaacgcgggcatattgaaaatgaacatgggtaacatttacctgaagcagagaaactacagtaaagccattaaattttatagaatggcgcttgatcaagtcccttctgttaacaagcaaatgcggatcaaaatcatgcaaaatatcggtgtaactttcatccaagccggtcagtattcggacgcaataaattcatacgaacacattatgtccatggcaccaaacttaaaagctggttataacctaaccatctgctacttcgcgataggcgatcgcgagaagatgaagaaggcgttccagaaacttatcaccgtccctttagagatagatgaggacaaatatatatcccccagcgatgatccgcacacgaatctggttacagaggccatcaagaacgatcatcttcggcagatggagcgagaacgtaaggccatggcagagaaatatatcatgacttctgctaaactgattgcacctgtgattgagacatccttcgcggctggctacgactggtgtgtggaggtcgtcaaggctagccaatacgtagagctggctaacgaccttgagatcaataaggcagttacatacctgcggcaaaaagactacaatcaggctgtcgaaattctcaaggtgctagagaagaaagattcccgtgttaaatctgccgccgcaaccaatctgtctgcgttatactatatgggcaaagatttcgcgcaggcatcctcctatgctgacatcgccgtgaactctgaccgctataatccagctgccctgaccaacaaggggaataccgtgtttgccaatggcgactacgaaaaagccgccgagttttacaaagaggctctgaggaacgacagtagctgcaccgaagccctgtataacattggcctgacgtatgaaaaactgaatagactcgacgaagcacttgactgttttttgaaactgcatgccatcctgcgtaattctgccgaagttctctaccaaatcgcaaatatctacgaacttatggaaaatccatcccaagccattgagtggctgatgcaggtagtgtctgtaatcccaactgatcctcaggttttatctaagctcggggagttatacgaccgcgagggcgacaagagtcaagccttccaatattactatgagtcctacagatacttcccatgcaacatcgaggtcattgagtggctgggcgcgtactacattgacacccagttttgggagaaggctattcagtactttgagagggcctccttgatacagcctacacaggtcaagtggcagctgatggtagcctcgtgcttcaggaggtctggcaattatcagaaggcactggacacctataaggatactcaccgaaagttccccgaaaatgttgagtgcagcgggagcgtccgcactgggcatatggagcgcgacccactgaacctcttgccaaggaaatcggttcttccagggcccgagatcgccaagtgtaactacttctctggtgagaaatactacctcagcgcatttctcagtagttctctgcaccgttcgtggattaaacggtgttcccgaatctgccaaaagaccgaagaagtgggcaagaatgagcgcaataagggcaccgcccacaaggtgcggcagaggtggcagtggggcctgccctggcagaagagaaggaagtgttag

SEQ ID NO: 24752 - DNA, 192 bp, Artificial Sequence
  Description of Artificial Sequence: Synthetic coding sequence
atgagctactaccggagctactacggcggcctgggctacggctacggaggcttcgggggctggggctacggatatgggtgcggctacggcagtttcaggcgactagggtatgggtgtggatacggaggctatggtttcagttgctgccgtcctttatattacggaggatatggattctcagccttttattag

SEQ ID NO: 24753 - DNA, 135 bp, Artificial Sequence
  Description of Artificial Sequence: Synthetic coding sequence
atgagctactacggcaactactacggcggcctgggctacggctacgactgtaaatattcatacaccagcgggttcggggcctttcggattctggactgtggctaccgatgtggctgtgggggcgtgtggatctag

SEQ ID NO: 24754 - DNA, 135 bp, Artificial Sequence
  Description of Artificial Sequence: Synthetic coding sequence
atgagctactacagccacctgagcggcggcctgggctgcggcctggcagtggccgtgaccatgggcaggaccgtggccgtggctgagtatggtcgctgtcgacatggatgccatagcagttattcagcaaggtag

SEQ ID NO: 24755 - DNA, 138 bp, Artificial Sequence
  Description of Artificial Sequence: Synthetic coding sequence
atgtgctactaccacaactactacggcagcctggactacggctgctcctacggcagcgaatatggcaattctggatacgcttgcaacttcccatgttcctatggcagattcctcctggcccccaggaaaaagttctag

SEQ ID NO: 24756 - DNA, 624 bp, Artificial Sequence
  Description of Artificial Sequence: Synthetic coding sequence
atgccccacagccactgccacagcctgcggagcttccacaacgccccccccctgtcggcaatcacccacggtacgaacccaatcaccttcgaggatagactttgtctgcctagctcatttcatagtcggacttgcttcctagacaatttccaggaaacatgtaacgagacaacaagttgccagatgacaaattgtgagcaggatcttttcacagacgactcatgtgtccaatcgaattgcttccccggcgttgtgcagacaacatatagcaatagccgtccatgtgaacggactgcctgtcagtccgagtcctcgtcagctgggctggcctgcgtgtcccagccttgccagtctgagtctacacagcagatgggctttgtcgcccagtcctgtcagccagcatctctcaaaggtaattcatgcccgcctaaaaccagtaagtctaaaaattttgagaccttagaaagagcctcctcacaatgtcagtgccagagccagaaccccgagtcatcgagctgccggcccctcgtcaatgtggccccagaaccacagctcttagagtcgtccccaggggttgagcccacatgctgtgtcaccggcggctcgcaactcccatctaaatag

SEQ ID NO: 24757 - DNA, 645 bp, Artificial Sequence
  Description of Artificial Sequence: Synthetic coding sequence
atggcccacgtgagcagcgagacccaggacgtgagccccaaggacgaacttactgcgagcgaagcttccacaaggagccccctctgcgagcatacctttcctggagattctgatctccgcagcatgattgaagagcacgccttccaggtactgtctcaaggctcccttctggaaagcccgtcttacacggtttgcgtgtcagaaccagacaaagacgatgattttctgagcctcaactttcccagaaagctgtggaaaatcgttgagagcgatcaattcaagagtatcagctgggacgagaacggcacctgtattgtgataaatgaagagctgtttaagaaggagattctcgaaaccaaggccccatataggatctttcagactgacgcgatcaagagctttgttaggcaactcaacctctacggtttcagcaagattcagcagaattttcagcgttcagctttcctggccacgttcttgtccgaagaaaaggaaagctctgtgttgagcaagttgcacgtcttcgtgtttcaccactctctgtttggcgcaaccttcggagaacatcactttcagccctgccccctgccttctggaaataaagctccaatctctacttggagtggcgattcttggctcctgtag

SEQ ID NO: 24758 - DNA, 645 bp, Artificial Sequence
  Description of Artificial Sequence: Synthetic coding sequence
atggcccacgtgagcagcgagacccaggacgtgagccccaaggacgaacttaccgcttcagaggcctccacccgaagccctctatgtgagcacacatttccaggagactcagatcttcgttccatgatagaagagcacgcctttcaggtgttatcacagggatcacttttagagtcaccttcctacactgtttgtgtcagcgagccagataaggatgatgacttcctctctctgaacttcccccggaaactatggaagatagtggagagcgaccagtttaaaagcataagctgggacgaaaacgggacgtgcatcgttatcaatgaagagctgttcaagaaagagatcctggagactaaggccccgtaccgaatcttccagacggatgccatcaagtcgttcgtgaggcagcttaacctgtacgggttcagtaagattcagcagaactttcagcgcagcgcgttccttgctaccttcctcagcgaggaaaaggagtcaagcgtgctgtccaagttacacgtgttcgtctttcatcactccctgttcggcgcaacctttggagagcaccacttccagccgtgtcccctgccgagcggtaataaagcgccgatcagtacttggagcggtgatagctggctgctttag

SEQ ID NO: 24759 - DNA, 1437 bp, Artificial Sequence
  Description of Artificial Sequence: Synthetic coding sequence
atggccgccgccctgaagtgcctgctgaccctgggccggtggtgccctggtcttggggtggccccccaggcacgagcactagcggcactggtgcccggcgtcacccaggtcgacaataaatcagggttcctgcagaaacgaccccaccggcagcatccaggtattctgaaacttccccacgtcaggttgcctcaggccctcgcaaacggagcccagctccttctactgggctccgcagggccaacaatggagaatcaggtgcagacacttacctcctacctatggtcccgacacttgccagtggagcctgaggaactgcagcgacgtgcccgccacttggagaagaagtttctggagaatcctgatctctcccagacagaagaaaaactgagaggcgctgtacttcacgcattgcgtaagacaacctaccactggcaggagctatcttatacggagggcctgtctctcgtatacatggctgccaggttagacgggggattcgctgcagtttccagggcgtttcatgagatcagggcccgaaatcctgcatttcaacctcagacacttatggatttcgggagtggcactggtagtgtcacatgggcagctcactctatatgggggcagtctcttcgagaatacatgtgtgtggacagatccgctgctatgcttgtgctcgcggaaaagttgcttaaaggaggatctgagtcgggagaaccatatatccccggggtgttctttcggcagtttcttcccgtcagtcccaaagtgcagttcgacgtggtggtgagcgcttttagcctttcggaactgccctctaaggctgacagaacagaggtcgtgcagactctctggcggaaaacgggccattttttagtgctggtggagaatggaaccaaagctgggcacagcttgctgatggacgcccgagacttagtcctcaagggaaaagagaaatcgccactggatcctcgccccgggtttgtgtttgcaccctgcccccatgagcttccgtgtcctcaacttaccaaccttgcatgttccttctctcaggcctatcatccgatccccttctcctggaacaagaagcctaaagaagagaagtttagcatggtgattctagcgcgaggatccccagaggaggcccaccggtggcccaggataacacagcccgttcttaaacgcccccggcatgtacattgtcatctgtgctgtccggatggccacatgcagcacgccgtgctgaccgccagacgccacggccgctatgggggttgcgatcagaatcagtgggatgttgctgggtcatgcagccccagacagcatctattcccccaagggtttgtctcgctatgcccgtgccagctgctgggtcgatcgtttacatgtgcctactcagtctgtgtctcaagcatttatggctccgggtcactgtag

SEQ ID NO: 24760 - DNA, 774 bp, Artificial Sequence
  Description of Artificial Sequence: Synthetic coding sequence
atggaggaggaggccagcagccccggcctgggctgcagcaagccccatctggagaaattgaccttgggtattaccagaatcttggagagttccccgggtgtgactgaggttaccataattgagaagccacctgctgaacgccatatgataagtagctgggaacaaaaaaacaactgtgttatgccagaggacgtcaaaaacttctatctgatgacgaacggctttcacatgacgtggagcgtgaaacttgatgccagtgatgatcagccagagaagccccacttcgattcccgatccgtcatcttcgaactagatagttgtaacgggtcaggcaaggtatgcctggtttataagtctggcaaacccgcattggccgaggatacagagatttggttcttggatcgcgccttgtattggcatttcctgaccgacaccttcacggcatattacaggctcctgatcactcatctcggcttgccccagtggcagtatgcctttactagctatggcatcagtcctcaagccaaacaatggttttcgatgtacaaaccaattacatataacacaaatctgctcaccgaggagacagattccttcgtcaataagctggacccttctaaggttttcaagagtaaaaataagatcgtgatccccaagaaaaaaggtcccgtccaaccagcaggaggacaaaaaggccccagtggcccatctggccctagcacctcgagcacttcgaaatcaagctcaggcagcggtaatcctacccgcaagtag

SEQ ID NO: 24761 - DNA, 792 bp, Artificial Sequence
  Description of Artificial Sequence: Synthetic coding sequence
atgctgagcagcaagggcctgaccgtggtggacgtgtaccagggctggtgtggtccttgtaaaccggtggtgtcactgtttcagaagatgcggattgaggtggggctggacttattgcactttgccttggctgaggctgatcgactcgacgtcctggaaaagtatcgcggcaagtgtgagcccaccttccttttttacgcaattaaggatgaagcactcagtgacgaggatgaatgtgtgtctcatggcaagaacaacggagaggatgaggacatggtctcttcagagcgtacttgcactctagctattatcaaacccgacgccgtggcacacggcaagacagacgagatcattatgaagatccaggaggctggttttgagatcctgaccaacgaggagagaaccatgacagaagccgaagtccgactgttctatcagcataaagccggcgaggaagcttttgaaaagctggtgcaccacatgtgttccggccccagtcatctgcttatattaactcggaccgaggggttcgaggacgtggtaacaacctggagaacagttatgggtcctagagaccctaacgtggcccgacgagagcagccagagtctttaagagcccaatacgggaccgagatgccgtttaacgcggtgcacgggtcgcgagatcgcgaagatgctgaccgggagctcgcgctactatttccgagtctgaaattctccgacaaagatactgaggcaccccagggcgaatcatctactcaaccaagactgaaaatcaccgatctggactag

SEQ ID NO: 24762 - DNA, 390 bp, Artificial Sequence
  Description of Artificial Sequence: Synthetic coding sequence
atggccgagctgatccagaagaagctgcagggcgaggtggagaagtatcagcagctgcagaaagacctctccaaaagcatgtcaggccggcaaaagctcgaggctcagctcaccgagaacaacatcgtcaaagaggagctagctctgttggacgggtccaatgtggtgtttaagctgctgggcccagtgctggtcaagcaggaactcggagaggccagggctactgtagggaaaagactggattatattaccgcagagattaagcgatatgagtcgcagttgcgtgaccttgaacgacagtccgaacagcagcgggaaactctcgctcagttgcaacaggagttccaaagggcgcaggctgccaaagccggtgctcccggaaaggcttag

SEQ ID NO: 24763 - DNA, 1626 bp, Artificial Sequence
  Description of Artificial Sequence: Synthetic coding sequence
atggaggccctgctggagggcatccagaaccggggccacggcggcggctttctgaccagctgtgaagcagagttacaggagctgatgaagcagatcgatattatggtggctcataaaaaatctgaatgggagggccggacacacgcacttgagacctgccttaagatacgcgagcaggaattgaagtcactgcgaagccagctggatgtcacacataaagaggtgggcatgctccaccagcaggtagaggagcacgagaagatcaagcaggaaatgacaatggagtacaaacaggagctcaagaagctgcatgaagaactctgcattctgaagcggtcatatgaaaagttgcagaagaagcagatgcgtgaattccgcggcaacaccaaaaaccaccgcgaggatcgtagcgaaatagagcgcctgacagctaaaatagaggagtttcgacagaagtctttagattgggaaaagcagaggttgatctaccagcagcaagtatcaagcctcgaagcacaacgtaaggccctggccgaacagagtgagattatccaggcacagctcgtcaatcgaaaacagaagctagagtctgtggagctcagcagtcagagcgagatccaacatctttcatccaaattggagagggccaatgatacaatttgtgccaatgaattggagattgaacgtctgactatgcgcgtcaatgacctcgtgggtacaagcatgactgtactacaggagcagcaacagaaggaagaaaaactaagagagtcagaaaagttgctggaggcgctccaggaggaaaaacgtgagctgaaagccgccctccaatcacaggaaaatctcattcacgaggctcggatccagaaggagaagttgcaagagaaggtgaaggccaccaatacccagcacgccgtggaggctattcgcccgcgcgaagaatccctggcggagaagaagtacacatctcaaggacagggggatctggattctgtgctatcacaactgaatttcacccacacatctgaggacctgctgcaggcggaagtgacttgtttagaagggagtcttgaaagcgtgtcagccacgtgcaaacagctaagccaggagctcatggaaaagtacgaagagttaaaacgtatggaggctcacaataatgagtacaaggcagagattaaaaagttaaaggagcagattctgcagggagagcagtcatattcctccgcattggaaggcatgaagatggagatttcccacttgacacaggagctgcaccagagagacatcaccatcgcttccaccaagggcagttcaagcgatatggagaagcggctgagggccgagatgcagaaggcggaggataaagccgtggagcacaaagagatcttggaccagctggaaagcctcaaattggaaaacagacacctttccgagatggtgatgaaactagaactggggttgcacgaatgctccctgcccgtgtccccactgggtagcattgcaacccggttcctcgaggaagaggaattgaggtcgcaccacatcctcgagagactcgacgctcacattgaggagttgaagagggagtcggagaaaaccgtgcgccagttcactgctctaaagtag

SEQ ID NO: 24764 - DNA, 483 bp, Artificial Sequence
  Description of Artificial Sequence: Synthetic coding sequence
atggaggccgagcggccccaggaggaggaggacggcgagcagggccctccccaagatgaggaagggtggccccctcccaactctacaaccaggccctggagaagtgcacccccatctcccccacctcccggaacacggcacactgccctgggacctcgaagcgctagtctgttatccctccagactgaactgcttcttgaccttgtggcagaagctcagtcaagaaggctggaagaacaacgcgcaactttctatacaccgcagaacccatcctctctggcccctgcaccgttgcgacctctggaagatagagaacagttgtactcaacaattctctcccaccaatgtcagcgaatggaggctcagagaagcgagcccccattgccgcccggggggcaggaattactcgaacttttactcagggtacagggaggggggcggatggaggagcagcgatctaggccgccgactcacacatgctag

SEQ ID NO: 24765 - DNA, 483 bp, Artificial Sequence
  Description of Artificial Sequence: Synthetic coding sequence
atggaggccgagcggccccaggaggaggaggacggcgagcagggccccccacaggacgaggagggttggcccccccccaattcgactacacgcccctggcgaagcgccccacctagtcccccaccgccggggacaaggcatacggcactcggcccccgctccgcctctctgctgagcctgcagaccgaacttctgctggacctagttgcagaggcccagtcccggagactggaggaacaaagggctactttttacacccctcagaatccctcatctctcgcgcctgcccccttgcgaccattagaggatagagagcagctatactccacgatcctgtcccaccagtgccaacggatggaggcccaaaggagtgagccccctctgccaccaggaggacaagagctcctcgagttgctattgcgcgtgcagggcggcggccggatggaggagcagaggagtcgacctcccacgcatacgtgttag

SEQ ID NO: 24766 - DNA, 3192 bp, Artificial Sequence
  Description of Artificial Sequence: Synthetic coding sequence
atgccccacctgcccctggccagcttccggccccccttctggggcctccgtcactccagaggcctgcccagattccattcagtgtcaactcagtctgaaccccatggctccccaatcagccgacgtaatcgcgaagctaagcagaaaaggcttcgggaaaaacaggcaacacttgaggcggaaattgctggtgagtctaagtccccagcagagagcatcaaggcctggaggcctaaagagctcgtactctacgagataccaacaaaacccggagagaagaaagatgtgtctgggcccttaccgccggcctatagtcccaggtacgtggaggccgcttggtatccctggtgggtgcgagaaggattctttaaaccagagtaccaggcacgtctgccgcaggcaaccggggagacatttagcatgtgtatccctccccccaatgtgacagggtctctgcacattgggcatgccctgaccgtggctatacaggacgccctggtcaggtggcataggatgcggggggaccaggtactgtgggtgccaggtagtgatcacgccggaattgccacgcaagcggtggtcgagaaacagctgtggaaagaacgaggggtccgcagacacgaactgagccgggaagcttttttacgcgaggtgtggcagtggaaagaagcaaagggtggtgagatctgtgagcagctcagagctctgggggcaagccttgattgggaccgcgagtgttttacgatggacgtcggcagctctgtggctgtcaccgaggcattcgtgagactgtacaaagccggtcttctgtaccgaaaccaccagctagtcaattggtcgtgtgcgttgaggtcagctatcagcgacatcgaagtcgaaaaccgacccctgccaggtcatactcaactgcgcctgcctgggtgtcccacgccagtcagtttcggtctgctgttctctgtcgccttccccgttgatggggagcctgatgcagaggtggtcgtgggaaccaccagacctgaaactctacccggagacgtcgctgttgccgtgcatccagacgactctagatacacgcacctgcacggaaggcaactcagacatcccctcatgggccagcccctgcctttaatcactgactacgccgtgcagccccacgtgggtacaggagccgttaaagttacacccgcccactcaccagcagacgccgaaatgggggcaaggcacgggcttagccccctgaatgtgattgctgaagatggcaccatgacctccctctgtggcgattggctgcagggtctgcatagatttgtcgccagggaaaaaattatgagcgttctgtccgaaagaggattatttagaggcctccagaatcaccccatggtactgcctatttgctcgcggtccggcgacgttatcgaatacctgttaaaaaaccagtggtttgtgcgatgtcaagagatgggagcccgggcagccaaggcagtcgagtctggcgcattagaactgagtcccagtttccaccagaaaaactggcagcattggttttcacacattggcgattggtgtgtatcccggcagctttggtgggggcatcagatccctgcctatctggtagtggaggatcatgcacagggtgaagaggactgttgggtggtggggagatcagaggcagaagcgagggaagtggccgcagaactgacagggcgcccaggggctgagctaacgctcgagcgagaccccgacgtgctcgatacctggttttcatccgctttattccccttcagcgctttggggtggccacaggagaccccagacctcgccaggttctaccccctttccctgctggagaccggcagtgatttactgctcttttgggttggccgcatggttatgcttggaacacagttaactggccagctgccttttagcaaggttctccttcatcccatggttagagatcgtcaaggccgtaagatgtccaaaagtttgggcaatgtactggaccccagagatataataagcggcgtcgaaatgcagctgctgcaggaaaaactcagatctggaaatctggacccagctgagcttgccattgtagccgctgcgcagaagaaggactttccacacggcattcctgagtgcggaacggatgcgctgaggtttacgctttgcagtcatggcgttcaggccggcgatctccacctctcagtgtccgaagtgcagtcctgcagacacttttgtaacaaaatctggaacgctctgagatttatcttaaatgctcttggcgaaaagttcgtgccccagccggctgaggagctcagcccatcaagccctatggacgcatggatcctctcccggcttgctctggccgcacaagagtgtgagcgtggattccttacaagggagctgtcattagtgacccatgcactgcatcatttctggctacataatctgtgtgacgtgtatttagaagccgtgaagccagttctctggcattcccctcgacccttgggcccccctcaggtccttttctcctgtgctgacctcggacttaggttgctggctcctctcatgcctttccttgctgaagaattgtggcagaggctgcctcctcggcctggctgtccccctgcaccatccatcagcgtcgccccatacccttccgcctgtagcctggaacattggaggcagccagagctggaacgccgatttagcagggtccaggaagttgtgcaggtgcttagggcattgagagcgacttaccagctcactaaggccagacctcgcgtgctgctacagtcaagtgagcctggggaccaggggttgttcgaagcctttctggagcccctcggcactctcggatactgtggcgctgtcggtttgctcccgcctggcacagccgccccatcagggtgggcccaagcacctttatccgataccgcgcaagtgtacatggagctacaggggctcgtcgacccacaaatccagctgcccttacttgctgccaggcggtataagcttcagaaacagctggacagcctaaccgcacgcacaccatccgagggcgaagcgggtacacagagacagcagaaactgagtagcttacaactggaactgtccaagctggacaaagccgcgagccacctgagacaactcatggatgagccccccgcccccggctccccggaactgtag

SEQ ID NO: 24767 - DNA, 1620 bp, Artificial Sequence
  Description of Artificial Sequence: Synthetic coding sequence
atggccaccagcgcccccctgcggagcctggaggaggaggtgacctgtagcatctgcctcgattacctcagggatcccgttaccatagattgcggtcatgtcttttgtaggagttgcacaaccgacgtccgcccgataagcggcagcaggcctgtgtgcccgctctgcaagaagcccttcaaaaaagaaaatatcagaccagtgtggcagcttgcaagcttggtcgaaaatatcgaacggcttaaggtcgataaaggccggcagccaggtgaagtgactcgagagcaacaggatgcgaaactatgtgaaaggcatcgggaaaaactgcactattactgcgaagatgatggcaaactgctgtgtgttatgtgcagagagtcccgagagcatcgccctcatacggctgtgctgatggagaaagccgcccagccccacagagaaaaaattctgaatcacctaagcacattacggcgagaccgcgacaagatccagggcttccaggccaaaggcgaggccgacatcctcgccgccctcaagaagttacaggaccaacgccagtacatcgtggccgagttcgagcagggccatcagtttttgagagaaagagaggaacatctgcttgaacagttagccaagctagaacaggaattgaccgaagggcgcgaaaaattcaagagcaggggagtgggggaactcgcacggctggcactggtgatcagtgaactggaggggaaagcccaacagcctgcagcggaactgatgcaggacacacgagatttcttaaatcgttatccaagaaaaaagttctgggtgggaaaaccgatcgccagagtggtgaagaaaaagactggcgagttctctgacaagcttctgagcctgcagcgcggacttagggagttccagggaaagttgctgcgagatctggagtacaagaccgtctctgtgacgctcgatcctcagagtgccagtggctatttgcagttgtccgaagactggaaatgtgtgacttatacctcactatataagtcggcctatctgcacccccagcagttcgactgtgagcctggagtgctgggtagcaaaggcttcacatggggtaaagtttattgggaggttgaagttgagcgggaaggatggtcagaggatgaggaggaaggggatgaagaggaggaaggcgaggaggaggaagaggaagaggaagctggatatggcgacgggtacgatgattgggagaccgacgaagacgaggagtcactcggtgatgaagaagaagaggaggaggaagaagaggaagaagtactggagtcatgcatggttggtgtggctagggattctgtgaagaggaagggagacctgagtcttaggccagaggatggagtttgggccctacgcttaagtagcagcgggatttgggcaaacacctcccccgaggccgaactgttcccagcgctcaggcctaggagagtggggatcgccttagattacgagggcggaacggtgacctttactaatgccgagtcccaggagctgatatatacgttcacagccacctttacacgccgcctggtcccttttctgtggctcaagtggcccgggaccaggttgctgctccggccttag

SEQ ID NO: 24768 - DNA, 678 bp, Artificial Sequence
  Description of Artificial Sequence: Synthetic coding sequence
atggccgccggcagcgaggccaccacccccgtgatcgtggccgccggcgcagggggagaagagggagagcatgtcaagcccttcaagcccgagaaagctaaagagattatcatgtccttacagcagccagcaattttttgtaatatggtgtttgattggccggccagacattggaatgccaaatatctttcacaagtgcttcatggaaaacagattcgcttccgaatgggaatgaaaagcatgagtacagtgcctcaattcgagaccacatgcaattatgtcgaggccaccctagaagagtttctgacctggaattgtgatcaaagtagcatctcggggcccttccgggattacgatcacagtaaattttgggcttatgcagactacaagtacttcgtaagtctgttcgaggataagacagacctattccaggacgtgaagtggagcgattttggcttccctggtaggaacggtcaggaaagcactctctggattggaagtcttggagcgcacacaccatgtcacttagattcctatgggtgcaatctggtctttcaggttcagggaagacttgaatgcaacgggatgatcatcgcccccggcccacaggccatcttgctgccccaacccctcaaatacctgggattacaggaaactatggcgagtctaagcagctag

SEQ ID NO: 24769 - DNA, 2571 bp, Artificial Sequence
  Description of Artificial Sequence: Synthetic coding sequence
atggacatcagcaagggcctgcccggcatgcagggcggcctgcacatttggatatccgaaaacagaaaaatggtgcctgttccagagggagcctacggcaacttcttcgaagagcactgttacgtgattctacacgtcccacaatcccccaaagctactcagggcgcttctagtgatctgcactattgggtgggcaagcaggctggggctgaagctcagggcgctgcagaagcctttcaacagagactgcaggatgagttggggggacagacagtattgcatagggaggcgcaagggcacgaatctgactgtttctgttcttattttagacctggaataatttatcgcaagggcggcttggcatcagatttgaaacacgtcgagacaaatttgtttaatatccagaggctgctccacatcaaaggtcggaagcacgtaagtgccactgaggtggaactgagctggaattcgtttaacaagggcgacattttcctgctcgacctggggaaaatgatgatccaatggaatggtccgaagacctccatctctgagaaggctagagggctggccctgacatatagcttacgggacagagagaggggggggggtcgggctcagataggcgtggtggacgacgaggctaaagctccagatctgatgcagattatggaggctgtgctgggcagaagagttgggtcgctgcgggctgctaccccttcaaaagatatcaaccagcttcaaaaagcaaacgtgcggttatatcacgtctacgaaaaggggaaggatctggtcgtgttggaattggccaccccaccgctgacgcaggacttgttacaagaggaggacttttacattctggaccagggcggctttaagatttacgtgtggcaaggccgcatgagcagcctacaggagcgtaaggccgcttttagtcgggcagtggggttcattcaggctaagggctaccctacttataccaatgtggaggtggtcaacgacggtgctgagtctgctgctttcaagcagttattcagaacctggtctgagaagcgtcggcgcaaccagaagctggggggacgggacaagagcattcacgttaaattggacgtgggcaagttacacacccagcctaagctcgccgctcagttgagaatggtagacgatggctccggaaaggttgaggtttggtgcatccaggacctacaccggcaacccgtggatccaaagcgtcatgggcaactctgtgctggtaattgctacctagtactttacacctatcagagactgggccgtgtgcagtacatcctctacctgtggcagggccaccaggccacagcagacgagatcgaggccctgaacagcaacgcagaggagctagatgttatgtacggcggcgttcttgtccaggagcacgtcacgatgggctctgagcccccccactttcttgccatttttcaagggcagctcgtgatttttcaggaaagagccggccatcacgggaaaggtcagtccgccagcaccaccagactattccaggtgcaagggacggactcccacaacactcgtactatggaagtgcctgcccgtgcaagctcactgaactcctcagatatcttcttactcgtcacagcttctgtgtgttatttatggtttgggaaagggtgtaacggcgaccaacgcgagatggctcgcgttgttgtgacagtgattagcaggaagaatgaggaaacagtgttagaaggccaggaacccccacatttttgggaagcactgggcggcagagcaccctaccctagcaacaagcgcttacctgaggaggtgccaagttttcagccaagactgtttgagtgtagcagccatatggggtgtctggtgcttgccgaagttgggttctttagccaggaggaccttgataagtacgacattatgctgttggacacatggcaggaaatttttttgtggttgggcgaagcagctagtgagtggaaggaggctgtggcctggggccaggaatatctcaagacccaccccgcaggtcggtctccagccacacccattgtgctggtgaagcaggggcacgagccacccacctttatcggctggttttttacctgggatccttataagtggacgtctcacccctctcacaaagaagtggttgacggatcacctgcagctgccagcaccatttccgaaatcacagccgaggtcaacaatctgagactgagccgttggccagggaacggccgcgcgggcgccgtcgccctgcaagcacttaaaggctcccaggattccagtgaaaacgatctggtgagatccccaaagtctgccggatcaaggacaagtagttcggtttctagtacttccgcaaccattaacggaggcctcagacgggaacaactgatgcaccaggcagtggaggacctgcctgagggagtggatcctgcccgaagggaattttacctgtctgattcggacttccaagacatattcgggaagtctaaagaggagttttacagcatggccacatggcggcagcggcaggaaaagaagcagctgggctttttctag

SEQ ID NO: 24770 - DNA, 2607 bp, Artificial Sequence
  Description of Artificial Sequence: Synthetic coding sequence
atggccagcttccccgagaccgacttccagatctgcctgctgtgcaaggagatgtgcggttcacccgcaccgctgtctagtaattctagcgcttcctcatcttcatcccagacctcaacaagctccgggggcggaggtggaggaccaggcgctgctgcccgaagactgcacgtgctcccctgcctccatgccttctgccggccgtgcttggaggcacaccggctccctgccgctggcggaggcgctgccggcgagcccctcaagcttaggtgcccagtatgcgaccaaaaagtggttcttgctgaagctgctggaatggacgccttgccctctagtgctttcctcctgagcaatctgttagacgcggtggtcgcgacagcggatgaacctcccccaaagaacggcagagccggcgcacctgccggggctggcggtcacagcaatcaccgtcatcatgcacaccatgcacaccctagggcgagcgcctcagccccacccctgccccaggctcctcaaccaccggctccctcccgttctgctccgggcggccctgctgcttctccctctgcccttttactacgacggcctcacgggtgtagctcttgcgacgaagggaatgccgcctcctcacgctgtctggactgtcaggagcatctgtgcgacaactgtgtgcgcgcccaccaacgggtgagactcacaaaagatcactatatcgagcgcgggccccctgggccaggggctgctgctgctgctcagcagttaggcctgggtcccccctttccaggccctccattctctatcctgtctgtctttccagagcggctggggttctgccagcaccatgacgatgaggttctgcacctgtattgcgacacatgctccgtgcccatttgcagggaatgtaccatgggacggcacggaggtcactcctttatttaccttcaggaggcgctgcaggactcacgcgccctgactatccagctccttgctgacgcgcagcagggtcggcaggcaatccagctttctatcgagcaggcacaaacagtggcggaacaggtagaaatgaaagcaaaggtggtacaaagcgaggtcaaggcagtgacggctagacataaaaaagcattagaagagagagaatgcgagctgctctggaaggtggaaaagattagacaggtgaaagctaaaagtctgtatttgcaagtggagaagctgagacagaacttaaacaagctcgagagtacaatctctgcggtgcagcaggtgttagaggaggggagagctttggacattcttctggcaagagacaggatgctcgcacaggtgcaggaactgaagaccgtgcgctccctgttgcagcctcaggaggatgaccgggtgatgttcactccccccgaccaggccctgtacctcgccatcaagtcttttggatttgtctctagtggcgcctttgcacctctgactaaggccacaggagatgggctcaagcgtgctcttcagggcaaagtagcttcatttacagtgattgggtacgaccatgatggcgagccccggctttctgggggtgatctgatgagtgccgttgttttaggtccagacggcaatctatttggagctgaggtttcggatcagcagaacggaacgtacgttgtgagttatcggcctcagcttgagggggaacaccttgtgtccgtaacactgtgcaatcaacatatcgagaacagccccttcaaagtggtcgtcaaaagtggtcggtcttacgtggggattggactaccggggcttagtttcggatctgagggagattccgatggcaagctttgcagaccatggggggtctccgttgataaggagggctacatcattgttgctgatcgaagtaacaaccggattcaggtatttaagccgtgcggtgcctttcaccacaaattcggaacactgggcagccggcctggccagttcgataggccagccggagtggcttgcgacgcctccaggagaatcgtcgtggccgataaagataaccatcgcattcaaattttcacatttgaaggccagttcctcctgaagttcggtgaaaaggggactaagaatgggcagttcaattacccttgggacgtcgctgtaaattctgagggtaagattctcgtgagtgacacgcggaatcaccgcatccagctgtttggtccagacggcgtgttcctgaataagtatggcttcgaaggtgcactgtggaagcactttgacagcccaaggggcgttgcattcaaccatgaagggcaccttgtggtgacagattttaataatcaccggctgttggtgatccatcctgattgccagagcgctcgctttttgggttccgaaggaacaggcaacggacagtttctgagacctcaaggagtcgccgtggatcaagaggggcgcatcatcgtggcagactccaggaatcaccgcgtacaaatgttcgagtcaaacggtagctttttatgtaagtttggagctcagggtagtggcttcgggcagatggacagaccgagcgggatagccataacccccgacggaatgatcgtcgtagtagacttcggaaataaccgcattttagtcttctag

SEQ ID NO: 24771 - DNA, 1107 bp, Artificial Sequence
  Description of Artificial Sequence: Synthetic coding sequence
atgcgggagcccgtgctgacctggtgcgtgcccctggagctgctgtgcagccaccccctacctttatcggcctttttaaaaagccaggtaaagctttatacttacagagcatgcgctggaaaggatgaaatgggcaagatggtcagtgtgatcaatacagtggatacatctcacgaggacatgatccacgatgctcaaatggactactatggaacccggctagcaacctgctccagcgatcggtcagttaaaattttcgacgtgcgcaatggcggacagattctgatcgcggatttacgcggtcatgaaggacccgtgtggcaggttgcttgggcccacccgatgtatggaaatatactcgccagttgttcttacgatcggaaagtaatcatctggcgggaagagaacgggacatgggaaaagagtcacgaacatgcagggcacgatagcagcgtaaactccgtttgttgggccccacacgactatgggctgatccttgcatgcggctctagtgatggcgcgataagtctgctgacctatacaggggagggacaatgggaggtgaagaagattaacaatgcccataccattggctgtaacgccgtgtcctgggcacccgctgtggtgcctggctctctgatcgaccacccgtcaggacagaagcctaattatatcaagcgctttgcctccggaggctgtgacaacctgataaagctttggaaggaggaggaggatggtcagtggaaagaggagcagaaactggaagcccattccgactgggtgcgggatgttgcttgggcccccagtatagggttgccgacctctaccattgcttcctgttcccaagatggacgcgtttttatttggacgtgcgacgacgcctcctcaaatacctggagtcccaaactcttgcacaagttcaatgatgtcgtctggcatgtctcctggagcattactgctaatattctggcagtgtccggaggagacaataaggtgaccctgtggaaggaatccgtcgatggccagtgggtgtgcatcagtgacgttaataagggccaaggaagcgtgtccgcgtccgtcaccgaagggcagcagaacgaacaatag

SEQ ID NO: 24772 - DNA, 1059 bp, Artificial Sequence
  Description of Artificial Sequence: Synthetic coding sequence
atggacatcgacaaggacctggaggcccccctgtacctgacccccgagggctggtcactgttcctacagagatactaccaggttgtgcacgagggggcagagttgcggcacctcgatacacaggttcagaggtgcgaggatatcttacagcagctgcaagctgttgtgccgcagatagatatggagggcgaccggaatatttggatagtaaaacccggcgccaaatccaggggaagaggcatcatgtgcatggatcatttggaggaaatgctcaagttagtaaacggcaacccggtagtgatgaaagacggcaagtgggtggtgcagaagtacatagagcgccctctgcttatatttgggactaaattcgacctacgccagtggttcctggtgaccgattggaatcccttaacagtttggttctacagggatagttacatccgatttagcacccaacctttcagtttgaaaaacttagacaactccgtgcatttgtgcaacaacagcatccagaagcatttggaaaattcctgccacaggcaccctctcttgccccccgataacatgtggtccagccaacggttccaggcccacctccaggagatgggtgcaccaaacgcttggtccacaattatcgtgcctggcatgaaagatgccgtgattcatgcgcttcagacctcccaggacactgttcaatgcaggaaagcctctttcgaactgtacggcgctgacttcgtcttcggagaagactttcagccgtggctgatcgaaatcaatgcgtccccaaccatggccccctctactgccgtgaccgctagactgtgtgcgggcgtgcaagccgatactctgagggtcgtgattgacaggatgctggatcgcaattgcgacactggcgcatttgaattgatatacaaacaacctgtcaccacttcccccgcatccacgcctcgcccgtcttgccttttacctatgtattccgatactagggcccgaagctcagatgattcaacagcttcttggtgggccttgagaccgtgtcgtccccaggctcgaccttag

SEQ ID NO: 24773 - DNA, 579 bp, Artificial Sequence
  Description of Artificial Sequence: Synthetic coding sequence
atgggcaagggctgcaaggtggtggtgtgcggcctgctgagcgtgggaaagaccgcgattctcgagcagctgctgtacggcaaccatacaatcggtatggaagattgtgaaaccatggaggatgtgtatatggcatccgtcgagacggaccgaggagtgaaggagcagctacatctgtacgacacccgcgggcttcaagagggggtggaactgcccaaacattatttctccttcgccgatggctttgtactcgtgtatagcgtgaataatttggagtcgttccagagagtcgagcttctgaagaaagaaatcgataaattcaaggacaaaaaggaagtggcgatcgttgttttggggaacaagatcgatttgtccgagcagcgccaggtggacgccgaagtggcgcaacaatgggccaaatctgaaaaggtgcgcttatgggaagtgaccgtgacagatagaaaaacattaatcgagccctttacactccttgcttcaaagttgtcgcagccgcagtcaaagtcttctttcccccttcctgggcgcaaaaataaaggcaactctaattctgaaaactag

SEQ ID NO: 24774 - DNA, 1419 bp, Artificial Sequence
  Description of Artificial Sequence: Synthetic coding sequence
atgagccggcgggtggtgcggcagagcaagttccggcacgtgttcggccaggcagctaaggccgaccaggcatacgaggacatcagagtcagtaaagtgacctgggactctagcttctgtgccgtcaatccaaagttcctagcaattattgtcgaagcagggggcggcggggccttcatcgttcttcctttggccaaaaccggcagagttgacaaaaactaccctctggtcactggacacacagcccctgtgctcgatattgactggtgtcctcacaatgataacgttatcgcctcggcgtcagatgacaccacaatcatggtgtggcagattccagattacacccctatgcggaacattaccgagccaatcataactctcgaggggcattccaagcgcgtgggcattctgtcttggcaccccactgcgcggaacgtgctcctgagtgctggaggagacaacgtcataattatatggaacgtgggtactggcgaagtgctcttatctctggacgatatgcaccccgatgttatacacagtgtgtgctggaacagcaatggctcgcttttggccaccacttgcaaggacaaaacattgcggataatcgaccctaggaaaggccaggtagtagctgagcgtttcgcagctcacgaaggcatgagaccaatgcgcgcagtgttcacccggcaaggacatatctttaccactggatttacacggatgtcccagagggaacttggactgtgggacccaaataattttgaggaaccggtagcacttcaggaaatggatacctcaaatggcgtgctcctcccattctacgacccagatagtagcatcgtgtacttatgcggaaagggcgatagcagcattagatattttgaaattacggatgaacctcctttcgtgcattatctgaatacgtttagctccaaggagccacagcgggggatgggattcatgcccaaacgcggccttgatgtgtccaaatgcgagattgcaagattctataagctacatgagagaaagtgcgagcccattatcatgaccgttccacggaaaagcgacctgttccaagacgacctgtatccagatactcctggtcccgagcctgcacttgaagctgacgaatggctgtcaggacaggacgccgaacccgtgcttatttcgctgcgagatggatacgtccccccaaagcatcgcgagctcagagttaccaagcgcaacattctggacgtccggcccccatctggtcccaggaggtcgcagtcagcctccgacgcaccactatcccagcagcatacactggaaacgctattagaagagatcaaggctctgagagagagagtgcaggcgcaagaacagaggattacagctctggagaacatgctctgtgagttggtcgacggcacggattag

SEQ ID NO: 24775 - DNA, 2628 bp, Artificial Sequence
  Description of Artificial Sequence: Synthetic coding sequence
atgggcgacagcgacgacgagtacgaccggcggcggcgggacaagtttcggcgcgagcgcagtgactacgatcgtagtcgagaacgggacgagagacggcgcggtgacgactggaatgacagggagtgggatcgaggcagagagcgcaggtcaagaggcgaatacagagactatgatcgcaaccgccgggagcgcttctcacccccacgccatgaacttagccccccccagaagcggatgaggcgcgactgggatgagcattcctccgacccataccactctggctacgagatgccctacgcaggaggaggaggagggccaacatacggcccacctcagccttggggtcatcctgatgtacacattatgcagcatcacgtgctgcctatacaggctaggcttggcagtatagcggaaattgacctgggtgtcccaccacccgtgatgaagacttttaaagaattcctgctctcactggacgactccgtagacgagacggaggcagtcaaacgctataatgactacaaattagactttcgccggcagcagatgcaagatttctttcttgcccacaaagacgaggagtggttccggagcaaataccaccctgatgaagtggggaagagacggcaggaggccagaggagcactgcagaacagattacgtgtgtttttatctcttatggagacgggatggtttgataatctcctgcttgatattgacaaagccgacgctattgtcaaaatgttggacgcggccgtgattaagatggaggggggaacagagaatgatctgaggatcctagagcaggaggaggaggaggaacaggccgggaagcctggtgaaccaagcaagaaggaggagggccgcgcaggcgcgggcctcggggatggcgagcgcaagaccaatgacaaggacgagaaaaaggaggatgggaagcaggctgaaaacgatagcagcaacgacgataagacaaaaaaatcagaaggggacggggataaagaggagaagaaggaagatagtgagaaagaggcaaaaaagtcatcaaagaagagaaatagaaaacattccggcgacgactctttcgatgagggatccgtgtccgagtctgagtccgagtcagagtccggccaagctgaagaagaaaaagaggaggccgaggctctgaaggagaaggagaagcccaaggaggaagagtgggagaagcctaaggatgcggcagggctggaatgtaagcctaggcctcttcacaagacatgctccctgtttatgcgcaatatagccccaaacatcagccgcgctgaaatcatcagcctctgcaagaggtaccccggcttcatgcgggttgcccttagcgaaccacagccagagcgcagattctttagaagggggtgggtgacctttgatcggtccgtgaacatcaaagagatctgctggaacttacaaaacatcaggctgcgcgagtgcgagttgagccccggtgtgaaccgcgatctgactaggcgggtccgcaatataaatgggatcacccagcataagcaaattgtgcgcaatgacattaaactggccgcaaaactcatacatacattggatgacaggacccagttgtgggcgagcgagcccgggaccccaccactgccaactagtctccctagccaaaatcccatcctgaagaatattactgactatctgatcgaagaagtctctgccgaggaggaagaactcctgggcagttccggaggcgctcctcctgaggaacctccaaaggagggcaatcccgccgaaatcaatgtcgagagagatgagaagttaattaaggtcctggataaattactcctgtacctgcgaatagttcacagtttggattattacaacacatgtgaatatcctaatgaggacgagatgcccaaccggtgtgggatcatacatgttagaggccctatgccacctaaccggatttcccatggtgaagtacttgagtggcagaaaacgttcgaagaaaaacttacacccttattaagcgtgcgggaatccctgagcgaagaggaggctcagaaaatgggaaggaaagacccggaacaggaggtggagaagttcgtgacgtctaatacgcaggagctaggaaaggacaagtggctgtgcccactctcaggcaagaagtttaagggcccagagttcgtccggaaacatatctttaataagcacgctgaaaagattgaggaagtgaagaaagaggtggccttctttaataactttctgaccgatgcaaaacgtcccgctttgcctgaaatcaaacctgcgcaacctcctggccccgcccagatcctccctccaggattgactccaggtctcccataccctcatcaaaccccccaggggctgatgccttacgggcaacccaggccccctatactaggttacggagcgggagccgttaggcctgctgtccctaccggaggcccaccgtaccctcacgcaccctatggtgccgggcggggaaactacgacgctttcagaggtcagggcggctatcccgggaaacctagaaatagaatggtaaggggcgacccacgcgctattgtagaatacagggacctagacgcgcccgatgacgtggactttttctag

SEQ ID NO: 24776 - DNA, 816 bp, Artificial Sequence
  Description of Artificial Sequence: Synthetic coding sequence
atggccgccgtggagaagcggcggcaggccgtgcccccccccgccggtttcaccgattctgggagacagtctgtcagcagggcagcgggggccgccgaatcagaagaagatttcctgagacaggtgggagtgactgaaatgctgagagccgcgctcctgaaggtgttggaagctcgcccagaggaacccattgcttttttggcccactatttcgaaaacatgggcctgcggtcaccggtgaacggaggcgccggggagcccccaggacaactgcttctgcagcagcagcggctaggccgcgcgttatggcatctgaggctcgctcaccattcccagagagctgcctttaataataacgtgagtgtcgcctacgagtgtctcagcgctggggggagaaggaagcgacctgggctggacgggaggacttattcagaactgctgagacgcatttgtcgtgatggacaggcgccagaagaagttgtcgccccactcctgaggaaagtccagtgtcgtgaccacgaggccgtcccactatcagtattccgggcgggtaccctgacatgcttcgttctgctggaatttgtcgcacgcgcaggggccctgtttcagctgttggaagatagtgcagcggctgtggccgaccggcgcgtcgggcaggcagtcctggatacgctggaaggcgctctgcaggcgtctgatgctgcagctcccgcacgatttctggaagcaggcagccgtctggcccccatgaccagagaggaatttctggagagagccgctgcactatttattgccaaggttaagccggtgggatag

SEQ ID NO: 24777 - DNA, 1977 bp, Artificial Sequence
  Description of Artificial Sequence: Synthetic coding sequence
atgggcggccacctgagcccctggcccacctacaccagcggccagaccatcttgcagaatcgtaaaccttgctcagacgactatcggaagcgagtgggatcttgtcagcagcatccattccgaactgccaagcctcagtatcttgaagagcttgaaaattatctgagaaaggagcttctccttttggacctgggaacggactctacacaggagctccggttgcagccctatcgcgaaattttcgaattttttattgaagatttcaaaacgtacaagcccctgttgtcctcaatcaagaatgcatacgaagggatgctggcccaccagcgggagaaaataagggccctggagcccctcaaggccaaattagtgactgtgaatgaagactgcaacgagcggatcctggctatgcgagctgaggagaaatacgaaatcagcctactcaaaaaggagaaaatgaacctcctgaaactcatcgacaagaaaaacgaggaaaagatttccctgcagtctgaggtcactaaactgcggaaaaacttggccgaagagtacttgcattatctctcagaaagagatgcatgcaagatcctcattgcagacttgaacgaactgcgataccagcgagaagacatgagtctggcacagtcaccagggatctggggcgaagatcccgttaagctgactctcgcactgaagatgactaggcaggacctcacacgcacacaaatggaactcaacaacatgaaggctaattttggagacgtggttccacgccgcgacttcgaaatgcaggagaaaactaacaaagatcttcaggagcagttggatacgcttcgcgcttcatatgaggaggtaaggaaggagcatgagatactcatgcagctgcacatgagtactttaaaagaacgagaccaattttttagcgagcttcaggagattcaaaggaccagtacccctaggcctgactggacaaaatgcaaggatgtggtggctgggggcccagaaagatggcaaatgttggcggaagggaaaaactctgatcaattagtggacgttctcctcgaagagattggatccgggcttctacgtgagaaggatttttttccaggcctcggctatggggaggccattcccgcgttcctcaggttcgacggcttagtggaaaataagaaaccgagcaagaaggatgtcgtgaacctgctaaaggacgcttggaaagagagactggccgaggaacagaaagaaactttcccggatttcttctttaattttctcgagcaccgcttcgggccgtctgacgcgatggcttgggcctacaccatcttcgaaaatatcaagatctttcattcgaacgaggttatgagccaattttatgctgttctcatgggtaagaggagtgaaaatgtttatgtcactcagaaagaaactgtggcccaactattgaaagagatgaccaacgcagatagtcaaaatgaaggactgctaactatggaacaatttaataccgttctgaagtcaactttccccttaaagactgaggaacaaatccaggagttaatggaagctggaggatggcacccttcttcctcgaacgcggacttacttaattatcgcagtctttttatggaagacgaggaaggtcagtccgagccatttgtccagaaactgtgggagcagtacatggacgagaaagacgaatatctccagcaactgaaacaagagttgggcatcgagctacacgaggaggttaccctgccgaagcttcggggtggtctgatgactatcgatccctctttggataaacagacggtcaacacttacatgtcacaggcctttcagctgcccgagagcgaaatgccagaagagggggatgagaaagaagaagctgtggtggagatcctacagactgcgcttgaaaggcttcaggttatcgatattcgtcgcgtggggccacgagagccggaaccagcctcttag

SEQ ID NO: 24778 - DNA, 1287 bp, Artificial Sequence
  Description of Artificial Sequence: Synthetic coding sequence
atggagcccctgaaggtggagaagttcgccaccgccaagcggggcaatggcctgcgcgccgttaccccactccggcccggcgaactgctgtttagaagcgaccccctggcttacaccgtgtgcaaggggtcccgcggcgttgtctgcgatcgatgccttttagggaaagaaaaattgatgcgctgtagccagtgccgggtcgccaagtattgctctgcgaagtgtcagaaaaaggcttggccggatcataagcgcgaatgcaagtgcctgaagtcatgcaaacctcgttatccaccagactctgtgcggctgctgggacgcgtggtctttaagctcatggatggggccccgtcagaatctgagaaactatactccttctacgacttagagtccaatattaacaagctaactgaagacaagaaagagggacttagacagctggtaatgactttccagcacttcatgagggaggaaatccaggacgcgtcccagttacccccagccttcgatctgtttgaagcctttgctaaggtgatttgcaactccttcacaatttgtaatgccgagatgcaggaagtgggggtgggtttgtatcccagtattagcttgctgaaccacagctgtgatcccaactgtagcatcgtgttcaatggaccccaccttctcctcagagctgtacgggatatcgaagtcggcgaggagttaaccatctgttatctagatatgctcatgacttccgaggaacgccggaagcagctgagagaccaatactgctttgagtgcgattgtttccgttgtcagacacaggataaagatgccgatatgctcactggggacgagcaggtgtggaaggaagtgcaggagtctctaaagaagatcgaggaactcaaggctcattggaagtgggaacaggtgctggccatgtgccaagcaatcatctcatccaattcagagcgactgcccgatattaatatctatcagttaaaagtactggactgcgctatggatgcctgcattaacctgggactcttggaggaggcgctgttctacggcacccggacaatggaaccgtatagaattttctttccaggttcccatcctgtcagaggcgtccaagtgatgaaagtgggtaaactgcagctgcatcagggcatgttcccacaggctatgaagaatttgaggcttgcattcgatataatgcgggtcactcacggtagagaacactccctgatcgaggatctgattctgctgctggaggagtgtgatgctaatattcgagccagctag

SEQ ID NO: 24779 - DNA, 1122 bp, Artificial Sequence
  Description of Artificial Sequence: Synthetic coding sequence
atgagcagcggcaactaccagcagagcgaggccctgagcaagcccacgttctccgaagaacaggccagtgctttggtggagagcgtcttcggtctaaaggtgagtaaggttcgcccccttccttcttatgacgatcagaactttcacgtttatgtgagtaagactaaggatggacctactgagtatgtattgaagatcagtaacactaaagcgagcaaaaacccagatttgattgaggtccaaaaccacataattatgttccttaaggcggccggcttcccgaccgctagcgtttgccatactaagggcgacaatacagcgtccctggtgtcggtcgactcgggaagcgaaattaaaagttaccttgttcggctcctcacttaccttccaggaaggcccattgccgagctccctgtgtcgccacagctgctgtatgagattggcaagttggccgctaagctggataagaccctgcagcgctttcaccacccaaaactatcaagtctgcaccgagaaaacttcatctggaaccttaaaaacgtgcccctattagagaagtatctctacgctttgggccagaaccggaacagagagattgtggaacacgtgattcacctattcaaggaggaggtgatgacgaaactgtcccatttccgggaatgtatcaatcatggcgacctaaacgatcataacattcttatcgagtcttccaaatctgctagcgggaatgctgaatatcaagtcagcggaattctggactttggagatatgtcctatggttactacgtttttgaggtcgcaattactatcatgtacatgatgatcgaatccaaatcccccatccaggtcggaggccacgtcctggctggattcgaaagtatcacaccgttgaccgccgtggagaaaggcgctctgtttcttcttgtgtgtagtcgcttttgccagtctctggtaatggcagcttacagctgtcagttgtatcctgagaacaaagactatctaatggtgaccgctaaaaccggatggaagcaccttcagcagatgttcgacatgggtcagaaagccgtggaggagatctggttcgagaccgccaagtcttatgaatccgggattagtatgtag

SEQ ID NO: 24780 - DNA, 2766 bp, Artificial Sequence
  Description of Artificial Sequence: Synthetic coding sequence
atggccctgctgtgcggcctgggccaggtgaccctgcggatctgggtgtcactcccatctcagagcgaaaatggcatcggctccggcggcatggaagccctaacaactcagttggggccgggccgggagggcagttccagtccaaatagtaaacaggagctgcagccatattccggatccagcgcgctcaagcccaaccaggtgggagaaacttccctgtatggcgtgcccatcgtatcacttgtgatcgatggacaggagcgactgtgcctggcccagatttccaatacgttattgaagaactatagttacaatgagatacacaacaggcgggttgccctaggcattacatgcgttcagtgtaccccagtgcagctggagattctgagaagggccggcgctatgcctatttcttccagaagatgtggtatgatcactaaacgggaggcggagcgcctgtgcaagtccttccttggcgaacacaagccccctaaactgcccgagaacttcgctttcgatgtagtccacgaatgtgcctggggatcaagagggtctttcatcccagctagatacaatagttcaagggccaagtgtataaaatgtgggtattgcagcatgtactttagccctaataagttcattttccactcccatagaactcccgatgctaaatatactcagcccgacgctgctaacttcaatagctggcgcagacacctcaagctgtctgacaagtctgccacggacgaacttagccacgcttgggaggatgtcaaggccatgtttaacggcggcactagatgcggagcagagatggcacctggcccaccacctcacaagagcctcaggtgtggcgaagacgaggcagctgggccacccggacctcccccaccgcatccacaacgaggcctcggcttggcaacaggcgccagcggccccgctggccctggcggccctgggggcggggccggcgtgcgatcctaccctgtgattccggtgccctccaaaggtttcggccttctacagaaactccctcccccattgttcccccatccatatggtttcccaactgccttcgggctgtgccccaagaaggacgaccctgtgctaggtgcgggagaacccaaagggggcccagggacagggtctggaggcggtggtgccgggactggcggaggagcgggcggaccaggagcttcccatttgccacccggtgcaggagcgggcccgggtggtggcgctatgttctggggtcaccagcctagcggagccgccaaagacgctgccgctgtggcagccgcagcagccgcagctactgtctacccgacatttcccatgttctggcctgccgccggtagcctgcccgtgccttcttatccagctgcgcagtcccaggcaaaagctgtggccgccgctgtggcagccgccgccgcggcggctgccgcagcagccgggtccggcgccccagaaccacttgacggggccgagccagccaaagaatccggtttgggagcagaagaacgatgcccctccgccctgagccggggccctttagacgaggatggcaccgacgaggccctgccaccccccctagctcccttgcctccaccgccacccccaccagccaggaagggatcttacgtctctgcttttagacccgtggtgaaggacacagaaagcatagccaagctgtacggttcagcacgggaggcgtacggggctggtcctgctcgggggccgggacctggcgctggttctggaggatacgtttcccccgacttcctgtccgaaggtagttcttcgtacaattcagcaagcccagacgtcgatacggcagatgagcccgaagtcgacgtagagagcaaccgcttcccagatgatgaagacgcccaagaagaaacagagcctagcgccccttccgctggcggaggccccgacggcgagcagcctactgggccccccagcgcgacctcctcaggggccgacggcccggccaattcaccagatggcgggtcccctcggccgaggagacggctcggccctcctcctgcgggaaggcctgctttcggtgatctagccgctgaggatctggtgagacggccagagaggtcgcctccaagcggagggggcggctatgaactgagggagccttgtggccctcttggtggcccagctcccgcaaaggtgttcgctcccgagcgagatgaacacgtgaaatcagccgctgtggcgttagggcctgccgcctcctacgtgtgcacccctgaagcccatgaacctgacaaggaagataatcactctccagcggacgatctggagacacgcaagtcttatcctgaccagcgcagtatctcccagccatctcctgcaaacactgatagaggcgaagatgggttaacactcgacgttaccggcacacaccttgtggaaaaggatattgagaatttggcaagggaggagctccaaaaattactgctcgagcagatggaactgcgtaagaaattagagcgcgagtttcagtcgctgaaagataacttccaggatcagatgaagcgagagctagcctacagggaggaaatggtccagcaacttcagatcgttagggacaccctatgcaacgagcttgatcaggagcgcaaggctcgctacgctatccagcaaaaattgaaagaggctcatgatgccctacatcacttctcatgcaaaatgctaacgcctcggcattgcacaggaaactgctccttcaaacccccactgctcccttag

SEQ ID NO: 24781 - DNA, 1395 bp, Artificial Sequence
  Description of Artificial Sequence: Synthetic coding sequence
atggccatgaccgccggcaccaccaccaccttccccatgagcaaccacactagagagcgcgtgaccgtagctaagctgacacttgagaatttctactcaaacctgattctgcagcacgaggaaagggagacacgccagaagaaactggaggttgctatggaggaggaggggttggcggatgaggagaaaaagctcaggcgcagccagcatgctcgcaaagagaccgagttcctccgcctcaaacggacccggctcggccttgatgacttcgaatcattgaaagtgatagggcggggtgcctttggcgaagtgcggcttgttcagaagaaagataccggccatatctatgccatgaaaatcttgcggaagagcgatatgctggagaaggagcaggtggcccatatcagagctgagagagacatcctggtagaggcagatggcgcctgggttgtgaagatgttctactcattccaggacaagagaaacttgtacctgattatggaattcctgccaggtggggatatgatgaccctactcatgaagaaagacaccctgacagaggaggagacgcagttttatatttctgaaaccgtcctggccatagatgcaattcaccaacttgggttcatccatagggacattaagcccgacaacctgctgctggatgccaaaggccacgttaaactgagcgatttcggtctatgcactggcctgaaaaaggcccaccgaacagagttctaccggaacctcacacataatccaccttccgacttcagctttcaaaatatgaatagtaaacggaaggcagagacttggaagaaaaaccgcaggcaactggcctacagcaccgttggcacacctgattacatcgctcccgaggtatttatgcagacggggtacaataaactgtgtgactggtggagcctgggcgtgattatgtacgagatgttaatagggtacccaccattctgctctgagacaccccaggaaacctacagaaaggtcatgaactggaaggaaacattggtgtttccacctgaagtccccatcagtgagaaggccaaggatttgattctgcgattttgcatcgactcagagaacagaatcggtaactccggagtagaagagatcaaggggcacccctttttcgagggggttgactgggagcacattagagagagacccgccgctatccccatcgagattaaaagtattgatgatacttcaaactttgatgattttccggagtccgatattttacagccagtccccaacaccacggagcccgattacaaaagcaaagactgggtctttctcaattatacctataagaggttcgaaggcctaactcagaggggctctatcccaacatacatgaaagccgggaagctgtag

SEQ ID NO: 24782 - DNA, 3951 bp, Artificial Sequence
  Description of Artificial Sequence: Synthetic coding sequence
atggccagcaagggcgccggcatgagcttcagccggaagagctacaggcttacttccgacgcggagaagagcagggtgaccggaatcgtgcaggaaaagttgctgaatgattatctgaatcgcatttttagctcttccgaacacgccccacctgctgccactagtcgcaaacctctaaatttccagaatctccccgagcacctggatcagttactgcaagtggacaacgaagaggaagagagtcagggccaggtggagggaaggctaggcccaagcaccgtcgtgctggatcacaccggcgggtttgagggactactactcgttgacgacgacttactgggagtgattggccattctaattttggaactatcaggtcaactacttgtgtttataagggaaagtggctgtacgaggtgctgatctccagtcagggcctgatgcagatcgggtggtgtaccatcagctgtcggtttaatcaggaggaaggagttggcgacacacacaactcatatgcttatgatggaaacagggtgcgtaagtggaatgtgactacaacaaactatggcaaggcttgggctgccggggatatcgtatcgtgcctgatcgacctagacgacggcaccctgagcttctgtctcaatggggtcagtctgggaaccgcctttgagaacctctcacgagggcttggtatggcatatttcccagccatcagtttgagttttaaggagtctgtcgcttttaatttcggctcccgacctctgagatatcccgtcgcagggtaccggccgctacaggatccaccttcagcggaccttgtgcgagcgcagcgcttgcttggttgcttccgggcggtgctgtcagtcgaactcgatccagtggagggccgcctgcttgataaggaaagttccaagtggagactgcggggacaacccacagtattgttaactctggcacatattttccaccattttgccccactgctccgcaaggtgtaccttgtcgaggcagtcctgatgtcctttttgttgggcattgtggagaagggaacaccaacacaggcccagtctgtcgtacatcaggtgctcgatctcttgtggttgttcatggaagattatgaggtacaggattgtctcaagcaactgatgatgtccctcctacgcctctaccgcttcagccctatcgtccctgacctgggccttcagatccattatctgcgcctgaccatcgcaatcctgagacatgagaaatctagaaagtttctcttaagcaacgtgcttttcgacgtgctgcgcagtgtcgttttcttttacattaagtcccctctgagggtggaggaggctggattacaggaactgattcctaccacgtggtggccccactgttcgagccgggaagggaaggagtcaaccgaaatgaaggaggagaccgccgaggagcgcctgcggcgtagagcgtacgagcgaggatgccagagactgaggaaaagaattgaggtcgtggaagaactgcaggtgcagatcttgaaactgctgttagacaacaaagacgacaatgggggcgaggcttctcgctacatttttctcaccaagttccgtaagttcctccaagagaatgcctcaggacgggggaacatgccaatgctctgtccccccgagtatatggtttgcttcctgcaccgactgattagcgccctccgctattattgggacgagtacaaggcttcaaacccccatgccagcttctccgaggaggcttacattccaccacaggtgttttacaatggcaaagtggattattttgatctacaaagactgggcggtctccttagccacctgagaaagacactgaaggacgatctagccagcaaagctaatatcgttatcgatccactggaactccagtctaccgctatggacgacctggacgaagatgaggaacccgcacccgccatggcccagagaccaatgcaggccctcgcagtggggggccctcttcccctcccgaggccaggatggttgtcttcccccacactgggacgcgctaataggttccttagtaccgcggccgtgagcctaatgaccccccgtcggcctttgagcacgagcgagaaggttaaagtccggactttgtcggtggagcaaagaacacgcgaggacatcgaaggaagccactggaacgagggactgctgttaggtcggccccccgaggagccagagcaacctctgacagagaacagtctccttgaggtgcttgatggggccgtaatgatgtacaatttatccgtacatcaacagctgggtaagatggtcggtgtgtctgatgacgtgaatgagtacgccatggcacttagagacacagaagacaagttaagacgctgccctaagcggagaaaagatattctcgcagaattaaccaagtctcagaaggtgttttcagagaaattggatcacttaagcagaaggctggcctgggtgcacgcaacggtctactctcaggaaaaaatgctggacatttactggctcctgcgggtctgtctgcgcacaattgagcatggcgacagaactgggtctctgttcgctttcatgcctgagttctacctcagcgtcgccatcaacagttattctgctctgaagaactacttcgggcccgttcattctatggaagagttgcccggctatgaagagactctcaccagactcgctgctatcctcgcaaagcactttgccgatgctcggattgtcggcacggacatcagagatagtctgatgcaggccctggcctcatatgtctgctaccctcactccctccgggccgtcgaaaggataccagaggaacagcgtatcgccatggtgcgcaatctcctggcaccctacgagcagcgaccatgggcacagaccaattggatcctggtccggttgtggagaggctgcggctttggatacagatatactcgtttgccccaccttctaaagacaaaattggaggacgccaatctgccgtccctgcagaaaccgtgtccaagcactttactccagcagcacatggcggatctgctgcagcagggtcccgatgttgctccaagttttctgaattctgtacttaatcaactgaactgggcgttttctgaatttatcggcatgatccaagagattcaacaagccgccgagagactagagcggaacttcgttgatagtcggcagctgaaagtatgtgccacttgtttcgatctgtccgtgagcctccttcgtgttcttgaaatgacaatcaccctcgtaccagagatctttctggactggaccaggcctacaagcgagatgttgctacggaggcttgcacagcttcttaatcaggtcctcaacagggtcactgccgagcggaatctatttgatcgggtagtaacactgcggctgccgggtctggaatctgtggatcattaccctatcctagtggccgtgaccgggatccttgtgcagttgctcgtacggggccccgcctccgagcgtgagcaggccacgagtgtactgctggctgacccctgcttccaattacgctccatttgttacctcttaggacagcctgagccgcctgccccggggaccgctttacctgccccagacaggaaacggtttagccttcagtcctatgctgattatatcagcgctgatgagctggcgcaggtggagcagatgctagcccatctcacctcagcctctgcacaggcggcagccgctagtctgcccaccagtgaagaggacctctgtcctatctgctacgcacatccaatcagcgctgtcttccagccttgcgggcacaaatcttgtaaggcctgtatcaaccaacatcttatgaacaacaaagactgctttttttgcaaaaccactacctcaaacctgctggcatgtctatatcctcattggtgggaaccttcccacgggccaaactgcgcgtag

SEQ ID NO: 24783 - DNA, 2043 bp, Artificial Sequence
  Description of Artificial Sequence: Synthetic coding sequence
atgcccagcgtgagcaaggccgccgccgccgccctgagcggcagccctcctcagactgagaagcccactcattacagatatttgaaagagtttcggaccgagcagtgccctctcttttctcagcataaatgcgctcagcacaggcctttcacttgttttcattggcatttcctcaaccagaggcggagacgccccttgcgcaggcgagacggtaccttcaattattcacctgacgtttattgctccaaatataacgaagctactggcgtctgtcccgatggagatgaatgtccatacttgcataggacaaccggggatactgaacggaaataccatttaagatactacaaaactggaacctgtatccatgagaccgacgccagggggcattgcgtcaagaacggccttcactgcgctttcgcccacggcccactggacttaagaccaccagtttgcgacgttagggagcttcaggcacaggaggcattgcagaatggccaactgggcggcggcgagggcgtgcctgatctgcaaccaggagtcctggcctcccaggcaatgattgagaagatcttgtctgaggatcctcgctggcaggacgcaaattttgtgctgggcagttacaaaaccgagcagtgtccaaagccaccaagactgtgcaggcaagggtatgcttgcccgcactaccacaattctcgggatcggcggcgaaatccacgtagattccagtaccgctcaacaccctgtccatccgtgaagcatggagacgaatggggtgagccaagccgatgtgacgggggggacggctgccaatactgccactccagaactgagcagcagttccatcccgaatctacaaagtgcaacgacatgcgtcagaccggatactgtccacgcggtccattttgcgcttttgcgcacgtggaaaaatcgctaggcatggttaacgaatggggatgccatgatctgcaccttacttccccctctagtactggatcagggcaaccaggaaacgccaagaggcgagattcccccgcagagggcggtccccgggggtcagaacaggatagtaaacaaaatcatctggcagtgttcgccgctgttcatccaccagcccccagtgtctcatcaagcgtcgcgtcgtcgctagcctccagtgccggaagcggctctagctccccaaccgccctgcctgcccctcccgcgagggccctacccctgggcccagcatcaagcacggtcgaagccgtcctcggaagcgcactggaccttcatctttctaatgtgaacatcgcaagcttggaaaaagatctggaagagcaagacggtcatgacttgggagccgccggacctaggagcctcgctggcagcgcccctgtggcaattccgggaagccttccccgcgccccgtcactacatagtccatcatctgcatctacatcccctttggggtcactatcacagccactccccgggcctgtaggatcaagcgctatgaccccccctcagcagccacctccgcttcgcagcgagcctggtaccttaggtagcgctgcctcatcctacagtcccctaggcttgaatggggtgccagggagtatttgggattttgtttcgggtagtttctcacctagcccttcccccattctcagtgctggcccacctagttcttccagcgcctcccccaacggcgcagaactggcccgggtgcgccgacagttggatgaggctaagcgtaaaatcagacagtgggaagagtcttggcagcaggtgaagcaggtgtgcgacgcatggcaacgcgaggctcaggaagctaaggagagggctagggttgcagactccgacaggcaactcgcactgcagaaaaaggaagaggtcgaggcacaggtgattttccagctgcgggctaaacagtgtgtggcctgccgcgaaagggcgcacggggccgtacttcgtccttgtcagcaccacatcctctgtgagccctgcgccgccacagcacctgagtgcccatactgcaagggtcaacccttgcagtggtag

SEQ ID NO: 24784 - DNA, 462 bp, Artificial Sequence
  Description of Artificial Sequence: Synthetic coding sequence
atgagcagccccctggccagcctgagcaagacccggaaggtgcccctgcccagtgagccaatgaaccccggccgccgtgggattcgtatctacggagatgtgccagccagtcatgactctgaactgatggccttcatgaccagaaagctctgggatttagaacagcaagtcaaggcccagactgacgaaatactgagcaaagaccagaagattgctgcgttggaggacttagttcagaccttgagacctcaccctgcggaggccactctgcagcgccaggaggagctcgagactatgtgcgtgcagctgcagagacaggttagggaaatggaaaggttcttgagtgattatggcttgcaatgggttggggagcccatggaccaggaggactcggagagtaagactgtcagcgagcacggagaacgcgattggatgacagccaaaaaattctggaagccctag

SEQ ID NO: 24785 - DNA, 2382 bp, Artificial Sequence
  Description of Artificial Sequence: Synthetic coding sequence
atgggccagtgctacaacctggaggacgacgacctggagaccgacgtgaacaagctgtccagtaagcctggcctggacagacccgaggaggagctgatgcagtacgaggtgatgtgcctcgaactgtcctatagcttcgaagaactgcagagtaaactgggcgacgacctaaattcggagaaaacacagtatgctaatcaccatcatattccagctgccgcgagctccaaacagcattgctattccaaagatcaaagttcatgcggccaggagcgcgaatatgccgtgcagactagcctgctgtgcagagtgaaaaccgggaggagtaccgtccatctggggtcaaagaaaaatcccggggtgaacctgtatcagaacgtccagtcgaattctcttaggagagattcctccgagagcgaaatccccgacatccaggcatcgcctaaggccgacgcttgggacgtggacgctatcttttgccctagaatgtcggcctcattttctaattctactaggacacgcgaagtggttaaagtgatcgacaagctgttacagacgcacttgaaaagggttcccttccatgatccatatctgtatatggctaaggcccgacgaacttccagtgttgtggatttcaagatgatggcgtttcccgatgtttggggtcactgccccccaccaaccacgcagcctatgctggaacgcaagtgcggcgtgcaacgaatccggatatttgaggacattcggagactgattcagccatccgacgtgatcaataaggtggtcttcagtctggatgagccatggcccttgcaggataatgccagcaactgccttcgcttcttttccaagttcgagagcgggaatctgagaaaggcaattcaggtgagggaattcgagtacgatctgttggttaatgccgatgtgaactccacccagcatcaacaatggttttactttaaagtttcaggcatgcaggctgctattccatatcacttcaacattattaactgcgaaaagccaaacagtcaattcaattacggcatgcagcccacactgtatagtgttaaagaagcactgctggggaagcccacttggatcaggactggacacgagatttgctattataagaatcactacagacagtcaactgccgtggctggtggagcatcaggcaagtgttattacaccctgaccttcgcagtcaccttccctcattccgaggacgtctgctatctggcctaccactacccatatacctacactgcactcatgacacacctcgacattctggaaaaaagtgtcaaccttaaggaggtgtattttaggcaggacgtcctttgccagacactcggtggcaatccatgtcctctcgtgacaattactgcaatgcctgagagtaatagtgatgagcatctggaacagttcaggcaccgcccctaccaggtgatcacagcccgggtccaccccggtgagtccaatgcctcctgggtaatgaaaggcacacttgagtttctagtgtccagtgatccggttgcccgtttacttagagaaaacttcattttcaagataatcccgatgctgaaccctgacggcgttataaatggcaaccacagatgttccctgtctggcgaagacctcaaccgccagtggctaagcccttcagctcacctgcagcctacaatctatcatgccaaaggcctcctgtatcacttatcctcaatcggccgcagccctgttgtgttctgtgacttccatgggcattcccaaaaaaaaaacgtgtttctctacggttgctcaatcaaagagacactgtggcaggctgcctgcacagtggggacctctacgatcctggaagaagtaaactaccggaccttacctaagattctcgataagctggctcctgcgttcactatgagctcctgttctttcctagttgagaaatcaagagccagtactgcgcgagtggtggtctggagggagatgggcgtgtctcggtcatacactatggaatcaagttactgcggctgcaatcaaggaccctaccagtgcactcagagactgcttgagcgaaccaaaaacgaacgggcccacccagttgacggcctccagggactccaatttgggactagagaacttgaggaaatgggcgctatgttctgcctgggacttctgattctggaattaaaatcggcatcctgcagtcaccagctgctggcccaggcggctaccctcctctctgctgaggaggacgcgctggaccagcacctgcagcgcctgaagtccagtaacttcctccccaagcatatttggtttgcctaccacttctttgctattaccaatttctttaaaatgaatctactccttcacgtgtcaccttag

SEQ ID NO: 24786 - DNA, 153 bp, Artificial Sequence
  Description of Artificial Sequence: Synthetic coding sequence
atgatgcagaacgtgcacctggcccccgagaccgacgaggacgacctctactccggctataacgattacaatccaatttacgacattgaagaactagagaacgatgccgcctttcagcaggcagtgagaacctcacacgggcgaagaccctag

SEQ ID NO: 24787 - DNA, 1299 bp, Artificial Sequence
  Description of Artificial Sequence: Synthetic coding sequence
atgaccgccgtgcgggccgccggcttcaccaaggccgccctgcggggttccgcctttgacccgctctcgcagtccagaggaccggcctctcctctggaagccaagaaaaaggattcccctgaggagaaaatcaaacagttggagaaggaagtcaatgagctcgtggaagagtcttgcatcgcaaactcctgcggtgatctgaaattggcgctggagaaggcgaaggatgcgggaagaaaggaacgagtgctggtccgacagcgcgagcaggtcacgacccccgagaatatcaatctggacctaacctatagcgtcttatttaatctcgctagccagtacagcgtgaacgagatgtatgctgaagctcttaacacttatcaagtcatagtgaaaaacaagatgttctcaaatgcagggattctcaagatgaatatgggcaacatctacctgaagcagcgaaattacagcaaagctatcaaattctatcggatggcactcgaccaggtgccctctgtcaacaagcagatgcgcatcaagataatgcagaacattggagtcacttttatccaagctgatcgggagaaaatgaaaaaagcattccagaagttaatcacagtgccccttgagatcgacgaggataaatatatatctccaagtgacgacccccatacgaatcttgtaactgaggcgataaagaatgatcacctgcgccagatggagagggagcgtaaagcaatggccgaaaaatacataatgacaagcgcgaaattaatcgccccagtgattgagacgtctttcgcagcaggatatgactggtgcgtcgaagttgtgaaagcttcccagtacgttgagttagctaatgatctggaaatcaacaaggctgtgacgtacctccgccagaaagattacaaccaggccgtggaaatcctgaaggtgctggagaaaaaggatagtagggttaagtcagccgctgcaacgaacttgtctgccctctactatatgggtaaagactttgcacaggcaagctcttatgccgacattgccgtcaatagcgacagatataaccccgctgctttgactaacaaaggaaacaccgtctttgcgaacggcgattatgagaaggcagctgaattttataaagaggctttgcgcaacgacagttcctgtactgaggccctttataacataggactgacatacgaaaaactgaatcgcctggatgaagcactggattgcttcctgaagctgcatgccatactacgaaattctgccgaggtgctctaccagatagctaactag

SEQ ID NO: 24788 - DNA, 387 bp, Artificial Sequence
  Description of Artificial Sequence: Synthetic coding sequence
atggccgccgccgccgccgagcagcagcagttctacctgctgctgggaaatcttctgagcccagacaacgtggttcgaaagcaggccgaagcacgacaaatggctgccgtgctgctccggcgactcctcagctctgcatttgatgaagtgtacccagccctccctagcgacgtccagacagcaattaaatccgagctgctgatgataattcagatggaaacccagtcatccatgcgcaagaaagtttgcgacatcgcagctgaactggctcgtaatcttatagatgaggatggcaacaatcaatggccagaagggttgaagtttcttttcgattctgtgtcctctcagaacgtcggacttagggaggccgcccttcacatcttctag

SEQ ID NO: 24789 - DNA, 2766 bp, Artificial Sequence
  Description of Artificial Sequence: Synthetic coding sequence
atgcggcccgagggcgccggcatggagctgggcggcggcgaggagcggctgcccgaggagagtcgtcgcgagcactggcaactcctgggtaacctaaagacaactgtagagggcttggtgagtacaaacagtccgaacgtgtggtctaagtacggggggttagaacggttatgtcgtgacatgcagagtatcttatatcacggactgatcagggaccaagcttgccggcggcagaccgactattggcagttcgttaaagatattagatggctcagcccccactctgctttacatgtggagaagtttatttccgtccatgaaaacgatcagtcctctgcagatggcgcctccgagagggcagtggccgagctatggctgcagcactctctacagtatcattgtctgtcggcccaactgcgacccctgctcggcgatcgccagtatatacgaaaattttacacagatgccgcctttctcctgtcggacgcacatgtcaccgccatgttacagtgcttagaggcagtggaacagaacaaccctagactcctggctcagattgatgccagtatgttcgcccggaaacatgaaagtcctctgctggtcaccaaatcccagtccctcaccgcactcccaagcagtacctataccccacctaacagctacgcccagcactcttattttggatctttctcttctcttcatcagtcggtgccaaataacggcagtgagaggcggagtacctcatttcctctatctggcccgcctcggaaaccccaagaaagtcgagggcacgtcagcccagcggaagaccaaacgatccaggcgcctccagtgtctgtttcggcccttgcccgggattccccacttacaccgaacgaaatgtcgtcttccaccctgacctcccccatagaagcctcatgggtaagctctcagaatgacagtccaggcgacgcctccgaagggccagaatatctcgctataggtaacttggaccctaggggaagaaccgcatcctgccagagtcacagtagtaatgctgaaagctcaagcagcaatctgttcagttcttccagctcccaaaaacccgactcagctgccagttctctcggcgatcaggagggcgggggcgaaagccagttatcgtctgttttgcgacgcagtagtttcagtgagggacagactcttactgttacctcaggtgccaagaagtcacacatccggtctcattcagatacctccatcgcttcacggggggcccctgaaagttgcaacgataaagctaagcttcgggggccacttccctatagtggtcagagcagtgaagtttctaccccctctagcctctacatggagtatgaaggaggccgctacctgtgcagtggtgaaggcatgtttcgcaggccgtcggaggggcaatctctgatctcctatttatcggaacaggacttcgggtcctgtgccgatttagagaaagagaacgctcatttttcgatttccgaatccctcatcgccgccattgaactgatgaagtgtaatatgatgagccagtgtctggaggaagaggaggtggaggaggaggatagcgatagagaaatacaagaactgaaacaaaaaatccgactcaggcggcagcagatacggaccaagaacctgttacctatgtaccaagaagccgagcacgggagctttcgcgtgacaagctcatcctctcagttttcttctagggactcggctcagctgagcgactcaggaagcgccgacgaggtcgacgagtttgagatccaggacgggtcagaggggagcaacctgactcatatcagcaaaaacggtttatctgtgtctctggctagtatgttttcggacgccgatatccgtagaaacaccgctagttcttccaagagttttgtgtcatctcagtctttttctcattgcttccttcactcaacaagtgcggaggcagtggccatggggctgctaaaacagtttgagggaatgcagttgcccgcagcgagcgaactcgaatggctggtgccggagcacgatgcaccacaaaaattgctgcccatccctgactcactgcccataagtccggacgatgggcagcacgccgacatttataagctgcggatcagagtgcggggtaatctggagtgggcccctccacgccctcaaataatcttcaacgtgcatcctgctcctacccggaaaattgctgtggcgaagcagaattaccggtgtgccggttgcggcatcaggacagatcctgattatattaaacgacttaggtattgtgagtacttgggcaagtacttctgtcagtgttgccatgagaacgctcagatggcaataccctctcgtgtgcttcgaaagtgggatttcagcaagtactacgtatctaacttcagcaaggaccttctgattaagatctggaacgatcccctgtttaatgttcaggacatcaacagcgctttgtacaggaaagtgaaactcctcaaccaggttagactgctgcgggtacagttatgtcacatgaagaacatgttcaagacttgccgtctggctaaagagctcctggacagctttgataccgtgccaggacacctgacagaggacctgcacctctatagcctaaatgatctaacggcgactcgcaaaggagaactcgggcctaggctggccgaattaaccagggccggtgctacacacgtggaaagatgtatggtcaggaaatctcattgcagcatgcagctcagtccctgcttttag

SEQ ID NO: 24790 - DNA, 1644 bp, Artificial Sequence
  Description of Artificial Sequence: Synthetic coding sequence
atgcgggccctgaccgtgcagcgggtgaagttcgccatggacctgccactgcttaagagagctgggcaagacctggccgaaaagacaaagaattttgtttcaaggagcctcgtaattggggaagtgctttccatggcagacatggctactggtgttaagtgtggtatcatctattggctgtttggaggggctattaggaaccttggcagcccagaacacgtaaccaagtggttccaacccctgcaagaacagaaatatactggaatgtttgccatgactgaacgaggccatggttcaaatgctcgaggaatccagactgaggccacattcgacctcagtgcacaagagtttgtcatcgatacaccatgtgagaatgccgagaagatgtatatcggcaacgctatgtatggaaattacgctgcagtatttgctcagcttatcatcgacggaagatcccagggaccacactgcttcatcgtgcccgtgcgcgacgagaacggatctctgtatccaggtgtaacggctatcgacatgatgtacaaagaagggctgcatggggtggacaatggtatcttgatctttgataaggtcaggatcccaagagagaatctcttagacaagtttggatctgtagcgcctgacggacagtatcacagcccaatacgtaacaaatcagccagatttaacgctatgctggctgcccttacccctagcagacttgccgtggccttccaagctatgggggctatgaagttaggcctcacaatcgcgattcgctactctcactcacgaagacaatttggtcctaaaacaaaagaagaggtgaagatcatcgagcatcaaacccagaccctgcgccttatgccccacctggctactgcactggctttgacgtttgtctctcggtatgccggcgccctgctggacgaggacgtgttccagggtaaagagttagtgaattcccgcagtctgcaggccttggtggctggtctcaaggcttacagtacctgggagaacataagatgcttgcaggactgccgggagtgtaccggcggcatgggatacatgatggaaaacagaatatccggtcttaagtgcgacacagatgtattcgcaacattcgagggcgatgacgttgtcatgctgcaggtcgtcggccgagagttgcttgctcagtataccaaacagtatgaggagaagcccctcttcggcttgcttcagaactgggccgagtctgtgggggacaaactgcggacaagcttcctcgcctttaacatggatactgtagacgaccttgcattcttgttaaaggcagtcaagtttagggaacgcgtgctacaacgcgggctagtggcaaggatctactacaaagttaaaactaagaaggaggactttttccatgcttggaatagctgtctccatcacgtggccagtctgtctctggctcacacacatagggtgacactggagcagttctctctggccgtaaaatcatgtcccgaccaggaggaccagacgttgcttatgaagttctgtcttctgtatgggactaagctcgttttccaagaacgcgcctggtacctcgagcacaagtacctgacacctatggcttctactcgtatccgcaaccaggagcgctgctag

SEQ ID NO: 24791 - DNA, 6087 bp, Artificial Sequence
  Description of Artificial Sequence: Synthetic coding sequence
atggacgtgaccgtgagcgagctgctggagctgttcctgcagagcccacttgtcacttgggtaaaaacatttgggcccttcggcagcggaagccaagacaacctgacaatgtacatggacctcgtcgatggcatatttctcaaccagatcatgctgcagattgaccctagacccactaaccaacgcataaacaagcatgtgaacaatgacgtgaacctcagaattcagaatcttacaatcctcgtgaggaacattaaaacctactaccaggaggtgctgcaacaactgattgttatgaatttaccaaacgtgttgatgatcggaagagaccctttgtctggaaaaagtatggaggaaatcaagaaggtgctactcctggtgctcggctgtgctgtgcagtgtgagcggaaggaggaattcatagagcgtataaagcagcttgatatcgaaacccaggccggcatagttgcccatattcaggaagtgacccataaccaggaaaacgtttttgacctacaatggctcgagctacctgatgttgccccagaggagcttgaagccttgtcacggagcatggtgctccatctcagacgcttgattgatcagagagatgagtgtacggagttgatagtggacttgacccaggaaagggattaccttcaagctcagcatccaccatctccaatcaagtcttcgtccgcagactccacgcctagtcctactagcagccttagcagcgaagataagcagcatctggccgttgagttagccgatacaaaggctagacttcgccgcgtgcggcaagaactggaggacaaaacagagcagctggtcgacacacgccacgaagtggatcagctggtgctggaactgcagaaggttaagcaggaaaatattcaactcgctgccgacgctaggtcagccagagcttaccgagacgaactggattcacttcgagaaaaggcaaatagagtggaaaggttggagctggagctgaccaggtgtaaagaaaagctccatgatgttgatttttataaggctagaatggaggagctcagagaggacaatattatactcattgagactaaagccatgttggaagagcagctgactgccgcacgtgctcggggagataaagtccatgagctcgaaaaagagaatctgcaactgaagtccaaactccatgaccttgagttggatagggacactgacaaaaagcgaatcgaggagcttctggaggagaatatggttctcgagattgcccagaagcagagtatgaatgaaagcgcccacctcggatgggaactggagcaattgtcgaaaaatgccgatttgtccgatgccagtagaaagagcttcgttttcgaattgaatgaatgcgctagctccaggattctaaagctagaaaaggagaatcagtccctgcagagcaccattcagggtctcagagacgcctctttggtgttagaggaaagcgggttgaagtgcggcgagctggaaaaagaaaaccatcagctgtcgaaaaaaatcgagaaactgcaaacccaacttgagcgcgaaaaacagtccaaccaggacttagagacactgtcggaggagttgatccgtgagaaagaacagctgcagtccgacatggagacattgaaggccgataaggcccggcagattaaagatctggagcaggaaaaagatcacctcaatagagcaatgtggagcctacgagaacgctcgcaagtgagctcagaggccaggatgaaggatgtagaaaaggaaaacaaagcactgcatcagacagtcaccgaagctaatgggaagttgtcgcagctcgagttcgagaagcgccagctgcatcgcgacctggaacaggccaaagaaaaaggggaacgagcggaaaaactcgagcgggagttgcaacgcctccaggaggagaacggtagactggctcggaaagtcaccagtctcgagaccgcgaccgagaaggttgaggccctggagcatgagtcccagggccttcagctcgaaaacagaacccttcggaagtccctggatacacttcagaatgttagtttacaactggagggactggagcgcgataacaagcagctcgacgccgagaacctggaactgagaaggctggtagagacaatgagatttactagtaccaaattagctcagatggagagagaaaatcaacagcttgagcgagaaaaagaggagctgagaaagaacgtggacctccttaaagcgctggggaagaaaagcgagcgccttgaactcagctaccaaagcgttagcgctgagaacctgagacttcagcagtctctggagtcctcgagccacaaaactcagactctcgagtcggagttaggagagttggaggccgaaaggcaggccctgcgtcgggatcttgaagctctgcgcctagccaacgcccagctcgaaggagccgagaaagaccgcaaagctctcgaacaagaagtggcacaactcgagaaggacaagaaactgctagagaaggaggctaagcggttatggcagcaggtggagcttaaagatgccgtgcttgacgatagcacggcaaaattatcggccgtagaaaaggaaagccgggctctggacaaagagctggcccgctgccgggacgctgccggtaaactgaaagaactggagaaagataatcgcgacttgactaaacaggtgaccgtgcacgcccggaccctgacaaccctgcgggaagatctcgtgctggagaaactgaaatctcagcaattgagttctgagctcgacaaactttcacaagagctggaaaaggtgggtctaaaccgtgagctcttactgcaggaagacgacagtggctccgatacgaagtacaagatactggaaggccgaaatgaaagcgccctgaagacaacgctggccatgaaggaggagaaaatcgttctgctcgaagcacagatggaggaaaaagctagcctgaatcgccaactagaatcagaacttcaaatgctgaaaaaagagtgcgaaactctgagacagaatcagggtgaggggcaacacctgcagaatagctttaaacatcctgctgggaagacagcggcttcacaccaagggaaggaggcatgggggccgggacataaagaggcaactatggagttgctcagggtgaaagatcgcgccatcgagctggagcgcaacaacgctgcgctgcaggcagagaagcagctgttaaaggagcaattacaacacctggaaacacagaacgtcacctttagctctcaaatcctcaccctgcaaaagcaaagcgcatttcttcaggaacacaacacaacccttcagacgcagactgctaaactccaggtcgagaattctacactttccagccagtccgctgctctgaccgctcaatacaccttgcttcagaaccatcacaccgccaaggagaccgaaaatgagagcttacaacgccagcaggagcaacttacagccgcctacgaagcactgctccaggatcatgagcatctcggaacactgcacgagaggcagtctgccgaatatgaggctttaatccgccagcactcatgccttaagaccttacataggaatttagagctggagcacaaggaactcggtgagaggcatggtgatatgcttaaacgcaaggctgagctggaggagcgcgagaaggtgctgactaccgagagagaagctctgcagcaggagcagcgcacgaatgccctagccatgggtgagaaccagcggcttagaggcgagttagacagagtcaattttcttcaccaccagttgaagggtgaatacgaggaactccatgcgcatacgaaggaactgaagacctccctaaacaacgctcagttggagctgaaccgatggcaggccagattcgacgaactcaaagaacagcatcagactatggacatcagtttgactaagcttgataatcattgcgaattgctgagccgcctaaaaggcaatctggaggaggaaaatcaccatctccttagccagattcaactgctgtcacagcagaatcaaatgttgctggagcaaaacatggagaacaaagaacaataccacgaagagcaaaaacagtatatcgacaagctgaacgctttacgccggcacaaggagaaactcgaagaaaagataatggaccagtacaagttctacgaccctcccccgaagaagaagaaccactggatcggagctaaggcgctagtgaagctcattaagcctaaaaaagagggatctagggagcgtttaaagtctactgtggatagccctccctggcagctggaatccagcgatccagcatcgcccgcagcttctcagccactgcgctcacaggccgaaaacccagatactcccgcattagggtcaaactgcgctgaggagcgtgacgcccacaacggatcggtcggcaagggccctggggacctcaaaccgaagcgcggaagcccgcacagaggttccttagatagaacggacgcaagcactgatctggccatgcgcagttggccttccgagctgggaagccggacctgctctacctcagccactaccacagccccatctaattccacccccatcgccagacatcccgggaggacaaagggttataattcggatgacaacctgtgcgagccgagcctggagttcgaggttcccaaccaccggcaatacgtgagcaggccttcttccctggaaagttcaaggaacacaagctccaattcatcacctctcaacctcaaaggatcatctgagcagctgcacggtcgctctgagagtttctcctcggaggatcttatacccagccgggacttagctaccttacccagggaggcttcaacgcccggcagaaatgcactgggtcggcacgagtacccactgccgcggaatggacccctgccacaagagggtgcacagaaacgagggactgcccccccctacgttggcgtgcgtccctgtagcgcaagcccctcttccgagatggtcaccctagaggaatttttggaggagagtaacaggagctcacccacccatgacacgccctcatgtcgggatgatctgctgtctgactacttccgaaaggccagcgacccaccagcaattggtggccagcccggcccccccgccaagaaagaaggggctaagatgccaacgaacttcgtcgctcctactgtcaagatggcagccccaacctcagaagggcgacctctgaagcccggtcaatacgttaagcctaattttcgcctgaccgaggccgaggctcctcctagcgtagcacctaggcaggcccagccaccacagtctctctcacttggtcgccccagacaggcccctgtgccgcccgcgagccatgcaccagcttctcgttccgcgtcgctgagtcgcgctttcagtctcgcatcagccgacttgctccgcgcttcaggacccgaggcatgtaagcaggagagtccacagaagctcggagcaccggaggccctgggcggtcgcgagactggctcccatacactgcagtcacctgcccctcccagcagccatagcctcgcaagagagagaacaccattagtgggtaaagctgggagttcctgtcaagggccagggccccgttcccggcctctggataccagacgctttagtctggctcccccaaaagaggagcggctcgctcccctgcatcagtcagcaacagcccctgctattgcgacagctggagcaggagcagccgccgcggggagcggctctaattctcagctccttcatttttcccccgctgcggctccagctgctagaaccaagcctaaagcccccccccgttcaggcgaggtagcaacaatcacaccggtgcgggctggactatctctgtctgagggggatggagttcctggacaaggttgcagtgaaggattgcctgccaagagtccgggccgcagccccgatctcgcgcctcatcttggccgcgctctggaggactgttccagggggagcgtgtctaaatccagccccgcttctccagaacccggcggcgaccctcaaactgtttggtacgagtacggctgcgtgtag

SEQ ID NO: 24792 - DNA, 3831 bp, Artificial Sequence
  Description of Artificial Sequence: Synthetic coding sequence
atggacgaggtggagcaggaccagcacgaggcccggctgaaggagctgtttgacagcttcgatacaaccgggaccgggtctcttggccaggaagagctgacggatctgtgtcatatgctgtctctagaggaggtagcccctgtcttgcagcagactctcctgcaggacaaccttcttggcagagtgcacttcgaccagttcaaggaggccctgattttgatactttctagaacgttaagcaacgaggaacacttccaagagcctgactgcagtctcgaagcacagcctaagtatgttcgcggggggaagcgctatggtcggaggagcctgcccgagttccaggagagtgttgaggagttccccgaggttacagtaattgagcccctcgacgaggaagccaggcctagccacattcccgccggcgattgttccgagcactggaaaactcagcgcagcgaggaatacgaagcggaagggcagctgaggttttggaacccagacgatctgaacgcaagccagtccggctctagtcccccccaagattggatcgaggagaagcttcaagaggtatgcgaggacctgggcatcacgagagatgggcatctaaacaggaaaaaacttgtgtctatttgcgaacagtacgggcttcaaaacgtcgacggggaaatgttagaagaagtgtttcacaatctggacccagacggaacaatgagtgtcgaagacttcttctacgggctctttaagaacggcaagagcctgaccccgagcgcctctaccccatatcgccaacttaagcggcacctgagcatgcaaagttttgacgagtctggaagacggaccaccacatcttccgccatgacttctacaataggcttccgcgtgttttcttgtttggatgatggcatgggccatgcatctgtggaaagaatactggatacctggcaggaggaaggaatcgagaatagccaggagatcctgaaagccctggatttttcactggatggaaacatcaatctgacagaactaacactggcgttggagaatgagctcttggtgaccaaaaacagcattcaccaggccgccctggcatccttcaaggccgaaattaggcacttactcgagcgcgtcgaccaggtagtgcgagagaaggagaagctgcgatcagacttagataaagcggagaagctcaagagcctgatggcatctgaggtagatgatcatcatgccgcaattgagcgacgtaacgagtacaatctgagaaaactagacgaggaatacaaggagaggattgcagcattaaagaatgaattaaggaaagaacgcgaacagatcctccaacaggccggtaagcagcgactagaattagaacaggagattgaaaaagcgaaaacagaggaaaattacatcagagatcggctggctctgtcgctgaaagagaactcaaggcttgagaacgagctgcttgagaatgccgaaaaattggccgaatatgagaacctaaccaataagttgcagcggaatttagagaacgtacttgcagagaagtttggcgacttggatccgagtagtgctgaattctttttgcaggaagaaagattgacacagatgcgaaacgagtacgagaggcagtgccgcgtcctccaagaccaagttgatgagctgcaatcggaattggaagagtaccgtgctcagggacgagtcctgagattacctctcaaaaatagtccttctgaagaagtagaggccaacagtggcggaatagaacccgaacatggtttggggagcgaagagtgcaaccctcttaacatgtcaattgaagccgagctcgtgatcgaacaaatgaaagaacagcaccatagggatatctgttgcctgaggctggagctggaagacaaggtgcggcattatgagaaacagctggatgagacagtggtatcttgtaaaaaagcccaggagaatatgaagcagcggcacgagaatgaaactcacaccctcgaaaaacagatttcagacttgaagaatgaaattgccgagctgcagggtcaagctgccgtcctcaaggaggcgcatcatgaagccacatgtcgccatgaagaggagaagaaacagctccaggttaagttggaagaagagaagactcatctccaagaaaaactccgcctccagcacgagatggagcttaaagcacggctcacacaggcacaagcctcctttgaaagggagagggagggcttgcagagcagtgcatggaccgaagagaaagtgaggggcctgactcaggagctggagcagtttcaccaggagcagctgactagcctcgttgaaaaacatacgctcgagaaagaggagctccggaaagagctgcttgaaaaacaccagagggagctccaggagggtcgctacgaatcagaaaagctgcagcaggagaactccatattacgtaacgaaattacaaccctgaatgaggaggacagtatttctaaccttaaactgggcaccttgaatggcagccaggaggagatgtggcagaagacagaaacagtgaaacaggagaacgctgctgtccagaagatggtggaaaaccttaaaaagcagattagtgaacttaagataaagaatcagcaactggatctggagaatacggaactttctcaaaaaaatagccagaatcaagaaaagttacaagagctgaatcagagactcactgagatgctttgtcaaaaggaaaaggaaccaggcaactcagccttggaagagcgggagcaggagaagtttaatctgaaagaagagctggagcggtgtaaagtgcagtcctccacactggtgtcctcactggaagcagagctcagtgaggtgaaaattcagactcacatagtacaacaggaaaaccacctattgaaggacgagttggagaaaatgaagcaactccaccggtgcccggacctgagtgattttcagcaaaaaatctcaagtgtgctgagttacaacgaaaaactccttaaggagaaggaggccttgtcagaggagctaaacagctgcgtcgacaagctggctaagtccagcttactggagcaccgcatcgccacaatgaagcaagagcagaaatcctgggaacaccagagtgcatcactaaaatcccagcttgttgcttctcaggaaaaggtgcagaacctggaggacacagtccagaatgtgaacctgcagatgtcaaggatgaagagcgacctacgggttacccagcaggaaaaggaagctcttaaacaggaggttatgtcccttcacaaacagttacagaatgctggcggtaagagctgggccccagaaatcgcgacccacccgtcaggcctccacaaccagcagaaaagactcagctgggacaagttagatcatctgatgaacgaggaacagcagctcttgtggcaggaaaacgagaggctgcagacgatggttcagaatacaaaagcagagctcactcattcaagggaaaaagtcaggcagctggagtccaatctgcttccgaagcaccagaaacacctcaacccttcaggcacaatgaaccctactgagcaggagaaactcagtctgaagagggagtgtgaccagtttcagaaagaacagtctccagctaataggaaagtcagccagatgaactctctggagcaagaattagagaccattcatttggagaacgagggcttgaaaaagaaacaggttaagttggacgaacaattgatggaaaactctgtcgtgggatcaagtagggaaggctgctcgtcactgcccgagatcgtttgcgaagatgccgcacctgaggtgcattgcgacgcgtag

SEQ ID NO: 24793 - DNA, 2997 bp, Artificial Sequence
  Description of Artificial Sequence: Synthetic coding sequence
atgaaggacagcggcgacagcaaggaccagcagctgatggtggccctgcgagtcagacctatctctgtagccgaactagaagaaggcgccacattaatagcccacaaggtggatgagcaaatggtggtgcttatggacccgatggaggaccctgatgacatcttacgcgcccacagatctagggagaagagctacctttttgatgtcgcttttgacttcactgccacccaggagatggtttatcaagccacgactaagagtctgattgaaggggtgatcagtggatacaacgcaacagttttcgcctacggtccgacgggttgtggaaaaacatatactatgcttggtaccgaccaagaaccagggatttacgtgcagaccctgaatgatttgtttcgggcaattgaggaaacttccaacgatatggaatacgaagtatcaatgagttacctggaaatatataacgagatgattagagatttgctcaaccctagtctgggctatttggaattgagagaggactccaagggtgtgatacaggtagccgggattacagaggtctcaactatcaatgcgaaggagattatgcaactgttaatgaagggtaatcgccagcggactcaggagcctactgccgcaaaccagaccagctctagaagtcacgcggtactgcaggtaacagttcgacagcggtcgagagtgaaaaacatcctgcaggaagtgcggcagggacgtttatttatgattgacctcgccgggagcgagagagcctcgcagactcaaaataggggccagcggatgaaggagggtgctcacattaataggagtctgcttgccctggggaactgcattaacgctctctctgataaagggtctaacaagtacatcaattacagagattctaagctgaccagactgctgaaagatagcttaggaggaaactcacggaccgtcatgatcgcccatatctcacccgcatcatcggctttcgaagaatccagaaacacactaacctacgccggcagagcaaagaacataaagactagggtgaagcagaatttactgaacgtttcatatcatatcgcccagtacactagtattatagctgacctaaggggggaaatccaaagactgaagcggaagatcgatgaacagacgggaaggggccaggcgagaggcaggcaagatcgaggcgacattagacacatccaggcagaagtgcagctgcattctggccaaggggagaaggccgggatgggccagttgcgggaacagcttgcttccgctttccaggaacaaatggacgtcaggcgccgcctgcttgaactcgagaatagggctatggaggttcagatcgatacaagcagacacttgcttacaatcgcggggtggaaacacgaaaaatccagaagagccctgaaatggcgggaggaacagagaaaagagtgctacgctaaggatgactccgaaaaagacagcgacaccggtgacgatcagcctgatatactggaaccccctgaagtggcagcagcccgggaaagcattgcagcactagtggacgagcagaaacaactgcggaagcaaaaattggcactagaacagcgctgcagggaactacgcgctcgagggcgccggttggaggaaactctgcctcggcggattggctctgaagagcaacgcgaggtgttgtctttgctttgcagggtgcatgagctagaagtggaaaataccgaaatgcagtcccatgcgttgctgagagacggtgcgctccgccaccggcacgaggccgttcggcgtttggaacagcacaggtctctttgcgatgaaattatacaggggcagagacagataatcgacgactacaacttggccgtaccacaacggctcgaagagctttacgaagtgtacttgcgcgagctggaagaaggaagtctagaacaggcaacaataatggaccaagtggccagccgggccctccaggactcctcactgcctaaaatcacaccagccgggacatcgttgacaccggatagtgatttggagtccgtaaagactctcagcagcgatgcccagcacttgcagaactctgccctcccaccactgtcgacagagtccgaggggcaccacgtgtttaaagccgggaccggagcgtggcaggcaaagtcatcttctgttccgactccaccccctatacaactggggtctctcgtgactcaggaggctccagcccaggacagcttgggtagttggattaactcctcccctgacagctcagaaaatctgagtgaaatacccctctctcataaagagcgcaaagaaattctcaccggtacaaagtgcatttgggtcaaagccgcaagacgacgatcccgcgcactgggaaccgaggggagacacctgctggcaccagcaactgaaaggagctcactgagcctccacagtctatctgagggcgatgacgcacgcccaccaggacctctagcatgcaagcgtccaccgagtcctaccctgcaacatgctgcttctgaagacaacctgagttcctctaccggcgaagctcccagtcgtgccgtggggcatcacggagacggtccacgtccctggttacgtgggcagaagaagtccctgggcaaaaaaagggaggaatccctggaagcaaagcggaggaagcgcagatcccggtcgtttgaggtcacaggtcaaggactctcacatcctaaaacacatctcctcggcccccaccaggccgagcgcattagtgaccatcggatgcctgtttgtcgccaccctgcgcccggcattcgccacctggggaaggtgacccttcctctggcaaaagtgaaactgccgccgagccagaataccggaccaggagatagctcgcccctagcagtacctccaaaccccgggggtggctctcgcagagctacgcgtgggccacgtctaccccatgggacttctactcatggtaaagacgggtgcagtcgccacaactag

SEQ ID NO: 24794 - DNA, 1194 bp, Artificial Sequence
  Description of Artificial Sequence: Synthetic coding sequence
atgaccgccgaggagggcgtgcagctgagccagcagaacgccaaggacttcttcagggtgctcaatttgaacaagaagtgcgacacgtcaaaacacaaagtgctggtggtttctgtgtgcccacagagtcttccatactttgcggccaagttcaatctgagcgtcactgatgcctcccgtcggctgtgtggtttccttaagagcctgggcgtacattacgtgttcgacaccactattgcggcggatttttcaatccttgaaagtcaaaaggagtttgttcggagataccggcaacacagtgaggaagagaggactctgcccatgctgacatctgcctgccctggctgggtacgatacgcagaaagggtgctgggacggccaatcacagcacacctctgtaccgccaagagcccacagcaggtgatggggagcttggtaaaggattatttcgcgcgccaacagaatttgagtccagagaagattttccatgtcatcgtggctccttgctatgataaaaagctggaggccctacaggagtccctgcctcccgcccttcacggttcacggggggcggattgcgtgctcacctccggcgagattgctcaaatcatggagcaaggcgacctgtctgttagggatgcagccgtagacacactctttggcgacctcaaggaagataaggtgactcggcacgatggagcctcctccgatggacatctcgcccacatcttccggcatgccgctaaagaactcttcaacgaagatgttgaggaggtgacctatcgtgcgcttagaaataaagacttccaggaggtaaccctggagaaaaatggggaggttgtcctgcgatttgcagctgcttatgggtttcggaacatccagaatatgattctgaagctgaaaaagggcaagtttccatttcactttgtggaggtgctcgcctgtgctggcggctgtcttaacgggcgaggccaggcacaaactcccgacgggcatgcagataaggctctccttaggcaaatggaggggatctacgccgatatacccgttaggcgccctgaatcttcagcacatgtccaagagttgtaccaggaatggttagaagggataaattcacctaaagctagagaggttctacacacaacttaccagagccaagagcgcggcacacactccctcgatatcaagtggtag

SEQ ID NO: 24795 - DNA, 3603 bp, Artificial Sequence
  Description of Artificial Sequence: Synthetic coding sequence
atgaaggtggccggcggcctggagctgggcgccgccgccctgctgtctgcaagcccaagggctcttgtgaccctttcaacaggtcctacatgttccatactcccaaaaaacccactgtttcctcaaaatttaagctcccaaccctgcatcaagatggagggcgacaagtctctaacattctcctcttacgggctccagtggtgtctctatgaactcgataaggaagagtttcaaactttcaaagagctattgaagaagaagagctccgaatcaaccacatgctccattcctcagtttgagattgaaaacgcaaacgtggaatgcttggcgctccttcttcatgaatactacggcgcatccctagcctgggcaacttccatctccatctttgagaacatgaatcttcgaacactctcggaaaaagctcgtgacgacatgaagaggcatagccccgaagaccccgaagccacaatgaccgatcagggcccgtctaaggagaaggtacctggaatttcacaggccgttcagcaagattccgccacagctgccgaaactaaagaacaagagatctcacaggccatggagcaagagggggccacagctgctgagacggaggagcaagagatttcccaagccatggagcaagagggagccacagcagccgagactgaagaacagggacatggcggcgatacgtgggattacaagtcccacgtcatgaccaaattcgctgaagaagaagatgtcaggcggagcttcgagaacaccgcagctgattggcccgagatgcaaactctggcaggcgcttttgattccgacaggtggggcttccgaccaaggaccgtggttcttcacggtaagtcaggcatcggtaaatcagccctcgcccggcgcatagtcttatgttgggcacagggcggtttataccaaggtatgttttcctatgtctttttcctgcccgtccgagaaatgcagagaaagaaagagagcagcgtgacagaattcatctctcgggaatggccagatagtcaggcacctgtgactgagataatgtccaggcctgaacgactgctgtttatcattgatgggttcgatgatcttgggtccgttctgaacaacgacactaaactctgcaaagactgggcagaaaagcagcctccttttacccttataagatcactactgcgcaaggtgctgctgccagaaagctttcttatcgtcaccgtccgcgatgttggaactgagaagctgaaatcagaggtcgtgagtcctagatacctattggtgcgggggatcagcggtgaacagcgcatacacttgctcctcgagcgggggatcggcgaacatcagaagacacaagggcttcgagctattatgaacaatagagagttgctggaccagtgtcaggtacctgctgtaggtagcctcatctgcgttgcgttgcagctccaggacgtcgttggggagtccgtggccccctttaaccaaactctcacaggcctgcacgctgccttcgtttttcaccaactgacaccaaggggagtggtgcgtaggtgcttaaatctcgaagagcgagtggttctcaaacgtttctgccgcatggccgtggagggcgtttggaataggaaatccgtatttgatggggatgatttaatggtgcagggactgggcgaatcggaactgcgcgcactgttccatatgaatatccttctgcctgactcccattgtgaggaatactacaccttctttcacctgagcttgcaggacttctgtgccgccctgtactacgtactcgagggtctggaaattgagcctgcgctctgcccgctctacgtggagaagaccaagaggtcaatggagctaaagcaagcaggctttcacatccactcactttggatgaaacggttcctcttcggcttggtgtccgaggatgtccgtcgccccctcgaagtgttattgggatgccctgtcccactgggcgtgaagcaaaaactgctgcactgggtgagtctcctcggtcagcagccaaatgccaccacccccggagacaccctggatgcctttcactgcctgttcgaaacccaagacaaggaattcgtgcggctcgctctgaattcattccaggaggtatggctgcctataaatcaaaatctggatctcatagcttcaagtttctgcctgcaacactgtccttaccttcgaaaaattcgcgtggacgtgaagggaatctttccccgggatgagtctgccgaggcatgcccagtggttccgctctggatgcgcgataaaaccctgatcgaggaacagtgggaggacttctgctctatgcttggaacacacccccacttgagacagcttgacctgggctcaagcattctgaccgagagagccatgaaaactctgtgtgccaagttgcggcacccaacttgtaaaatccagacacttatgttccggaatgctcagatcacacccggtgtgcagcacctatggcgcatagtgatggccaaccggaacttaaggagtctgaacctcggtggaacccatctgaaggaggaggacgtacgcatggcttgcgaggcgttgaagcacccgaagtgcctgctggagagcttgcgccttgattgttgcggtctgacccatgcctgctacctgaaaatcagccaaatcctcaccacaagtccctcactgaagtccctctctctggctggaaacaaggttacagaccagggagtgatgccactgtccgacgcccttcgagtgagccagtgcgcactacaaaagctcatcctggaggactgtggaatcacagcgacagggtgccagagcttggcttccgctctggtctctaaccgctctctaacacatttgtgcttgagcaataattcgctcggcaacgagggcgtgaacctcttgtgtaggtccatgagactcccacactgctcccttcagaggctgatgctgaaccagtgccatctggatacagccggatgcggttttttggcacttgcactcatggggaattcctggctcacacacctgtcactgtccatgaacccagtggaggacaatggagttaagttgctgtgtgaggtcatgagagaaccctcttgtcaccttcaggatctagaactggttaagtgccacctgaccgccgcttgttgtgagtcactgtcatgtgtcattagcagaagtagacacctgaaatcactcgacctcacggacaatgctctgggggacggaggggtggcggcgctttgcgaaggattgaagcagaaaaactccgtgctcgcccggctagggctgaaggcttgtggcctcacaagtgactgctgtgaggcgctctcccttgccctctcatgcaatcgccatcttacttcactcaacctggtacagaacaatttttctcctaaagggatgatgaagctgtgttcggctttcgcatgcccgactagtaatctccagataatagggctgtggaagtggcaatacccggtccagattaggaagctgttggaggaggtccagttgcttaaaccacgcgtcgtcattgacggatcgtggcactcctttgatgaagatgaccggtattggtggaaaaactag

SEQ ID NO: 24796 - DNA, 2787 bp, Artificial Sequence
  Description of Artificial Sequence: Synthetic coding sequence
atgaacgaggccatggccaccgacagcccccggcggcccagccggtgcacgggtggtgtggtcgtgcgccctcaggcagtgacagaacaatcatacatggaaagtgtagtgaccttcctgcaggacgttgtgccccaggcctattcaggaaccccattaactgaggagaaggaaaaaatcgtctgggtgaggttcgaaaacgccgacctgaacgatacaagccgcaatcttgagtttcacgagatacacagcacaggcaacgagcccccactgctgataatgatcggttatagcgacggaatgcaggtgtggagcatccctatctccggagaagcacaagaactctttagtgtacgccacggtccaattagggcggccaggatcctccccgctccccaattcggagcgcagaagtgtgacaatttcgctgaaaagcgccctctgctgggcgtttgcaagtctataggatcctccggcacatctcccccttattgttgcgtggatctgtactccctgcggaccggagagatggttaaatcaattcaatttaagacacccatctacgatttacattgcaataaaagaattttagtcgtggtgttacaggaaaagatagcagcttttgactcatgtacttttaccaagaagttttttgtgaccagttgctatccctgtcccgggcccaacatgaatcccatcgcactggggagcaggtggcttgcatacgctgagaacaaacttattcgctgccatcagagtaggggaggtgcttgtggtgacaatatacagagctataccgcaaccgtgatctcagcggccaaaacactgaagagtggcctcacgatggtgggcaaggtcgttactcaactcactgggaccctgccttcaggcgtcactgaagacgatgttgccatccacagcaatagccgaaggtcccctctcgtgccgggtattattacagtgatagatacagagacagtgggagagggacaggtcctcgtgagtgaggactccgatagtgacggcattgtggcccattttcccgcgcacgagaaaccagtctgctgcatggcttttaatacatcaggaatgctcctggttactactgataccctagggcacgattttcacgtctttcagatccttacccatccgtggtccagcagccaatgtgccgtccaccatttatacacactccaccgcggcgagaccgaagcaaaggttcaggatatttgcttctcacacgactgcaggtgggtggtagtttcaactctccgaggaacatctcacgtgtttcccattaacccttatggggggcagccatgtgttagaacgcacatgtctccacgcgtggtcaatcggatgtcaagattccagaagtccgccgggcttgaagagattgagcaggaattaacgagcaagcaggggggccgatgttctcctgtccctggtctgtccagctcacctagcgggtccccactgcatgggaagctgaattctcaggacagttacaacaattttaccaataataatccgggcaatcccagattatcacccctgccctccttgatggtggttatgcctctcgcccagatcaaacagcctatgacgctgggcactattaccaagcgtacaggcccatacctcttcggggcagggtgcttttctattaaagcaccctgcaaagtgaaaccaccaccccagatttcaccatccaaatctatgggaggcgagttttgtgtggccgccatctttggcaccagcagatcatggtttgctaataatgcagggctgaaaagagaaaaagatcagtccaaacaagtggtagttgagtctctgtatatcatctcttgttatggcaccctggtggagcatatgatggagccccgtcccttgtctacggccccaaaaatcagtgacgatacacccctggagatgatgaccagccctagagcttcttggactcttgtcaggactccccagtggaacgagctccagcctccatttaatgccaaccatccactgctcctggctgccgatgcggtccagtactaccaattcctcttggcggggctggtgccacctggctctcccggacctataacaaggcacgggagttacgattcactggctagtgaccattctggacaggaagacgaagaatggctgtctcaggtggagattgtcacgcatacagggcctcacagaagactgtggatgggtccccagttccagttcaaaacgatccacccgtccggtcagacaacggtgatttctagcagttcctcagttctgcaatcacatgggccaagtgatacaccacagccgctcctcgactttgacaccgatgatctggatttgaatagtctgagaatccagcctgtgagatctgaccccgtctccatgcccgggtcgagtaggcctgtgtcagatagacgcggagtatccacggttattgatgcagctagcgggaccttcgataggagtgtgactctcttggaagtgtgtgggtcctggcccgaaggcttcggcctgagacacatgagctcaatggagcatacagaggaaggcctgagagagaggttggcagatgcgatggccgaatccccttccagagatgtggtcggatcagggaccgagcttcagagagaagggagcattgagaccctgtccaactcaagcggcagcaccagcggttccattccgcgcaattttgatggttaccggagtcccctgcccacaaacgaatctcagccgttgtctctgttccctactggcttcccctag

SEQ ID NO: 24797 - DNA, 501 bp, Artificial Sequence
  Description of Artificial Sequence: Synthetic coding sequence
atggtgaacagctgctgcggcagcgtgtgcagcgaccagggctgcggactggagaattgttgtcgtccatcatattgccaaactacctgttgccgcaccacatgttgtcggcccagctgctgcgtatcatcctgctgtaggcctcagtgttgtcagaccacttgctgtagaaccacctgctgtcacccttcctgctgtgtgagctcatgctgtcgaccgcagtgctgtcagagcgtgtgttgtcagcctacctgctgtcggccgcagtgctgccagacaacgtgttgtcgcaccacatgttgtagaccttcatgctgtagaccccagtgttgtcagtccgtttgctgccaaccaacttgttgttgcccaagctactgcgtctcgtcatgctgccggccacagtgttgccagacgacctgttgccgcactacttgctgccgtccttcttgctgtgtctccagatgttatcgcccgcactgcggtcagagtttgtgttgttag

SEQ ID NO: 24798 - DNA, 1104 bp, Artificial Sequence
  Description of Artificial Sequence: Synthetic coding sequence
atggacgacgccgccgtgctgaagcggcggggctacctgctgggcatcaatttgggcgagggctcctacgccaaggtgaagagcgcctatagcgagaggctgaagttcaacgtggctataaaaataatcgatagaaaaaaggcacccgcagattttctcgaaaagtttttaccgagggagatcgagatactggccatgttgaatcactgttccattattaagacctatgaaatcttcgagacctcgcacggaaaagtgtacattgtaatggagctggctgtccagggagacctgctggagttgataaaaacgcgcggcgcactccatgaagatgaagctagaaaaaagttccaccagctctcactcgccatcaaatattgccatgacttagatgtggtccaccgagacctaaaatgtgataatctgctcctggacaaagacttcaacatcaaactgtcggatttctctttcagtaagcgttgcctcagggatgatagtggaagaatggctctgtcaaagactttctgtggcagtccggcttacgccgcgcccgaggttttgcagggaattccttaccagcccaaggtgtacgacatatggagcctcggagttattctctatatcatggtgtgtggttctatgccttacgatgactccaacatcaagaaaatgctgcgcatccaaaaagagcatagggtgaactttcctcggtccaagcacctcaccggtgagtgtaaagacctgatctaccacatgttgcagcctgatgttaatagaaggctgcatatcgacgagattctgtcccactgttggatgcagcctaaggcacgaggatcaccttccgtggccattaataaggagggggagagcagtagggggaccgagccattgtggacacccgaacccggatctgacaagaaatccgcgaccaagctcgagcctgaaggcgaagctcagccccaggcgcagccagagacgaaacctgaaggcaccgccatgcagatgtccagacagtcagaaatcctgggatttccatccaagccaagtactatggaaaccgaagagggcccaccgcagcagcccccagagactagagctcagtag

SEQ ID NO: 24799 - DNA, 273 bp, Artificial Sequence
  Description of Artificial Sequence: Synthetic coding sequence
atgagccactacggcagctactacggcggcctgggctacagctgcgggggcttcggcggcttgggctatggttatggctgtggctgtggctccttttgtcgcagaggtagcggatgtggctacggaggctatggatacggaagtgggtttggtagctatggatacggatcgggctttggtggttacgggtatggatccgggtttggtggctatggatatggctgctgtagacccagctataatggtgggtacggcttcagcggtttttattag

SEQ ID NO: 24800 - DNA, 519 bp, Artificial Sequence
  Description of Artificial Sequence: Synthetic coding sequence
atgagctacaactgctgcagccggaacttcagcagctgcagccacggcggttatctgcactaccccggaagtagctgtggatccagttacccgtcgaacttagtgtacagcactgacctatgcagccccagtacatgccagctggggagttccctgtacagggggtgtcaggaaacctgttggcgccctaattcttgtcagactctgtgtgtcgagagttcaccatgccatactagttgttattacccaagaacgcacatgctctgcaattcttgtttgacgatgcatgtgggctcccgaggcttcgggagcaatagctgctgctcgcttagctgcggcagcaggtcatgttcaagcctggggtgcggctccaacggttttcgctatctgaactaccggattcacacatccccaagccagagttacagatccagattctgccaccctatatacttccccccgcgacggtggttccattccagctgttaccaacctttctgcagaagcggcttttactag

SEQ ID NO: 24801 - DNA, 1554 bp, Artificial Sequence
  Description of Artificial Sequence: Synthetic coding sequence
atgagcggcagctgcagcagccggaagtgcttcagcgtgcccgccaccagcctttgttccaccgaagtttcctgtggaggacccatctgtctgccctcctcttgtcagagccaaacctggcagctggtgacttgccaggacagctgcggcagtagcagctgtggcccccagtgcaggcagcccagctgccccgtctctagctgcgcacagcctctctgttgtgaccccgtgatatgtgagcccagctgctccgtttcaagcggctgtcagcccgtttgctgcgaggctactacatgtgagccgtcttgctcagtttccaactgctaccagccggtatgctttgaagcgaccatctgtgaaccatcatgtagcgtctccaactgctgccagccagtgtgcttcgaagcaaccgtgtgtgagccaagctgctcagtgtctagctgcgcacaacccgtatgctgtgaacccgcaatttgcgaaccttcctgcagcgtgtcgagttgttgccaacccgtcggttcagaggccacatcttgccagcccgtcttgtgcgtccccaccagctgccagcccgtgctttgcaagagttcctgctgccaacccgtggtctgcgagccaagttgctgcagtgcagtgtgcacactgcccagtagttgccaacccgttgtctgtgaacccagctgctgtcagcccgtgtgtcccacccccacatgctccgtaacgtcctcctgccaggctgtttgttgcgacccatccccctgtgagcccagctgttcagagtcttcaatctgtcaacctgcgacctgtgttgccctcgtatgtgagcctgtgtgcttgaggcccgtgtgttgcgtccaatcttcctgcgaacccccgagtgtgccatcaacatgccaggaaccgtcgtgctgcgtttccagcatctgccagcccatatgctcagagccttctccttgttcaccagctgtctgcgtgagctctccatgtcagcccacgtgctatgtggtcaagcgatgtcccagcgtgtgccccgagcctgtttcctgtccttctacctcttgccgcccactctcctgttcccccggctctagcgcctccgccatctgtaggccaacatgtccccggaccttttatattcccagcagttctaaacggccttgtagtgctaccatatcttatagacctgtgtcccggcccatctgtagacccatctgttcgggccttctgacctatagacagccttatatgacttcaatatcctataggccagcgtgctatagaccctgttattctatcctgcgcagacccgcttgtgttactagctactcttgccgcccagtctatttccgcccctcctgtacagagtcagacagctgcaaacgggattgcaagaaatcgaccagcagtcagttggactgcgtggacaccactccttgcaaggtggatgtttctgaggaggctccatgccagccaacagaggccaaacccatcagtccgactaccagggaagcagcagccgcacagccggctgcctcaaaaccagcaaattgctag

SEQ ID NO: 24802 - DNA, 1026 bp, Artificial Sequence
  Description of Artificial Sequence: Synthetic coding sequence
atggccgacggctgctgccccggcaacaccaccgccatccccgccgtccccaccatcacaacgtatcccgtgaagggcggctttcgccacgcattatgcctcccctcctcttgccacagccggatgtggcagctggtaacctgtcaggagtcatgtcagccaagtataggcgcaccctccggctgtgatccagccagctgccaacctacacgtctgcccgctactagttgtgttggttttgtgtgtcagccgatgtgctcacacgctgcctgctaccagtcagggactgggcagtctccctgtctggtgtcttcttgccaacccagttgctcagagagtacttgttgccaggaaaaatgctgtgacgcatcaccctgtcagcagagttcatgtcaggaatctgtgtgtatgagtggttcatgccaggccgcctgtggccagtctgtatgctgcgacgccggatcctgtcagccatcttgcagcgaggtgacttcctgtcccgaaacatcatgtctacccactatctgcacagcttctccttgtcagcccacttggtgccagggttcgagctgccagccggtcagcggagagggtcagccatgcaaatctacatactatcaaccaatttgttacatctttaaaccatgtcagtccgccctgtacatgcccgtgccatgtcaaccaagtacttgcgtcttctcttcctgcaataccacatgctgcgtcccgtctcattgccagcccccacactgccaactggtcccctcaacttgctttatatatcagcccgtggctaattgccaggctccttgctccaccaagaactgctgcaaacccgcttcctgcgacactgtaattagtggtcaacctacctgtgacggtcccccgagttacaaccagtccggatgcaagtctgcctgctgcgtgactggcctcggcaccagtccctcgtccgggtccaattgtctgcccacaagctgccagcccagctgcgagtcaagtttttgcaaggccaccctgtgctag

SEQ ID NO: 24803 - DNA, 588 bp, Artificial Sequence
  Description of Artificial Sequence: Synthetic coding sequence
atggtgagcagctgctgcggcagcgtgtgcagcgaccagagctgcggtcaaggactcgggcaggaatcgtgttgtcgacccagttgttgccagaccacatgttgtcgtactacctgttgccgcccttcctgctgcatctcttcttgttgtagaccgtcttgctgcatctcgtcatgttgcaagccttcatgctgcagaacgacatgttgtcgcccctcgtgctgcatttcatcttgttgccggcccagctgttgtatcagttcatgttgcaagccgtcctgctgtaggacaacttgttgcagacctagctgctgcatctcctcatgctgcaggccaagctgctgcatttccagctgttgcaagccgtcatgctgccagacaacctgttgtcgcccctcgtgctgtatttccagctgctatcggccccagtgctgtcagccctcttgctgcagacccgcctgttgtatttctagctgttgccatcctagttgctgcgtgtcaagctgccgatgcccattcagctgtcccacgacctgttgccgcactacctgttttcaccctatttgctgtgggtccagctgttgctag

SEQ ID NO: 24804 - DNA, 588 bp, Artificial Sequence
  Description of Artificial Sequence: Synthetic coding sequence
atggtgaacagctgctgcggcagcgtgtgcagccaccagggctgcgggagggatctgtgccaggagacatgttgtagaccctcctgctgcgagacaacctgctgcaggactacctactgccgccctagttgctgtgtgtcaagttgctgccgcccccagtgctgtcaaagcgtgtgctgccagccgacatgctgtcggcccagatgctgtatcagctcctgctgccgcccaagctgttgtgtgtcttcttgctgtaagccgcagtgctgtcagtcaatgtgttgtcagccgacttgctgccgacctcggtgctgcatttcttcctgttgccggccaagctgctgtgtatcttcctgctgccggccccaatgctgccagagcgtgtgttgtcaaccaacctgctgccaccccagttgtagcatttccagttgctgtcgccccagctgctgtgaatccagttgttgccgcccttgctgctgcctcaggcccgtgtgcgggagggtctcttgtcatacgacatgctaccgccctacctgcgttatatccagctgtcccagaccactttgctgcgcctcttcctgctgctag

SEQ ID NO: 24805 - DNA, 633 bp, Artificial Sequence
  Description of Artificial Sequence: Synthetic coding sequence
atggtgagcagctgctgcggcagcgtgtgcagcgaccagggctgcgggcaggatctgtgccaggagacttgctgtcgtccgagctgctgcgagaccacgtgctgtcgaacaacatgttgcagaccatcctgctgtgtgtcaagctgctgccgccctcagtgctgccagagtgtgtgctgccaaccaacatgttcccggccatcctgttgccagactacttgttgccgcacaacgtgctatagaccttcttgttgtgttagttcttgctgcagaccccagtgctgtcaacccgcctgctgtcaacctacctgctgtcgcccaagttgctgtgagacgacgtgttgtcatcccagatgttgtatatccagctgttgccgaccatcttgctgtgtcagtagttgttgtaaacctcagtgctgccagagcgtatgctgccaacccaattgctgccggccatcttgtagtatttctagttgctgccgcccgagctgttgcgagtctagctgctgcagaccctgctgctgtgttcgtccagtgtgtggtcgagtgagctgtcacactacatgttataggcctacctgtgtaatttcgagctgccctcggcccctgtgctgtgcttcaagttgttgctag

SEQ ID NO: 24806 - DNA, 387 bp, Artificial Sequence
  Description of Artificial Sequence: Synthetic coding sequence
atgaccggcagctgctgcggcagcaccctgagcagcctgagctacggcggtggctgctgccagccctgctgttgcagagacccctgttgctgtcgccctgtcacttgccagactaccgtttgccgacctgtgacttgtgtgcctagatgcaccagacctatctgcgaaccttgtaggagaccagtctgctgtgacccttgcagtttacaggagggctgctgtcggcctattacatgctgtccctcaagctgtaccgccgtggtgtgtcgaccttgttgctgggccaccacctgttgccaaccggtctcggtccagtcaccgtgttgcagacccccttgcggccaacccacaccatgcagcactacgtgcagaacctcatcatgctag

SEQ ID NO: 24807 - DNA, 387 bp, Artificial Sequence
  Description of Artificial Sequence: Synthetic coding sequence
atgaccggcagctgctgcggcagcaccttcagcagcctgagctacggtggtggctgctgtcaaccttgttgctgtcgggacccttgctgctgccgccctgtcacctgtcaaactacagtgtgccgaccagtgacctgcgttccccgctgcacgcggcctatctgtgagccatgtcgtcgcccagtttgttgtgacccctgttcccttcaggagggctgttgcagacctataacctgctgcccttcaagttgtacagccgtcgtgtgtaggccatgctgctgggccacaacatgctgtcagcctgtgtctgtacagtcaccttgctgcagaccaccatgcgggcagcccacaccttgctctaccacctgcaggaccagctcttgctag

SEQ ID NO: 24808 - DNA, 297 bp, Artificial Sequence
  Description of Artificial Sequence: Synthetic coding sequence
atggactgctgcgccagccggggctgcagcgtgcccaccggccccgcaacaacgatatgttcatccgacaagagctgcaggtgtggcgtgtgtctgccttccacctgtccacacactgtctggctgctcgagcctacatgctgtgacaactgccctccgccctgtcacattccacagccctgcgtgcccacatgctttctcctgaattcctgtcaacccactcccgggctggaaacattaaacttaacaacatttacgcaaccctgctgcgagccatgcctccctcggggctgctag

SEQ ID NO: 24809 - DNA, 297 bp, Artificial Sequence
  Description of Artificial Sequence: Synthetic coding sequence
atggactgctgcgccagccggagctgcagcgtgcccaccggccccgccacaacaatctgcagctcggataagtcctgccgctgtggggtctgtcttccttctacgtgcccacacaccgtctggttgctcgaacccatctgctgtgacaattgtccacccccgtgccacatccctcaaccttgtgtccctacatgttttctcttaaactcttgccagcctacacccggacttgagacccttaatctgaccactttcactcaaccatgctgtgagccttgtctgccacggggatgctag

SEQ ID NO: 24810 - DNA, 297 bp, Artificial Sequence
  Description of Artificial Sequence: Synthetic coding sequence
atgtactgctgcgccctgcggagctgcagcgtgcccaccggccccgcaacaactttctgttccttcgataaatcatgccgctgcggtgtgtgcttaccttctacatgtccccacgaaatatccctgctccagccaatttgctgcgatacatgcccgccgccgtgttgtaaaccagatacctacgtcccaacatgctggctcctgaataattgccaccccactccagggctatcgggcatcaatctgactacttacgtgcagcctgggtgtgaatccccttgcgaaccaagatgctag

SEQ ID NO: 24811 - DNA, 291 bp, Artificial Sequence
  Description of Artificial Sequence: Synthetic coding sequence
atgtgccacaccagctgcagcagcggctgccagcccgcctgctgcgcaccttccccatgtcaggcttcctgctatatcccagtggggtgtcaatcttccgtgtgtgtgcccgtgagcttcaagcccgctgtgtgcgtgcccgtgcgatgtcagagttccgtttgtgtgcccgtatcctgcaggccggttgtgtacgcagcaccatcttgccaatccagcgggtgttgtcagccaagctgcacatccgtcctgtgtaggcctatttcatgtagcaccccatcatgttgttag

SEQ ID NO: 24812 - DNA, 339 bp, Artificial Sequence
  Description of Artificial Sequence: Synthetic coding sequence
atgtgccacaccagccacagcagcggctgccccatggcctgccccggtagtccctgctgcgttccatccacatgttacccccccgagggatatggtacctcctgttgttgcagtgcaccctgcgtggcattgctgtgccgtcctctctgcggcgtcagcacttgctgtcagcccgcctgctgcgtgccaagtccctgtcaagtggcttgttgtgtcccggtatcctgtaaaccagtgctttgcgtggcttctttctgccccaccagcggatgctgtcagcccttttgtcctacattggtgtatcgaccagtgacatggagcacacccactgggtgttag

SEQ ID NO: 24813 - DNA, 666 bp, Artificial Sequence
  Description of Artificial Sequence: Synthetic coding sequence
atggccaccagcaccatgagcgtgtgcagcagcgcctacagcgacagctggcaggtggacgcctgtcccgagagttgttgtgaaccaccatgctgtgccacctcttgctgcgcccccgccccatgcctcacactggtgtgcactccagtgtcttgtgtgagctctccctgctgtcaggccgcctgtgaaccctctccctgtcagagtggctgtacatcctcatgtacgccttcctgctgtcaacagtcctcctgccagccggcgtgctgcacttcctccccttgccagcaggcctgttgcgttcctgtttgttgcaaaccagtatgctgcgtgcccgtctgctgtaagcccgtttgttgtaaaccgatttgttgcgtgcccgtgtgctctggagccagctcatcgtgctgccagcagagttctcgacagccggcgtgttgcactactagttgctgccgccccagcagctcggtttcacttctctgtcgccctgtgtgcaggtctacatgttgcgtgccaattcccagttgctgcgctccggcctctacctgtcagccctcctgctgcagacctgcttcctgcgtctctctcctgtgccggcccacatgcagccggctcagttccgcctgctgcggtctctccagcgggcagaaaagcagctgttag

SEQ ID NO: 24814 - DNA, 768 bp, Artificial Sequence
  Description of Artificial Sequence: Synthetic coding sequence
atggccgccagcaccatgagcatctgcagcagcgcctgcaccaacagctggcaagtcgatgactgccctgaaagctgttgcgaactgccatgcggaactccttcatgctgtgcccctgcgccatgcctaactctcgtgtgtacacccgttagctgtgtctcttccccatgctgccaggccgcttgcgagccttcagcatgccagagcggctgtacctctagctgtactccaagctgctgccaacagtctagctgccagcctgcctgctgtactagttctccctgtcagcaggcctgttgtgtgcccgtctgctgcaagccagtgtgttgtgtccccgtgtgctgtggggccagtagttgttgtcaacagtctagttgtcagcccgcatgctgcgcaagtagttcttgccagcagtcatgtcgagtcccggtgtgttgtaaggctgtgtgctgtgtccccacttgttccgagtccagctcatcttgttgccaacagtcctcatgtcagcccgcttgttgtacctcttccccgtgtcagcagagttgctgcgtttctgtgtgctgcaaaccggtatgctgcaagtcaatttgttgtgtgcccgtttgcagcggagcctcgtcaccgtgctgtcagcagagctcatgccagcctgcttgctgtacaagttcttgctgccgaccgagctcgtccgtgtctcttctctgtcgcccagtctgcagtagaccagccagttgttcatttagctccggccagaaatcaagctgctag

SEQ ID NO: 24815 - DNA, 312 bp, Artificial Sequence
  Description of Artificial Sequence: Synthetic coding sequence
atgtgcggcagctactaccggaactacaacggcggccacggctacggctgctgcggctacggtggccttggctgtgggtacggaggctgtggttatggctgttgtggttatggtgggctggggttcggatacgggggcttggattgcggatacggcggcctggggtgtggctatggctccttctgcggatgcggttacagaggcttagactgcggatacgggtgcggctacggttatgtctcccattcattctgcggttgtggctaccgctgcggttcagggtacggcagcagtttcgggtactattattag

SEQ ID NO: 24816 - DNA, 3117 bp, Artificial Sequence
  Description of Artificial Sequence: Synthetic coding sequence
atggtgagcagcgcccagatgggcttcaacctgcaggccctgctggagcagctctcccaggacgagctgtcaaagtttaaatatctgataaccacttttagtctcgctcacgagctccagaagatcccacacaaagaggtcgataaggccgatggtaaacaattggtagaaatcttgacaacacactgcgacagctattgggttgaaatggcgtccctgcaggtgttcgagaagatgcacagaatggacctatccgagcgggccaaggacgaagtccgggaagccgcgctgaagagctttaataagcggaagcccctttcactggctttcacagaaactaaggggaatgttatttgcctcggaaaagaggtcttcaaaggaaaaaagcctgacaaagacaatcggtgtcgctacatcctgaagaccaagttccgcgagatgtggaagtcctggcctggggattcaaaagaggtccaggtaatggcagaacgctataagatgctgattccattcagcaatccaagagtccttcccggccctttctcttacaccgttgtgctgtatgggcctgccgggctcggcaagacaacgttggcacaaaagcttatgctagactgggctgaagacaacctgatacacaaatttaagtacgcattttatttatcctgcagagagctgtctagactcggtccttgcagcttcgctgagctcgtgtttcgcgactggcccgagctgcaggacgatatcccccatatcctggcccaggcccgtaaaatcctctttgtaattgatggattcgacgaattgggggccgctcccggggccctgattgaggacatatgtggcgattgggagaagaagaagccagttcccgtgttattaggttccctcctgaacagagtgatgctccctaaggccgcactgttggtgaccacccgtccacgtgctctgcgggatttacgcatcctggcggaagaacctatatatatacgagtggagggattcttagaagaggacaggcgagcatacttcctccgccactttggtgacgaggaccaggctatgagggctttcgagcttatgaggtccaacgctgccctttttcaactgggcagtgcacctgctgtttgctggatagtgtgcaccacgctcaagctgcagatggagaaaggtgaggatcccgtgccaacttgtctaacacgcacagggctgttccttcggttcctgtgtagtaggtttccgcagggtgcccagctccggggagcactgaggacgttgagcctactggcagcgcagggtctgtgggcacagacgtcggtgctccatcgtgaggacctcgaacgactgggcgtgcaggaatctgatcttagactctttctcgacggcgacatcctgcgacaggaccgggtgtctaaggggtgttactcattcattcatctttcttttcagcagttcttgacagccctgttctatactttggagaaagaagaagaagaagatagggacggacatacttgggacattggcgacgtacagaaacttctgtccggggtggagcggttgcggaaccccgatttaattcaagcagggtactattctttcgggcttgctaatgaaaagcgagccaaggaactcgaggctacatttggctgcaggatgtcacctgatataaagcaggaattattgcggtgcgacatctcatgtaagggcggccacagcacagtaacagatcttcaggagttactggggtgcctgtacgaatcacaggaggaggagctggtcaaggaagtcatggcacagttcaaagagatcagcctacatcttaatgccgtggacgttgtgccgagctccttttgtgtgaagcattgccgcaaccttcagaagatgagcctccaagtgattaaagaaaacctgcccgaaaacgtcactgcctctgaaagtgatgccgaagtggagagaagtcaggacgaccagcatatgcttccattctggacagacttgtgctccatcttcggatcaaacaaggacttgatgggcctagccattaatgactcatttctgtccgcgtccctggtccggatcctgtgtgagcagatcgctagcgacacatgtcacctgcagagggtggtattcaaaaacatttcaccggccgacgcgcatcggaatctatgcttggctttgcgtgggcacaaaactgtcacctatctgacacttcaaggaaatgatcaggatgacatgttccccgcactatgcgaagtcctaaggcacccagagtgtaatctgcgatatctgggtctggtgtcttgtagtgctacaacccagcagtgggcggatttaagcctggcactcgaagttaatcagtctcttacgtgcgtgaatctctcagacaatgaactcctggacgagggggccaagctgctctataccaccctgagacatcccaagtgctttttgcagaggctgagtcttgagaactgccatctgacggaagcaaattgcaaagatttagccgctgtgctggtggtgagtcgcgaactcacacacttgtgcctagccaagaatccaatcgggaatacaggtgtgaagttcctgtgcgaaggcctgcgataccccgagtgcaagttgcagaccctcgtgctttggaattgtgatatcacaagtgacggttgctgcgacctgacgaaattgctccaagaaaaaagctctttactgtgtttggaccttggattgaaccacataggagtcaaaggtatgaagtttttatgcgaggctttgaggaaaccactctgcaatctgaggtgcttgtggctgtggggatgctccattccaccatttagttgtgaggatttatgttccgccctcagctgcaatcagagtcttgtaacactggatttgggacagaaccccctgggtagcagcggtgtgaagatgctgttcgagacgctcacctgctccagtgggacattgaggaccctgcggctgaagatcgatgattttaacgatgagctaaataagctgcttgaggagatcgaagaaaagaaccctcagcttatcatcgacactgagaagcatcatccctgggctgaacgtcccagtagccacgatttcatgatctag

SEQ ID NO: 24817 - DNA, 762 bp, Artificial Sequence
  Description of Artificial Sequence: Synthetic coding sequence
atggagctggagcagcgggagggcaccatggccgccgtgggcttcgaggagttttccgcaccgccaggatcagagctggccctgcctccactgttcgggggccatatccttgaaagcgagctggagacggaggttgagtttgtgagtgggggcctcggaggttccggcctccgggaacgcgatgaagaagaggaggctgctcgaggacgccgaagaaggcagcgtgagctgaacaggcgcaaataccaggctcttggacgccggtgtagagaaattgagcaggtcaacgagcgagtgctgaatcgtctgcaccaggttcagaggattacacgtagactgcagcaggaacgcagattccttatgcgggttctcgatagctacggcgatgattacagagcctctcagtttaccattgtgctggaagatgaggggtcccagggaaccgacgccccaactcctggtaatgccgagaacgagccccctgagaaggagacactttcacccccacggaggacacctgcgcctccagagccaggcagcccggcacctggcgagggtccctcaggtaggaagaggcgccgcgttcccagggacggacggcgggcagggaacgccctcaccccagagttggcacccgtgcagataaaagtagaggaagactttggtttcgaagcagacgaggctttggatagctcatgggtctctcggggtccagataagctattgccgtatcccacacttgcttcaccggcttcagactag

SEQ ID NO: 24818 - DNA, 2679 bp, Artificial Sequence
  Description of Artificial Sequence: Synthetic coding sequence
atgctgcggaccgccggccgggacggcctgtgccggctgagcacctatctggaggaattagaagccgttgagttgaagaagttcaagctgtatttaggtacagctacagagctgggcgaaggcaagatcccatggggttctatggagaaggcaggccctttagagatggcccagttactcataacacattttggacccgaggaggcttggcggttggccctatctaccttcgaacggatcaacagaaaggatttatgggagagggggcagagggaagatttagttagggatacgccgccaggtggcccatcctccctagggaaccagtccacatgcttgctcgaagtgtcactggtaaccccacgcaaggatccccaggagacctaccgagactatgtgaggcgaaagttccgactgatggaagacagaaatgctcgattgggggaatgtgtcaacctatctcaccgctatacccgactgctcttggtcaaagaacacagcaaccccatgcaagtccagcaacagcttctagacaccggacgcggccacgctagaaccgtggggcatcaggcatcacctattaaaattgaaactttattcgaacccgatgaggagcgaccagaaccaccaaggacggtagtgatgcaaggcgcagctggaatagggaaaagtatgctggcacacaaagtcatgcttgattgggccgacggaaagcttttccaaggccggttcgattatctattctacattaattgtcgcgagatgaatcagagcgcaacagagtgcagcatgcaggacctgatcttcagctgctggcccgaaccttccgcaccgcttcaggagcttatacgggtgccagagcggctactctttatcattgacggatttgacgagcttaaaccctctttccacgatccacaggggccttggtgtctttgctgggaggagaaacgaccaacagagctgctgctgaattccttgatcagaaagaaattgttacctgagcttagtctgcttatcacaactcggccaacagcacttgaaaagctccacagacttctggaacatccacggcacgtggagatactcggcttctcagaggccgagcgaaaggagtacttttacaagtactttcacaacgctgagcaggctggacaggtcttcaactacgtgcgtgataacgaacccctcttcaccatgtgtttcgtgccactcgtatgctgggttgtttgtacttgcttgcagcaacagctggaaggcggcggattgcttagacagaccagccgcacgacgacggctgtttacatgttgtacctactgagcctgatgcaacccaaacccggcgctcctcggctgcagccaccccccaatcaacggggcctgtgctccctggccgccgacggactctggaatcagaagattctctttgaggaacaggatctgaggaagcacggcctagatggagaggatgtgagcgctttcttaaatatgaatattttccagaaagatattaattgtgagaggtactactccttcatacatctcagcttccaggaattcttcgccgctatgtattatatattagacgaaggagaggggggtgctgggcccgaccaagatgtgaccaggcttttgaccgagtacgctttttccgagcgatcattcttggccctgacatcccgcttcttgttcggattacttaatgaggagaccagaagtcatctggaaaagtccttgtgttggaaggtatccccccacatcaagatggatctcttacagtggatccagtccaaagctcagagcgacggatccactcttcagcaggggtcattggagttcttcagctgcctctacgagatacaggaggaggaatttatacaacaggctctctcccatttccaggtgattgtcgtgagtaacatcgcctctaagatggagcacatggttagttcgttttgccttaagcggtgcagatcagctcaggttttgcatctgtacggcgcaacctacagtgcggacggggaagacagagcgcgatgtagtgccggtgcacatactctgctcgttcagctgaggccagagaggaccgttttattggacgcctactctgaacatctggctgccgcactgtgcaccaacccaaatctgatagaattgagcttatatcgcaacgccctcgggtcccgcggcgtgaaacttctgtgccagggcctgcgccaccccaattgcaaacttcagaatctgcggctgaagaggtgccggatctcatcaagtgcgtgcgaggatctttccgcagcacttatcgccaacaagaacctcacccggatggacctgtcaggaaacggcgtagggttcccaggcatgatgctgctgtgtgagggcctgagacatccccagtgccggctgcagatgatccagttgcggaaatgtcaacttgagagtggcgcctgtcaagagatggcttctgtgctaggcaccaaccctcacctagtggagctggatttaacagggaatgccctggaagaccttggactgagactgttgtgtcagggacttcggcaccctgtatgtcggctgaggacactgtggtggctttttggtatggatctcaacaagatgacgcattcccgattggccgcactccgagttacgaaaccgtaccttgacattgggtgctag

SEQ ID NO: 24819 - DNA, 3189 bp, Artificial Sequence
  Description of Artificial Sequence: Synthetic coding sequence
atgctgcggaccgccggccgggacggcctgtgccggctgagcacctacctggaggagctggaggccgttgagctgaagaagtttaagttgtacctgggcacggctacggagttaggcgaaggaaaaataccgtggggctcaatggaaaaggcaggcccgttagagatggcgcagctactgattacccactttggcccggaggaagcctggagactggcactcagtacattcgagcgcatcaaccggaaggacctatgggagcgcggtcagagagaagacctggtgcgcgatacccctcctggcggtccctccagcttggggaatcagagcacttgtctccttgaggtaagcctggttacacctcgtaaggatccccaggaaacgtatcgcgactatgtgaggcgcaaattccggctgatggaggatcggaatgctcgccttggcgagtgcgtcaatctcagccatagatatacgaggctgctgctggtgaaggagcactccaacccaatgcaggtgcagcaacagcttctggacaccggtcgaggccacgcacgcacagtggggcatcaggctagccccatcaaaattgagactctctttgaacctgacgaggagcgccccgaaccacctaggactgttgtgatgcagggtgcagccgggatcggaaagtccatgctcgcgcacaaggtgatgctcgactgggcagatggtaaactgttccagggccgattcgattatctgttctatatcaactgtagagagatgaaccagtccgcgacagaatgcagcatgcaggacctgattttcagttgttggccagaacccagtgcaccattgcaggaactgatccgcgtccctgaaagacttctgtttatcatagacggcttcgatgaactcaagcccagcttccacgaccctcagggaccatggtgcctttgctgggaagaaaagagaccaacggagcttcttctaaattccctcataaggaagaaactgctgcccgagctgtccctcttaataaccactcgaccaaccgctctggagaaactgcataggcttctagagcatcctaggcatgtcgaaatcctggggtttagtgaggccgaacgaaaggagtatttttataaatatttccataatgccgaacaagcgggacaggtgttcaattacgttcgcgataacgagcccctgttcacaatgtgcttcgtacccctcgtgtgttgggtggtctgcacttgccttcagcagcagctcgagggcggggggctgcttagacagacctccaggaccactaccgcagtttacatgctgtatctcctgtccctgatgcagcctaagcccggagctccacgcttgcagcctccgcccaatcaaagaggcctgtgtagtctagctgccgacggactttggaaccagaaaatactattcgaggaacaggacctgcggaaacacgggctcgacggtgaagacgtttccgcctttctaaatatgaacatttttcaaaaagacattaattgcgaacgctattacagttttattcatctgtcttttcaggagtttttcgccgcaatgtattacatactcgatgaaggtgaaggcggggcaggacctgaccaggacgttacgaggctcctcacagagtacgctttttccgagaggtctttcctcgccctgacaagcagattcttatttgggctgcttaacgaggagacgaggtctcatcttgagaagagcctgtgctggaaggtcagcccccatattaaaatggatcttctgcagtggattcaatctaaggctcagagcgatggctcaactctccagcagggcagtctcgagtttttttcttgtctgtacgagatccaggaggaggagtttattcagcaagccctgtctcactttcaggtaatagttgtctctaatatcgcaagcaagatggagcacatggtgtctagcttttgcctcaaaagatgtaggtccgcacaagtcctgcatctgtacggcgcaacatatagcgccgatggtgaagaccgagccagatgctccgccggcgcccatactttgctggtgcagctgagacccgagcggaccgtccttctcgacgcatatagcgaacacctggcagcggccctttgcaccaacccaaacttaattgaactgtctctttaccgaaatgcccttgggtcacgtggagtgaagctactatgccagggtctgaggcatcccaattgcaaactgcagaatctccgtctcaagcgttgcagaatctcatcctcagcctgtgaggatctcagcgccgccctcattgcaaataaaaatcttacccgaatggacttgtcaggaaacggcgtcgggttcccggggatgatgctgctctgcgaaggtttgaggcatcctcaatgccgcctccagatgattcaactccgtaagtgtcagctggagtccggggcttgtcaggaaatggctagtgtgctcgggaccaacccgcacctcgtggagcttgatctcaccggcaatgctcttgaggatctcggtctgcggttactgtgccagggcctgcgccaccctgtctgcaggctccgaaccctgtggttaaagatctgtcgcttgacagccgcggcctgcgatgagctggcttccaccttgagcgttaatcagagccttagagagttggatctgagcctgaatgaacttggcgacctgggagtgctattactctgcgaagggctcaggcatcccacctgcaagctgcagactctcaggctggggatctgccgtctgggaagtgccgcttgtgaaggactctctgttgtgctacaggctaatcacaacttaagggagctcgacctgagcttcaacgacctcggggattggggcctgtggcttttggcagaagggctgcagcatcctgcctgtaggctccagaagctgtggctcgatagctgtggattaactgccaaggcatgcgagaacttatacttcacgttgggcattaaccagacgctgaccgacttatatctcactaataacgccttgggtgacaccggcgtgcggctattatgtaagagactcagccaccctggctgtaagctgcgcgtgttgtggctctttggaatggatctcaataagatgactcacagccgcttggcggcattgagggtgacaaaaccttatctggacataggttgttag

SEQ ID NO: 24820 - DNA, 3015 bp, Artificial Sequence
  Description of Artificial Sequence: Synthetic coding sequence
atgctgcggaccgccggccgggacggcctgtgccggctgagcacctacctggaggagctggaggctgtggaactgaagaaatttaaactctacctgggtacagccaccgagctgggcgagggcaagatcccttgggggtccatggaaaaggctgggcccttggaaatggcccagttactgatcacacactttggacccgaagaggcgtggagactcgctctgagtactttcgaacggatcaataggaaggacctatgggagagggggcagcgcgaagatctcgttagagatacgccccccggcggccccagtagcttaggtaatcagagtacgtgtctcctcgaggtttctctggtgactccaagaaaggatccacaagaaacctatagagattatgtgcgtcgtaagttccggctcatggaggataggaatgcccgtctgggggaatgcgttaatctgtcccaccgttatactagactcttgctcgtgaaggagcacagcaaccccatgcaggtacagcagcagcttctggacacaggcagagggcatgccaggactgtgggacaccaagcctcccccattaaaattgaaaccttatttgagcccgacgaggagagacccgaaccgcctcgaactgtagtcatgcagggagctgcaggcattgggaaaagcatgctggcccacaaggtcatgcttgactgggcagatgggaaattgtttcagggtcgtttcgattatctcttttatattaactgtagagagatgaatcaaagcgccactgaatgtagtatgcaggacttgatctttagctgttggccagagcccagcgcaccattgcaggagctgattcgcgtgccggagcggctcctctttattattgatgggtttgacgagcttaaaccttcgttccacgacccacagggcccctggtgtctatgttgggaagaaaaacggcctacagaactgctcctgaactccctcattcggaagaagctcttacctgaattgtccctgttgattaccactcggcctacggcattagaaaaacttcaccggcttctggaacatccaaggcatgtcgaaattctgggcttctccgaggctgagcggaaggaatatttttataagtactttcacaacgctgagcaagcaggccaggtgtttaattatgtgcgggacaatgagccccttttcaccatgtgcttcgtccctctcgtgtgctgggtagtctgcacgtgccttcagcagcaattggagggcggcggtctgttgcggcagacaagcaggaccaccacagcagtgtacatgctgtatttgctgtcactgatgcagcccaagcctggtgcgcccaggttgcagcccccaccaaaccagagggggctgtgctccctggccgctgacggactatggaaccaaaaaatcctgttcgaagagcaggatcttcggaaacatggcctggacggtgaagacgtgagcgcattcctaaacatgaacatctttcagaaagatattaattgcgaacggtactatagttttatccatctctcgttccaggagtttttcgcggccatgtactacattctggacgaaggcgaaggcggcgcagggccagaccaggatgttactaggctcctgacagaatacgccttctctgaacggagttttctagcgctcaccagcagattcctcttcggcctccttaacgaggagacacgatcccatctggagaagagtctctgctggaaagtgtccccacatatcaagatggacttactgcagtggatccagtctaaggctcagagcgacggatcgactttgcagcagggctctcttgagttctttagctgtctgtacgagattcaggaggaggagtttattcaacaggcgctttctcatttccaggtgatcgtggtctcgaacatcgcctcaaagatggagcacatggtatcatccttctgtctgaagcggtgccgatctgcgcaggtgctacacctgtatggggccacgtattcagccgacggagaggaccgcgcccgttgttccgcaggagctcacaccctactggtgcaactgccagaaagaaccgtgcttctcgatgcgtattctgagcatctagcggcagctttatgtactaacccgaacctcattgaactctccttgtaccggaatgccctgggatcgcggggagttaaacttctgtgccaggggttacgacatcctaattgcaaacttcaaaacctgcggttaaaacggtgcaggatctcgagcagcgcttgtgaggacttgtccgccgcactcatcgctaacaagaatctcacgcggatggacctgagcggtaacggggtcggcttccctggcatgatgctgctgtgtgaagggcttcgtcacccccagtgcagacttcagatgatccaactgcggaagtgccagctcgaatctggggcctgccaagagatggcctctgttctgggaaccaatccacacctagttgaactggacctgacagggaatgcattggaagacttaggtctgaggctgctctgccagggtctccgtcacccggtgtgtaggttacgcactctttggcttaagatctgtcggctgaccgcagctgcctgcgacgagttggccagcacccttagcgttaatcaatctctccgagagttggatctgtccctaaacgaactcggtgacctgggcgtgctgctgctgtgcgagggacttcgccatcccacctgtaaattgcaaactcttagactcgacagctgtggcctgacagctaaggcctgtgaaaatctttacttcactttaggtattaaccaaacattgacagatctctatcttactaataatgctcttggagacaccggcgtacgcttgctctgcaagcggcttagccatccaggttgtaagctccgagtgctgtggctgtttgggatggacctgaacaagatgacgcactcgagactggccgccctcagggtaacgaaaccctatttagatatcggatgttag

SEQ ID NO: 24821 - DNA, 327 bp, Artificial Sequence
  Description of Artificial Sequence: Synthetic coding sequence
atggccagcggccggcccgaggagctgtgggaggccgtggtgggcgcagcagagcgattccgcgcccgtacagggacagagttagtattactcacggctgcacctcctcctcctcctcggccagggccctgtgcatatgcagcacatggcagaggggctctcgcagaggccgctaggaggtgcctccatgatatcgctttggcccatcgggccgctactgcggccaggcctccagccccaccacctgcaccacaaccacccagtcctacaccatcacccccgcggccaactctagcgcgagaggacaacgaggaggatgaagactag

SEQ ID NO: 24822 - DNA, 771 bp, Artificial Sequence
  Description of Artificial Sequence: Synthetic coding sequence
atggccagcggccggcccgaggagctgtgggaggccgtggtgggcgccgcagagagattcagagccagaaccggaactgagcttgtgctcctgactgctgcgccacccccacctccccgacctggaccatgtgcttacgcagcgcatggccggggcgccctggccgaagccgccaggaggtgtctgcatgacatcgcactggcacacagggctgcgaccgcagcgcggcctcctgcacccccacccgcccctcagcctccttcacccaccccatctcccccgcggcctaccctggcccgggaagacaatgaagaggatgaagatgaacccaccgaaaccgagacgagtggtgaacagctcggcatttcagacaacggtgggctgttcgtgatggacgaggacgctaccctgcaggacctgcctcctttctgcgaatctgaccctgagtccactgatgacggctcccttagtgaagagacccccgctggccctcctacctgtagtgtcccaccagcatctgccctccccacacagcaatacgccaaaagcctgcccgtgtcagtgcccgtatgggggtttaaagagaaacgcacggaggcacgttcatcagacgaggagaacggtcctccaagtagtcccgacttggatcggatcgccgccagtatgcgtgcattggtgttgcgggaagcggaagatacacaggtcttcggagatctgccacgcccacgactcaacaccagcgatttccagaagctcaagcgcaagtactag

SEQ ID NO: 24823 - DNA, 771 bp, Artificial Sequence
  Description of Artificial Sequence: Synthetic coding sequence
atggccagcggccggcccgaggagctgtgggaggccgtggtgggcgctgcagaaaggttccgcgcaaggacagggacagaactcgtgctcctgacagcagcaccccccccaccaccgcgtcctggcccttgtgcctacgctgctcatggtcggggggctttggcggaggcagcccggagatgcctgcacgacatagcacttgcccatcgggccgctaccgccgcacgacctccggcgcctccccctgcaccacagccccccagccccactccctctccccccagacctacgctggcccgagaagacaatgaagaggatgaagacgaaccaacagaaactgagacgagcggcgagcagttaggaatctcagataacggcggcctgtttgttatggatgaggacgccactcttcaggacctcccaccattctgtgaatccgacccagaatcaaccgatgacggcagcctgagcgaggaaactcctgccggacctcccacctgtagtgtcccacctgcctcagctttaccgacacagcagtacgccaaaagtctgcctgtctctgtgcccgtctggggattcaaagaaaagcgaaccgaagctcgctcgtcagatgaagagaatggcccaccctcatcccccgatcttgatcgcatcgctgccagtatgcgggctctcgtcctgcgtgaggctgaggatacccaagtgttcggagatctgcctcgcccgcggcttaatacttcagattttcaaaaactcaaaagaaagtattag

SEQ ID NO: 24824 - DNA, 771 bp, Artificial Sequence
  Description of Artificial Sequence: Synthetic coding sequence
atggccagcggccggcccgaggagctgtgggaggccgtggtgggcgcggctgagagattcagggccagaacagggaccgagctagtgttacttactgcagctccacctcccccaccgcgcccgggaccttgcgcctacgctgcccatgggagaggcgccctggctgaagccgccaggagatgcctgcatgacatagccctggcacatcgtgccgccacagctgcacggcccccagctcccccacccgctccgcaaccgccctccccaacgcccagtccacccagacccacattggccagggaggacaacgaggaggacgaggatgagccaaccgagaccgagacaagcggagagcaactaggcatttccgataacggtgggctgtttgttatggatgaagacgccacccttcaagacttgcctcccttctgcgagtctgatcccgaatccacggacgatggatccctctccgaagaaacaccggcagggcctccaacctgcagcgtcccacccgcttccgctctccctacacagcagtacgctaagtctctgccagtaagtgtaccagtctggggtttcaaagagaaacgaactgaagcccggtcaagcgatgaagaaaatggtccgccatcttctccagatttggatcgcatcgccgcaagcatgagggccctcgtattgcgcgaggctgaggacacacaggtttttggcgacctgccgaggcctcgccttaacactagcgattttcaaaaattgaaaagaaaatattag

SEQ ID NO: 24825 - DNA, 771 bp, Artificial Sequence
  Description of Artificial Sequence: Synthetic coding sequence
atggccagcggccggcccgaggagctgtgggaggccgtggtgggcgctgcggagagattccgcgccagaactggaacagagctggtgcttttgacagctgcaccacccccccctccacggccagggccttgcgcttacgccgcgcatggcaggggtgcattggccgaagctgccaggagatgcttgcatgacatcgccctggcgcatcgtgccgccactgcggcgcggccccccgcaccacctcctgccccccaacctcctagcccaactcctagtccgcctagacccacattagcacgagaagacaatgaagaggacgaagacgagccaacggaaacagaaacctccggtgaacagttaggaatttctgataatgggggtctattcgtgatggacgaggacgcaaccttgcaggaccttccacccttctgtgagagcgatccagaatcaacggacgacggcagcctcagcgaagaaacccctgccggtccacccacatgttcagtcccaccggcttcggctttaccaacacagcagtatgcaaaaagcttgccagtttcggtccctgtgtggggcttcaaggagaagagaaccgaggccaggtccagtgatgaggagaatggcccccccagctccccagacttggataggatagcagcctcaatgcgggcgctcgtgttgcgcgaggcagaggatactcaagtgtttggcgatttgccacgtccacggcttaatacatcagacttccagaagttgaaacgaaagtactag

SEQ ID NO: 24826 - DNA, 831 bp, Artificial Sequence
  Description of Artificial Sequence: Synthetic coding sequence
atgagcttcgagggcggcgacggcgccggccccgccatgctggccactggcactgctcgaatggcaagcggtcggcctgaggagctttgggaagccgtcgtgggagctgccgagaggttccgagcaaggactggcaccgaactggtactgctcacggctgcaccgcctccccctccccgtccagggccttgcgcctatgcagcccatgggcggggggctctggccgaagcagctagaaggtgtttacacgatatagcattggcacatcgagctgctacagctgcccgcccccccgccccccccccagcaccgcaaccgccctctccaacgccctcaccaccccgcccaacactggcccgggaagacaacgaggaagacgaagatgaacctaccgagacagaaactagcggcgagcaactcggaatcagcgataatggtgggctgtttgtcatggacgaggatgcaaccctgcaggatcttccacccttttgcgagagcgacccggagagtaccgatgacggttctctgtcagaggagacgccagccggtcccccaacttgcagcgtacctcctgcttcagccctgcccactcaacagtatgccaagtctctgccagtctccgtgcctgtctggggattcaaagagaagcggacagaagctcgctcttccgatgaggagaatggccctccctccagtcctgacctcgataggatcgctgcatctatgcgggccctggtcctccgcgaggcggaggacacccaggtcttcggtgatctgcctagaccccggctgaacacgagtgattttcagaagctcaagagaaagtattag

SEQ ID NO: 24827 - DNA, 906 bp, Artificial Sequence
  Description of Artificial Sequence: Synthetic coding sequence
atgacccggcacggcaagaactgcaccgccggcgccgtgtacacctaccatgagaagaagaaagacactgccgccagtggctatggaactcagaatatccgccttagtcgcgatgcagtgaaagatttcgactgctgctgtctttcactacaaccatgtcatgatcctgtggtgacaccagacggctacctgtacgaaagggaagctatcctagaatacatcctacaccagaagaaagagattgccagacagatgaaggcctatgagaagcagagagggacacgccgggaggagcagaaagagctacaaagagcagcaagtcaggatcatgtgagaggctttctggagaaggagtctgccattgtgtccagacccctcaatccctttactgcgaaggcactgtccggcacatctccagacgatgttcagcctggcccaagtgtaggaccaccttctaaggacaaggacaaggtccttccatctttctggatcccctctctgacaccggaagccaaggcaacaaagctggaaaaaccctccagaacagttacgtgccctatgtcaggcaagccactgcgcatgtccgatctgacgccagtgcatttcacccccctagacagctcagtggatcgagtgggcctaataacaagaagtgagcgctatgtttgtgccgtgactcgcgattctttatctaatgcgactccttgcgcagtactgaggcctagcggtgctgtggtcacccttgagtgcgtggagaaattgatcagaaaggacatggttgatccagtgactggtgacaaattgacagatcgggacatcatagttcttcagcgaggcggaaccgggttcgctgggagcggggtcaagctgcaggccgagaagtctcgaccagtcatgcaagcctag

SEQ ID NO: 24828 - DNA, 612 bp, Artificial Sequence
  Description of Artificial Sequence: Synthetic coding sequence
atggccgaggtgcaggtgctggtgctggacggccggggccacctgctggggaggttggcagccatcgttgctaaacaggtattactgggtcggaaggtggtcgtcgtcaggtgcgagggcatcaatatcagcggcaatttttatagaaataaactgaagtatctcgccttcttaaggaaaaggatgaacacaaaccccagtcgtggcccctatcattttcgggccccatctagaatattttggaggacagtaaggggcatgttgcctcacaaaactaagcgcgggcaggccgctttggatagactgaaggtgttcgatgggatccccccaccatatgacaagaaaaaacgcatggtggtccctgctgccctaaaagttgtccgactgaaacccacacgaaagttcgcctacttgggccgtctggcgcatgaagtagggtggaaatatcaagccgttactgctacactggaggaaaaacgtaaagaaaaggcgaaaatacactataggaagaagaagcaattaatgcgcttgcggaagcaagccgaaaagaacgtagagaagaagattgacaagtatactgaggttctgaaaacccatggtttgctggtgtag

SEQ ID NO: 24829 - DNA, 690 bp, Artificial Sequence
  Description of Artificial Sequence: Synthetic coding sequence
atgacctgctgcagccaggtgcccccccggcggcggcccagcctggcactgtcgccacggcttgactgtaacggtctcaacggcgtgcccggctctatttgggactttgtatcgggaagcttcagtccaagtccctcgcctattctgtcagccggccctccgagtagttctagcgccagccccaacggcgcggagcttgctagagttcggcgccaactggatgaggccaagagaaaaataaggcaatgggaggaaagctggcagcaggtgaagcaggtatgcgacgcgtggcagcgagaggctcaggaagcaaaggagcgggctagagtggccgattctgaccgccagctggcgctgcagaaaaaagaagaggtagaagcccaagtgaagcaactccaggaagaactggaggggctcggcgtggcaagtacgctgcctggcctgaggggctgcggcgacattggaactatccctctacctaaactgcattcactgcaaagccagttacgactcgacctggaggccgttgacggggtgatttttcagctgagagccaaacagtgcgtggcctgcagggagcgagcacatggcgctgtccttcgcccctgccagcaccacatcctctgtgaaccctgcgccgccacagcacctgagtgcccatactgtaaggggcaacctctgcagtggtag

SEQ ID NO: 24830 - DNA, 2283 bp, Artificial Sequence
  Description of Artificial Sequence: Synthetic coding sequence
atgatggaggagcgggccgccgccgccgtggccgccgccgccagctcatgtcggccgctcggcagtggagccggacctggtccaaccggagccgcccccgtgagtgccccagcaccgggccctggcccggctggcaaaggaggcggcggaggaggctcccccggcccgactgccggcccagagccactatctctgcccggcattctgcatttcatccaacatgaatgggctaggttcgaggcggaaaaggcgaggtgggaagccgaaagggcagagctccaggcccaagtagctttcctccagggggagcgcaaagggcaggagaacctgaagacggatctcgtacgtcgcattaaaatgctggaatacgcattgaagcaggaaagagcgaagtatcataaactgaagttcggtacagacctcaatcaaggggaaaagaaagcagacgtaagtgagcaagtgtctaacggaccagtggaaagtgtaacactggaaaacagccctttagtgtggaaggagggaaggcagttactgaggcagtacctcgaggaggtcggatacacagacacaattctggacatgcggtcaaagagggtgcgcagtttgctgggacgatcactggagctgaatggggcagtcgaaccctctgaaggagcaccccgggcaccacctggacccgccggtttgtctggtggcgagtctttgttagtaaaacagatcgaggaacagatcaaacgcaacgctgcaggtaaagatggcaaggagcgcctcgggggatcagtcctgggtcagatcccttttctccaaaattgtgaggacgaagactccgacgaggacgacgaacttgatagtgtccagcacaagaagcagcgggtgaagctaccctctaaggccttagttccggagatggaggatgaggacgaagaggatgactccgaggacgccatcaacgagttcgactttctgggcagcggtgaggatggagagggggccccggatccgaggagatgtaccgttgacggttctcctcatgagctggaaagcagacgggtgaaattacagggaattctggccgacctgcgggatgtggatggactgccaccgaaggttacaggacctccaccaggcacccctcagcccaggccccatgaagggagcttcggcttctcttcagatgtgttcattatggatactattggcggaggcgaggtgtcccttggtgaccttgctgatctaactgtgactaacgataacgacctgtcctgcgatctgtctgacagtaaagacgccttcaagaaaacttggaatcccaagtttactctgcggtcgcattatgacgggattcgctctctggcatttcatcactctcagtcggcccttctgaccgcgagtgaggatggcacactcaaactgtggaatctccagaaggctgtgacagctaaaaaaaacgcagccctcgatgtggagccaatccacgctttcagggcccaccgaggacctgtcctggcagtggccatgggttctaattctgaatactgctactctggcggggccgacgcttgtattcactcttggaagataccagacctgagcatggatccgtacgacggatacgaccccagcgtcctgagtcatgtgttggagggtcacggcgatgcagtgtggggtctggctttctcacctacctcgcagaggctggcctcctgctccgccgacggaaccgtgagaatctgggacccatcttcttcttcaccagcctgcttgtgtacgttccctactgccagtgagcacggcgtacctacttccgttgcgtttacttccaccgaacctgcacatatcgtcgccagtttccggtcgggtgacacggtgctgtacgatatggaagtgggatccgcgctgctcaccttggagtcacgggggagttcaggccccactcagattaatcaggtcgtgtcccaccccaatcagcctttgacaatcaccgcacacgacgatcgcggcatcagattcctggacaacagaactggcaagcccgtgcatagcatggtggcacacctcgacgccgtgacctgcttagcagtagatccaaatggggcctttcttatgtccggcagccatgactgcagccttcgtttatggagtctcgacaacaaaacatgcgtccaggagatcactgcacaccgcaaaaagcacgaagaggccatccacgctgttgcatgtcatccgtctaaagcactcatcgcatccgccggcgccgatgcactcgccaaagtattcgtgtag

SEQ ID NO: 24831 - DNA, 327 bp, Artificial Sequence
  Description of Artificial Sequence: Synthetic coding sequence
atgacccccgaggagctgcagaagcgggaggaggaggagttcaacacggggcctctgtccgtgttgacacagtctgtgaagaacaatacacaggtgttgatcaattgccgcaataataagaaactgctcggacgcgtgaaggctttcgatcgtcattgtaatatggttctggaaaacgtgaaggagatgtggaccgaagtgccgaagtcagggaagggaaagaagaaatccaagccggtgaataaagaccgatacatctccaagatgttcctgagaggggatagcgtgattgtggtccttcgcaatcccctgattgcagggaaatag

SEQ ID NO: 24832 - DNA, 1275 bp, Artificial Sequence
  Description of Artificial Sequence: Synthetic coding sequence
atggtgcagaccctgtactacagcgccgaccacaagctgctggacggcaaccttctggatggtcaagctgaagttttcgggagcgacgatgatcatattcaatttgtgcagaagaagcccccgcgcgaaaatggtcacaagcagatttcttcaagcagcacagggtgcttgtcatcgcccaacgctactgtacagagtcccaagcacgaatggaagatagttgcctcagaaaaaactagtaacaacacctacctctgcctggcggtgcttgatgggatcttttgtgtgatattcttgcacggacggaactctccccaaagctccccgaccagtaccccaaagctgtccaagtctttgtcctttgagatgcaacaggacgaattgattgagaagcccatgtcacctatgcaatatgctcggagtggattaggaaccgccgagatgaatggaaagctaatcgccgctggcggctataacagggaagagtgtctgaggactgtggaatgttataacccccatacagaccattggagctttttggctccaatgagaaccccaagagctcgcttccagatggccgtgctgatgggccagctttatgtggtgggcggcagtaacggccactcggacgacctaagctgtggcgagatgtacgactcgaacatagacgactggatacctgtcccagaattgcgcactaataggtgtaatgccggtgtgtgtgccctaaacgggaagttatatatcgtcggaggctcggatccttacgggcaaaagggcctcaagaactgtgacgtgttcgacccagtaacgaagctgtggacatcctgtgctcctttaaatatccgtcgccatcagagcgccgtttgtgagctgggaggctatctttatatcataggtggggccgaatcttggaactgcctgaacaccgtagagcgatataatcctgagaacaatacctggaccttaatcgccccaatgaatgtggccaggcggggcgcaggggtggcggtgctcaatggaaagctatttgtgtgtggtgggtttgacggttcgcatgctatcagctgcgtggagatgtacgaccctacgcgcaatgaatggaaaatgatgggcaatatgacgtcaccaagatcaaacgccggcatcgcgaccgtgggaaacactatctatgctgttggcggctttgacgggaacgaattcctcaacacagtggaagtctacaatctggagtctaatgagtggtctccctacacaaaaatattccaattctag

SEQ ID NO: 24833 - DNA, 483 bp, Artificial Sequence
  Description of Artificial Sequence: Synthetic coding sequence
atgaacaacgcccggtacctgtggaagcggatcccccccgccatcaagagtgcaaattccgagctcggtggcatttggagcgtcggccagcgcatttggcagcgggatttccctggcatctacacaactattaatgcacatcaatggtccgagaccgtgcaacctattatggaggctctgagagacgcaactcgcagacgggctttcgctctagtctcacaggcgtacacttcaattatcgccgacgacttcgccgcctttgtagggttacccgtggaggaagcggttaaaggaatcctcgagcaggggtggcaagcggacagcactacgcgtatggtgttgccacgcaaaccagtggccggagcactggatgtctcctttaacaaatttattccacttagtgaaccagcacccgtgccgcccatccccaatgaacagcaattagcgaggctcaccgattacgtggcttttctggaaaattag

SEQ ID NO: 24834 - DNA, 927 bp, Artificial Sequence
  Description of Artificial Sequence: Synthetic coding sequence
atgatggaggagatcagcatcatggtggcctacgacgcccacgtgttctcccaattgcacgacgaagatttcttgacctcactggtggcgatctccaagccgcgcagcatggtccctacgaagaaacttaagaaatatgaaaaggagtatcagacaatgcgagaatctcagttgcaacaggaggatcccatggatagatataagagagagaacagacgcctgcaagaagctagcatgcgcctggaacaggagaacgacgacttagcccacgaacttgtgacttctaaaatagctctaagaaatgaccttgaccaggcagaggacaaagctgatgttctgaacaaagagctgctcctcaccaagcagcgcctagtggagaccgaggaggagaagaggaagcaggaagaagagaccgcccaactcaaagaggtgtttcgcaaacaattggagaaagctgagtatgagattaagaaaactactgccataatcgcagagtataaacaaatatgttcacagctgtccacgcgtttggaaaaacagcaagcagcctctaaagaggagctcgaggtggtgaaaggcaagatgatggcctgcaagcactgcagcgatatcttctcgaaagaaggcgcactcaagcttgcagcgactggtcgggaggaccagggaatcgagacagatgacgagaaagacagcctcaaaaagcagctgcgcgagatggagctggagctggctcagacaaagttgcagttggtggaagcgaagtgcaagatccaggaactggagcatcaaaggggcgccctgatgaatgaaatacaggccgccaagaattcctggttctccaaaacactgaatagcatcaagacggctacgggtacccaacccctgcagccagctcccgtgactcagccaccaaaggagtctacgtag

SEQ ID NO: 24835 - DNA, 3600 bp, Artificial Sequence
  Description of Artificial Sequence: Synthetic coding sequence
atggccagcgccggcacccagcactacagcatcggcctgcggcagaaaaattccttcaaacagtccggcccctccgggaccgtacccgccaccccccctgaaaagccttcggaaggcagagtgtggccccaagctcaccagcaggtaaaacccatttggaagctggagaaaaaacaggtcgagaccctgagtgctgggctgggacccggtttgctcggtgtccctcctcagcccgcctacttcttttgcccaagtaccctgtgctccagcggcaccacagccgtcattgctgggcactcgagctcttgctatttacactcccttcccgatttgttcaattctaccctcctctatagacggtcctcctatcgacagaaaccatatcagcagctggagagtttttgtttgcgaagctcaccatccgagaaaagtcccttttctctcccccagaaaagcctacccgtctctcttactgctaacaaagccacatcctctatggtgttctcaatggctcagccaatggcctcctcttctactgaaccatacctgtgtctggctgccgccggagagaacccatcaggcaagtccctcgcctcggctataagcggcaagattcccagcccgctctcttctagctataagcctatgctcaataataattccttcatgtggcccaatagtacccctgtgcctctgctacagaccacccagggtctcaagcctgtctcccctcctaagattcagcccgtctcctggcaccactccggtgggactggcgactgtgctccgcagccagtggaccataaggttcctaagtctattggtacagttccagctgacgctagtgcacatatcgccctatccaccgcgagtagccatgacaccagcaccacttctgtggcaagttcctggtataaccgcaataacttagccatgcgggctgagcctctgtcttgcgccctggacgattcttccgactcacaagacccgacgaaagagattcgatttaccgaagctgtcaggaaactgactgcgagagggttcgagaagatgcctcgccaaggttgccagcttgaacaaagctccttcctcaaccccagttttcagtggaacgtgttaaataggtcacgccgctggaagccaccggccgtgaaccagcagtttcctcaggaggacgccggctccgtgcgcagggtgctgcccggagcgagtgatacgctcgggttagataataccgttttctgtactaagcggatctccatccatctgctcgccagccatgcctcaggccttaaccacaatccggcctgtgagagtgtaatagactcatctgcgttcggcgaggggaaggcacccgggcctcctttccctcagactttgggtattgccaatgtggcaacccgcctgtcttcgatacagctgggccagtccgaaaaagaacgcccagaagaggccagggaactggattcctcagaccgggatatctcatcagcgactgatttacaaccggatcaggcggagaccgaagacaccgaggaggagctagtcgacggactcgaggattgttgctctcgcgatgagaatgaggaagaggaaggcgattcagaatgcagctctctttcagccgtttcaccttccgaaagtgttgccatgatcagtcggtcgtgcatggaaattctgactaagccactgagtaaccatgagaaggtggtcagacctgctcttatctacagtctgtttcccaatgtcccgcccaccatttacttcggcactcgcgatgagagggtggagaaacttccgtgggaacaacgcaagctgctgaggtggaagatgtccacggttacgccaaacatcgtaaaacagacaatcgggaggtcccatttcaagattagtaaaagaaacgatgattggttaggatgttggggccatcacatgaagtcgccttcattccggtcaattcgcgaacatcagaaattgaatcattttccaggaagctttcagattggacgcaaggaccggctctggcgcaatctgagcagaatgcagtcgcggtttggaaaaaaagaattcagtttctttccccaatcctttattctcccgcaggatgccaagctgctaaggaaggcttgggagtcctcgagcaggcagaagtggatagtgaaacccccggcgagtgcacggggaataggcatccaggtgatccataaatggtctcagctccctaaacgtcggcctctgctagtgcaaaggtatttgcacaagccgtatctgatcagtgggtctaagttcgacctgagaatctacgtttacgtgacaagttatgatcccctgaggatttatctcttctccgatgggctggtgagatttgctagttgcaaatacagtccttccatgaaatccctgggcaataagttcatgcacttaacaaactattccgtaaacaagaagaatgccgaatatcaggccaacgctgacgagatggcttgccagggacacaagtgggcccttaaagctctttggaactaccttagccagaaaggcgtgaacagtgacgccatttgggaaaaaattaaggatgtggtggtgaaaactatcatctccagcgagccctacgtgacttctttattaaaaatgtatgtccgccgtccttatagttgccacgagctgtttggcttcgatataatgctggatgagaatctgaaaccatgggttctggaggtgaatattagtccatccctgcatagttctagtccactggatatttcaatcaagggacagatgattagagatctgttaaacctcgcaggctttgtccttccgaatgcagaggacattattagtagcccatcttcctgtagctcatcaacaacatccttgcccacctcccctggggataaatgtcgcatggctcccgaacacgtcactgcacagaagatgaagaaagcctactacctgactcaaaagattccagatcaggacttctatgcctctgtgctggacgtgctcaccccagacgatgtccgcatcttagtggaaatggaggatgagttctcccggaggggccaattcgagagaatcttcccctcccacatctcttctcggtacctgcgattcttcgagcagccccgttactttaacatcctgacgacacagtgggaacaaaagtaccacggcaacaaactcaagggagtggatctcctaagatcttggtgttacaaggggtttcacatgggagtggtgagcgatagtgcacccgtctggagtcttccaacatctctcctcaccatctccaaggatgatgtcatcctgaacgcatttagcaaaagtgaaacctcgaagctgggcaaacagtcttcttgcgaggtcagcttgctgctttccgaggacggaacaacacctaagagtaagaagacccaagccggattatctccctatccacagaagccatcatcttccaaagacagcgaagacacctcaaaggagcccagcctgagtacccagaccctcccggttattaagtgtagtggccagaccagcaggctttccgctagcagtacttttcagagcatctcagattccctgctggccgtttcgccatag

SEQ ID NO: 24836 - DNA, 2337 bp, Artificial Sequence
  Description of Artificial Sequence: Synthetic coding sequence
cggatccaggagcagctggagagcagcttcaccggcctgaccgacgaaaaagtaaaggcctatctgtccctgcatccacaggtactggacgagttcgtgagtgaatccgtaagcgctgaaacagtcgagaagtggttgaagcggaaaaacaataaaagcgaggacgaaagtgcccccaaggaagtgtccaggtatcaggacacaaatatgcagggcgtggtgtatgagctgaactcatatatagagcagaggctcgatacagggggagacaatcagctgttgctttacgaactgtctagcattattaagatcgcgaccaaggctgatgggttcgccctgtacttcttgggggagtgcaataattccctgtgtatcttcacccccccaggtatcaaggagggaaagcccaggctgattcctgccggaccaatcacgcagggcacaactgtctcagcctatgtcgctaagagtaggaagactttattggtcgaagacattttaggcgatgagagatttccccgtggcaccgggctcgaatctggaacgagaatccagagcgtgctgtgcctccctattgttaccgctatcggcgatctgattggaatcctggagctgtaccggcactggggcaaagaggctttttgcttgagccatcaagaggtggctaccgcgaacctcgcgtgggcctctgtcgctatccatcaggtccaagtctgtcgcggactcgctaagcagacagaactcaacgacttcctgctcgatgtttctaagacctattttgacaatatcgttgccatagacagtttgctcgagcacattatgatttacgctaagaatttggtcaatgccgataggtgtgccctcttccaggtggaccataaaaacaaagaactgtattccgatctgtttgatattggcgaagaaaaagaaggcaagccagtgtttaaaaagacaaaggagatccggttttcgattgaaaaagggattgccggacaggtggcaagaactggagaagtgttaaatattcctgacgcctatgcagacccgcgattcaaccgtgaggtcgatttgtataccggttatacgacacgtaacattttgtgcatgccaatcgttagcagaggaagtgttattggagtggtacagatggtgaataagatctcagggagtgcattttcaaaaacagacgaaaataacttcaaaatgtttgcggtgttttgcgctcttgctcttcactgcgctaatatgtaccatcggatccggcatagcgagtgtatttaccgcgtgacgatggagaaactgtcataccactcaatttgcacatctgaggaatggcaggggctgatgcagtttactctgcccgtgcgactgtgcaaggagattgagctttttcattttgatattggcccctttgagaacatgtggcctggtatttttgtatacatggttcacagatcatgtggtacctcctgctttgaactggagaaactttgcagatttataatgtctgtgaaaaaaaattatagacgtgtaccctatcataattggaagcacgcagtcactgtcgcccattgcatgtacgccatactgcagaacaaccacactctgttcaccgatttggaaaggaaagggcttctcatcgcctgcctatgtcacgacctggaccatagggggttcagcaattcttacctgcaaaagttcgaccaccccttagctgctttgtactcgacatcgacgatggagcagcatcatttcagtcagactgtatctatccttcagctggaggggcacaacatttttagtacactcagcagcagcgagtatgagcaggtgctcgagatcatacgtaaggcgattattgccacagatctggccttgtattttgggaaccgtaaacagctagaagaaatgtatcaaacggggagtctgaacttgaacaatcagagccaccgggacagggtgattgggctcatgatgactgcttgtgatctctgtagtgttacaaagctgtggcctgtgactaagcttaccgcaaatgatatctatgctgagttctgggccgaaggtgatgaaatgaagaagctgggaattcagccgatccccatgatggatcgagacaaaaaggatgaagtcccgcagggccagcttgggttctacaatgctgtcgcaataccgtgctacacaacactgacacagattctaccacccaccgagccattgctaaaggcttgccgggacaacctgtcacagtgggagaaagtgatccgaggagaggagacggccacctggatcagctccccgagcgtggctcagaaagccgctgccagtgaggattag

SEQ ID NO: 24837 - DNA, 1281 bp, Artificial Sequence
  Description of Artificial Sequence: Synthetic coding sequence
atgtggcccctgaccgccctgctgctgctggtgcccagcagcggccaggcggccactttggagaagccaattctaagcctacaccccccatggaccaccatctttaagggggagcgagtgaccctgaagtgtgacggctaccatcctcttttgttggagttacagcccatctccacactgtggtatttgggccatcttttattgccgtctcataagaagtcaatcgaggtgcaaacacctggcgtttacagatgccagacccgtggcgccccagtgtccgacccgatccatcttagtgtgtcaaacgattggctcatcctgcaggtcccctatgctcccgtattcgagggcgagcctctcgtgcttcggtgtagagggtggtacgataaagtggtctacaagctgcactattaccatgacgggcaggctgtgcggtacttccattcgagtgctaattacaccgttctacaggctcgtgcatctgattccggcagataccagtgtagtgggactatgcggatacccgtcgagtcagcccccatgttctccgctaaagtggctgtcaccgttcaggagctgtttagggccccagttctcagggtcatgggacctcgggaggcccgcggtgccgcattgggtggggtcgtgctcaggtgcgatacccggctccatccgcagaagcgggacaccccacttcaatttgccttctacaagtacagcagagccgtacgtcggttcgactggggcgccgagtacaccgtgccagaaccagaggtggaggagttagaatcatactggtgcgaggcggccaccgcaacacgaagtgtgagaaagagatctccatggctgcaattgcccggacccggaagccctctggaccctgcctccaccaccgcccccgccccatgggctgctgcgctggccccggggaaccgccctctgtcatttaggaagcctcctgtctcccggtctgtgccactggtgacctccgtaagaaataccacaagcaccggcttacaattcccggcaagcggtgcgccaacagcaggcccgcctgcgtgcgcgcccccaaccccacttgagcagtcggcaggtgctctgaagcctgacgtggacctgctgctccgagagatgcagctgctgaaagggctgctctcaagggttgtactggagctcaaagagccccaggcgttgagggaattaagaggcactccagagacaccaaccagccatttcgccgtcagcccaggaacacctgagacaacaccagttgagagctag

SEQ ID NO: 24838 - DNA, 1779 bp, Artificial Sequence
  Description of Artificial Sequence: Synthetic coding sequence
atggacgtgatgctggagaactactgccacctgatcagcgtgggctgccatatgaccaaaccggacgtaatcctgaagttagaacgcggagaggaaccctggaccagcttcgcggggcacacctgtctcgaggaaaactggaaggccgaggacttcctcgtgaagttcaaagaacaccaggagaaatactcgaggtctgtcgtttccataaatcataagaagctggttaaggaaaaaagcaaaatctatgagaaaacttttaccctgggcaaaaatcccgtgaattctaaaaaccttcctccagaatacgatacacacgggcggatcttgaagaacgtaagtgagctgatcatctccaacttaaatcctgcccgcaaaagactttcagagtacaacggatatggcaagtccttgctatcaactaaacaagaaacaacacacccagaagtgaagagccacaatcagtccgctcgcgccttcagtcataatgaggtgctgatgcagtatcagaagacagagacgccggcgcaatcctttgggtacaacgactgcgagaagagctttcttcagagaggcggtctgatcactcacagccggccttataaaggagagaatccgagcgtgtacaataagaagaggcgagcaactaatatcgagaaaaagcacacctgcaacgagtgcgggaagtctttttgtcggaaatctgttttgattctccatcagggcattcatagtgaagaaaagccatatcagtgccatcagtgcggaaacgccttcaggcggaagtcttaccttatcgaccatcaacggacgcacactggtgagaagcctttcgtgtgcaatgagtgcgggaaaagctttcgcctgaagaccgcgctgactgatcatcagcgcacccacacaggagaaaagtcctatgagtgtttacagtgccgcaatgcattcagactgaagtcccacctcattcggcaccagaggactcataccggagagaaaccctacgaatgtaatgattgcggtaagagcttccgacagaagactacactgtccttacatcaaagaattcacaccggcgagaaaccgtacatctgcaaggaatgcgggaagtcattccaccagaaggcgaacctcaccgtgcatcagcggacacacactggtgagaagccttacatctgcaacgaatgcggcaagtctttttcccagaaaaccaccctcgctctgcacgaaaagactcacaatgaagagaagccatacatttgctcagaatgtggcaagagttttagacagaaaaccacccttgtggcacaccaacgtactcacacaggagagaaaagctacgaatgccctcactgcggtaaagcgtttcgcatgaagagctacctcattgaccaccatcggacacacaccggtgagaagccctacgagtgcaatgaatgtggcaaatccttcagccagaaaactaacttgaacttgcatcagcggattcatacaggcgaaaagccttacgtgtgcaatgagtgcggaaagagctttaggcagaaggctacactcactgtgcaccaaaaaatccacactggccagaagtcttatgaatgcccccagtgcgggaaagctttctcccggaagagctatctgatccatcatcaacgtacacatactggcgagaaaccatacaagtgctccgagtgcggaaagtgcttccgtcagaagaccaacttgattgtgcatcaacgtacgcacacaggaggcgaggatggcttgaccggctgcctgtcatag

SEQ ID NO: 24839 - DNA, 645 bp, Artificial Sequence
  Description of Artificial Sequence: Synthetic coding sequence
atggaggtgaccggcgtgagcgcccccaccgtgaccgtgttcatcagttctagcctaaacacatttaggtcagaaaaaaggtactctcggagcctgacgattgctgaatttaagtgtaagctggagctcctggtcggtagtcccgcatcttgtatggagctagagttatacggcgtggacgataagttctattctaaattggatcaggaggacgctcttctgggctcttatccagtggacgatggctgccgcattcacgtcattgaccattccggcgcacggttaggagagtatgaggacgtaagtcgagtcgaaaagtacacaatcagccaagaggcttatgaccagcgacaggacactgtcaggtccttcctcaaacgctccaagctcggcagatacaatgaagaagagcgagcccagcaggaggcagaagctgcccagaggctcgcagaagagaaggcccaggcctccagcatccctgtgggcagtcgttgcgaggtgagggccgccggacagagccctcgtcggggcactgtgatgtatgtcggcgcttggcttgcgggtcccgtgccaggctctcgcgccccacgtcctggtggcaacgtgggtggaacggtggagcctagacgccccagatcggcctag

SEQ ID NO: 24840 - DNA, 189 bp, Artificial Sequence
  Description of Artificial Sequence: Synthetic coding sequence
atgagcatccagtggaagacccggcagctgcagagcaagctgcacgaggccgatatcgtggttctcggcagtcctaagccagaagagatcccgcttacatggattcagcccggtaccactgtcctgaattgttcacacgacttcctgtctgaaagcctcattatcatccgacgcatggctatcttctag

SEQ ID NO: 24841 - DNA, 1269 bp, Artificial Sequence
  Description of Artificial Sequence: Synthetic coding sequence
atgtaccccaaccccctgatctactgcacctgctgggacccctggaatctggggccaagaaagcttattaaaacaccgcaattgcctcgaaaaaattccactggctcttccaagctcacacccctggtgccagcacccaagaaccacaattaccttcagcctaccaaaccagtggtcagtcctaagatgaaaatccatagtgcaaggcaggaggagaccaataagagcttttatgaagtaatcaatgtaagccctggataccagctagttcgaaaccgcgagcagatatctgtgactttaggtgatgaaatgttcgatcggaagaagaggtgggaatctgaaattcctgacaaaggtaggttctcaagaaccaacatcatctctgacctggaagaacaaatctctgagctcacggctattattgagcaaatgaatagagaccaccaaagtgctcagaagcttctgtcgtctgagatggacctccgctgtgcagagatgaaacagaactttgaaaataagaaccgtgagcttaaggaagcacacgaagcagagctgtcagaactcgaaaacaattacaaagccgctctcaaagccgaaaagttggccgctcaggaaaagctggaggaaatgggtaaggagtataaatacctgaaaaacatgtttcggacataccaggatagcatctacgacgaaatggaagagaaatggtctaagcagaaagccaaatggaaaaaggatgagaaattcgagagggagaatatcctgctacagcagaaaaagaagatgactaaaaagttcgagatggaatccggtgaggaggataagaagatcaacgaatcttgttcggcggtgttcgaaaattttatccaggaaaaggaggagttgctgaaacaacaccagtcagatactctgcagttagaagagcttcgaaagactaaggaggttatgcaggaagaattgcatgcccaagctttaatcctggaaagcctcaacaccaatttgtactatacacagctagagttgcagaaagagaaggccattgtgggcaacttagagaaaatgctgcagacgaaatttgccgagactgaggaaaagtacaaacataccatacagattttgactgaggaaaacattcatctgaaacaaaagataattagcaaaaatgaggaaatttgtgagggatgttccggcaggctggcctcaattacagtttccaaagacgactctgataccgttcaggacggttcaaaaaagggccaggagagctag

SEQ ID NO: 24842 - DNA, 1380 bp, Artificial Sequence
  Description of Artificial Sequence: Synthetic coding sequence
atggtgcccttcggccccttcgccttcatgcccggcaagctggtgcacacaaatgaggtcacagtcctgcttggcgataattggttcgcaaagtgttcggcaaagcaagccgtcggcctggtggagcaccggaaagagcacgtgaggaaaacaatagatgacttaaaaaaggtgatgaaaaattttgagagccgggtcgagtttacagaagatctgcaaaagatgtctgatgcagctggcgatattgttgatattagggaggaaataaagtgtgacttcgagttcaaggccaagcaccggattgcccataagccccattcaaagccaaagacttcagatattttcgaggctgatattgccaatgatgtcaagagcaaagatctgctcgctgacaaagaattgtgggcgaggctggaagaacttgaaaggcaggaagagttgctcggagaactggactcaaaacctgataccgttattgccaatggcgaggataccacaagctcagaagaggagaaagaggatagaaacaccaatgtcaatgccatgcatcaggtgaccgattcacacacaccctgtcataaggatgtcgcatcttctgagccattttcggggcaggttaactcacagctgaattgcagtgtcaacggatcttccagctatcattccgacgacgacgacgacgacgacgatgatgacgacgatgataatattgacgacgacgatggcgataacgatcatgaggcgctgggcgtcggcgataattctattcccaccatctatttctcccatacagtcgagccaaaaagggtccgaatcaacactggtaaaaacaccactctgaaattttcagaaaaaaaagaggaggcaaagcgcaagcggaaaaatagtactggctcaggtcattccgctcaggagttgcctaccatcagaactccagccgacatctacagggcctttgttgacgttgtgaatggagagtacgtgcctaggaaaagcatcctgaagagtaggagcagggaaaattccgtatgctccgatacatcggagagtagtgcagccgaatttgacgacagaagaggggtgctgaggagtatttcctgcgaagaggcgacctgcagcgatacatcagagagcatcctggaggaagagccccaggagaaccagaagaagcttttgccactctccgtcactccagaagcatttagcgggactgtgatcgagaaggagttcgtgtctccgagtcttacacctccccctgccatcgcacaccctgcattgccaacaattccggagagaaaggaggttctccttgaggcgagcgaggaaactgggaaacgcgtcagcaaattcaaggctgcgagactccagcagaaagattag

SEQ ID NO: 24843 - DNA, 1068 bp, Artificial Sequence
  Description of Artificial Sequence: Synthetic coding sequence
atgcgggagatcgtgcacatccaggccggccagtgcggcaaccagattggggccaagttctgggaggtcataagtgatgaacacggaatcgatccgactgggtcttaccacggggattccgatctccagctgctgactcattccctgggaggaggcaccggcagcggaatgggtaccctgttaatctccaaaatccgggaggagtacccggaccggatcatgaatacgttctctgtgatgcctagtccaaaggtttcagatacggttgtggaaccttataacgccacactgtctgtccaccagctcgtggagaacacggacgaaacttactctatagacaatgaagccctatatgatatttgctttcggactctgaaacttaccacacccacatatggcgatctcaaccaccttgtttccgcgaccatgtctggagtgacaacttgtctgaggttccctggacagctgaatgccgatctcaggaagttggccgtgaacatggtcccttttccccgcctgcacttctttatgccaggattcgcgcctctgacttctcggggctcccagcagtatcgcgcactcaccgtgccagaactgacccagcagatgttcgatagtaagaacatgatggccgcctgtgatccgaggcatggtcgttatctgacagttgctgccatttttcgagggcgaatgtccatgaaagaagtggacgaacagatgcttaacgttcagaataaaaattcgagctattttgttgaatggattccgaacaacgtgaaaacagctgtgtgtgacatccctcccagaggtctcaaaatgagtgcaacctttatcggcaacagcactgccatacaggagctcttcaagcgtatctccgagcagtttactgcgatgttcaggcgcaaggcatttctgcactggtacacaggcgagggcatggatgaaatggaatttacggaagctgaatccaacatgaatgatttagtgtctgagtatcagcagtaccaggatgccaccgccgatgagcaaggtgagttcgaagaagaggaaggtgaggacgaagcctag

SEQ ID NO: 24844 - DNA, 255 bp, Artificial Sequence
  Description of Artificial Sequence: Synthetic coding sequence
atgaaggtgaagatcaagtgctggaacggcgtggccacctggctgtgggtggccaacgatgagaattgtggcatttgtcgaatggcgttcaatggctgctgtcctgactgcaaggtgccgggagatgattgccctctggtttggggacaatgcagtcattgcttccatatgcactgcattctcaagtggctccatgcacagcaggtccagcagcactgtccaatgtgcaggcaggagtggaaattcaaagaatag

SEQ ID NO: 24845 - DNA, 1416 bp, Artificial Sequence
  Description of Artificial Sequence: Synthetic coding sequence
atgaagatgcaggtgttctgcaagagcatcgaggacatgaccgtgaaagctgagcagtcgcagcaagaagccgccaaaaagcacgaggaggaaaaaaaagagctcgagcgcaaattatcagacctggagaagaagatggaaacctctcacaaccagtgtcaagagctgaaggctagatacgaaagggccacgtccgagactaagaccaaacacgaggagatcttacagaacttgcaaaagaccttactggacaccgaggacaaactgaaaggtgcacgcgaagaaaactcaggcctgttgcaggaactcgaagagctgcgcaaacaagccgacaaagcaaaggcagcccagactgcagaggacgcgatgcagattatggagcagatgacaaaggagaaaaccgaaaccctggcctccttagaggataccaagcagacgaacgcaaagctgcagaacgagcttgacactttaaaggagaacaacctgaagaacgtggaggagctgaacaaatctaaagagctgctaaccgttgaaaaccagaagatggaagaattcaggaaggagattgagaccctgaagcaggcagcagcccagaaatcccagcagctgtccgccctccaggaagaaaatgtcaaactggccgaagagctgggccggtcccgggacgaagtgacctcacaccaaaagctcgaggaggagcgttctgtactgaacaaccagctgcttgaaatgaaaaaacgggaaagtaagtttatcaaagacgcagacgaggagaaggctagcctacagaagagtattagcattacaagtgctctgctgacggaaaaggatgcggagttagagaagctgcggaatgaagtgaccgtgcttcgcggagagaacgcctcagccaaatcattacatagcgtcgtccagacgctggaatcggacaaggtcaaacttgagttgaaggttaaaaatctggaactccagttaaaggagaacaaacgccagctgagctcttcgtccgggaacaccgacacgcaagccgacgaggacgagcgcgcacaagagtcccaggttatgatcgattttctaaactcagtgattgtagatctccagagaaaaaaccaggatcttaaaatgaaagtggagatgatgagcgaagctgcccttaacggaaatggcgatgatctgaacaattatgattccgatgatcaggagaagcagtccaaaaagaaaccgcgcctattctgtgacatctgcgattgcttcgatctacacgacacggaggattgtcctacacaggcccaaatgagcgaggaccccccacattctactcatcacggatcgcgaggtgaagagcggccatattgcgagatctgtgaaatgttcgggcactgggcgactaactgtaacgacgacgagactttctag

SEQ ID NO: 24846 - DNA, 1602 bp, Artificial Sequence
  Description of Artificial Sequence: Synthetic coding sequence
atgagcagctgcgtgagcagccagcccagcagcaaccgggccgccccacaggatgagctgggaggacgcgggagttccagtagtgagtctcagaagccttgtgaggcgttaagaggcctcagtagcctgtccattcatttggggatggagagcttcatcgtggtcactgaatgcgaacccggctgcgctgttgacttggggctggcacgcgatcgtccgctggaggcggacggccaagaggtcccactcgataccagcggcagccaggccagaccccatctctccggcaggaagctctctctgcaagagcggtcgcagggcggcctggccgccggaggttcactggacatgaatggtaggtgtatctgccccagcttgccctattccccagtgtcgtccccacagagcagcccacggctgccgcggaggcctacagtggagtcgcaccatgtctctattacaggaatgcaggactgcgttcagttaaatcagtacacactgaaggatgaaattgggaagggatcgtatggcgtcgtgaaactggcctataacgagaacgacaatacatactatgccatgaaagtgctctctaaaaagaaactaattcgccaggccggctttccgaggagaccgccaccaagggggacccgtcctgcccctggcggctgtattcaaccgcggggccccatcgagcaggtgtaccaggaaatcgctattctcaagaagcttgaccatcccaacgtcgtgaaactcgtcgaggtactagatgatccaaacgaagatcatctttacatggttttcgaactcgtgaatcagggtcccgtcatggaggtgcctacactgaagccactttctgaagaccaggcccgattctactttcaagatttgattaaggggattgagtacctgcattatcagaagatcattcatcgagacatcaaaccctccaatctacttgtgggagaagatgggcacattaaaatagccgattttggtgtgagtaacgaatttaaagggtctgacgctttgctgtctaatacagttggcactcccgcatttatggcccctgaatctctgagcgagactcgcaaaatattttctgggaaggccctggatgtgtgggccatgggggttacgctctattgtttcgtctttgggcagtgcccatttatggatgaacggatcatgtgcctacattcaaagattaagagccaagctcttgagtttcccgaccagcccgacatcgccgaggacctgaaagacctgattacgagaatgctggacaagaaccccgaatcacgtatagtagttcctgagatcaagctgcacccatgggtgaccagacatggagccgaaccactgccgagcgaagatgaaaactgtacgctagtggaagtcaccgaagaagaggtggagaactccgttaaacatatcccctccttggccactgtaatccttgtgaagactatgattcggaagcggagcttcggaaatcccttcgaggggagccgaagagaggagagaagcctctctgccccaggtaatcttctgaccaagaaacccacccgtgagtgcgagagcttatccgagttaaagacatag

SEQ ID NO: 24847 - DNA, 1671 bp, Artificial Sequence
  Description of Artificial Sequence: Synthetic coding sequence
atgagcagctgcgtgagcagccagcccagcagcaaccgggccgcccctcaagatgagctgggtgggcggggatcctcctcgagtgagagccagaaaccttgtgaggccctgaggggactgtcctccttgtctatacatttgggcatggagtcctttatagtggtgactgagtgcgaacccggatgcgccgtggatctgggcttagctagagataggccactcgaagccgatggccaggaggtgcccctcgataccagtggctctcaagcacggccccacctgtctggacggaaattgtcattacaggagcggtcccagggtggattggccgccggtggctcgttggacatgaatggccgctgtatctgcccatcactcccgtatagcccagtatcttccccccagagctccccacggctgcctcgccgaccaacagtggagtcccaccacgtgagcatcaccgggatgcaagactgcgttcagctcaatcaatacaccctgaaagatgaaatcggcaaagggtcttatggggtggtaaagctggcctacaacgagaacgataatacctattatgctatgaaggtgctgagtaagaagaaactgattaggcaggctggatttccccgcaggcccccaccgagggggactcgcccagcaccaggggggtgtatccagcccaggggtccaattgagcaggtgtatcaggagatcgcaatccttaaaaagctggatcatccaaatgtagttaaactggtagaggttctggatgatcctaacgaggatcacctgtatatggtcttcgagctggtgaatcagggccccgttatggaggttcctaccctgaagcccttatccgaagatcaggcccgcttctactttcaggacctgataaaaggtattgaatatctacactaccaaaaaattattcaccgcgacattaagcccagcaatcttctggtcggtgaggacggccacattaagatcgcagattttggtgtgtctaatgagttcaaaggttcagacgctctgttgtccaacacagtgggaacgccagcattcatggctccagaatcgctctccgagacccgcaaaatcttttccgggaaggccttggacgtgtgggccatgggtgtgactctctactgcttcgtattcgggcaatgccccttcatggatgaacgcatcatgtgcctccactccaaaattaaatctcaagcgctcgagttcccagatcagccggacatagctgaagatcttaaggacctaattacccgcatgttggataagaacccggaatcccgtatagtcgtaccggaaataaaactgcacccctgggttactcggcacggcgcagagccccttcccagcgaagatgaaaattgcacactggtcgaagttaccgaagaggaggttgagaattcagtgaagcacatcccctcgctagcaacagtgattctggtgaaaacgatgattcggaagagaagtttcggcaacccattcgagggcagtcggcgcgaggagaggtccctgagtgctcctgggaatctgttaacaaaaaagcccacacgggagtgtgaatccttatctgagctgaaggggaccaaaaagaagaaaggcctcgactccatgacttccaccgtcgctgccggctggctagacaggagagtgtag

SEQ ID NO: 24848 - DNA, 309 bp, Artificial Sequence
  Description of Artificial Sequence: Synthetic coding sequence
atgctgagcgaggaggagaaggaggagctgaaggccgagctggtgcaactggaagatgaaatcaccaccctcagacaggtgctgtctgccaaggagcggcatctcgtggagattaagcagaagttaggcatgaacctcatgaacgagctcaaacaaaactttagcaaatcgtggcacgatatgcaaacaacaacagcttacaaaaaaacccatgagacattgtcacatgctgggcagaaagccaccgctgccttttctaacgtcgggacagccatttctaaaaagttcggggacatgcggcgcaagtag

SEQ ID NO: 24849 - DNA, 615 bp, Artificial Sequence
  Description of Artificial Sequence: Synthetic coding sequence
atggaggccgagcccaagggcctgctggagaccgagcccctgcaggggaccgatgaggatgcagtagcatcagctgactttagctcaatgctgtcagaggaggaaaaggaagaacttaaggccgagctggtgcagttagaagacgagatcaccactctgcgccaggtactgtctgcaaaagagagacacctcgtagagattaagcagaaactgggcatgaaccttatgaatgaattaaagcagaacttcagcaagtcttggcacgacatgcagaccactaccgcgtacaagaaaacccacgagactctgtcccatgccggccaaaaagccacagcggcgttctctaacgtgggcaccgccatctcaaagaagttcggcgatatgtcctattccattcgccattctatcagcatgcctgccatgcgaaattcccctacatttaagtccttcgaagaacgtgtggagacaaccgtcacctctctgaagactaaagttggagggaccaatccaaatggggggtcctttgaggaggttctgtcgagcactgcacatgcaagcgcacagtctctagccggcggctctagacggaccaaggaagaggagctgcaatgttag

SEQ ID NO: 24850 - DNA, 369 bp, Artificial Sequence
  Description of Artificial Sequence: Synthetic coding sequence
tgatacctggtggccctgggctgcatcaagcccctgtgcgacctgttgacggtcatggattccaagattgtacaagtggccttgaatgggctcgagaatatccttcgcttgggcgaacaggagagtaaacagaatggtatagggattaacccatactgtgcgctgattgaagaggcgtatggacttgacaagattgagtttctgcagtcacatgagaatcaggagatttaccagaaggctttcgatctcatcgaacattattttggagtcgaagaagacgatccttccattgtcccccaggtggacgagaatcagcaacagtttatcttccagcagcaagaggcaccgatggacggattccagctgtag

SEQ ID NO: 24851 - DNA, 1137 bp, Artificial Sequence
  Description of Artificial Sequence: Synthetic coding sequence
atggaggtgaagcccccccccggccggccccagcccgacagcggccggcgccgtcggcggagaggggaggaaggtcacgatccaaaggaacctgagcagttgagaaaactgttcataggtggcctctcgttcgaaacaacggacgactcgctgcgggagcactttgaaaaatgggggaccctcacagattgcgtggtgatgcgggatccccagacaaagcgcagcagaggcttcggattcgttacttatagctgtgtcgaggaagtggatgccgctatgtgcgcccgccctcacaaagtcgacggacgggtggtggagccaaagcgggcagtttcccgtgaagattccgtaaaacctggcgctcatcttactgtcaagaagatcttcgttggaggtatcaaggaggataccgaggagtacaacctgcgcgactacttcgagaagtacggaaaaatagaaaccatcgaggtcatggaggatcggcagagcggaaaaaagaggggcttcgctttcgtgactttcgacgatcatgacacagttgataagattgtcgtgcagaaatatcataccattaacggacataattgcgaggtcaagaaggccttgtcaaaacaggagatgcagtcagcaggctcccagagggggagaggaggaggatctgggaatttcatgggtagaggtggcaatttcggaggtggaggagggaattttgggaggggaggcaatttcgggggcagaggcggctatggtgggggaggggggggtagtagagggtcctacggagggggggacggggggtacaatggatttggcggagacggaggaaattacggcgggggccccgggtacagcagccgaggtggctatggcgggggaggacctggttatgggaatcaaggcggaggctatgggggaggcggtggatacgacgggtataacgaagggggtaattttgggggaggtaactatggtggtggaggcaattacaacgactttgggaactactcggggcagcaacagagcaattatggccccatgaaagggggcagcttcggaggcagaagcagtggatccccctacggcggggggtatgggtcaggcgggggatctggcggctacgggtcgagacggttctag

SEQ ID NO: 24852 - DNA, 3063 bp, Artificial Sequence
  Description of Artificial Sequence: Synthetic coding sequence
atgcggcggttcctgcggcccggccacgaccccgtgcgggagcggctgaaaagagatcttttccagtttaataaaaccgtcgagcatggtttcccgcaccaaccaagtgccttggggtactcgccttcgctgcgcatactcgccatcggaacgcgctccggggccatcaagctgtatggagccccaggtgtagagtttatggggctccaccaggaaaataatgccgtgactcaaattcatctcttgccggggcagtgtcagctggtaacgctcttggatgacaactccctccacttatggagtctgaaggtgaaaggtggcgctagcgagctgcaagaggacgagtcttttactctgcgtggaccaccgggcgctgcccccagtgctacacagatcacagtggttcttccccatagtagttgtgagctcctctatctggggactgagtcaggtaacgtgttcgtagtccaactgcccgcattccgcgccctcgaagaccgcaccatctcgagcgatgccgtcctgcagcgccttcctgaggaagcaagacaccgccgtgtcttcgagatggtggaggcattgcaggagcatcctagggatccaaatcagatcctaattggatattctagaggcctggtggtgatctgggaccttcagggctcccgtgtcctctatcacttcctgagttcccaacaactcgagaatatctggtggcagagagacgggcgcttgctcgtgagctgtcactcagatggctcttactgtcagtggcctgtatcttccgaggctcagcagcccgaaccactccgatctctcgtgccatacggacctttcccctgcaaagccataacgcgcattctctggctgaccacaaggcaaggccttcctttcaccattttccagggaggcatgcctagggcatcctatggggatcgacattgtatctcagtgatccacgatggtcagcagactgctttcgacttcacatcacgagtgatagggttcaccgtactgactgaagctgacccggccgccacttttgatgatccctacgccttagtagtcctggccgaggaagaactggtggtcattgatcttcagacagcaggctggccacccgtgcagctgccctacctggcctccctccactgctctgccattacctgtagccatcatgtttcaaatattccgctgaagctttgggaacggattatagcagctggttcccgtcagaatgcccattttagcactatggaatggcccatcgacggtggaacctctctgacacctgctccgcctcagcgtgacctactgctcaccggccatgaggacgggaccgtgcggttttgggacgcaagtggcgtttgccttcggctgctctataagctatccacagtgcgcgtgtttctgacagatactgaccctaacgaaaattttagtgcccagggcgaagatgagtggcctccgctgcggaaagtcggtagctttgatccgtattccgatgacccaaggcttggaattcagaaaatttttctttgcaaatacagcggctatctggctgttgccggtactgcgggacaggttctcgtcctggaattgaatgatgaagctgccgaacaggcagtagaacaggtagaggctgacctgctgcaagaccaggaagggtacaggtggaaagggcacgagaggctggccgccaggtccggcccggtgcgatttgaacctggatttcagccattcgtcctagtgcagtgtcagcccccagccgtagttacatcactcgccctgcactctgagtggcggctagtggcctttggcacatctcatggttttgggctgtttgatcatcagcaaagaagacaggtgttcgttaagtgcacattgcatcctagcgaccagcttgccttggagggacctctcagtcgtgtgaaaagcctgaagaagtccttacgccagtcgttcagacgaatgagaagaagtcgcgtttcaagtcggaagcgacatccagccgggcctcccggagaggcacaagaaggatcagccaaagccgaacgtccaggactgcagaacatggagctggcacccgttcagcgtaagattgaagcccgcagtgcggaagatagtttcacagggtttgtacgaactctgtattttgccgatacctacttaaaggattctagtagacattgtccaagcctgtgggcgggcacaaacggagggacgatatatgccttctccttgagggtaccccctgcggaaagaaggatggacgaacctgttagggccgaacaggccaaagagatccagttgatgcatagagcacccgtggtgggtatcctagtgctcgatggccactcagtgccactgcctgaacctttggaagtcgcccacgatcttagcaagtcgccagacatgcagggaagtcaccagttgctggttgtgagtgaggaacagttcaaggtgttcacacttcccaaggttagcgccaaacttaagctgaaactgactgctctcgaggggagccgcgtacggcgagtcagcgtggcgcactttggcagtcgccgcgcagaagattacggcgaacaccacctcgccgtgctcaccaatcttggcgatattcaggtggtaagcttgcctttgctgaaaccccaagttcggtactcatgtattagaagagaagacgtgagtggaatagcctcctgtgtatttaccaagtatggacagggattctatctcattagcccttccgaattcgaacggtttagccttagtacgaagtggctcgtggagccccgctgccttgtggactctgcggagaccaagaatcacaggcccggtaatggcgccggccccaaaaaggcaccctcacgcgcgcgcaactctggcacccagtcagatggcgaggagaaacagcccggcctcgtgatggaacgagctcttctttccgatgaaagggtcctaaaagagattcaaagcaccttagaaggagacagagggtctggtaactggcgatctcaccgcgcagcagtgggttgctctctaagtaatggcggagccgaatag

SEQ ID NO: 24853 - DNA, 1458 bp, Artificial Sequence
  Description of Artificial Sequence: Synthetic coding sequence
atggccgccgagctgtacgcccccgccagcgccgccgccgccgaccttgccaattcaaacgctggggcggccgtgggccgcaaagccgggccaaggagtcctccatctgccccagcacccgccccccctcctccagcccctgccccaccgaccctgggcaataaccaccaagaatctcctgggtggagatgctgtaggccaaccctccgcgagagaaacgctctcatgttcaacaacgaactgatggccgacgtgcacttcgtggttggaccgcccggcgccaccaggactgtgcccgcgcataaatatgtactggccgtcggtagcagcgtcttctacgccatgttctacggtgatctagccgaagtcaaatccgagatacacattcctgacgtggagcccgcagcgtttctgatactactgaagtatatgtattctgacgagattgatctggaagcggacaccgtcttagctactctgtatgctgccaaaaaatacatcgttccagccctcgccaaagcatgcgttaacttcctggagacttccctcgaggccaagaacgcatgcgtgttgcttagccagtctagactttttgaggagcctgagctgacgcagcgctgctgggaggtgattgatgcgcaggcagagatggcactgagaagcgagggtttctgcgagatagatcggcagacacttgagattatagtgacccgggaagccctaaatacaaaggaggccgtggtctttgaagcagtgctgaactgggcagaggcagaatgtaagaggcaaggtttacccatcacacccagaaataagaggcacgtgctggggagagcattgtatttggtacgcattcctactatgactctggaggaattcgctaatggcgctgcccagtccgatatcctcacgttagaagaaacccactcaatattcctgtggtataccgctacaaataagcctaggctggatttcccattgaccaagagaaagggtctggccccgcagcggtgtcatcgctttcagtctagcgcctaccggtccaaccaatggcgatatcgggggcggtgcgatagtattcagtttgcggttgaccggcgagtattcattgccggcctggggttatacggctctagctcagggaaagctgagtattccgtcaaaattgagctgaagcggctgggagtggtcctggctcagaacctaacaaagttcatgagtgacggaagcagtaataccttcccagtttggttcgaacaccccgtgcaggtggaacaggacactttctatacagccagcgcagtgctcgatggtagcgagctgtcatacttcgggcaggagggcatgacagaagttcaatgtggcaaagtggctttccaattccagtgctctagcgactctacgaacgggaccggggtccaaggaggccagatacctgaattaatcttttatgcttag

SEQ ID NO: 24854 - DNA, 2883 bp, Artificial Sequence
  Description of Artificial Sequence: Synthetic coding sequence
atgagccggctgatcgtgaagaacctgcccaacggcatgaaggaggaacgctttcgacagttatttgctgccttcggaacccttactgactgcagccttaaatttactaaggatgggaaatttcgtaagtttgggtttatcggcttcaagtcggaagaagaggcccagaaggcccaaaagcattttaataaatcatttatagacacatctcggattaccgttgaattctgcaagagctttggagaccccgccaagccgcgagcatggtccaaacacgcccagaagcccagccagcccaagcaaccccccaaggactccacgacgcccgaaattaaaaaagacgaaaagaagaaaaaagtcgctggccagttggagaaactgaaggaggataccgagtttcaagaattcctgtcagtccaccagcgccgagcccaagcagctacatgggccaacgacggcctggacgctgaaccttctaaaggaaagagcaagcccgccagtgactatctgaatttcgactccgacagcggacaagagagcgaagaggaaggcgcaggcgaggatttagaagaggaggcgagtcttgagccaaaggccgcagtgcagaaagaactctctgacatggactatcttaagtccaaaatggtgaaggccggctccagttctagttccgaagaggaggagtcagaggacgaagccgtacactgcgatgagggcagcgaggccgaggaggaagatagcagcgctacacccgtgctgcaggagcgtgactctaagggggccggacaggagcagggaatgcccgcagggaagaaaagaccccccgaagctcgtgccgagacagaaaaacccgcgaatcagaaagaacctaccacttgtcataccgtgaagttgagaggcgctccatttaacgtcaccgagaaaaatgtgatggaattccttgcccctctgaagccagtggcaatcagaattgttcggaacgcccacggaaacaaaacaggctatatctttgtcgatttttccaatgaggaggaggtaaaacaggccctgaagtgcaaccgggaatacatgggaggtagatacatcgaggtgttccgcgagaaaaacgtccctacaaccaaaggcgcccccaagaataccacaaagtcttggcaaggccggatccttggagagaatgaggaagaggaggatttagcggaatcagggcgcttatttgtccgtaacctgccttacaccagcaccgaggaggatctggagaagctgttctcaaagtatggaccgctctcggaacttcactaccctatcgattcgttgaccaaaaagcctaaaggattcgctttcattacatttatgttccctgaacacgccgtcaaggcgtatagcgaggttgatggccaggtgtttcagggacgaatgctccatgtcctgccaagtacaatcaaaaaggaggcctccgaggacgcttccgccctcgggagttcgagctataaaaaaaaaaaggaggcacaagataaagcaaactctgcgtcttcccataattggaatactctgtttatgggtccaaacgctgtcgcggacgccatagctcagaaatacaacgctactaagagccaggttttcgaccacgagaccaaagggtccgttgccgttcgggtggccctaggcgaaacacagctggtgcaggaggtccgccgcttcttgattgataatggcgtatctctggacagcttttctcaagccgccgccgagaggagtaagacggtaatcctcgtgaagaacttgccagccgggactctggcggcccagttgcaagagaccttcgggcacttcggcagtctgggcagagtcctgctgcccgagggcggtataactgccatagtggagttcctggaaccgcttgaagctcgcaaggcctttcgtcacctggcctacagcaaatttcaccatgtgccactgtacctggaatgggctccagtgggtgtgttcagttccacagccccccagaaaaaaaagttacaggacaccccctctgaacccatggagaaagatccagccgaacctgagaccgtacccgacggggagacacccgaggatgagaatcccacagaggagggagcggataactccagtgcaaaaatggaggaggaagaagaggaagaggaagaggaggaagagtccctgcctggatgcacactgtttatcaaaaatctgaatttcgatacaaccgaggaaaagttgaaagaggtgtttagcaaagtgggcacagtgaaatcttgctcaattagtaagaagaagaataaagccggggtcctgctgtctatgggcttcggctttgttgagtaccgtaagcccgagcaggcccagaaagctttgaagcagcttcaggggcacgtggtggatggacacaagcttgaagttcgaatcagcgagcgagcaactaagccagccgttactctggctcggaagaagcaagttccaagaaagcagactaccagtaagattctggttcgaaacataccctttcaagcccacagtcgtgagatccgagaactgttctccaccttcggggagctcaaaacagtgaggttgcccaaaaagatgactggcaccggaacccatcgcggcttcggctttgtagattttctgactaagcaggatgccaaaagagcttttaatgccctgtgtcactctacccacctgtacggacgtaggctcgtgctggagtgggcagacagtgaggtcacactgcaggcactcaggagaaagaccgcagcccacttccacgaacctccaaagaaaaagcgatctgtggtgctagatgagattctggaacagctggaggggtccgattccgactccgaagagcagaccttgcaactctag

SEQ ID NO: 24855 - DNA, 669 bp, Artificial Sequence
  Description of Artificial Sequence: Synthetic coding sequence
atggagcggatcgagggcgccagcgtgggccggtgcgccgccagcccatacctgcgcccactgactctgcactatagacaaaatggggcccagaagagctgggatttcatgaagacccacgattcagtaactgtcttactgtttaattcaagcaggcgttctcttgtattagtgaagcagttccgaccggcggtctacgcaggagaggtggaacgtcgttttcctggaagtttggccgctgtcgatcaggatgggcctcgggagctgcagccggccttgccaggatcagcgggagttaccgtagaattgtgcgcaggcctcgtggaccagccgggcctctcactggaggaagtagcctgtaaagaagcgtgggaggagtgtgggtaccatctggcaccgagcgacttacggagggtcgccacctattggtcaggagtaggtctgacgggatctcgccagaccatgttctataccgaagtcacagatgcacagagaagtggtccagggggcggtttagtggaagaaggcgaactgatcgaagtggtacacttgcctctggaaggtgcccaggcattcgccgatgaccccgatatacccaagactctgggcgtgatatttggagtgagctggtttctcagtcaggttgccccgaacttagatctccagtag

SEQ ID NO: 24856 - DNA, 876 bp, Artificial Sequence
  Description of Artificial Sequence: Synthetic coding sequence
atgaacatgatctggcggaacagcatcagctgcctgcggctgggcaaggtaccgcatcggtaccaaagcggctaccatccagtggctcctctggggtcaaggattctgacagacccagctaaagtgttcgagcacaatatgtgggatcatatgcagtggtctaaagaggaggaagctgctgctcggaagaaagtcaaggagaacagcgcagtcagagttctgctggaagagcaggtgaagtacgaacgagaagcaagcaaatactgggacaccttctacaagattcacaaaaacaaattctttaaagatagaaactggttactgcgggagttcccggaaatccttcccgtggatcagaagccggaggagaaggctagggagtcatcttgggaccacgttaagacctccgcaactaacaggttctctcgcatgcattgccctactgtcccagacgaaaagaaccattacgagaaaagttccggcagtagcgaaggtcaaagtaaaacagaaagcgattttagtaatctcgacagcgagaaacacaaaaagggtccaatggagactggtctcttccctgggagcaatgcaacttttcgaatcctggaagtgggctgcggcgcaggcaactcagtattccccattctcaacacactggagaactctccggagagctttttgtattgttgcgactttgcctccggtgctgtggagctcgtcaaatctcactcctcataccgggctacccaatgttttgcatttgtgcacgatgtatgcgacgatggcctcccatacccctttccggatgggatcctggacgttatcttacttgtttttgttctctcaagcatccatccggaccggaccttattcatatag

SEQ ID NO: 24857 - DNA, 630 bp, Artificial Sequence
  Description of Artificial Sequence: Synthetic coding sequence
atgaagaaggtgcggctgaaggagctggagagccggctgcagcaggttgatgggttcgaaaagccaaagctgctgctcgagcagtatccgacacggccccacattgcagcgtgtatgctgtacactatccataatacctatgatgacattgaaaacaaggtcgttgcagatttaggctgtggctgcggggtgttatccatcgggaccgccatgttaggcgccggcctttgcgttggctttgatatagacgaagacgcccttgagattttcaatagaaatgcagaagaatttgaactcaccaacattgatatggtgcagtgtgatgtgtgtctgctcagtaatcgcatgtccaagtcatttgacactgtcatcatgaaccctccctttggcaccaaaaataataaggggactgatatggcatttctcaaaacagctctggagatggcccgcacagctgtgtacagtttgcataagagctccacacgcgagcacgtacagaagaaagcagctgagtggaagattaagatagacataattgctgaactgcggtacgatctgccagcctcttataagttccacaagaagaagtccgtggacatcgaagtggacctgattcggttctccttctag

SEQ ID NO: 24858 - DNA, 504 bp, Artificial Sequence
  Description of Artificial Sequence: Synthetic coding sequence
atgcccgcctaccacagcagcctgatggaccccgacaccaagctgataggcaacatggccctgttgcccatacgttcccagtttaaaggtcccgcaccacgtgagaccaaggataccgatattgtggatgaagctatctattacttcaaggcaaacgttttcttcaagaattacgagataaaaaatgaggctgacaggacactcatctacattactctgtacatctcagagtgtctgaagaagctccagaaatgtaatagtaagtcacagggagaaaaggagatgtataccttgggcatcactaacttccccattccgggagaacccggatttccgctgaacgccatttatgcaaagccagcgaataagcaggaggacgaggtgatgagggcatatctacagcagctccggcaggagaccggtttgagattatgcgaaaaggtaatcaagggcgacctgaagttcagcgcagccctcaaactggctctcaacaagaacaagtag

SEQ ID NO: 24859 - DNA, 4074 bp, Artificial Sequence
  Description of Artificial Sequence: Synthetic coding sequence
atggccgacaccgacctgttcatggagtgcgaggaggaggagctggaaccctggcagaagatttccgatgtcatcgaagattccgttgtggaagattacaactctgtggacaaaactaccacggccggaaatccactggtccaacaaggaggacaacccttaattttaacccagaatccagcccctggcctgggtacaatggtgacacagcccgtactgcgtccagtacaagtgatgcagaacgccaatcatgtgactagctcacctgtcgcaagtcagccaatcttcatcacaacacagggctttccagtccggaatgtgcggcccgttcaaaatgctatgaatcaggtaggcatcgtgctcaatgtgcagcagggccagaccgtgcgtcctattacccttgttcctgcgccagggacgcagttcgtcaaacccacagtgggagtcccacaagtgtttagccagatgacacctgtgagaccaggctctaccatgcctgtgaggccgacaaccaacacgttcactacggtcataccggctaccctgacgatacggtcaactgtgccccagagccagtcgcagcaaaccaaatctaccccttccacctccacgacccctacagccactcagcctaccagcctgggtcaactcgcagtgcagtcccccggccagtccaatcagactaccaacccaaaactggccccaagctttccgtctcccccggccgtatctatcgctagtttcgtcactgttaagaggccaggcgtgaccggggaaaactcaaatgaggttgctaaattagtgaacaccctaaacaccatcccttccctcgggcagtcgccaggtcccgtcgttgtgagtaataacagctctgcccatggttcgcagcgtaccagcggccctgagtcttcaatgaaggtcacctctagcatacccgtgttcgatctacaggacggcggtcgtaaaatctgtccacggtgcaatgcccaattcagagtgactgaggcactcagggggcatatgtgctattgctgtcctgaaatggtcgaatatcagaagaaggggaaaagccttgactccgagccgagcgtgccgtcggccgcaaagccgccctcgcctgagaaaacagctcccgttgcatccactccaagctctactccaataccagcacttagtcctccaaccaaggtgccagagccaaatgaaaacgtgggggacgcagtacaaacaaagttgattatgctggtggacgatttctactacggacgcgacgggggaaaagtcgcgcaactgacgaacttcccaaaagtggccaccagcttcaggtgcccccactgtacaaaacgactaaaaaataacattcggtttatgaaccatatgaagcatcacgtagaactggaccagcagaatggggaagttgatggccacaccatctgccagcactgttacaggcaattcagtacaccattccaattgcagtgccacctcgaaaacgtccactcgccatacgaatcaactacgaaatgtaaaatctgtgagtgggcatttgaatcagagcccctgttcttgcaacatatgaaggacacccataagccaggcgagatgccttatgtgtgccaagtgtgtcagtatcgaagctctctgtacagcgaggtggatgtgcattttcgcatgattcacgaggacaccagacaccttctgtgtccctattgtctgaaggtgtttaaaaatggcaatgcctttcaacaacattacatgcgccatcaaaaacgcaacgtctaccattgcaataagtgtcgattacagtttctgttcgccaaggataagattgaacacaagttacagcaccacaaaactttcaggaagccgaaacagcttgagggcctgaagcctggcacaaaggtaacaatccgcgcctcccgcggacagcctcgaacagtgccagttagctctaacgataccccaccatctgcactgcaggaagcagctccactgacctccagtatggaccctctcccagtcttcttatacccacctgtgcaacggtctatacagaaacgggccgtacgaaaaatgtcggtgatgggcaggcagacatgtctggagtgcagctttgagatacccgacttccctaaccacttccctacctacgttcattgttctctttgccggtactcaacatgttgttctcgcgcctatgcgaatcacatgattaacaatcacgtcccgcgtaaatctcctaagtacctggctttgtttaagaatagcgtcagcggcattaaactagcatgtacctcctgcaccttcgtcacctcagtgggagatgccatggccaaacatctcgtgtttaacccctctcacaggtcatcttccattctcccacgcgggctgacttggatcgcccactctcgccacggccagacccgagatagggtgcacgacaggaatgtcaaaaacatgtaccctccaccctcctttccgacaaataaggccgctactgtgaagtcggctggcgctaccccagcggagccagaggagcttctcaccccgttggccccagcgctgccctcaccagcctccacagccacccctccaccaaccccaacacacccccaggcgctcgcgctgcctcctctggccactgagggagcggaatgtctgaatgttgacgatcaggatgaggggtcacccgtgactcaagaaccagaactggcttccggaggcggcgggtctggtggggtgggtaaaaaagagcagctgagcgtgaaaaaactgagggtggtcctgttcgccctttgttgtaacaccgagcaggctgccgagcattttcggaacccacagagaagaatccgccgatggctgagaagatttcaagcaagccagggcgagaatctggagggaaagtacttatcctttgaggctgaagaaaaactggccgagtgggtattgacccagagggaacagcaattgcccgtgaacgaggaaacattatttcaaaaagctacaaagatcggccgatctctagaaggcggctttaaaatctcgtacgaatgggcggtgagatttatgctgaggcaccatctgacaccacacgctcgccgggcagtagcccacactttgcctaaggatgtcgcagagaatgccggtctgtttatcgactttgtgcaacggcagattcataaccaagatctccctctgagcatgattgtagcaatcgacgagatatcactgtttcttgacacagaagtgctgagcagcgatgatcgcaaagaaaatgcgttgcaaactgtgggaacaggagaaccttggtgcgacgtggtattggccattctggctgatggaaccgtactgccaacactggtgttctaccgcggtcagatggaccagccggcgaatatgcccgacagtatcctgttagaggccaaagaatcaggttactcagacgacgagattatggaattgtggtcaactcgggtgtggcaaaagcataccgcctgtcaacgttcgaaggggatgcttgtgatggattgccatcggacccacttgtctgaggaagtactagcaatgctgtccgcaagttccacgctgccagctgtcgtccctgctggttgtagctctaaaattcagcccctggatgtgtgtattaagcggaccgtcaagaattttctccataaaaaatggaaggaacaggctagagagatggcagatacagcctgtgactccgacgtgttgcttcaactggtgctggtctggctcggggaagtgctcggggtaatcggcgactgcccagagctggttcagcgctccttcctagtggcaagtgtgctaccgggccctgatggcaatatcaatagcccaacacggaatgccgacatgcaggaggaacttattgcctcgttggaagagcagctcaaattgtcaggggagcatagcgaatcctccactcccaggccacgctctagccctgaagagacgatagagcctgaaagtcttcaccagctgttcgagggcgagagcgaaaccgagagtttctacggattcgaagaggccgaccttgatctgatggaaatatag

SEQ ID NO: 24860 - DNA, 288 bp, Artificial Sequence
  Description of Artificial Sequence: Synthetic coding sequence
atgctgaagaacaagggccacagcagcaagaaggacaacctggccgtcaacgctgtggccctccaggaccacatcctgcacgaccttcagttaagaaatttatcagttgctgatcacagtaaaacgcaggtgcaaaaaaaagaaaacaagagcttgaagcgtgatactaaggccatcatcgatacagggctgaagaagactacacagtgcccaaaactggaagattccgaaaaggaatatgttcttgaccccaaaccacctcctctgactctgggataccatagttag

SEQ ID NO: 24861 - DNA, 708 bp, Artificial Sequence
  Description of Artificial Sequence: Synthetic coding sequence
atgctgaagaacaagggccacagcagcaagaaggacaacctggccgtgaacgctgtcgccctgcaagaccatatcttgcacgacttgcagctcaggaacctttcagtggcagatcactctaagacccaggttcagaagaaagagaataagagtctgaaaagggataccaaggccataatcgatacagggctgaagaaaaccacacagtgtccgaagctggaagactccgaaaaggagtacgtgctggaccctaaaccacctccattgactctcgcccagaagctgggcctaatcgggccacctccaccaccactctctagcgacgaatgggagaaagtgaagcagcgcagcctgctgcaaggcgacagcgtgcagccatgtcccatttgtaaggaagagtttgagctgcggccccaggtgctcctgtcctgctcccacgtctttcacaaagcatgcctccaggccttcgagaaattcaccaataagaaaacctgccccttgtgccggaagaaccagtatcaaactcgcgtcatccatgatggagccagactcttccggatcaaatgtgttacgcgtatccaggcctattggcgcggttgcgtggttcgtaagtggtacagaaatctgagaaagacagtaccccccaccgacgctaagctgcggaagaaattcttcgaaaaaaaaacccaggattggaagcctgcgtag

SEQ ID NO: 24862 - DNA, 1089 bp, Artificial Sequence
  Description of Artificial Sequence: Synthetic coding sequence
atgctgaagaacaagggccacagcagcaagaaggacaacctggccgtcaacgctgtcgcgcttcaggatcacatcttgcatgacctgcagttgcgtaaccttagtgtggccgatcattcaaaaacccaggtgcagaagaaggagaacaagtcactgaagagggacacaaaggcaataattgatacaggccttaagaaaacgacccagtgccctaagctagaagatagtgagaaagaatacgtgctggaccccaagcctcccccacttacattggcccaaaaactaggactgataggaccccctccgcctcccctgagctccgatgagtgggagaaggtgaaacagaggagcctcctccaaggagattctgtgcaaccttgtccgatttgcaaggaggagttcgagttgcgcccccaggttctgctctcatgttcccacgtgtttcacaaggcctgcctgcaggccttcgaaaagtttaccaacaaaaagacatgccctctgtgtcggaagaaccagtatcagactagggtcattcatgatggggcccgactattcagaattaagtgtgtcactcgcatccaagcatattggaggggatgcgtcgtgcgtaagtggtaccgcaacttgcggaaaacagtgcctccgaccgacgccaagctaaggaaaaaatttttcgagaaaaaatttactgaaataagccatagaatcttgtgtagctacaataccaacattgaggaattgtttgcagaaatagaccagtgcttggccatcaatcgatcagtactccagcaactggaggaaaagtgcggacatgaaataactgaggaggaatgggagaaaatccaggtgcaggcgctgcgtcgggaaactcacgagtgtagcatttgcctagctccactcagtgccgcaggcgggcagagagtgggtgccggacgccgaagccgtgagatggctctgctgagctgttcccatgtttttcatcacgcctgcctgcttgcgctggaggagttcagcgtgggggatcggccacctttccacgcctgtcccctctgtcgctcttgctaccagaaaaaaatcctggagtgctag

SEQ ID NO: 24863 - DNA, 1278 bp, Artificial Sequence
  Description of Artificial Sequence: Synthetic coding sequence
atggacaagaacatcggcgagcagctgaacaaggcctacgaggccttccgccaggcctgtatggatcgtgattccgcagttaaagagttacagcagaaaactgagaactacgagcaaagaatccgcgagcagcaggagcagctttcccttcagcagacaatcattgacaagctcaagtcccaactgctgctggtcaactccactcaggacaacaattacgggtgtgtcccactgctcgaagactctgaaacacgaaagaacaacctgaccctggaccagcctcaagacaaggtaatatctggcatcgcaagagagaaattgccgaaggtccgtagacaggaggtgtcgtccccccgaaaagaaacctctgcgcgatctcttgggtctccccttctgcatgagcgcggcaacattgaaaagaccttctgggatctgaaggaggagtttcataaaatctgtatgctcgccaaagcccagaaggatcacctcagcaaattaaacataccggacacggccacagagactcagtgctctgtgccaatccagtgcacagataaaaccgacaagcaggaagctctgttcaagccccaggctaaggatgacattaatagaggggcacccagcatcacttctgtgacacctcgcggcttgtgccgggacgaggaggacacatcattcgagtctttatcgaagtttaacgtaaaatttccaccaatggataacgacagtaccttcctccacagcacacctgagcggccaggcattcttagtcctgccacatccgaggccgtgtgtcaggagaagtttaatatggagttcagggacaaccccgggaacttcgtgaaaaccgaagagacacttttcgagattcagggtattgatccaattgcttctgccatccagaaccttaagaccaccgacaaaaccaaaccttcaaatctggtcaatacttgcatacgcactaccttggatagggccgcctgcctgccaccaggtgaccacaacgccctctacgtaaatagtttccccttgctcgaccctagtgacgccccatttccctcgctcgactcccctgggaaggctatcaggggaccacagcaaccaatctggaagcctttccccaatcaagattcggactctgtggtgctaagtggaactgactccgaactgcacattccccgcgtgtgcgaattttgccaagcagttttccccccaagcatcacctctcgcggtgattttctgagacatctgaattctcacttcaacggcgaaacctag

SEQ ID NO: 24864 - DNA, 639 bp, Artificial Sequence
  Description of Artificial Sequence: Synthetic coding sequence
atggccccctggggcaagcggctggccggcgtgcggggcgtgctgttggacataagtggcgtactatatgatagcggagcagggggcggaaccgctattgcaggatcggtggaggcggtggcgcgacttaagagaagccggctcaaggtccgcttttgtaccaacgaaagccagaagagtagagcagagctggttggccagctgcagcgccttggattcgacatttcagagcaggaagtcaccgcgccagcgccggccgcttgccagattctgaaggagcagggactcagaccatatctgctgattcacgatggggtcaggtcggaatttgaccagatcgacacctccaatccgaattgtgttgtcatcgcggacgccggggaaagttttagctatcagaacatgaacaacgcctttcaggtgctgatggaactggagaagccagtattgatctcacttggcaagggtcgctactacaaagaaacctctggattaatgcttgacgtggggccttacatgaaggccctcgaatatgcttgcgggattaaagcagaggtggtggggaaaccatcgccagagttctttaaaagcgccctccaggcgattggtgtcgaggcacatcagcttctcagcgtgtag

SEQ ID NO: 24865 - DNA, 2868 bp, Artificial Sequence
  Description of Artificial Sequence: Synthetic coding sequence
atggaggtgggcagcgaggaggagaagtgggagaagctggacgccgagttcgaccatttcgtcgttgatatgaagccctttgtactaaagctgcctcatcgaaccgaaaggcagagatgtgcactttggattcgtaagctatgcgagcccagcgggacaggcgcaggtatcatggggcggaaaaacagaaacttatacgcaaaactattgctgcacatgctcaagcgtggagcgctcgaaggcccattcacacatcggcctgagcccggaacccttaaaatacttccatcttatatgtccatctacttcgatgaacctaatccagctcgggccaagggtagctcccccgaaggtctcccggcttgggtgctgggcgagctggagacatctgagcacaaactaaatgaaagttggaagctcagcagcggcgaagacaatacactcgtgcagtctcctacagatgtctatagcagagaacagtacacaggtaaactaagggtcaggagccattccctgtcaccaacccaccgggaggacggacaaaatattacgccaaagatctgcgaggtgtacagcaagaagtcccctgtttctctggacgacagcgatattgaggctaggctaaattcgtggaatctagggatcgagaatcccagatacctgcgccagaaaccaatcccagtcagcctgatgaccccaaaattcagcctcaggaagtcctctagcttccatgatgaccatttcctatcgcgcatacgagagaaagagctggacatgaagacaaagatgatggaggccaaattccacgaagaaaagttaaaattgcaacaaaaacacgacgcggatgttcagaagatcctcgagcggaagaacaatgagatagaggagctgaaaactctgtacaggtccaagcagcacgagacggaagagaccatccgcaaactcgagaaaaaggtgcagacactcatcagggactgccaggttattagagagaccaaggaggaccagattgctgaactgaagaagatctgcgagcagagcactgaatctcttaacaatgattgggaaaaaaagctccataacgccgtcgccgagatggagcaggagaagttcgatctgcagaagcagcacaccgagaatattcaggagctacttgaagacactaacgttcgcctgaataaaatggagagcgagtatatggcacagactcaatccacaaatcatatgatcaaggaacttgaggcccgggtgcagcagctcaccggtgaagccgagaacagcaacctccaaagacagaagctaatccaggagaaagcagaactggaacgctgctaccagatcacttgttctgagctccaggaggtaaaggcgcgcaggaatactctgcacaaagagaaagatcatctggtgaatgactacgagcagaacatgaaattactgcaaactaaatatgatgctgatattaatttgttaaaacaggagcacgccctcagtgcatctaaggcatctagcatgattgaggagctcgagcagaacgtgtgccagctcaaacaacagctgcaggagtcggagcttcagaggaaacagcagttgagagatcaagagaataaattccaaatggagaaatcacatctgaagcacatttatgagaaaaaggcccatgatctccaaagcgagctcgacaaaggcaaggaggatacccaaaaaaaaatccacaaattcgaagaggcactgaaggagaaggaggaacagctgacccgggtgacggaggttcagcggctgcaagcccagcaggcagacgctgccttggaggaattcaagcgccaggtggaactgaattctgaaaaagtgtatgccgaaatgaaggagcagatggagaaggtggaagcagatctcactcggtcgaagtcgctcagggaaaaacagagcaaggaattcctgtggcagttggaggacatcaggcagcggtacgaacagcagattgttgaactgaaactggagcacgaacaagagaagactcatttattgcagcagcacaacgctgagaaggatagtctggtgagagaccacgagagagagattgagaacttagagaagcagctccgtgccgccaatatggagcacgagaatcagattcaggagtttaagaagcgggacgcccaggtgatagccgacatggaagcccaggttcataagttgagggaagaactgatcaacgttaactcccagaggaagcagcagttggtcgaactgggcttgctgcgagaagaggagaagcagagggccacccgggagcatgaaatcgtggtaaacaaactcaaagccgagtccgagaagatgaagatcgaactgaagaagacacacgctgccgagactgagatgacgctggaaaaagccaatagtaagttaaaacagatcgagaaagaatacacccagaagctggccaagagctcccagattattgccgagttacagacaacaatctctagtctgaaggaggagaattcccagcagcaactggctgccgagcgaagattacaagacgttagacaaaaattcgaagatgaaaagaagcagctgatcagagacaacgatcaagctattaaagtgctccaggatgaactggaaaaccgcagtaaccaagtacggtgcgccgagaagaaactgcagcataaggagctcgaatcacaggaacagattacatacatccgacaagaatacgaaacaaagctgaaggggttgatgcctgcatctctgaggcaggaactggaagacacaatctcatcccttaagtcacaagttaatttcttacaaaagcgtgccagcatacttcaggaggaacttaccacgtatcagggcagacgctag

SEQ ID NO: 24866 - DNA, 1269 bp, Artificial Sequence
  Description of Artificial Sequence: Synthetic coding sequence
atgccccggaagggcacccagcccagcaccgcccggcggcgggaggagggccccccccctccatcgcctgatggcgccagctcagacgcagagcccgagccaccctcaggccgcaccgaatctccagccaccgcagccgaaactgccagcgaagaactggataaccggtctttggaggaaatactcaacagcattccaccacccccaccccctgctatgaccaacgaggcgggagcccctcgcttgatgatcacacatattgttaaccagaattttaaaagttatgcgggcgagaaaatcctggggccattccataaacgattcagctgcattattggcccgaatggtagcggcaaaagtaacgtgatcgacagcatgctgttcgtctttggctacagagcccagaagatccgcagtaagaagctaagcgtgctgattcataactcggacgaacacaaggacatccaatcctgtacggtcgaagtgcactttcaaaaaatcatcgacaaagagggagatgactacgaggtcatcccaaacagcaatttttatgtctccagaactgcgtgtagggacaatacttccgtgtaccatatcagcgggaagaagaaaacttttaaggacgtgggcaacctactccggagccatggcatcgaccttgatcataaccgctttctcatactgcagggagaggtggaacaaatcgcaatgatgaagcccaagggccagaccgagcacgacgaagggatgttggaataccttgaagatatcattgggtgcggacgtctgaacgagcccatcaaggtgctttgcagaagagtggagatcttgaacgaacacaggggtgaaaaactgaaccgcgtgaaaatggtggaaaaggaaaaggacgctctcgagggtgagaagaatattgccattgaattcctgacactggagaatgaaatttttcggaaaaaaaaccacgtgtgtcagtattatatttacgagctacaaaagcggatcgccgagatggaaacacagaaagagaaaatacacgaggataccaaagagattaacgaaaagtcaaatattcttagtaatgagatgaaggccaagaataaggacgttaaagatacagagaagaaacttaacaaaatcactaagtttatcgaggagaataaggagaaattcacccagcttgatcttgaggacgtccaagtgcgtgaaaaactcaagcacgccacgtcaaaagcaaagacaggggagactaccagcaagaggaagaagtag

SEQ ID NO: 24867 - DNA, 303 bp, Artificial Sequence
  Description of Artificial Sequence: Synthetic coding sequence
atgcggaagcggctgagcgcccccgagctgcggctgagcctgaccaagggacccggcaacgatggcgccagcccaacccagtcagctccatcctccccagatggtagctccgatcttgagattgatgaactggagactccctccgactccgagcaactcgactctggacacgagtttgagtgggaggatgagctgccacgcgctgagggactcggcactagcgaaaccgccgaacggcttggacgcggctgtatgtgggatgtcacaggtgaagacgggcatcattggagagtatttcggtag

SEQ ID NO: 24868 - DNA, 1059 bp, Artificial Sequence
  Description of Artificial Sequence: Synthetic coding sequence
atgggcaaggtggagaacagcaagagcgcccagggcctggccggccttcggaacctgggcaatacctgttttatgaatagcatactccaatgtttgtctaacaccagagaattgagagactactgcctgcagagactgtacatgcgagacctgcatcacggaagcaatgcgcataccgctctggtcgaagaatttgcaaagctcatccaaacaatctggacttcatctcccaatgacgtagtgagcccatcagaatttaagacccagatccagcgttacgcaccccgctttgttggctacaatcagcaggacgctcaggagttcctgaggttcctgctggatggtttgcataatgaggtcaatagggtcaccctcaggcctaagtccaacccagagaatttggaccacctgcctgatgatgagaagggtaggcagatgtggcgtaaatacctcgagagggaagactctcggattggcgacctgtttgtgggacagctcaaatcatcgctaacgtgtacggactgcggctactgttctaccgtgtttgacccattttgggatctgtctttgcccattgccaaaagaggatatcctgaagtgacactgatggattgcatgcggctctttacaaaggaagatgtcctggacggcgatgagaagccaacgtgctgtaggtgtcgcggccggaagcgctgtattaaaaaattttcgattcagcgtttccccaagatccttgtcctgcacctgaagcgtttttctgagtccaggattcggacttctaagcttacaacctttgtgaattttcctctccgagacctggatttgcgggagttcgcttcagaaaacaccaaccatgcggtctataatctctatgccgtatcaaatcactccggcaccaccatgggcggccactataccgcatattgccgcagccccgggaccggggagtggcacacctttaatgattcttcagtgacccctatgagtagcagtcaagttagaacatccgatgcatacctgctgttttacgagcttgcctccccaccttccaggatgtag

SEQ ID NO: 24869 - DNA, 1497 bp, Artificial Sequence
  Description of Artificial Sequence: Synthetic coding sequence
atggtgatcgaggaggtgaacttcatgcagaaccacctggagatcgagaaaacatgtcgagaaagcgccgaagcactggctactaagctcaataaagagaacaaaacacttaagaggatttcgatgctctatatggccaagcttggcccagacgtgattactgaagagattaatatagacgacgaggattctaccacagatacagatggagctgccgagacctgtgtgagtgtgcagtgccagaaacagatcaaagagctccgagatcagattgtgagtgtgcaagaagaaaaaaagatcctggccattgagctagaaaacctcaaaagtaaacttgtagaggttatagaggaagtaaataaggtgaagcaggagaagaccgtgctcaatagcgaagtccttgagcagcgcaaagttttagaaaagtgtaatagggtctcaatgcttgctgtagaggagtatgaagagatgcaggtaaaccttgagctagaaaaggatcttagaaagaaagccgagtcctttgcgcaggagatgtttattgaacagaataaattgaagagacagagtcacctattgctgcagagcagcatcccagaccagcagttgttgaaggcgctggacgagaacgcgaagcttacacaacaactggaggaggagaggatccagcatcagcagaaggtgaaggaactggaagagcaactagagaatgagaccctccataaggaaatccacaatctgaagcagcagctggaactgttggaagaggataagaaagaactcgagcttaagtaccagaatagcgaggaaaaggcccgcaacctcaagcactccgttgacgaattgcagaagagggttaatcagtccgagaacagcgtgcccccaccgcctcctccgcctcctcctttgccgccgcctccaccaaaccccatccggtccctcatgtctatgattcgcaagaggtctcatccttctggctcgggggccaagaaagagaaagccactcagcctgagaccaccgaggaagtgacggacctgaaaaggcaggccgtggaagagatgatggacaggatcaagaagggtgtacacctcaggcccgtgaaccagacagctaggcccaagactaaacccgaaagctcgaagggttgtgagtcagctgttgacgagttgaagggcattctcgggaccctaaacaagtctacaagttctcggagtctgaaaagcctggaccccgaaaactctgagacagaactggaaagaatcctgagaagacgtaaggtaacggcagaagccgactcatcctccccgacaggaattctggcaacttctgagtcaaagtctatgcctgtgctgggctctgtttcttccgtgaccaagaccgccctcaacaaaaagactttggaggctgagttcaattccccatcccccccgaccccggagcctggggagggaccaaggaagctggagggctgtacatcatctaaggtgacctttcaatag

SEQ ID NO: 24870 - DNA, 1950 bp, Artificial Sequence
  Description of Artificial Sequence: Synthetic coding sequence
atgaacagcagcgacgaggagaagcagctgcagctgatcaccagcctgaaagaacaagcgatcggtgagtatgaggacctccgggctgagaatcagaaaaccaaggagaaatgtgacaaaattcgtcaggaaagagatgaagccgttaaaaaattggaagaatttcagaagatctcacacatggtcatcgaggaggtgaatttcatgcagaatcacctagaaatcgagaaaacatgtcgtgagtctgccgaggccctggccaccaagcttaacaaggagaacaaaactttaaagaggatcagcatgctgtatatggccaaactaggccccgacgttataaccgaagagataaatatcgatgacgaagatagcacaaccgataccgatggcgctgcagagacgtgtgtgagcgtgcagtgtcagaagcagattaaggaactcagagaccagattgtgtctgttcaggaagaaaagaagatcctcgccatcgagctggagaacctgaagtccaaactggtcgaggtgatcgaggaggtgaacaaggtcaaacaggaaaagacggtattaaattcagaagtattggaacagcggaaggttctggagaagtgtaatagggtgtccatgctggctgtggaggagtacgaagagatgcaagtgaacctggagcttgagaaggatctccgaaagaaggcggagagtttcgcacaggagatgtttattgagcagaacaagctcaagcgccagtcacacctactgcttcagagttcgatcccggatcaacagctgcttaaagccctcgacgagaatgccaaactaacccagcagttagaagaggagcgaatccaacaccagcagaaagtgaaggagctagaagagcagctggaaaatgaaaccctccataaagaaatacacaacctgaaacaacaactggaactgctcgaggaagataagaaggaactggaattgaagtaccaaaattccgaggagaaggcccggaacctcaaacactctgtggatgagctgcaaaaaagggtgaaccagagcgaaaacagtgtccccccgccacccccaccacctccccccttacctcccccccctcctaaccccatcaggtctctgatgtctatgatcagaaagcggtcacatccgtccggctcaggggcaaaaaaagagaaagccacccagcccgagacaaccgaagaggtgaccgatttaaaaaggcaagccgtagaggagatgatggaccgaatcaaaaagggcgttcatttacggccagtcaaccaaacagctcgtccgaagaccaaacctgagtcgtccaaggggtgcgaaagtgctgtcgatgagctaaagggcatactggggacattgaataagtcaacctccagccgcagcctgaaatctcttgatccggaaaacagcgaaacagagttggagaggatactgcgccgtaggaaggttacggcagaagctgatagctcatcccctaccggcatcctcgctaccagcgaatcgaagtctatgcccgtgctgggtagcgtcagtagcgtgaccaaaaccgccctgaacaaaaagactctggaagccgagttcaattccccttcccctccaactccagagcctggagaaggtcctagaaagttagaaggctgcaccagctccaaagtgactttccaacctccttccagcattgggtgtcgcaaaaaatatatagatggcgagaaacaagcggaaccggtagtggtgctggatcccgtgtccacccacgaaccgcaaacaaaagaccaagtcgccgaaaaggacccgacccagcataaggaggatgaaggggagatccagccggagaataaggaggactccatcgagaactttttcccctttcatttcgggttcgagggcgttctcccattggcaggtgtgactctttccactaaggcacgagacccaaaatag

SEQ ID NO: 24871 - DNA, 837 bp, Artificial Sequence
  Description of Artificial Sequence: Synthetic coding sequence
atgggcaagagcagcgagtggtgcgagcggatcgccggcatccagaagtttgtactcgaaaagtggacaaaaaaggccaagcccgaggacaccctcaacttatgccagttactgaataacgacctcgccagcaccgtggtttcgtacccccggaggtttgttggactggggaccctcccaatgcaggcccctgaactggccgttaaagagatggagcgatgcgtgaaggagctcggatttcctggagtgcagataggtacccacgtgaatgagtgggatctaaatgcccaagagctgttcccagtctacgctgccgctgaacggcttaagtgttctttgttcgtccacccttgggacatgcagatggacgggcggatggcaaagtattggctaccctggctggttggtatgcctgcagagaccacgattgccatatgtagtatgattatggggggcgttttcgaaaaattccctaaactgaaggtgtgcttcgcacacggaggaggcgcatttcccttcaccgtcgggaggattagtcatggatttagtatgcggccggacttgtgtgcacaggataatcccatgaaccccaagaagtacttgggctcattttataccgatgctctcgttcacgaccccctgtccttgaaactgttgactgacgttattggcaaggacaaagtaatcctgggcacggactatccatttccgctgggagaactagaaccaggcaaattgattgaatcaatggaagagtttgacgaggaaaccaagaataaactcaaagcagggaacgccctggctttcttggggctcgaacggaaacagttcgagtag

SEQ ID NO: 24872 - DNA, 1368 bp, Artificial Sequence
  Description of Artificial Sequence: Synthetic coding sequence
atgttcaccgagggcgaggagatgtacctgcagggcagcaccgtgtggcacccagactgcaaacagtctaccaaaaccgaggagaaattacgactgcccaacattagaagaagttcaagcgactttttttactccaagtctcttattcgtagaacggggcgcagtccctccctccagccgaccaggaccagttctgagtccatctactctcgccctggctccagtatacccggctccccagggcacacaatctacgccaaggtggacaacgagattctggattacaaggacctcgcagccatccctaaggtgaaagctatctacgatatcgagcggcccgacttgataacctacgagccgttctatacctccggctacgacgataagcaagaacgacagagtctgggggagtccccaaggaccctctcacccactccctccgccgaggggtaccaggatgtgagagatcgtatgatccaccggagcacatcccaaggttcaattaacagccccgtttactcccgccattcttatacacctacaacttcaagaagcccccagcactttcaccgtcccgaccagggaataaacatttacaggaagccccccatctacaaacagcacgccgccctcgcagcccaatctaagtctagcgaagatattatcaaattttctaagtttccagcggcccaagcccccgacccctctgaaaccccaaagattgagaccgatcattggccaggacctcctagcttcgccgtcgtggggccagatatgaaaaggagatcgtcaggtcgggaggaggacgacgaggagctcctccgccgccggcaacttcaagaggagcagctgatgaagctcaacagtggcctgggccagttgatacttaaggaggagatggaaaaagaaagcagagagaggagttcgctcttagcatctaggtatgactctcccataaactcagcctctcatattccttcttcaaagacagcaagtttgcctggatacggccgcaacggcctgcataggcccgtgagcacagactttgcccagtacaattcttatggtgacgtatctgggggtgtgcgggactaccaaacacttcctgacggacatatgccagcaatgagaatggatcggggagtgagtatgccaaacatgctggagccaaagatcttcccctatgaaatgctgatggtgacaaaccgcgggcggaacaagatcctcagggaagttgacaggactcggctggagaggcatctggctcccgaggtttttcgagagatatttggaatgagtatacaggagttcgaccgccttccattatggcgcagaaatgacatgaagaagaaggctaaactgttctag

SEQ ID NO: 24873 - DNA, 1959 bp, Artificial Sequence
  Description of Artificial Sequence: Synthetic coding sequence
tgaagccacgccttcatcagccagtgggtgtgccggcactggcgggatcctgtggcccatccacaggatccccatcacccttcagagaagcccgtgatccattgccacaagtgcggagaaccatgtaaaggcgaggtcctgagggtgcagaccaaacattttcacatcaagtgctttacctgtaaggtttgcggctgcgatctcgcccagggtggatttttcattaaaaatggcgaatacttgtgcactttggattatcatcccaactgtttcgcctgtacaatctgcaagaggccctttccaccaggagatcgagtgactttcaatggacgcgactgtctgtgccagctttgcgcacagcccatgagctctagcccaaaagagacaacctttagtagtaactgcgctggatgcgggagggatattaagaatggacaggctctgctcgctttagacaaacagtggcatctcggctgtttcaagtgcaagagttgtggcaaagtactgacaggcgaatatatcagtaaagatggggccccatattgtgaaaaagactaccagggcctgttcggcgtaaagtgtgaggcctgccatcagttcatcacggggaaggtgctggaggcaggggacaagcactaccacccatcttgcgctcgatgttctagatgtaatcagatgtttacagaaggcgaggaaatgtatctgcaaggctccaccgtgtggcaccccgattgcaagcagtcaaccaagacagaagagaaactgcgccctacccgcacaagcagcgagagcatatatagcaggccgggcagctcgatacctggctccccaggacacaccatctacgctaaagtagacaacgaaatcttagattacaaagacctagcagctattcccaaggtcaaggcgatctacgatatcgagagaccagacctgataacatatgaaccattttacacttctggttacgacgataagcaggagagacaaagcttaggcgagagtccacggactctgtcccctaccccaagtgctgaaggctaccaagatgtgagagaccggatgatccacaggtccaccagtcaggggtcaatcaatagcccagtgtactcccgccatagctatacccccaccacctctcggtcaccccaacattttcaccgaccagatcaaggtattaacatctatcgtaaaccccccatctataaacagcacgccgccctcgcggcacagagtaagtcttccgaggacattatcaaatttagtaaattccccgcggcacaagcccctgaccccagcgaaactcccaaaattgaaactgatcactggcctggccctccttctttcgccgtagtcggcccagacatgaagcgcaggagcagtggccgggaggaggacgacgaggaactgttaaggcggagacaactgcaggaggagcagctgatgaaactgaactctggactgggacagctgatccttaaagaagagatggagaaggaatcaagagagcgctcatctctcttggcgagccggtacgactcccccatcaattccgcttcacacatcccctctagcaagactgcctcactgccgggctatggccggaacggccttcataggcccgtctcaaccgattttgcccagtataattcctatggcgacgtgtcagggggggtgagggactaccagactttaccagacggtcatatgcccgccatgagaatggaccgtggtgttagcatgcctaacatgctggaacctaagattttcccctatgagatgttaatggtcaccaacagagggaggaacaaaattttaagagaagtggaccgcacccgcctggaaagacacttagcccccgaggtgttcagggaaatctttgggatgagcattcaggaattcgataggctgcccctgtggcggcgcaatgacatgaagaagaaggctaaattgttttag

SEQ ID NO: 24874 - DNA, 837 bp, Artificial Sequence
  Description of Artificial Sequence: Synthetic coding sequence
atgacccagcagtggcgggaggtgaacgaggaccgggaggccgtggcccaggccagatcctggcagagcctcaatctcggcgaccgcgatatgggggtttcctttatcgaaacagctctcgccttgtcagccgctagagcaagacgccccctccttactagtcacccaccatctaggccgtttcagcctccgaagcacacaccatcaccaccacccgccccgcgtgtgaatagtagacatccaggaagatctgtatccctcagcctgccaagcgctagtcaggccccaccagtccctctggcatccccagaaggaaggccgcacactgtgggagctcctcacgccagcacttggaagcggactcggggacgacagcgagcacggccgcctaaaatcgttaaggaagccgaagtcccacaggccgcactgggagttcctgctcaaggcacaggcgacaacggacatacccccgtggaagaggaggtcggggggattccagtgccagccccgggactgctgcaggtaacggagaggagacagccactgagctctgtctcatccctggaagttcacttcgacctgctggatctcaccgagctcactgatatgtcagatcaggagttagcagaagtatttgcagatagcgacgatgagaacctgaataccgagagtcctgccggtctgcaccctttgccacgggccggctatctgagaagtccgtcatggacaagaactcgtgccgaacaaagccacgagaagcagcctctgggggaccccgagcgacaagccaccgttctagacacatttctgactgtagagcgcccacaggaggactag

SEQ ID NO: 24875 - DNA, 540 bp, Artificial Sequence
  Description of Artificial Sequence: Synthetic coding sequence
atgaccgacctggtggccgtgtgggacgtggccctgagcgacggcgtgcataaaattgaatttgaacacggcactacatccggcaagcgggtggtgtatgtggatggtaaagaggaaattcgaaaagagtggatgtttaagctagtcggtaaggagactttttacgtgggagcggctaagactaaagcgactatcaatatcgatgccatcagtggcttcgcatacgagtacacactcgaaattaatggcaaaagtttgaagaaatacatggaggatcgttccaagaccaccaatacttgggtgctccacatggacggagagaacttcagaatcgtgctggagaaagatgcaatggatgtctggtgcaacgggaaaaagctagaaactgctggcgagtttgtagacgatggtactgaaacacatttttccattgggaatcacgactgctacattaaggccgttagtagcgggaagcgcaaggagggcattatccacacactgattgtcgacaatcgagagatccctgagattgctagctag

SEQ ID NO: 24876 - DNA, 540 bp, Artificial Sequence
  Description of Artificial Sequence: Synthetic coding sequence
atgaccgacctggtggccgtgtgggacgtggccctgagcgacggcgtacacaaaatcgagttcgaacatggcaccacttctgggaagcgtgttgtgtacgtggatgggaaggaggaaattaggaaggaatggatgttcaagctggtgggtaaggagaccttctacgtcggagctgcgaagaccaaagccacaattaacatagatgcaatcagtggtttcgcctacgagtacacccttgagatcaacggaaaatccttaaagaagtatatggaggacaggtctaaaactaccaatacctgggtgctacacatggatggcgagaattttaggatcgtgcttgagaaggacgccatggacgtatggtgcaatgggaaaaaattagagaccgctggggaattcgtggatgatgggaccgagactcatttttcaatcgggaaccatgactgctatatcaaagccgtgtcttctggtaagaggaaagagggcataattcataccctgattgtcgataaccgggagatccctgaaattgcaagttag

SEQ ID NO: 24877 - DNA, 1053 bp, Artificial Sequence
  Description of Artificial Sequence: Synthetic coding sequence
atgggcccctgcaacctgagcagcgccgccggccccaccgccgagaagtctgtgccgtaccagagaacgcttaaggaaggccaggggacctctgtggtagcgcaaggtccctctcggcctctgccgtccacggccaacgtagttgtcatcggcggagggtccttaggctgtcagacgctctatcacctcgcgaagctgggaatgtcgggtgctgtccttctggaacgagaacgcctgacgtctgggacaacttggcatactgcaggtctgctatggcagctacgcccctccgacgtggaggttgaactgttggctcacactaggagggttgtgagcagggaacttgaagaggaaactggactgcacacaggctggatacaaaatggtggtctttttatagcctccaacagacagaggttagatgagtacaaacgcctgatgtccttgggaaaggcctatggagttgagtcgcacgttctgtctcctgccgagactaagaccctgtatcctctcatgaatgtagacgacttgtacgggacactctacgtgccccacgatggtaccatggacccagccggcacatgcactaccctagcccgagcagcatcagcccggggggcccaggtgattgagaattgtcctgtaactggcattcgagtttggaccgatgattttggggtgcgccgcgtcgctggagtggagacccagcacgggagcatacaaaccccatgtgtagtcaattgcgcgggggtctgggcctcagcagtaggaaggatggccggagtcaaggtccccctggttgccatgcaccacgcatacgtggtgactgagcgcatcgaaggtatccagaatatgcccaatgtccgggatcatgatgcctcagtgtatctccggcttcagggtgatgcactgagcgtaggtggatacgaagccaacccaatattctgggaggaagcagttaaatatagaccacgcgcagcagggggcttatgccttaagacaagtactgaaaaagtgtgtgctgtgtggtcagatgacctcagacgtgcatag

SEQ ID NO: 24878 - DNA, 2001 bp, Artificial Sequence
  Description of Artificial Sequence: Synthetic coding sequence
atggcccgggccggcagctgcggcggcgccgccgccggcgccggcaggcccgagccctgggagctgagtcttgaggaggtcctcaaggcatatgagcagcctttaaacgaggagcaagcatgggccgtgtgctttcaggggtgccgggggctcagaggaagtcctggccggcgcctgagggataccggggacctgctccttagaggcgatgggtcagttggtgctagggagccagaggccgctgaaccagcaacaatggtggtgccactcgcatcgtcggaggcacagactgtacaaagcctgggcttcgctatctaccgtgcgctcgactggggtcttgatgagtcggaagaacgtgaactcagccctcaactggagcgtctgatagacctcatggccaataacgattccgaagacagtggctgcggcgccgctgacgagggctacggaggacccgaagaggaagaggaagccgaaggggtgcccaggtcggttcgtacctttgcgcaggccatgagactgtgcgctgccaggctgacagatcctcgcggagcacaggcccattatcaagccgtctgtagagcactgttcgtggaaaccctggagttaagagcttttctggctcgggtgagagaagccaaagaaatgttacagaagctgagagaggatgagccccacctcgagacacctagagcagagctggacagcctcggtcacacagattgggcaaggctgtgggttcagctcatgcgagaactcagaaggggggtcaagcttaagaaggtacaggagcaggaatttaatcctctaccgacagagtttcagctcacaccattcgagatgctgatgcaagatattcgggcccgcaattataagttacgcaaggtcatggtcgacggcgatattccgccaagggtcaagaaggatgcacacgagctcatcctcgactttatcaggagtaggcctccattgaagcaggtaagcgagaggcggcttcggcccctaccacctaaacagcgctcactccatgaaaagatcctggaggaaataaagcaggaacggaggctgaggcccgtcagaggggaaggatgggcagctagaggctttggctcgttaccctgtatcttgaacgcatgtagcggcgatgctaagtctacctcctgcatcaatttgagtgtgacagacgcgggagggagtgcacaacgtccacgtccgcgagtactgcttaaggcccctacactcgccgagatggaagagatgaacacttcagaagaggaggagagtccttgtggtgaggtcacccttaagagggatcgctcttttagtgagcatgatctggctcagcttcggagcgaggtggcgtccgggctgcagagcgccacccaccctcctggtgggacagagcccccgcgcccacgcgccggtagtgcccatgtttggcgacccgggagcagagatcagggcacctgtcccgcctccgtaagcgaccctagccaccctttgctgagcaaccggggatcgtctggagataggcccgaggcatcaatgaccccagatgccaaacatttatggctcgagtttagccaccccgtcgagtcactggccctaactgtcgaggaggtgatggatgttaggcgcgtattggtcaaggcagagatggagaaattcctgcagaacaaggagctattctcctcactgaagaagggaaagatctgctgctgttgtagggccaagtttccactcttcagttggccgcctagctgcctcttctgcaagagatccctccagggcccccagtggcaatctgtggaagaagcctttcctcatatatacagccacggttgcgtgttgaaagacgtgtgttcagaatgtacaagttttgtcgctgacgtagtgaggagctctcgcaaatctgtggacgtcctgaacaccactccgcgacgcagccggcaaacacaatcattgtacataccaaatacacggacactggactttaaatag

SEQ ID NO: 24879 - DNA, 474 bp, Artificial Sequence
  Description of Artificial Sequence: Synthetic coding sequence
atggagaccctgcagagcgagaccaagacccgggtgctgcccagctggctcacggctcaggtcgccacgaaaaacgtggcacctatgaaggcccctaagcggatgaggatggctgcagtgccagttgccgccgccaggttgccagccacaaggacagtgtattgcatgaacgaagccgaaatcgttgacgtcgccctcggaatccttatcgagtcccggaaacaagagaaggcctgtgagcagcccgcgctcgctggcgcagacaatcctgaacattcgccaccctgttcggtatcaccgcatacgagttctggctcctcgagcgaagaagaggatagtggtaagcaggcacttgctccgggtctcagcccctcacagcgccccggcggatctagtagcgcttgtagtcgcagccccgaagaggaggaggaagaggatgttttgaaatacgtaagagaaatcttcttcagctag

SEQ ID NO: 24880 - DNA, 804 bp, Artificial Sequence
  Description of Artificial Sequence: Synthetic coding sequence
atggccaactgcgagcggaccttcatcgccatcaagcccgacggcgttcagcgcggtcttgtgggtgagatcatcaagagatttgagcagaagggcttcagacttgtcgggttaaagttcatgcaggcttcggaggacctcctgaaagagcactacgtggacctcaaggaccgcccttttttcgcaggtctcgtaaaatacatgcacagtggcccggtggtggccatggtttgggaggggctcaatgtggtgaagacggggagggtcatgctgggcgagactaatcctgcagattccaagcccggtaccatcagaggtgacttctgtattcaagtagggcgcactatggccaacctcgaacggaccttcatagccatcaagccagacggagtccagcggggacttgtaggcgaaatcatcaaacgattcgaacagaagggatttcggctggtcgctatgaagttcctgcgggcttcagaagagcacctgaaacagcactatatcgatctcaaggatcgcccattcttccctggcctcgtaaaatatatgaactcaggcccagtcgtcgcaatggtctgggagggcctgaatgttgtgaagactgggagagttatgttgggggaaactaatcctgctgactccaaacccggtaccattcggggggatttctgtatccaggtgggccggaacatcattcacgggagtgatagtgtaaagtccgcagagaaggagatttccctttggtttaagcccgaggagctggtggactacaagagctgtgcccacgactgggtttacgagtag

SEQ ID NO: 24881 - DNA, 879 bp, Artificial Sequence
  Description of Artificial Sequence: Synthetic coding sequence
atggtgctgctgagcaccctgggcatcgtgttccagggcgagggcccccccatctcatcctgcgacaccggaaccatggctaattgcgagagaacatttattgcaatcaaaccggacggagtgcagcgcggcctcgtgggtgagatcattaaaagattcgaacagaaggggtttaggctagtaggtcttaagttcatgcaggcaagtgaggatctgctgaaggagcattatgtcgacttaaaagaccgaccattctttgcgggtctcgtgaagtacatgcattccggccccgtagtcgccatggtgtgggaaggcctgaacgtggtcaagaccgggagagtgatgttgggtgagacaaatccagccgatagcaagccgggaaccattcgaggagacttttgcatccaagtcggaaggaccatggcaaacctggagaggacatttatagcaatcaagcccgatggggtccagaggggtttggttggagaaattatcaaacgcttcgaacagaagggatttcggctagtggccatgaaatttctgagggcttctgaagagcatttgaagcaacactacattgaccttaaggaccgtccctttttccccggactggttaaatacatgaactctggccccgtcgtggccatggtgtgggaaggcttgaatgtggtgaagactggaagagtgatgctgggcgaaaccaaccctgctgacagcaaacccggaaccatcagaggcgacttttgtatccaggtggggagaaacattattcatggctcagactcagtgaaaagcgctgaaaaagaaatatccctttggttcaagccagaggagctggtcgactataagagctgtgcacatgactgggtgtacgagtag

SEQ ID NO: 24882 - DNA, 492 bp, Artificial Sequence
  Description of Artificial Sequence: Synthetic coding sequence
atgaagagcagccagaccttcgaggagcagaccgagtgcatcgtgaatacactcttaatggacttcctgagtccaactctgcaggtggcatcaagaaatctctgttgtgtcgatgaggtggacagtggagagccttgtagcttcgacgtggctattattgccgggcggttgagaatgctgggcgatcagtttaatggcgagctggaagcctctgctaaaaacgtgatcgctgagacgatcaaaggacagaccggggctattcttcaggatacggtggagagcttgtctaagacctggtgtgcgcaagactcttctttggcttacgaacgggcttttcttgctgtgtccgtgaaactcttggagtatatggcccatatcgcacccgaggtggtggggcaggtagccatccctatgactggcatgatcaatggcaaccaagcaatccgggaatttattcaagggcagggaggctgggaaaacctagaaagctag

SEQ ID NO: 24883 - DNA, 558 bp, Artificial Sequence
  Description of Artificial Sequence: Synthetic coding sequence
atgggcaagaagcagaacaagaagaaggtggaggaggtgctggaggaggaggaagaggagtacgttgtagagaaggtgttggacagacgagtggtcaaggggaaagtcgaatatcttctcaaatggaaaggattctccgacgaggataacacttgggaaccggaggagaatctcgactgccccgacctgattgccgagtttcttcagtcccaaaagaccgcacacgagactgacaaaagcgagggaggaaaacgtaaagctgacagcgactcggaggacaaaggagaggagtccaaacccaagaaaaaaaaagaagagtccgagaagccgcgcggatttgcacggggcctggaacccgagagaatcataggcgccaccgactccagcggggagctgatgttcctcatgaagtggaagaacagtgatgaagccgacctggtccctgcaaaggaagccaacgttaagtgtccccaggtcgtgatctcattctacgaagagaggctgacttggcactcttatccttctgaagacgatgacaagaaggatgataagaactag

SEQ ID NO: 24884 - DNA, 1350 bp, Artificial Sequence
  Description of Artificial Sequence: Synthetic coding sequence
atgatgctgggcaccgagggcggcgagggcttcgtggtgaaggtgcggggactcccatggagctgttccgctgacgaggtgcagcgattcttctccgattgcaaaattcagaatggcgcccaaggcatcaggtttatatacaccagagagggacgcccctccggtgaagcctttgtcgaactggaatccgaagacgaagttaaactggcactgaagaaggacagagagaccatgggacaccggtacgtagaagtgtttaaatctaacaacgtggaaatggactgggtgctgaaacatacgggacctaactctcccgacaccgccaatgatggctttgtgcgcctgcgcggcctgcctttcgggtgctccaaggaggagattgtgcagttttttagtggcttggaaatagtccctaacgggatcaccctgccagttgactttcaaggacggtcaacaggtgaagcgttcgtgcagttcgcatctcaagagatagctgaaaaggctctgaaaaagcacaaggaacgaatcgggcatagatatattgaaattttcaagtcaagcagagctgaggtaagaacccattatgatcccccgcgcaaacttatggctatgcaaagacctggcccctacgataggccgggtgccggaagaggctacaatagtattggcagaggtgcaggttttgagaggatgcggaggggcgcgtacggcggcgggtacggcggttacgacgattataacgggtacaatgatggctacgggttcgggtcagatcgctttggccgagacctgaactactgtttttctggaatgtccgatcaccggtacggcgacggcgggtctaccttccagtcaacaaccggccattgtgtgcatatgaggggcctgccctatcgggccaccgaaaacgatatctacaatttcttttcgcccctgaatcctgtgagggtgcacattgaaatcggacccgatggaagagtaactggtgaggctgacgtcgagttcgccacccacgaggatgctgtcgccgcaatgtcaaaagacaaagcgaatatgcaacataggtacgtcgagctcttcttgaattccactgccggagcgtccggcggcgcgtacgaacaccggtacgttgaactctttcttaactcaacagcaggggcgtccgggggggcgtatggatcacagatgatgggaggcatgggactatcaaatcagtcctcttatgggggccctgcatcacagcagctgagtggcggatatgggggagggtatggaggacaatcatctatgtccggctatgatcaggttttgcaggagaactcttccgacttccagtctaacattgcctag

SEQ ID NO: 24885 - DNA, 741 bp, Artificial Sequence
  Description of Artificial Sequence: Synthetic coding sequence
atgagcggcgccggcgaggccctggcccccggccccgtgggcccccaaagggtcgccgaagctggcggaggacagctgggatccaccgcccagggcaagtgcgacaaagacaacacggaaaaagacatcacacaggctaccaatagccacttcacccacggagagatgcaagatcaaagcatttgggggaatcccagcgacggcgagttgatcaggacacagccacagcgcttaccacagctccagacatcagctcaagtgccgtctggcgaagaaatcggcaaaatcaagaatggccacaccgggctctccaacggaaatggcattcatcacggtgctaaacacggcagtgcagataataggaagctgtccgcgcctgtgagtcagaaaatgcatcgcaagatacagtctagcctttcagtcaattctgacataagcaagaagtccaaagttaacgcagtgttttctcaaaagactggtagctcgcccgaggactgttgtgtgcactgcatcctcgcctgcttattctgtgagttccttaccctgtgcaacatagtgcttggtcaagcttcgtgcggtatctgtacctcggaggcatgttgttgctgttgcggggatgaaatgggagatgattgcaattgtccgtgtgacatggattgtggcataatggacgcatgctgcgaaagttctgactgtcttgaaatctgtatggagtgctgcggaatatgctttcccagctag

SEQ ID NO: 24886 - DNA, 30 bp, Artificial Sequence
  Description of Artificial Sequence: Synthetic coding sequence
atgagctactaccagcggcccttcagctag

SEQ ID NO: 24887 - DNA, 2001 bp, Artificial Sequence
  Description of Artificial Sequence: Synthetic coding sequence
atgaacaccggccgggacagccagagccccgacagcgccaagggcttccgctcggtgaggccaaatttgcaggacaagaggtctcctactcaaagtcagatcaccgtaaatggcaactctggtggcgctgtatcaccaatgagctattatcagcgaccgttctcgccttctgcctactctctaccagcgagcctgaactctagtatcgtgatgcagcacggcacctccctcgatagtaccgacacttatccgcagcacgctcagtccctggatggcacaaccagcagtagcattccgctgtacaggagttccgaagaagagaagagagtgactgtcatcaaagccccccactaccccggcattggaccagtcgatgaatctggaatccccaccgccatcaggacgaccgttgatagacctaaggactggtataagaccatgttcaaacagatacacatggtgcacaaaccggacgacgataccgacatgtataataccccttacacctacaatgctgggctatacaatccaccgtactcagctcagtctcatcctgctgcaaagacccagacatataggcccttaagcaagtctcatagtgacaacagtcctaacgcgttcaaggatgcctcctcacccgttccaccaccccatgtgcctccaccagtacctccacttcgcccaagagatagaagttcgactgaaaaacacgattgggatccccctgaccggaaagtggacacacgcaaattcagatccgagccccggtcaatctttgaatacgagcctggtaaatcttcaatcttacagcacgaacgacctacagatagaatcaatccagacgacattgatctcgaaaacgagccctggtacaaatttttctcagaacttgaatttggtcgacctccacctaaaaaacccttggactacgtgcaggaccactcctccggggtgtttaacgaggcaagtctgtatcagagcagcattgatagaagtctggagagacccatgagcagcgcgtccatggcctctgacttccgcaaacggcgcaagagcgaacccgctgtagggcctcccagagggttaggggaccaatccgcatcgcgtaccagtccagggagggtggacttaccaggaagttcaaccaccttaaccaagagcttcacgtcctctagcccttctagtccatcccgtgcaaaagatcgcgagagccctcggtcttattcttccaccctaacagacatgggacgctccgcaccccgtgaaaggcgggggacgcccgaaaaggagaaattgcccgccaaagcagtgtacgatttcaaggcccaaacatctaaggaactaagcttcaagaagggcgataccgtgtatatcctcaggaagattgatcagaactggtacgaaggtgaacaccacggacgcgtaggaattttccccatctcttacgtagagaaactgacccctccagaaaaggcacagccagcccgacctccaccacccgcccagccaggtgaaatcggtgaagcaattgccaaatacaatttcaatgctgatacaaatgtagagttgagcttaaggaagggagatagagtgatcctactgaaaagagtggatcagaactggtatgaagggaagattccaggtaccaatcggcaagggatttttcccgtgtcctatgtggaggttgtaaagaagaacaccaagggggctgaagactatccagatccacccatcccccattcctacagttctgataggatacactcactatcatccaataagcctcaaagaccagtgtttacacatgagaatattcagggcgggggagagcctttccaggccttgtacaactatacaccaaggaatgaggacgaattggagctccgggagagtgatgtgatcgatgtgatggagaaatgcgatgacggttggtttgtcggcacatctcggagaaccaagttttttgggacttttcccggaaattatgtaaaacggctgtag

SEQ ID NO: 24888 - DNA, 2472 bp, Artificial Sequence
  Description of Artificial Sequence: Synthetic coding sequence
atgaccctgctgagcagccagagcagcagcctggtggcccccagcggatcggtctccgccgagaacccagagcagaggatgctggaaaagcgcgcaaaggtgattgaggaactactccagacagaaagagattatataagagatttggagatgtgtattgagcgtatcatggtgcccatgcagcaagcccaggtgccaaatatagatttcgaagggttatttggcaacatgcaaatggtcataaaggtgagtaagcaactgttagctgccctcgagataagcgacgccgtgggccctgtgtttctgggacatagagatgagttagaagggacctataaaatttactgtcagaaccacgatgaggctattgccctgctcgagatttatgaaaaggacgagaagatccagaaacatctccaggacagcctcgccgatttgaactctctagtgttgaagaagggatgtaccaattacataaacttgggttcttttttaatcaaacctgttcagcgcgtgatgcggtatccactgctgttaatggaactgctgaattcaactcctgagtcacacccagacaaggtcccactcaccaatgccgtcttagcagtgaaagaaatcaacgtgaatataaacgagtacaaacggcgcaaagacttggtgctcaagtatcgcaaaggggatgaagattctctgatggagaagatttctaaactgaatatccattccattattaagaagagcaatagagtgagttcccaccttaagcatctgaccgggttcgcaccacagatcaaagatgaggttttcgaagaaactgagaagaattttcggatgcaagaaagactgatcaagtcctttattcgagacctgtctctgtatctccagcacattcgagaaagtgcctgcgtgaaggtcgtggccgcagtctccatgtgggatgtctgcatggagcggggccatagggatctcgaacagttcgaacgcgtccatagatatatttccgatcagctttttaccaacttcaaggaacgaactgagcggctggtaatttctcctctgaaccagctcctgtccatgttcaccggaccccataagctggtgcagaaaagatttgacaaactactggacttctacaattgcacagagagagcagaaaagctgaaggacaaaaagactctcgaggagctacagagcgcccgaaacaattatgaagcacttaatgcccagttactcgacgagctgccgaagtttcaccaatatgcgcaaggcctgtttacaaactgcgtgcatggatatgccgaggcacactgtgacttcgtgcatcaagctttggaacaactgaaaccgctcctgtccctcctgaaagtcgccggtcgggaaggcaacctcattgcaatctttcacgaagagcactcccgggtgctccagcagctgcaggtgtttaccttcttcccggaaagcctccctgctacaaagaaaccatttgagaggaaaacaatagatcggcagagtgcacgtaaacccttgcttggccttcctagttacatgctgcagagtgaagaactgagagcatcgttgctcgcacggtatcctcctgaaaagctcttccaggcggagagaaactttaacgccgcacaggacctggacgtctccctgttggagggcgatctggttggtgtcataaaaaagaaggatcccatgggatcccagaatcgctggctcatcgataacggagtgaccaagggcttcgtctacagttctttcctgaagccttacaatccaagacgctcccactctgatgcttcggtgggcagccacagtagtacagaaagcgaacatggaagcagtagtccgagatttcccaggcaaaattcggggtctacactgaccttcaatccaagctcaatggccgttagttttacttctgggtcatgccagaagcagccccaggatgcctcacctcctccgaaggagtgtgaccagggaactctgagcgctagcctgaacccttcaaactctgaatcctccccaagtcgttgcccctcagatcctgactccacaagccagccaagatccggggattcggcggacgtcgctagagatgttaaacagcctaccgcaacgccacggagttatcggaatttcagacaccctgagatcgtcggctactccgttccggggagaaatggccagtcacaggacctggtgaaaggatgcgcccgcacggctcaagccccggaggatcgttctacagaaccggatggtagtgaagcagaaggaaaccaggtgtattttgcagtttacacctttaaggcccggaatcctaacgagctgtctgttagtgccaaccaaaagcttaaaattttggagttcaaggatgttactggtaatacagagtggtggttggctgaagtgaacggaaagaaagggtatgtgccctccaactatatccggaaaaccgaatatacatag

SEQ ID NO: 24889 - DNA, 2964 bp, Artificial Sequence
  Description of Artificial Sequence: Synthetic coding sequence
atggccgagagcagcagcgagagcgaccacttccggtgccgggaccggctgagtccctgggccgcccgtagtacccatcggggcaccaggagtctacctaccgtggaggtgaccgaaaaggtcaataccatcacttcaacgctacaggatacttcccggaaccttagacaggttgaccagatgctgggccggtatagggagtactcaaatggccaagccggggccatcgagcacttgaaggaaagtctggagcaatctatagatcagctgcgaagtcagagactgctgagaaatagtgggggacgcagcatctccgtgaccagcctgtcagcttccgatctcgatggcgggaccggttccgagctacaccatttcccccccactagccctcttaaagactacggggacccccaaggaatcaaacgaatgaggtctcggaccggcgttagattcgtacaggagacagacgacatgacacagctgcacggcttccatcagtcacttagggacctctcttctgagcagattaggcttggcgatgacttcaatagagagctgtcacgccgctctaggagtgacgctgagactaaacgcgccctggaggaactgaccgaaaaacttaacgaggcccagaaacaggaagtagtatccgaccgggtggagagaaggttacaggaactggaacgcgagatgaggacagaaagagaactagtagaaagacggcaagatcaactcggcctgatgtcgctccagctccaggaggccctaaaaaagcaagaggcgaaagcggatgaacacgagggggctataaagaataaactgaggcagaccgaaaccgaaaaaaatcagctcgagcaggaactcgagctatcacgtaggttgctcaaccagtccgaagggtcccgcgaaaccctactccatcaagtagaagaactcagaacccagctcacaaaggcagaaggcgaccggaaaggccttcaacaccaggtgtctcaaattagcaaacagcaatcgaactatcaggacgaacagggcgaggactggaggtttcgtcggggggtggaacgggagaaacaggatctggagaaacaaatgagcgaccttcgtgtgcagcttaatttttcagcaatggctagcgagctggaggaggttaagcgctgcatggagcgcaaagacaaggagaaggcccaccttgcttcccaagtggaaaatttgaccagagagctggagaacggcgagaaacagcagctccaaatgcttgaccgcttgaaagagattcaaaaccactttgatacgtgcgaggcggagagaaaacacgccgacctgcaaatttccgaactaacccggcatgccgaggatgccaccaaacaggccgagaggtatctcagcgaacttcagcaatctgaggcactgaaggaggaggctgagaagagacgggaggatttgaagctgaaagctcaggagtcaatcagacagtggaaattaaaacacaagaaacttgagagagccttggagaagcagtctgaaacagttgatgaactgaccggcaagaataaccagatactgaaggagaaggacgagcttaagacccagctgtacgcagctctccagcaaattgagaatctacgaaaggaactgaatgatgtactgaccaaaagagccttgcaggaggaagagcttcactctaaagaggagaagctacgggacatcaagagccaccaggctgacttagagctggaagtcaaaaacagccttgacaccatccatagactggagtctgaacttaagaaacagtccaaaattcagtcacagatgaaagtggagaaggctcacttagaggaggagatcgcggaactcaagaagagtcaggctcaggacaaggctaagctacttgagatgcaagagtccatcaaggacctctctgcaatacgggcagatctggccaacaaactcgccgaggaggagcgcgccaaaaaagccgtccttaaggatctgagcgacctcactgcccaggccaagtctcgagacgaagagaccgcaacgataatcacccagctgaagctggagagagatgtgcatcagcgtgaattgaaggacctcacctcctccctacagagcgtgaaaacgaaacacgaacaaaatattcaagagctgatgaaacatttcaagaaggagaaatccgaagcagaaaatcacatccggacacttaaggcagaatcactcgaagagaagaatatggctaagatacaccgcggccagctggagaaactgaaatcacagtgcgatcgtttgacagaagagctgacccagaacgagaatgaaaataagaaattgaagcttaaataccagtgtctgaaagaccagttggaggaaagggagaaacacattagtatcgaagaggagcacctccggcgaatggaagaggctcgattgcagcttaaggaccagcttctgtgtctcgaaacagaacaggaatccattttgggggtgatagggaaagagatagacgctgcatgcaagacattctctaaagactctgtggaaaaactgaaagttttttcctccggaccagacatacattacgatccccaccgatggctggcagaatccaaaaccaaattgcagtggctgtgtgaggagctgaaggaacgtgagaaccgcgaaaaaaatttgcggcaccagctgatgctgtgtagacagcagctgcgaaatctgacagaaaacaaggagtccgagctccaatgcctgttccaacaaattgagcgccaggagcagctgctcgatgagatccatcgcgaaaagcgcgacctgctggaagaaactcagaggaaagacgaggagatggggagtcttcaggacagggtgattgccctggagaccagcacacaggtcgctctcgatcaccttgagtccgttccagagaagcttagccttctggaagacttcaaagattttagacgatag

SEQ ID NO: 24890 - DNA, 5157 bp, Artificial Sequence
  Description of Artificial Sequence: Synthetic coding sequence
atgagcggcaccagcagccccgaggccgtgaagaagctgctggagaatatgcagtcagatctgcgggcgctctccttggagtgcaagaaaaaatttccccccgtcaaggaggcggcagagagcggcattataaaggttaaaactattgccgcccggaacaccgagatactggccgccctgaaagagaacagtagtgaggtagtccaaccattcctcatgggatgtggcacaaaggaaccaaaaatcactcaactatgtctggctgctattcagcgcctcatgagtcatgaggttgtgagcgaaactgcagctgggaacataatcaacatgctgtggcagctgatggagaactccctcgaagagctgaaactccttcagactgtattagttctgcttaccacgaataccgtggtgcacgacgaagccctctctaaagcaatcgttctctgctttagactgcacttcacaaaagataatatcacaaacaacacagccgccgctactgtgcggcaggtcgtgacagttgttttcgaaaggatggtggcggaggacgaacgccaccgggatatcattgagcagcccgtgctagtgcagggtaatagcaaccgaaggagcgtgtctactcttaaaccatgtgccaaagatgcctacatgctcttccaagatctgtgccagttagtaaacgcggatgccccctactggctcgtggggatgactgaaatgacgaggacctttggcttagagttactggaatcagtgctgaatgatttcccccaggtcttcttacagcatcaggaattcagttttttgttgaaggaacgcgtctgccccctggtgatcaaattattcagcccaaacatcaagttccgtcagggatcttctacatcctcgtcacctgcaccagtcgagaagccatacttccctatctgtatgagactgctgagggtcgtgagcgtcctgatcaaacagttttacagcctgttggtcaccgaatgcgagatattcttgtctcttcttgtgaaattcctagacgccgacaagccgcagtggttgagggctgtggctgtggaatctatccatcgtttctgcgtccagccacagctgcttagatctttttgccagtcttatgatatgaagcaacatagcaccaaagtttttcgggatattgttaatgccctaggtagcttcatacagtctctgttcctcgttccccctacaggaaacccagccacgtccaatcaagctggcaacaacaatctgggcggttctgtctccgcccccgcaaattcgggcatggtgggcatcggtggcggggtaacactcctgcctgccttcgaatatcgcggcacctggatccctatcctgaccatcacagtgcaggggtcggcaaaggctacttatttggagatgctggacaaggttgaaccacctaccatccccgaagggtatgctatgtctgtcgcctttcactgtcttctggacctggtgaggggcattacaagtatgatcgagggggagctcggggagcttgagacagaatgccagaccacgactgaagagggctccagtcctacccagtccacagagcagcaggatttgcagtctacgtccgaccagatggataaagagatagtgagtagagccgtgtgggaggaaatggtaaatgcctgctggtgcggcctactagccgctctgtccctgctcctggacgcctcaacagacgaggccgctaccgagaatatattaaaagcagagcttacgatggcagcgctgtgcggacgtctgggcctcgtgacctctcgggacgctttcatcaccgccatctgcaaggggtctttgcccccacactatgccctcacagtgcttaacaccactaccgccgctaccctgagtaacaagtcatactccgttcagggtcagtccgtgatgatgatctctcccagctctgagtcccatcagcaggtcgtggccgtggggcagcctctggcagtgcagccacagggcacagtcatgcttacaagcaaaaacattcaatgtatgcgaacattactgaatctggcccactgtcatggcgccgtactcggcacctcctggcaactggttctggccactctccagcatctagtatggatcctgggactaaaaccctccagcggcggggccctgaaaccgggtcgggccgtggaggggcccagtactgtgttgactacagcggtgatgaccgatctgcctgtcatatcgaacatcctttcaaggttgttcgagagcagccagtatctggatgatgtctccctgcatcacttgattaatgctctctgttcattaagccttgaggcgatggacatggcctacggtaacaataaagaaccttcgctgtttgcagtggccaagctcctggagactggactggtgaacatgcaccgcatagagatcctctggagaccccttactggacacctgctggagaaggtttgccagcatcccaatagtcggatgcgtgaatggggggctgaggctctgaccagcttgattaaggccggcctgacgtttaatcatgaccctcccctcagccaaaaccagcggttgcagctgcttctattgaacccactgaaggaaatgagtaacatcaatcatcccgatattcgcctgaagcagcttgaatgtgtgttgcagattttgcagtctcagggtgattcactgggccctggctggccactggtccttggggtgatgggcgcaatccgtaatgaccaaggagagtcgctgataagaacagcatttcagtgtcttcagctggtggtcaccgattttctccctactatgccttgcacctgtctgcaaatcgttgtggacgtggctggctcgtttgggctccataaccaggagttaaatatcagccttaccagtatcggtttgctctggaatatttccgactacttcttccagagaggagagaccattgaaaaggagctgaacaaagaagaggctgcacagcagaaacaggctgaggagaaaggagtcgtattgaatcgccctttccaccccgccccccccttcgactgcctgtggctgtgcctttacgctaagcttggcgagctttgtgtcgacccccgcccggctgttaggaagtcagccggtcagaccctcttttcaacaattggggctcacggcaccttattgcagcactctacttggcacactgtcatttggaaggtcctttttcatctgctggaccgcgtcagagaatcgtcgacaaccgccgataaggagaagatcgagagcgggggtggcaacattcttatccatcatagcagagacactgcagaaaaacagtgggctgagacttgggtgcttacactggcgggcgtggcccggatcttcaacacaaggaggtacctgcttcagccactgggggatttcagccgtgcctgggacgtgttgctggatcacatccagagcgcagccctgtccaaaaataatgaagtctcacttgcggcgctgaaaagtttccaagaaatcctccagattgtctccccggtgcgggacagtgataagccagagacaccaccggttgtgaacgttccggttcccgtcttaatcggaccaatcagcgggatgagccgaccctttgtgcgcacggacagtataggcgaaaagctcggccggtattcctcaagcgaacccccaattgtgaccgacgagctagaggatctcaacctgtggtgggccgcctggaacacgtggtacaggatcgggagtgaaagtaccaaacccccgattacattcgataagctgaccttcattcccagtcaaccctttctcacagcactgatacagatcttccccgcactgtaccagcacattaaaacagggtttaacatggacgatttacagaagctgggagtgatcctacactctgctatcagtgtgccaatctcctctgatgccagcccctttatattgccaagctacactgaggccgtgctgacgtcactgcaagaagcagtcttaaccgcgctggatgtcttacaaaaggctatttgtgtggggcctgaaaatatgcaaatcatgtatcccgccattttcgatcaactgctcgcctttgtggaattcagctgcaagccacctcaatacggccagctggagacgaagcatatcgccaatgctaagtacaaccagattcagcttttcgccccggctgagtgggtggccctcaactatgtaccctttgctgagcgcagcctggaagtggtagtcgacctgtaccaaaagacagcgtgtcataaagctgtggtaaacgaaaaagtgcttcagaacatcatcaaaactctcagagtgcctctcagcctgaagtacagctgtcctagtgagtccacttggaaattggctgtctctagcctcctccgagtgctgagtataggcctgcccgttgctcggcagcatgccagctccggtaaattcgattctatgtggcctgagctggccaataccttcgaagactttttattcaccaaatctattcctcccgacaacctgtccattcaggaattccagaggaatgagaatatcgacgtggaagttgttcagctcatctctaacgaaatcctgccctatgcaaactttatcccaaaagagttcgtgggtcaaataatgaccatgcttaataagggctccattcactcacagtcttctagttttactgaggctgagattgatatccgattacgcgaggagttctccaagatgtgtttcgaaacactcttgcagtttagcttttccaacaaggtgaccaccccccaggaaggctatatctctcggatggccctctcggtcctgcttaaacgcagccaggatgtcctacatagatatattgaagacgaacgtctcagtggtaagtgtcctctgccaaggcaacaggttactgaaattatcttcgtgttaaaggcagtgtcgaccttgatagactcccttaagaagacccaaccagagaacgtggacggtaatacgtgggcacaggtgatcgcgctgtatcccacactcgtggaatgtataacttgctcctccagtgaggtctgtagcgccctgaaggaagctctcgtgccatttaaggactttatgcagccccctgccagtcgggttcagaacggcgagtcctag

SEQ ID NO: 24891 - DNA, 2100 bp, Artificial Sequence
  Description of Artificial Sequence: Synthetic coding sequence
atgagcagccggaaggtgctggccatccaggcccggaagcggcggcctaagcgagagaagcaccctaagaaaccggagccccagcagaaagcgccactcgtgcctcctcccccacctcctcctccacctcctcctccgcccttgcccgatccgacgccccctgagccagaggaggagatactaggaagcgacgacgaagagcaggaggatcctgcggactattgtaaaggtggctatcaccccgtgaagataggcgacttgtttaacggtagataccatgtgatcaggaagttgggctggggccatttcagcactgtttggctgtgctgggatatgcagggtaaacgatttgtcgccatgaaggtggtgaagtccgcacagcactatactgagactgctctagacgaaatcaagctgctcaagtgcgttagagaaagcgatccaagcgatccgaacaaagacatggtcgttcagcttatcgacgacttcaagatcagcggaatgaatggaatccatgtctgcatggtgtttgaagtgctcgggcatcacctgctgaaatggataataaagtcaaattaccaaggcttgcctgtgcggtgcgtcaagagcatcattaggcaagtgctgcagggcctggattatctgcactcaaaatgtaaaatcatccacaccgacatcaaacccgaaaacatcctcatgtgcgtggacgatgcctacgttcggagaatggccgcagaggctactgaatggcagaaagctggagcacctcctccaagtgggagtgctgtgtccactgccccccagcagaagcctatcggcaaaatatctaaaaataagaaaaagaagttgaaaaagaaacaaaagagacaggcggagctccttgagaaacgattacaagagatcgaagagctcgagagggaggcagaacgcaagattattgaggagaacattaccagcgctgcaccctctaatgaccaggatggggaatattgcccagaggtgaagctgaaaactaccggcctagaagaagccgcagaggctgagacagccaaagataacggggaggccgaggatcaggaggagaaagaggacgctgaaaaagaaaatatcgagaaagatgaggatgacgtggaccaggagctcgccaatatcgaccccacctggatcgagtctcctaagacaaacgggcatattgagaatggacccttttccctggaacagcagcttgacgacgaagatgacgatgaggaggactgccctaatcctgaggaatataacctggacgaaccaaatgctgaatcagactatacctattccagctcctatgagcagtttaacggcgagttgcccaatggtcggcacaagatcccagagagccagtttccagagttttcaacatccctgttctccggcagtctggaacctgttgcttgtggatcggtgctctccgaggggtcacctttgactgaacaggaagaaagctctccttcccatgaccgatccaggaccgttagcgccagtagtactggtgacctcccaaaagccaagactcgggcggctgacctgctggttaatccgctggatcccaggaatgcagataaaatccgggttaagattgccgatctcggcaacgcatgttgggtgcacaaacacttcaccgaggatatccagacccggcagtaccgctccatcgaagtgctgatcggtgccggatactctacaccagcagacatttggtccacagcttgtatggcattcgaactggccaccggggactatctcttcgaaccacattcaggtgaggactattctagagacgaggaccatatagcccacattatcgaattgttagggtctattccacgacattttgcattgagcggaaagtactctagagaatttttcaacaggaggggagagttgcggcacatcactaaactgaagccctggtcactcttcgacgtcctcgtggagaagtacggttggccgcacgaagatgctgcacagttcactgactttttgatccccatgctcgagatggtacctgagaagagagcttccgccggagagtgcctgcgccatccttggttgaacagctag

SEQ ID NO: 24892 - DNA, 1113 bp, Artificial Sequence
  Description of Artificial Sequence: Synthetic coding sequence
atgggcttcaaccggcccagcaagatccaggagaacgccctgcccctcatgcttgccgaaccacctcagaatctaatagctcagtctcagagtggaacaggcaagaccgcagctttcgtgttagccatgctaagtcaggttgaacctgcaaacaaataccctcagtgcctctgcctgtccccgacctatgagctggccctgcaaaccggaaaagtgatcgaacaaatgggaaaattttaccctgaactgaaattagcctacgcggttagaggtaataaactcgagcgcgggcagaaaattagcgaacagattgtgatagggacaccaggtacagtgttagactggtgctcgaagctcaagttcatagatccaaagaaaataaaggtgtttgtgctcgatgaggctgacgtgatgatagccacgcagggacatcaggaccagagcattcgcatacagcgcatgttaccgaggaactgtcagatgcttctctttagtgccaccttcgaggacagcgtgtggaaattcgctcagaaggttgtgcccgacccaaacgtaattaaattgaaaagagaggaggaaacgctcgatactattaaacaatactatgtgttgtgctccagcagagatgagaaatttcaggccctgtgtaatctatatggggctattacaattgcgcaagcgatgattttctgccacacaaggaagacggcaagctggctggctgctgagctgtctaaagagggccatcaggttgcactcttatccggggaaatgatggtggagcagcgggcagcggtgatagagaggtttcgagagggcaaagaaaaggtgctcgtgacaaccaacgtatgtgccagaggaattgacgtcgagcaagtttccgttgtgattaattttgatcttccggtggacaaggatggaaacccggataatgagacctatctgcataggatcggccgaaccggcagattcggtaagcggggactggccgttaacatggttgattccaagcactccatgaatatcctgaaccgaatacaggagcacttcaataagaagatcgagcgtctggacactgacgacttggacgaaattgagaaaatcgccaattag

SEQ ID NO: 24893 - DNA, 2640 bp, Artificial Sequence
  Description of Artificial Sequence: Synthetic coding sequence
atgttctggaagttcgacctgcacagcagcagccacatcgacacccttcttgaacgcgaggacgtgaccctgaaggaactgatggacgaggaagacgtgctgcaggagtgcaaggcccagaaccgcaaactgatcgaatttcttctgaaagcggaatgtttggaggatttagtgtcctttattatcgaagagccgcctcaggacatggacgagaagatccgctacaagtatccaaatattagctgcgaactcttaacaagtgatgtttcacagatgaatgatcgattgggtgaagatgagagcttactcatgaagctctattcattcttacttaacgacagcccactgaatcccctactcgctagttttttcagcaaggtgttaagcattctgattagcagaaaacccgagcagatcgtagacttcctgaagaaaaagcacgattttgtagacctcatcataaaacacattggaacctccgcaattatggatctgctgctgcgtctcctcacctgtatcgagcccccccagcctaggcaggatgtgctcaactggctgaacgaagagaaaatcattcaaaggctcgtcgaaatagtgcaccccagtcaggaggaggacaggcactcaaacgcctcacagagcctgtgtgagatcgttcgcctgtcgcgggatcagatgctgcagatacagaattccaccgagccagacccattgctggccacactggaaaaacaggagatcattgaacagctacttagtaatatcttccacaaagaaaaaaacgaaagcgcaatcgtgagcgcaatccagatcttgttgactcttctcgaaacgaggcgcccaaccttcgagggacacatagagatttgtccgcctggcatgagccattctgcctgttccgtgaacaagagcgtcctggaagccattcgagggcgcttaggctcatttcacgagctactccttgaaccgcctaagaaaagtgtgatgaaaaccacttggggcgttctcgatcccccggttgggaacaccagattgaacgtgatcagattaatctcgtccctgttacaaaccaatacctcctcaattaatggagaccttatggaattgaatagcatcggcgtgatactgaatatgttctttaagtacacatggaacaactttcttcacactcaagtcgagatctgcatcgcactaattttggcgagccctttcgagaacaccgagaatgctactattacagaccaggactccaccggagacaatctgttacttaaacatctgttccagaagtgtcagctcatagaaagaatccttgaggcctgggagatgaacgagaagaaacaggctgagggggggagaagacacggctacatgggccatctgacacgcatagctaactgcatcgtccactccaccgataagggacccaactccgcgctagtccaacaattgatcaaggaccttcccgatgaagttcgggagcggtgggaaacattttgtactagttcccttggagaaaccaacaaacgcaatacagtggatctcgtgacaacctgtcatatccactcttccagcgatgacgaaattgacttcaaggagactgggttctctcaggacagcagcctgcagcaagcgttctctgactaccagatgcagcagatgacaagcaactttattgatcagtttgggttcaacgatgagaagttcgccgatcaggatgatatcggaaatgtatctttcgaccgggtgagcgatataaacttcaccctcaatacaaatgaatctggaaacatcgctctgttcgaagcctgttgcaaggagaggatacagcagttcgatgatgggggttctgatgaagaggacatctgggaggaaaagcacatcgccttcacaccagagagccagcgtcgctcatcatccggctctaccgactcagaggagagtaccgatagtgaagaagaagacggcgctaagcaagacctcttcgagccaagtagtgccaacacagaagacaaaatggaagtcgacctttctgagcctccaaactggtctgctaattttgatgtgccaatggaaaccacccacggtgcaccgctggattccgtgggttccgacgtttggtctactgaggagcccatgcctaccaaagaaaccgggtgggcctctttttcagagtttacatcatctcttagcaccaaggatagcctgcgtagtaactcacccgtggaaatggagacaagcactgaaccaatggaccccctcactccctctgcggcagctctcgcggtccagcccgaggcagccggctcagtggccatggaggccagcagcgacggtgaggaagatgcggaaagcaccgataaagttaccgaaactgttatgaacggaggaatgaaggaaactttgtccctgacggtggatgccaaaacggaaaccgctgtgtttaagagactcctcggcggctgcagtgaagagggcaagctgtctaccagccaagatgccgcgtgcaaggacgccgaggagtgtccggagaccgcagaagccaagtgcgcagctcctcgtcccccaagtagcagtcccgagcagagaactggacagccatcggctccaggagatactagcgtgaatggccccgtgtag

SEQ ID NO: 24894 - DNA, 2622 bp, Artificial Sequence
  Description of Artificial Sequence: Synthetic coding sequence
atgttctggaagttcgacctgcacagcagcagccacatcgacaccttgctcgagcgtgaggacgttaccttgaaggaactgatggacgaagaggacgtgcttcaggaatgcaaagctcagaatagaaaactaatagaattccttctgaaggctgagtgtctggaagatcttgtgtcatttattatcgaagaacccccccaggacatggatgagaagatccgctataagtaccccaacatttcttgcgaactgctgacctccgacgtgagtcagatgaatgaccggcttggcgaagacgagagcctcctgatgaaactgtactcttttctgctgaatgacagccctttgaatcctctgctggcttccttcttctccaaagttctgagcatccttataagccgcaagccagagcaaattgttgacttccttaagaagaaacatgattttgtcgacctcatcattaaacatattgggaccagcgcaatcatggatttgctcctgagacttctgacatgcattgagcccccacaaccccgccaagacgtgttgaactggttgaacgaagagaagattatccagcgcctagtcgagatcgtgcacccttcacaggaagaagacaggcacagtaacgcgtcccaaagcctctgcgagattgtccgcctgtctcgcgaccaaatgttgcaaatccagaatagtacagagcccgatccccttctcgctactttagaaaagcaggaaattattgagcaactgctgtcgaatatttttcacaaagaaaaaaacgagagcgccattgtaagcgctatccagatcctgttgacactgctagaaacccgcagacctacctttgagggacacatcgagatctgtcctccaggaatgagccacagcgcatgctctgtgaataagtcagtgctagaggcgatcaggggacgattgggctcattccatgaactgttgttggagcctccaaagaaaagcgtaatgaaaaccacgtggggcgtactggaccccccggttggcaataccagactgaacgtgatccgcttaatttcaagtctgctgcagaccaatacttcttctatcaacggggacctcatggagctgaacagtatcggcgtgatattgaacatgttcttcaagtatacatggaacaatttccttcatacgcaggtggagatatgtatcgcactcattctggcgagccctttcgagaataccgaaaacgcaaccattacagaccaagatagtacaggtgataacctcctactgaagcacctgttccagaagtgccagctcattgagcgaatcctcgaggcctgggaaatgaacgagaagaaacaggcagaaggagggcgccggcacggctacatgggccacctgaccaggatcgcaaactgtatcgtccattcaacggacaagggaccaaactctgccctcgtccagcagctgatcaaggacttgccagatgaggtgcgggagcgctgggagaccttttgcacgagcagtttgggggagaccaacaaacgtaataccgtagatcttgtgactacttgccacatccactcatcttcagatgatgagatcgactttaaagaaaccggcttctcccaggactcatccctacagcaggccttcagcgactatcagatgcagcagatgacttccaattttatcgaccagtttgggttcaacgatgagaaattcgctgatcaggacgacatcggaaacgtgtcttttgatcgggttagtgatatcaattttaccctcaacactaatgagtccggtaacattgctctctttgaagcgtgctgcaaggagcgcattcagcaattcgatgacggagggagcgatgaggaagatatctgggaagagaagcacatcgcatttacaccagagagccagcggagatctagcagtggctccactgactccgaagaaagcacagatagcgaggaagaggatggagccaagcaggacctgttcgagccttcttcagcgaacaccgaggataaaatggaggtcgatctctcagaacccccaaactggtctgccaacttcgatgtccccatggagactacacatggcgctcccttagactcagtcggttcggacgtgtggagcactgaagaacccatgcccacaaaggaaactggctgggcgtccttctccgagttcacctcgtccctctcaactaaggactccctgcgctcaaatagccctgtcgaaatggaaacaagtacagagccaatggaccctctgacgccaagcgcagctgccctcgccgtccagcccgaggctgccggttctgtggcaatggaggcttcatccgatggggaggaagatgcggaatcaaccgataaagtgaccgagaccgtcatgaatggaggaatgaaggaaactttgtctcttaccgtcgacgctaagacagagacagccgtctttaagtctgaggaaggcaaactgagcactagtcaggatgctgcatgcaaagatgctgaggagtgccccgagacagcagaggctaagtgtgcagccccacgtcccccctctagctcccctgagcaacggaccggacaaccatccgcccctggcgacacctccgtgaatggtcccgtgtag

SEQ ID NO: 24895 - DNA, 2640 bp, Artificial Sequence
  Description of Artificial Sequence: Synthetic coding sequence
atgttctggaagttcgacctgcacagcagcagccacatcgacaccctcctggagcgagaagacgtgactttaaaggagctgatggacgaggaagatgttcttcaggaatgtaaagcacaaaaccgtaaactcatagaattcctgctcaaagccgagtgtctggaagaccttgtctcttttattatcgaggagccccctcaggacatggacgaaaaaatccgatataaatacccaaacatttcctgcgagctgctgacttcagacgtttctcagatgaacgatagactcggggaagatgagtctctgctgatgaaattgtactcttttctgctcaatgactcacccctcaacccattgttggcttccttcttcagcaaggtgctgagtatcctgatctctcggaaaccggaacagattgtcgatttcctgaaaaaaaagcatgattttgtggacctgatcatcaaacatattggcactagtgctataatggatctcctcctccgactcctgacatgtattgagccacctcagccaaggcaggacgtcctaaattggctgaatgaggagaagattattcaacgactcgtggagatcgtccatccgagccaagaagaggacaggcattcaaacgccagccagtctctctgtgagattgtacgcttgtccagagaccaaatgctgcaaattcagaattcgaccgaacctgatccgctgctcgcgactctcgagaagcaggagatcatcgagcagttactgtcgaacatttttcataaagagaagaacgaaagcgccattgttagcgcaatccagatactgctgaccttattggagacccggcgaccaactttcgaagggcatattgaaatatgtccccccggcatgtctcacagtgcctgcagcgttaacaaaagcgtccttgaggccatacggggccgcctcggctcctttcatgagctgctgctggaaccgccgaaaaagagtgtgatgaagaccacctggggagtcttggatccccccgtgggaaatactcggctcaatgtgatcaggcttatatccagtctgcttcagaccaacacaagctctatcaacggcgacctgatggaacttaattcaattggcgttattctcaatatgtttttcaaatacacctggaataactttctgcacacccaggtcgaaatttgcattgctctgattctcgctagcccctttgagaatacggaaaatgccacgatcactgaccaggactccacaggcgacaacctgctcttaaagcatctgtttcagaagtgtcaactgattgaacgtatcctggaagcatgggagatgaacgagaaaaaacaggctgaggggggtagacgccacggctacatggggcatctgacacgtattgcgaactgcatcgttcattcaacggataaaggccctaattccgccctcgttcagcagctcattaaggatttgcctgatgaggtacgcgaaaggtgggagactttctgcacatctagcctgggggagactaacaagcgaaacaccgtcgatctggtgacaacctgccatatccattcgagcagcgacgatgaaattgacttcaaggagaccgggttcagccaagacagctccctccaacaagcttttagcgactaccagatgcaacagatgacctcaaacttcattgatcaattcggttttaatgacgagaaatttgccgatcaggacgacattgggaatgtgtcctttgaccgggtgtctgatattaattttacgttgaatacaaacgagtccgggaatattgccttattcgaggcttgttgcaaggaacggatccagcagtttgacgacggagggtccgatgaagaggacatctgggaggaaaaacacatagctttcacacccgagtctcagagaagatctagcagcggttcaacagacagcgaggagagtacagattcggaagaggaggacggcgctaagcaggatctatttgagccttcatcagccaacaccgaagacaagatggaggtcgatctgagcgagcctccgaattggtccgccaatttcgatgtgcctatggaaacaactcatggcgcgccactggattcagtgggcagtgacgtgtggtccaccgaagaacctatgccaaccaaagaaaccggctgggccagcttctctgagtttacctcatcactgtctactaaggactcccttcgcagcaactctccagtggagatggagacctctacggagccaatggatccattgactccatccgccgccgccctggccgtccaacccgaagcggcgggttcagttgccatggaagcctcttctgacggcgaagaagacgcagagtcaactgacaaggtgactgagaccgtcatgaacgggggcatgaaggagacactttctttaacggtagacgccaagacggagacagccgtgttcaaaagagttctgaagtcgtatagggaggaaggcaaactgtccacctctcaggacgccgcatgcaaagacgccgaagagtgtccagaaaccgctgaagccaagtgtgcagccccacgccccccatcctcctctcctgagcagcgcactggccagcccagcgccccaggggacacaagtgtaaatgggccagtgtag

SEQ ID NO: 24896 - DNA, 1134 bp, Artificial Sequence
  Description of Artificial Sequence: Synthetic coding sequence
atgagcgacgaggtgttcagcaccaccctggcctacaccaagagccctaaggtgacaaagaggactacttttcaagacgaacttatccgggctatcaccgctcggtccgcacgacagcgctcctccgagtactcagatgacttcgatagcgacgaaatcgtgagcctcggtgatttctcagacaccagtgccgatgagaactccgtaaataagaaaatgaacgacttccatattagcgatgacgaggaaaaaaacccgtcaaaactgctcttcctcaagacaaataagagtaatggaaatatcaccaaggatgagcccgtatgtgctataaaaaatgaggaggagatggctcccgatgggtgtgaggacatcgtcgtgaaaagcttttcagaaagccagaacaaggatgaggaatttgagaaggacaaaattaagatgaagccgaagccgcgaatcctgtcaattaaatcgacgtctagcgcggagaacaattccctcgatactgacgatcactttaagcctagtcctagaccacgcagcatgttaaaaaaaaagagccacatggaggaaaaggacggtctggaggacaaagagacagcgctttctgaggaactggagctgcactctgcaccttcaagcctacctaccccaaacggtattcaattggaggcagagaagaaggctttcagcgaaaacctggaccccgaagacagctgcctcacaagcctggcttcaagctccctgaagcaaatattgggggattcattttcacctggatctgaggggaatgcatctgggaaagatcccaatgaggagattaccgaaaaccacaacagcctgaagagcgatgaaaataaggagaacagctttagcgccgatcacgtcacgacagcagtcgaaaagtccaaagagtcccaagtgacagcagacgatctggaggaggagaaagcaaaagctgaattaataatggatgatgacagaacagtggaccccctactctccaagtcccaaagcattctgatctccaccagcgctaccgccagctccaagaagaccattgaagatagaaacattaaaaataagaaatctacgaataatcgagcatcgtcggcgagcgcctcgaaggcctcttag

SEQ ID NO: 24897 - DNA, 576 bp, Artificial Sequence
  Description of Artificial Sequence: Synthetic coding sequence
atgggcaagagctgcaaggtggtggtgtgcggccaggccagcgtgggaaaaacctcaatcctggagcagcttttgtatggaaatcacgtggtaggaagtgaaatgatcgagacacaagaggacatttatgtggggtcgattgagaccgaccggggcgtgcgggaacaggtaagattctatgatactagaggactaagggatggagccgagctgccacgccactgtttctcatgcaccgacgggtatgtccttgtatattctaccgattccagggaaagcttccagcgggttgaactcttaaagaaggagatcgataagagtaaggacaagaaggaggtgacgatagtcgtcctggggaacaaatgtgaccttcaagagcagcgccgagtcgaccccgatgtggcacagcactgggctaagtcagagaaagtgaagttgtgggaggtttccgtggcagatcgaagaagccttctagaaccttttgtctacctcgcctcaaaaatgactcagcctcagtccaagagcgccttccccctctccagaaagaataaggggtccggctctctcgatggatag

SEQ ID NO: 24898 - DNA, 576 bp, Artificial Sequence
  Description of Artificial Sequence: Synthetic coding sequence
atgggcaagagctgcaaggtggtggtgtgcggccaggccagcgtgggaaagacctccattcttgagcagttattgtacggaaaccatgtggtgggctcggagatgatcgagactcaagaagacatctacgtgggctcgatcgagactgaccggggagtgagagagcaggtccggttctatgacactcgggggcttagagacggcgcggagctgccgagacattgcttcagctgtactgacggatacgtcctcgtttacagcaccgactcccgtgaatcctttcagcgggtggagctcctcaaaaaagagattgacaagtcaaaggacaagaaggaggtgaccattgtagtgctgggtaacaaatgcgatctgcaggaacagagacgagttgacccagatgtggcccagcactgggccaagagtgagaaagtgaagttgtgggaagttagtgtggccgatagaaggtctctgctggaacccttcgtgtacctggcgagtaagatgacccagccacaatccaagagtgccttccccctgtctaggaaaaacaaaggctcgggaagtcttgacggctag

SEQ ID NO: 24899 - DNA, 570 bp, Artificial Sequence
  Description of Artificial Sequence: Synthetic coding sequence
atgggcaagagctgcaaggtggtggtgtgcggccaggccagcgtgggaaagactagcattctcgagcaattgttgtacggaaaccacgttgtcgcaatgatcgaaacacaggaagatatctatgtcggctcaatagagaccgaccgcggggttcgtgaacaggtgcggttttacgatacacggggattgagagatggagcagaactgccccgccactgcttctcgtgtacggacggatacgtcttagtctattcgacagactcccgcgaatcctttcagagggtggagctgctgaagaaagaaatagataagtctaaagacaaaaaggaggtcaccatcgttgtgcttggaaataaatgcgatctccaggaacagaggagggtggaccccgatgtggcacagcattgggcaaaatcagaaaaggtcaagctgtgggaggtgagtgtggccgataggaggagcctgctagagccattcgtttacctggccagcaaaatgacccagccgcagtccaagtctgcttttcccctgtccaggaagaacaaaggctcaggctccctggacggctag

SEQ ID NO: 24900 - DNA, 576 bp, Artificial Sequence
  Description of Artificial Sequence: Synthetic coding sequence
atgggcaagagctgcaaggtggtggtgtgcggccaggccagcgtgggtaagacaagtattctggagcaactcttatatggcaaccacgttgtcggaagcgagatgatagagacacaggaggatatttacgtgggatcaattgagactgacagaggtgttcgggagcaggtgcggttctatgatacgaggggcctccgagacggtgcggagcttccgcgtcactgcttttcatgcaccgacgggtatgtgttggtttacagtacagattctcgcgagtccttccagagagtagagttattaaaaaaggagatcgacaagagcaaggacaaaaaagaggtgacaattgtcgtgttaggcaacaagtgcgacctgcaagagcaaagacgcgtcgaccccgatgtggctcaacactgggccaagtccgagaaagtcaaactctgggaggtgtcagttgccgaccggaggtcactgcttgaacccttcgtctatctggcctcaaagatgacccagcctcagtctaagagtgcctttcctctctctagaaaaaataaaggctccggctcattggatggctag

SEQ ID NO: 24901 - DNA, 1005 bp, Artificial Sequence
  Description of Artificial Sequence: Synthetic coding sequence
atggccgaggaggtgcggcgggaggaggccagcggcgtgggccgggcacggacacccacacctggagctttgcgggcgccccagttggtgaccgaggcccctccactgcatcctgggcatactctgatgaaagcgacagtgctgatgagacagccgggccgagtgcaagagattgtcggtgccttgaggaagggaggaggcgacagactccaggtaatatcagatttcgatatgaccctgtcaagatttgcatataatggtaaacgatgtccctccagttacaacatcttggataactcgaaaatcatctctgaggaatgccgcaaggagttgaccgctcttctacaccattattaccccatagagatcgatcctcaccgaaccgtgaaagaaaagctgcctcacatggttgaatggtggacaaaagctcacaacctgctgtgtcagcagaagatccagaaatttcagatagcccaggttgtaagggaatccaacgcaatgctgagagaagggtacaaaactttcttcaatacactctatcataacaacatcccgctcttcatctttagtgctggcatcggtgacattttggaggaaataatcaggcagatgaaagtgttccaccccaacattcatattgtcagcaattacatggacttcaacgaagatggctttctgcagggctttaagggccagctgatccatacatataataagaattccagcgcctgcgaaaatagcggttactttcagcagctcgaggggaaaactaacgtgattctcctgggagattccattggtgatctgacaatggccgatggggtccctggtgtgcagaacatccttaagattggcttcctcaatgacaaggtagaggaacgacgagaacggtacatggactcctatgacatagttttggagaaggacgagacattagatgtcgttaatggactactacaacacatcctgtgccaaggggtgcaattggaaatgcagggcccatag

SEQ ID NO: 24902 - DNA, 531 bp, Artificial Sequence
  Description of Artificial Sequence: Synthetic coding sequence
atggccgccagcaccgacatggccggcctggaggagagcttccggaagttcgcaattcacggcgatcctaaagcctcaggccaggagatgaacggcaaaaactgggccaagctgtgcaaggattgtaaagtcgccgacggaaaatctgtgacgggcacagatgtagatattgtgttctcgaaggttaaaggcaagtctgccagggtgatcaactatgaagagttcaagaaggctctcgaggagttagccaccaagagattcaagggaaaaagtaaagaagaagctttcgacgccatttgtcagttggttgcgggaaaggaacccgccaatgttggagtgactaaggccaaaacaggcggagccgtggataggctgaccgatacttcccgatataccggctcacacaaagagagattcgacgaatccgggaagggcaaaggtatagctggccgccaggacatcttggacgattctgggtatgtgtccgcttataagaacgcaggtacttacgacgctaaagtcaaaaaatag

SEQ ID NO: 24903 - DNA, 912 bp, Artificial Sequence
  Description of Artificial Sequence: Synthetic coding sequence
atggacagcctgcccgacgagttcttcgtgcggcaccccgccgtggaggatcagagaaaggaagagaccgagaataaactggagaagtcatcaggccaactgaacaagcaggagaacgacatccctactgatttggtcccggtcaacctgctcttagaggtgaaaaagcttctgaacgccatcaataccctcccaaaaggcgttgtcccacatattaagaagttcctgcaggaggatttcagtttccagaccatgcaacgggaggtggccgctaactcacagaatggtgaggagattgtacctgctttaactttgcgatttctaattacacagttggaagctgccctgcgaaatatacaagcaggtaactatacagcccaccaaataaacataggctactacctgacactcttgttcctttacggggtcgcgctgaccgagagggggaagaaggaggactacacggaggctgagaacaagttccttgtcatgaaaatgatgatacaggaaaatgagatctgcgagaatttcatgtccctcgtctatttcgggagagggttgctgcgctgtgcccagaagcgatataacggcggcctcttggagtttcacaagtctctccaggagatcggtgataaaaatgaccactggttcgacattgaccctactgaggatgaagatctgcctaccactttcaaagacctcctgaataatttcataaaaacaaccgagtcgaatattatgaagcagaccatatgttcttatttggactgtgaacgtagttgcgaggcagacatcctgaaaaacacaagctataaaggattcttccagttgatgtgttccaaaagttgttgtgtttatttccacaagatctgttggaaaaagttcaagaacttgaaatatccaggtttctag

SEQ ID NO: 24904 - DNA, 1869 bp, Artificial Sequence
  Description of Artificial Sequence: Synthetic coding sequence
atggacctgctgacccgggagaacgtggccctgaaggtggagagcgcccagcaaccaaagcaggtgctcaagatggaggtcgccgtcctaaaaaagctccaggggaaggaccacgtgtgcaggttcatcggctgtgggcggaatgaaaaattcaattatgtggtaatgcagttgcagggcaggaacctggctgacctgcggagatcccagccgaggggaacgttcacactcagtactacactgcgactcggcaaacaaatcctcgaaagtattgaagctatccattccgtgggattccttcaccgggatatcaaacctagtaattttgctatggggcgcttgccttctacatacaggaaatgttacatgttggactttggcttagctagacagtataccaacactacaggcgacgtgcggccaccccgcaacgtcgcagggtttagagggaccgtgcggtatgcctctgtgaatgctcataaaaatcgggaaatgggacgccatgacgacttatggtccttattctatatgctagtggaatttgccgttggccaattaccctggaggaaaattaaggataaggagcaggtgggaatgattaaagagaagtacgaacataggatgttgcttaagcacatgccttccgagtttcatctatttctcgaccatatcgcctcactggattacttcactaagccggactaccagttaatcatgagtgtgtttgagaatagtatgaaagaaaggggcatcgctgaaaatgaggcttttgattgggagaaggctggcacagacgccttgctgtcaaccagtactagtacccctccacagcagaacacaaggcagaccgctgccatgtttggcgtggttaacgtgacacctgtccccggtgacctcctgcgggagaacaccgaggacgtcctgcagggggaacacctgagtgatcaggagaacgcccccccaatactgcctggccggccctctgaagggctgggtccatcccctcatcttgtgcctcaccccggtggcccggaagccgaggtctgggaggagactgatgtgaataggaacaaacttcgcatcaacatcgggaagtccccgtgcgtggaggaagagcagtctcggggaatgggcgtcccctcgagcccagtgcgtgcgcctcccgattctcctacaacacccgttcggagcctcaggtaccgcagagtgaattctccagagagcgagcgtctgtctacagccgacggtagagtcgaattacctgagaggaggtctaggatggaccttcctggcagcccttctagacaggcatgtagcagccagcccgcacagatgctgtccgttgatactggccacgccgataggcaggcaagcggccgtatggatgtatctgcctctgtggagcaggaagcactatccaacgcattcagaagcgtgccgctggcagaggaggaggactttgactccaaagagtgggtgataatcgacaaagagacagaactaaaagacttcccccctggcgccgagcctagcacatctggcacgacagacgaagagcccgaggaattgcggcctctgccagaagagggtgaagaacgccgacgcttaggcgccgagccgccatttccgttgacgccagcactggggactccaccctctacggagcgcgtagggccacacaggcccacagaaactgtcgggggtggccagaccctcggcgcacttccgcccgccgttcagccccctgccactactggagtgctgcgcgtcctcctccttcatgccggtgacggcgccttaccgtccccacggcgcaggcggctattgggtctcctgaggttccctcactctgctcagccactgggatag

SEQ ID NO: 24905 - DNA, 447 bp, Artificial Sequence
  Description of Artificial Sequence: Synthetic coding sequence
atggccgccgccatggtgcccggccggagcgagagctgggagcggggagaaccaggccgcccagcgctctatttttgcggctccattaggggcggacgcgaggaccgcactttgtacgagcgcattgtgtctaggctccgccgctttggtacggtcctcactgagcacgtggctgccgccgaactgggggccaggggcgaagaggccgccggaggcgaccggctaattcacgagcaggacttggaatggttacagcaagcggatgtcgtcgtggctgaagtcacacagcccagtttaggtgtcgggtatgaactcggaagagccgtggcattcaacaaacggatcctgtgcctttttcgaccacagagcggtaggggagaacaccccaagcccccaagctggctatctatggaccctgcactaagcagctttccaggaggactgtag

SEQ ID NO: 24906 - DNA, 606 bp, Artificial Sequence
  Description of Artificial Sequence: Synthetic coding sequence
atggtgaacagctgctgcggcagcgtgtgcagcgaccagggctgcggtctcgagaactgttgcagaccatcctgctgccaaacaacctgttgtcggaccacctgctgcaggccatcttgctgtgtcagctcttgctgtcggcctcaatgttgccagtctgtttgttgtcaaccgacatgctgtagaccttcttgctgtcagactacctgctgcagaactacatgctgcaggccctcctgctgtgtgagtagctgctgtcgccctcaatgctgccagtctgtgtgctgccaacccacatgctgccgccccagctgctgtcaaacgacatgttgccgcaccacctgctgtaggcctagctgctgcgtgagctcttgttgtcggccccagtgttgtcagagtgtgtgctgccaacccacatgctgtaggccaagctgttgtatatcgagctcatgttgcccatcctgctgtgaaagcagttgttgccggccatgttgctgccttcggccggtgtgcggtcgcgtctcgtgtcatactacctgctatcggccaacgtgcgtcatcagcacatgtcctagaccattgtgttgtgcctctagctgttgttag

SEQ ID NO: 24907 - DNA, 387 bp, Artificial Sequence
  Description of Artificial Sequence: Synthetic coding sequence
atgaccggcagctgctgcggcagcaccctgagcagcctgagctacggcggtgggtgttgccaaccctgctgctgtcgagacccctgttgttgtcgtcctgtaacatgccagacaaccgtgtgtcgcccggtgacatgtgtgccacgatgtacccgtccgatttgtgagccatgcaggcgccccgtgtgctgcgatccgtgttctctgcaggaaggttgctgtcgcccaatcacttgctgcccctcttcatgtactgccgtcgtatgtcgaccttgctgctgggccactacctgttgtcagccagtatccgtgcagtctccatgttgccgccccccatgcggccagcctaccccttgtagcaccacgtgccgcacttcttcctgttag

SEQ ID NO: 24908 - DNA, 1140 bp, Artificial Sequence
  Description of Artificial Sequence: Synthetic coding sequence
atgagcctgcggctgagcagcgccagccggcggagctgcccccggcccacaacgggaagtctccggctatatggaggtggaacaagtttcggtacaggcaactcctgcggcatctctggaatcggatctggcttctcgtcagccttcgggggctcttcatccggaggcaataccggtgggggaaatccttgcgccggattcaccgtgaacgagcggggcctgctgagcggcaatgagaaagtcactatgcagaaccttaatgatcgcttggcctcttatttggatagtgtacatgccctcgaggaggccaacgccgatctggagcagaaaattaagggttggtatgaaaagttcgggccagggagttgccgagggctggatcacgactacagtcgctactttcctattatcgacgatctgaagaatcagattattgcctctacaacctctaatgcaaacgcggtgttgcaaatcgataacgctcgcctaactgcagatgatttccggctgaaatatgagaacgagctggccctgcatcagtcggtagaagcagatgtgaatggactccgtcgcgtgcttgatgagattacactctgtcggacagacctcgagatccagtatgaaaccttgagcgaggagatgacgtaccttaagaaaaatcacaaggaagaaatgcaggttctgcagtgtgcagccggaggcaacgtaaatgtggagatcgagcttcagagcctgctggcaaccaaacattcacttgagtgttctctgaccgaaacagaaagcaactattgtgctcagttggcccagatccaggcacagattggagctctggaagagcagctgcaccaagtgcgcaccgaaacagagggacagaagctcgagtacgagcaattactggacataaagctccaccttgaaaaggaaattgagacctattgcttgctaattggtggcgacgacggcgcttgtaaatcgggaggctataaaagcaaggattacggctccgggaacgtgggttctcaagtgaaggacccagctaaagcaatcgttgtgaaaaaggtactcgaggaggtcgaccagagaagcaagatcctgactactcgattacactcacttgaggaaaagtcccagtcgaactag

SEQ ID NO: 24909 - DNA, 768 bp, Artificial Sequence
  Description of Artificial Sequence: Synthetic coding sequence
atggacaaggacgaggaggccctgaaggccgcccaggccgagctgaaggaagcgaggaggcagtggcaccatctccaggtggaaatagagtccctgcatgcggtagaacgcggtttggaaaattccctgcacgccagtgagcagcactaccagatgcagctacaggacttagaaaccgtaattgaaggtctggagaaggaactgcaggaagtgcggcgcggtatcgagaagcagctgcaggagcacgaaatgctgctgaacacaaagatgcgactggagcaggaaatcgctacctaccgccacctgctcgagaaggaagagattagatattacggctgtattcagggtgggaagaaggataaaaagccaaccactagccgtgtcggattcgttttgcccagcgcaataatcaacgagatctcttttacgactaaggttccacagaaatatgagaatgaaaacgtggagacggtcactaaacaggccatcttaaacggcagcatcgtcaaagagtcaactgaggctcacggaacaatacagaccgagaaggtcgacgaagttattaaggagtgggagggatccttctttaaggacaaccctagacttagaaaaaaaagcgtctctctccgctttgacctgcacctggccgccactgacgaaggctgtctggaaactaaacaggacaaccttcccgacattgaagtgagactgattatgaggaggtcctgttctattccaagcattaaaccccccagcacagcaaattag

SEQ ID NO: 24910 - DNA, 888 bp, Artificial Sequence
  Description of Artificial Sequence: Synthetic coding sequence
atggagctgagccagctgctgaacgagatccgggccaactacgagaaaattctaactagaaatcagatcgaaaccgtcctaagcactcgtatccagcttgaggaggatatctccaaaaagatggacaaggatgaagaggcactgaaagccgcacaggcggaactgaaagaggcccgtcggcagtggcaccacctccaggtcgaaatcgagtctctgcatgctgtcgaacgggggctggaaaacagcttgcatgccagtgagcagcactatcagatgcagctacaggacctggaaacagtgatagaaggattggagaaagagctgcaagaagtcaggcggggaatcgaaaagcagttgcaagagcatgagatgctgctcaatacaaaaatgcggctcgaacaagaaatcgcaacctacaggcatctgctagaaaaagaagaaataagatattatgggtgtatccaggggggaaagaaagataagaaaccaactacaagccgcgtggggttcgtgctcccatccgctataatcaacgaaatttcattcactactaaagtgccgcagaagtatgagaacgaaaacgtcgagacagttaccaagcaagctattctaaatgggtctatagtcaaggagagcactgaagctcacggcaccatccagacagagaaagtggatgaagttataaaggaatgggaaggttctttttttaaagacaatccaaggcttcgaaaaaaaagcgttagcctccgattcgatttacatctagccgcaaccgatgaaggatgcctggaaacaaaacaggataacttgccggatatcgaggtccgtctaataatgagacgttcctgctctatcccttctatcaagcctccgagcacagccaactag

SEQ ID NO: 24911 - DNA, 1860 bp, Artificial Sequence
  Description of Artificial Sequence: Synthetic coding sequence
atgagcggcctggtgctgggccagcgggacgagcccgccggccacaggctgtcacaggaggaaatcttggggtccacccgacttgtttcgcaaggactcgaggcccttcgatcagagcatcaagcagtgctgcagtccctgtcacaaactatcgagtgtctgcagcaggggggccacgaggaggggcttgtgcacgagaaagcccgccagctcaggcggtccatggagaacattgagctgggcctgagcgaagctcaagtcatgctggctctggcctcccacctgtccacagtcgagagcgagaagcaaaagctacgcgcacaagtcagacggttatgccaagaaaatcaatggctaagggacgagctggctggtacacagcagcgactacagcggtcggaacaggccgtggctcaactcgaggaagagaagaaacacctcgagttcctcggacaactcagacagtatgatgaagatggccacacctctgaagaaaaagaaggggatgcaaccaaagattcactggatgacctgttccccaatgaggaggaggaggacccttccaacggcctgagcagagggcagggtgccaccgcagcccaacaaggtggttacgagattcccgcaaggctgcgcacgcttcacaacctcgtcatccaatatgctgcccaggggcgttatgaggtggccgtcccgctctgtaaacaggctctcgaggacctcgagcgaacctcaggtcggggccaccctgatgtcgctacaatgctcaacatcctagctctagtatatcgcgatcagaacaagtacaaagaggccgcccacctgctcaacgatgcactgtctattcgggagagcacactcggtcctgaccacccggccgttgccgctaccctgaacaacttagctgtgctgtatggcaagaggggaaaatataaagaagccgagcctttgtgtcagcgagcgttagaaattcgggagaaggttctcggtacgaatcatccagatgtcgccaagcaactgaataatctggccctcctttgccaaaaccagggcaaatacgaggccgtggaacgctactatcagcgggccctggcgatttacgaaggccagctggggccagacaaccccaacgtggcccgaaccaagaacaacctagcgtcatgttacctgaagcagggaaagtatgccgaggctgagacactgtataaagagattctgacgagggcccacgtgcaggagttcggtagcgtggacgacgaccacaagcccatatggatgcacgccgaggaacgcgaggagatgtcgaaaagccgtcaccatgaaggcggtacgccatatgccgagtacgggggctggtacaaggcatgtaaggttagttcgccaaccgtcaacactaccctgaggaatctgggggccttataccggcgacaaggcaaactggaggcagctgagactctggaagaatgtgcgcttcggtcacggagacagggcacagacccgatcagccaaactaaggtcgctgaactgctgggagaaagcgacggtcgaagaacatcacaggagggccccggcgacagcgtaaaatttgaaggcggcgaagacgcttccgtcgcagtggagtggagcggcgacggttccggcacgctgcagaggtcaggaagcctggggaagataagagatgtgctgcgccgatcctcagagttgcttgtaagaaaattgcaaggtacagagccccggccttcttcctccaatatgaagcgggccgcatctctaaattatttgaatcagccttctgcagccccgctgcaagtgtcacgggggttaagtgcgtctaccatggacctttcatctagcagctag

SEQ ID NO: 24912 - DNA, 1860 bp, Artificial Sequence
  Description of Artificial Sequence: Synthetic coding sequence
atgagcggcctggtgctgggccagcgggacgagcccgccggccacaggctcagccaggaggaaattctggggtctacgcggctcgtcagccagggcttagaagcactgaggagcgagcatcaggcagtcctccagtcattgagccagaccattgagtgcctccagcaaggtgggcatgaggaaggcctggttcatgagaaagcaaggcagctacgacgatctatggagaatatcgagttggggttaagcgaagcgcaggttatgttggctctggcctctcacttgagtaccgttgagtctgagaaacagaaattacgcgcccaggtaagaagattatgtcaggaaaaccagtggcttcgcgacgaactggccggcacccagcagcggcttcagcgctccgagcaggcggtggctcagctagaagaggaaaaaaagcacctggaatttctaggtcagctgagacagtacgatgaagacggccacacatcagaggagaaggaaggtgatgctacaaaggactcactcgatgacctgttccctaacgaagaggaggaagatccctccaatggattatcacggggacagggcgctacagccgcacaacagggcggttatgagatacccgctaggcttcgcactctgcacaacctcgtgatccagtatgctgcgcaaggaagatacgaggttgcagtgcctctttgtaaacaggctctcgaggacttggagcgaacatccggccgcggacatcctgatgttgccacaatgttgaacattcttgccctagtgtaccgtgatcagaataaatataaggaggccgctcatctcctgaacgatgccctgagcatccgagagagcacgctgggaccggaccaccccgccgtagctgccacccttaacaacttagcagtgctttacggaaagagaggcaagtataaggaggcggagccactctgccaaagagccctagaaatccgcgaaaaagttctggggaccaaccaccccgatgtggctaagcagctgaacaacttggcactgctgtgccagaaccagggcaaatacgaggctgttgaaagatactatcagagggcgttagcaatttatgaaggacaacttgggcctgataatccaaacgtggcccgtacgaagaacaacctggcctcatgttatctgaagcagggcaaatacgccgaagcggagacactgtataaggagatcttaacccgagctcatgtacaagagttcgggtccgtcgacgatgaccataaacctatctggatgcatgctgaggagcgagaagagatgtcaaagagcagacatcacgagggagggactccgtatgcagagtatggtggctggtataaagcttgcaaagtaagttctcctacggtgaatacgaccctcaggaacctgggtgccctctatcggcggcaggggaaactggaggctgctgagaccctcgaggagtgtgctttgagaagcagaaggcagggcactgacccaatttcacagactaaggttgccgagttgctgggtgagtctgacggccggagaacgtcacaggaagggcctggggacagcgtcaagtttgaggggggagaggacgccagcgtcgctgtcgagtggagtggggacggctccgggacactccagaggtcaggcagtctcggcaagatccgggacgtgcttaggcgttctagcgagctcctggttcgcaagctccagggaaccgaacccaggcctagcagtagcaacatgaaacgcgcagcatctctcaactatctcaaccaaccatcggccgccccactccaggtaagcagaggactaagtgcctctaccatggatctgagctcaagcagctag

SEQ ID NO: 24913 - DNA, 1170 bp, Artificial Sequence
  Description of Artificial Sequence: Synthetic coding sequence
atgctgcggtggaccgtgcacctggagggcggcccccggcgggtgaaccacgccgccgtcgcagtgggccacagagtctactcgtttgggggctactgttcaggagaagattacgaaacactcagacagattgacgtgcacattttcaatgccgtaagtttgaggtggaccaaactgccaccagtaaagtccgcaatccgggggcaggccccagttgtcccatatatgagatacggtcattcaactgttctgattgatgatacagtacttctctggggaggccgcaacgacacagaaggcgcttgcaatgtactctacgccttcgatgttaatactcataaatggttcacgcctagagtgagtggtactgtccctggcgcgcgggacggccactctgcatgcgtcctcggtaagatcatgtatatcttcggaggatatgaacaacaggctgattgtttctctaacgacatccacaaacttgacacttccaccatgacatggacactgatttgcactaagggttctccagcacgatggcgggactttcactctgcgaccatgctcggcagtcacatgtacgtattcggtggaagggccgaccggttcggaccattccatagcaacaatgagatttactgcaaccggattcgcgttttcgataccaggactgaggcatggctggactgtccacccaccccagttttgcccgagggtaggagatcacactccgcgttcgggtataatggcgagctgtatatattcggcggatataatgccagactcaaccgccactttcacgatctatggaagtttaatcctgtatctttcacttggaagaaaattgaacccaagggcaaaggcccctgccctcgcagacggcagtgctgttgcatagtgggggataagattgtgctgttcggaggtacttctccatctcccgaagaggggttgggggacgaattcgacctgatagaccattcagatctgcacattctagatttcagcccgtcacttaagacactctgcaagctcgccgttatccaatataacctagaccaaagttgtctgccccacgacatcaggtgggaattaaacgccatgacaacaaactccaatatctcaaggcctatcgtatcctctccctttgcatacccactgccatcagcctag

SEQ ID NO: 24914 - DNA, 549 bp, Artificial Sequence
  Description of Artificial Sequence: Synthetic coding sequence
atgcccatcccccccccccccccccccccccccggccccccccccccgccaacatttcatcaggccaacaccgaacagcctaaactgtcacgtgacgagcagcggggtcgtggggcgctgttacaagatatctgcaagggaaccaagctgaagaaggtgacaaacataaacgacagatcagccccaattttggaaacgccaccaccacctccacctgtgatccggaacggggctcgagacgcccccccccctccgccaccttaccgtatgcacggttctgaaccaccaagcagggggaagccaccgcccccaccctctcgcacaccggccggccctccaccgccaccgcccccaccactgcgcaacgggcacagggactctattaccacggtcaggtcatttctcgatgacttcgagagcaaatacagtttccatcccgtggaggatttccctgccccggaggaatacaagcatttccagcgtatctatccttcaaaaactaatcgcgccgctagaggggctccccccctgcctcccatcctacggtag

SEQ ID NO: 24915 - DNA, 831 bp, Artificial Sequence
  Description of Artificial Sequence: Synthetic coding sequence
atgaccagcttccggctggccctgatccagctgcagatcagcagcatcaagagtgataacgtaacgcgcgcatgctccttcataagggaggcagccacacagggagcaaaaatagtctctttacctgagtgttttaattcaccttatggcgccaaatacttccccgaatatgcagaaaaaatacccggagagtctacccagaaactctctgaggttgctaaagaatgctcaatatatctgattggaggtagcattcctgaagaggacgccggcaaactttacaatacttgcgcggtcttcggacccgatggaaccctgctggctaagtacagaaaaatacacttgtttgacattgacgtacccgggaagataactttccaggagtcaaaaacactatccccgggagattccttcagcactttcgacaccccttattgccgcgtcggcctcgggatctgctatgatatgcgttttgccgagctcgcccaaatctatgctcaacgaggatgccagctgctagtttatccaggagccttcaacctgaccacagggccagctcactgggaactgctccagcgcagcagggctgtggacaaccaggtgtatgtcgcaacagcaagtccggcacgggatgacaaggctagctacgttgcatgggggcacagcaccgttgtgaatccgtggggggaggtgctggcaaaggccgggacagaagaggccatagtttattctgacattgacctgaagaagctggctgagatacgccagcagatccctgttttccggcaaaagcgaagcgatctgtacgctgtcgagatgaaaaaaccttag

SEQ ID NO: 24916 - DNA, 1476 bp, Artificial Sequence
  Description of Artificial Sequence: Synthetic coding sequence
atggaggagatccccgcccaggaggccgccggcagcccccgggtgcagttccagagtttggagacacaatccgaatgtctttctcctgagccgcaatttgttcaagatacagacatggagcagggacttacgggcgacggagagacccgagaagagaacaagctcctgataccgaaacagaaaatctctgaggaggtgcatagctacaaagtgagagtcgggcgcttgaaacatgatataacccaggtgccagaaaccagggaagtttataagagcgaagaccgcctagagcgactgcaggaaatcctgaggaagttcctatacctcgaacgcgaattccgccagatcacaatctcgaaggagacatttacatcggaaaagaacaatgagtgccatgagcctgagaagagtttctcactcgactctaccatcgatgctgatcaacgagttctcagaatccagaacaccgacgataacgataagtacgacatgtcctttaaccagaattccgcttcaggcaagcacgaacacctcaatttgacggaggacttccagagttcggagtgtaaagagagcctgatggatcttagccacctcaataaatgggagtctattcctaatactgagaaatcttataaatgcgacgtgtgtggtaagatttttcatcagtcaagcgccctcacccggcaccagcggattcatactagagagaaaccatacaaatgcaaggagtgcgaaaaaagttttagccaatccagcagcctgtcaagacataaaagaatccatactcgggaaaaaccatacaaatgtgaagcctccgacaagtcatgtgaggccagcgacaagagctgttcacctagctcaggaatcattcagcataagaaaattcacacccgagccaagagctacaagtgttcctcatgcgagagagtgttctcaaggtccgtgcaccttacccagcatcagaagatacacaaggagatgccatgcaagtgcacggtgtgcggctccgacttttgtcataccagctacttacttgaacatcaacgagtgcaccatgaagaaaaggcatacgaatatgacgaatatgggttggcgtatatcaagcagcagggcattcatttccgcgaaaagccctatacgtgcagcgaatgcggcaaagacttccggctcaattcccacctcatccagcaccaacgcatacacactggagagaaggcgcacgaatgcaatgaatgcggaaaggcttttagtcagacttcctgcctcattcagcaccataagatgcatcggaaagaaaaatcttatgaatgcaacgagtacgagggcagcttttcacactctagtgacctgatccttcagcaagaggtgttaacaaggcaaaaagcattcgactgcgacgtctgggaaaagaatagcagccagagggctcacctggtgcagcatcagagtatccacacgaaagagaacagttag

SEQ ID NO: 24917 - DNA, 1089 bp, Artificial Sequence
  Description of Artificial Sequence: Synthetic coding sequence
atggcccacagcagcttcttccccgacgagtacttcacctgcagctcactttgtctgtcttgcggcgtgggatgcaagaagagtatgaatcacggcaaagaaggggtgccgcatgaggccaaatcaagatgtcgttattcacaccagtacgacaatagagtatacacctgtaaggcttgctacgagcggggcgaggaggtgagcgtggtgcctaagacctccgcatccacggactctccttggatgggactggccaaatatgcctggtctggctacgtgattgagtgtcccaattgcggtgttgtgtaccgttcccggcaatattggtttggtaaccaggacccagttgatactgtggtgcgcactgaaatcgtacacgtgtggcccgggactgacgggtttttaaaggacaataacaatgcagcccagcgactgctggacggtatgaactttatggcccagtcagtgtccgagttaagtcttggcccgacaaaagcagttacgtcctggctcactgaccaaatcgcccctgcttattggcgtccaaattcacagatcctgtcatgcaataaatgcgcgacctcatttaaggacaatgacactaaacatcactgtcgcgcttgtggagaagggttttgtgactcttgctccagtaaaactcgacccgtgcctgagaggggatggggacccgcccccgtgcgcgtctgcgataattgttacgaggcaaggaacgtgcagctggcggttactgaagctcaggtggatgatgaaggaggcactctgatcgctcggaaggttggagaggccgtccagaacactcttggtgcagtggtgacagcaatcgatattcccctcggcttagtgaaagatgcagccagacctgcctattgggtgcctgatcatgagatcctgcattgtcacaactgtcgtaaggagttcagcataaaactgagcaaacaccactgtcgggcctgcgggcagggtttctgcgacgaatgcagccacgatcgcagggccgtgccatcaagaggctgggaccatcctgttagggtgtgtttcaactgtaataagaaaccaggcgatttgtag

SEQ ID NO: 24918 - DNA, 348 bp, Artificial Sequence
  Description of Artificial Sequence: Synthetic coding sequence
atgagcggcgagcccggccagaccagcgtggcccccccccccgaggaggttgagcccggctctggcgtccgaattgtggtcgagtactgcgaaccctgtggattcgaagcaacctaccttgagctggcatctgccgttaaagaacaatatcctggaatcgaaattgaatccagactgggcgggacaggcgctttcgagatcgagattaacggccagttggtgttttcaaagttggaaaacggcggctttccttatgaaaaggaccttattgaggctatccgaagagccagtaacggcgagacccttgaaaagattacgaatagccgccccccatgcgttatcctctag

SEQ ID NO: 24919 - DNA, 507 bp, Artificial Sequence
  Description of Artificial Sequence: Synthetic coding sequence
atgctgttccggctgagcgagcacagcagccccgaggaggaggccagcccgcatcagagagcctccggagaggggcaccacctgaagagcaaaaggccgaatccatgtgcttacacgccacctagtctgaaagcagtccagcgcattgcagaaagccatctccaaagcatctccaacttgaacgagaatcaggctagcgaggaggaagatgagttgggtgagttgcgcgagctaggctatccaagggaggaggatgaggaggaggaggaggatgacgaggaagaggaagaggaggaagatagccaggcagaggtgcttaaggttattcgtcaatccgccgggcagaagacgacctgtggccagggtctggagggaccttgggaaaggccgcctcccttagatgagtcagaaagggacggcgggtccgaagaccaggtggaagatcccgctctgtccgagccaggggaggaaccccagaggcccagtccaagcgagcccgggacatag

SEQ ID NO: 24920 - DNA, 507 bp, Artificial Sequence
  Description of Artificial Sequence: Synthetic coding sequence
atgctgttccggctgagcgagcacagcagccccgaggaggaggcctcgccgcaccagagagcctcaggcgagggccaccaccttaagagtaagagaccaaatccgtgtgcctacaccccgccatcactgaaagcggtgcagagaatcgctgagtcccatctgcagtctattagtaatctcaacgaaaaccaagcctctgaagaggaagacgagctcggcgaacttcgcgaattaggataccccagggaggaggatgaggaggaagaggaagacgatgaagaagaggaagaggaagaggactcccaggctgaggtgctgaaagtcatcagacaatctgctggacagaaaactacttgtgggcaaggtctcgaggggccctgggagcggccacctcctttggacgagtccgaaagagacgggggttccgaggatcaggtggaggatccggcacttagcgaaccgggcgaagagccgcagcggccctcacccagtgagcccggcacctag

SEQ ID NO: 24921 - DNA, 648 bp, Artificial Sequence
  Description of Artificial Sequence: Synthetic coding sequence
atggaccccaaggaccggaagaagatccagttcagcgtgcccgccccaccctctcagctggatcctagacaggttgagatgattcgcagacgtcggcctactcccgccatgctgtttaggctctcagagcactcttccccagaagaggaggcctccccacaccaagtgacacctttgacctggcatttcccttggcagagggccagcggagagggtcatcatctcaagtccaagaggcctaacccgtgtgcctatacacctccatccttgaaggcggttcagcgtatagccgagtcccaccttcagagtatttccaacttaaacgagaaccaggcaagtgaggaagaagacgagctgggcgaactgagggagttaggatatccccgggaagaggatgaggaggaggaggaggacgatgaagaagaagaagaagaggaagattcccaggccgaggtactgaaggtgatccgccagagtgctggccagaagacgacctgtgggcagggtttggagggtccctgggagcgtcccccacctctcgacgagagcgagcgcgatggaggcagtgaagaccaggtcgaagacccagctctttccgaacccggtgaggaaccgcagagaccatctcctagtgaaccaggaacctag

SEQ ID NO: 24922 - DNA, 5169 bp, Artificial Sequence
  Description of Artificial Sequence: Synthetic coding sequence
atggagagcaacttcaaccaggagggcgtgccccggcccagctacgtgttctctgctgatccaatcgctcgcccttctgaaataaacttcgacggaattaaattggacctgtcacacgaattttccttggtggcccccaataccgaggctaacagctttgagtctaaagactacctgcaggtgtgcctgaggattagacccttcacacagagcgagaaagagctcgaatcagaggggtgcgtgcacatactggacagtcagacagtggtgctgaaggagcctcaatgtatcctggggaggctctcagaaaaatcttccggccaaatggcgcagaagttctcctttagtaaggtgttcggtcctgctactacccagaaggagtttttccaggggtgtataatgcaaccagtaaaagacttgcttaagggacagtctcgccttatttttacttacggacttacaaacagtggcaagacatacacgtttcagggaaccgaggagaatattggcatactgccgcggactttaaatgtcctcttcgactcgctgcaggagcgtctttataccaaaatgaacctgaaacctcaccgctcaagagagtacctaagactcagcagcgagcaggaaaaagaggaaatagcttccaagtcagctttacttcgccagatcaaggaggtaaccgtgcacaacgactcggatgataccctttatggctctttaactaattctctgaatatctctgaatttgaggagtcaatcaaggattacgagcaagccaacttgaacatggcgaatagtataaagttctcagtctgggtctctttcttcgaaatctataatgagtacatctacgacctgtttgtacccgtcagtagcaagttccagaagagaaagatgcttcgcttatcccaggacgtgaaaggctactcttttattaaagacctgcagtggatacaggtgtctgacagcaaggaggcgtaccggctacttaaattagggatcaagcatcagtccgttgcatttacaaagttgaacaatgcatcttctcgttcacatagcatctttaccgtgaagatcctacagattgaagattccgaaatgtcgcgggtgattcgagtgtccgagctgagcctgtgcgacctggcaggtagtgagcggaccatgaagacccagaacgaaggagagaggttacgggagaccgggaatatcaatacttctctgctaaccctaggaaagtgtattaacgttctcaagaatagcgagaaatctaaattccagcaacacgtgccattccgcgaatcaaaacttacccactactttcagtctttctttaatggaaaggggaagatatgtatgattgtcaatatttctcagtgctatctagcctatgacgaaactctcaatgtgctgaagttttctgctatcgcccagaaggtctgcgtccccgacaccctcaactcgtctcaggaaaaattgttcggcccagtgaaatcctctcaggatgtctctctcgacagcaacagtaattctaagattctgaatgtgaagcgcgcaaccatcagctgggagaactcgttggaggatctcatggaggatgaagatctcgtggaggaattagagaacgccgaggaaacccaaaacgttgaaaccaagctgcttgatgaagatctggacaagactctcgaagaaaataaggcatttatttctcatgaggagaaacggaaactgctggatctgatcgaagatcttaagaagaaactgattaacgaaaagaaggagaagctcactctggagttcaaaatacgcgaagaggtgacccaggaatttacccaatattgggcccaaagggaagcagacttcaaggaaacccttctccaggaaagggagatcttggaagagaacgctgagcgccgtctggccatcttcaaggacctcgtagggaaatgcgataccagggaggaggctgctaaagatatttgtgctaccaaggtcgaaactgaagaaacacacaactatgttgggtttgaggacatcatcgattcacttcaggacaacgtggccgacatcaagaaacaggcagagattgcacatctgtacattgcctcactcccagatcctcaggaggctaccgcttgtctggaactgaaatttaaccagatcaaagcagaactggccaagacaaagggagaactgatcaaaaccaaggaggaactcaagaagagggagaatgagtccgattctctcatccaagagctagagaccagcaataagaaaatcattactcagaatcagcgtataaaggagctcataaatatcattgatcagaaggaggataccataaacgaatttcagaatctgaagtcccatatggagaacactttcaagtgtaatgacaaggccgacacttctagcttaatcatcaacaacaagttgatctgtaatgaaacagtagaggttccgaaggactcaaaaagtaaaatttgttcagagaggaagcgcgttaatgaaaacgagctccagcaggacgagccaccagcaaaaaagggttctattcacgtctccagcgcgattactgaggaccagaaaaagtctgaagaagtgcgtcccaacattgctgagattgaggatatacgggtcctacaggagaacaatgaaggcctgagagccttcctgctgaccattgaaaatgagctgaagaatgaaaaggaggagaaagctgaactcaataagcaaattgtgcactttcaacaggagctgtccttaagtgaaaaaaagaacctcacattaagcaaggaagtccagcagatccagagtaattacgatatcgcgattgctgagctccacgtgcagaagtctaaaaaccaggaacaagaggagaaaattatgaagctgtcgaatgagatagagacagcaacacggtctataacaaacaatgtttcacagattaaactgatgcatacgaaaatcgatgaacttaggaccttggattccgtgtctcaaatctctaacatcgaccttcttaaccttagagatctgagtaacggatcagaagaagacaacctccccaatacccagctggacctcctcggaaatgattatctggtgtcaaaacaggtaaaggaatataggatccaggagcccaaccgtgaaaacagcttccattcctcaatagaagctatttgggaggagtgtaaggaaatcgtcaaagcttcatcaaagaaatctcatcagattgaggaactggagcagcaaatcgaaaaactgcaggctgaggtgaaggggtataaggacgaaaataatcgtttgaaagaaaaagaacacaagaaccaggacgacttactcaaagagaaggaaacccttatccagcagctcaaagaggaactgcaggaaaaaaacgtgaccctagatgtacaaatccagcatgtggtagaagggaaacgcgctctatcggagctcacccagggagtgacgtgttacaaagcgaagatcaaagagctcgaaactattcttgagacacagaaggtggaatgcagccatagcgccaagctcgaacaggatattctggaaaaggagtcaattatcctgaagctggagcgcaatcttaaagagtttcaggagcatcttcaggacagcgtgaagaacaccaaggatctgaacgtcaaagaactgaaacttaaggaagaaattacccagctgacaaataatttgcaggacatgaagcaccttcttcagcttaaagaggaagaggaggagacaaatcgacaggaaactgaaaaactgaaagaagagctctctgcttcaagtgcacggacacagaacctgaaggccgatctacagaggaaggaagaggactacgcggacctgaaggaaaaactgacagacgccaagaagcagattaagcaggttcagaaagaagtgagtgtaatgagagacgaggataagctcctgcgaatcaagattaatgaactggaaaaaaaaaaaaatcagtgctcccaggaactggacatgaaacagagaacgatccagcagttgaaagaacagctcaataaccaaaaggtggaggaagcgattcaacaatacgaaagagcttgtaaggatctgaacgtgaaggagaagatcatcgaggatatgcggatgacattagaggagcaggagcagacccaagttgagcaggaccaggtgctcgaagccaaactggaagaagtggagagactggccacagaacttgagaaatggaaagagaagtgtaacgaccttgaaacgaagaacaatcagcgcagtaacaaagagcatgaaaacaacacagacgtgttgggcaagttgacgaacctgcaagatgagctgcaggagtcggagcaaaaatataacgccgacaggaagaagtggctggaggaaaaaatgatgctcattacacaggcaaaggaagcggagaatatccgcaataaggaaatgaagaagtacgcagaggaccgagagaggttttttaaacagcaaaacgaaatggaaattttaacagctcaactcacagagaaggacagcgatctgcagaaatggcgagaggagagagaccagctagtggccgcgcttgaaattcagcttaaagccctgatctcctctaacgtgcaaaaagataatgagatcgaacagttgaagcggatcatttccgagacatcaaagatcgagactcagattatggatattaagccgaaacgcatatctagtgctgatccggataaacttcagacagagcccctttcaacatccttcgagatttccaggaataagatcgaggacggcagcgtagtgctggattcctgtgaggtctctactgagaatgatcaatccacacggtttccgaagccggagctggagatccagtttacaccactacagcccaacaagatggcggtcaagcatccaggctgcacaacacctgtgactgtcaagattcccaaagctcgcaaaagaaaaagtaacgaaatggaggagtccgcctctcctcctccaaaggaatgctcctccagtccagccatggaacagtcctggaaagagaatgacttcgacaagttgcgcgaggagggctttaggaggagtaattatagcgagctacaggaagaaatccagaccaagggcaaggaggtggagaacttcgaaaagaacctggactag

SEQ ID NO: 24923 - DNA, 1215 bp, Artificial Sequence
  Description of Artificial Sequence: Synthetic coding sequence
atgcggcgggacgtgaacggcgtgaccaagagccggttcgagatgtttagcaatagcgacgaggcggtgatcaataagaagcttccaaaagaattactgctaaggatattcagtttcttagacgttgtaaccctctgtcggtgcgcccaggtcagcagagcatggaacgtgctggctctcgacggttcaaactggcagcgtatcgacttgtttgactttcagcgcgatattgaggggagagtagtggaaaacatttctaagagatgcggtggtttcctgaggaagctgtctctacggggctgtcttggagtcggggataacgcactgcgaacttttgcccagaattgccgcaatattgaagtcctgaacttaaacggatgcacaaagactactgacgcagaaggatgtccactcctcgagcaactgaacatcagctggtgtgatcaggtcacaaaagacggaatccaggccttggtgcgcggctgcggcggtctcaaagccctatttctgaagggctgcacacagttggaggacgaagctctcaagtacatcggcgcccactgccccgagctggtgaccctgaacctccaaacgtgccttcagattaccgatgaaggcttaatcactatttgtcgtggttgccacaaactccaaagcttgtgtgcctcagggtgcagcaatatcactgacgccattctgaacgctctgggccagaactgccctaggctcagaatcttagaagttgcaaggtgctctcaattgaccgatgttggctttacaactctggccaggaactgccacgagttggagaagatggacctcgaagagtgcgtgcaaatcaccgatagcacactcatacagttgtcaatccattgccctcgactgcaggtgctgagtctaagccattgcgagttgatcactgacgatggaataaggcacttggggaacggcgcttgcgctcatgatcaactggaggtgatcgagctggataattgtccactgattaccgatgcctcacttgagcatctgaaaagctgtcatagccttgagaggatcgagctctacgactgccagcagatcactcgagctggcattaaacgcctgcggacacatttgccaaatattaaagtacacgcttatttcgcgcccgttacaccgcccccgtccgttggcgggagccgccagcgtttttgccgctgttgtattatcctgtag

SEQ ID NO: 24924 - DNA, 1251 bp, Artificial Sequence
  Description of Artificial Sequence: Synthetic coding sequence
atggcccacagccccgtggccgtgcaggtgcccggcatgcagaacaatattgccgacccagaggagcttttcaccaaattggagaggatcggtaaaggctcatttggagaggtgttcaagggcattgacaacaggacccagcaagtggttgctatcaaaataattgacctggaagaagctgaggatgaaattgaggacatccagcaggagattacagtgctcagccagtgtgactcctcttatgtgactaagtactacggctcctacttgaaaggcagcaagctgtggattatcatggagtacttggggggcggctccgccttggatctgttacgggccgggccctttgatgagtttcagatagccaccatgctgaaggagatcttaaagggactggactatctccatagcgaaaagaagatccacagagacatcaaagccgctaacgtgctgttatccgaacagggggacgtaaagctggcggactttggagttgccgggcagctcactgacactcaaatcaagagaaataccttcgttgggacccctttctggatggctccagaggtgatccagcagtctgcctacgattccaaagcagacatttggagcctgggtattactgctattgagttagcaaaaggtgagcctcccaactctgacatgcatcccatgcgggtcctgtttctaatccccaaaaataaccccccaaccctcgtaggagattttacaaaatcttttaaggagtttatcgacgcttgcctgaataaggacccctcatttcgccctacagctaaggaactcctcaaacataaattcatagttaaaaacagcaaaaagacttcttatctaaccgagctgattgatagatttaaacgatggaaagcggagggacacagcgacgacgaaagcgattcagaaggctccgattccgagagcacatccagagagaataacacacacccagaatggtcgttcacaactgtgagaaagaagcctgatcctaaaaaggttcaaaatggagcagagcaggatctggtccaaacccttagttgtctctcgatgatcattacccctgcatttgccgaattaaaacagcaggatgaaaacaatgcctcacgcaatcaggcaatcgaggaattggagaagtcaatagcagtcgctgaggctgcgtgccctggcatcaccgataagatggttaaaaagctcattgagaaatttcagaaatgtagcgccgatgagtccccctag

SEQ ID NO: 24925 - DNA, 1020 bp, Artificial Sequence
  Description of Artificial Sequence: Synthetic coding sequence
atggcccacagccccgtggccgtgcaggtgcccggcatgcagggcagcaagttgtggatcattatggagtaccttggaggaggtagcgcgctcgacctcctccgggccggccccttcgacgaatttcagatagctacaatgctgaaagagattctgaaaggccttgactacctgcattcagagaaaaaaatccacagagatattaaggccgctaacgtcctactatctgagcagggagacgtcaaactggctgactttggcgtggctgggcagctcaccgatacccaaataaagcggaataccttcgtgggaaccccattttggatggcccccgaggtgatccagcaaagtgcctatgattctaaagcagacatctggtccttgggtattaccgcaatcgaacttgccaagggggagccacccaacagcgatatgcatcccatgcgagtgctgtttctgatcccaaaaaacaatccacccaccctggttggagattttaccaagtcctttaaagaatttattgatgcctgcctcaataaggacccctccttccgacccacagcaaaagagctcctcaaacataagttcatcgtgaaaaacagcaaaaagaccagctacttgaccgagctgattgaccgatttaaacgctggaaggcggaaggacacagtgatgatgagtcagacagtgaaggtagtgactcggagagcacatcaagggagaataacacccacccagagtggtccttcacgaccgtgaggaaaaaaccggaccctaaaaaggttcagaacggcgcggaacaggatttggtgcagactctctcttgtctgtcgatgatcattactccggccttcgcagaactgaaacagcaggatgagaataatgcatcaagaaaccaggccatcgaagagctagagaagagcatcgcagtcgccgaagctgcatgcccaggtattacagataaaatggtaaaaaagcttatcgaaaagttccagaagtgcagtgccgatgaatcaccttag

SEQ ID NO: 24926 - DNA, 2625 bp, Artificial Sequence
  Description of Artificial Sequence: Synthetic coding sequence
atggaggtgctgcgggagaaggtggaggaggaggaggaggccgagagggaagaagccgccgaatgggctgagtgggccagaatggaaaaaatgatgcggccagtggaagtgaggaaggaggaaatcaccctgaaacaggagacgctccgagacctcgaaaagaagctgagcgaaatacaaatcacggtgtccgcggagctccccgcgtttaccaaggacaccatcgacattagtaagctgccgatttcttataagacaaatacccctaaggaagaacatctcctacaggttgcagacaacttctcgagacaatatagccacctatgccctgatcgtgttcccctttttctccaccccttgaacgagtgcgaggtgccgaagttcgtaagcacaactctgcggcctacattgatgccctatccagaactctacaactgggatagctgcgcccagtttgttagcgacttcctcacaatggtgcccctccctgatcccttgaagcccccctctcacctttatagcagcacaacagtgctgaagtatcagaaaggaaactgttttgacttcagcacacttctttgttccatgctgatcggatccggctacgatgcctactgcgtcaatggctatggttcattggacctgtgtcatatggatttgacaagagaggtatgtcctctaacagtgaagcccaaagaaaccatcaagaaggaggaaaaggttttgccaaagaagtataccatcaagcctccacgcgatctgtgttcgagatttgagcaagagcaggaagtgaagaaacagcaggaaattagagcccaggaaaagaagcggcttcgggaggaagaagagagattgatggaggcggagaaggcgaagcctgatgctctgcacggactgagagtgcactcttgggtcctggtcctgtccggcaaaagagaagtccccgagaacttctttattgacccgttcactggccattcctactctacccaggacgagcatttcttggggatcgagagcctgtggaaccataaaaattactggatcaatatgcaggactgttggaattgctgtaaagacttgatctttgacttgggcgaccccgtccggtgggaatacatgctgctgggaacagacaagagccaactttcgttgacagaagaggatgacagcggaataaatgatgaagacgatgtggagaatttagggaaggaggacgaggacaagtcattcgatatgcctcactcctgggtggaacagatcgaaatatcccctgaggccttcgagacccgctgcccgaatggaaagaaggtgattcagtataagagggcaaagctcgaaaaatgggcgccctacctaaactctaacggcttggtctcacggcttaccacgtacgaggatcttcagtgcaccaatatattagagataaaagagtggtaccagaatcgtgaggatatgctggaactgaagcatatcaataagaccaccgatctgaaaaccgattactttaagccgggccacccacaggccctcagggtgcattcttacaaaagcatgcagcccgaaatggatagggttatcgaattctacgaaacggcacgggtagatggactaatgaaacgtgaagaaaccccaagaacgatgactgaatactaccagggtcgtcctgacttcctgagctatcgccatgcttcttttggtccccgagtaaagaaactcaccctttcatctgctgaaagcaacccaagacccattgttaaaattaccgaaagattctttcggaatccagccaagcctgcagaggaggacgtcgcggaacgggttttcctcgtggcagaggaaaggattcagctgaggtaccactgtagggaagaccacattaccgccagtaagcgagagttcctgcggcggaccgaggttgactctaagggtaacaagatcattatgacaccagatatgtgcatatctttcgaagtggagcccatggaacacacaaagaagctgctctaccaatatgaggctatgatgcacctcaaaagggaagagaaattgtccaggcatcaggtgtgggaatctgagctggaggtgctggagatcctgaagttgagagaagaggaagaggccgcccatacattgacaatttcgatctacgatactaaaaggaacgagaagagcaaagaatacagagaagccatggaacgaatgatgcacgaagagcatctcagacaagtggagactcagttagattacctggcgcctttcctagctcaattgcctcccggagagaaattgacgtgctggcaagccgtgaggctgaaagacgaatgccttagtgatttcaaacaaaggttaattaacaaagcaaatcttattcaagcgaggtttgaaaaggagacccaggagctccagaaaaagcagcagtggtatcaagagaatcaggtgactctgacccctgaggatgaagatttatacctgagctattgcagccaggcgatgtttcggatccggatcctggaacaaagactgaatcgtcacaaagagttagccccgttgaaatatttggccctagaagagaaactctacaaggacccacggctcggggagctgcagaaaatcttcgcgtag

SEQ ID NO: 24927 - DNA, 1449 bp, Artificial Sequence
  Description of Artificial Sequence: Synthetic coding sequence
atggagcagagcaacctggagaagctggagctgaacgtgcggaagcttcaacaggagctggaccagctaaacagggataaactttcactgcacaatgatatatctgccatgcaacaacagctacaggagaagcgtgaagctgttaattccctccaggaagagttagccaatgtgcaggaccatctgaacctggccaaacaggacctgctgcataccaccaagcatcaggacgtgttgctgtccgaacagacccggctgcagaaggatattagtgaatgggccaatagattcgaagactgccagaaggaggaggagaccaaacaacagcagctacaggttttacagaatgaaattgaagagaacaagttgaaattagtgcagcaggaaatgatgttccagcgattacaaaaggagagagaaagtgagaagagcaagctcgatcaggtcctcagcaaagtcctcgcagccgaggagagagtgcgtaccctccaggaggaggagagatggtgcgaaagcctcgaaaagactttgagtcagacaaagcgccaactctcggagcgggagcagcagctggttgaaaaaagcggggagctgttggccctccaaaaggaggcagactctatgcgtgccgatttcagtcttttgcgcaaccaattcctgacagagcgcaagaaggctgaaaaacaggtggcctctctgaaggaagccctgaaaatccagaggtcccagcttgagaaaaatcttctggaacagaagcaggagaattcttgcatacagaaagagatggcaaccatcgaacttgtcgcccaagacaaccatgagcgggctcgccggttgatgaaagagctgaatcaaatgcagtatgaatatacagaactgaagaaacagatggccaaccaaaaggatctggaaaggaggcagatggagattagcgatgccatgagaacactgaagagcgaggtgaaggacgaaatccgcaccagcctgaaaaatcttaaccaattcctaccagaactgccggccgacctggaggccatactggaacggaacgagaacctagaaggcgagctcgagtctctcaaagagaatcttccgttcaccatgaacgagggtcccttcgaggaaaagctgaacttttcccaagtacacattatggacgagcactggagaggtgaggccttgcgagagaaactgcggcatagggaagaccgtctgaaagcccaactccggcattgcatgtctaagcaagcagaggttctgataaaaggaaagcggcagacggagggaacccttcactcactgcgccgacaggtggacgcactcggggaactagtgacctctaccagtgctgacagcgctagttcaccatcccttagccagctggaatcttcgctcaccgaggatagtcagctaggacagaaccaggaaaaaaatgcatccgcaaggtag

SEQ ID NO: 24928 - DNA, 3780 bp, Artificial Sequence
  Description of Artificial Sequence: Synthetic coding sequence
atggccctgcggcccggcgccggcagcggcggcggcggcgccgccggggctggagccggcagtgctggtggtggcggctttatgttcccggtggccggtggaatcagaccaccgcaggcggggctgatgccgatgcaacagcagggtttcccgatggtgagtgtcatgcaaccaaatatgcagggaataatgggaatgaactactcgagtcagatgagccaagggcccattgcaatgcaggccggcatccccatgggccctatgccagctgctgggatgccctacctgggacaggctccgttcttggggatgaggccacccggccctcagtatacccccgatatgcagaaacagttcgctgaggagcagcagaaaaggttcgagcagcagcaaaaactacttgaagaagaacgaaagaggagacaatttgaagagcagaagcagaaactgcggctgctcagcagtgtcaagcccaagacaggcgaaaaatcccgcgatgacgctctcgaagctataaagggcaacttagatggattttcaagagatgctaagatgcacccgaccccagccagtcacccaaaaaaacctggagtgggcgtgttccccagccaagacccagcccagccgaggatgccaccatggatctacaacgaatccctcgttccagatgcctacaagaagatcctcgagactacaatgaccccaacagggatcgatactgcgaagctgtatccaatactcatgtcctctggcctgccaagggaaacattggggcagatctgggcattggccaatcgaacaacgcccggaaagctgaccaaggaggagctgtacaccgtcctagccatgatcgccgtaacacagagaggggtgccagctatgtctccggacgctttaaatcaattcccggcagcccccatccctaccttgtcagggttctctatgacgctgcctacacctgtgagccaacctacagtgattcccagcggtccagctgggagcatgccactgtccctcggccagccggtaatgggtattaacttggtcggaccggtgggaggcgccgcagctcaggcctcgtcagggtttatacccacttatcctgcgaatcaggttgttaaaccagaagaagacgattttcaggattttcaggatgctagcaagtctggatcccttgatgatagtttctctgactttcaggagctgcccgcttcaagcaagacttctaattcccagcacgggaattctgctccaagcctactcatgccgctgcccggcacaaaggcccttcccagcatggacaagtacgctgtcttcaagggcatcgccgctgacaaaagttcggagaacaccgtgccacccggggaccctggggataaatattcagcctttcgcgagttagagcagactgccgaaaataagcccctcggcgagtccttcgctgagttcaggtccgccggtacagacgatggctttaccgacttcaaaacagcagattctgtttcccctctggagccacctacaaaagacaagacatttcctccaagttttccatcagggacaattcaacaaaagcagcagacccaggtgaaaaatccccttaacctggctgatttggacatgttcagcagcgtaaactgttcttccgagaagcccctgagcttttcagccgtgttcagcacatccaagtccgtgagcacaccccagagtaccggaagtgcagcgactatgaccgcactagcggctaccaaaacctcaagtttagcagatgattttggtgagttcagcctgttcggcgaatactcgggactcgcccccgtaggtgaacaagacgactttgcggacttcatggccttctctaatagcagtattagcagtgaacagaaacctgatgataaatacgacgcccttaaggaagaggccagcccagtgcctctgacttctaacgtgggctctacagttaagggcggccaaaattcaactgcagctagcaccaagtatgacgtctttcgccagctgtccttagaagggtcgggtcttggggtggaagatttgaaggacaacacacccagcggaaagagcgatgacgacttcgccgactttcactccagcaaattctcatccattaactccgacaagagcctgggggagaaagccgtggctttccggcacaccaaagaagactcagctagtgtgaagtctctcgatctgccatcgataggtggcagcagcgtgggcaaagaagacagcgaggacgccctgtctgtgcagtttgacatgaagctggctgacgttggaggtgacctgaaacacgtgatgagtgattcgagtttggatctgcccaccgtgtccggacagcacccccctgccgcagacatcgaagatctaaagtatgcagccttcggcagctactcaagcaactttgccgtgagcactctcacctcatacgactggtctgaccgggacgacgccacacagggcaggaaactttcaccattcgtgctgtctgcgggcagcggaagcccaagtgcaacgtctatcctgcagaagaaggagactagttttggcagttccgagaacataactatgactagtcttagtaaggtaactacatttgtgagtgaggacgcattaccagagacaactttccctgcccttgcgagttttaaggatacgataccccaaacttcagagcagaaggagtacgagaaccgggattataaggacttcaccaagcaggacctgcctacagccgagcgcagccaagaggccacatgtccaagcccagctagcagcggcgcctcccaggaaacccctaatgagtgttccgacgatttcggtgaattccagtcagagaagcctaaaatttcaaaattcgatttcctggtagcaaccagtcagagcaaaatgaaatcttcagaagagatgatcaagagtgaacttgccacattcgacctgtccgtacagggatctcataagagaagcttgtccctgggggataaagaaatttcgcgcagttcgccttcgccagccttggaacagccattcagagatcgttcaaacaccttgaatgaaaagcccgctctcccggtcatcagggacaagtataaagacctgaccggcgaggtggaggagaacgagcgctatgcctatgaatggcaacgctgcttgggttcggccctgaatgtcattaagaaggctaacgacaccctcaatggcattagcagcagttctgtgtgtactgaggtgattcagagcgcccaaggaatggaatatttgctcggtgtagttgaggtgtatagggtgacgaaacgtgttgaactaggcatcaaagccaccgcggtctgttctgaaaagctccagcaactgttaaaagacatcgacaaggtgtggaacaatttgattggctttatgtcactggccactctgacctgttgttgggaaaaaatgaccgtgatcacaaagcacctttccccctatcacgaacttctggaggaaaaacctgacgagaatagtctcgatttctcttcgtgtatgcttaggcctgggattaagaatgctcaggagctcgcctgtggggtttgcctgctcaacgtggattccaggagtcggaaggaagaaaagcccgctgaggagcaccctaaaaaagcgttcaacagcgaaaccgattctttcaagctggcctacggtggacaccagtaccacgcttcatgtgctaacttctggattaactgcgtggagcccaagccccccggattagtccttccagatctcctctag

SEQ ID NO: 24929 - DNA, 1158 bp, Artificial Sequence
  Description of Artificial Sequence: Synthetic coding sequence
atggccctgcggcccggcgccggcagcggcggcggcggcgccgccggcgccggtgccggcagcgcaggcggtggagggttcatgttccccgtagccgggggtatcagacccccccaagcaggtttaatgcccatgcagcaacagggcttccctatggtgagtgtcatgcagcctaatatgcagggcataatgggcatgaactacagcagtcaaatgtctcagggtccaatcgcgatgcaagctggtattcctatgggcccgatgcccgcagcaggcatgccatatctcggtcaggcccccttcctcggtatgcggcctcctggcccacagtacactccagacatgcagaagcaattcgcagaggagcagcaaaaaaggttcgagcagcagcagaaattgctggaagaagagaggaagcgccgacagttcgaagaacagaagcagaaactgcgcctgctctccagcgtgaagccaaagactggcgagaaaagtcgggatgacgctctggaagcaatcaagggcaacctggacggcttctctagagatgccaaaatgcaccccaccccagcatcacatcccaaaaagcccgattgcccaacgtcatcccactctacaaagaccgttagtccttctcccgccttcctcgatgaggaggaattttctgacttcatgcagggtccagtggaagtccctccatgtggcccgtccagtacttctcaacccttccagtcattccatcccagcaccccactcggacagttgcatactcagaaagccggaacacaaccccttcctccaagtcaatccccagtgccctttgcactgcacggcgtacctggtcaaattccatacttctccaccgcctcggctagccacagcgtccccgaagccggcccgtccctagaggaaaagttcctcgtctcttgtgacatctccacgtctgggcaggagcagatcaagctgaatacatcagaagtgggacacaaggcactggggcccggctcctctaaaaagtacccctccttgatggccagcaatggcgtagcggtggacggatgcgtgtgggagtactttcctcatcgcatactgctaagcccggaatgcttactgggttttaccatgagggtgtggtttcagatgcctatccgtaagtcctag

SEQ ID NO: 24930 - DNA, 939 bp, Artificial Sequence
  Description of Artificial Sequence: Synthetic coding sequence
atggccgacttcggcatcagcgccggccagttcgtggccgtggtgtgggacaagagcagccctgtcgaagccctcaaaggattggtggacaagctccaggctctcaccggaaatgaaggccgagtctcagtagagaatattaagcagctgctgcagtctgcccataaggagagtagctttgatattatactgtccggcctcgtgcccggtagcaccacgctgcattcggccgaaatcctcgctgagatcgcgcggatcttaagaccaggcggatgcctgttcctgaaagagcccgttgagactgccgtcgataataacagcaaggttaagactgcctctaaattatgcagcgccctcacattatccggactcgtggaagtgaaagagcttcagcgagagcccctgactcccgaggaagttcagagcgtgcgcgaacatttagggcatgagtccgataacttgctgttcgttcagattacagggaaaaagcccaatttcgaggtgggttcctctagacagctaaaattaagcataacgaagaagtccagccccagtgtgaagcccgctgtggaccccgccgctgcaaagctatggactctgagcgcaaatgacatggaggatgactctatggacctgatcgatagcgacgagttactcgatccggaagacctgaaaaaaccggacccagccagcttacgcgccgcctcatgtggcgagggtaaaaagaggaaggcgtgcaagaactgcacctgtggactagctgaggagttggaaaaagagaagtctagggagcagatgtccagccaacctaagtccgcctgtggaaattgttatttgggggacgccttccggtgcgcaagttgcccttatctcggcatgcccgcctttaagccgggggagaaagtgctcttgagcgactcaaacctgcacgatgcctag

SEQ ID NO: 24931 - DNA, 1056 bp, Artificial Sequence
  Description of Artificial Sequence: Synthetic coding sequence
atgaacgagagcaacgacagcaccaactacgacatggccccctactacgaggccctgtgtaaatccctcgactggcagattgatgtggacctactcaataagatgaaaaaggctaatgaagacgaacttaaaaggctcgacgaggaactggaagatgccgagaaaaatctgggagaatcggagattagagacgcgatgatggccaaagcggaatatctttgccgcatcggcgacaaagagggcgccctcaccgccttccgaaagacatatgacaagaccgtggccctcggacataggctcgacatcgtcttctacctcttacgaatcggactcttttatatggataacgacctaattaccagaaacacggagaaggccaagtctttaattgaagaaggaggtgactgggatcggcgcaataggctcaaggtctaccagggactgtattgcgtcgctatacgggatttcaagcaggctgcggagctgtttctcgataccgtgtccacctttaccagttacgaactaatggattacaaaaccttcgttacctacacagtttacgtatccatgatagcactagaacgacctgatctcagggaaaaagtcattaagggcgcagagatcttagaggtgctgcatagcctgccagccgtcaggcagtaccttttctctctgtacgaatgcagatactccgtgtttttccaatcactagcggtggtcgaacaagaaatgaagaaagattggctctttgctccccactacaggtattacgtacgcgaaatgcgcattcacgcctactcccagcttcttgagagttatcgctcccttacgctgggatacatggctgaggctttcggggttggcgtagaatttattgatcaggagttgtctcgcttcatagctgctggtcggctgcattgcaaaatcgacaaggtgaacgaaatcgtggagaccaaccgtccagactctaaaaactggcagtatcaggaaactatcaagaagggtgacctgctcctcaaccgcgttcagaagctcagtagagtgatcaacatgtag

SEQ ID NO: 24932 - DNA, 414 bp, Artificial Sequence
  Description of Artificial Sequence: Synthetic coding sequence
atgatcctgcccaccaaggccatggccacccaggagctgaccgtgaaacgcaaactgtccggtaacacgctgcaggtccaggcttccagtcccgttgctctgggagtcaggatacctaccgttgctttgcatatgatggaactgtttgatactaccgtcgagcagttatacagcatttttaccgtgaaggagctgacaaacaagaaaatcattatgaaatggcgctgtggtaattggccagaggagcattatgcaatggtcgccctgaactttgtgcctacccttggtcaaacagaactgcagctcaaggagttcctctctatctgcaaagaagagaatatgaagttttgttggcagaaacagcactttgaagagattaaggggtctctacagctcactccccttaacggatag

SEQ ID NO: 24933 - DNA, 2796 bp, Artificial Sequence
  Description of Artificial Sequence: Synthetic coding sequence
atggccgaggtggaggccgtgcagctgaaggaggagggcaaccggcatttccaactgcaagattacaaagcggccactaacagctactcgcaggctctgaagttgactaaagacaaggcgctgctggctaccctctaccggaatagagcagcatgtggtcttaaaaccgaaagttacgtccaggctgcaagcgacgcatctcgtgcaatagacattaactcgtctgatatcaaagcattgtatcgaaggtgtcaagccttggaacacttgggaaaacttgaccaggccttcaaagatgtccagaggtgtgctacccttgagcccaggaatcagaatttccaggaaatgttgcgaaggctgaacacctccattcaagaaaaattacgtgtacaattttccacagatagcagagtacaaaagatgtttgagattttactagacgagaacagtgaagctgacaaacgtgagaaggccgcaaacaatctgattgttttgggacgcgaggaagccggtgctgagaaaattttccagaataacggggtcgctctgctgctgcagctgctggacaccaaaaaaccagagttggttctggcagccgtgagaacactcagtgggatgtgtagcggccaccaggccagagctactgttatattgcacgctgtgcgcatagatcgaatttgttccttgatggccgttgagaacgaggagatgtcgttggccgtgtgcaacctgttgcaggctatcatagactcattatctggcgaagataagcgcgagcacagagggaaagaagaggccctcgtgttagatacaaagaaggacctgaagcagattacatcccatttgctggacatgctggtcagcaagaaggtctcaggacagggcagagaccaagccctaaacctgctaaacaaaaacgtcccccggaaggatttagcgatacatgacaacagcaggacaatctacgttgtcgataacggcctgaggaaaatcctcaaggttgtcgggcaggtaccggatctccccagctgtttgcctttgaccgacaatacccgcatgctcgcctccattctaattaataaactgtacgacgatctgaggtgtgatcctgagagagatcacttccggaagatctgcgaagaatacatcactggtaagtttgacccacaggacatggacaaaaacctgaacgcgatccagacagtctcaggaatcctgcaggggccttttgatcttggaaaccagctccttggtttgaaaggagtgatggagatgatggttgcactgtgtggatcggaacgggaaacggaccagctggtggccgtggaagcccttattcacgccagcaccaaactgagtagggcgacattcattattacaaatggagtgtctctgctaaagcagatctataagacaacaaagaatgagaaaatcaaaatcaggaccctcgtggggctttgtaaactgggcagtgcaggaggcactgattatggcctcagacaatttgcggaaggtagtacggagaagctggctaaacagtgccgaaaatggctgtgcaatatgtccatcgatacccggacacggcggtgggcagtggaaggattagcctacctgacactggatgcagacgtcaaggatgacttcgtgcaggatgtgccagccttgcaagccatgtttgagctcgcaaaagctggaacgagcgataaaactatcctgtattccgtggcaacaacccttgttaactgcaccaactcatacgacgtgaaggaagtcatccccgagttagtgcagttggcgaagttttccaagcaacacgtccctgaagaacaccctaaagacaaaaaggactttatcgacatgcgggttaagaggctgctgaaagctggcgtgatctcagcgctggcctgcatggttaaggcagacagcgccatactaaccgaccagactaaagaactcttggcccgagttttcttggccctctgtgacaaccctaaagacagagggaccatcgttgcccagggaggtgggaaggcacttatcccattggccctggaagggaccgatgtgggcaaagttaaggcagcccatgccctggccaagattgccgctgtttccaacccagacatcgcatttccaggggaacgcgtgtatgaagtcgtgcgaccgttggtgcgacttctcgatacacaaagggatggtcttcagaactacgaagctctcctcggacttactaacctgagcggcaggagtgacaaacttaggcagaaaatcttcaaagagcgcgcactacccgacatcgagaattacatgttcgagaaccatgatcaactccgtcaggctgccactgagtgcatgtgtaatatggtactgcataaggaagtgcaagagagattcctggctgatggaaacgatcgcctcaaactggttgtgctgctgtgtggagaggacgacgacaaggtgcagaacgcagccgcaggggcccttgccatgctgacagcagcacacaagaagctatgtttaaagatgacccaggtcacaacacaatggctcgagatcttacagaggctgtgcctgcacgatcaactgagtgttcagcatcgcggcttagtcatcgcttacaacctgctcgctgcagacgccgagctcgcaaaaaagttagtggaaagtgaattgttggaaatcctgactgtggtcggcaaacaggagccagacgaaaagaaggcggaggtggttcagactgcccgagagtgcctcatcaagtgtatggactatggctttatcaaaccggtaagctag

SEQ ID NO: 24934 - DNA, 318 bp, Artificial Sequence
  Description of Artificial Sequence: Synthetic coding sequence
atggccctgcggtaccccatggccgtgggcctgaacaagggccacaaggtgaccaaaaatgttagcaaacctcgacacagtcgccgcagaggccgactcacaaagcatacgaagtttgtgcgtgacatgatcagggaggtctgcggctttgctccatatgaaaggcgcgccatggagttgttgaaggtttcaaaagacaagcgggcactcaagttcataaagaagcgagttggtactcatattcgtgccaagcgtaagagggaggaattatcgaatgtgctggctgccatgcggaaagcagctgcgaagaaagactag

SEQ ID NO: 24935 - DNA, 663 bp, Artificial Sequence
  Description of Artificial Sequence: Synthetic coding sequence
atgaacagcatggaccggcacatccagcagaccaacgaccggctgcagtgtattaagcagcatcttcagaacccagccaacttccataacgctgccaccgaattgctggattggtgtggagaccctcgcgcctttcaacggccctttgagcagtctttaatggggtgtctaaccgtggtaagccgagtggccgcgcagcaaggctttgacctggatctgggttaccgcttgcttgctgtctgtgccgcgaatcgtgacaagttcactcctaagtccgccgcactgctgtcctcttggtgcgaagagctcggcaggctgctcctgctcaggcatcagaaaagccggcaaagcgacccgccaggaaagctcccaatgcagcctcctctttcaagtatgtcaagcatgaaacccacactgtcccatagcgacggctcattcccatacgacagcgtaccctggcttcccgcttaccctgcatgtactccaccaccgtcacaatctcacccaaattcttgcagcttgaagcagaaacaacctcttgcatttcccccccccctgtgctccatctggctcacaaccctgcagggacttctcggatccctcagctgtgttcactttgtgagcggatggagtgtgccaagagaaccccacggcttaggctag

SEQ ID NO: 24936 - DNA, 354 bp, Artificial Sequence
  Description of Artificial Sequence: Synthetic coding sequence
atggtgcagcggctgacctaccggcggcggctgagctacaacaccgcaagcaataagacacgtctgtcccggacccccggcaaccgcattgtctacttgtacactaagaaagtgggaaaagcgccaaaaagcgcgtgtggggtgtgccctgggcgtctgcggggggtgagagccgtcaggccaaaggtattgatgcggctgagcaaaaccaaaaagcatgtttcacgcgcatacggcggttccatgtgcgcgaaatgtgttcgggacaggatcaagcgcgcatttcttattgaagaacaaaaaatagtggttaaggtgctaaaagcgcaggcccagtcacagaaggccaagtag

SEQ ID NO: 24937 - DNA, 354 bp, Artificial Sequence
  Description of Artificial Sequence: Synthetic coding sequence
atggtgcagcggctgacctaccggcggcggctgagctacaacaccgcatccaacaaaaccaggctgtctcgcaccccaggaaatagaatagtgtacttgtatacaaaaaaggtggggaaggcgcccaagagcgcttgtggcgtctgcccaggccggttacgtggggttcgcgctgtgcggcctaaagtgttgatgaggttatccaagacgaagaaacatgtctctcgcgcctatgggggttcaatgtgtgccaagtgtgtgagagatcggataaaacgagcgttcctgatcgaagagcagaagatcgtggtcaaggtgctgaaggcacaagcccagagtcagaaagctaagtag

SEQ ID NO: 24938 - DNA, 354 bp, Artificial Sequence
  Description of Artificial Sequence: Synthetic coding sequence
atggtgcagcggctgacctaccggcggcggctgagctacaacaccgcaagcaataaaacaaggctgtctcggaccccaggcaacaggatcgtgtatctatacaccaagaaagtggggaaggcccccaaatccgcttgcggagtgtgcccaggacgtctgcgcggagtgcgcgcagtcagacccaaggtcctaatgcgactgtcaaagacaaagaagcatgtaagccgagcttatggcggtagcatgtgtgcaaaatgtgtccgggatcgcatcaagagggcattcttgattgaagaacagaagatcgtggtgaaggtgcttaaagctcaggcccagtcacagaaggctaagtag

SEQ ID NO: 24939 - DNA, 1902 bp, Artificial Sequence
  Description of Artificial Sequence: Synthetic coding sequence
atgaaggccatcaagaagagcctgaccgaggaggagtacctgtacctggacttctcacaccagacagagggctgtatcttcccactccacacaagtgtgaccctgttcttactgagctattgcgactgtaagattttcaaaatctgtttagtggtgacaaaagaagtaagccgggatagctcgctactgcgcgatgatcttatccaagacgtagagatccagatcatttcgcgacaagaactcccaccaatagttcagaactgttgcctgccggctgtggtggagaggagcgataatttctgcagagccggcttggctgtggtcctgagacacataatccagaagagttacgaagcggatcccttgaagaaagaactgctggagctgcttggatttaaaaagacatgcctgaaagcctgcgcggaggtatcacaatggacaagactgtgtgaattaacaatccctctggcaatcgaaaatttcttacgggaatcttctgaccagccaccaactattcccgtcgaaattctgcagctggaaaagaagcttagcgagcccgtcagagtccacaatgacgataagcttaggagacagaaacttaaacagcaaaaggccgatggggtgggtccccccctgaccaagggaaaagccaaatctaaggtgcacacacaagagacctcagagggactggactcatcctcgaagagcctcgagctgaaggttgcgttttcaaagttgactgtgcaggaggaacccgcaacaacgaatcgtgagccctctcatataagaaaagcaaaagcctcagatctgcccccactggagcacgtgttcgcagaaggtctatacttcacccttgcagatatagtgctgctcccatgtatccatcacttccttgtgatcatcagccgtaagtttagtgaaaaactcgttgagtttcctttgctcgcttcttggtaccagcgcattcaggaagtccccggagtgaagaccgccgcaagtaagtgtggcatccagttcttgcatctcccaaagctcctgaccactagcaccgagcagcaccctaatctctgcgaagtgcccggagtggaagagcagtccgacccattgttcatcggaggacctcggcccactatggccaagttaatggaaaaggggattgaggttatgttcagccctcatccgtgcccgacatggactctggactggaacgtactgccggcggccgtttccccaaaagaaggcaaaatgtctagcgatagggctttgcgtaaacagcagcagttgaataaccttgtatacgtagtgacaaaccaagccaagcccggcgaccgcattgtggacttctgcagcgggggcgggcatgttggtattgtgcttgctcatatgttgccttcctgccaggtcacactgattgaaaacaaggaattgtccttaattcgcgcaaaaaaacgaagcgatgaattagggttgtccaatatatggttcattcaggcaaacatggagtactttacaggaatgtttaacattggcgttgccctgcatgcttgtggcgtagccacagacatggtgattgagcactgtatcaaaaccagggcatcattcgtcacctgtccatgctgctatggcttcatccaaaatacctctaaattcaatttccccaagagcgaacaattcaaaaagaccctgagttacaaggagcacatgattttgtgtaggtttgcagatcaaactgccgttcagctgcctcctcagaggcgcctcattgggaagcagtgtatgtgtctcgtggacttagatcgagctcgcgccgcagaggaatgcggctactctgtacaagttatttctatggagcccgaatcctgctcccctaagaacaacatgattgtgggcgttccaatttag

SEQ ID NO: 24940 - DNA, 1641 bp, Artificial Sequence
  Description of Artificial Sequence: Synthetic coding sequence
atgaaggccatcaagaagagcctgaccgaggaggagtacctgtacctcgacttctcccatcagacagaagggtgcatttttcctctccacaccagcgtgacactgtttttactgagttactgcgactgtaaaattttcaaaatctgtctagtcgtaactaaagaagtgtcccagtggactcgcctgtgtgaactgactatacccttggccatcgagaacttcttgcgggagagctccgaccagcctcccacgatccccgtggagatcctccagctggagaagaaactctccgagcccgtgcgggtgcataatgatgacaagttaagaagacagaaactcaaacaacagaaggcagacggcgtgggaccacctctgacaaagggaaaagctaaatcaaaagttcacacccaggaaacttctgaaggattggatagttcatcaaagtccttagagctgaaggttgctttcagtaagctgactgtgcaggaggagccagccaccacaaaccgagaaccctcacatattaggaaggccaaagctagtgatctgcccccattggagcacgtgttcgccgaaggtctctactttactcttgctgatatcgtcctgctgccgtgcattcaccatttcctggtcataatctcccggaagtttagcgaaaagctggtcgagtttccacttctggcatcctggtatcagcgtatacaggaagtgcccggtgtgaagacagctgccagcaagtgtgggatccaattcttgcacttaccaaagctgctcacaaccagcaccgagcaacacccaaatctttgcgaggttcctggcgtagaggagcagagtgaccccctctttatcggaggacctcgtcccacaatggcgaaattgatggagaaaggaatagaagtgatgttctcaccgcacccatgccctacctggacactggactggaacgtcctaccagccgccgtgtcaccgaaagagggcaagatgtcttctgaccgggctctgcggaagcagcagcaactgaataatctggtctatgtggtaaccaatcaggctaagcctggagatcgtattgtcgacttctgttccggaggaggccatgttggtattgttctggcacacatgctgcccagctgccaggtcacattgattgagaataaggagttgtccctaatccgagcgaaaaagcgcagtgatgaactcggactctccaatatttggtttatacaggctaatatggagtattttacgggcatgtttaacattggcgtcgctctgcatgcctgcggagtcgcaaccgacatggtgatcgagcattgcataaaaactcgggcgagttttgtgacgtgcccttgttgctatggattcatccagaatacatctaagtttaacttccctaaatcagaacagttcaaaaaaacattgtcatacaaagagcatatgatcctttgtagattcgcagaccagacagctgtgcaactgcctccccaacggcgactcatcggaaaacagtgtatgtgcctggtcgatctggaccgtgccagggcagccgaagagtgtggatactctgtacaagtaatctctatggagcctgaatcttgcagcccaaagaacaatatgatcgtcggagtcccaatctag

SEQ ID NO: 24941 - DNA, 1542 bp, Artificial Sequence
  Description of Artificial Sequence: Synthetic coding sequence
atgctgctggagaacctgaccgacaacgagagcgagaacaccaacctaaaaaagaaagtctttgaaaaagaggcgcacattcaggaactctcatgtcttttccaatcagagaaggccaacaccctcaaagccaaccggttcagccaaagcgtcaaggtcgtgcacgagcggctgcagatacagatccataaacgcgaagccgaaaacgacaagctgaaggagtacgtaaagtctcttgagacaaagatagctaagtggaatctacaaagtaggatgaacaagaacgaggctatagttatgaaggaggcgagccggcagaagacagtcgccctaaaaaaggcttccaaggtgtacaagcagcgccttgaccactttacaggcgctatcgagaagctgacatcacagatcagagatcaggaagcaaaattgtctgagactatcagcgcgtccaacgcttggaaaagccactacgaaaaaatcgttatcgaaaagactgaattggaggtgcagattgagactatgaagaaacagattattaatttactggaggatttgaagaaaatggaagatcatgggaagaattcctgcgaagagattctccggaaagtacacagcattgagtatgagaacgaaacactcaaccttgagaataccaaactgaagaccactctagcggcactcaaggacgaggtggtgtcagtggaaaacgagctctcagagctccaggaggttgaaaagaagcaaaagaccctgattgagatgtataagacacaggttcagaaactacaggaagctgccgaaattgtcaagtccagatgtgaaaacctgttgcataagaacaatcagattactaaaacaaaaaataagaacgtggaaaaaatgcgcgggcagatggaatcccacctgaaagaactcgagcgcgtgtgtgactcactaacagccgcggagcggcgacttcatgagtgccaggaatcactgcaatgctgcaaaggaaaatgcgctgatcaagagcacaccatccgagagcttcagggccaagtggatggaaatcataatctgcttaccaagttgtctctggaagaggaaaactgcctgatccagctgaagtgtgagaatctccagcaaaaactggaacaaatggatgcagaaaataaagagcttgaaaagaaactggccaatcaagaggagtgtctgaagcacagtaatcttaagtttaaggaaaagtctgccgagtacaccgcccttgcaaggcagctcgaagccgccctggaagaagggaggcaaaaggtcgctgaggaaatagagaagatgtcatcaagagaaagtgctttgcaaattaagatactggacctagagacggaactccgaaaaaagaacgaggagcaaaaccagttggtctgcaagatgaactcaaaggcgcagcaccaggaggtgtgcctgaaggaggtacagaactccctcgagaaatcggagaatcaaaatgaatccattaaaaattatctccagttcctgaagacgagttatgtgaccatgttcgagtag

SEQ ID NO: 24942 - DNA, 1167 bp, Artificial Sequence
  Description of Artificial Sequence: Synthetic coding sequence
atggccgccgccgccgccctggcccggctggagcagaagcagagccgggcgtggggcccgacaagccaggatacaatccgaaatcaggtaagaaaggagctccaagctgaagctaccgtgtcaggcagccctgaggctcctggaaccaatgtcgtgtcagaaccacgcgaagagggctcagcccatctcgctgttccaggggtgtatttcacctgccctctgacaggcgcaactctgcgcaaagaccagagggacgcatgtatcaaggaagcaattctacttcacttttccactgaccccgtagccgcaagcattatgaagatttacaccttcaataaggatcaggatcgtgtgaagctgggagtagacaccatagccaagtatctagacaacattcacctccatcccgaggaagagaagtacaggaagattaagctgcagaacaaagtgttccaggagcgtataaattgtttggaggggacccacgagttcttcgaggccatcggcttccaaaaggttttgctgcctgcacaggaccaggaggaccccgaggaattctacgtattaagtgaaacaaccttagcacagccccagagcctcgagaggcacaaggagcagctgttggcagccgaacccgtacgggccaagcttgaccggcagcggcgtgtgtttcagccgagtcctctggcgagccagtttgaactgcccggggacttttttaacctgaccgccgaagaaatcaaaagagaacagcgcctgaggagcgaggccgtggagagactgtcagtgctgaggactaaagccatgcgcgaaaaagaggaacagcgcgggctgagaaagtataattatacactgcttcgcgttcgcttgcccgacggctgccttttacaagggaccttctacgcaagagaaagactgggtgcggtatacggcttcgtgagagaggcccttcagtcagattggcttccattcgaacttctggcatccggaggacagaagctgagcgaggatgaaaacctggccctcaatgagtgcggtctggtgccttcagccctcctgaccttctcatgggatatggcggtactggaggacataaaagccgccggagcagagcccgatagcattctgaagccagaactgctgtcagcgatcgaaaaacttttgtag

SEQ ID NO: 24943 - DNA, 2691 bp, Artificial Sequence
  Description of Artificial Sequence: Synthetic coding sequence
atggacggcgccgccggccccggcgacggccccgcccgggaggccctgcagtcattgtctcagagattgcgcgtgcaggagcaggaaatggaactcgtgaaagcggccctggccgaggccctgaggttgctgcgactgcaggtgccaccgagctccctgcagggcagtggaacccccgctccccctggggactccctggccgccccccccggcctgcctcccacatgcaccccttccctcgtgagtcggggaacacagacagagaccgaggtggagctgaagagcagcccaggaccacccggtctgagcaacgggcctccagcaccccaaggggcctctgaagagccatcgggcacacagtccgaaggcgggggcagctcctcgtcaggggccggctcccccggtcccccgggcattttacgtcctctgcaacccccccaacgagcagacacacccagacgcaattcttcttcctcatctagtccatcggagaggcccagacagaaactgagcaggaaggcaattagctccgccaacctcctcgtccggtcagggtccactgaatccagaggggggaaggatcccctgtcttcccctggagggcctggatctagacggagcaattataatttggaaggtatttccgtaaagatgttcctccggggcaggccgataacaatgtacattcctagcggtattcgttcactcgaagagctgccaagtggccctccccctgagactctttccctagattgggtatacggataccgcggcagggactctcgtagcaacctctttgtactgagaagtggagaggttgtctatttcattgcatgtgtggtcgtcctatataggcctggcgggggcccaggagggccaggcgggggcggacaacgacactatagagggcataccgattgcgtacgatgtctggcagtgcaccctgacggcgtgagggtagccagcggtcagacagccggcgtggacaaggatgggaaacccctgcagcccgtggtgcatatttgggatagtgagaccctcctgaagcttcaggagattgggctgggtgcttttgaacgtggagtaggggccctcgccttcagcgcggcagaccaaggagctttcttgtgcgtggtggacgactcaaatgaacatatgttgtcggtctgggactgcagccggggcatgaagctcgcggaaattaagagcacaaatgattcagtgctggcagtggggttcaatcctagagactcttcgtgtattgttacttcgggcaagtcccatgtccatttttggaactggtctgggggggtgggcgttcctggcaacggcacactgacgcgcaagcagggggtgtttgggaagtacaagaaaccaaagttcattccatgtttcgtgtttttacccgatggagacatcctgacaggggattccgagggtaacatactgacatggggaaggagtccttcggactctaagactcctgggcgaggaggagccaaagaaacctacgggatcgtggcccaggcccacgcccacgagggatcaatattcgccctgtgccttcggagggacggaaccgtgctgtcgggtggaggacgggacaggcgtctagtgcagtggggcccaggcttggtggccttgcaggaggctgaaatccccgagcattttggcgctgtgcgcgcgatcgctgagggactgggaagcgaacttcttgttgggacaacaaagaacgctttgctgcgtggtgatcttgcccagggctttagcccagtgatccaaggacacacagatgaactctggggactgtgcacccatcccagccagaatcggtttctgacttgcggccacgaccggcaattgtgcctgtgggatggcgaatctcacgccctggcctggagcatcgacctgaaggaaaccggcctgtgcgccgacttccaccctagcggcgcagtggtcgctgtcggcctgaacaccggccggtggctagtgcttgacaccgaaacacgcgagatcgtttccgatgtgatcgacggtaacgagcagctgtctgtagtccggtactccccagacggactgtaccttgccattgggagccacgacaacgttatttatatctactcggtcagctctgacggggccaagtcgagtcgctttggccggtgcatgggccactcaagctttattacccacctcgactggtccaaggacggaaactttataatgtctaactccggcgattacgaaatattgtactgggacgttgctgggggttgtaagcaactcaaaaatagatacgagagcagagacagggagtgggcaacttatacttgtgtattaggcttccatgtctatggggtctggcccgacggcagcgacggcacagacataaactccctttgtcgcagtcacaatgaacgggttgtcgccgttgcggatgatttttgcaaagtgcacctttttcaatacccgtgtgcaagagcaaaagctccatcacgcatgtacggcggccacggatcacatgtgacaagtgtgaggttcacgcatgacgatagtcaccttgtatcccttggcggaaaggatgcctccatctttcagtggagggtcttgggagccggaggtgctggacctgcccccgctacgccctctagaacccctagcctgtcccctgcctcgtcattagatgtctag

SEQ ID NO: 24944 - DNA, 2934 bp, Artificial Sequence
  Description of Artificial Sequence: Synthetic coding sequence
atgggcgccgaggaggaggtgctggtgaccctgagcggcggcgccccttgggggttccgacttcatggaggcgccgaacaacggaagcccttgcaggtgtctaagatacgccgccggtcccaggccggaagggctgggctgcgggaaagagatcagctgctggctataaacggtgtcagttgtaccaacttatctcatgcttctgccatgtcccttatcgatgcgtccggaaaccagctggtactcacagtccagagattagccgacgaaggccctgtccaatctccctcgccccatgaattgcaagtgcttagccccttgagccccctcagtccggagccaccaggcgctccagttccgcaacctctgcagccaggcagcctgcggtcccctccggacagtgaagcatactatggagagaccgattccgatgcagacggacctgccacacaggagaagccgcgtcggccccgacgacgcggacccactcgtcctacccctccgggagctccgcctgatgaggtgtacctgagcgactcacccgcagagccagctcctacgattccaggccccccaagccagggcgattcacgtgtgtcctcaccttcatgggaagacggcgccgcactgcagccccctcctgctgaagccttgttgctccctcatggacctctgaggccagggccccatctcattcctatggtgggacccgtcccacaccctgtggctgaggatttaaccaccacatacactcagaaagccaaacaggccaagttgcagagagccgaatccctacaggaaaagtctataaaagaggccaagaccaagtgccggactatcgcttcccttctcacagccgctccgaaccctcacagcaaaggcgtcctcatgttcaagaagcgacgtcaacgcgccaaaaagtacactctcgtgagtttcggcgccgcagctggcaccggggcggaagaagaggacggagtgcctcccacatccgaaagtgagctagatgaagaggcgtttagcgacgcccgctctctgacaaatcaatccgattgggattccccatacctggatatggagctggcccgggccggatcgcgagccagtgaaggccaggggagcgggttggggggccagctgtctgaagtgagtggaagaggggtgcagctgttcgaacagcagcgccagcgggctgactcaagtactcaggagctggccagggtggagcctgccgctatgttgaatggggaagggctgcaatcccctccgcgagctcagtctgcgccccccgaagcggcagtgctgcctccaagtccactccctgcccccgtggcatctcctcggccattccagcctggtggcggagctccaacacctgccccttctatctttaacagatctgccagaccgttcacacctggtctccaagggcagcgccccacaacaacttcagtgattttcagacctctggccccaaagagagctaacgactcgctgggagggctctcgcccgcccctccccccttcttgagctcgcaggggccaacccctctgccaagttttaccagcggtgtcccatcacatgctccggtgagcggcagccccagcacacccagatcctccggaccagtgactgcaacatcttctctgtatatccccgctccttcccgcccagtcaccccgggaggggcacctgaaccgcctgcccctcccagtgccgctgctatgacctcaacagcatcaattttcctcagcgctccccttcgcccttctgctagacccgaggcaccggcccctggcccaggagctccggagccgccatccgcaagagaacagagaatcagtgttcctgccgcacggaccggcatccttcaggaagccaggcgacgcggtacgcgcaaacagatgtttaggccagggaaggaagaaaccaagaactcaccgaaccccgaacttctttcgcttgtacaaaaccttgacgagaagccacgtgctgggggagccgaaagcgggcccgaggaggatgccttaagtctcggggcagaagcttgcaactttatgcaacccgtgggagcccgcagttacaagactctgcctcacgtgacaccaaaaacacctccccctatggcacctaagactcccccaccaatgacccctaagactccacctcccgtggcaccaaagccaccaagcaggggacttttggacgggctggtgaatggcgccgcctcgtccgctggcataccagaaccacctagacttcagggccgaggtggcgagctattcgcaaaaagacaatcaagagcggatagatacgtggtggaaggcacccctgggccggggctgggcccccgtcctagaagcccgtcccccacaccctcgttgccacctagctggaaatatagccctaacatcagggctcctcctccaatcgcctataatccactcctgagtcctttttttccccaggccgcccgtacccttcccaaggcacagtctcagggccctagggccacacctaagcagggcatcaaggccctcgacttcatgcggcaccagccttatcagttaaaaaccgccatgttttgtttcgatgaagtcccccctacacctggcccgatcgcttctggaagtcccaagactgctcgggtacaggagattcgacggtttagcacgccagcgccacagccaaccgccgagccactcgctccaaccgtgttagccccacgcgccgccactactctggacgaacccatctggaggacagaacttgcctctgcccctgtgccttcgcctgccccgcctcctgaggcgcctaggggtctgggtgcatcgccttcatcatgcggatttcaggtggccaggcctcggttcagtgcaacaagaacagggttgcaggcacacgtgtggcgccccggggcgggccatcagtag

SEQ ID NO: 24945 - DNA, 2757 bp, Artificial Sequence
  Description of Artificial Sequence: Synthetic coding sequence
atgggcaccaccgcccccggccccatccacctgctggagctgtgcgaccagaaattaatggaatttttgtgtaacatggacaataaagaccttgtttggctggaggaaatccaggaagaggctgaaagaatgtttactcgcgaattctcaaaggagcctgagcttatgccgaagaccccctctcagaagaaccggcggaagaaacgcagaattagctacgtccaagacgagaatagagacccaattaggcgaaggctgtcccggcgtaagtctcgctcaagccaactctcatcacgcagactgaggtccaaagatagtgtggaaaaacttgcaactgtcgtcggcgaaaacggctctgtccttcggcgggtcacacgcgccgctgctgccgccgctgctgcaactatggctctcgctgccccaagctccccgacacccgagtccccgacaatgctgacaaaaaagcccgaggataaccatacccagtgccaactggtgccggtcgtagagattggtatttcggagcgccaaaatgccgagcagcatgtgacgcaattgatgtccaccgagccattaccaagaactctcagccctactcccgcctccgcgacggcacccacgtcacagggcattcctacatcagatgaggagagtacccccaaaaagtccaaggctcgaatccttgaaagcattactgtgagtagcctcatggccactccacaggatccgaagggccagggtgtggggacggggcgcagtgctagcaaacttaggatcgcgcaagtgtcgcctggacctcgcgattctcctgcattccccgattctccatggagagagcgggtcctggcgccgatactgcctgataacttttccacaccaactgggagtcggactgatagccagagcgtgcgacactcccctatagcccccagttcacccagcccccaagttctggctcaaaaatatagcctagtagccaagcaggaatccgtcgtgaggagggcaagcaggcgtctcgccaagaaaacggccgaagagcctgcagcctccggcaggattatctgccatagttacctcgaacggcttttgaacgtggaggttccccaaaaggtcgggagcgaacaaaaggagcctccggaggaggcggagcccgtggccgcggctgagccggaggtccctgagaataacgggaacaatagttggccccacaacgatacagagatcgccaattcaacccctaatcctaagcctgccgcctcttctccggagacgccctctgctggtcagcaggaagccaagaccgatcaggcagacggacctcgagagcctcctcagtcggctcggcgtaagcgatcctacaagcaggccgtgtccgagctggatgaagagcagcacctggaggacgaggagctgcaacctcccaggtccaaaactccatcatctccctgtccggctagtaaggtggtgaggcccctgcgtacttttctccacaccgtacaacgtaaccagatgctgatgacccctaccagtgccccaagatcagttatgaaatcatttataaaacgcaacacgccgcttaggatggaccccaagtgtagttttgtcgagaaggaacgccagcggctcgagaatctgcggcgtaaagaagaggccgagcagctacggcgtcagaaggtcgaagaggacaagcgacgccggctagaggaggtgaaactgaagcgggaggagcgattgagaaaggtcctgcaggccagggaacgcgtggagcagatgaaggaagagaaaaagaaacagatcgagcagaagttcgcccaaattgacgagaaaacagagaaagccaaggaggagcgtcttgccgaagaaaaagccaagaaaaaggccgcagccaaaaaaatggaggaggtcgaagcccggagaaagcaggaggaagaagcacgccgactgagatggctccagcaggaagaagaagagcgccgacaccaggagctgttacagaagaagaaggaggaagaacaggaacgtcttcgaaaagccgccgaggcgaagcggcttgctgagcagagagagcaggagagacgggaacaggaacgtcgggaacaagagcgacgtgaacaggagaggagggaacaggagcggcgcgagcaggaacgccagctcgctgaacaggaacgtcgcagagagcaagaaagactgcaggctgagcgtgaattgcaggagcgagagaaagccttgagactacagaaggaacaactgcagagggaattagaagaaaaaaagaagaaggaggagcaacagagactcgccgagaggcagctgcaggaagagcaggagaagaaggcaaaggaggcagcgggagcgtccaaggccttaaatgtcactgttgatgtgcagtcaccggcctgcacttcatatcaaatgacaccgcaaggccaccgtgctccacctaagatcaatcccgacaactacgggatggacttaaattccgacgactccacggatgatgaagcccacccaaggaagcccattcccacctgggcaaggggtacgcccctgagccaggcgatcattcatcagtactatcatccccctaatctgctggagctgtttgggacaatactgccgttggacctggaggatatcttcaagaaaagcaaaccaagataccacaagcgtacgagctcagccgtttggaacagcccacccctgcagggggcccgggttccatccagcctggcctactccctcaaaaagcactag

SEQ ID NO: 24946 - DNA, 1728 bp, Artificial Sequence
  Description of Artificial Sequence: Synthetic coding sequence
atgaccagcaagaagctggtgaacagcgtggccggctgcgccgacgacgcgctcgccggacttgtcgcatgcaatccaaacttgcagctcctgcaggggcacagggtcgccctccgaagtgatctggactccctgaagggaagagtagctctgctcagtgggggcggatctggacacgagccagcccacgcggggtttattgggaagggaatgctgactggcgtcatcgccggtgccgttttcacatctcccgccgtgggatctattctggccgctattagagcggtggctcaggccggcacggtaggaacactgctaatcgtgaaaaactacacgggagatcggcttaacttcggcctggccagagaacaggctagggctgaggggatcccggtggagatggttgtcatcggcgacgactccgcttttacagtgctcaaaaaagcgggaaggagggggttgtgtggaaccgttctgatccataaagtagccggcgcactggcggaagctggtgttgggctggaggagatcgctaagcaggtgaatgtagtggccaaggccatgggaacgctgggggtttcactgtcctcatgtagcgtccctggttcgaaacctacttttgagctctctgctgatgaggtggaattggggctaggcattcatggagaagcaggggtccgtcgcatcaagatggccacagccgacgagatcgtgaagctgatgctggaccacatgaccaacacaaccaatgcttcacacgtccccgtgcaacccggaagtagtgtggttatgatggtgaataatttaggagggttgagctttctggaactggggatcatcgccgacgccaccgttcggagcctggagggtcggggagtgaagatagccagagctttggtcgggacctttatgtcggctctcgagatgccgggcatttcccttactcttctgcttgttgacgagcccctactgaaacttatcgacgcggagacaacggccgccgcatggccgaatgtcgcagccgtcagtatcacaggcaggaagcgatcccgagttgccccagcggagccacaagaggcccccgattccacggctgctggtggcagtgcttctaaaagaatggctttggttctggagcgggtgtgttctacattattaggcctggaagagcacctcaacgcgctcgatcgggctgcaggtgatggtgattgtggaactacacattctagagcagcccgcgcaattcaagaatggcttaaggaagggcccccacccgcttcccccgcacagctgttgtccaagctgtccgtcctactcctcgagaagatgggtggttctagcggggccctgtatgggctgttcctgaccgctgccgcacagcctctcaaggctaaaacttcgctgccagcctggtctgcagccatggacgctggactggaagccatgcagaaatatggcaaagccgcgcccggagacagaaccatgctggattctctttgggccgcaggccaggagctccaggcttggaagtcccccggtgcagacttactacaagtgctgacgaaggctgtgaagtccgcagaagcggctgcagaggctacaaaaaacatggaggcgggtgccggcagggcgtcctacatttcttcagcaagactagagcagcctgaccctggcgctgtcgctgccgccgcaatactccgagctatcctcgaagtgctgcagtcctag

SEQ ID NO: 24947 - DNA, 1080 bp, Artificial Sequence
  Description of Artificial Sequence: Synthetic coding sequence
atggccgccccctgcgccgaggaccccagcctggagcggcacttcaagggccaccgggatgcagtaacttgtgtagacttctctatcaatactaagcagctcgcttctggttccatggacagctgtttgatggtgtggcatatgaagcctcagagcagggcctaccggttcactggtcacaaagacgcggttacctgtgtgaacttctccccctcaggtcacctattggcgtctggcagccgggacaagaccgtacgaatctgggtccctaatgttaagggcgagagtacagttttccgtgcacatacggctactgtaagatccgtgcacttttgcagcgatggacagtctttcgttaccgcatcagacgataaaaccgtaaaagtttgggccacgcaccgccagaaattcctcttttccctttcacagcatatcaattgggtgcgatgcgcaaaattcagccctgacggaaggttgatcgtgtctgccagtgatgacaaaacagtgaaactatgggataaaagctcccgggagtgtgttcactcatactgcgaacatgggggattcgttacatacgtggattttcatccatctggcacctgcatagcagccgcaggcatggacaacaccgtcaaggtgtgggacgtccgaacacatcgcttgcttcagcactaccagctgcacagcgccgccgtgaacgggctgtctttccacccgtctgggaattatttaataacagcgtctagcgattctactctcaagatcctggacttgatggagggcaggcttctctataccctgcatggtcaccaaggtccagccactactgtcgccttttcccgcaccggggaatactttgcgagcggaggcagcgacgagcaagtgatggtttggaaatccaattttgatattgtcgatcacggcgaagtcaccaaggtccctcgcccccccgctaccctggccagctctatgggaaatttgacagtaagtatcttggagcagcggcttaccctgaccgaggacaagcttaagcagtgcctcgagaaccagcagctgattatgcagagagctacaccttag

SEQ ID NO: 24948 - DNA, 633 bp, Artificial Sequence
  Description of Artificial Sequence: Synthetic coding sequence
atggccgccagcgtggagcagcgggagggcaccatccaggtgcagggccaggccctattcttccgtgaggcgctgcccggttctgggcaggccaggttctcagtgctcctgctgcacgggatcagattttcctctgaaacttggcagaacttgggtacactccatagactcgcccaagctgggtatcgcgccgtggccattgatttgcctggactgggccacagcaaagaggcggcagccccggcccctatcggtgaactcgccccagggtccttcctagcagccgtcgtggacgcacttgagctgggaccgcccgtggtcatctctccttctctgagcggcatgtattctcttccatttctgactgcccccgggagccagctgccaggcttcgtccccgtcgccccaatttgtaccgataagataaatgccgccaactatgcatccgtgaagaccccagccctcatagtttatggcgatcaagaccctatggggcagactagtttcgagcatctgaaacagctcccgaaccaccgggtcttgattatgaaaggagctggccatccctgctatctagacaaacccgaagagtggcataccggtctgctggacttcctgcagggactgcagtag

SEQ ID NO: 24949 - DNA, 1491 bp, Artificial Sequence
  Description of Artificial Sequence: Synthetic coding sequence
atggaccaggactacgagcggcggctgctgcggcagatcgtgatccagaatgagaacacaatgcccagggtcacagagatgcgcagaactcttacccctgcatcctcccctgtgagctctccctccaagcatggagatcggttcatcccgtcaagggccggagcaaattggtccgtgaactttcacagaattaacgagaacgaaaaatccccttcacagaatcggaaagctaaagacgccaccagtgataacgggaaagacggtctcgcttattcagccctcctgaagaacgagctcctcggcgctggaattgaaaaggtacaggacccccagacagaggataggaggttgcaaccatcaacacctgagaagaaaggcctgttcacatactcactatctactaaacgctccagcccggatgacggtaatgatgtcagcccctatagcctgagccccgtttccaacaaatcccagaaactgttaagatcaccacggaagcctactcgcaagattagcaagatccctttcaaggtgctggatgcaccagagctgcaggacgatttctacctcaacttggttgactggtcctctctgaatgtgctgtcggtgggactgggcacctgcgtctatctgtggtcagcttgcacctcccaggtgacaagactttgtgatctgagtgttgaaggagatagcgttacctctgtaggctggagcgagcgagggaaccttgtggccgtgggtactcataaggggtttgtccaaatatgggacgcggcagctgggaaaaagctgagcatgttagagggtcacacagcgcgggtaggggccctagcctggaacgctgagcaattgtcctctggctcacgggaccggatgatcctgcagcgcgacattagaacgccacccctacaatcagagcgaagactgcagggacatagacaagaggtgtgcggcctgaagtggtccactgaccatcagttactcgcgagtgggggtaacgataataagctactggtttggaatcactcttcactctcaccagtgcagcagtacactgaacatctcgcagccgtaaaggccatcgcttggtccccccaccagcacggattactcgcaagcggtggagggaccgccgaccgctgtattcggttttggaacactctcaccgggcaacccctacagtgcattgataccgggtcccaggtgtgcaatctggcctggtctaagcatgccaatgaactcgtaagcacacacggatactctcaaaatcagatcctcgtgtggaaatatccctctttgacccaagtagccaaactgacaggccacagctatagagttttatacctcgccatgtcacctgatggggaggccatcgttacaggagcaggtgacgaaaccctgcgattttggaatgtattttcaaagacccgaagcacaaaggttaagtgggagtctgtttccgttttgaatctgttcacaaggatacggtag

SEQ ID NO: 24950 - DNA, 390 bp, Artificial Sequence
  Description of Artificial Sequence: Synthetic coding sequence
atggccgagctgatccagaagaagctgcagggcgaggtggagaagtaccagcagctccagaaagatctgagcaagtctatgtcaggacgccaaaaactagaggctcagctcactgaaaacaacattgtgaaggaggaattagccctcctcgatggcagcaatgtcgtattcaagctgctgggtcccgtgctggtgaaacaggagttgggagaagcccgcgccaccgtgggcaagcgactggactatattaccgcagagattaaaagatatgagtctcagttgcgagacctggaaaggcagagtgagcagcaacgcgagacgctagctcagcttcagcaagagtttcagcgggcccaggccgcaaaggccggagctccaggcaaggcctag

SEQ ID NO: 24951 - DNA, 888 bp, Artificial Sequence
  Description of Artificial Sequence: Synthetic coding sequence
atggagctgatccaggacaccagccggccccccctggagtacgtgaagggcgtccctctcataaaatattttgcggaggccctcggtcctcttcagtcttttcaagctcgccctgatgacctcttgattaacacctacccaaagtcggggaccacctgggtgtctcagattcttgacatgatttatcagggtggagatttagaaaagtgcaatcgagcaccgatttacgttagagtcccttttctggaggttaacgatcctggggaaccctcgggtttggaaacacttaaagacaccccaccaccacgcctaatcaagtcgcacctgcctcttgcactgcttccgcagaccctgttggatcagaaggtgaaggtagtgtatgtcgccaggaacccaaaagatgtcgccgtgtcatactaccacttccaccgtatggaaaaggctcatcctgagccaggcacttgggacagttttctggagaaattcatggccggggaggtttcttatggctcctggtaccagcacgtccaggaatggtgggagctctctcggacccatcccgtgctgtacctcttttatgaggacatgaaggagaatcctaagcgcgagattcagaaaattttggaatttgtcggccgctcactgccagaggagacaatggatttcatggtgcagcacacgagttttaaagagatgaagaagaacccaatgaccaattacaccactgtgccacaggagctcatggaccatagcatttccccatttatgcggaaaggaatggcgggagattggaaaaccactttcacagtagctcaaaatgagcgcttcgacgccgattacgccgaaaagatggccggttgtagcctgtctttccgatctgaactgtag

SEQ ID NO: 24952 - DNA, 888 bp, Artificial Sequence
  Description of Artificial Sequence: Synthetic coding sequence
atggagctgatccaggacaccagccggccccccctggagtacgtgaaaggcgttcccctcattaaatattttgccgaagccctgggccctctccagagtttccaagcacgcccagatgatcttctaattaacacgtatcccaagtctggtacaacatgggtgtcacaaatcctggatatgatatatcagggaggtgatctggagaagtgtaacagagcacctatttacgtgagggttcccttcctagaagtgaacgaccccggtgagcctagtggtctcgaaacccttaaagacacacctcctccgcgactcattaagtcccatctccccttagccttgctaccacagacgttgctggaccaaaaggtgaaagtggtttacgttgcccgcaatcccaaagatgtggccgtcagctattaccatttccatcggatggaaaaggctcatcccgagcctggcacgtgggactccttcctggaaaaattcatggcaggagaagtttcctacgggagctggtatcagcatgtgcaagagtggtgggaactgagcagaacccatcccgtgttatacctgttctatgaagatatgaaggaaaaccccaagagggagatccaaaaaattcttgagtttgtgggaaggagcttgccggaagaaaccatggactttatggtgcagcacacatcatttaaggagatgaagaagaatcctatgacaaactatacaaccgtgccacaagagctgatggaccacagcattagccctttcatgcgcaagggtatggcaggagattggaaaactacattcaccgtcgcacagaacgagaggtttgatgccgactacgccgagaaaatggcggggtgttccttgtctttccggtccgagctttag

SEQ ID NO: 24953 - DNA, 354 bp, Artificial Sequence
  Description of Artificial Sequence: Synthetic coding sequence
atgctgtgctggggcaacgccagcttcggccagctgggcctgggcggaatagacgaagagatagtgctcgagcctagaaaatcagatttcttcatcaataaaagagtccgagatgtcggatgcggcctgagacacaccgttttcgtcttggatgatggaacagtgtacacatgcggatgtaacgacctgggccagcttggtcacgagaagagccgcaagaagccagagatacttaaggtatgccagatcagccggctgtacagattgctagtggtaaccatcatccatcttcatttcttgaagcaggttaaaagctcagtgggcgaccggatcaatatggcgaattgggtctag

SEQ ID NO: 24954 - DNA, 3174 bp, Artificial Sequence
  Description of Artificial Sequence: Synthetic coding sequence
atgctgtgctggggcaacgccagcttcggccagctgggcctgggcggtattgacgaggaaatcgttcttgagcctcgaaagagcgatttcttcatcaacaaacgggttagagatgttggatgcggattaaggcatactgtctttgtgttagacgatggcacagtatacacgtgtggctgcaacgacctggggcagctcggacacgaaaagagcagaaaaaaacccgaacaggttgtggccctggatgcacaaaacatcgtggccgtttcctgcggagaagcccacactctggcattaaacgacaagggacaggtgtacgcatggggtctcgactcagacggacaacttgggctcgtgggttccgaagaatgtattagggtgccacgcaatattaaatccttaagcgatattcagattgtgcaggtcgcgtgcggatactaccacagcctggctctgtccaaggccagcgaggtgttctgctgggggcaaaacaagtatggacaactgggactgggcacagattgcaaaaagcagaccagcccgcaactcctgaagtctctgttaggcatacccttcatgcaggtcgccgctggcggggctcatagctttgtgctgaccctgtctggtgcaatcttcggctggggccgcaacaagttcggccaactcggcctcaatgacgagaatgaccgttatgtcccgaacctgcttaagtcactcaggtcacaaaagatcgtgtatatatgctgtggcgaggatcacacagctgcactaaccaaggagggaggggtctttacgtttggtgccggcggctatgggcagttaggccataattcaacatctcacgaaatcaatcctcggaaggtatttgaactgatggggagtattgtgaccgagatcgcttgcggacgacagcacactagtgcatttgtaccaagcagcggaagaatatattcctttggcctcggcggtaacgggcaattaggcaccggaagcactagtaataggaaatcacccttcaccgtgaagggcaactggtacccatataacggacagtgtttgcctgatattgactccgaggagtatttttgcgtcaagaggatcttttctggaggcgatcaaagcttcagccattactcctctccacaaaattgcgggccccctgacgactttcgatgccccaatccaactaaacagatatggacggtgaacgaagctctgattcagaagtggctgtcataccccagcgggcgcttccccgtcgagatcgctaacgagattgatgggacattttccagttcaggatgtttaaatgggtcatttctagcggtttccaatgacgaccattaccgaacaggtaccaggttctccggcgtcgacatgaacgccgctaggctcctgtttcacaagctgatacaacccgatcatcctcaaatatcgcagcaggtggcagccagcctagagaaaaacctgatacccaaactgaccagctcactccccgatgtggaagccctgaggttctaccttacgctacccgaatgtcctctgatgagcgattctaataatttcactacaatagctattccctttgggacagccctcgtgaacttggagaaggctcctctgaaagtgctggaaaattggtggagcgtgctcgagccccctctatttctgaaaatcgtcgagctgttcaaggaggtagtagttcacttgctgaaactgtataagatcgggattccaccttctgaacggcggattttcaactcatttctgcacacagcactgaaagtgctggaaatcctgcacagggtgaacgaaaagatggggcagatcatccaatatgataaattctacatccacgaggtacaggagttgatcgatatccgtaatgactacattaactgggtgcagcaacaggcttatggcatggatgtaaatcacggcctgaccgagttggccgatatccctgtcaccatctgcacctacccttttgtgtttgatgcccaggccaaaacgacccttttgcagaccgatgccgtactacagatgcagatggcgatcgaccaggcccacaggcagaacgtgtcctctctgttcctgccagtgattgagtccgttaatccgtgtttgatccttgtagttaggagggagaatattgtcggagacgcaatggaagtactccgaaaaaccaagaatatcgattacaagaagccactgaaagtgatctttgtaggcgaggatgcagtggacgctggtggcgtcagaaaagagtttttccttctgattatgagagagcttttggacccaaagtacggtatgttcagatactacgaggattcccgcctgatttggttttccgataaaacttttgaggacagcgacctctttcatctgattggggtgatttgtggacttgcaatatacaactgcacaatagtggacttgcactttcccctcgccctttataaaaagctccttaagaagaaaccaagcctggatgacctgaaggagctcatgcccgatgtgggaagaagcatgcagcagcttcttgattatccagaagatgatattgaagaaactttctgcttgaatttcactattactgtggagaactttggtgccaccgaggtcaaggaactggttctgaatggtgccgacacagcagtaaataagcagaacagacaggagttcgtggacgcctatgtggattatatctttaacaagagcgtcgcaagccttttcgatgcttttcacgccggattccataaagtgtgcggcggcaaagtactgctcctcttccagcctaatgaactccaggcaatggttatcggcaacacaaattatgattggaaggaattggaaaaaaatacagagtataagggcgagtattgggctgagcatcctacgattaagatcttctgggaggtctttcatgaactgccattagagaaaaagaaacaattcctgttgttcctgacgggatctgacagaattcctatcctggggatgaaatccctgaaactagtgattcagagcacagggggcggggaagaatatctccctgtgagccatacctgctttaatctgttggacctgcccaagtacaccgagaaggaaactctcaggagtaaactgattcaagcaattgaccacaacgaggggttcagcctcatctag

SEQ ID NO: 24955 - DNA, 1080 bp, Artificial Sequence
  Description of Artificial Sequence: Synthetic coding sequence
atgagctaccggcgggagctggagaagtaccgggacctggacgaggacgagattctcggcgccctgaccgaagaggaactgaggaccctggaaaacgaattagacgaattggatcccgacaacgctttgttgccagccggcctgcgccaaaaagaccagaccacgaaagctcccactggaccctttaagagagaagagctgctggaccacttagagaagcaggcgaaggaatttaaagatagggaggacctcgttccctatactggcgagaagaggggcaaagtctgggtgccgaaacagaagcccctcgatcccgtgcttgagagcgtgacactagaacccgagcttgaggaggcgttagcaaatgcatctgacgcagaactgtgcgacatcgcggccatcctgggcatgcacacactcatgagtaatcagcagtactaccaagccctgtcctcctcctcaataatgaataaggagggtttgaattctgtgatcaagccaactcagtacaagcccgtcccggatgaagaacccaacagcaccgatgtagaggagactttggagaggattaagaacaacgacccgaagcttgaggaggtgaatctcaacaacataaggaatatacccatcccaactcttaaagcatacgctgaagcactgaaagagaactcctacgtcaagaaattctccatcgttggaactaggagcaacgatcccgtggcttatgcgctcgcagagatgctgaaagaaaacaaagtgctcaagacgctgaacgttgagagtaattttatttccggcgctggcatcctgagactggtcgaagccctgccctacaatacctctctcgtggagatgaagattgacaatcagagccagcctttgggcaataaggtggagatggaaattgtgagcatgttggagaagaacgccacacttctgaaatttggctatcacttcacccaacaagggccccgactcagagcctcaaatgctatgatgaacaacaatgatctggtgagaaagaggaggctggcagacctgactggtccaattatccctaaatgccggtcgggggtttag

SEQ ID NO: 24956 - DNA, 714 bp, Artificial Sequence
  Description of Artificial Sequence: Synthetic coding sequence
atggaggtgatggagggccccctgaacctggcccaccagcagagccggcgggcggatcgcctacttgccgcgggcaagtatgaagaggcaattagttgccataagaaggcagcagcctacctcagtgaagccatgaaattgactcagagtgaacaggcccatctcagtttagagctccagcgcgactcccacatgaagcagctgctactgattcaggagaggtggaagcgcgcccagcgggaggaacgcctcaaagcccagcagaacaccgtgttgtacctgctgcaacagaagagcgaaccagcggaaccttgcattggatctaaagcaccaaaagatgacaagactattatagaggagcaagctacaaaaattgcagacctcaagcgacacgtggagttcctcgtggccgaaaacgagcgccttagaaaggagaataagcagctaaaggctgaaaaggcaagacttctgaagggccctattgagaaagagttagacgtcgatgcagacttcgtggaaacgagcgaactatggtctctgcccccacacgccgagacagcaacagcctccagcacctggcagaaatttgcggctaatacggggaaagccaaggatattcccatcccaaacctgccccctctagatttcccgtcacccgagctgcccctgatggagctatccgaagatatcctaaagggctttatgaacaattag

SEQ ID NO: 24957 - DNA, 1458 bp, Artificial Sequence
  Description of Artificial Sequence: Synthetic coding sequence
atgaacggcaccctggaccaccccgaccagcccgacctggacgccataaagatgttcgtggggcaggttcctaggacgtggtccgagaaggatctgagggagctgtttgaacagtacggggcggtgtacgaaataaatgtgctcagggataggagtcagaaccccccgcagtcgaaaggctgttgctttgtcacattttataccagaaaagctgcactggaggctcagaatgctctgcacaacatgaaagtcttgccggggatgcaccacccaattcagatgaaaccagctgactctgaaaaaaacaacgtggaggaccgcaaactgtttatcggcatgatcagcaaaaaatgcaccgaaaatgacattagagtgatgttctcctcatttgggcaaatcgaggagtgtaggatcctccggggcccagacggactcagtcgcgggtgtgcattcgtgaccttcactacaagggccatggcccaaactgctattaaggccatgcatcaggcccagacgatggaaggctgtagtagccccatggtggtgaagttcgccgacactcagaaggacaaggagcaaaagagaatggcacagcaactgcagcagcagatgcagcaaatttccgctgcctccgtgtggggcaatctggctggtctcaacaccctgggtcctcagtatcttgccctgtatttacaacttttacagcagactgcctccagcggtaacttaaatactctgagttctctccatcccatgggcggccttaacgcaatgcaactgcagaatctcgctgcactggccgctgctgcctccgccgctcaaaacactccctccgggacgaatgccctgaccaccagctctagtcctttatccgtgttgacttcctctggaagcagcccaagctcctccagttccaatagtgtcaaccctattgcttcattaggggcattgcaaacactagctggcgcaaccgcgggcctcaatgtcgggtcactggccggcatggccgccctgaacggggggcttggatcttcgggtctgtcaaacggcacagggagcaccatggaagccttgacccaggcctattccggcattcaacagtatgctgctgctgctctgcctacactgtataatcagaatcttttgacccaacaatcaatcggggcagctggttctcagaaggaaggccctgagggtgccaacctttttatatatcatctgccacaggagttcggcgatcaggatctgctccagatgttcatgccattcggcaatgtagtcagtgcaaaagttttcatcgacaagcagaccaatttaagcaagtgctttgggttcgtgagctacgacaaccccgtctcagcccaggcagcaatacaaagcatgaatgggttccaaatcgggatgaaaagactcaaagtccagctaaaacgaagtaagaatgattctaaaccttactag

SEQ ID NO: 24958 - DNA, 1452 bp, Artificial Sequence
  Description of Artificial Sequence: Synthetic coding sequence
atgaacggcaccctggaccaccccgaccagcccgacctggacgccatcaagatgtttgtcggtcaggttccacggacttggagtgaaaaggaccttcgtgaattgttcgagcagtacggagccgtgtacgaaattaatgtgctgagagacagatcccagaaccctccacagtctaaaggttgttgcttcgtgacgttctataccaggaaagccgctctggaagcccagaatgcactgcataatatgaaagtcctgcccggcatgcaccaccccatccagatgaaaccagcagacagcgagaagaataatgctgtggaggatcggaaactgttcatcggaatgatcagcaagaagtgcaccgagaatgatatccgtgtgatgttttcctcctttgggcagatagaggagtgccgcattctgcggggtccggacggtctgagtcgcggctgcgcctttgtgactttcaccacacgggccatggcacagaccgcaattaaggctatgcatcaggctcagacaatggaaggatgtagtagccctatggtggtcaagtttgcggacactcaaaaggacaaagagcagaaacgcatggcgcagcagcttcagcagcagatgcagcaaatcagtgctgccagtgtgtggggtaaccttgccggcctcaataccctgggaccacagtatctggcattgctgcagcagactgctagttccggaaacctgaatacactgagcagcttgcacccaatgggaggattaaacgcaatgcagttacagaatctggcagctcttgccgccgcggcaagcgcggcacaaaataccccaagtggaaccaatgcccttacaacctcctcgtcgcctctgagtgtgcttacaagttccgcggggtcatctccttcgtcaagttcttctaacagtgttaacccaatagcctctttgggagcattacagacactagccggcgcgacggccgggctcaacgtggggagtctcgcaggaatggcggccctgaatggcggcctcggaagctccggtctctccaatggtactgggtcaacaatggaggccctcactcaggcgtactctgggatccagcaatatgcggccgctgctctgccgacgctctacaaccaaaatctattgacacagcaaagcatcggcgccgccggatcgcagaaggaaggccccgagggtgcgaacctctttatctatcatttgccgcaggagttcggtgatcaagacttactccagatgtttatgcccttcggtaacgtcgtaagtgcaaaagtgttcattgacaaacaaacaaatctgtctaagtgtttcggatttgtctcctacgacaatccggtcagcgcccaagcagcaatccagtctatgaatggatttcaaatcgggatgaaacgccttaaggtccagctgaaacgatccaaaaacgatagcaagccgtactag

SEQ ID NO: 24959 - DNA, 3570 bp, Artificial Sequence
  Description of Artificial Sequence: Synthetic coding sequence
atggacgacaagggcgaccccagcaacgaggaggcccccaaggccatcaagccgaccagtaaagagttccgaaagacttggggattccgccgaactacgatcgccaagagggaaggcgcgggagacgcagaagctgacccccttgagccccccccaccacaacagcagttgggactgtcacttagaagaagcggccggcagcctaagcgcactgaacgcgttgaacagtttttgaccatcgcacgccggaggggtcgtaggtcaatgccagttagcctggaggactcgggggagcccacttcgtgccccgcaacagatgccgaaacagcttctgaaggatccgtcgaaagcgcctcggaaacacgctccggaccacagtcggctagcaccgccgttaaagagaggcctgctagcagcgagaaggtgaaaggaggagacgaccacgatgacactagcgattctgatagcgacggtctgaccttgaaggaacttcagaataggttgcggagaaaaagggagcaagagccgaccgaaaggcctctcaaaggaatccagtctagactgcgcaaaaaacgaagagaggaggggccagccgagaccgtcgggtccgaagctagcgataccgtcgaaggagtgttgcctagcaagcaggaaccagaaaatgaccaaggtgttgtttctcaggcaggcaaggatgaccgggagagcaagcttgaaggtaaagccgctcaagatatcaaggacgaggagcccggtgatctgggacgcccaaaaccggaatgtgagggatacgaccccaatgctttgtactgtatctgccgccagccccacaacaatcgatttatgatttgttgtgaccgctgtgaagagtggttccacggcgattgcgttggcataagtgaagcccgcggccgcctcctagaacggaacggtgaggattatatttgccccaattgcaccatcctgcaggtacaggacgaaacccatagtgagacggctgatcagcaagaggcaaagtggcgccccggcgatgcggatggcacagattgtacgtcaatcggtacaattgaacagaagagttccgaagatcaaggaataaaggggcggatcgagaaagccgcaaatcccagcggtaaaaaaaagctgaagattttccagcccgtcatcgaggcaccaggtgctagtaagtgtattggccctggctgttgtcatgtcgctcagcccgatagcgtgtattgctctaacgactgtatactgaaacacgccgccgcaaccatgaagtttctgtcttctggtaaggaacagaagccaaagccaaaagaaaaaatgaagatgaagcccgagaaaccctccctgcctaagtgcggcgctcaggcaggaataaaaataagctccgtccataagagacccgctccggagaaaaaggaaacaactgtgaaaaaagccgtggttgtgcccgccaggtccgaggccctgggcaaggaggccgcttgcgaatcctcaacaccctcctgggcctctgaccacaactacaatgccgtgaagcctgagaagaccgctgcaccaagtccttctttactgtataagtcaaccaaagaggatcgccgttccgaggagaaggccgcagctatggccgccagtaagaaaactgcgccacccgggagtgcagtgggaaagcagcctgccccaagaaatctagtgccgaaaaagagctcctttgctaatgtggcagccgctacacctgccataaaaaagccaccatcagggtttaaaggtaccatacccaagaggccctggttaagtgctacgccaagcagtggggcatcggccgcacggcaggcaggaccagcaccagctgccgccaccgctgccagtaaaaagttcccaggcagcgcagcgttggtaggagccgtgagaaagccagtcgtgccgtccgtccctatggcctccccagccccaggacgcctgggagctatgagcgcagcgccctcgcaacctaacagccaaatcagacagaacatcagacggtccttgaaggaaatcctgtggaaacgtgtgaatgacagtgatgacctcattatgacagagaacgaagttggcaaaattgcacttcacatcgagaaggaaatgttcaaccttttccaagtgacagacaacagatacaagagcaaataccgatcaatcatgtttaatttgaaggatccaaaaaaccagggactttttcatagggtgctccgtgaggaaatctctctcgccaaattagttcgacttaaacccgaagagctcgtctccaaggagctgtctacctggaaggaacgaccagcgcgaagtgtgatggagtccaggacgaaacttcacaatgaatcaaaaaagacagccccgagacaggaagcaatccctgacctggaagactcccctcctgtgagcgacagcgaggagcaacaagaaagcgccagagccgtgcctgagaagtccactgccccattgttggatgtgttttcaagtatgctgaaagacactacatcccagcatagagcgcatctatttgatttgaattgtaagatctgcacaggccaggtgccaagcgcagaggatgaaccagcgccaaaaaagcaaaaactgagcgctagcgtcaaaaaggaggacctaaagtcaaaacacgactcatccgcaccagatcccgcccctgactcagcagacgaggtgatgcccgaagcggtcccggaggtggcatctgagccggggctagaatctgccagccatccaaacgtggatcgaacgtattttcctgggccccccggggatggacatccggagcccagcccattagaggacctgagcccatgcccagcctcctgcgggagtggggtggtgactacagtgaccgtctctggcagggatcctcgtaccgcccccagtagttcatgtaccgcagttgcctccgctgcatcccggccagactccactcatatggtggaagctcggcaggatgtccccaaaccagtgctcacgtccgtgatggtgccaaagagcatactggccaaacccagtagtagtcctgaccccaggtacctgagcgtgcccccctctccaaacatatccacctcagaatcgaggagccccccagagggggatacgaccctcttcctgagccggttatccaccatttggaaagggtttataaacatgcagagtgtagcaaagtttgtgaccaaagcatatcctgtgtccggctgtttcgattatctgagcgaggatctgcctgacactattcacattggaggtaggattgcgccaaagaccgtctgggactatgttggtaaactcaagtcctcagtttccaaggaattgtgtttgattcgatttcatcctgccacagaagaggaggaggtcgcctatataagcctatacagctacttcagcagccgaggccgtttcggagtggtggctaataacaaccgccatgtgaaagatttgtacctgattcccctctcggctcaagaccctgtaccctccaaactacttccgtttgagggccctggcaagaggaggctatctggctggcgttag

SEQ ID NO: 24960 - DNA, 3570 bp, Artificial Sequence
  Description of Artificial Sequence: Synthetic coding sequence
atggacgacaagggcgaccccagcaacgaggaggcccccaaggccatcaaacccacaagcaaagaattcagaaaaacatggggatttcgaagaacaacaattgcgaaaagggaaggtgctggtgacgccgaggcagaccccctggaacctccaccaccccagcagcaactcggcctcagtctgcgaaggagcggaagacaacccaagcggaccgagcgcgttgaacaatttcttactatagctcggcgacgcggcagaaggtccatgcccgttagcctggaagactcaggggagcctacttcctgtcctgcgactgatgcggaaaccgcctcagaggggtcggttgagagcgcgtctgaaacaaggtccggaccccaatctgcctccaccgcggtgaaggagcggccggcaagctcagagaaggttaaaggcggcgacgatcatgacgatacgtcagactcagattccgacggcttaaccttaaaagaacttcagaatcgacttagacgaaaacgcgagcaggagcctacggaacgccccctcaaaggaatccagtcccggctgagaaaaaaacgccgcgaggaggggccagcagagaccgtaggctccgaggcttctgacacagtagaaggagtgctgccctccaaacaagagcccgagaatgatcagggtgtggtatctcaggcaggtaaggacgatcgggagagcaaactcgaggggaaagccgcccaggacattaaagacgaagaacctggcgatctgggacgtcctaagcctgaatgtgaaggttacgatcctaacgccctctattgtatctgccgccaaccccataacaataggttcatgatttgctgtgatagatgcgaagaatggtttcatggagattgcgtgggaattagcgaagctagaggcaggctgctcgaacgtaacggggaggattatatctgccctaattgcaccatcctgcaagtgcaggacgaaacccacagtgagacagcagaccagcaagaggctaaatggcgcccaggagatgcagacggcacagactgcacgagcattggcactattgagcagaagtctagcgaggatcagggcataaagggacggatagagaaagctgccaatcctagcggtaaaaagaaattaaaaatctttcaaccggttattgaggctcctggcgcctccaagtgcattggaccgggctgttgtcatgttgcccagcctgacagcgtgtattgttctaatgactgcattctcaagcacgccgcagctactatgaagttcctgagctctggcaaggagcaaaaacccaaaccgaaggagaaaatgaagatgaagccagagaaaccaagcctccctaagtgcggggcacaggccggtataaagattagctcagtccacaaacgcccagctccagagaagaaggagaccaccgtcaaaaaagctgtcgtagttccagcccgctctgaagcgttgggcaaggaagccgcctgcgaaagcagcaccccatcatgggctagcgatcacaactataatgctgtgaaaccagaaaagaccgcagctccaagtccgagtcttctgtacaaatctaccaaggaggatagacgctcagaggaaaaggctgctgcgatggccgccagtaaaaaaactgccccgcctggttccgcagttggcaagcagcccgctccccgaaacctggtgcctaagaaaagttccttcgccaacgtggcagccgctaccccagccatcaaaaagccacccagtggctttaaaggaacaattcccaagcggccatggctcagcgctacaccatcttccggtgcctctgctgcacggcaggctggacctgcaccggctgctgccaccgcagcctccaagaagttccccggttcagccgctctggtgggagctgtcaggaagcccgtcgtaccttctgtcccaatggcctctcccgctccgggcagattaggcgccatgagtgctgccccctctcaacctaacagccagatccgtcagaacatccggagatcgcttaaggaaattctgtggaaacgcgtcaacgattcggacgatctcattatgaccgagaacgaggttgggaaaatcgccctgcacattgagaaggagatgtttaatctgtttcaggtgactgataatcgctacaaaagcaaatatcggagcatcatgttcaatctgaaggacccaaagaaccaggggctttttcatcgcgtgttgagagaggagatctctcttgcaaaacttgtacgcctaaaacccgaagagctggtgtctaaagaactgtccacctggaaagagcgcccagctaggagtgtgatggagagtagaacaaaactgcacaacgagtctaaaaaaaccgcaccacgtcaggaggctatcccagacctggaagactccccccccgtgtcggactccgaggaacagcaagaatccgcacgggcggtgccagaaaagtcaaccgctccccttcttgatgtgttctcctctatgctgaaggacacaacgtcccaacacagagcccacctgttcgacttaaattgtaagatttgtacagggcaagtgccaagtgcagaggatgagcccgccccgaagaaacaaaaactgtctgcatccgtgaaaaaagaagaccttaagtccaagcacgattcttccgctcccgacccagcccctgactctgctgacgaggtaatgcccgaagccgtgccagaggtggcctcggaacctggcttggaaagtgcttctcatcctaacgtggatagaacatatttcccaggcccacccggtgatgggcacccagaaccatcccccctggaagatttaagtccctgtcctgcttcttgcggctccggagtggtgaccacagtcaccgtgagcgggcgagacccgcgcaccgcacctagttctagctgcacagcagtggctagcgcagcctctcgacccgattctacacacatggtggaagcccggcaagacgtcccaaagcccgttctgacatcagtcatggttcctaagagcatactcgctaaaccttcttcaagccctgacccgagatatctcagcgtccctcccagtcctaacattagtacaagtgaatccaggtctccccctgagggagataccaccctctttctgagccggctctcaactatatggaaggggtttataaatatgcagagcgtggccaagttcgtcactaaagcctatccagtcagtgggtgctttgactacctgtcggaggacttgccggatacaattcatattggtggacgcattgccccaaagacagtatgggattatgttggaaaactaaaaagctctgtttctaaggaactgtgtctcatccgattccatcccgcaacagaggaagaagaggttgcctatatttcactctatagctatttttcatcacgcggccgattcggtgtggtggccaataataatcgccacgtgaaagatctatacttaatcccgcttagtgcccaggaccctgtgccttccaagttattaccatttgaaggtcccgggaaacgaaggttgtcgggttggcgctag

SEQ ID NO: 24961 - DNA, 6723 bp, Artificial Sequence
  Description of Artificial Sequence: Synthetic coding sequence
atggacgacaagggcgaccccagcaacgaggaggcccccaaggccattaagccgacttctaaagaatttcgaaaaacctggggatttaggagaaccacaatcgctaagagagaaggggccggcgacgctgaagcagaccccctggaacctcccccgcctcagcagcagcttgggctgagcctgaggagaagtgggaggcagcctaagcggacagagagggtcgagcagtttctgacaatcgctcgtcggcgggggcgcaggtctatgccggtgtccctggaagattctggagaacctacctcctgcccggccactgatgctgaaaccgcttccgagggctcagtggaatcggcctcagagaccagaagcggccctcaaagtgcctctaccgctgtcaaagaaaggccagcaagctcagagaaagtcaaaggaggggacgaccatgatgatacctctgatagcgacagtgacggattgacccttaaggaattacagaataggctcagacggaagcgggaacaggaacccaccgagcggcctcttaagggaatccagagtaggctgcggaagaagcggcgagaagagggccccgccgagacggtgggctccgaggccagcgacaccgtcgaaggggttctgccaagcaagcaagaacctgaaaatgatcagggcgtggtgtcccaagcaggaaaggatgacagagaatccaaattagaaggcaaggccgctcaagatatcaaagatgaggagcccggggatctgggacggcccaaaccggaatgcgagggatatgatcctaatgccctctattgcatctgccgccagccacataataaccggttcatgatctgttgtgaccggtgtgaagaatggttccacggggactgcgtgggaatcagcgaagcccgaggtagactgctcgagcggaatggagaggattatatttgccccaactgcacgatcctgcaggttcaggatgaaacccacagtgaaactgcggaccagcaggaggctaagtggcggcctggggacgccgatggaacagattgtacatcaatagggactatcgaacaaaagtctagcgaggatcaagggatcaagggacgtatcgagaaagctgccaacccatcaggcaagaagaagttgaagattttccagccagtgatcgaagctcctggcgcttctaagtgtattggaccgggctgttgtcacgttgctcagcccgactcagtgtattgctcaaacgactgtattcttaagcacgccgccgccactatgaaatttctgagtagtgggaaagaacagaagcctaagcctaaggaaaaaatgaaaatgaagcctgagaagccctcactgcctaagtgtggagcccaggcaggtataaagatatcttccgttcacaaaagacccgcccccgaaaagaaagagacgacagtgaagaaagctgttgtagttccagcccgtagtgaggctctgggcaaagaagcagcctgcgaaagcagcacgccgtcctgggctagcgatcacaactacaatgcagtgaagccggagaaaaccgcagcccccagcccatccctgctatataaatcaacgaaggaagatcgtagaagcgaagaaaaagctgcagctatggctgcatccaaaaaaaccgcacctccgggcagcgccgtggggaaacagccagcacctcgtaatctggtcccgaaaaaatctagcttcgctaatgtggctgcggcaacaccagcgatcaagaaaccgccaagcggctttaagggcacgatccctaaacgtccctggctgtccgccaccccctcctccggtgcgtctgctgccaggcaggcggggccagcgccggccgcggcaactgcggcctccaaaaagtttcctgggtccgctgccctggtcggggctgtgcgcaaacccgtcgtgccgtctgtgccaatggccagtccagcaccaggcagactgggcgctatgtctgcagctccctcacaacccaactcccagatcaggcagaatattaggcgatctctcaaggaaatcctgtggaagagagttaacgacagcgacgatctcattatgaccgaaaatgaagtgggaaaaattgccttgcacattgagaaggaaatgtttaatttattccaggtcactgataacagatataaatccaaatacaggagcattatgttcaacctaaaggatccgaagaatcagggtctctttcacagggtgctacgcgaagagatctcgcttgccaagctggtgaggttaaaacccgaggagctcgtctcaaaggagctctctacatggaaggagagacctgcccgctcagtcatggagtcaagaaccaaactacataacgaatccaagaagacagcccctagacaggaggccatcccagaccttgaggatagcccccctgtgtcggactctgaggagcagcaggagtcagcaagggccgttcctgagaaatcaactgctccattattagatgtattctcctctatgttaaaggatacaactagtcagcatcgcgcacatctattcgatctgaattgtaagatctgtactgggcaggtaccctcagcagaagacgaaccagcccccaaaaaacagaaacttagtgcctcggtgaaaaaagaggacctgaagtcaaagcatgactcatctgctcccgacccggctcccgatagtgcagacgaggtgatgcccgaggctgtgcctgaggtagcctcggagccaggactggagagcgcctctcaccccaacgttgaccggacttacttccccggaccacctggagatggacacccagagccgtctccattggaagacttgagcccctgcccggccagctgtggctcaggagtggtgacaaccgtcactgtcagcggccgggatcctcgcaccgccccgtccagctcgtgcactgccgtcgcatctgctgccagccgccccgattccacacatatggtcgaggcccgtcaggacgtgcccaaaccagtcttaacctcggtcatggtccccaagtctatccttgccaagccctctagctcaccagatcctagatatctctcagtgcccccttctcctaatatctccacctccgagtctaggtccccaccagagggagataccaccctctttctctctagactgtccactatctggaagggtttcattaacatgcagtcagtagccaagttcgtcactaaagcttaccccgtgagcggctgcttcgactatctgtccgaagacctgccggataccattcatattggcggcaggatcgcccctaagacagtgtgggattacgtgggcaaactgaaatcttcggtttccaaggaactgtgcctgatcagattccaccccgccacagaagaagaagaagtggcttatatcagtctgtacagttattttagtagtaggggtcgttttggcgttgtggctaataacaatcgccacgtgaaggatttgtatcttatcccattgagcgcacaggaccctgtgcctagtaagctccttcccttcgaagggccaggcctcgagagtccccggcccaatatcattctgggcctggtgatttgccaaaaaatcaaacgtcccgccaattccggggaactggataagatggacgaaaaacggacccggcttcagccagaggaggcggatgtgccagcgtatcccaaggtggcaacagtgccacagtcagagaagaagccaagcaaatatccgctgtgttctgctgacgctgctgtctccacgactccccctggctctcccccacccccaccccccctccctgaaccccctgtccttaaggtgctttcgagtttaaaacccgccgctccatctcctgcgacggcagccacgaccgctgccgccgcaagcacagcagcttcctccacagcaagctccgcgtcaaagactgctagcccgcttgaacatattcttcaaacactcttcgggaaaaagaagtcttttgatcctagcgcacgcgagcccccggggtcaactgccggtctgcctcaggaaccaaagacgacagccgaggatggggtgcccgccccgccgctcctggatcctatagtgcagcagtttggccagttctctaaggataaagccctggaggaagaggaggacgaccggccctacgaccccgaggaagagtacgaccctgaaagagctttcgacacgcagttggtcgagagaggcagacgccatgaagtagaaagagcccctgaggcagcagccgccgagagagaggaggtggcatatgacccggaagacgagacaatcctggaggaggccaaagttacagttgacgatcttccgaatcggatgtgcgccgatgtgcgaagaaacagcgtggaacggcccgctgaacctgtggcaggagcagccaccccctccttggtcgagcaacagaagatgcttgaggagttgaataagcagattgaagaacaaaaaaggcagctcgaagagcaggaggaggcattaagacaacagagagccgctgtcggcgtctctatggcccatttctctgtgtctgatgctctaatgtctcctccacctaaatcatcccttcctaaagccgagttattccagcaggaacagcaatctgcggataagccagcgtccctgccacccgcttctcaggcctcaaaccaccgggatccacgacaggcaaggaggctcgccaccgagactggcgagggagagggcgagccccttagtaggctgagtgcaaggggggctcagggtgctttgccagagagggacgccagccgcggtggcctggttggtcaggcccctatgcctgttccagaagaaaaggagcccgcctctagcccgtgggcttccggcgaaaagcctcccgctggatcagagcaggacggttggaaggctgagcccggcgagggcacgcgacccgccactgtgggcgattcttcggcaaggccagcacggcgcgtgttactcccgacacccccgtgtggggccctgcaaccaggctttcctctgcaacatgacggagaaagggaccccttcacctgccccggcttcgcttctcaggacaaggctcttggcagcgctcagtatgaggatcctaggaacctgcactcagccggtcggtcttcttctccggccggagagaccgagggtgatcgcgagccacaggccagacctggggagggtacagcgcccctgccaccaccgggtcagaaagtagggggttcccagcctcccttccagggccagcgggagcccggaccccacgctctcgggatgagcggactccatgggcccaacttcccaggtccgcgggggccggccccacctttccctgaagagaacatcgcttcaaacgatggacctcgtgggcccccacctgcaaggttcggagcgcaaaaaggtccaatcccatcgctattttctggacagcatggaccgcctccttatggggactctagagggcctagccccagctatcttggcggaccccggggagtcgcaccaagccagttcgaagaaagaaaagatccccatggcgaaaagcgcgagttccaggatgcaccttacaacgaggtgacaggagcgcccgctcagtttgagggaacagagcaagctccctttcttggctcacggggaggcgccccattccaatttggaggacaacgcaggccattgctgtcgcagttgaaggggcctaggggcggaccccccccaagccagtttggagggcagaggggacctccccctggtcattttgtaggaccacgcggaccccatccatcacagttcgagacagcgagagggccccaccccaaccagtttgaggggccccgagggcaggccccaaacttcatgccaggcccccgggggattcaaccccagcaattcgaggatcaacgcgttcacagcccacctagattcactaaccagcgggcccctgcacctctccaatttggcgggctgagaggctcagcaccttttagcgaaaagaacgagcagacccccagccgatttcattttcagggccaggctccccaggtgatgaagcccgggcctcggcccctacttgagcttccttctcaccctccccaacaccggaaagaccgctgggaagaggccggccctcccagtgctttgtcctcttctgcccctggtcaggggcccgaagccgacggacagtgggcttccgcggatttccgcgaaggtaagggacacgagtacaggaaccaaacattcgagggaaggcagcgtgagcgttttgacgtcggtcctaaggagaaacctctggaagaaccagacgctcaggggcgtgccagcgaggacagaaggagagagcgggagcgaggccgcaactggagccgcgaaagagattgggatagacctagagagtgggatcgtcaccgagataaggactcgagtagagactgggatcgcaaccgtgagcgctcagcaaatagagatcgcgagcgcgaggcggataggggtaaggagtgggatcggtcccgtgagcgctcaaggaacagggagagagagcgggacaggcggcgcgacagagataggtccagatcgagagagagagatcgtgataaagccagagacagagaaaggggacgggacagaaaggaccgatccaagagtaaggaaagcgcccgagatcccaaacctgaagcctcccgggcctcagatgccggtactgcttcacaagcgtag

SEQ ID NO: 24962 - DNA, 888 bp, Artificial Sequence
  Description of Artificial Sequence: Synthetic coding sequence
atggagctgatccaggacaccagccggccccccctggagtacgtgaaaggcgttccgctgatcaaatatttcgctgaagccctgggtccacttcagtcatttcaagcccggcccgacgatcttctaattaatacatatccaaagtccggcaccacttgggtgtcgcagatactggacatgatttaccagggaggagatctggagaaatgcaatagagcgcctatttacgtgagggttccttttttggaagtgaatgacccaggagaacctagcgggttggaaacattaaaagacaccccaccacctcggttaattaagtctcatctccccctggcattgctgccccagacactgttagatcaaaaggtaaaagtcgtgtatgtggctaggaaccctaaagacgtggctgtttcttactatcattttcatcgtatggaaaaagcccacccggagcccgggacttgggacagtttcctcgagaagttcatggcgggagaggtcagttacggaagttggtatcagcacgtgcaggagtggtgggaactatcccgcacccatccggtattgtacttgttctatgaagacatgaaggagaaccctaaaagggagatccagaaaatattagaattcgtgggcagatcattgcctgaagaaacaatggatttcatggtacaacatactagtttcaaggagatgaagaagaaccccatgactaactacacaaccgtgccacaggagctcatggatcactcaatttcccctttcatgcggaagggcatggctggggactggaagactacttttaccgttgcacagaacgaacgatttgacgccgactatgcagagaaaatggccggatgcagtctctcctttcggagtgaactgtag

SEQ ID NO: 24963 - DNA, 834 bp, Artificial Sequence
  Description of Artificial Sequence: Synthetic coding sequence
atggaggccgccgagaccgaggccgaggccgccgccctggaggtgctagcagaagtcgccggcatactggagccagtaggcctgcaggaagaagcggagcttccagcgaagatcctggtggagttcgtcgtagattcacagaaaaaggacaagctcctgtgctctcagcttcaggtcgcggacttcctgcagaacatcttagcgcaggaagacacagcaaaaggtctggatcccttggcatccgaggataccagtcgccagaaagctatcgccgcaaaggaacagtggaaagagttgaaggctacataccgagaacacgtagaggctatcaaaattggcctgacgaaagctttgacccagatggaggaagctcagagaaaaagaacgcagctgcgagaggcatttgagcagctccaggcgaagaaacagatggctatggaaaagcgccgggcggtgcagaaccaatggcagctgcagcaagaaaaacacctgcaacacctggctgaggtctctgccgaagtgagggaacgaaaaactgggactcagcaggagctggacagagtgttccaaaagctgggcaatttgaagcaacaagctgagcaagagcgtgataagctgcagagataccaaacctttctccaactcctttatacactgcaaggaaaactgttgttccccgaagcagaagccgaagctgaaaacctgcccgacgataaaccgcagcagcctaccaggcctcaagaacagtctacgggggacactatgggcagggatccgggagtctccttcaaggccgtagggctccagcccgcaggagatgtgaacctcccgtag

SEQ ID NO: 24964 - DNA, 1245 bp, Artificial Sequence
  Description of Artificial Sequence: Synthetic coding sequence
atgggcaccgtgaccgaggacctgatccggcggaacgccgagcacaacgattgtgtcattttctcactggaagagctgagtctgcaccagcaggaaattgaacgcttggaacacatcgacaagtggtgtagagacctgaagatattgtatttgcagaataatctaataggcaaaatcgagaatgtgtctaagctgaagaaactcgagtatctgaatctggcccttaacaatattgagaaaatcgaaaacctggaagggtgcgaagagttggccaaactggacctcaccgtaaacttcatcggcgagctgtcttctattaagaacctccagcataatatacatctgaaagaacttttcctcatgggcaatccatgcgcttcattcgatcactacagggagttcgtggtggccactctgcctcagctgaaatggctcgacggtaaagagattgaaccctcggagcgaattaaagcactgcaagattattccgtcatcgaaccacagattcgcgaacaggaaaaagaccactgtctgaaacgagctaagctgaaggaggaggctcaacgcaagcaccaggaggaagacaaaaacgaggacaagcggtctaacgcagggttcgacgggaggtggtacactgatattaacgcaactctgagctccctggagagcaaagatcaccttcaggctcccgataccgaagaacacaacacgaaaaagttagataactccgaggacgacctcgaattctggaacaagccatgcctcttcactcctgagagccggctcgaaacactccgccatatggaaaaacagcgcaaaaaacaggagaagctgagtgagaaaaaaaaaaaagtaaagcctccccggaccctcatcaccgaagatggcaaggccttgaacgttaacgagccgaaaattgactttagcctgaaagataatgagaagcagataatacttgacctcgctgtatacaggtatatggatacatctcttatcgacgtcgatgtccagccaacttacgtgcgggtcatgattaagggcaaaccttttcagctagtcttgccagctgaggttaagccagacagtagcagcgctaaaaggtcccagacaacgggccatcttgtcatatgtatgcccaaggtgggagaggtgattaccggcggccagcgcgccttcaaatcgatgaaaaccacttccgatcgaagtcgtgagcagaccaacacatcctattccaccgggttttag

SEQ ID NO: 24965 - DNA, 2529 bp, Artificial Sequence
  Description of Artificial Sequence: Synthetic coding sequence
atgagcagcagccacttcgccagccggcaccggaaggacatcagcacggagatgattcggaccaaaatcgcccaccggaagagcttaagtcagaaagaaaatagacataaggaatatgagagaaatagacacttcgggcttaaagatgtgaatattccaacactggaaggccggattttagtggaactagacgagacgtcgcagggactggtccccgaaaagacaaatgtcaagcctagagctatgaagacaatcctaggggaccaaaggaaacagatgctgcagaagtataaggaggagaaacagcttcagaaattgaaagaacagcgggagaaagcaaagcgggggattttcaaggtaggtcggtatcgacctgatatgccatgttttctcctgagtaaccagaatgccgtgaaagcagaaccaaagaaggctatcccttccagtgtgcgaatcactcgttcaaaggctaaggaccagatggagcaaactaagatcgacaatgaatccgatgtgagggccattaggcctgggccacggcagactagcgagaagaaagtgtcggacaaggagaagaaggtggttcagcccgtcatgcctacctcgctcagaatgacacgctctgctactcaggccgcgaagcaggtgccgagaaccgtatctagtacaaccgcccgcaagcctgtgaccagagccgccaacgaaaacgaaccagaggggaaggtccctagtaagggaaggcctgccaaaaatgtagagacaaagcccgacaaagggatctcttgcaaggtagattcggaagagaacacgctgaacagccaaacaaatgcaacatccgggatgaaccccgatggtgtgctgtctaaaatggaaaatctccccgagattaacacagcaaagataaaaggaaagaatagttttgcccccaaggactttatgttccaacccctagacggcctgaagacatatcaagtgacacctatgactccccgttccgccaacgctttcctgactcctagttacacctggacaccgttaaagacggaggtggacgagtctcaagcaacgaaagaaatcttggctcagaaatgcaagacctattcaaccaagactatccagcaagactccaataaattaccatgtcccctcggccctctgaccgtgtggcacgaagagcatgtgttgaacaagaatgaagccaccaccaagaacctgaacgggctgcccatcaaggaggtaccaagccttgaacggaatgaggggaggattgcacaaccacaccacggggtgccatacttcaggaatattctgcagtctgaaacagagaaactcacatcacattgcttcgagtgggaccggaagttagaacttgacattcctgacgacgctaaagacctgatccggacagccgtgggccagactcgattgctcatgaaggagcgcttcaagcagtttgagggcctggtggatgactgtgaatacaagcgagggatcaaagagacaacctgcactgacctagacggtttttgggatatggtgtccttccaaatcgaggacgttattcacaaattcaacaacctaatcaaactcgaagaatccggctggcaggtgaacaacaacatgaatcacaatatgaataaaaacgtctttcggaaaaaagtggtaagcgggattgccagtaaacccaagcaagatgatgcagggcggatagccgcgagaaatcgtctggcagcgatcaaaaacgctatgcgggagcgtattcggcaggaggagtgcgcagaaacagccgtctccgtgataccaaaggaagtagataagattgtgttcgacgcagggttcttccgcgtggagtcacccgtcaagctttttagcgggctatcagtctcgtctgaagggcccagtcaaagactggggacgccaaaaagcgtcaacaaagccgtttcccagtctcgtaacgagatgggcattccgcagcagacgacaagtcctgagaacgctggacctcagaatactaaatccgagcatgtgaaaaaaaccttgttcttatcaattcccgagtcgcggagcagcattgaagacgcgcagtgccccggtctgccagacttaattgaagaaaatcatgttgttaataagaccgacctgaaagttgattgcctcagttccgagcgcatgagcttgcctcttctggccggtggtgtcgccgatgacatcaacaccaataaaaaagagggaataagcgatgtagtggagggaatggagctgaactcctccatcacttcacaggacgtgctgatgagctcccctgaaaaaaataccgcaagccagaactccatcttggaggagggcgaaactaagatctcccaaagcgaactgttcgacaataagagtctaactaccgagtgccacctgctggactcagtcggttcttgctacgttgcccgggccgggttggaggttctgggctcatctgatcccaccacaagcgccagcagagttgctggaacgacagcacgttctaagctgcagtag

SEQ ID NO: 24966 - DNA, 1710 bp, Artificial Sequence
  Description of Artificial Sequence: Synthetic coding sequence
atgctgtgcagccccagcttctgcaagctgtgctggaagcggcagcgggaaaacggacaaaggaagtacggtggaccaccccccggatgggatgctgctcctccggagcgggggtgtgagatcttcatagggaagctgccgcgggacctgtttgaagatgagctgattccactctgtgaaaaaattgggaagatttacgagatgaggatgatgatggattttaacgggaataaccgcggctatgcattcgtcactttctcgaataaggtggaggcaaaaaacgctatcaagcagctgaataactatgagatccggaatggccgactgctgggcgtctgcgcaagtgtggacaattgtaggcttttcgtgggtggcattccaaagaccaaaaaacgcgaggagatcttaagcgaaatgaagaaagtgactgaaggagtcgtggacgtgatagtctatcctagtgccgcagacaaaacaaaaaacagaggcttcgcctttgtagaatatgagagtcaccgtgccgccgctatggctcgccggaagcttctcccagggcggatccagctgtggggacacgggattgccgtggattgggctgagccagaagtggaagtggacgaggacaccatgtccagcgtgaagatattatacgtcaggaatcttatgctctccacctcagaagagatgatagagaaggaattcaacaacatcaaaccaggggccgtcgaaagggtgaagaagatccgggactacgcatttgtgcatttctctaacagggaggacgctgtggaagccatgaaagctctcaatggaaaagtactggacgggtctcctatcgaagttactctggctaagccagtcgataaggactcctatgtgagatacacgcgagggacaggcggcaggggaaccatgctccagggagagtacacgtattctctgggtcaggtgtatgacccaacgaccacttatctcggggcaccagtcttctatgcacctcaaacatatgcagctattccgtctctgcacttccccgcgacaaaaggccaccttagcaacagggccatcatccgggccccatccgtgcggggggcagcaggggtccgcgggctgggaggccgcggctacctcgcgtacactggactgggacgaggctaccaggtgaagggcgataagcgtgaggacaagctgtacgacatccttccaggcatggagctcacacccatgaacccggtcactttgaagcctcaaggaattaaacttgccccgcagattctggaggagatatgtcagaagaataattggggtcagcccgtgtaccaactgcacagtgcaatcggccaggatcaacgtcagttgttcctctataagatcactattccggcactggcttcccagaaccctgcgatacacccttttacacctccaaagctgtccgccttcgtggatgaagccaaaacttacgcggccgagtacactctgcaaaccctaggtattcccactgacggcggagatggaactatggcaaccgcagccgccgccgccaccgccttcccgggttacgcagtcccaaacgccacagcaccagtatccgctgcccagctaaagcaggcagtgaccctcggccaggacctggcggcctacacgacctacgaagtctacccaacatttgctgtgacggctcggggcgacgggtatggcaccttttag

SEQ ID NO: 24967 - DNA, 1764 bp, Artificial Sequence
  Description of Artificial Sequence: Synthetic coding sequence
atgagcaccgccatccccggcctgaagaagggcaacaacgccctgcagtctatcatattacaaaccctattggagaaagagaacggccagaggaaatacggcggcccaccccctgggtgggacgcggcacctcctgagcgggggtgcgagattttcataggcaagctcccgcgtgatctgttcgaggacgagctgattcccctatgtgagaagatagggaagatctacgaaatgaggatgatgatggattttaatgggaataatagagggtatgcgtttgttacattctccaataaggtggaggccaaaaatgccatcaagcaactcaacaactacgaaatccgaaatgggagactactgggagtgtgcgccagtgtcgacaactgccggctctttgtcggaggcatccccaagacgaagaaacgtgaagagatactttctgagatgaagaaggtcactgaaggcgtggtggatgtgattgtctatccttccgcggccgataaaaccaagaatcgcggatttgccttcgttgaatacgagtcacatcgtgcggctgcaatggctcgacgaaagctcctgcccggccggattcaactctggggtcatggaatcgctgtggactgggcagaaccggaagtggaggtggatgaggatactatgtcaagcgttaagatcctgtacgtgcgaaatctgatgttaagtacttctgaagagatgatagaaaaagaatttaacaacattaaacccggtgccgtggagagggtcaagaagatccgagattacgcctttgtgcactttagcaatcgagaggatgccgtcgaggctatgaaggccctcaacggcaaggttctcgatgggtcgccaattgaggtgactctagccaagccagtggacaaggattcctatgtcaggtacacacgagggactggagggcgtggtaccatgttacaaggtgagtatacatattcattggggcaggtgtatgacccaacaacaacttatcttggcgcaccagtgttttatgccccccagacctacgccgccatcccatcgctacacttcccggccactaaaggtcacctgtccaaccgggctatcatccgggctccaagcgtcagagagatttatatgaacgtcccagtgggagctgctggcgtgaggggcctgggagggaggggatacctcgcatatacaggcctaggacgggggtatcaggtcaagggcgacaaacgcgaagataaactgtacgacattctgcccggcatggagctaaccccgatgaaccctgtgaccttgaagccgcagggcattaagctggcaccacagatactcgaagagatttgtcaaaaaaataattggggtcagccagtttatcagcttcacagtgcaatcgggcaggatcaacgccagctgtttctctacaagattactattcccgcactggcatctcaaaatcctgcaattcaccctttcactccgcccaagctgtcggcatttgtcgatgaagcgaagacctatgccgccgagtatacccttcagaccctggggataccaaccgatggcggtgacggcactatggccaccgccgcagccgcagcaaccgcatttcccggatatgcagtccccaacgcaacagcacccgtctctgccgcacagctgaaacaagccgtcacattgggccaggatctcgctgcttataccacgtacgaggtttatcctaccttcgctgttaccgcgcgcggggacgggtatggcacattctag

SEQ ID NO: 24968 - DNA, 1620 bp, Artificial Sequence
  Description of Artificial Sequence: Synthetic coding sequence
atggagagcaaccacaagagcggcgacggcctgagcggcacccagaaagaggcggccctccgggccctggttcagcgaactggctactccctggtacaggaaaatgggcagaggaaatatggaggcccaccgcccggctgggacgctgcccccccagagcgcggctgcgagattttcatcggcaaacttcctagagacctattcgaagatgaactcatcccgctttgtgaaaaaataggaaagatatatgagatgcgaatgatgatggactttaatggcaacaatagaggatatgcattcgtcacattttctaataaggtcgaagccaagaatgctattaagcagcttaataattacgaaattagaaatggccgactcctcggggtctgtgcctctgtggacaactgccgcctgtttgtagggggcatccctaagacgaagaagcgtgaggaaattctgtccgagatgaagaaggtaaccgaaggggtggtggatgtgatcgtgtaccctagcgcagctgataagacaaaaaacagaggtttcgcctttgtagaatatgaatcccaccgggcagcagccatggcacggagaaagctgttgcccggggcggtggagagagtgaagaagatccgtgactatgccttcgtccacttctctaatagagaggatgcagttgaagcaatgaaagcactaaacggcaaagtgctcgacggctcccccatcgaggtcacccttgcgaagccagtggacaaggattcttacgtccggtacacgcgaggtaccgggggaaggggaacaatgctccagggcgagtatacttactccttgggccaggtctacgatccgaccacaacttacctcggagctccagtattctatgcaccgcagacctacgcagcgataccctccctccatttcccggccactaaaggtcacttatccaacagggctatcattcgcgcccctagcgtacgtgaaatttatatgaacgttcccgttggcgctgccggtgttcgggggttgggcggccgcggatatttagcctacaccggcttgggcagggggtatcaagttaagggagacaagagagaggataagttatatgatatcttgcccggcatggagctgacccccatgaacccagtgacactaaaaccccagggcatcaagctggctccccagatcctggaggagatctgccagaagaacaactggggccagcctgtctatcagctgcactccgccataggacaggatcagagacaattgtttctgtataagataaccattccagccctggcatcccagaaccctgcgattcatcctttcacccctcctaaactgtccgcgttcgtcgatgaggctaaaacctatgcagccgagtacacactccagactctaggcatcccaacagacggtggagacggcactatggccactgcagctgccgctgctacggccttccccggctatgcggttccaaacgccaccgcccctgtctcagcagcacagctaaaacaggcagtaacactcggccaggacctggccgcctacacaacgtacgaggtgtacccaacctttgcagtgactgcccgaggagacgggtacggtacattttag

SEQ ID NO: 24969 - DNA, 1044 bp, Artificial Sequence
  Description of Artificial Sequence: Synthetic coding sequence
ttcagcctgttccccgccgtggacaacgaggaggccgccctgctgcatgaggaggctacaatgaccatagaagaactcctaacacgatacggccagaactgccataaggggccaccacactctaaaagcggggcttccgataagcttcccagggtggccaagagcaaatttttcgaagacagtgaggacgagtccgatgaagccgaagaggaagaggaggattccgaggagtgttctgaggaagaggacgggtacagttcggaagaagcagagaacgaggaggacgaagacgataccgaagaggctgaagaagacgatgaggaagaagaagaggagatgatggtgcctggcatggagggaaaggaggagcccggatccgacagcggcaccacagcagtcgtggctctcattaggggcaagcagctgatcgtggcgaatgcaggagattcgcgctgcgtcgtgagcgaagccggcaaagccttggatatgagctacgatcacaagcccgaggacgaagttgagctcgctcggattaagaacgccggtggtaaggtgaccatggatggcagagtgaatgggggacttaacctttcacgtgccatcggggaccatttttacaagagaaataagaacttaccccctgaggagcagatgattagcgccctcccagacattaaagtgctgacgctcacagacgaccatgaattcatggtcatcgcatgcgacggaatttggaatgttatgagctcccaggaagtggtggattttattcaaagcaagatctcacagcgggatgagaacggcgaactccgcctattgtcctccatcgtggaagagctgctggatcagtgtctggctcccgacaccagcggggacggtacagggtgcgacaatatgacctgtatcatcatttgtttcaagccgagaaataccgccgaactgcaacctgaaagcggcaaacgtaaattggaggaggtgctgtctaccgaaggggccgaggaaaacgggaatagcgacaagaaaaagaaagcaaagagagactag

SEQ ID NO: 24970 - DNA, 1218 bp, Artificial Sequence
  Description of Artificial Sequence: Synthetic coding sequence
atggagaccgacctgaacagccaggaccggaaggacctggacaagtttatcaagttctttgccctcaagactgtacaggtcatcgtgcaggcacgcctaggggagaagatttgcacgcgatcttcttccagcccgaccgggtccgattggttcaatctggctatcaaagatattcccgaggtgacacacgaggcgaaaaaggccctggctggacaactgcctgctgtgggccggtccatgtgcgtggaaatctcccttaaaaccagcgagggcgatagcatggagctagaaatctggtgtctagagatgaatgaaaagtgcgataaagaaattaaggtctcttatacagtgtataaccggctgagccttttgctgaaaagcctgctggcgatcactcgcgtgacgcccgcctatcggttaagcagaaaacagggacacgaatatgtcatcctctatagaatctattttggagaagtccagctgtcgggattgggagagggatttcaaacagtgcgggtgggaacagttggcaccccagtgggcaccattactctatcatgcgcttaccgtatcaacctggccttcatgagcacccgtcagttcgaacgcacacccccaatcatgggcatcatcattgaccatttcgtggatcgtccttacccaagttccagccccatgcatccctgcaattatcggacagcaggtgaggacacaggggtgatctatccaagcgtggaagattctcaggaagtctgcaccacttccttcagcacctccccacccagtcaactcatggttcctggcaaagaggggggtgtgccgctggcccctaaccagcctgtgcatggtacgcaggctgatcaggagcgactggctacctgcacaccatccgaccgcacccactgtgcggcaacccctagcagctctgaggatactgaaaccgtgagtaattcctcagagggccgagcctccccacacgacgtcttagagacaatattcgtaagaaaagtgggggcattcgtgaataagcccatcaaccaggtgacgttgacctccctggatattccattcgccatgtttgcccctaaaaacctagagctcgaggacacagatcccatggtgaacccgccggactctcctgaaactgagtctccactacagggtagcctgccatgtagctggccgcttccgtgcctgctttccccgagtacggtctag

SEQ ID NO: 24971 - DNA, 2025 bp, Artificial Sequence
  Description of Artificial Sequence: Synthetic coding sequence
atgcagaccagcagcagccggagcgtgcacctgagcgagtggcagaaaaactatttcgccatcactagcggcatttgcacaggacccaaggctgatgcttatcgggcacagatcctgcggattcagtacgcctgggccaattcagagatttctcaggtttgcgcgacaaaactcttcaaaaagtatgcggaaaagtattcagccataatcgactctgacaatgtagagagtggattgaacaactacgccgaaaacatcttaaccctggctggctcacagcagactgactcggacaaatggcaaagtggactatccataaacaacgtttttaaaatgagttctgttcagaagatgatgcaggctggaaagaagtttaaggactccttactggagcccgctctggccagtgtggtaatacataaagaggccacagtgttcgacctgcccaagttttcagtctgtgggagttcccaggaaagcgacagcctgccaaattccgcacatgatcgcgacagaacacaagatttccctgagagcaacagattaaaactgctgcagaatgctcagcctcctatggtgacaaacactgctcgaacctgccccactttctccgccccagttggtgagtccgccacagctaagttccacgtaactccactatttggaaatgttaaaaaggagaaccatagcagtgcaaaggagaacatcgggctgaacgtttttctgtctaatcagtcatgttttcctgccgcttgcgagaaccctcagcgtaagagcttctacggatccggcaccatcgatgcccttagcaacccaatactgaacaaggcttgctctaagacggaagacaacgggccaaaagaggactcctccctgccgacctttaagacggcaaaagagcagttatgggtcgatcagcagaagaagtatcaccagcctcagcgcgcctctgggtcttcttatgggggagtcaagaagagcttgggcgccagccgctcccgcggcatactgggaaagtttgtgccccccattccgaagcaggacggcggtgaacagaacggcggaatgcagtgcaagccttatggtgcaggccctaccgagccagctcacccagttgacgaacggctgaagaatctggaacccaagatgatcgagctgatcatgaacgagatcatggaccacgggccaccagtgaattgggaggacatagcaggcgttgagttcgcaaaagcgactatcaaagagatcgtagtctggccaatgcttagaccagacatattcacgggcctgcgcgggcccccaaaaggaattctgctctttggaccacccgggacaggaaagaccttgattgggaaatgtatcgcctctcagagcggggcaacctttttctccatttcggcgtccagcttgaccagcaagtgggtgggggagggtgagaaaatggtcagggcactgtttgcagtggccagatgccaacagcccgctgtgatcttcattgacgagattgacagccttctgagtcagcgaggggatggtgaacacgaaagctccaggcgcataaaaacagaattccttgttcagctcgacggagctaccacaagcagcgaggatcggatcctggtagttggggccaccaatcgtcctcaagaaattgatgaggcggcccggcgccggctcgtcaagcgcctttacatacccctgcccgaggcttctgcacggaaacagattgtgatcaatctgatgtcaaaggagcagtgctgtcttagcgaagaggaaatcgaacagatcgtacagcaatccgatgccttcagcggcgccgacatgacccagttgtgccgtgaggcctccttgggacccatacgttcacttcagacggcagacattgccaccattacccccgatcaagtgaggccaattgcctatatcgattttgagaatgcttttcgtacagtccggcccagtgtctccccgaaggatttggaactctacgagaactggaataaaaccttcgggtgcgggaagtag

SEQ ID NO: 24972 - DNA, 2640 bp, Artificial Sequence
  Description of Artificial Sequence: Synthetic coding sequence
atgaactaccccggccggggcagcccccggagccccgagcacaacggccgcgggggaggtgggggcgcttgggagctcggaagcgacgccaggcccgccttcggaggaggggtgtgctgtttcgaacacttacctggaggcgacccagatgatggcgatgtcccgctggcattgctgaggggagagccagggctgcatctggccccagggaccgacgatcacaaccatcacctggcactggacccatgtctctccgatgaaaactatgacttctcctctgccgagtcaggttcctccctgagatactactctgaaggggaatctggaggcgggggaagctcactctcactacatccccctcaacaaccccctctcgttccaaccaattccggagggggaggcgcaactggtggttcacctggagaaagaaaacgcacccgattaggtgggcctgcagcacgccatcggtacgaagtggtgaccgaactcgggcccgaagaagttcgttggttttacaaggaagacaaaaaaacatggaagccatttattggatacgactccctacggattgaactggcttttcgaacactgctgcagactaccggggcccgccctcagggtggggaccgggacggagatcacgtgtgctccccaactgggccggcctcttctagtggcgaggatgacgatgaagaccgcgcctgcggcttctgtcagtcgactactggtcacgagcccgagatggtcgagctggtcaacatcgaacctgtttgcgtgagggggggactgtatgaagttgatgtcacccagggcgagtgttaccctgtctactggaatcaagcagacaagattcccgttatgagaggacagtggtttatcgatggtacgtggcagcctcttgaagaagaagagtcgaatctcatcgagcaagagcacttgaattgttttcgtggccaacagatgcaggagaacttcgacatcgaggtgtccaagtctatcgacggtaaggatggatcaggtattaactactctgccgtgcactcttttaagctgagcaggaaccatgtcgattggcactccgttgatgaggtctacctatatagcgatgcaacaacctcaaagatcgcaagaacagtgacacagaagctcggtttttctaaagcctcctcgagcgggacccggctccataggggctatgtggaagaagctacgttggaagataagccatcccaaactacgcacattgtgtttgttgtgcacggtattggccaaaagatggatcagggaaggataatcaagaacactgccatgatgagagaggccgccaggaaaatcgaagagcggcacttctcgaaccacgctacacatgtagagttcctacctgttgaatggaggagcaaactgaccctggacggcgacactgtcgactctataacccctgataaggtgagaggtctgagagatatgctgaattcatccgcaatggatattatgtattacaccagcccgctgtaccgagacgagctggtgaagggccttcaacaggagttaaatcgcctttactctttgttttgttcacgcaatcctgattttgaggagaagggaggaaaggtgagcattgtatcacactcccttggctgtgtgatcacttacgatatcatgactggatggaatccggtgcgtctgtacgagcagctcctgcaaaaggaagaggagctccctgatgagagatggatgtcttacgaagagcgccaccttctggatgagctgtatattacaaagcgcagactgaaggagatcgaggaaaggttacacggactgaaggcatccagtatgacgcaaacccccgccctgaagttcaaagtcgagaactttttttgcatgggatccccgctcgctgtgtttctggcgttgcgggggattagacctggaaatacaggaagccaagatcatattcttccgcgggaaatctgtaatcgcctgttaaatatctttcaccctacagatcctgtggcctaccggcttgagcctctgatcctaaaacactactctaacattagccccgtgcagattcattggtacaacacatcaaaccctcttccttatgaacacatgaagccttcgtttttgaacccagctaaagagcccaccagtgtgagcgagaacgagggaatttccacgatacccagtccagttactagccccgtgctcagtcggagacattacggagagagcatcaccaatatcgggaaagcctctattctcggcgccgcttctataggcaagggactcggcggtatgctgttttcccggttcggtcggagtagtacaacccagagcagtgagacatcaaaagacagcatggaagacgagaagaaacccgtagcttcacccagcgccaccactgttggtacgcagaccctgccacacagtagctccggcttcctcgatagcgctttagagctggaccataggatcgactttgaactcagggaaggattagtggaaagcagatactggtccgccgtgaccagccatacagcctactggagctccctggacgtggccttgttcctgcttactttcatgtacaagcatgaacatgatgacgatgctaagccgaacctggacccgatatag

SEQ ID NO: 24973 - DNA, 2316 bp, Artificial Sequence
  Description of Artificial Sequence: Synthetic coding sequence
atgaactaccccggccggggcagcccccggagccccgagcacaacggacgcggcggaggcggaggcgcgtgggaactggggagcgacgcaaggccagcctttggtgggggagtctgttgctttgaacacctgccaggcggtgatcctgacgacggtgacgtgcccttggctctgctgaggggcgaacctggtcttcacttggcgccggggaccgatgatcataaccatcacctggcactggacccttgcctttccgatgaaaactacgatttcagttctgcagagtccggctcctcactccggtactattctgagggggaaagcggcggtggcggcagtagcctaagtctccatccgccccagcagcctccactggtgcccaccaatagcggaggcggcctctacgaggtggacgtaacccagggggaatgttatcccgtctactggaatcaggctgataagattccagtcatgaggggccagtggtttattgacgggacctggcagccactggaggaggaggagagtaacctcattgaacaggagcatctgaattgctttcgaggccagcagatgcaggagaactttgacatcgaggtaagtaaatctatcgacggcaaagatgccgttcacagctttaagcttagtcggaatcacgtagactggcactccgtggacgaggtgtacctatatagcgatgccaccacctccaaaattgctcggaccgtgacacagaagctaggcttctcaaaggcttcaagcagcgggactcggctgcacaggggatatgttgaggaggctaccctcgaagacaaacctagccagacgactcacatagtgttcgttgtgcacggcataggccagaagatggatcaggggcgcatcataaagaatacagctatgatgcgagaggctgccaggaagattgaggagcgacattttagcaatcatgcaactcacgtcgagtttctgcccgtagaatggcgctcaaaactgacacttgacggagatacagtcgattcaatcaccccagataaagttcggggactgcgggacatgctgaactcctcagcgatggacatcatgtattatacgagcccactgtatagggacgagctggtcaagggactgcaacaagagttaaaccggctgtattcgttgttttgttcccgtaatccagattttgaggaaaagggtggtaaggtgagtattgtgagtcacagtttaggctgcgtgataacatatgacatcatgaccggctggaacccagtccgcctgtacgaacagctgctccagaaggaggaggagttaccagacgagcggtggatgtcctatgaggaaaggcacctgcttgacgagctgtacatcacgaagcggcgccttaaggaaattgaggagcggctccacgggttgaaggcctcatctatgactcagaccccggccctcaagtttaaagtagagaactttttctgcatgggctctccgctggccgtattcctggctctgaggggaatacggcccggcaacacggggagccaggaccacatcctgcctagggaaatatgtaacagactcctgaacatctttcatcccaccgaccccgtggcgtacaggctagagccattgattctcaagcattactctaacatttcgcccgtgcagattcattggtacaacacctccaaccctctgccctacgagcacatgaagcccagcttcttaaatcccgccaaagagccaaccagcgtatcagagaatgaaggcatatccacaatcccttcacctgtgacctctcccgtcctgtcgcgccgccactacggagaaagcatcactaatatcggaaaagcgtcaatcttgggagcggcttccataggcaagggtttagggggcatgttgttctccaggtttggtcggtcatccacgacacaatcctcagagacctcgaaggattcaatggaagatgagaagaagcctgtcgcctcccctagtgctaccaccgttggtacccaaaccctgccacattcgtcttctggattcctcgattccgcttactttagactacaggagtcgttcttcaaccttcctcaacttctttttcccgaaaacgtgatgcagaacaaggacaacgcacttgtggaactcgatcacagaatcgatttcgagctgcgcgaggggctagttgaatctagatattggagtgccgtcacatctcacactgcctactggtcatctctagacgtcgccttgttcctgttgaccttcatgtacaagcatgaacacgacgatgacgcaaagccgaatctcgatcctatctag

SEQ ID NO: 24974 - DNA, 1179 bp, Artificial Sequence
  Description of Artificial Sequence: Synthetic coding sequence
atgggcaccacctgcctgcacctgggcaccctggagcagagcctggtgtttgaaaacaaagtgaacagtgaaaaggtgaagctgtcgttaagaaacttccctcacaatgactacgaggatgtatttgaggaaccttctgaatcagggtccgatccatccatgtggaccgcaaggggcccttttcgtcgggatagatggtcttccgaagacgaggaggcagcaggcccttcccaggcactgagtccgctcctgagcgatactcgcaaaatagtgtctgagggggagctggaccaattggcccagataaggccgctgatcttcaactttcacgagcagaccgcgatcaaggattgcctcaagattctggaagaaaagactgcagcatatgatattatgcaggaattcatggccctggagctcaagaatttaccaggggaatttaattctggaaatcagcccagtaacagagagaagaacagatatcgtgacatcctaccttatgatagcacaagggtacctctgggcaagagcaaggactatattaacgcttcctatatcagaatcgtcaactgtggggaggagtacttttatattgctactcaggggccccttctctcaaccatagatgacttctggcagatggttctggagaacaatagcaacgtaatagccatgattacaagagaaattgagggtgggattatcaaatgttatcattattggcccatctccctgaagaagcccctagaactgaaacactttagagtgttccttgagaactaccagatccttcagtatttcattatccgtatgtttcaggttgtagaaaaatccacgggaacgtcacacagtgtcaaacaattgcagttcaccaaatggcctgatcatggcacaccagcttctgcagatagtttcatcaagtatatccggtatgcacggaagagtcatctgaccggcccgatggttgtgcactgctctgccggtattggcagaaccggtgtcttcctctgcgtagatgtggtgttctgtgccatcgtcaagaactgttccttcaacataatggacatagtagctcagatgagggagcagagatccggtatggttcagactaaggagcagtatcatttctgttacgatattgtactagaggtgttgcggaagctcctgactctggactag

SEQ ID NO: 24975 - DNA, 621 bp, Artificial Sequence
  Description of Artificial Sequence: Synthetic coding sequence
atgagcagcccccgggacttccgggccgagcccgtgaacgactacgagggcaacgactctgaggctgaagacctaaattttcgggaaacactacccagctcgtcgcaagagaatacaccacgtagcaaggtgtttgagaacaaggtgaacagtgaaaaggtcaaattatcattaaggaacttccctcataatgactacgaagacgtgttcgaggaaccgtctgaaagcggatctgacccaagtatgtggaccgcccggggtcctttcaggcgcgaccggtggtcctccgaggatgaggaggcggcagggccttcacaggctcttagcccgctccttagcgacacccgtaaaatcgtgtctgaaggcgaactcgatcagctggctcagatccggcctctcattttcaattttcatgagcaaaccgcaattaaggactgtctgaaaattctggaggaaaagaccgctgcttatgatatcatgcaggaatttatgttcaacataatggatatagtcgcccaaatgagagaacaacgtagcgggatggtgcagaccaaagaacaataccacttttgctatgatatcgtcctggaagtgctccgtaagctgctcactctggactag

SEQ ID NO: 24976 - DNA, 438 bp, Artificial Sequence
  Description of Artificial Sequence: Synthetic coding sequence
atgtggaccgcccggggccccttccggcgggaccggtggagcagcgaggatgaggaggccgcaggcccctctcaggctctgtcccctctgctctcagacacaaggaagatcgttagtgaaggtgaactggaccagctggcccaaatccgccccctcatcttcaattttcacgagcagacagctatcaaagactgcttaaaaatcctggaggaaaaaactgcagcttacgacatcatgcaggagttcatggccttggagttgaaaaatttgccaggcgaattcaacagcggcaatcagccgagcaacagagagaagaatcgctatcgcgatatcctccccttccagcaccacggctacagtggcccgaacgaaagaaccactttttggcatggtagcaatgagggtgcagtgtcactgctcttgcggtactgtgcctag

SEQ ID NO: 24977 - DNA, 1020 bp, Artificial Sequence
  Description of Artificial Sequence: Synthetic coding sequence
atgtggaccgcccggggccccttccggcgggaccggtggagcagcgaggacgaagaagccgccgggccttctcaagccctgagcccactcctgtcggacacaaggaagattgtgagcgagggggagctcgatcagttggcccagatcagaccattaatttttaattttcacgaacagactgccataaaagattgtttgaagatattggaggagaagactgcggcttatgatattatgcaggagtttatggcacttgagttgaaaaatcttcccggagagtttaattcggggaatcagccttccaaccgcgaaaagaaccgataccgcgacatccttccgtatgatagtactcgggtccctctgggcaagagtaaggattatatcaatgcctcttacatcaggattgtaaactgtggggaagagtacttctatatcgctacacaaggcccccttctgtcaactatcgatgatttttggcagatggtgttggagaataactctaacgtgattgccatgattacacgagaaattgagggcggaattatcaagtgttaccactactggccaatttctctcaagaagccgcttgagctgaagcattttagagtcttcctggaaaattatcagatccttcagtattttatcatccgcatgttccaggtggtcgagaaatccactggcacttcgcactcagtcaaacagctccagttcaccaagtggccggaccacggaacgccagcgagcgcagattctttcatcaagtatatcaggtacgcacgcaagtcacacctgactggcccgatggttgtccactgttccgctgggatcgggaggacaggggtgttcctttgcgtggacgtggtgttttgtgctattgtcaagaactgtagctttaacatcatggatatcgtagcccagatgcgggaacaacgctcaggaatggtccagactaaggaacaataccatttctgctacgatattgtgcttgaggttctgcgaaaacttcttaccttggattag

SEQ ID NO: 24978 - DNA, 1047 bp, Artificial Sequence
  Description of Artificial Sequence: Synthetic coding sequence
atgcagttcggcgagctgctggccgccgtgcggaaggcccaggccaacgtgatgctgttcttggaggaaaaggaacaggcagctctttcccaggctaatgggattaaagctcatctcgagtatagatcagctgagatggagaaatctaagcaagagctcgagactatggccgcgattagtaatactgtgcagttccttgaagagtactgtaagttcaaaaatactgaagacattacttttccaagtgtctatatcggcctcaaggataaactcagcggcattcgcaaggttatcactgaatccacagtgcatttgattcagctattagagaattataagaagaaactgcaagaatttagcaaggaagaggagtatgacattagaactcaggtctctgccatcgtgcagcggaagtactggaccagtaagcccgagccctcaactagggagcagttcctgcagtatgtacacgacatcacatttgatccagacacagcccacaaatatcttcggttgcaagaggaaaaccgtaaggtgacaaacaccacgccctgggaacatccttaccccgacctgcctagtagatttcttcactggagacaagtcctatctcagcagagcctgtacttacatagatactactttgaggttgaaatcttcggggccgggacatacgttgggctcacttgtaaggggattgaccagaaaggcgaggaaagatcatcttgtatttctggcaacaacttttcttggagtctgcagtggaatgggaaggaattcaccgcttggtacagcgatatggaaactccactcaaggccgggcccttctggaggctcggggtgtacatcgattttcccgggggaatcctctctttttacggtgttgagtacgactccatgaccctggtccataaattcgcttgcaaattttccgaaccagtgtatgccgccttttggctgtcaaaaaaagagaacgcaatcagaatcgtggatctaggagaggagcctgaaaagcccgcaccaagcctggtcgggaccgccccttag

SEQ ID NO: 24979 - DNA, 1047 bp, Artificial Sequence
  Description of Artificial Sequence: Synthetic coding sequence
atgcagttcggcgagctgctggccgccgtgcggaaggcccaggccaatgttatgctgttcctcgaagagaaagagcaggctgccttatctcaggcgaacggcatcaaggcccatctcgagtatagatccgcagagatggagaagagtaagcaggaacttgagaccatggcggcaatctcaaacacagtacaatttctggaggaatactgtaagtttaagaacacagaagatatcacctttcctagtgtttatattggactgaaggacaaactctcaggcattagaaaggtgattactgagtctacagtacatcttattcagttgttggagaactataagaagaaactccaagaattttctaaggaggaagagtacgacattagaacacaagtgtcagcaatcgttcaacgcaagtattggacatcgaagccggagccaagtaccagagagcaatttctacagtatgtgcacgacatcaccttcgatccagataccgcccataagtacctgcggttgcaagaggagaatcgcaaggtgactaacacgacgccctgggagcacccataccctgacctgccaagccgttttttacactggagacaggtcctgtcgcaacagtccctgtacctgcaccggtattatttcgaggtcgagattttcggggcgggaacatatgtgggccttacgtgtaagggaatcgatcagaagggggaagagcggtcttcctgtattagtggtaacaacttctcatggtcccttcagtggaacgggaaggaatttaccgcttggtacagcgacatggaaactccactaaaagccgggcctttttggcggctgggggtttacatcgactttcccggaggcatactcagtttctatggggtggagtacgatagcatgacgctggtgcacaagtttgcatgcaagttcagcgagccggtgtatgctgcgttctggctcagcaaaaaagagaacgccatcagaatagtggatctgggcgaggagccagaaaaaccagccccctctcttgtcggaaccgctccttag

SEQ ID NO: 24980 - DNA, 687 bp, Artificial Sequence
  Description of Artificial Sequence: Synthetic coding sequence
atgatcgacgacagcacccgggtgcccctgggcaagagcaaggactacatcaatgcttcatacatccgcatagtgaactgcggggaggagtatttctacatcgcgactcaggggcccctgctgagcacgatcgacgacttctggcagatggtactggagaacaactccaatgtgatcgccatgatcacacgtgaaattgagggcggaattatcaaatgttaccactactggcctattagcctcaaaaagcccctggaattgaagcattttcgagtcttcctggagaattatcagatcctgcaatattttatcatccgcatgttccaagtggtagagaaaagcacaggaacatcacatagcgtcaaacagctccagttcactaaatggcccgatcacgggaccccagcctctgccgattcctttattaaatacatacggtacgcaagaaagtcccacctgactggtcccatggtggtgcattgttccgctggaattggccggactggtgtgtttttatgtgtggatgtggtgttttgtgcgatagtgaagaactgtagttttaatattatggacattgttgcccagatgcgggaacagaggagcggtatggttcagacaaaagagcagtaccacttttgctatgatatcgtactagaggtgttgaggaaattgctaactctcgattag

SEQ ID NO: 24981 - DNA, 1449 bp, Artificial Sequence
  Description of Artificial Sequence: Synthetic coding sequence
atggtgatggagaagcccagccccctgctggtgggccgggagttcgtgagacagtactacactctcctgaataaggctcctgaatatttgcaccgtttttacggaagaaactcaagctatgttcatggcggggttgacgcaagcggaaagccgcaggaagccgtgtacggacagaatgatatccaccacaaagtgctgtctctgaacttctccgagtgccatacaaagatacggcatgttgacgctcacgcaaccctgtctgacggcgtcgtggtacaggtcatgggcctattatccaatagtggccagcccgaacgaaagttcatgcagaccttcgtgttggcaccagagggatctgttcctaataagttctacgttcacaatgatatgttccgttacgaggatgaggtgttcggcgatagtgagcctgaattggacgaggaaagcgaggatgaagttgaagaagagcaggaagagcgacagccctccccagaaccagtccaagagaacgctaatagtggatattatgaggctcaccctgttactaacggaatcgaggagcctttggaggaatcctctcatgaacctgagcctgaacctgaatcagagactaagacagaagaattaaagcctcaggtcgaagaaaagaacctggaggagctagaggaaaagtcaaccacaccaccccccgctgagccagtatcgctgccccaggaaccaccgaaagccttcagctgggcttccgttacttctaaaaatctgccaccaagcggaaccgtgtcatcttcgggaatcccaccacacgttaaggctccggtttcacaaccccgggtcgaggcaaagcctgaagtccagtctcaaccgccgcgtgttagggaacagcgtccccgcgaaaggccaggtttcccccctagaggccccagacctggacgtggggatatggaacagaatgactcagacaaccggcgcataattcggtacccagacagccaccaactatttgtgggcaaccttccccatgacattgacgagaacgagcttaaggagttcttcatgtcattcggtaacgtggtggagctgcgtattaacacaaagggggtagggggaaagcttcccaattttgggtttgtcgtgtttgatgactccgaacccgtgcagagaatactgattgccaagccaataatgttcagaggcgaggtgcgcctcaacgtagaggaaaagaaaaccagggccgcacgagaacgggagactcgcggaggcggcgatgataggcgagatatcagacgcaacgatcggggacccggagggcctaggggaattgtcggaggagggatgatgagggaccgcgacggtcggggaccacctcccagaggcgggatggcacagaaacttggctctggccgtggcacaggtcagatggaaggacgctttacaggtcagcggcgttag

SEQ ID NO: 24982 - DNA, 1020 bp, Artificial Sequence
  Description of Artificial Sequence: Synthetic coding sequence
atgtggaccgcccggggccccttccggcgggaccggtggagcagcgaagatgaagaggctgcaggtccctcccaggcactttctcctctcttgagtgataccagaaaaatagtgtctgaaggagagctggatcaactggcacagataagacctttgattttcaatttccacgagcagactgccattaaagactgtcttaagattctcgaggagaagaccgccgcctacgacatcatgcaggaattcatggcccttgagctcaaaaaccttccgggcgaatttaacagcggcaaccaaccgtcaaacagggaaaagaaccgttaccgggacattttaccatacgactctactcgggtgccactaggtaagagtaaggattacattaacgcttcatatatacgtatcgtgaactgtggggaggagtatttttacattgcaactcaagggcccctactttccactattgatgacttctggcagatggttcttgagaacaacagcaatgtcattgctatgatcactagagaaattgagggtggaatcataaaatgctaccattattggccaatttcactgaagaaacctttggaactgaaacacttccgagtgttccttgagaactaccagattttgcagtatttcattattcggatgttccaagtggttgaaaagagtacaggtacatcccacagtgtaaagcagctgcagttcacgaaatggcccgaccacggtactcccgcaagcgcggacagtttcatcaaatatataagatacgcaaggaagagccacctcaccggacccatggtcgtgcattgttctgccggcatcggcaggaccggcgtttttctgtgtgtagatgtggtgttttgtgccatcgtgaagaactgctcattcaacatcatggacatagtcgctcagatgcgggaacaacgatctggcatggttcaaacaaaggaacaataccacttctgctacgatattgtcttggaggttctccggaagctattgacactcgactag

SEQ ID NO: 24983 - DNA, 621 bp, Artificial Sequence
  Description of Artificial Sequence: Synthetic coding sequence
atgagcagcccccgggacttccgggccgagcccgtgaacgactacgaaggaaatgacagtgaagctgaagacctcaattttagggaaacgctccctagcagctcccaggagaataccccccgatctaaggtctttgagaataaggtcaactccgaaaaagttaaactgtctcttcgtaacttcccccataacgactatgaggatgtatttgaggagccaagtgagtccgggagtgatcccagtatgtggactgcccgcggccctttcaggagggacaggtggtcatcggaggatgaggaggccgcgggcccctctcaggctttgagcccactcctgtctgatacccgcaaaatagtgtcagaaggcgagttagaccagctcgcccagatcaggcccctgatctttaactttcacgagcaaaccgcgatcaaagactgtctgaagattctcgaggagaaaacagcagcctacgatatcatgcaggaatttatgtttaatatcatggatattgtcgcacagatgcgagaacaaaggtccgggatggttcagactaaggagcagtaccatttttgctacgatatcgtgctggaggtactgcggaaattactaacactggactag

SEQ ID NO: 24984 - DNA, 438 bp, Artificial Sequence
  Description of Artificial Sequence: Synthetic coding sequence
atgtggaccgcccggggccccttccggcgggaccggtggagcagcgaagatgaagaagctgcgggtccatctcaggccttaagccccctgctgagtgatacccgcaagatagtgtcggagggcgaactggaccagctcgctcagatccggccactcatttttaattttcatgagcagacggccatcaaggactgtctgaaaatccttgaggaaaaaactgccgcctacgacataatgcaggagtttatggccctggagcttaagaacctgcctggtgaattcaactccgggaatcaaccttccaatagggaaaagaatcgttaccgcgacattttacctttccaacaccatggctactctggtcccaacgaaagaacaacgttctggcatggatctaacgagggggctgtcagtctgctactcagatattgcgcctag

SEQ ID NO: 24985 - DNA, 687 bp, Artificial Sequence
  Description of Artificial Sequence: Synthetic coding sequence
atgatcgacgacagcacccgggtgcccctgggcaagagcaaggactacattaatgctagttatatacgcatcgtgaattgcggcgaagagtatttttacattgctacgcagggaccgcttttgagcactattgacgacttctggcagatggtgttagagaacaattcaaacgtgatcgctatgataactcgggagatcgagggtggcatcatcaagtgctatcattactggcctatctcactgaaaaagcccctggaactgaaacattttcgcgtattcttggaaaactaccagatcctgcagtatttcatcatacggatgttccaggtagttgagaagtccacgggcacaagccattccgtgaagcagcttcagtttactaagtggcccgatcatggcacccccgcctctgccgacagctttatcaagtatataagatacgctaggaaaagtcatctcacgggccccatggtggtgcactgttccgcgggaatcgggcgcaccggcgtgtttctgtgcgtcgatgtcgtgttctgcgcaatcgtaaagaattgctcgttcaatataatggacatcgtggcacaaatgcgcgagcaacgatccgggatggtgcagaccaaggagcagtatcacttttgctatgacattgtgctggaagtgctgaggaaactgctcacccttgactag

SEQ ID NO: 24986 - DNA, 2802 bp, Artificial Sequence
  Description of Artificial Sequence: Synthetic coding sequence
atgttctggaagttcgacctgaacaccaccagccacgtggacaagctgcttgacaaggaacacgtgactctgcaggaactaatggatgaggatgacatcctgcaggaatgcaaagcacagaaccagaaattactggactttctctgtcgccagcagtgcatggaagaactcgtttctctgatcactcaggatccccccttagatatggaagaaaaggtgcgattcaagtaccccaacaccgcttgcgaactgctgacatgtgacgtgccccagatctctgatagactgggaggggacgaatctctgctgtccctgttatacgactttctggaccacgaaccaccactgaaccctcttcttgcgtcattttttagcaaaactatcggtaacctcatcgcacgtaaaacagaacaggtcataacctttctgaaaaaaaaagacaagttcatcagcttggtgcttaagcatatcggcacctctgcgctgatggatttgcttctgcgcctcgtttcctgcgtggaacccgctggtcttcgccaggacgtcctgcactggctgaatgaagaaaaggtgattcaacgcctggtagagctcattcatccctcccaggacgaggataggcaaagcaatgcctcccagacattgtgtgacatcgtgagactcggaagagaccagggctctcagctgcaagaggcactcgagcccgaccctctcctgaccgcattagaatcccgacaggattgtgtcgaacagctcctgaagaatatgttcgatggggataggaccgaatcgtgcctcgtatcgggcacccaggtgctgttgacactactcgagactcgacgggttggcactgaggggctcgtggattcatttagccagggcttggaaagatcctacgcggtcagcagtagtgtgttgcatggaatcgagccccgtctgaaagactttcaccagctgcttctcaatcccccgaaaaaaaaagctattttaaccactataggagtgctggaggagcccctggggaatgcacggctacacggtgcccgactcatggcagcgttgctgcataccaacactccttcaatcaaccaggaactgtgccggctcaacacaatggatctactgcttgacctcttctttaaatacacctggaataacttcttgcacttccaggtagagctgtgcattgcagctattctctcgcacgcagccagagaagagcggaccgaagcatcggggagtgaatccagagtggagcctcctcacgagaacggaaatcggtcgttagagacgccccagcctgccgccagcctgcccgacaacaccatggtgacacacctctttcagaagtgctgtctggtccagagaattctggaggcttgggaggccaacgatcatacccaagcagcaggaggcatgcgccgggggaatatgggacatttaacccgtatcgcgaacgcagtggtccagaacctagaacgggggcccgttcagacacacatcagcgaagtgattcgtggcctgcctgcagattgccgcggacgctgggagtcttttgtcgaggagaccttgacagagacaaatagaagaaatactgtggacctggcattctccgattaccagatccagcaaatgactgcaaattttgtggatcaatttgggtttaacgacgaggaattcgctgatcaggacgacaatatcaatgctccattcgatcgaattgccgagattaattttaacatcgatgccgacgaggattctccgtctgctgccctgtttgaggcttgctgtagcgacagaatccagcctttcgacgacgacgaggacgaggatatctgggaagacagcgatacaagatgcgccgccagagtgatggctcgccccaggttcggggctcctcatgctagcgagagctgctccaaaaacggacccgagcgcggcggtcaggacgggaaagcctcattagaggcccatcgcgacgctcccggtgccggcgcgccacctgcacctggaaaaaaggaggcacctccagtggagggggatagcgagggcgctatgtggaccgcagtcttcgatgagcctgccaactccacacctacagccccaggagtcgtaagagatgtagggtcctcagtctgggcggctgggacatcagcccccgaggaaaagggttgggccaagtttactgacttccagcccttttgctgtagcgaatccggtccaagatgctcaagccctgtcgatactgaatgttcccacgccgagggttcgcgatcccagggacccgagaaagccttcagtcctgcctcgccctgtgcctggaacgtctgtgtcacacgcaaagcaccacttctggcttcagactccagcagcagcgggggttcgcattccgaggacggcgaccagaaggccgcttcggctatggatgctgtctcacggggccctggcagagaagccccccccctcccgacagttgcccggactgaagaggccgtgggcagggtgggatgcgcggatagccggttgcttagtcccgcctgcccagctcctaaagaggtgacagccgcacccgccgtcgcagtccctccagaggccacagttgcaattactaccgccctgtctaaggcagggcctgccattcccactcctgctgtaagttctgccctggcggtggctgtgccgcttggtcctattatggccgtcaccgcggcacctgcaatggtagccacgctcgggacagtgacaaaagacggtaaaacagatgcacccccagagggtgcagctcttaacggcccagtctag

SEQ ID NO: 24987 - DNA, 2799 bp, Artificial Sequence
  Description of Artificial Sequence: Synthetic coding sequence
atgttctggaagttcgacctgaacaccaccagccacgtggacaagctcctggacaaggaacacgtcacattgcaggagctaatggatgaggacgatatcctgcaggaatgcaaagcccagaatcaaaagctgctcgattttctttgccgacagcagtgcatggaagaactggtgagtctgatcacacaggacccccccttggatatggaggagaaagtcagattcaagtatccgaacacagcatgcgagctgcttacatgtgatgtgccccagatctcagatagacttggaggcgatgaaagcctcctctctctgctgtacgatttcttagaccacgaaccaccactgaaccctctcttagcctcgttcttttccaagacaatcggcaaccttatcgcaagaaagacagagcaggtgatcactttccttaaaaagaaagacaaattcataagcctggtcctgaaacatatcggtacgagcgctttgatggatctgctgctgcgtttggtgtcttgcgtggaacccgccggtttacgacaagacgtgctgcattggctgaatgaggaaaaggtcatacagcggctggttgagctgattcatcctagccaggacgaagaccgacaatcgaatgctagtcagacactctgcgacatcgtgagacttggccgcgaccagggctcgcaactacaggaggcccttgaacccgacccacttctcaccgcgctggaaagccaggactgcgtcgagcaacttttgaagaacatgtttgatggtgatcgaaccgagagctgtctggttagcggaacacaggtactcctaacattgttggaaacacgacgggtcggcacagaggggctcgtggactccttttcccaggggctggaacgttcatatgccgtaagcagctctgtgctacacggaatcgagccccgcctcaaagattttcatcagcttctgttaaatccacctaaaaagaaggccattttgaccacaatcggagtgcttgaggagcctttgggtaacgcccgactccatggtgcacgacttatggcagcgcttttgcataccaatacaccctccatcaaccaggagttatgtcggcttaatactatggatctcctactggacctcttcttcaagtatacttggaacaactttctccatttccaggttgagctgtgtattgcagccattctttcgcacgctgcccgcgaagaacgcactgaagcctctgggagcgagtccagggtagagcccccccacgagaacggaaataggtcactggagacacctcagcctgcggcatccctgcctgacaatacaatggtaacccacctgttccaaaagtgctgtctggtgcagaggatcctggaagcatgggaagcaaacgaccacacacaggcggccggaggcatgagacgggggaacatggggcatctgactcgtattgccaatgccgtggtccagaacttggagagggggcccgtgcaaacccatatcagcgaggtcattcgcggactgcctgccgattgtagaggtagatgggagtcgttcgttgaagagacgctcaccgaaacgaatagacggaacaccgtggaccttgctttctctgattaccagattcagcaaatgacagcgaattttgtggaccagtttggcttcaatgatgaggaatttgccgaccaggacgataatattaacgctccgttcgaccggatcgctgagatcaatttcaacatcgatgccgacgaggacagcccttctgctgcattgtttgaggcatgctgctccgacaggattcagcctttcgatgatgacgaagacgaggacatctgggaagattccgacactcggtgtgccgcgcgagtgatggcccggcctcggtttggtgccccccacgccagcgaaagctgcagcaagaatggacccgagcgcggtggacaggacggaaaagcgtctctggaagcacacagagacgccccgggcgccggggcaccacccgcccctggtaagaaagaagctcctcctgtcgaaggggactcagagggggcgatgtggacagcagtattcgacgagcctgcaaactctacgcccacagcaccaggagtggtcagggatgtcggctcgtccgtttgggcagcgggtacttcagctccagaggaaaagggctgggccaagttcactgactttcagcctttttgctgttccgagtcaggccctaggtgttcatcacccgtggacaccgagtgcagccacgccgagggcagccgcagccagggaccagaaaaggcctttagccctgcatccccttgtgcctggaacgtttgcgtcacgaggaaagcccccttattggcatcggatagctcttctagcggcggctctcacagcgaagatggcgatcagaaagctgcatccgctatggacgctgtaagcagagggccgggtcgagaagcaccaccacttcctacagtcgcaaggacggaggaggccgtgggccgtgtcggatgcgccgacagccgattactttctcctgcatgcccagccccgaaggaggtgaccgccgcacccgccgtagccgttcccccggaagctactgtagctatcaccaccgcactatcgaaagctggccctgctatcccaaccccagcggtttcatcggctctagctgtcgctgtgccactcggccccattatggcggtcactgctgccccagctatggtggccaccttaggtactgtcactaaggatgggaagacagatgcaccaccagagggagcagcgctaaacggccccgtctag

SEQ ID NO: 24988 - DNA, 789 bp, Artificial Sequence
  Description of Artificial Sequence: Synthetic coding sequence
atggccctgagcctgggctggaaggcccaccggaaccactgcggcctcctcctgcaggcccttagatcctcggggttgctcctttttccctgcggacaatgcccttggagaggagctggctcctttctcgacccagaaattaaagcatttcttgaagagaataccgaggtaacaagctctggaagcttaacacctgaaatccagctccggctgttgacccccagatgcaagttctggtgggagagggccgatttatggcctcattctgacccctactgggcaatatactggcctggcggccaagcattgagcaggtacctcctagacaaccctgatgtcgttaggggaaagagcgtgctggacctggggagtgggtgtggtgccactgcaatcgcagcgaaaatgtccggagctagtagaattctcgcgaatgacattgacccaattgctggtatggcaattaccctgaattgtgagctgaataggctaaatccctttcctatcctgatccagaacatccttaatctcgagcaggacaaatgggatctggtggtccttggcgatatgttttatgatgaagatctggcagatagtctgcaccagtggcttaagaagtgcttttggacctaccgcacaagagtactcataggagaccccggaaggccgcagttctccgggcactcaatccagcatcacctacacaaagtggtagagtactccttgctcgaatctacacgccaggaaaattccggattgaccacctccaccgtgtgggggtttcaaccctag

SEQ ID NO: 24989 - DNA, 2718 bp, Artificial Sequence
  Description of Artificial Sequence: Synthetic coding sequence
atggaggtgcaggtgagccaggccagcctgggcttcgagctgaccagtgttgaaaaaagtttgcgtgagtggagtaggctgtcacgggaggtaatcgcttggctttgcccgagcagccccaattttatcctgaacttcccaccccctccctcagcaagttccgtgtcgatggtgcagcttttctcttcgccctttggataccagtcaccatcgggtcatagcgaagaggagcgtgaaggcaatatgaagagtgctaagccacaagtgaaccattcccagcacggcgaaagtcagagggctctgtcaccccttcagtccaccttgagctccgcagcgagcccatctcaggcttacgagacgtacatcgaaaatggcctgatttgcctgaaacacaaaatccggaacatcgagaaaaagaaattgaagttagaggattacaaggatcgactaaagtcaggcgagcatctgaaccctgaccagctggaagctgtggagaagtatgaggaagtccttcataacctggagtttgcaaaggagttgcagaagacctttagcggactttccctcgatcttcttaaagctcagaaaaaagcccagcgcagggagcacatgctgaagctggaggccgagaagaaaaaattacgtacaatcctgcaggttcagtacgtactgcagaacctgactcaggagcacgtgcagaaggacttcaagggcggcctgaacggtgcagtatatctaccctctaaagagctcgactatttgattaaattttctaagctgacttgtcctgaaagaaacgagagcctctcagtggaagaccagatggagcagtcttccttatacttttgggatctgctggaaggttccgagaaagcagtggttgggactacttataagcatctgaaggatctgctctcaaagctgttgaattctggttattttgagtcaatccctgtgcctaagaacgccaaggagaaggaagtgccattggaggaagaaatgcttatccaaagcgagaagaagacacagctgagcaaaactgagtctgtgaaggaaagcgaatccctcatggagtttgcacagcctgaaattcagcctcaagaatttctcaacagaaggtatatgactgaagtggattatagcaacaaacagggcgaggaacagccatgggaagctgattacgctcgaaagccaaatctacctaagcggtgggatatgctgaccgaacctgatgggcaagagaaaaaacaggaaagtttcaaaagctgggaggcgtctggtaagcaccaggaagtgtctaaaccggccgtgtccctcgagcaacgcaaacaagacacgtccaagttaaggtctacgctgccggaagaacaaaagaagcaggagatcagcaagagcaagccttcccccagtcagtggaaacaagacaccccaaagtccaaggcaggatacgtgcaggaggagcagaagaagcaggaaacccccaagttatggccggtccagttgcaaaaggagcaagatcccaagaagcagactccaaaaagctggaccccaagtatgcagtctgaacagaatacgactaagtcctggactacacctatgtgcgaagaacaggactcaaaacaacctgagacccctaaaagctgggagaacaatgtggaatcccagaagcattcactgaccagccaatcacagatatcccccaagtcctggggagtggctaccgcatcactcattccaaacgatcaactgttgccaagaaaactaaacacggaacctaaagacgtacccaagcccgttcatcagccagtcgggtcctcatcaacccttcccaaagatcccgtgctccgaaaagagaagctgcaggacttgatgacgcagattcagggcacctgcaacttcatgcaagaatctgtccttgatttcgataagccctcatctgccatccccacttctcagcctccaagtgctacccctgggtcgccagtagcatcaaaagaacagaacctatcctcacaatcagactttttgcaggaacccctgcaggcagctatacctcctggaaagcagcctagtagcctggcgtcacctaatcctcccatggctaagggcagcgagcagggcttccagtcccccccggcctctagttcatccgtgaccatcaacacagccccctttcaggccatgcagacggtgttcaacgtgaacgcccctcttccgcctaggaaagagcaggagattaaggagtcgccgtattctccaggctacaaccagagcttcacaaccgctagtacacaaactcctccgcagtgccagctgccctctatccacgtcgaacaaaccgtacactcacaggaaaccgctcagaccaatgtgttccctcgccccacgcagccctttgtgaatagccggggctcagtaaggggatgtacccgtggtgggcgcctgattaccaatagttacaggtcgcccggaggctacaaggggttcgacacttatcgagggctgccaagtatatccaatggaaattactcccagctccagttccaggcccgcgagtactcaggggctccgtacagccaaagggacaactttcaacagtgctataagaggggaggaacaagcggcggccccagggcaaacagtcgagccaattgctttataatgagaaattcactcctcctcatcaagcaacaaggcggagtgattctccttcgttag

SEQ ID NO: 24990 - DNA, 1107 bp, Artificial Sequence
  Description of Artificial Sequence: Synthetic coding sequence
atgagcctgttcggcaccaccagcggcttcggcaccagcggcaccagcatgttcgggtctgcaacaactgataatcacaaccctatgaaggatatcgaggtgacaagcagtccagacgactccatcggctgtcttagctttagccctcccacactgcctggaaatttcctgatcgcagggagttgggccaatgatgttaggtgctgggaagttcaggactctgggcagacaattcctaaggcccaacaaatgcacaccgggcctgtcttggatgtgtgttggtctgatgacggctctaaggtgtttaccgccagttgcgataaaaccgctaagatgtgggacttgtcaagtaaccaagctatacagatagcccagcatgacgctcctgttaagaccattcactggatcaaagcccctaactactcgtgtgtcatgactggctcctgggacaagacattgaaattttgggacacccgatcctccaaccctatgatggtgctgcaactaccagaacggtgttactgtgccgatgtcatctatcctatggcagtcgtcgccaccgcagagagaggtctgattgtgtaccagctggaaaaccaaccaagcgagttccgtcggattgaatcacccttgaagcaccagcatcgctgcgtggccattttcaaggataagcagaacaaacccaccggcttcgcgcttggcagcattgaagggagagtagccattcactacattaaccctcctaatcccgccaaagacaatttcacttttaagtgtcacaggtcaaacgggactaataccagcgctccacaggatatatacgcagtgaacgggatcgcctttcacccagtgcacggcactctggctaccgtgggctctgacgggagattcagcttttgggacaaagatgccagaacaaaattgaagacatcagagcagctcgatcagccaatcagtgcctgttgctttaatcataatggcaacatctttgcctacgctagctcttacgattggtccaaaggccacgaattctataacccccaaaaaaaaaactatatattcctgaggaacgcggccgaggaactgaaaccccgcaataagaagtag

SEQ ID NO: 24991 - DNA, 1107 bp, Artificial Sequence
  Description of Artificial Sequence: Synthetic coding sequence
atgagcctgttcggcaccaccagcggcttcggcaccagcggcacctctatgttcgggtctgcaacgaccgacaaccataatcctatgaaagacattgaagttaccagctcgcctgacgactctatcggatgcctcagcttcagcccgcctacactgccggggaactttcttatcgccgggagttgggctaatgatgttcggtgctgggaagtgcaggattctggacagacgatccccaaggcacaacagatgcataccgggcccgtgctagacgtgtgctggagtgacgacggctccaaagtgtttacagctagctgcgataaaactgcgaaaatgtgggacctctcaagcaaccaggcaatccagatcgcccagcacgacgctcccgtcaagacaatccactggatcaaggctcctaactactcttgcgttatgactggctcctgggacaagacactaaagttctgggataccagaagcagcaatcctatgatggtcctgcagttgcctgagaggtgttactgcgctgatgtaatctacccaatggctgtcgtggctaccgctgaaagaggcctgatagtgtatcagctggagaaccaacctagcgagtttcgcaggatcgaaagtcctctgaaacaccagcatagatgcgtggcaatatttaaggacaaacagaataagcctaccggatttgcacttggtagcatcgagggaagagtcgcgatacactatatcaatcctccaaatccggctaaggacaattttacttttaaatgccataggagcaacggcacaaatacctccgccccacaggatatttatgcagtcaacggaattgcattccatccagtccacggaacactggctacagtgggctccgatggccggttttcgttctgggacaaggacgcccgcactaagctgaaaacatctgaacagctcgatcagccaatcagtgcctgttgtttcaaccataacggcaatattttcgcctacgcctccagctacgattggtccaaggggcacgaattctataacccccaaaaaaagaattacattttcctgaggaacgccgctgaggagctcaagcctcggaacaaaaagtag

SEQ ID NO: 24992 - DNA, 2745 bp, Artificial Sequence
  Description of Artificial Sequence: Synthetic coding sequence
atgagcagcagcggctacccccccaaccagggcgccttcagcaccgaacaatcgaggtaccccccgcacagtgtgcaatacacgttcccaaatactcgacaccagcaggaccccgcattcggcggaaaacacgaggccccatcatcacctataagtggtcaaccctgtggtgacgaccagaacgcctctcccagtaagctcagcaaggaggaactgattcaatcaatggacagggtggaccgtgagatcgctaaagtggagcaacaaatcctgaaactgaagaagaagcaacagcagctggaggaggaagccgccaagcctcctgagcccgagaagcctgttagccccccaccagttgagcagaaacatagatcaatcgtgcagatcatatatgatgagaacaggaagaaagcggaggaggcacacaagatctttgaaggcctggggccgaaagtcgagctaccactgtacaatcagccctccgacactaaagtgtatcatgagaacatcaagaccaatcaagtcatgcgtaagaaattgattttgttctttaaaaggcgaaaccacgccagaaagcagagggagcagaagatctgccagcgttatgatcagttaatggaggcttgggaaaaaaaggtcgatcgaatcgaaaacaacccaaggcgcaaggctaaggaaagcaaaacccgagaatactatgagaaacaatttcctgaaatcaggaagcagcgggagcagcaggaacgatttcagagagttggccagaggggagccggactgtctgccacgatagccagatccgaacacgaaatctccgagattatcgatggcctcagcgaacaggaaaacaatgagaagcagatgaggcaactctcagttattccccccatgatgttcgacgcagaacagcgacgggtgaaattcattaatatgaacggccttatggaggaccctatgaaggtgtacaaagataggcagttcatgaacgtttggacagatcatgaaaaggaaatcttcaaagataagttcatccaacacccaaaaaattttgggctcatcgcctcttacttagagagaaagtctgtccccgattgtgtattgtattattatctgaccaagaagaacgagaattataaggcgttggtccgccgaaattacgggaaacggcggggccgcaaccaacagatcgcaaggcccagccaggaggagaaggtcgaggagaaagaagaggataaagcagagaaaacggagaagaaagaagaagaaaaaaaagacgaagaggaaaaggatgaaaaggaggattctaaggagaacacaaaggagaaggataaaattgacggtactgcggaagagactgaagagagagagcaggcaactccccgcggccgcaaaaccgcaaactcacaagggcgacgcaaaggtcggattacacggtccatgacaaacgaggccgccgccgcctctgccgctgctgctgccgccacagaggaacctccacctccactgccccctccccccgagccaatttccactgaacctgtagaaacatctaggtggaccgaagaagaaatggaggttgcgaagaaaggactggtagagcacggacggaactgggctgctattgccaagatggtggggaccaagtccgaggcccagtgcaaaaatttctattttaattacaagagaagacacaaccttgacaatctgctgcagcagcacaaacaaaagactagtcgtaaaccaagggaggagcgagatgtgtcacagtgcgagtccgttgcttcgactgtctccgctcaagaggacgaagacatcgaggccagcaatgaagaagaaaatccagaggacagtgagggagcggagaactcctccgacacagaatctgccccttccccctcccccgtagaggcagtcaaaccaagcgaagacagtcctgagaacgccacttctcgcggtaataccgaacccgccgtggagctggagcccacaactgagacagcccccagcacatccccttccctcgcagtgccgagcacgaagcccgcagaagatgagtctgtggagactcaggtgaatgactccatttcagcagaaaccgcagaacagatggatgtcgatcaacaagagcatagcgccgaagagggcagcgtgtgtgacccccccccagccacaaaagctgattctgtggacgtcgaagtgcgggtccccgagaaccacgcatcaaaggtcgagggtgataacacaaaagaacgggacttggacagagcatccgaaaaggttgaaccacgggacgaggatctcgttgttgcacagcagatcaacgcccaacggcctgagccacagagtgataacgattcgtccgctacttgtagcgctgatgaggacgtggacggtgagcctgaacgccagcgcatgtttccaatggattcaaagcctagtttgctcaatcctaccggctctattttagtcagctctccattaaagcccaacccacttgatctgcctcagctccagcatcgtgctgcagtgattccacctatggtctcctgcactccttgtaatatccccattgggacgcctgtgtctggctatgccctgtatcagagacacatcaaagcaatgcatgagagtgccctactagaggaacagcgtcagcgccaggaacagatcgacttggaatgtcgctctagtacatctccttgtgggacgagtaaaagccctaatcgggaatgggagggcaggtag

SEQ ID NO: 24993 - DNA, 7032 bp, Artificial Sequence
  Description of Artificial Sequence: Synthetic coding sequence
atgagcagcagcggctacccccccaaccagggcgccttcagcaccgaacaatctcgttatccacctcactctgtccagtatacttttcctaacacacgtcatcagcaggaccccgctttcgggggaaagcatgaagccccctcctcgcctatatccggccagccatgtggtgatgatcagaacgcctccccgagcaaactcagcaaggaggagttaatacagagtatggaccgcgttgatcgggagatcgcaaaggttgagcagcagatcttgaaactgaagaagaaacagcagcagttggaggaggaggcagccaagccacccgagccggagaaacccgttagccccccccccgtcgaacagaagcatagatccatcgtgcagattatatacgatgagaacagaaagaaagctgaagaggcccacaagatttttgaagggctggggccaaaggtagagttgcctctgtataatcaaccatccgacaccaaagtctatcacgaaaacatcaagaccaaccaagtgatgcgaaagaaactgatcctatttttcaaaagaaggaaccacgctagaaagcagcgggagcagaagatttgccagaggtacgatcagctgatggaagcctgggagaaaaaggtggatagaatcgaaaataatcctaggaggaaagctaaggagtcaaaaacaagagagtattacgagaagcagtttcccgagatccgaaaacaacgagagcagcaggaaaggttccagcgcgtcggccagcggggggccggcctgagtgccacaatcgcgcgaagcgagcatgagatctctgagatcatcgatggactctctgagcaggagaacaacgaaaagcaaatgcgacaattgagcgtaatcccacccatgatgtttgacgcagaacagcggagggtgaaattcatcaacatgaacggactgatggaggatcctatgaaagtgtataaagaccggcagttcatgaatgtttggacggaccatgaaaaagagatattcaaagataagttcatccagcacccaaagaattttggactcatcgccagttaccttgaaagaaaatctgttcccgattgcgtgctgtactattaccttacaaaaaaaaacgagaattacaaagcattagtgcgaagaaattatggaaaacggaggggccgaaatcaacagatcgccagaccaagccaggaggagaaggtggaagaaaaggaggaagataaggccgagaaaaccgagaagaaagaagaggagaaaaaggatgaagaagagaaggatgagaaggaggattccaaggagaacacaaaggaaaaagacaagattgacggcacagctgaggaaacagaggaacgggaacaggcaactccgcgggggcggaaaacagcgaattcccagggccgcaggaaaggtaggatcactcggagcatgacgaatgaggccgctgccgcgagcgccgcagccgctgctgccaccgaagaacccccacctcccctcccaccaccaccggagcctataagtacagagcctgtcgaaacctcccgatggacagaggaggagatggaggtcgccaagaaagggctcgttgaacacggacggaactgggctgccatagccaagatggtggggactaaatcagaagcccaatgtaagaatttttacttcaattataaaagaagacataatctcgacaacttgttacaacagcacaaacaaaagacctcccgtaaacctcgcgaggagcgggacgtgagccagtgtgagtcagtcgcatccacggtttcggctcaggaagacgaagatatcgaagcatcgaatgaggaagaaaacccagaagattcggagggcgcggaaaacagttctgatacagaatccgctccttctccatccccggttgaagccgtgaagcctagcgaagatagccccgaaaacgccacctctcggggtaataccgagccagctgtagagttagaacctactacggagacagctccatccacctctcccagtttggctgttccgagtacgaaaccagccgaagatgagtccgttgaaacccaggtcaacgacagcatctccgctgaaacagctgaacaaatggatgtggaccagcaggaacacagcgccgaagaaggtagcgtgtgtgaccccccccctgccacaaaggccgactccgtagatgttgaggtgcgggtgccggaaaatcacgcaagtaaggtggagggtgacaacactaaggagcgggatctggatagggcctcagaaaaagtggagcctagagacgaggacctggtcgtggcacaacagattaacgctcagcgaccggagccccagtcagataatgacagttctgctacctgctctgcagacgaggacgtggatggagaaccggagcggcagagaatgttccctatggactccaaaccttcactcctgaacccgacggggtctatcctggtctctagtccgctgaagcccaacccgctggatcttcctcaactgcaacaccgtgcggcggtgatcccacccatggtctcctgcaccccctgtaacatacctattggcacgccagtgagcggatatgcattgtatcagcggcacattaaagcaatgcacgagagtgctctcctcgaggagcagagacaacggcaagagcagatagatttggaatgtagatcatccacctctccatgcgggacatctaagtcaccaaaccgagagtgggaggtcctccagcctgcccctcatcaggtgataaccaacctcccagaaggagtcagactcccaactaccaggcccacaaggccgccgcctcccctgatcccctccagcaagacgaccgtcgcgagcgaaaaacccagttttattatggggggaagcatttcccaggggaccccagggacatatcttacatctcacaaccaagcctcttatacgcaggaaacccctaagccgagtgtgggaagcatttcgcttggacttccccgacagcaggagtctgcaaagtccgcgaccctcccttatatcaagcaggaagaatttagccctagatctcaaaatagccagcccgagggactgcttgtgcgtgcccagcatgagggagtggtaagggggactgccggtgctattcaggagggctccattaccagggggactcctacctcaaaaatcagtgttgagtcgatccctagcctccgtgggtcaatcactcagggcactccagccctacctcagaccgggattccaactgaggctctcgttaagggatccattagcaggatgcctatcgaggatagttctcctgagaagggcagagaggaggcggctagcaagggccatgttatttacgagggtaagagcggacacatcctctcgtatgacaatattaagaatgctagagaaggtaccagatcccccagaaccgcacacgaaatttctctaaaacggagctatgaatctgtggagggcaatatcaaacagggcatgtctatgcgggagtccccggtgtctgccccacttgagggtttgatttgtagagctctgcctagaggcagcccgcactccgacctgaaggagagaactgttctatccggctccattatgcaggggactccccgggctactaccgagtctttcgaggacgggctgaaatatcctaaacaaatcaagagggagtcccccccaattcgagccttcgaaggtgctataactaagggaaagccttacgacggaatcaccactattaaggaaatggggagatctatccacgagatcccccgacaggacatccttacacaggagtcgcggaaaacacccgaagtcgtgcagtcgactcggcctatcatagaaggctccataagccaaggaacccctatcaagttcgataataattccgggcagtctgcaataaaacataatgtgaagtccctgatcacaggcccttcaaagctttctaggggaatgccgccactggaaatcgttccggagaacatcaaagtcgtggaacgaggcaagtacgaagacgttaaagctggagagactgttaggtctcggcacacttcagttgttagcagcggtcctagcgttttaaggagcaccctccatgaggcccctaaggcgcaactgtcccccggaatctacgatgacacttccgcaagacgcactcctgtgtcataccagaatactatgtccagggggtccccaatgatgaaccgcacctccgacgtctctagcaacaagtccacaaatcatgagcggaagagtacccttacccccactcagcgggagtctattcctgcaaaatcaccagtgcctggagttgaccccgttgtctctcacagtccattcgaccctcatcatcggggtagcaccgccggagaggtataccgcagccacttgcccacccatctcgaccccgccatgccctttcatagagcactggatcccgccgccgcctacctgttccagaggcaattgtcgccaacaccaggataccccagccaataccaactgtatgccatggagaatacccgacagactattctgaatgattatatcacctcccagcagatgcaggtcaaccttaggcccgatgtcgccagagggctgtcgccgcgtgaacagcccttggggttgccctatccagcaacgaggggcattatagatcttaccaacatgcccccaaccatcctggtgccacacccagggggtacatccacaccgccaatggatcgcatcacatatattcctggcactcagatcaccttccccccgcgcccctataattccgcatcgatgagccctggccaccccacacatcttgccgcagccgcctctgccgaacgtgagcgggagagagagagagagaaagagagagaacgagagagaatcgctgccgcatcaagcgatttgtaccttagacccggttctgagcagccaggccgcccaggcagccacggatatgtcaggagcccttcgccgagtgtgcgaactcaggaaactatgttacagcagcgtccttccgtgttccagggcaccaacggaactagtgtgataacccctttagatcctacagcgcagctgagaataatgccgctccccgccgggggcccctcgatcagccagggcctgcccgcgagtaggtacaacacagctgccgatgcactcgctgccttagtcgacgccgctgcctcagcccctcagatggacgtgtctaagaccaaagaatctaagcatgaggccgccagactggaagaaaatttgcggagccgatctgccgccgtctccgagcaacagcagttagagcaaaaaaccctcgaagtggaaaaaagaagcgtccaatgcctctatacctcttctgcctttccttccggaaagcctcaacctcacagctctgttgtctattccgaggccggcaaggataagggcccaccccccaagtctagatatgaggaggaacttcgcacaagagggaagaccacaatcaccgctgctaattttatcgatgtaattatcactcgccagatcgcatcagataaagacgcacgggagcgcggaagccagtcaagcgattcaagctctagcttgtcttcacaccgctacgaaactccatccgacgctatagaagtgattagccctgcgagcagcccagcccctcctcaggagaagctacagacttatcaaccagaggtggtcaaagcgaatcaagccgaaaatgatccaacaaggcagtacgagggaccgctccatcactaccggccccaacaggagagccccagtccccagcaacaactgcctcccagcagccaggctgaaggaatgggtcaggtgcctaggacccaccgcctgattactctcgcagatcatatttgtcaaattataacacaggacttcgcccgcaatcaggtaagtagtcagacgccacagcagccccctacgtcgacttttcagaacagccccagtgctctcgttagtactcctgtccgcacgaagacgtctaacagatattcccccgaatcacaggcccagtcagtgcatcatcagagacctgggagccgagttagtcctgagaacctggtcgacaaatctcgaggcagccgaccgggcaaatctcccgaacggtctcatgtgtcgagtgagccatacgagcctatctcgccccctcaggtccctgtagtgcacgaaaagcaagattcacttctactcctgagtcagcgaggagctgagcccgctgaacagcgcaatgacgcaaggagcccaggctccatttcatatctacctagcttctttacaaaacttgaaaatacttctccgatggtaaagtctaagaagcaggaaattttcagaaaactgaactccagcggcggcggagattcagatatggcagccgctcagccaggcactgaaatcttcaacctccctgcagttaccacatctgggagtgtctcttccagagggcactcattcgcggaccctgcttccaacctggggctcgaagatattatcagaaaggccctcatgggatctttcgatgataaggttgaggatcacggggtggtgatgagtcagccaatgggtgtcgtccctgggacggccaatacctccgtggtgacctctggcgaaactaggagggaagagggtgacccatcgccccactcgggggtgtgcaagccgaagctcatctccaaatccaattctcggaagagcaaatcaccaataccgggccagggctatctgggcaccgagaggcccagttctgtcagctcagtgcacagtgagggagactaccaccgccagacacctgggtgggcctgggaagataggccgtcttccacgggttcaacacagtttccctataatccgttgaccatgagaatgctttcttcaactcctcccactcccattgcttgcgccccaagcgcggtgaaccaggcagctccacaccagcaaaacagaatctgggaacgagaacccgcccccctgctcagtgcccagtacgagaccctcagcgattccgatgactag

SEQ ID NO: 24994 - DNA, 7014 bp, Artificial Sequence
  Description of Artificial Sequence: Synthetic coding sequence
atgagcagcagcggctacccccccaaccagggcgccttcagcaccgagcaatcaagatatcctccgcacagtgttcagtacacctttccaaacacccggcatcaacaggaatttgcagttcccgattaccgctcttctcaccttgaagtttcgcaggcctcacagctgctgcagcaacagcaacaacagcagctaagacgacgtccatcgctattgtctgaatttcatccggggagcgaccgacctcaagagagaagaactagctatgagccgtttcatccaggaccgtctccagtcgatcacgacagtctcgaatcaaagaggcctcgcctcgaacaggtgtctgacagccacttccagcgtgtctcagcagccgtgttacccctggtgcatcccctccccgaaggtctcagggctagcgccgatgctaaaaaggatcctgcattcggaggcaaacacgaagccccgtccagtcccattagtggacagccctgtggcgacgaccagaacgcctcaccgagtaagctcagtaaagaggaattgatacaatccatggaccgcgtcgatcgagagatcgccaaagtggaacaacagatcctcaaattgaagaagaaacagcagcagttagaagaggaggcagcaaagccacccgaaccagaaaagcctgtgtcaccaccgccagtagagcaaaaacaccgcagcatagtgcagattatttacgacgagaataggaagaaggcagaagaggcccacaaaatattcgagggactggggccaaaagtagagctccccctatacaatcagcctagcgacactaaagtgtaccatgagaacatcaaaaccaatcaggttatgagaaagaaattgattctgtttttcaagcgcagaaatcacgcccgcaagcaacgcgaacagaaaatttgtcagaggtatgatcagttgatggaggcctgggaaaaaaaggttgatcggatagagaacaacccccgaaggaaggctaaggagtcaaaaactcgcgaatattatgaaaaacagttccccgagattagaaagcagagagagcagcaggagcggttccagagagtgggtcaacgcggcgccggcttatccgccaccattgcaaggagcgaacacgagatctccgagatcattgacggcctcagcgagcaagaaaataacgaaaagcagatgaggcagctgagcgttatcccacctatgatgttcgacgccgaacagcggagagtgaagtttatcaatatgaatggactcatggaggatcctatgaaggtgtataaggataggcagttcatgaacgtgtggactgaccatgagaaggagatctttaaggataagttcatccaacatccaaagaactttggcctcattgccagctacctggagagaaaatcagtcccggattgtgttctctactactacttgactaagaagaacgaaaattacaaggctctcgtgcggcgcaattacggcaaacggcgcggccgaaatcaacagattgcccgtccaagccaggaggaaaaggtcgaagagaaagaggaagacaaagccgaaaagaccgaaaaaaaagaggaggaaaagaaggacgaagaggagaaagatgagaaagaggacagcaaggagaacacaaaggaaaaagataagattgacggcactgctgaggagaccgaggagcgtgaacaggcaacacccagaggcaggaaaaccgccaacagccagggccggcgcaagggccgcatcaccaggagtatgactaatgaagcggccgctgctagcgctgccgctgcagccgccaccgaggaacccccgccacccctgccccccccacccgagcctatctcaaccgagccagtggagacctcacgctggacagaggaggagatggaagtggcaaaaaaaggcttggtggaacacgggcggaattgggcggccatcgcgaaaatggttggcaccaagagcgaagcgcagtgtaaaaatttttatttcaactacaagcgccggcacaatctcgacaaccttctccagcagcacaaacagaaaaccagcagaaaaccgcgtgaggaacgggacgtatctcaatgtgaaagcgttgctagcactgtgtcggctcaggaagacgaggatatcgaggcttcaaacgaagaagagaacccagaagactccgagggcgctgaaaattcctccgatactgaaagtgcgccatccccaagccccgtcgaggctgtcaagcctagtgaagattcacctgaaaatgcgacgtcaaggggtaacacggagcctgccgtggaactggagccaaccactgaaaccgcaccgagcacttcgccctctctggccgtgccatccactaagcccgccgaagacgagagtgtagagacacaagtcaatgactcaatcagcgccgagacggccgagcaaatggacgtggaccagcaggagcactctgctgaagaaggctcggtctgtgacccccccccagcaaccaaggctgacagcgtggacgtggaagttagggtgcctgagaaccacgcatccaaagtcgagggcgacaatacaaaggaacgggatcttgatcgcgccagtgaaaaggttgagccaagggatgaggacctcgtcgtggctcaacagattaatgcccagcgacctgaaccccaaagtgacaatgacagtagcgccacatgcagcgccgatgaggatgtcgacggggaaccagagcggcaacggatgtttcccatggatagcaagccaagccttctgaatccaactggctcaatactggtgtccagtcccctcaaacccaatccactagacctgcctcagctgcaacacagagcagccgtgataccgcctatggtttcttgtactccttgtaatatcccgattggaacccccgtgtctggctacgccctttaccaaagacatattaaggctatgcacgaaagtgctctcttagaagaacagagacagcgacaggagcagatcgatctcgaatgtaggagtagtaccagtccttgcggcactagcaagagtcccaatcgggaatgggaagtgctccagcctgcgcctcaccaggtgatcactaatcttccagagggggtgcgcctgccaacaactcgtcctactaggccccctcccccacttatcccttcttccaaaaccacagttgccagtgaaaaacctagcttcattatgggtgggtcaatctctcagggtacgccaggcacttatctcacaagccacaaccaggcctcttacacgcaggagacgccaaagccttccgttggcagtatttcgctaggcctccccaggcaacaggagagcgctaagtccgccacactcccctacattaaacaagaggagtttagtcctcgcagtcagaacagtcagccagaaggactgctggtgcgggcccagcatgaaggcgtcgttcgaggtaccgctggcgccatacaggaaggctctatcacaaggggaaccccaacgtccaaaataagcgtggagagcataccaagtctgcgtgggtccatcactcagggcaccccagccctcccccagacagggattcccacagaagctcttgtgaaaggcagcatcagtcggatgcccattgaggactccagccctgaaaagggccgcgaggaggcagcctccaagggtcatgtgatctatgaaggcaagtctgggcatattctttcctatgataacattaaaaatgcacgagagggcacacgcagccctagaaccgcccacgagattagccttaaacgatcttacgaaagcgtcgagggaaacataaaacagggcatgagtatgcgggagtcacctgttagcgctccactggaaggtctgatctgccgggccctcccaaggggcagtccgcactcagacttaaaagagcgaactgtactttccgggtccatcatgcaggggacgcctcgggcaacaacagaatcttttgaagatggcctgaagtatccaaaacagatcaagagggagtctccacctattagagcatttgaaggagccattaccaagggcaagccttacgatgggatcaccaccatcaaagaaatggggcggagcatccacgagataccccgccaggatattctgacccaggagtcccgcaaaaccccagaagtggtacaaagcaccagacccattatcgaaggctccatcagccaaggtacccccattaaatttgataacaattcgggacaatccgccatcaagcacaatgtcaagtccctgattacaggtccatcaaagctctctagaggaatgccgccattggagattgtccctgagaatattaaggtggtagaacgcggtaagtacgaagacgttaaggctggcgagaccgtcagatctcgccacacgtccgttgtgtcctccggcccgtcggtgttaagaagtacgctgcacgaggcgcctaaagcccagctgagcccaggcatctacgatgacaccagcgcccggagaaccccggtcagctatcagaatacgatgagccgcggctcacccatgatgaatcgaacttctgacgtgaccattagcagcaataagtccacaaaccacgagcgaaaatccactctgacccctacccaacgggaatcaattcccgccaaaagcccagtccccggggtcgacccagtggtgtcccactctcctttcgacccgcatcatcgaggaagcacagctggtgaagtctatcgaagccatctgcctacacacctggatcccgctatgcccttccaccgggcgctggatccagctgctgccgcatacttgttccagcgccagctgtccccaacacccggatatcctagtcagtaccagctctacgccatggagaatacacgacagactatattgaatgactacattactagtcagcaaatgcaggtaaatttgcgcccggatgtggcccgtggcttgtcacctcgagaacagcccctgggactcccgtaccctgctactcggggaataattgaccttacaaacatgcccccaacgatcctggtccctcatcctggcggcacgagtactccaccgatggatagaataacctatatccctgggacacagatcacatttccaccacgtccctacaacagcgctagtatgagtccggggcatcctacccacttggccgccgccgcttcagccgaacgagagcgtgagcgcgagcgcgagaaagagcgggagagagagcgtatcgcggcagccagtagcgacctctatctgcggcctggctcggaacaaccagggcggcccggaagccacggttatgtacggtctccatccccaagcgtccgcacgcaggagactatgctgcaacaacgtccctcagttttccagggtactaacggtacatccgtcatcacccctctagatcccaccgcacagttgagaatcatgccactgcctgctgggggccctagtatttcacaggggctccccgcttccagatacaacaccgcggcggatgcactggcagctctggttgatgcggccgcgagcgctcctcagatggacgtgtcaaagacaaaggaaatcagctctcatagatatgagacccccagcgacgctatcgaggtcatctccccggcctcttctcctgcccctcctcaggaaaaacttcagacataccagcctgaggtggtcaaagccaatcaggctgaaaatgatcccactagacagtatgagggaccactacatcactatcgacctcaacaggagagtccttcccctcagcagcaactgcccccttcgagtcaggccgagggaatgggtcaggtaccacggacccatcgcttgatcaccctggcggaccatatatgccaaattattacccaggatttcgcccgtaatcaggtgtctagtcagacaccccagcaacctcccacttccacatttcaaaactctcccagcgccctggtgtccacaccagttcgaactaaaaccagcaaccgatatagcccagaaagccaggcacaatccgtgcaccaccagcgtcctgggagccgggtgagtccagagaacctggtcgacaagtcacgggggtcgagacctggaaagtctccagaaaggtcccacgtgagctccgaaccatacgagcccatctcacctccccaggtacctgtagtgcacgaaaaacaggacagcctcttacttctctctcaacgtggtgccgaacccgcagagcagaggaatgatgcacgttcacctggatctatatcctacctgccctcctttttcaccaagctcgagaacacctctcctatggtcaagtccaaaaaacaggagatctttcggaagctgaactcaagtggggggggtgatagcgacatggctgcggcccagcccggcaccgagatttttaacctgccggctgtgactaccagtggcagcgtttcttctcgaggacactcatttgccgatcccgcaagcaacctcgggctggaagatatcatcagaaaagccttgatgggtagctttgacgataaagtggaggatcatggcgttgtgatgtcccagccaatgggggtggtccctggcaccgctaacacgagcgtcgttacaagtggcgaaaccaggagggaggagggggaccccagccctcattctggcggcgtttgcaagccgaaactgatctccaagtcgaactcccgaaagagcaagtctcctataccaggacagggctacttgggtaccgagagacctagttcagtgagcagcgtccattctgagggggactatcaccgccagactcctggctgggcttgggaggaccgcccatcttctaccggatccacacagttcccttataaccctttgacgatgagaatgctgagttctacccctcccactcctattgcctgcgccccctctgccgtgaaccaggctgctcctcaccaacagaaccgaatctgggagagagaacctgcaccactgctttctgcacaatatgagacactgtctgactccgatgactag

SEQ ID NO: 24995 - DNA, 3075 bp, Artificial Sequence
  Description of Artificial Sequence: Synthetic coding sequence
atgccccccctggagatcgtgcccgagaacatcaaggtggtggagcgagggaagtatgaggacgtgaaagccggggaaactgttcgttcgcgccacacctcggtggtgtcaagcgggccaagcgttcttcggtctaccttgcacgaggcccccaaagctcagctgagccctggcatttatgacgacacatccgctcggagaactcctgtgtcctatcagaacacaatgtcgcgcggaagccccatgatgaatagaacctctgatgtgactatttccagcaataagagtacgaaccacgagcgcaaatccactcttacccccacccagcgggagtcaatacccgccaagagtcctgtgccaggagtggatcccgtggtgagccactcaccttttgacccccatcatcgcggatctacagccggagaagtgtaccgctcccacttacccactcacttggatccggctatgccgtttcaccgtgctcttgaccccgcagctgcagcttacctcttccagcgtcagctgtcccccacaccaggctacccttcacagtaccagttgtatgctatggaaaacaccagacagactatcctcaacgactatatcacttcccaacagatgcaggtgaatctgcgtcctgacgtggctcgggggctcagcccacgcgagcagcctctgggtcttccgtacccagcaacgcggggtatcatcgatcttaccaatatgccaccgaccattcttgtcccacatcctggggggacttccacgccacccatggaccgcattacctatatcccagggacacagattacgttccctccgcgaccgtacaacagcgcaagcatgagtcccggccaccccacccatctggccgcggcagcaagtgccgaacgagagcgggagagagagcgagaaaaagagcgtgaacgcgagcgaatcgccgcagcaagcagcgacctgtacttgcgacccggatcagaacagccagggcgtcctggtagtcacggatatgtgaggtccccatccccctccgtgcgaacacaggagaccatgcttcagcaacgtcctagtgtgttccaagggaccaacgggaccagtgtgatcacacccctggatcccaccgcgcagctacgaattatgcctcttcctgctggaggtccttctatttctcagggcctgcctgcaagtcgttataatactgcggccgatgccttggcagctctggtggatgctgcagcatcggcccctcagatggacgtctccaaaacaaaagaatcgaagcacgaagcagcacgcctggaggaaaacttaagatcccggtcagcagccgtctccgagcagcaacaactggaacagaaaaccttggaggtggagaagcggagcgtgcagtgtctgtacaccagctcagccttcccatctggcaaaccccagccacattcatcagtggtatattcagaagcagggaaagataagggtccgcccccaaaaagccggtatgaggaagagctccggaccaggggaaagaccactattacagctgccaattttattgacgttattattaccaggcaaatagcatccgataaagacgcaagggagaggggcagccagtcctcagacagcagcagcagcctatccagtcatcgatacgaaactccatctgatgcaatagaggttatctctcctgcctcaagcccagctcccccccaggagaaattgcagacctatcagcctgaagtggtgaaagctaaccaggccgagaatgatccgacccgacaatatgaaggaccgcttcaccactaccgcccgcagcaggagagccctagtccacaacaacaactgcccccatcatcccaagctgagggtatgggccaggttcccagaacccaccgcctgataaccttggccgatcatatatgccagatcattactcaggacttcgctaggaaccaggtcagtagccagaccccacagcagcctcccacatccacttttcaaaattctcctagcgcccttgtgtccacccctgtgcgaacgaaaacatctaacaggtacagtcccgagtcccaggcccagagtgtgcaccatcagcgccctgggtcacgggtttccccagagaacttggttgacaagtctaggggaagtcgcccaggcaaatcccccgaacgtagtcatgtgagctcggagccttatgaacccatctcacccccccaggttccggtcgtgcatgaaaaacaggattctttattgttgctatctcagcgcggcgccgaaccagccgagcagagaaacgacgcccggagccccggctctatctcatatctaccatctttcttcaccaagctggagaacacctctccaatggtaaaatctaagaagcaggagatttttcggaagctgaattcaagcgggggcggcgatagcgacatggcggcggcgcagccgggcaccgaaatctttaatctgccggcggtgacaacatccggatccgtcagcagccggggacattcgtttgctgacccagcatccaacctaggactagaagatattatccggaaagccttgatgggcagttttgacgacaaagttgaggaccacggggtggtgatgtcccaaccaatgggcgttgtccccggtactgctaacacaagcgtggtcactagtggagagacccgtcgagaggagggggatccatcacctcattccggcggtgtctgtaaaccaaaactgatcagtaaatccaactccaggaagagtaagtcaccaataccaggacagggatatttagggacagaacgacccagctcggtctctagtgttcattctgaaggcgactatcatcgacagactcctggctgggcctgggaagaccggcctagctccactggatcgacgcaattcccatataaccccctgacaatgcgcatgctgtcttccacccctccgactcccattgcgtgcgctccctctgcagtgaatcaagccgctccccatcagcagaaccggatctgggaacgagaacccgcccccttgctcagcgcccagtatgaaacactgtccgattctgacgattag

SEQ ID NO: 24996 - DNA, 4821 bp, Artificial Sequence
  Description of Artificial Sequence: Synthetic coding sequence
atgctgctgcacctgtgcagcgtgaagaacctgtaccagaaccggtttctgggtctggccgctatggcttctcccagcagaaatagccagtcaagacgccgatgcaaagaacccctcagatactcctacaatcctgaccaattccacaacatggatctgaggggagggccacacgatggggtcacaatccctaggagtacctcggacaccgacctagtcacatcagactccaggagtacgctgatggtcagctcctcatattattctattggtcacagccaggacctcgtgattcattgggacatcaaagaagaggtggatgctggggattggattggtatgtatctgatcgacgaagtgctgtccgagaactttttagattacaaaaaccgcggtgtaaacggatcccatcgcggacagataatctggaagattgacgccagctcttacttcgtcgagcctgagactaaaatttgttttaaatactaccacggtgtatccggagccctgagagccacaacccctagtgttactgtcaagaactcggccgctcccatatttaaatccataggtgctgacgagaccgtacaagggcagggcagccgccgtctcatatccttttccctctcagattttcaggctatgggcctaaagaagggaatgttcttcaatcctgatccatacctcaaaatctcgattcagcctggaaaacacagcattttcccagctcttccacaccatggacaggaaagacgatcaaagattattggcaatactgtcaatcccatctggcaggccgagcaattctccttcgtgtcccttcctacagacgtgttggaaatcgaggtgaaagataagttcgctaaatctaggcccatcatcaaaagatttctaggcaagcttagcatgcctgtgcaacggctgctggaaagacatgccattggggatcgcgtggtaagctacacgctcgggcgcaggctccccaccgaccatgtgtccggccagcttcagtttagattcgagattaccagtagcatccatcccgacgatgaagaaataagcctgtctaccgagccagaatccgctcaaatccaggactccccgatgaataacctgatggaaagtggcagtggcgaacctcgatctgaggctccggagtccagtgaatcttggaagccggaacagctcggggaaggcagcgtgcctgacgggcctggtaaccagagcattgaattgtctaggcctgcagaagaagctgcagttatcactgaggcaggcgatcagggcatggtgagcgtgggacccgagggggcaggagaattgttggcgcaggtgcagaaagacatccagccagcacccagcgctgaggagctggctgagcaactggatctgggagaggaagcttccgcgcttttgctggaggacggcgaggcccccgcctcaacaaaggaagagcctttagaagaagaagccacaactcagtcgcgggcagggcgcgaggaagaggagaaggaacaggaggaggagggggacgtcagtactctggagcagggggaggggagattacaattgcgcgcctctgtgaagcggaagagtaggccatgctcactcccagtcagcgaactcgaaactgtaatcgccagcgcttgtggcgaccccgagaccccacgaactcattacatcagaatccatactctcctgcacagcatgcccagcgcacaaggaggctctgcagcagaggaagaagacggggccgaggaggagagcaccctgaaggactcctcagaaaaggatggactttctgaggtggacacagttgccgccgatccatctgccctggaggaagaccgcgaagagcccgagggtgccactcccgggacagcacaccctggccacagtgggggccattttccatccctggcaaatggcgctgcccaggatggagacacgcacccctcgaccggaagcgaaagcgacagctcacctcgacaaggaggcgaccacagttgcgaaggttgtgatgcaagttgctgttcaccgtcctgctatagcagcagttgttacagcacaagctgttactcgagtagttgctatagtgctagctgttatagcccaagctgctataacgggaatcggttcgcatcccacaccaggtttagctctgtcgatagcgccaagatcagcgaatccacagtgttctccagccaggatgacgaagaagaggagaactctgcgttcgagtcagtgccagatagtatgcaatccccggagctcgatcctgaatccactaacggggccggaccttggcaggatgagctcgccgcgcccagcggccatgtagagaggtcccctgaagggctcgagagtcctgttgccgggccatccaaccgccgggagggagagtgcccaatcctccataactcccagcctgtgtcccagcttccatctctgcgccccgaacaccatcactaccccaccattgatgagccacttcctcctaattgggaagcccggatcgattcacacggacgagttttttatgttgatcatgtaaatcgaacaacgacttggcagcgccccaccgcagcggcaactccggatggcatgcggagatccgggtccatacagcaaatggagcaattgaatcgaagatatcaaaatatccagagaacgatcgctacagaaagaagtgaggaggacagcggcagccagtcatgcgaacaggcacccgcgggaggtggaggcggaggaggatctgacagcgaagccgagagctctcaatcgagtctggatctgcgtcgggaagggtctttgtccccagtgaattctcaaaagatcaccttgctgctacagagcccagcagtaaagttcatcaccaatcccgagtttttcacagtattacacgccaactattccgcctatcgcgttttcacatcttcaacatgcctcaaacacatgatcctgaaagtgagacgcgacgcaagaaacttcgagcggtaccagcataatagggaccttgtcaatttcatcaacatgttcgcagatactaggttggagttgccgagagggtgggagattaagacagatcaacagggcaagtccttctttgttgatcacaactctagagctactactttcatcgaccctcgcattccactgcagaacgggagactgcccaatcatctgactcaccggcagcacctgcagagattacgcagctacagtgcaggcgaggcctcagaagtaagtaggaatagaggtgcttctctccttgctcgtccaggccattccttagtggccgccatccgctcacaacaccagcacgaaagcctccctctggcgtataacgataaaatcgtggcttttttgcgtcagccaaatatcttcgagatgttacaggaaagacaaccttccctggccaggaatcataccttacgagagaagattcattatatccgaactgaaggaaatcacggtctggagaagttatcctgcgacgccgatttggtcatcctgcttagcctgttcgaggaggaaataatgagctatgtgccactccaagcagcctttcaccctggatatagctttagcccaaggtgtagtccttgttcgtccccccaaaattcgcccggactccaacgtgcatcagcacgggcgccttccccctaccgacgcgacttcgaggccaagctccgtaacttctataggaagctagaggcaaaaggatttggccagggccccggcaagattaagctcatcattaggagggatcacctgctggagggcaccttcaaccaagttatggcctattcacgaaaggaacttcagagaaacaagctttatgtaaccttcgttggggaagagggactggactacagcggcccctcccgggaattcttctttctgttgagtcaggaactgttcaacccctattatggactatttgagtactccgccaatgatacttacacggttcaaatttcccccatgagcgctttcgttgagaaccatctcgaatggtttagatttagcggccgtatcctcggcctggcccttattcaccagtatttgctggacgccttcttcaccagacctttctataaagccctgctgagattaccttgcgacctttctgacctggaatacctggatgaggaattccaccagtcactgcagtggatgaaggacaataacatcaccgacatcctcgatttaaccttcacggtcaacgaggaagtcttcgggcaggtcactgaaagggaactaaaatccgggggcgcgaacactcaggtgaccgagaaaaacaaaaaggaatacatagagcggatggtcaagtggagagttgagagaggagtggttcaacagaccgaagccttagttcgtggtttctacgaggtggtcgatagcagactcgtcagcgtcttcgatgctagggaactggagttggtgatcgccggcactgcggagatcgacctcaatgactggcgaaataacactgaatatagaggaggctaccatgatggccatctggtgatcaggtggttttgggccgccgtggaacgatttaataacgagcagaggcttcgcctcttgcagttcgtcactggcacgtcgtcggtgccctacgagggctttgcagccctacgaggcagcaacggtctcaggcgattttgtatagagaaatggggtaagattacaagcctgccgcgtgctcatacctgtttcaatcgtctcgatcttccaccctaccctagttatagtatgctgtacgaaaagctcctgacggcggtcgaggagacaagcaccttcggcctggagtag

SEQ ID NO: 24997 - DNA, 1209 bp, Artificial Sequence
  Description of Artificial Sequence: Synthetic coding sequence
atggccgccctgtgccggaccgccgagagccaggccgagctgcagtgtacacagctggaccttgaaaggaaactcaaactgaacgagaacgccattagcaggctccaagccaatcagaagtccgtgctggtgagtgtgtcagaagtcaaggctgtggccgaaatgcagttcggcgaactcttggccgcagtcagaaaagcacaggcaaacgttatgctgttcctggaggaaaaagagcaggccgctctgagccaggccaatggtataaaggcgcatcttgagtataggtctgcggagatggaaaaatccaaacaggagctggaaacaatggccgccatttcaaacacggtccagttcttagaagagtactgcaaattcaaaaatactgaagacataacattcccatctgtttatataggccttaaagataagctgagtgggattaggaaggtgattaccgagtcaacggtgcatctcatccagctactcgagaactacaaaaaaaagctacaagaattcagcaaagaggaggagtatgacatccggacccaagtgtcagcaatcgtgcagaggaaatattggacgtctaaaccagagcccagcaccagagaacagttcttgcagtacgtgcacgatatcacctttgaccctgacactgctcataaatatttgcgtttgcaagaggaaaaccgaaaggtaacaaacacgaccccctgggagcacccttaccctgacctgccttccaggttcctgcactggcgccaggttcttagccagcagagtttatatctacacagatactactttgaagtagagattttcggagccggaacttacgtgggactgacctgtaaggggatcgatcaaaaaggagaagaaaggtcatcttgtatttccggcaacaacttctcatggtccctccagtggaatggcaaggaattcacggcttggtacagcgacatggagacacccctcaaagctgggccgttctggcggttgggggtgtacatcgattttcccggggggattctgagtttctatggagtggagtatgattcaatgaccctggtgcataagtttgcttgtaaattctctgagcccgtctacgctgccttttggttgagcaagaaggagaacgcaataagaatagttgacctgggtgaggagcccgagaagcctgccccgtccctcgtgggcacggctccatag

SEQ ID NO: 24998 - DNA, 1677 bp, Artificial Sequence
  Description of Artificial Sequence: Synthetic coding sequence
atgcaccggagcgcccccagccagaccaccaagcggagccggagccctttcagcaccaccaggagaagctgggacgactcggaatcaagcgggactaacttgaacatagacaatgaagactattcccgctacccacctcgggagtatagggcctccggttctcggagaggcatggcttacggccatatcgatagctacggggcagatgacagtgaggaggagggggctggcccagtggaacgccccccagttcgaggcaagacgggtaagttcaaggacgacaagctcctggaccccgtgccagccgctcgttgtagcgcttccagggcagattttttacctcagagtagtgtggcgtcgcagagttcatctgagggtaagctcgccaccaagggtgattcatctgagagagaacggcgagagcagaatctgccagcacggcctagcagagcaccagtgtccatctgtggcgggggagagaatacctcaaagtcagctgaggaaccggtggtcaggcctaagataaggaatttggcctccccaaattgtgtgaaacctaagatctttttcgatactgatgatgacgacgacatgccgcactcaacgagtcggtggcgagacactgctaacgataatgaaggacattctgatggcctggcaagacgagggcgcggggaaagtagcagtggctaccctgagcccaagtaccccgaggataagagggaggcccgttctgatcaggttaaaccggagaaagtgcctagaaggcgcagaacaatggccgatccagacttttggacccacagcgacgactattacaagtactgtgatgaggactctgattctgacaaagagtggattgccgcgttaagaaggaagtatcgcagtagagaacagactctgagttcgagcggcgaaagttgggagacattgcctggaaaagaagagcgagagccacctcaggccaaagtgtccgctagtaccggcactagtcctggccccggagcttccgccagcgcgggggctggcgctggtgcatcagctgggagcaacgggagtaactacttggaggaagtgagagagcctagcctccaggaagaacaagctagccttgaggagggcgagattccttggttgcagtaccacgaaaacgattctagcagtgaaggagacaacgattccggacacgagctcatgcagcctggcgtatttatgctggacggtaataataacctggaggacgactccagcgtgtcggaggatttggaagtggactggtccctgtttgatggttttgctgacggtctgggcgtagcagaggctatttcatatgtggatccgcagttcctcacctacatggcattggaagagcgcttggcacaggccatggagacagccctggcccatctcgaaagcctggccgtggacgtggaagttgccaaccctccagcctctaaagagtcaatcgatgccctgcccgaaattctggtcaccgaagaccacggggccgtgggacaggaaatgtgctgccccatctgctgttcagaatacgtaaagggtgaggtagccacagagctgccttgtcaccattactttcataaaccatgcgtttccatatggctccagaaaagtggtacctgtcctgtgtgccggtgcatgtttccaccgcccctatag

SEQ ID NO: 24999 - DNA, 3591 bp, Artificial Sequence
  Description of Artificial Sequence: Synthetic coding sequence
gtgcccccctgccccgccgagctgcggagcgtgaccaacggccagagtaatcaaccttctaacgaaggggatgccataaaagtcttcgttcgcataagaccccccgccgaacgctcgggaagtgccgacggagagcagaacctgtgtctgagtgtcctgagctccaccagcttgaggctgcacagtaacccagagcccaagacgtttacatttgatcatgtggcagatgtggataccactcaagagtccgtgtttgcaacagtagccaaatccatcgtggaatcgtgtatgagtggctacaacgggacaatcttcgcttacggtcaaaccggatcaggcaagacctttactatgatgggtccatccgaaagcgacaacttctcacataacttaaggggcgtgattccccgcagttttgagtacctcttctccctcatagaccgggagaaggagaaagctggagcaggaaagtcttttttgtgtaaatgcagttttatcgagatctacaacgaacagatctacgacctccttgatagtgcctcagctggcctgtacctcagggagcacatcaagaaaggagtgttcgtggttggcgcggtagaacaggtcgttacaagtgctgcggaggcatatcaagtgctcagtggaggatggcgtaataggcgtgtggcctcaacctcaatgaacagagagtcctctagatcccacgccgtgtttaccatcaccattgagtctatggagaaatccaacgaaatcgttaacatacggacaagtctgctgaatctggtcgacctggccggatcagaacggcagaaggatactcatgctgaagggatgcgactcaaagaggcgggtaatattaataggtctctgtcatgcctgggacaggtcattacagccctggtggacgtgggtaacggtaaacaacgacatgtctgctatcgagatagcaaactcactttcttgctcagggattccctgggtggcaacgccaagactgcgatcatcgcaaatgtgcacccggggagcaggtgttttggcgagacgctgtctactctgaactttgcccagagggctaagctaataaagaataaagccgtagttaacgaggatacacaggggaatgtgtcccagttgcaagcagaagtcaagcgtctgaaggagcaactggctgagttggcctctggccaaacgccacccgagtctttcctgacccgggataagaagaaaactaactatatggagtattttcaggaagcaatgttattctttaagaaaagtgagcaggaaaaaaaaagcctgatcgaaaaggtcactcaactggaggatctgacacttaagaaggagaaattcatccagagcaataagatgattgttaagttcagagaggatcagataattcgactggagaagttgcacaaggaatcaagagggggattcctgcctgaagaacaggacagattactgtcagagctgaggaacgaaatccagacactccgagaacagatcgaacaccacccacgcgtcgccaaatatgccatggaaaatcacagcctcagggaagagaaccgcagactgcgcctcttggaacccgtcaaacgtgctcaggagatggacgctcagactatcgccaaactggagaaggcgttctccgagatcagcggcatggagaagtctgataaaaatcaacaagggttcagccctaaggctcagaaggaaccctgtcttttcgccaacactgagaagctgaaggcccagctactgcagatacagacggaactgaataacagcaagcaggaatatgaagagtttaaagagttaacgaggaagcgccagctcgaattggagagcgagctgcagtccctgcaaaaggcaaacctcaacctcgagaacttgctggaagctacaaaggcttgtaaacggcaagaggtctcccagctcaataaaattcatgccgaaactttaaagatcattaccacccccaccaaggcttaccagctgcacagtcgcccagttcccaaactcagcccggaaatgggatcttttgggtcgctgtatacccagaattcttccatcctcgataacgacatcctgaatgaaccagtccctccagaaatgaatgagcaggcgtttgaagcaatcagcgaggaactgagaacagtgcaggagcagatgagtgccctgcaggccaaattggatgaagaggagcacaagaacctcaagctgcagcaacacgtggataagcttgaacaccattctacccagatgcaggaactgttctcttcagaaagaatcgactggacgaaacaacaggaggagctactgagccaactgaacgtgttagagaagcagttgcaagagacgcagacgaaaaatgactttcttaaatctgaagttcacgaccttcgggtcgtgctgcatagcgccgataaggagctgagctccgtaaagcttgagtatagcagctttaagacaaaccaggagaaagagttcaacaagctgagcgaacgccacatgcacgtgcagctgcagcttgataacctccgactggagaatgagaaactactggagtcaaaagcgtgcctgcaggattcatacgataacctgcaggagatcatgaagttcgaaatcgaccagctctccaggaatttgcagaacttcaaaaaagaaaatgagacattgaagtccgacctaaacaatttgatggagctcctggaggcagagaaagaacgaaacaacaagctttcattgcagtttgaggaagacaaagaaaacagttcgaaggagatccttaaagttttggaggccgtgcgacaggaaaagcagaaagagactgcgaagtgtgagcaacagatggctaaggtgcagaaactcgaggaatcactgcttgctacagagaaggtgatctcaagcttggagaagtctcgagactctgataagaaggtcgttgcagacctaatgaaccagattcaggaactcaggaccagtgtttgcgagaagaccgaaaccatcgacactttgaaacaagagttgaaggacatcaattgcaagtacaattccgcattagttgaccgcgaggagagtcgcgttttgatcaagaagcaggaagtcgacatccttgatctgaaagagacactccggttgagaattctgagtgaggatatcgaaagagacatgctgtgcgaggacctcgcccacgccaccgagcaactgaacatgttgaccgaggcctccaaaaaacacagtggtttgctccagagtgcccagcgcaccgaccaggagggatcacctgacagtggcacatctgcccaagccaaacccaaagagagaggaagcagaacagaagaagaatataacttcaagatgaggcaattggagcacgtaatggactccgctgccgaggacccacagagcccgaaaaccccccctcactttcagacacatctggcgaagctgctagagacgcaagaacaggaaatcgaggacggcagagcgtctaagacatccctagagcacctggtgaccaagctcaacgaggatcgagaggtaaagaatgccgagatcctgcggatgaaagaacagctgcgctag

SEQ ID NO: 25000 - DNA, 3264 bp, Artificial Sequence
  Description of Artificial Sequence: Synthetic coding sequence
atggaccccttcaccgagaagctgctggagcggacccgggcccggagggaaaatctccagaggaaaatggccgagcgccccactgctgccccacggagcatgacgcatgccaagcgggcacgccaacccctgtctgaggcgtctaatcagcaacccctctctggaggcgaggaaaagtcatgcaccaagcctagcccctccaagaagcggtgttctgataacaccgaagtggaggtatccaacctggagaataagcagcctgttgaatcaacaagcgctaaatcttgttcaccttcacccgtgtcaccacaagtacagccccaggcagcggacaccatctcagattctgtggccgtccctgcgagtctcctgggaatgaggcgtggtctgaactctcgcttagaagctactgccgccagctccgtcaagacccggatgcaaaaactggctgagcagcgacggcgctgggataacgatgacatgacggacgatatccctgaatccagcctatttagcccaatgccctctgaagagaaagccgcatcacctccccgcccacttttgtccaatgcatccgccacaccagttggcaggaggggccggttggccaaccttgcggccacaatttgctcttgggaggatgacgtcaaccatagctttgcaaaacagaacagtgttcaggaacagcctgggactgcttgcctctcaaagttcagttctgcatctggggcctctgcaagaattaattccagttccgtaaaacaggaggctacattctgcagtcagagggacggtgacgccagccttaacaaggccttatcatcatcagccgacgacgcatctttggtgaacgcaagtatttcctccagcgtcaaggcaacctcaccggtgaagtcgactactagcataacagacgccaagtcctgcgaggggcagaatcctgagctgctacctaaaacgccgattagccccttgaagacaggagtgtccaaacctattgtgaagtccacattgtcccaaacagtgccttccaagggtgaactgtctcgagaaatctgcttacaatctcagtccaaggacaagagcacaacaccagggggaactggcatcaagccattcctggagcgatttggtgaaaggtgccaggaacactcaaaagaatctccggcaaggagtacgcctcatcggaccccaattatcactcctaataccaaggctatccaggagagactgtttaagcaagataccagttcctcaacgacacatctggcccagcagctgaaacaagagagacagaaggaactggcttgtcttagaggacgatttgacaaggggaatatatggagtgccgagaaagggggaaacagcaagtctaagcagctcgaaacaaagcaggagacacactgccagtctaccccgttgaagaaacatcagggtgtgtcgaaaacccagagcctgccagtaaccgagaaggtgactgagaatcaaatcccagccaaaaactccagtaccgagccaaaagaagttatccgcgaaatcgagatgtctgtggacgacgatgacatcaactcatccaaagtgattaatgatttgttctcagatgtcctggaagaaggcgaactcgatatggagaagagccaggaagaaatggaccaggcgcttgccgagtcttctgaggaacaagaggatgcactgaacatctcctctatgagccttcttgctcctctggcgcagactgttggcgtcgtatccccagaaagcctcgttagtacaccaagactggagctcaaggacactagtcgttctgatgagtcacccaaacctggcaagttccagcgcaccagggtgccgagagccgagagtggcgactccctgggaagtgaagaccgcgatctattatattccatcgacgcttaccggtctcagcgatttaaggagacagaaagaccttctatcaagcaggtgatcgtccgcaaggaagacgtcacatccaaactggacgagaagaataacgcgtttccgtgccaagttaatattaagcagaagatgcaggagctgaataacgagattaatatgcagcagacagtgatttaccaggcatctcaggcgctcaattgctgtgtagacgaggagcatggcaaaggcagcctggaggaggcagaggccgagcgtctgctcctgattgctaccggcaaacgtaccttactgatcgacgagctgaataagctgaaaaatgagggcccccagagaaagaacaaggcctccccccagagtgagtttatgcccagtaaaggctcggtaacactttcggaaattcgactccctctcaaagcagactttgtttgctcaactgtgcagaaacctgacgcagcaaattactactatcttatcatcctgaaggccggggcagaaaacatggtggctacccctctcgccagtacttctaattcgcttaacggagacgcactcacgttcactaccactttcaccctgcaagacgtgagcaatgatttcgagattaacatcgaagtctacagcctggtgcaaaagaaggacccctctggcctagataagaaaaaaaagaccagtaagtccaaagccatcaccccaaagaggcttctcacctcaatcacaaccaaatccaatatacactcttcagtcatggcttcccctggcggcctgagcgcagttagaaccagcaattttgccctcgtgggatcctataccctctcactgtcatctgttggcaataccaaatttgttctggataaggtcccgttcctgtctagcctcgaaggccacatatatctaaagatcaaatgtcaagttaactccagcgtcgaggaacggggattcctaactatcttcgaagacgtgtccggtttcggggcttggcataggcgatggtgcgttctctcaggaaattgcattagttactggacataccccgatgacgagaagcgcaaaaaccccataggtagaattaatttagcgaattgtacctcccggcagatagagcctgctaacagagaattttgcgcgagaagaaacaccttcgagttgatcaccgtccgcccacagagagaggacgacagagaaacactggtttcacagtgtcgagatacactttgcgtgacgaaaaactggctgtctgcggataccaaggaagaacgggatctgtggatgcagaaactgaaccaagtgctggtggatatccgtctctggcagcccgacgcctgttataagcccatcggtaagccttag

SEQ ID NO: 25001 - DNA, 648 bp, Artificial Sequence
  Description of Artificial Sequence: Synthetic coding sequence
atggtgttccggcggttcgtggaggtgggccgggtggcctacgtgagtttcggtcctcacgctggcaaacttgttgccatcgtagatgtaatagaccagaatagagctctggttgacgggccctgtacgcaggtgcgcagacaggccatgccgtttaagtgcatgcaactaactgactttatcctgaaattcccacattccgcacatcagaaatatgtgcgccaggcctggcagaaagctgatatcaataccaagtgggcggctacccgttgggcaaaaaagattgaagcccgggagagaaaagccaagatgaccgatttcgatcggttcaaagttatgaaggctaagaagatgcgaaataggatcatcaagaatgaggtgaagaagttacagaaagcagccctccttaaggcaagcccaaaaaaggcccccggcactaaaggtactgccgccgctgcggccgctgctgctgcagctaaggtgccagcaaaaaagatcactgccgcatccaaaaaagctcctgctcagaaggtccccgcccaaaaggctacaggccagaaagctgccccagcacccaaagctcagaaaggccaaaaggctccggcccagaaggcccccgccccaaaagcgagcggtaagaaggcatag

SEQ ID NO: 25002 - DNA, 2976 bp, Artificial Sequence
  Description of Artificial Sequence: Synthetic coding sequence
atggaggagtacgagaagttctgcgagaagagcctggcccggatccaagaagccagcctgagtacagagtcctttttgccagcccagagcgagtccatttctctgatcaggtttcacggcgttgctatcctctcaccactgctgaatatagaaaaacgcaaggagatgcagcaagagaaacagaaagcactggacgtcgaggcccgaaaacaggtgaataggaaaaaagcactcttaacccgggtccaggagatcttagacaacgttcaggttaggaaggctccaaacgcctcagattttgatcagtgggagatggagaccgtgtacagtaacagtgaggtgaggaacctcaatgtgcccgccacttttccaaactcctttccctctcacacagagcactctacagcagcaaaactggacaagatcgcggggatcctgccgctcgataacgaggaccagtgtaagaccgatgggatcgacctggccagagacagcgaaggtttcaattccccaaagcagtgcgattcatccaacattagccatgttgagaacgaggcgttcccgaagacaagctccgccacaccacaggagaccctcataagtgacggacctttttcagtcaatgaacagcaagacctgccactactcgctgaagttatccccgatccctatgtgatgagcctgcaaaatttgatgaaaaagagcaaggaatacatcgaacgcgaacagtctaggcgatctctgcggggcagtattaacagaattgtgaacgagagccatctggataaagaacacgacgctgtggaggtcgctgattgtgtgaaagaaaaggggcagctgaccggcaagcactgcgtgtccgtgatccctgacaaaccatcactgaacaaatctaacgtgctgctccaaggagccagtacccaggcttcctccatgagcatgcccgtgctggccagctttagcaaggtggatattcccatcaggacaggacatcctaccgtcctcgagagcaactccgactttaaggtaatcccaacatttgtgaccgaaaataatgtcattaagtcactgactggtagttacgcaaaactaccttctcccgagccaagtatgtctccaaagatgcatagacggagatctcgaacgtcctccgcctgccacatcctgataaacaaccccataaacgcctgcgaactgtctccaaaggggaaagaacaggctatggatcttatcatccaggacactgacgaaaacactaacgtaccggaaattatgcccaaactgcctacagacttagccggtgtctgctcgtcaaaagtctacgtagggaagaacacttcagaggtaaaagaggatgtggttctggggaaatctaaccaggtgtgccaatcatcgggcaatcacttagaaaataaggtgacacatggtcttgtgaccgtcgaagggcaattgacctctgatgagcggggagcccacattatgaattcaacctgcgctgccatgccaaagttgcatgaaccttatgctagttcacaatgtatagccagtcccaattttggcaccgttagcggcctgaaacccgcctctatgctagagaaaaattgtagcctgcagaccgaactgaataagtcctatgatgtgaagaacccaagtcccctgttaatgcagaatcagaataccaggcaacagatggatacaccaatggtctcctgtggaaatgagcagttcctcgacaatagcttcgagaaggtaaagaggcgccttgatctggatatagacgggcttcagaaagaaaattgcccttatgtgataacatccggcattactgaacaggagaggcaacatttacccgagaagcgctaccctaaaggatcgggattcgtcaacaagaataaaatgttggggacaagctctaaggagtccgaggaattgctgaaaagcaaaatgttggcattcgaggagatgcgaaaacggctggaagagcagcacgcccagcagctctcactgctgatagccgagcaggaacgggagcaggagaggctgcaaaaggagatagaggaacaggagaagatgctgaaggagaaaaaggccatgactgcggaggcttccgagctcgatattaacaacgccgtcgagttagaatggaggaaaatcagcgatagcagtctcttggaaacaatgcttagccaggctgattctttacacaccagcaattctaatagttccggctttacaaactccgcgatgcagtactcattcgtgagcgcaaacgaggcgcctttctacttgtggggaagctccacgagcgggctgaccaagctatctgtgactaggccgtttggcagggctaagaccaggtggtcgcaggtcttttcgctggaaattcaggctaagttcaacaagattaccgcggttgcaaaagggtttctgactcggcgactcatgcaaaccgacaagctcaaacagttgcgccagacagttaaggatactatggagtttataaggagttttcagagcgaagcaccgctgaagcggggcatcgtttcagcccaggacgcctcgcttcaggaacgggtcctggctcagctgcgagcagccctgtacgggattcatgacatcttcttcgttatggacgccgcagagcggatgagcatccttcaccacgatcgcgaagtgcgcaaagagaagatgttgcgtcagatggacaagatgaagtcaccgagggttgctttgagcgctgccacacaaaagagccttgacaggaagaagtacatgaaggctgccgaaatggggatgcctaataagaaattcttagtaaaacagaacccaagtgaaacgagggtgctccagcctaatcagggtcagaacgccccagtgcaccgcctcctgagtcggcagggatctatttgccgcaagaatccaaagaaggctgccaaatgctgtgacaacctacgacgccagcatagcttaggatag

SEQ ID NO: 25003 - DNA, 2976 bp, Artificial Sequence
  Description of Artificial Sequence: Synthetic coding sequence
atggaggagtacgagaagttctgcgagaagagcctggcccggatccaggaagctagcctcagcactgagtcattcttgcctgcgcagtccgaaagtataagcttgatccgctttcacggcgtggctattctatcaccgttgctgaacatagagaagcggaaggaaatgcaacaggaaaagcagaaggccctcgacgtcgaggctcgtaaacaggtgaataggaagaaggccttgctaacaagagttcaggagattcttgataatgttcaggtgagaaaagcaccgaacgccagcgattttgatcagtgggaaatggagacggtgtattccaacagtgaggtgcggaacctgaatgtacccgcgacttttcctaactctttccctagtcatacagagcacagcaccgcagcaaaactggacaagattgcaggtatcttgcctctggataacgaagaccaatgtaaaaccgatggcattgatcttgcacgcgatagtgaggggttcaactcccccaaacaatgcgacagctccaacattagtcacgtggaaaatgaggcattccctaaaacctcatctgcaactccccaggagacactaatctcggacgggcctttttctgtcaacgagcaacaggatctgcctctcctggccgaggtcatccctgatccgtacgtgatgtctcttcagaacctgatgaaaaaatctaaggagtacattgagagagagcaatccaggaggagccttagaggttccatcaaccgcatcgttaacgagtcacatctggacaaagagcacgatgcagtcgaggtggcagattgtgttaaagaaaagggccagcttacaggaaaacattgcgttagcgtcatcccggacaagcctagtttaaacaaatcaaacgttcttctgcagggggcttcaacacaagccagctctatgtctatgcctgttttggcaagtttctccaaggtggacatacccattcgcacaggccatcccaccgtgttggagtccaattccgattttaaagttattcctacttttgtcaccgaaaacaatgtcatcaaaagcttaaccggaagctacgcaaaactcccatcccctgagccctccatgtcacccaagatgcacagaagacgcagtaggacgagcagcgcttgccacattttaatcaacaatcctattaacgcctgcgaactctcccctaaaggtaaagagcaggctatggacttgatcatccaagatacagatgagaatacaaatgtgcccgaaataatgcccaagcttccgactgacctagccggtgtgtgttcatccaaggtgtatgtgggcaagaacacctccgaggtcaaggaggacgtcgtgctgggtaagtccaaccaggtctgccagtcgagcggcaaccacctggaaaataaggtaacccacggcttggtgacagttgaaggacaactgacatccgacgagcggggggcccacatcatgaatagtacttgtgcagccatgccaaagttgcatgaaccctatgcatcttctcagtgtatcgcgagccccaatttcggaacagtgtccggattgaagcccgcctccatgctcgagaagaattgtagtctccagaccgaactaaataaaagctacgatgtcaagaacccgtctccattgctcatgcagaatcagaacactaggcagcagatggacacgcctatggtgtcctgcggtaatgaacagtttcttgataactccttcgaaaaggtcaaaagacgtctcgatctggacatagacggactccaaaaagagaattgcccatatgttatcacaagcggcataactgagcaggaacggcaacatctgccggaaaagcgatacccaaaaggaagcggctttgttaataagaacaagatgctcggtaccagttcaaaggaaagtgaggagctcctgaagtccaagatgcttgccttcgaggaaatgcgtaagcggttggaagagcagcatgcacagcagttaagcctactcatcgccgagcaggaacgcgagcaggagcgcctccaaaaagagatcgaggaacaagaaaaaatgctgaaggagaagaaagccatgaccgccgaggcgagtgaactcgacattaataatgccgtagagctggaatggagaaagatttccgactcatcgttgctcgagacaatgctctcccaggctgattcccttcatactagtaacagcaattctagcggatttactaatagcgcaatgcagtacagcttcgtgtcagccaatgaggcacccttttatttgtgggggtcctccactagtggcctgaccaagctcagcgtaacacggcctttcggtcgagccaaaacaaggtggtctcaggttttttccctggaaatccaggctaagtttaacaaaattaccgcagtcgcgaaaggctttttgacaagaagactgatgcagaccgataagcttaaacaacttagacagactgtcaaggacacaatggagtttatccgatcattccagtccgaggcccctctgaaacggggaattgtatctgctcaggatgcgtctctgcaggagagagtgctggctcagctgcgggctgcattgtatggaatccatgacatcttcttcgttatggacgccgctgagaggatgagcatactgcatcatgatagggaagttaggaaagaaaaaatgctccgccagatggacaagatgaaatcccctcgcgtggctctgtctgccgctacccagaaaagcctggatcgaaagaagtatatgaaagccgcggaaatgggcatgcccaacaagaaattcttagtcaaacagaaccctagtgaaacacgggtactgcagcctaaccagggccagaatgctcctgttcatagactgttatcacggcaagggtccatctgcagaaagaatccgaaaaaagctgcaaaatgctgtgacaatcttcgtcgccaacactccctgggatag

SEQ ID NO: 25004 - DNA, 999 bp, Artificial Sequence
  Description of Artificial Sequence: Synthetic coding sequence
atggccaccatcaagagcgagctgatcaagaacttcgccgaggaggaggctatccaccacaataaaatcagcattgtcggcacaggctccgtgggagtcgcatgcgcgatcagtatattgctgaaagggctgtctgatgagctggtactggtggacgtggacgaaggcaagctgaaaggagagacaatggacctccaacatggtagtccttttatgaaaatgcctaacattgtctcttctaaggattaccttgtcaccgcaaacagcaacctcgtcattatcacagccggcgcaaggcagaaaaagggcgaaacgcgactagacctggtgcagcgcaatgtgtcgatcttcaagctcatgattccaaacattactcagtactcaccccattgtaagttattgatcgtgacaaacccagtcgacatcctcacctacgtagcatggaaacttagtggctttcctaaaaacagagtgattggatctgggtgtaacttggacagtgccagattcaggtacttcattggacaacggttgggaatccattctgaatcctgtcacgggcttatcctcggggagcacggggatagtagcgtaccggtgtggtctggcgtcaacatagctggcgttccactgaaagaccttaatcccgacattggcaccgacaaagatcctgagcaatgggagaatgtacataagaaagtcatttcgtccggctacgaaatggtgaagatgaagggatatacatcatggggcatcagcttgtccgtagctgaccttaccgagtctatcctgaaaaacttacggcgggtgcaccctgtgtctacactgagtaaaggcctgtacggcattaatgaagatatctttctgagcgtcccttgtattcttggagaaaatggcatcacagatctaataaaggttaaactgactctcgaggaagaagcatgtctccaaaaatccgcagagacactgtgggaaattcaaaaggagctgaagctgtag

SEQ ID NO: 25005 - DNA, 888 bp, Artificial Sequence
  Description of Artificial Sequence: Synthetic coding sequence
atgatggccaagaagccccccaagcccgccccccggcggatcttccaggagcggctgaagattactgccctcccattgtactttgaggggttcctgctcattaagcgctcaggctacagggaatatgaacactattggacagagcttcgaggtactacactcttcttctataccgacaaaaagagtattatatacgtagacaaattagacatcgtggacctcacttgtctgaccgaacaaaattccacggaaaagaactgtgctaagtttaccctggtactgcctaaagaagaagtgcagctcaagaccgagaatacagaatccggcgaggaatggcgaggcttcatcctaactgttacagagctgagcgtgcctcagaacgtgtccctgttaccgggccaggtgatcaagctgcatgaggtcctggaaagagagaaaaaacgacgaatagaaaccgagcaaagtacctctgtcgaaaaggaaaaagagcccaccgaggactacgttgacgtcctaaacccgatgcctgcatgtttctataccgtgtctcgtaaagaagctacagaaatgttgcagaaaaatccttccctgggcaatatgatcttgaggcccggatccgacagtcgcaattatagtattaccatccggcaggaaatagacattcctaggattaaacactataaggtaatgtccgtgggccagaactatactattgagctcgagaagcccgtgacgctgccaaacctgttcagtgtgatcgactacttcgtgaaggaaactcggggcaacctgaggcccttcatctgctcaacggatgaaaatactgggcaggagccgtccatggagggacgctccgaaaagttaaagaaaaatccccatatagcgtag

SEQ ID NO: 25006 - DNA, 1368 bp, Artificial Sequence
  Description of Artificial Sequence: Synthetic coding sequence
atggagggcgtgctgtacaagtggaccaactacctgagcggctggcagcctaggtggttcctactctgtggcggaattctgtcctactatgacagccctgaggatgcttggaaggggtgcaaaggtagtattcaaatggccgtgtgtgaaatccaggtgcacagtgtggacaacacccgcatggatctgattattcccggagaacagtatttctatctgaaggctcggagcgtcgccgaaaggcagcgttggttagttgcgttaggaagcgcaaaggcatgccttacagatagccgaacccaaaaggagaaggagtttgctgaaaacaccgaaaacttgaagactaagatgagtgagttgcgtctctattgcgacctgttggtgcagcaagtagacaagactaaagaagtgactactacaggcgtgtcgaactcagaagagggcattgatgtcggcacgctcctgaagtccacctgtaacacctttctcaagactctggaagaatgtatgcaaattgctaacgccgcattcacatccgagctcctgtataggactcctcctggatctccgcagttggccatgctgaaatcatcaaaaatgaagcacccaatcatccccatccataactctctcgagcgtcagatggagctgagtacctgcgaaaacggtagccttaatatggaaatcaatggtgaggaggagatcctcatgaaaaacaagaacagtttgtatctgaaatcagccgagatcgactgcagcataagcagcgaggagaataccgacgataacataaccgtgcagggcgaaattcgcaaggaggatgggatggagaacctcaagaaccacgataacaatctaacccagtccggatccgattcttcttgttctcctgagtgcctgtgggaagaagggaaggaggtgatccctactttcttcagcacgatgaacacttctttctcagacatcgaacttctcgaagactccggcatacctacagaggcttttctggcctcttgttacgccgtggtccccgtactggataaattaggtccaacagtgttcgcaccagtgaagatggatctcgtgggcaacattaagaaagtcaatcaaaaatatataaccaataaggaagagttcactacgctccagaaaatagtgctgcacgaggtagaggcagacgtcgcccaggtgcgaaattcggcaactgaagcattgctgtggttgaaacgcggactaaagtttctcaagggtttcctgacagaagttaagaacggcgagaaggacatccagactgcccttaacaacgcctacggtaaaactttacgccagcaccacggttgggtggtccgcggcgtgttcgccgtttag

SEQ ID NO: 25007 - DNA, 1320 bp, Artificial Sequence
  Description of Artificial Sequence: Synthetic coding sequence
atggagggcgtgctgtacaagtggaccaactacctgagcggctggcagccccgctggtttctactgtgcggaggaattctgagctactacgactctccagaagatgcctggaaaggctgcaaagggtccatccaaatggctgtttgtgaaatccaggtgcacagtgtggacaatactcgcatggacctgatcatccctggagagcaatatttttacctgaaggctcggagtgtggctgaacgccaaagatggcttgtcgccctgggtagcgccaaggcatgtctcaccgattccaggacccagaaagaaaaggagttcgctgaaaatacagagaacctgaaaactaagatgtctgaacttaggctatactgtgatcttctggtgcagcaggtcgataagacaaaagaggttaccacaaccggggtgtccaactcagaggaaggcattgatgtgggaactttgctaaagagcacatgtaacacatttctgaaaacgttagaagagtgtatgcagattgccaacgctgctttcacatcggaacttctctaccgtacgcctcctgggtcacctcaactcgctatgttgaaaagcagtaagatgaaacaccccattatccccatccataatagcctcgaacgccagatggaattatcaacgtgcgagaatgggtctctgaatatggaaataaacggcgaagaggagatactaatgaagaataagaacagcttgtatctgaagtctgccgagattgattgtagtatatcaagcgaggagaacaccgacgacaacatcactgtgcagggtgagattagaaaggaagatggtatggaaaatctcaagaaccatgataataatctcacccagtccggaagtgactcttcttgtagccctgaatgcttgtgggaagaagggaaagaagttatcccgacatttttttccactatgaatacaagtttttccgacattgagctcctggaggacagtggtatacccactgaggccttcctggcatcttgctacgccgtagttccggtgctcgataaactggggcccactgtctttgcccctgtcaaaatggatctagtcggaaacattaagaaggttaatcaaaaatatatcaccaataaagaagagtttactactctgcagaagattgtgctgcacgaagtcgaggccgatgttgcccaggtgcggaacagtgccaccgaggcactgctttggttgaaacgaggcctcaagttcctcaaggggtttctcaccgaagttaagaatggggagaaggatatacagacagctctatcggtcggcatgtgggtgtag

SEQ ID NO: 25008 - DNA, 984 bp, Artificial Sequence
  Description of Artificial Sequence: Synthetic coding sequence
atgtgcagcaccagcggctgcgacctggaggagatccccctggacgacgacgacctgaacaccatcgaattcaagatactggcttactacacgcgtcatcacgtgtttaagagtacaccagcactcttctctcccaaactgctgagaactaggtccctttcccagcgtggcttgggcaattgctccgccaacgaatcctggaccgaggtgtcatggccttgcagaaacagtcagtcctcagaaaaggctatcaacttgggaaagaagaaaagcagctggaaagcattcttcggcgtagttgagaaggaagattctcagagcacaccagcgaaagtctctgcgcaggggcagcgcacactggagtaccaggactctcactcccagcagtggagcaggtgtctctccaatgtggaacagtgcctggagcatgaagctgtcgatccaaaggtgatcagcatcgctaacagagttgccgagatcgtttacagttggcccccaccacaggccacccaggccggaggcttcaagagtaaggagatcttcgtcactgaagggctgtccttccaacttcaaggccatgtccccgtggccagttcatctaagaaggatgaagaagagcagatcttggccaagatcgtcgaactactgaagtactccggggaccaactggaaagaaagctgaagaaggataaagccctgatggggcacttccaggatggcctctcttattctgtgttcaaaacaatcactgatcaggtcctgatgggtgtcgatccaaggggcgagagcgaagttaaagcgcagggtttcaaggctgctcttgtgatcgatgtgaccgccaaactcacagccattgacaaccaccctatgaatcgggtgctcggctttggcaccaagtatcttaaagagaatttttccccatggatccagcaacacggcgggtgggagaagatcctcgggatctcacatgaagaggttgactag

SEQ ID NO: 25009 - DNA, 5229 bp, Artificial Sequence
  Description of Artificial Sequence: Synthetic coding sequence
atgatggagggcaacggcaccgagaacagctgcagccggacccggggctggctacagcaggacaacgacgcaaagccttggctgtggaaattctcaaactgctttagccggcccgagcagacacttccccattctcctcagactaaggaatatatggaaaataaaaaggtggctgtggagctcaaagatgtcccgagccccttacatgcgggcagcaagctgttcccagcagtccccctcccagacatccgttccctccagcagcctaaaatacagctgtctagcgtgcctaaggtgagttgttgcgcccactgtcctaacgagccctcgacaagccctatgcgctttggaggagggggtggagggtctggggggacatcaagcctgatccaccccggcgcactactcgattctcagagtaccaggacgatcacctgccaggtcgggagtggatttgcgtttcagagtgcaagcagcctgcagaatgcgtctgctagaaacaacctggctgggattgcctctgactttccctccatgtgcctcgagtctaaccttagttcctgtaaacatctgccttgctgtggcaagctgcatttccaaagttgtcatgggaatgttcataaattgcaccaatttcccagcctccaagggtgtacttcagccggttacttcccgtgttccgatttcaccagcggcgctcctggccatcttgaagagcatatctctcagtccgagctgactcctcatctttgcactaacagcctgcatttgaatgtggtgcctcctgtgtgcttgaaaggttctctctattgcgaggattgcctgaacaagccagccagaaactccatcatagatgcagccaaggtctggccaaacataccccccccaaacacccagccagctccattggccgtcccactgtgtaatggttgcggcaccaagggtaccggaaaagagactaccctgttgcttgccacctccctcggcaaggctgcttcgaagttcggaagtcctgaggtcgcagtggccgggcaagtactcgagaatctgcccccaatcggcgtgttctgggacatagagaactgtagcgtccctagtggcaggagcgccacagctgtggttcagcggatcagagaaaagtttttcaaagggcatcgagaggccgagttcatctgcgtctgtgatatatctaaggagaacaaggaggtcatccaggaactgaacaattgtcaggtaactgtagcgcacattaacgcaactgctaagaatgcagccgatgacaagctccggcagtcactgcggaggttcgctaatacacacaccgcgcctgccactgttgttctcgtgagtactgatgttaactttgccctggagctcagcgacctaagacacaggcatggcttccatatcatcctcgtgcataaaaatcaggctagcgaggctcttctgcatcacgctaatgaattaattcgctttgaggagttcatttctgacctgcctcccagactgccattgaagatgccacagtgccacacccttctgtacgtttataatttacctgccaataaagacggaaagtccgtgtccaacagactgagacgcctatcagataactgtgggggcaaggtcctgtccatcacggggtgtagtgccatcttacggtttattaatcaggattccgctgaaagagcccagaaacgcatggaaaatgaggacgtgttcggcaaccgcattatagtcagcttcacccctaaaaaccgcgaactgtgtgaaacgaagtctagcaacgctatagcagacaaagtaaagagccccaagaaacttaaaaatcctaaactgtgtttgatcaaagacgcctctgaacagagctcctccgccaaggccactcccggaaaggggtctcaggccaactccgggtctgcgaccaagaataccaacgtaaaatctctgcaggagttgtgcagaatggaaagtaagaccgggcaccggaactcagaacatcaacagggtcatttacgtctggtagtgccaactcatggaaattctagtgctgctgttagtacaccgaaaaactcaggagtagccgagccggtctataagacctcacaaaagaaggagaatctttcagcacgcagtgtaactagctctccagtggagaagaaagacaaagaagagacagtcttccaggtctcgtatccaagtgccttctccaagctagtggcctcccgacaagtcagcccgttactggcctcacagagctggagtagtcgttccatgagccctaacctcttaaatcgcgccagtccccttgcctttaatatcgctaattccagttccgaggccgactgtcctgatcctttcgctaatggagcggacgttcaggtcagcaacattgactatcgtctttccaggaaagagcttcagcagctcctgcaggaggccttcgcccggcatgggaaggtcaagtccgtcgaactgtcccctcacaccgactaccaactgaaggctgtggtacagatggagaacttacaggacgccattggggccgttaactctttacaccgttacaagatcggtagcaaaaagatactagttagtctcgccaccggagccgcctcaaagagcttaagcttactctcggcagagactatgtctgtactgcaggacgctccggcctgctgtctgccactgtttaagttcacggatatttacgagaagaagtttggtcataaattgaatgtcagtgacctgtacaagctgactgacaccgtcgcaatcagggaacaaggaaacgggcgtctggtgtgcctcctgccaagctctcaggcccggcagtctccactgggatcctcgcaatcccacgatgggtcatccacaaactgttccccaattatttttgaggaactggaataccatgagccagtgtgccgacagcactgttccaacaaagatttctccgagcatgagttcgatcccgattcctataaaatccctttcgtaatcctgagcctcaaaactttcgcaccacaggtgcactcattattgcagacccacgagggcacagtgccactgcttagctttcccgactgctacattgctgaattcggggacctcgaagttgtccaggagaaccagggcggcgtgccactggagcatttcatcacatgcgtaccaggggtcaacatagcgacagctcagaacggcatcaaggtcgtgaagtggatacacaacaaaccaccacctccaaataccgacccctggctgctccggagcaaatccccagtgggcaatccccagctcatccagtttagccgggaggtaatagacttactgaagtcacagcccagctgtgtgattcccatttctcacttcatcccaagctaccaccatcatttcgctaaacagtgtcgagtttcagattacggctactcaaagttaatagagctgctggaagcagtgccacacgtcctccagatcctggggatgggctctaagaggctgttgacactgacgcatcgggctcaggtcaagcggttcactcaggatctattaaaactcttgaaatcgcaggccagcaagcaggtgattgtccgggaattttcacaggcctatcattggtgtttttctaaggactgggatgtcaccgagtacggggtttgtgaattgattgatatagtgagtgagatcccagatacaactatctgcttgagtcagcaagataacgaaatggtgatctgcatcccaaagcgtgaacggacacaagacgagattgagaggacaaaacagtttagcaaggatgttgtggaccttctccgccaccaacctcattttaggatgccttttaacaaatttatcccttcataccaccaccatttcgggcgccagtgcaagctggcctattatggcttcacgaaattgttggagctgttcgaagcaatcccggacactttgcaggtgctcgaatgtggggaggagaaaatcctgacccttacggaggtagagagatttaaggctctggccgctcagttcgtgaagctgctcaggtcacaaaaagataactgcctgatgatgacggacctgctaaccgagtatgccaagacttttggttacacttttcgtctacaagattatgacgtgagcagcatctccgccctcacccagaagctttgtcacgttgttaaggtggccgacattgagtcgggtcgacagattcaacttatcaatcggaaaagtctgcgctcgctgaccgcacagcttctggtgctgcttatgagctgggaggggacgactcacctgtccgtggaagagttgaagaggcactacgagtctacccacaacacccccctgaacccttgtgagtacggcttcatgaccctgaccgaactgttgaaaagcctgccgtatctcgtggaggtgttcaccaacgacaagatggaagagtgtgtcaaactgacttcactgtatctgtttgctaagaacgtgcggtctctcttgcatacttatcactaccaacaaatattcctccatgagttctccatggcgtacacgaaatacgtgggtgaaacactgcagccgaagacctacggccactcaagcgtggaagagctcttaggcgccatcccacaggtggtctggattaagggtcacgggcacaaacgtatcgtggttctaaaaaatgacatgaaatccaggctttcttcactcagcctctctcctgctaaccatgaaaaccagccatccgagggtgaacggattttggaagtgccagaatcacacactgccagcgagctgaagctcggggcggacgggagcgggccttctcacactgaacaggagctgctgcggctcacagacgatagtccggtagacctgttgtgcgccccagtaccatcttgcctgcccagcccccagctgcgtcccgatcctgtcatcctacagtctgcagatcttatccaattcgaggaaagacctcaagaaccctccgagatcatgattctgaatcaggaggagaagatggagattccaatccctggtaaatctaagactctgacctccgatagtagctcatcatgcatctccgctgctgtgccagtacccccctgcccgagttccgagacctcagagtcccttctcagtaaagacccggtggagtcccctgctaaaaagcagcctaaaaacagggttaaattggccgccaacttttcattagcccccatcacaaaactgtag

SEQ ID NO: 25010 - DNA, 831 bp, Artificial Sequence
  Description of Artificial Sequence: Synthetic coding sequence
atgtgcagcaccagcggctgcgacctggaggagatccccctggacgatgatgacctgaacacaatcgagttcaagatccttgcctactatactcgccaccatgtgtttaaaagtacgcccgcgctcttcagtcccaagctgctgaggactcgaagtctgtctcagagaggcctgggaaactgtagcgcgaatgaatcctggacagaagtgtcttggccttgccgcaattcacagagctcggaaaaagctataaatttgggcaaaaaaaaatccagttggaaggcgttcttcggtgtggtcgagaaggaggatagccagtctacccctgccaaagtatctgcccagggtcagcgtaccctagagtaccaagattcccattcacaacagtggtcccgctgtctgtcgaacgttgaacagtgcctggaacatgaagcagtggatccgaaagttatctcgattgccaaccgcgtcgccgaaatagtgtactcttggcccccgccgcaagccactcaggctggcgggtttaaaagtaaagagatttttgtgactgaagggcttagtttccagctgcaagggcatgtcccagtcgcttccagttccaaaaaggatgaggaagaacaaatccttgctaaaatcgttgaactattgaagtatagtggagatcagctagaacgcaaggaaaaggagtgggaggagagcgccaagaccaagatcaaaatggccttgctgtggagatcttctgggggggggcctcgggtgctgagtattcccgaggcctttatgaagaattccttcacactgacaccaccaggattttcggaacacaactag

SEQ ID NO: 25011 - DNA, 552 bp, Artificial Sequence
  Description of Artificial Sequence: Synthetic coding sequence
atggccagcaacaagaccaccctgcagaagatgggcaagaagcagaacggcaaaagcaagaaggtggaagaagccgaacccgaagaatttgtggtagagaaggtgcttgaccggcgggtggtgaatggaaaagtagaatacttcttgaaatggaaagggttcaccgatgccgataacacttgggaacccgaagagaacctggactgtccagaactgatcgaagcatttctcaattcgcagaaggccggtaaagaaaaggacggtacaaagcgtaagagtctgtctgactcagaatctgacgattctaaaagtaagaagaaaagggacgccgctgataagcctcgcggatttgctagaggcttagatccagagagaatcattggggcaactgacagctcaggagagctcatgtttctgatgaagtggaaggatagcgatgaggctgatctcgtgctagccaaagaggccaacatgaagtgccctcagatcgtcatcgccttttatgaggagcggttgacttggcactcatgccctgaagatgaggcccagtag

SEQ ID NO: 25012 - DNA, 960 bp, Artificial Sequence
  Description of Artificial Sequence: Synthetic coding sequence
atgctgcggtgcggccagatgatcttcgcccaggccctggtgtgccgccacctcggccgcgactggagatggacacagcgtaagaggcaaccagatagctactttagcgtgctgaacgcattcatcgatcgaaaagactcatattatagcatccatcagatcgcacaaatgggagtgggggaagggaaaagcattggtcagtggtatggcccaaacacagtagcacaggtacttaaaaaacttgcggtgttcgatacttggtcttctctagccgtgcacatagccatggataacaccgtcgttatggaggaaataagaagactgtgcagaacaagtgtgccatgcgcaggggcgaccgctttccccgccgactcagatcgccattgtaacgggtttccagctggggcagaggtgaccaatagaccttctccctggaggcctctggtgctgctcatacctctgcgccttgggctgacagatattaacgaggcctacgtggaaactctcaagcactgctttatgatgccccagtctctgggtgtgattggaggtaagcccaactccgcccactatttcattgggtacgtcggcgaagaactgatttatctggacccacataccacccagccggcagtagagccaactgatgggtgtttcatccctgacgaaagctttcactgtcagcaccctccctgccgaatgagtattgccgagctggatcccagcatcgctgtgggctttttctgcaaaaccgaagatgacttcaatgattggtgtcagcaggtaaagaagttatcccttctgggaggagctctgccaatgtttgaactcgtagagttacaaccatctcacctcgcttgtccagacgtactgaacttgagcctggactccagcgatgtggagaggctcgagcgctttttcgatagcgaggatgaggactttgagatcctatccttgtag

SEQ ID NO: 25013 - DNA, 564 bp, Artificial Sequence
  Description of Artificial Sequence: Synthetic coding sequence
atgaacggccgggccgacttccgggagcccaacgccgaggtgccccgcccaattccccatatcggcccagactatatcccgacagaagaggaacgccgcgtattcgcggagtgtaacgacgagtccttctggtttcgctcagtgcctctggccgccacaagcatgcttatcacccaggggcttattagtaagggaattctttcctcacaccctaaatatggatcgattccaaagctgatcttggcctgtatcatgggttatttcgctggtaaactgtcatatgtaaagacttgtcaggaaaaatttaagaaactggaaaacagccctctaggtgaggccttgcgcagcggccaggcaagacgtagttcaccgcccggacactactatcagaaatccaaatacgactcttccgtctcaggacaatcaagtttcgtgacatcaccagccgcagacaatatcgaaatgctgccgcactatgaacctatccctttctcaagctccatgaacgaatcagctccgaccggtattaccgaccacatcgtgcaagggcgcaacttcagttag

SEQ ID NO: 25014 - DNA, 270 bp, Artificial Sequence
  Description of Artificial Sequence: Synthetic coding sequence
atgagcgagcagggcgacctgaaccaggccatcgccgaggagggcggtactgaacaagagactgccacacccgaaaacggaatcgttaaatctgaatccctcgacgaagaagaaaagttagaactccagagacggctggaagcacagaaccaagagcgcagaaagagcaagtccggcgccggcaaaggcaagctgaccaggagccttgccgtctgtgaagaaagcagcgccaggccaggcggtgaaagcctgcaggatcagacactttag

SEQ ID NO: 25015 - DNA, 270 bp, Artificial Sequence
  Description of Artificial Sequence: Synthetic coding sequence
atgagcgagcagggcgacctgaaccaggccatcgccgaggagggcggtacagagcaggagactgctaccccagagaacggaatcgttaagtctgaatcactggacgaggaagagaagctggagctccagaggcgactcgaggcccagaatcaggaaagacgtaaatcaaaaagcggagccggcaaaggcaagttgacccggtccctggcagtctgcgaggaaagttctgcaaggcctggaggggagagcctccaagaccaaaccttatag

SEQ ID NO: 25016 - DNA, 1473 bp, Artificial Sequence
  Description of Artificial Sequence: Synthetic coding sequence
atggaggacagcgccagcgccagcctgagcagcgccgccgccaccggtactagtacgagtacaccagcggctccaacagcccgcaagcaactcgataaggaacaggtccgcaaagcggttgacgccctcctgacccactgtaagtctcggaagaataactatggtctgttgctcaatgagaatgagtcactcttcctgatggtggtattgtggaagattcctagtaaagagttgcgcgtgaggctcacattgcctcacagtattaggagtgatagcgaggatatatgcctgttcactaaggacgaacccaattccactcctgagaaaacagagcagttctaccgcaagctgctgaacaaacatgggattaagacagtttctcaaatcatttcgctccagactttaaagaaggaatataaaagttacgaggcaaagttgcgcctgctgtcaagtttcgatttctttctgactgatgccaggatcagacggttgttgccctctttgatcggccggcacttctatcagaggaaaaaggtcccggtgtcggttaacctgctcagcaagaaccttagccgcgaaatcaatgactgcattggcggaacggtgctgaatatcagcaagagcgggtcttgcagtgctatcaggataggacatgttggaatgcagattgagcacataatagaaaacattgtggctgtgactaaggggctatctgagaaactaccagagaagtgggagtcagtgaagctgttatttgtcaagaccgagaaatcagctgcccttcctatattctcatccttcgtgtccaattgggatgaagccacaaagcggtccctcttgaataagaagaagaaggaggcccgtaggaagagaagagaacgaaattttgaaaaacaaaaagaacgaaaaaaaaaacgacagcaggccagaaagacggcgagtgtgttatctaaagatgacgtggctcctgagtctggggacactacagtgaaaaagcccgaatctaagaaagagcagactcccgaacacggaaaaaagaagcgcggccgcggcaaagcacaggtgaaggcgacaaacgaatccgaggacgagataccacagctggttcccattggcaagaagacccccgcgaatgagaaagtcgagatccagaagcatgctacaggcaagaaatctcccgccaagagtcctaaccctagtacccccagggggaagaagcgaaaggcacttcccgcttccgagacacccaaggctgcagagagcgagacgccaggaaagagccctgaaaagaagcctaagatcaaggaagaagctgtgaaagagaagtcaccctctcttggtaaaaaggacgctcggcaaaccccaaaaaaacccgaagctaaattctttactacgccttcaaagtccgtgcgcaaggcctcccatacccccaaaaagtggccgaagaagcctaaggttccccagagcacttag

SEQ ID NO: 25017 - DNA, 495 bp, Artificial Sequence
  Description of Artificial Sequence: Synthetic coding sequence
atggccgagcccgccagcgtggccgccgagagcctggccggcagcagagcccgcgccgctagaacagtgttgggtcaggtggttctgccaggagaagagttattactgccagagcaggaggacgctgaaggtccaggtggcgccgtggaaaggcctctcagccttaatgctagagcgtgctctagagtgcgggttgtgtgtggacctgggctgcgccggtgtggagatagactgctggtgacaaaatgcggcagactgcggcacaaagagcctggtagcgggagtgggggcggtgtttactgggtcgactcccaacaaaagagatatgtgcctgtaaaaggcgatcatgtgattgggatcgtgacagctaaatccggagatattttcaaggtagatgtgggcgggagtgagccagcctctctttcctatctgtctttcgagggagcaacgaagcgaaatcggcccaatgtccaggcgatatcttcacgactttag

SEQ ID NO: 25018 - DNA, 2508 bp, Artificial Sequence
  Description of Artificial Sequence: Synthetic coding sequence
atgacctgcaacaagcacggctgccggcaggccttccacgtgacctgcgcgcagtttgccgggctgttatgtgaagaagagggtaatggggcagataacgtgcaatactgtggctattgcaagtatcatttttccaagctcaagaagtccaaacgaggtagcaatcgcagttatgaccaatccctgtcggacagtagctcacattcacaagataagcaccacgagaaagaaaaaaagaaatacaaagaaaaagacaaacataaacagaaacacaagaaacagccagaaccttcaccggccttagtgccgtctctcactgtaaccaccgaaaagacttacactagcacgtccaacaacagcattagtggctcccttaagagactcgaggacacaacagctcgatttaccaatgctaacttccaagaagtgtctgcccacactagtagcggcaaagatgtgtctgaaaccagaggaagcgaaggcaagggaaaaaagtcgtcggcgcatagtagcggccaaagggggagaaaaccaggcggtggccgtaatcctggaactacagttagcgccgcctcgcccttccctcaaggatcctttagcggaacccctggctctgtgaagtcttcatccggcagctctgtgcaatcaccacaggactttctatcctttaccgatagtgatcttagaaatgactcctattcccacagccaacaaagtagtgcaaccaaagacgtgcacaaaggggagagtggctcacaggaagggggagtgaatagtttcagcaccctgatcggcctgccttccacgtctgctgtcacttctcagccaaagagcttcgaaaactcccctggagacctcggaaactcaagcttgcccaccgccggctacaaacgggcccagaccagtggtatcgaggaggaaacagtcaaggaaaaaaaacgcaagggcaacaagcagtccaaacacgggccgggaagaccgaagggtaacaaaaaccaggagaacgtgagccatctcagcgtcagctcggcttcacctacttcttccgttgcaagtgcagccgggtccattactagcagctcgctgcagaagtcacctacactgctcaggaatggcagcttacagtcactgtccgtgggctccagcccagtcgggtctgaaatcagtatgcagtatcgtcacgatggggcgtgcccgacaaccagtatctacaattctaatgacgtcgctgtgtcatttccaaacgtggtgagtggttccggctcctcgactcccgtgtcctcctctcacctgccccaacaatcctccggccatctacagcaagtgggggccctctcaccgtctgcagtaagtagcgctgctcccgccgtggccactacacaggcgaatacactgagcgggtcctccctctcccaagcgccaagccacatgtatggcaaccgctccaattcatcaatggcagccctcatcgctcagtccgagaacaatcagacagatcaggacctcggcgacaattccagaaatcttgtaggccggggctcgtctcctcgaggaagtcttagtcctcggtctcccgtatcttccctgcagattaggtatgatcagcccggcaactccagcctggagaatcttccccccgtagcagcctccatcgagcaactgttggaacgacagtggtcggaagggcagcaattccttctggagcagggcaccccaagcgacatcctcgggatgctgaagtctctgcaccagttacaagtggagaacaggcggttggaagaacagataaaaaacctgacggcgaagaaggaaagactccagcttctgaacgcacagctgagcgtgccctttcctactatcacagcgaatccttccccgtcccaccagatccacacattttccgcacagactgcccccacgacggactctctcaactcctcaaagtctccccacatcgggaattcctttctccccgacaattctcttcccgtcctgaatcaggatttaacttcctcgggacagagcacatcttccagctccgctctgtccactcctccacccgctggacagtcaccagcccagcaaggctctggggtctccggcgtgcagcaggttaacggggtcaccgtgggtgcgctcgccagcgggatgcaacccgtgacctctaccattccagccgtgagtgccgtggggggcattatcggcgcattaccggggaatcaattggcgatcaacgggattgtgggcgccctcaacggggtcatgcaaaccccagttactatgtcacaaaatccaacgcccctgacgcatacaaccgtgccgccaaatgccacacacccgatgcccgctacccttactaattctgcctccggtctcggtttactgagtgatcagcaacggcagattttaattcaccaacagcaatttcagcagcttctcaacagtcagcagctgactccaaatatggttaaagagttctctgctcaaattattgcctggaggccatag

SEQ ID NO: 25019 - DNA, 1620 bp, Artificial Sequence
  Description of Artificial Sequence: Synthetic coding sequence
atggccaccagcgcccccctgcggagcctggaggaggaggtgacctgttccatttgtctggactacttgagggaccccgtcaccatcgattgtgggcacgtattttgccgatcgtgtactacagatgtccgtccgatttcagggtcgcgtccagtgtgccctctttgcaagaagccgttcaagaaagagaatatccggccagtgtggcagctcgcttcactagtagagaatatcgaacgcctgaaagttgataagggacgccagcccggtgaggtgacacgcgagcaacaggacgcaaagttatgcgagaggcacagggagaaattacattattactgcgaagacgatggcaaactcttgtgtgtgatgtgtagggagtctagagaacacagaccacatactgccgttctgatggaaaaagccgctcagccacaccgtgagaagatcctcaatcacttgtcaaccctccggcgtgaccgcgacaaaatacagggcttccaggcgaagggcgaagcagatattctggctgctttaaagaagctccaggatcagagacagtacatcgtggctgaatttgagcaggggcaccaattcctgagagagagggaagaacatctcctggaacagctggccaaactcgagcaggaattaacagagggacgagagaaattcaagtcacggggggtaggggagttggctcggctggctctagttattagtgagttagagggcaaagcccagcagccggcagcggagctgatgcaagatacaagggacttcctgaaccgatatcccagaaaaaagttttgggtcggtaaacctattgctcgcgtggtaaagaaaaagactggtgaattctcggacaaactgctgagcttgcagagaggcctgagagagttccagggaaaattgctcagggatctggaatacaaaaccgtcagcgtcacattggatccccagtccgcatccgggtatctccagctctcagaggactggaaatgcgtgacttatactagcttatacaagtcagcatacctccatccccagcaattcgactgtgagccgggagtgctgggctccaagggatttacatggggcaaagtgtactgggaagttgaggttgagcgtgaggggtggagcgaggacgaagaagagggggatgaagaggaggagggcgaggaagaagaagaagaagaagaggcgggctatggagatgggtacgatgattgggaaaccgacgaggacgaggaaagtctgggagacgaggaggaagaagaggaggaagaggaggaggaggtgttagagtcctgtatggtcggggtggcccgcgactctgttaaaaggaagggggatctgagcctgcggcctgaagatggtgtgtgggctctgcggctgtctagctctggtatatgggccaatacgtcgcccgaggctgaactgttccccgcccttcgacccagaagagtcggcatcgcgttggactacgagggcggtactgtgactttcaccaacgcagaaagccaggaactaatttatacattcacagccacctttactcgccgcttggttcctttcctctggctaaagtggccagggacaaggctgctgttacggccctag

SEQ ID NO: 25020 - DNA, 444 bp, Artificial Sequence
  Description of Artificial Sequence: Synthetic coding sequence
atgagcagcgagccccccccccccccccagccccccacccaccaggctagcgtaggtttgcttgatacacctaggagcagagaaaggtcaccttctcccctcagaggaaatgtggtaccctcacctcttccgacgcgccgaactcgtacattctccgctaccgtgagggcctcacagggcccagtctataagggagtttgcaagtgtttctgcagatccaagggacatgggttcatcacgcccgctgacgggggacccgacatcttcctgcacatctcagacgtggaaggcgagtatgttcctgtcgaaggtgatgaggtgacttacaaaatgtgtagtatacccccaaagaatgagaagctccaagcggtggaagtggtgatcacacacttggctcccggcactaagcacgaaacttggtccgggcacgtgatatcttcttag

SEQ ID NO: 25021 - DNA, 951 bp, Artificial Sequence
  Description of Artificial Sequence: Synthetic coding sequence
atgacccccagcgagggcgcccgggccggcaccggccgggagctggaaatgcttgacagcttactggccttgggcggtctggtccttttacgcgacagtgtagaatgggagggaagatcgcttctgaaggccctcgtcaagaagtcagccttatgcggcgagcaagtccacattctggggtgtgaggtgtccgaagaggaattccgagaaggatttgattctgacataaacaaccgcttggtctaccacgatttctttcgcgatcctttaaattggtccaagactgaagaggcatttccgggtggccctcttggtgctctgcgtgccatgtgtaaaagaaccgatccggtgccagtgactatcgccctcgactcccttagttggcttctgctgcgcctgccctgtaccactttatgccaggtgttacatgcggtgtctcaccaggactcatgccccggggactccagcagcgtaggtaaagtgtcagtccttggtctgctacacgaagagctgcacggacccggcccagtgggcgccctctcatcgctcgctcagacagaggtcacacttggtgggacaatgggccaggcctcagcacacatcctctgccgtaggcccagacagcgccctactgatcaaacgcagtggttctccatccttcccgatttctccctggacctgcaggagggcccgtcagtggagtcccagccatatagtgaccctcacattccgcctgtggacccgacaacacacctgaccttcaatctccacctgtcaaaaaaggagcgcgaagctagggattctctgatactaccttttcagttctcttcagagaaacagcaggcgctcttacgaccgaggccagggcaggctacctcccacatattctacgagcccgacgcctacgatgaccttgatcaagaagatcccgacgatgacctggacatatag

SEQ ID NO: 25022 - DNA, 951 bp, Artificial Sequence
  Description of Artificial Sequence: Synthetic coding sequence
atgacccccagcgagggcgcccgggccggcaccggccgggagctggagatgctcgattcccttctcgcattggggggtttggtgctgctcagggatagcgttgagtgggagggcaggtcactcctgaaagccttagttaagaagtctgccctatgtggagaacaggtgcatatcctgggttgtgaagtgtctgaggaggaatttcgcgaaggcttcgacagcgacatcaacaatcggctggtgtaccatgacttcttccgggaccccttgaactggtccaagacagaagaagcattcccaggcggacctcttggagcgttacgggccatgtgtaaaagaacagaccctgttcctgtgactatcgctctggactctctgtcctggctgttactgagactcccatgcaccaccctttgccaggtcttacatgccgtatcacatcaggatagttgtcccggcgattccagctcggttggtaaggtttccgtgctcggtctcctgcatgaggaactccatggccctggcccggtcggtgcactgtcaagcctcgcccagacggaggtcacactgggaggcaccatgggccaagccagcgctcacatcctgtgccggcggccccgtcagaggcccacagaccagactcagtggttttcaatcctccccgatttctcacttgatctccaggaggggccttcagtggagtcacaaccatattctgatccccacatccctcctgtggaccccaccacccaccttacctttaacctccacctttctaagaaggaaagagaagcaagggacagcctgattctgccattccaatttagctccgaaaaacagcaggctcttttgcgcccaagaccaggccaggctaccagtcacatcttttatgaacccgatgcctacgacgacctcgaccaggaggaccctgacgatgacctcgacatctag

SEQ ID NO: 25023 - DNA, 810 bp, Artificial Sequence
  Description of Artificial Sequence: Synthetic coding sequence
atgaaccaggaggacctggaccccgacagcaccaccgacgtgggcgatgtgaccaacacagaggaggagctgatcagagaatgcgaggagatgtggaaagacatggaagaatgtcagaataaactttccttgatcggtactgagactctgacagacagcaatgctcagctctccctgttgattatgcaggtgaaatgtcttactgctgaactcagccagtggcagaaaaaaactccagaaacaatcccactcacagaggacgtcctcatcacactgggcaaggaagagtttcagaagctgcgtcaagacctagaaatggtgttaagcactaaggaaagtaagaatgagaagctcaaagaagatcttgagagagaacagagatggctagacgaacaacagcaaattatggagagcctaaacgtattgcatagtgaactgaagaacaaagtggagaccttcagcgagagtcgaatctttaatgagttgaagacaaaaatgctgaatatcaaagagtacaaggagaagctcttatctacacttggcgagttcctggaggatcatttcccgctgccggacaggtccgtgaagaaaaaaaaaaagaatatccaggagtcctcagtgaacctgataactctgcacgagatgctcgaaattctcattaacaggttatttgatgtgccacacgatccatatgttaaaatttccgacagcttctggccaccctacgtcgagcttctcttgcggaacgggatcgcacttcggcaccctgaggatcccaccaggatcaggctcgaggccttccaccagtag

SEQ ID NO: 25024 - DNA, 1173 bp, Artificial Sequence
  Description of Artificial Sequence: Synthetic coding sequence
atggccaccggcgacctgaagcggagcctgcggaacctggagcaggtcctgaggctgctgaattaccctgaggaggtggattgtgttgggctgattaagggagatcccgcagctagtctgcctatcatcagctattcatttacgtcctattccccgtacgtgacagagttgattatggaatccaacgtggagttaatcgctaagaacgacctacggttcatagacgcagtgtataagctcctaagggaccagtttaactataagccgatactgaccaaaaaacagttcatccagtgtggcttcgctgaatggaagattcaaatcgtgtgcgacattctgaattgtgtgatgaaaaaacacaaggaactttcttcccttcaaaaaattccgagccagcagcggaagaagatcagcagcgggaaaagcgagccaccgctcggaaacgagaagatctccgccgaagctgttggggtcgatatctccggaagattcatgacctcagggaaaaagaaggcagtggtcatcagacacctttacaatgaggataacgttgacatctctgaagacaccctgtcaccgattacagatgttaatgaggctgtagatgtctccgacctgaacgccacagaaatcaagatgccagaggtgaaggttccagagattaaggccgaacaacaggacgtaaacgtgaacccagaaattaccgccctgcagacaatgcttgccgagtgccaagagaatttgaagaagctgactagcattgagaaacgtttagattgcctggagcagaagatgaaaggcaaggtcatggtcgacgagaacacttggacgaacctgctctcacgcgtcacactgttagagacagagatgcttctgtctaagaaaaatgacgagtttatagaattcaacgaagtgtccgaggattacgcttcatgtagcgacatggacctgctcaacccccaccgtaaaagtgaggtcgagaggccggcctccatccccctctcgtctgggtactcgacggcctcctcagatagtaccccaagggctagcacagtaaattattgtgggctaaacgagatttctgaggaaaccacgatccagaagatggaaagaatgaagaagatgttcgaggaaacggcagagttgttgaagtgcccaaaccactacctgtag

SEQ ID NO: 25025 - DNA, 381 bp, Artificial Sequence
  Description of Artificial Sequence: Synthetic coding sequence
atgcccttcttcggcaacaccttcagccccaagaagacccccccccggaaatccgctagtcttagtaatttacacagccttgaccgatctaccagagaggttgaactggggctcgagtacgggtctccaactatgaaccttgctggccagtccctgaagttcgagaacggtcagtggatcgcggaaaccggggtgagcggaggcgtcgacagacgtgaagtgcagaggttgagacggcggaaccaacaactggaggaggagaataatctcctgcgattgaaggtcgatatcctcttagatatgctctccgagagtaccgccgagagtcacctcatggagaaggaattggatgagctgagaatcagcagaaagcgcaaatag

SEQ ID NO: 25026 - DNA, 711 bp, Artificial Sequence
  Description of Artificial Sequence: Synthetic coding sequence
atgcaggtgcaggacgacggcgtgaacctgatccccttcgccaagtgttcccgggtcgtaagtcgctccccccctcccaggttgccttctcagagtctgaggcccatgcctcagagatacggtgacgtcttttggaaaaatctgaatcagcgccccacccctacgtggctggaagaacaacatataccgcccatgctccgagcaacaggctgcagccagttgggcttgtatccccctgaacagctgccccccccagagatgctatggcgacggaaaaaaagaagaccatgtctggaaggaatgcagcagcagggcttgggtggagtccctgcaagagtgagggctgtgacttatcatctggaagatctgaggcggagacaaagcatcatcaacgaactaaagaaggcccaatggggatctagtggcgccgcctctgaaccagtagtgctcggcgaggaagggtgcggattcccctctacgaacgagtacccggatctggaagaggagcgggccacctacccacaggaagaagatagattcctgacacctggtcgcgcccagttgctctggtcaccctggtctccactcgaccaggaggaggcatgtgcgagtcgtcagctccactctttggcctcctttagcaccgtgactgctcgcagaaatccgcttcataacccttggggcatggagctcgccgcatcggaggaatag

SEQ ID NO: 25027 - DNA, 1680 bp, Artificial Sequence
  Description of Artificial Sequence: Synthetic coding sequence
atgaaccccctgttcggccccaacctgttcctgctgcagcaggagcagcaggggctagctggccccctcggggatagtctggggggagaccattttgctgggggaggcgatctcccgcccgccccgcttagcccagctggcccagccgcttactctccccctggtccaggcccggcacccccggcagctatggccttgaggaatgacctgggttccaatatcaacgtgctgaagaccctcaacctacgttttaggtgcttcctggctaaggtgcatgaacttgagcggaggaatagactgttggagaaacaacttcagcaggcgctggaagaaggcaaacaggggcgtaggggtctgggccgccgagaccaggctgtccaaaccggttttgtttctcctatacgcccgctggggctgcagctgggtgctagaccagccgcggtctgcagtccttctgctcgcgtcttgggatctccggcccggtccccagcagggccactggcccccagtgcagctagcctatcttcgtcatcaacttccacaagcaccacttacagtagctctgctaggttcatgcctgggaccatttggtccttttcacacgctcgccgactgggaccagggctggaacccaccctggttcagggcccagggctgtcgtgggtgcaccccgacggagtgggagtccagatcgacactatcacgccagaaatacgggccttgtacaatgtccttgccaaggtgaagagggagcgtgacgaatataaacgaaggtgggaggaggaatacacagtccgtattcagctccaggaccgcgtcaacgagctgcaagaggaagcccaggaggcagacgcctgtcaggaggaattagccctgaaggtggagcaactgaaagctgagcttgtggtattcaagggcctgatgtccaacaacctgtccgaactggacacgaaaatccaagaaaaagctatgaaagtggacatggacatatgtcgccggattgatatcacggccaagctgtgcgatgtcgcacagcagagaaactgtgaggatatgattcagatgttccaagtgccctctatgggcggaaggaagagagagaggaaggcagccgtggaagaggatacatccttatcagagagtgaagggcctcgacagccggatggagatgaggaggaatccacggctcttagcattaacgaggagatgcagcgcatgctcaaccaactgcgagagtacgatttcgaagatgattgcgatagcttaacttgggaggagacagaagagacacttttactctgggaggacttctcagggtatgctatggctgcggcggaggctcagggggagcaggaagactcattagagaaagtaataaaagatacagaatctctgtttaaaactcgtgaaaaggagtaccaggagaccatcgatcagatcgagctggagctggctacggccaagaatgacatgaatcggcaccttcacgaatacatggagatgtgctcaatgaagcgcggacttgatgtacagatggagacgtgtaggcgattaatcacacagtccggcgacagaaaatcacccgcttttacagccgtaccgctatctgatcctcctcctccaccttctgaggccgaagactcggacagggacgtgtcaagtgatagctccatgagatag

SEQ ID NO: 25028 - DNA, 1182 bp, Artificial Sequence
  Description of Artificial Sequence: Synthetic coding sequence
atggccagcggccgggcccggtgcacccggaagctgcggaactgggtcgtcgaacaggtcgagagcggccaattcccgggagtttgttgggatgataccgcaaagacgatgttccgaattccgtggaagcacgctgggaaacaggactttcgggaagaccaggacgccgcgttctttaaagcatgggcaatttttaaaggaaaatacaaggaaggggacaccgggggccccgctgtgtggaagacgcgtctgaggtgtgcactgaacaagtctagcgagtttaaggaagttcctgaacgcggaaggatggacgtggccgagccctataaggtttatcagctgctgcccccaggaattgtgagtggccaacccggaacacagaaagtccccagcaaacgccagcactcgagcgtcagctctgagagaaaagaggaggaagacgccatgcaaaattgcacactcagcccgtctgtgctgcaggattctctgaacaacgaggaggagggcgctagtggcggcgccgtccacagcgacattgggtcttcttccagctcaagttcaccagagcctcaggaagtaaccgacaccactgaagccccatttcagggtgatcagcgcagcttggagtttctgctccctccagaacccgattattcccttctgttgacctttatctacaatggccgcgtagtgggcgaagctcaggtacaatccctcgattgtcgccttgttgctgagcccagcggatccgaatcgtccatggagcaagtcctgtttccaaagcccggaccattagagcccacacagaggttgctctcacaattggagcgcgggatccttgttgcgtctaacccaaggggattgtttgttcagagattatgccctatccctatatcttggaatgctccccaggcaccacccgggcctggaccacacctactcccgtctaatgaatgcgttgagctttttagaacggcctacttctgtcgagacctcgtaaggtattttcagggtctgggacccccgcccaagtttcaggtgacactgaacttttgggaggagtctcacggctcatctcacacgccgcagaatcttatcacagtgaaaatggaacaagcctttgcgcggtacttattagagcagacacccgaacaacaggccgctattctcagcctggtatag

SEQ ID NO: 25029 - DNA, 2454 bp, Artificial Sequence
  Description of Artificial Sequence: Synthetic coding sequence
atgtggagcctgaccgccagcgagggcgagagcaccaccgcccacttcttcttaggggccggcgatgagggactgggtactcgtggcatcggaatgcggcccgaagagagcgattcggaactgctcgaggacgaggaggatgaggttccccccgaaccccagataatagttggcatatgcgccatgaccaagaagtcaaagagtaaaccaatgacccagattcttgaaagactgtgccgcttcgactatctaacagtggtcatacttggcgaggatgtgatccttaatgagcccgttgaaaattggcctagctgccactgcctcattagcttccactccaaaggttttcccttggacaaagccgtcgcatactcaaaactcaggaatcccttcctaatcaacgacttagccatgcagtactatatccaagataggcgcgaagtctaccgaattctccaagaagaagggatagacctcccccgatacgctgttctgaatagagaccctgctcgtcctgaagagtgtaatctgatcgagggtgaagatcaggtagaggtgaacggcgccgtctttcccaaacccttcgttgagaagcccgtctctgcagaagaccacaatgtgtatatttactatccttcctctgccggaggcggttcacaaagactgtttaggaagataggttcaagaagcagcgtgtacagtcccgagtctagtgtgcgcaagacgggatcttacatctacgaagagttcatgcctacagatggcaccgacgtcaaggtttacactgtgggccccgattacgctcacgccgaggccagaaagtcccctgcattggacggtaaggtggaaagggacagtgaagggaaggaaattcaatacccagtgatgctcaccgctatggagaagttggtcgcccggaaggtctgtgtggccttcaagcagactgtctgtgggtttgacttgctgcgagctaacgggcatagcttcgtatgtgacgtcaacggcttcagcttcgtcaaaaactctatgaaatactacgatgattgtgcaaagatccttggcaacaccatcatgagggagctggcaccacaattccaaatcccctggagtatccccaccgaggccgaggacatccccattgtccccactactagtggcacgatgatggagttgcgatgtgtgatagctatcatcagacatggcgacagaactccaaaacagaagatgaaaatggaggtgaagcaccctaggttcttcgctctgttcgaaaagcacggcggctataagacaggcaagttaaagcttaaacgaccagaacagctgcaggaggtactggatattacccgcttgctgttggccgagttggaaaaagagccaggaggtgaaatcgaagagaaaacaggaaagcttgaacagctgaagtccgttctggaaatgtacggccactttagtggcataaatcgcaaggtgcaactgacctactacccccacggagtgaaagccagtaacgagggacaggaccctcagcgggagacgctggccccctccctcctcctcgtcttgaaatgggggggtgaactgacccccgctggccgggtgcaggcagaggagcttggaagagcctttagatgcatgtatcctggagggcagggcgactacgccggattccccgggtgtgggctcctgcgtctccatagcactttcaggcacgacctcaagatttacgccagtgatgaggggcgagtacagatgacggccgccgcgttcgctaagggcctgctggccctcgaaggggaattaacccctatcctcgtccagatggtcaagtcagccaacatgaatggtctattggacagtgacggagacagcttgagttcctgccagcatagggttaaagctagactgcatcacatactgcagcaggacgcgccatttggccccgaagattacgatcagctggcacctactcggagcacgtctttgctgaacagtatgactattatccagaatcccgtcaaagtttgcgatcaggtgtttgcactgattgagaacctgacacatcaaattcgtgagcgtatgcaggaccccaggtctgtcgatctgcaactatatcattcggagactttggagttaatgctgcagcggtggtcaaagctggaacgcgacttcaggcagaagagcggccgatacgacatatctaaaattccggacatctatgactgtgtgaaatacgacgtgcaacataacggcagtcttggccttcagggcaccgccgaactgttgcgcctgtccaaggcactcgctgatgtagttatcccacaagaatacggaataagtagggaagagaagttggagattgctgtcgggttctgcctgccactgctgcgcaagatcctgctggatctccaacggacccacgaggacgaaagtgtgaataagcttcatccgctgtag

SEQ ID NO: 25030 - DNA, 417 bp, Artificial Sequence
  Description of Artificial Sequence: Synthetic coding sequence
atgatcctgcagcagcccctgcagcggggcccccagggcggcgcccagagattacctagggccgccctcggtgtcacgtggggtttagacgcttccagtccactccggggggccgttcctatgtctacaaagcggcgcctggaagaggaacaagaacccttgaggaagcagtttttgagtgaggaaaatatggccactcacttctcccagttaagtcttcataacgaccacccgtactgtagtcctcctatgacatttagtcccgctttgcccccgcttagaagtccgtgctccgaattgctgctgtggcggtaccccggctccctgattcccgaagcactgcggctgctgagactcggcgatacacccagccccccttatcccgccaccccagctggtgacattatggaattgtag

SEQ ID NO: 25031 - DNA, 4302 bp, Artificial Sequence
  Description of Artificial Sequence: Synthetic coding sequence
atgtggagcctgaccgccagcgagggcgagagcaccaccgcccacttctttctcggcgccggggacgagggcttgggaacccggggcattgggatgaggcctgaggaaagcgactccgaactgctggaggatgaggaagacgaagttccacccgaaccacagatcatcgtggggatctgcgccatgactaagaaatccaagtccaagccaatgacgcagattctggagcgcctatgtcgctttgactacctcaccgtggttattctgggagaggacgtgattttgaacgagccggtggagaactggccaagttgccattgcctgattagttttcactccaaagggttccctttggataaggccgttgcctactctaaactgcgcaatccctttctcatcaacgatttggctatgcagtattacattcaggatcggagagaggtgtaccgcattctccaggaggagggaatagatttgcctagatacgcagtcctgaatagggaccccgctagacctgaggagtgcaacctgatcgagggcgaagaccaggtggaagtgaatggagctgtcttcccaaaaccgttcgtcgaaaagcctgtgtccgccgaagaccataacgtatacatctactaccccagctctgcaggaggcggctcgcagcggctgttccgaaagatcggctcgaggagtagcgtgtactctccggagtctagcgtcaggaagaccgggtcctacatttacgaagaattcatgccaaccgatgggacggacgtgaaggtgtacaccgtaggccccgattatgcccacgcagaggctcggaagtctcccgccctcgatggaaaagtggaacgggacagcgaagggaaagagatccgctatcccgtaatgttaacggcgatggaaaaattagttgcaagaaaagtatgcgttgcgttcaagcagactgtctgtgggtttgacttgctcagagctaatgggcattctttcgtgtgtgatgttaacgggttcagttttgttaagaactcaatgaagtattacgacgactgtgccaaaatactagggaatacaatcatgagagaattggccccccagttccagatcccttggtctattcccacagaagccgaagacatcccaatcgtcccaactacctcgggcacaatgatggaactgcgttgcgttatagcgattatcaggcacggtgacaggacccccaaacagaagatgaagatggaggttaagcatccgcgcttttttgcactgtttgagaaacacggcggctacaagactggcaagttgaagttaaaaaggcccgagcagctgcaggaggttttagacataaccagactgctgctcgccgagcttgaaaaggaaccgggaggcgagatcgaagaaaagaccggaaagctggagcagctcaaatcggtcctcgaaatgtatggccatttctccggaattaatcggaaggtacaacttacctactacccccatggagttaaagcttctaacgagggccaggatccccagagagaaaccctagccccctcactgctgttggtgctcaaatgggggggggagctcacgcccgctgggagggtgcaagcggaggagctcgggcgagcgttcagatgtatgtatcccggagggcagggagactacgctggattcccgggttgtgggctgcttcggttgcactctacattccgccacgatctgaagatttatgcttccgatgaggggagggttcagatgacagcagccgctttcgctaagggcttgctggctctggaaggcgagttgacacccatacttgtgcaaatggtgaaatctgccaacatgaatgggcttttagattcagatggcgatagtctcagcagctgtcagcaccgtgtgaaggctcggctccatcatatcttgcagcaagacgctccatttggccccgaggactatgaccagctggcacctactcggtcaactagcctgctgaatagtatgacaattatccagaatcccgtcaaggtatgcgatcaggtgttcgcgctgatcgagaacctgacacatcagatccgcgagaggatgcaggatccgagatctgtggatcttcagttataccattccgagactttggaactaatgctccaaaggtggagtaagctcgagagagactttaggcagaagtccgggaggtatgacatctccaaaattcccgacatttacgattgcgtgaaatacgacgtccagcataacgggtcactgggcctgcagggaaccgcggaattacttaggctatcgaaggccctcgcagacgtggtaatacctcaagagtacgggatttccagagaggagaaattagagattgcagtgggattctgcctgccactgttgcgaaagattcttttagatcttcagaggactcacgaggacgaatccgttaataagctccacccgctttgctatctacgctatagccgaggtgtgctcagtcccggacggcacgtccgcactaggctgtatttcaccagcgagtcgcacgttcattctctgttaagtgtctttaggtatggggggttgctggacgagacccaagatgcccagtggcagagggccttggactatttgtccgctataagtgagctgaattacatgacacaaatagtgattatgctctacgaggataacactcaggaccctttgtctgaggagcgattccacgtcgagctacatttcagccccggtgtaaaaggggtggaggaggaggggagcgctcccgcgggttgcggattcagaccagcctccagtgaaaatgaagagatgaaaactaatcaagggtcaatggagaatctgtgccctggaaaagcctcagatgagccagaccgtgcactacagacatcacctcagccccctgagggacccgggctgccgcgaaggtcccctctcattaggaaccgaaaagcgggttccatggaagtattgtctgagacttccagcagccgccctggaggttataggttgtttagcagctcacgccccccgacagaaatgaaacagtcaggattgggttcccagtgtactgggctgttctctaccaccgtgcttggtggatccagctccgcccctaacctccaggactacgcccgttcccatggcaaaaaactccctcccgcatcccttaagcacagagatgaattactcttcgtgcctgcagttaaacgattcagtgtgtctttcgccaaacatcccacaaatggcttcgagggctgctcaatggtccctaccatctacccgctggaaactttacacaacgccctgtccctgagacaggtgagcgagttcttgtctcgagtatgccagagacacaccgacgctcaggctcaggcatccgctgcattattcgacagcatgcattcctcccaggcgtctgacaatcctttcagcccaccccggaccctgcacagccccccactgcagcttcagcagagatctgaaaaacctccctggtatagcagcggaccaagctccaccgtgtcttcagccggcccatcatcccctacaaccgtcgacgggaatagtcaattcggcttttctgaccagccttctctgaattcccatgtagcagaagagcaccagggcctgggattactacaggaaacaccaggcagcggcgcccaggaactgagcatagagggagaacaagaactttttgagcctaaccagtccccccaggttccccctatggaaacctcccaaccctatgaggaggtctcccaaccatgtcaggaagttcccgatatcagtcaaccctgccaggacatcagtgaggcactgtcccagccatgtcagaaggtccctgacatctctcaacagtgccaggagaaccacgacaacggcaaccacacctgccaggaagtcccacatatctcccagccttgtcagaagtcgtcacagctttgtcagaaagtgtcagaagaggtatgtcaactgtgtcttgaaaacagcgaagaggtcagtcaaccttgccaaggcgtgtcagttgaggtgggcaaactggtgcataaatttcacgttggcgtggggtcactcgtccaggagaccctggtggaagtgggatctccagctgaggaaattcccgaggaagttatccagccttatcaagaattttctgtcgaggtcggaagattggcgcaggaaacgtctgctattaaccttctcagtcaggggattcctgaaatcgacaagccttctcaggaattccctgaagagatcgacctgcaggcccaggaggtccctgaagagatcaactag

SEQ ID NO: 25032 - DNA, 435 bp, Artificial Sequence
  Description of Artificial Sequence: Synthetic coding sequence
atggccgaggtgcaggtgctggtgctggacggccggggccacctgttaggccgactggccgccatcgttgccaaacaggtgttgctggggcgaaaggtggtggtagtgagatgtgaagggataaacatctcaggaaatttctatcggaataagctgaaatatctggctttcctccggaagcggatgaacactaatccatccagggggccatatcacttccgcgcccccagtcgcattttctggcggactgtgaggggtatgttgccccataagaccaagcggggccaggctgccctggataggctgaaggtttttgatgggatccccccaccctacggtaataggccaaggcggacctggagacggaagctgacaaatacacagcgctcgtcacgtccaacggattcctggagcgaacccaacaaggactgttag

SEQ ID NO: 25033 - DNA, 408 bp, Artificial Sequence
  Description of Artificial Sequence: Synthetic coding sequence
atggccgccctgcggcccctggtgaagcccaagatcgtgaagaagcgcacaaaaaaattcattcggcaccagtctgacagatatgtgaaaattaaacgcaactggaggaaaccgagggggattgataaccgcgtaaggaggcggtttaaagggcaaatcttgatgccaaacataggctacggaagtaacaagaaaacgaagcatatgctgccctcagggttccgcaagttcctggttcacaacgtcaaagagctcgaggtattgctgatgtgcaataagtcttactgtgctgaaatcgctcacaacgtgtcctccaaaaaccgaaaagcgattgtcgaaagggctgcccagcttgcaatcagggtaacaaatcctaacgcacggctccgctccgaggagaatgaatag

SEQ ID NO: 25034 - DNA, 408 bp, Artificial Sequence
  Description of Artificial Sequence: Synthetic coding sequence
atggccgccctgcggcccctggtgaagcccaagatcgtgaagaagcgtaccaaaaaatttatccggcatcagtctgaccggtacgtgaaaattaaacggaactggcggaaacctcggggcatagataatagggtgcgaaggcggtttaagggacagatcttgatgcctaatattggctacggctccaacaaaaaaaccaagcacatgctgccctccgggttccggaaatttttggtccataacgttaaagaattggaggtgctgctcatgtgcaacaagtcctactgcgctgagatcgcccacaatgtttcgtccaagaacagaaaagcaattgtggaacgcgctgctcagctggcaattagggtaacgaacccaaatgcccgccttcgctcagaggagaatgaatag

SEQ ID NO: 25035 - DNA, 684 bp, Artificial Sequence
  Description of Artificial Sequence: Synthetic coding sequence
atggagccccagggctaccccgccttcggctgggaccacagcctgcataaacgaaagcgtctgcctcctgtgaagagatcactggtctattacttaaagaatagagaagttaggcttcaaaacgaaacgtcctactcaagagtgctgcacggatatgctgctcagcagcttccttccctcttgaaggaacgcgagtttcacctagggaccctgaataaagtatttgcctctcagtggttgaatcacaggcaggttgtgtgtggtacaaagtgcaatacgctctttgtggtcgatgtgcagaccagtcagatcacaaagattccgattctgaaagatcgagaaccaggcggggtgacccagcagggatgtgggatccatgccattgagctgaatccgagccggacactattggctactggcggggacaaccctaatagtttggcgatttaccggttacccacattggacccggtctgcgtgggggacgacgggcataaggactggatcttctcaattgcatggatcagcgacaccatggctgtatctggttcccgagatggaagcatggggttatgggaggtcacagatgatgtgctcacaaagtcagatgcccgacataatgtgtctcgggtgccagtctatgcccacattacccacaaggccctgaaagacattcctaagtag

SEQ ID NO: 25036 - DNA, 1554 bp, Artificial Sequence
  Description of Artificial Sequence: Synthetic coding sequence
atgacccggctgggcaccgtgccccggaaggccctggagatgagctgtgccatccagaatcagctggcacggatactcgccgagtttgagatgaccctggaaagagatgttctccagcccctcagcaggttgtccgaggaagaattacctgccatcctgaaacacaagaagagcctgcagaagctagtgtcagactggaataccctgaagagcagactcagtcaggctacgaagaacagcggcagcagccaggggctcggtggctcaccgggatcccacagtcatactacgatggcgaacaaggtggaaacgctgaaagaggaagaagaagaacttaaacggaaggtcgaacaatgccgagacgaatatctagccgacctgtaccactttgtcactaaggaggacagctatgcaaattattttattcgactcctggagatccaggcagattaccacagacgcagtctgagcagcctggataccgcacttgccgaactaagagagaatcatggccaggctgatcactctccttcgatgacagcaacccatttccccagagtgtacggagtgagcctggccacccatctgcaagagcttggcagggagatcgccctgcctattgaggcctgcgtgatgatgttgctgtctgaaggaatgaaagaagagggcttattcagactcgcagctggagcctccgtcctcaagaggctcaaacagacgatggctagcgaccctcattccctggaagaattttgttccgacccacacgccgtggcaggagcgctgaagagctacttgcgcgagctcccagagccattgatgaccttcgacctctacgatgattggatgagggctgccagtctgaaggagcctggtgcacgcctccaggcactacaagaggtctgcagcagactgccacccgagaatctcagcaatttacgttacctgatgaaatttttagcaagacttgccgaggagcaggaagttaacaagatgaccccatccaacattgcaatcgtgctcggacccaatctcttatggcctccagaaaaggagggcgaccaggcacagctggatgcggctagtgtttctagcatacaggtggtgggcgtcgttgaggctctgattcaatccgcagacactctgtttccaggtgatattaacttcaacgtgagcggcctttttagcgccgttaccttgcaggacactgttagcgatcgcctggcttctgaggaactgccgagcactgcagtccccactccagccaccacccccgcccccgctcctgcccccgctcccgcccccgcccccgccctcgctagcgccgcgaccaaggagcggactgagtcagaggtgcccccgaggccagcatccccaaaggttacccgctcaccccccgagacagccgcccctgtggaggatatggctcggaggagtccaaggggcgcaaccgggcgcaaagagcgctttgcttgctcctacggaactgactcttcactggctgatatgttctttgtccgactggtgaacaagttattttggactaaactgtag

SEQ ID NO: 25037 - DNA, 918 bp, Artificial Sequence
  Description of Artificial Sequence: Synthetic coding sequence
atggacctgagcggcgtgaagaagaagagcctgctgggcgtgaaggagaataataaaaagtcctctacccgggctccaagcccaacaaagagaaaagatcgctctgacgaaaaatctaaggaccgtagcaaggataaaggagccaccaaggagtcctcggagaaggatcggggcagagacaagacccgaaagaggagatcagccagctctggttcaagctcaacccgaagtcgcagttccagcacgagtagcagtggtagttctacatctacgggctcctcctctgggagtagctcatcatctgcctctagccggtccggatcaagttctacatcgcgttctagttcctcttcctcgtcctccgggtccccaagcccctcacggaggcggcacgacaatagacgcagatctagatctaaaagcaaacctccgaaaagagatgaaaaggagcgtaagagaaggagcccgtctccaaaacctactaaggtgcatattgggagattgactcgtaatgtgacgaaggatcacattatggaaattttctcaacgtatgggaaaattaaaatgatcgacatgcccgtggagagaatgcacccacacctatccaaagggtacgcatacgtcgaatttgagaatcccgacgaggcagagaaagccctgaagcacatggacggcggacagatcgacggacaagagatcacagcgactgccgtgttggccccatggccacgaccgcctcctaggcggttttcgccaccaagaagaatgctgccgcctccccctatgtggcgaagatcccctcccagaatgaggcggcggagcaggagccctcggcggagatcaccagtgcggagacgcagtcgaagccccggaaggaggagacatagatcccgctcttcgagtaactcctcccggtag

SEQ ID NO: 25038 - DNA, 927 bp, Artificial Sequence
  Description of Artificial Sequence: Synthetic coding sequence
atgatccacgacgcccagatggactactacggcacccggctggccacctgctccagcgacaggagcgtcaaaatatttgatgtcagaaatggcgggcagatcctgatcgccgacctacggggccatgagggcccagtttggcaggttgcctgggctcaccccatgtacgggaatatcctggcttcatgttcgtacgacagaaaggttatcatatggcgcgaagaaaatgggacgtgggagaagtcgcacgagcacgcaggccacgattcgtctgtcaatagtgtgtgctgggctccacatgactacggactgatcctagcctgtggctcttccgacggcgctatttctctgttaacttataccggggaaggtcaatgggaggttaagaagatcaacaatgctcacaccatcggatgcaatgccgtcagctgggcacctgcagtggtgccaggatccctgatcgaccatcccagtggtcagaagcccaattacattaagagattcgctagcggcggatgtgacaacctaattaagttgtggaaggaggaagaggacggacagtggaaggaagagcagaaactggaggcccacagtgactgggtcagagacgtcgcttgggccccgtcgattgggttgcctaccagtactatcgcatcttgcagtcaggacgggcgtgtctttatttggacctgcgatgatgcttcatctaacacatggtcaccaaaacttttgcataagtttaatgatgtggtatggcacgtgtcctggtccatcacagccaacattctggccgtgtctggcggagacaacaaggtgactctatggaaggagtccgtggatggacagtgggtctgtatttccgacgttaacaaggggcagggcagtgtctcagcttcagtcacggaaggtcagcagaacgagcaatag

SEQ ID NO: 25039 - DNA, 1542 bp, Artificial Sequence
  Description of Artificial Sequence: Synthetic coding sequence
atgagcatcgagatcgagagcagcgacgtgatccggctgatcatgcagtaccttaaggaaaactctctgcacagagcactggctacattgcaagaggagaccactgtctctctgaacaccgtggactcaattgagtcgttcgtagccgacattaattcggggcattgggataccgtgctacaggccatccaatccctgaaactgcctgataaaaccctgatcgacctctatgagcaggttgtcctggagcttatcgagctgcgcgaactgggcgccgctcgatccctactgcggcagacggatcccatgatcatgttaaaacagacccagcctgagcggtacatccacctggagaatttgctggccaggagctactttgacccaagagaggcttatcccgatggaagttccaaggagaaacgacgcgccgctattgctcaggcgctggcgggcgaagtgtccgttgtgcctccaagcagactgatggcgttactgggccaggcacttaagtggcaacagcaccagggattgctccctcccggcatgactattgaccttttccggggaaaagccgcggtgaaagacgtcgaagaggaaaagttcccaacacagctgagccgacatattaagttcggacagaagtctcatgtggaatgcgctcgcttctcccccgatgggcagtatctcgtcaccggttccgtagacgggtttattgaagtttggaatttcacgacagggaagatccggaaagatttaaagtaccaggcccaggataactttatgatgatggacgatgcagttctttgcatgtgcttcagcagggacacggaaatgttagctacgggagcccaggacggaaaaattaaggtgtggaagatccaatctgggcagtgtctgcggcgcttcgaacgagcacattcaaaaggagttacctgcctgagtttctccaaagactcatcgcagattctgagcgctagttttgaccagacgatacggattcacggcctcaaaagcggaaagactttgaaagaatttagaggtcattcctccttcgtcaacgaggctaccttcacacaggatggtcattatattatctctgcgtcctctgacgggacggtgaaaatttggaatatgaagaccaccgagtgttccaatacatttaagtccttaggctctacagcggggactgatattacagtgaatagcgtgatcttactgccgaagaatcccgagcattttgttgtatgtaatcgctccaatacagtcgtgatcatgaatatgcagggtcaaatcgttagaagctttagctccgggaaacgcgaaggcggtgattttgtgtgctgcgccctgagccctaggggtgagtggatttattgcgtgggggaggactttgttctgtactgtttctcaactgtgactggtaaactagagagaactttaaccgtgcacgaaaaagatgtgattggaattgctcaccacccgcaccagaatctgattgccacgtacagcgaagacggattactgaaactctggaagccatag

SEQ ID NO: 25040 - DNA, 2136 bp, Artificial Sequence
  Description of Artificial Sequence: Synthetic coding sequence
atgagcagcgtgcagagccagcaggagcagctgagccagagcgacccctctcctagccctaatagctgttcgtcatttgagctgatcgatatggatgcaggctcactatacgaaccagtgagccctcattggttttactgcaagatcatagacagcaaggagacctggatacccttcaactccgaggatagtcagcaattggaagaggcctacagttctggaaaaggatgcaacggtcgtgtagtccccacagatggaggcagatatgatgtgcacttgggagagaggatgaggtacgccgtctactgggatgaactggcttcagaggttcgaaggtgtacttggttctataagggcgataaggacaataaatacgtgccttattctgagtccttcagccaggttctggaggaaacatacatgctggccgtcactcttgacgagtggaagaagaagctcgagtcccccaatcgggagattatcatactccataacccgaaactgatggtccattaccaacctgtggccggcagcgatgactggggttcaactccaacagagcagggtagaccccgcaccgtaaaacgaggcgtggagaatatcagcgtcgatattcattgtggagagccgctgcagattgatcatcttgtgttcgtggttcatgggattggtccggcgtgtgatttgcggttccgtagcatagtgcagtgtgtgaacgacttccgaagcgtttctctcaacctgctgcagactcactttaagaaagctcaggaaaatcagcagatcggaagagtggaattcctgcctgtcaattggcactccccactccacagtactggagtggacgtcgacttgcagcgcattaccctgcccagcataaacagattgcgccacttcacgaatgataccatccttgacgtgttcttctataatagtcctacatactgtcagaccatcgtcgacacagtcgctagcgaaatgaacagaatttacactttatttctccagcgaaatccagactttaagggcggggtatccatcgccgggcatagccttgggagtctaatcctgtttgacattctcacaaaccagaaggatagtctaggtgatatcgattcagagaaagacagtctgaacatcgtaatggatcaaggtgacacacccacgctggaagaggacctcaagaaactgcagttgtctgagttctttgatatattcgaaaaagaaaaggtcgataaggaggccctagccctctgcaccgacagggacctgcaggaaatcggcattcctctgggtcccagaaaaaaaatcctgaactacttttctacacggaaaaactccatggggattaagcgccccgctcctcagccagcctctggcgcgaacattccaaaagagagcgaattctgttcctcatctaacactaggaatggggattatctggacgtcggcattggtcaggtgtctgtgaaataccccagacttatatataagcccgagatcttttttgctttcggctcccccattgggatgttccttactgtgagggggttaaagcgaattgacccaaattatcggtttcccacctgtaaagggtttttcaacatctatcatccttttgaccccgtcgcctaccgcatcgaacctatggtcgtgccaggggtcgagttcgagcccatgctcatcccccaccacaagggcaggaaaaggatgcacttggaactccgcgaaggactcaccaggatgtccatggatcttaagaacaatcttttgggcagcctgcgaatggcatggaaatccttcactagggccccttatccagccctacaggcatctgagactcctgaagagacagaagctgagcctgagtctacgtcagagaagccctcagacgtaaatacagaagagacgtccgtagccgtcaaggaagaggttttgcctattaatgtcggcatgctgaatgggggtcaaaggatagactatgtacttcaggagaaaccaattgagtcattcaacgagtatttatttgcgctccaaagtcatctttgttactgggaatccgaggacaccgtgctgttagttcttaaggagatctatcagactcaaggcatatttttggatcagcccctgcagtag

SEQ ID NO: 25041 - DNA, 3351 bp, Artificial Sequence
  Description of Artificial Sequence: Synthetic coding sequence
atgtacggcagcgcccggagcgtgggcaaggtggagcccagcagccaatccccaggaaggtcaccccggctgccccgctcacctaggctaggccacagacgcactaactctactggcgggtcatctggttcatccgtcggggggggctcaggaaagacactgtctatggaaaatattcagagtctcaacgcagcttacgctacttctggcccaatgtacctgtccgatcatgaaaatgtcgggagcgagaccccaaaatctactatgactctgggacgttctggcggcaggctcccctacggcgtgagaatgacagctatggggagctcacctaacattgcaagtagcggggtggccagcgatacgatcgccttcggcgagcaccacttgcctccagtgagcatggccagcaccgttcctcacagcctgaggcaggcgagagacaacacgataatggacctccaaacacagcttaaagaggtcctgagagaaaatgatctgcttagaaaggatgtggaagtgaaggaaagcaagctgtcaagtagcatgaactctatcaagactttctggagccccgagcttaagaaggaaagggctcttcgtaaagatgaggcatcaaaaattaccatttggaaggagcagtatcgcgtcgttcaggaagaaaaccagcacatgcagatgactattcaagccctacaggacgaactgagaatccagagagacctgaaccagttgtttcagcaggatagcagtagccgcaccggcgagccctgtgtagcagagctcaccgaggagaacttccagagattgcatgccgaacacgaacggcaggcaaaggagctgtttctgcttcgcaaaaccctggaggagatggagctgcgaattgagactcagaagcagaccctgaacgcgcgggatgaatctattaaaaagctgctcgagatgctccagagtaaagggctctcagcaaaggctacagaggaggatcacgagcgaactcgcaggttggcggaggccgaaatgcatgtgcatcacttagagtccctactcgagcagaaagaaaaagagaactctatgctcagggaggagatgcatcgcagatttgagaatgcacctgattcagccaagaccaaggcactgcagacggttattgaaatgaaggacagcaagatttcatccatggaaagagggctccgggacctggaggaagagatccagatgctgaaaagcaatggcgcactatctacagaggagcgtgaagaagaaatgaagcaaatggaagtgtatcggtcccactcaaagttcatgaagaataaagtcgaacagctgaaagaagaacttagttccaaggaggcgcaatgggaagaactgaagaagaaggcagccggcttgcaagcggagatcgggcaagttaagcaggaactctcccgaaaggacacagaactcctggctttgcagacaaaattggagaccctgactaaccagttcagcgactccaaacaacacattgaggtgttgaaggagagtttgacggccaaggaacagcgggccgctatcctgcagacagaggttgatgcactccgattacgtctggaggagaaagaaacaatgctcaacaagaagactaagcagatacaggatatggcagaagaaaaggggactcaagctggcgagatccatgaccttaaagacatgctggacgtaaaggaacgtaaagttaatgtactacaaaagaagatagagaacctgcaggagcaactgagggataaagaaaagcagatgtcaagcctcaaggagcgtgtcaaaagtctccaagccgacacaaccaacacagacacggcgcttaccactcttgaagaagccctggccgaaaaagagcgtactatcgagcgtctgaaggaacagagagatcgcgatgagagagaaaagcaggaagagatcgataactataagaaggacctgaaggatctgaaggaaaaggtttctttgctgcagggtgacttgtctgaaaaagaggctagtctcctagacttgaaagaacacgcttcatccctcgcttcatctgggctgaaaaaagattcccgcctgaagacacttgagattgccctcgagcagaagaaggaggaatgcctaaaaatggagtcacagctaaagaaagctcacgaggcggcacttgaggccagggccagtccagaaatgagcgacaggatccaacacttggagagggagattacccgctacaaagatgagtcttcaaaagcacaggctgaagtcgacaggttgctggagatccttaaagaagtagagaatgagaaaaatgacaaggacaagaaaatagcggagctggaaagacaagtgaaggatcaaaacaaaaaggtagccaacttgaagcataaggagcaggtagagaaaaaaaagagcgcccagatgctcgaggaagccaggaggagagaggataacttaaatgattcatcacagcagctgcaagactctctgagaaagaaagatgataggatcgaggagttagaggaggcactcagagaaagtgtccagatcacagctgagagagagatggtcctggctcaagaagaaagcgcccgcaccaacgccgaaaagcaagttgaggagctgctgatggccatggagaaagtgaagcaggaattggagtcaatgaaggccaagctgtcctctacccagcagtcactggctgagaaggaaacccacctgaccaacctgcgggccgagcgcagaaagcacctggaagaagtgctggagatgaagcaggaagccttactggcagcaatatctgaaaaagacgcaaacatcgctttgctagagctgtcttcaagcaagaaaaaaacccaagaagaggtggccgccctcaagcgagaaaaagaccggctggttcagcagctgaagcagcagacccagaatcggatgaaactcatggcagacaattatgaagacgatcacttcaagagttcgcacagcaaccagacaaaccacaagccctcaccggaccaaataattcaaccacttttggaacttgaccagaacaggtcaaagttaaaactttacatcggccatctgaccaccttgtgtcacgatagggatcctctgatccttagaggacttacaccccccgccagttacaacctcgatgatgaccaggccgcatgggaaaacgagttgcagaagatgactagaggccagctacaagatgaacttgagaagggcgagagagacaatgccgaactgcaggaatttgctaacgcaatcttgcagcagattgccgatcactgcccagatatcctagagcaagtggtcaatgcccttgaggaaagctcttag

SEQ ID NO: 25042 - DNA, 1233 bp, Artificial Sequence
  Description of Artificial Sequence: Synthetic coding sequence
atgcagaacatccacggcaaggagatcgacctgctgcggaccaccgtcaaagtaccagggaagaggctacctcgcgctactcccgccacagcgccaggaacttcgcctagagccaatggcctcagcgttgaacggtcaaacacacagctgggcggaggcaccgcctccgggcccgccgaagtcttatcatcatctccaaagttagatcctcctccatccccacattctaataggaagaaacatcgccggaaaaagagtacagggacgccgagacctgatggcccgagcagcgctaccgaggaggcagaggagtctttcgagtttgtggtcgtctcactgactggtcagacttggcacttcgaagcctccacagccgaggagagggaactgtgggtgcagagcgtacaggcacaaatactagcgtcattgcaggggtgccgctccgctaaagataaaacacgcttgggtaaccagaacgcggctttggccgtccaggccgtgagaactgtgagggggaactctttctgtatagactgcgacgcccccaaccctgactgggcctcacttaacctcggcgcacttatgtgcattgagtgttctggcattcatagacacttgggagcccacctcagccgggtgaggtctttggacttggatgattggccccccgaattgctcgccgtcatgaccgctatgggaaatgccctagcgaatagtgtgtgggagggcgcgctgggggggtattccaagcctggtccggacgcctgccgagaggagaaggaacggtggatacgggccaagtatgagcagaagttgtttttggccccactcccaagcagcgacgttcctcttggtcagcaattgcttagggcagtcgtggaagatgatctcaggctgctggtaatgctgctagcccatggctccaaagaggaagttaacgaaacgtatggcgacggagatggacgcaccgccctccatttaagtagcgctatggcaaatgtggtctttacccagctcctgatttggtacggtgtggacgtgcggagtcgagatgcaagaggacttacccctcttgcttatgccagacgcgccggatctcaagaatgcgccgacatcctgatccagcacggctgtccaggcgaaggctgcggtctcgcccccaccccaaatcgtgagcccgccaatggcactaacccttccgcggagctgcaccgttccccttctcttctgtag

SEQ ID NO: 25043 - DNA, 492 bp, Artificial Sequence
  Description of Artificial Sequence: Synthetic coding sequence
atgagcgacagccccgccggcagcaacccccggacccccgagagctccggcagcggcagtggcgggggaggcaaaagaccagccgtccccgcagccgtgagtctgctgcctccggctgacccactccgacaggctaatcgccttcctatacgcgtgcttaaaatgctgtctgctcacactggccatttgctgcatccagagtacttacagcctttgtccagtacgccagttagcccaatcgaactcgatgccaaaaagagccccctggcgctcctggcccagacatgtagtcagatcggctcccctgggagccttagcctacgaaacccccatacattaggcttgagccgttatcacccatacgggaaaagtcatctgtctaccgcggggggcctcgccgtgccatccttgccaactgccgggccttattacagtccctatgccctgtatgggcagagactagccagcgcttcagcattggggtatcaatag

SEQ ID NO: 25044 - DNA, 2736 bp, Artificial Sequence
  Description of Artificial Sequence: Synthetic coding sequence
atgaacttccaggccggcggcggccagagcccccagcagcagcagtctctagccgcccccggcggcgggggagctgcagctcagcagctggtctgcggtggtcagtttggtggcgctggtcccggtgccggcgggggaggaggcccatcccagcaacttgccggcggacccccgcagcagtttgccctatctaattccgccgccatccgggctgaaatccagcgctttgaatctgtgcatcccaacatctacgctatttatgacctaatagaacggattgaagacttagctctgcaaaaccagattcgtgagcatgtcatcagcatcgaagattctttcgtgaacagccaggagtggaccttgtcccggtccgtacctgagctcaaagtgggaatcgttggaaacctgagcagcggcaagtctgcccttgtgcaccgatatctgacagggacttacgttcaggaggaaagtcctgaaggaggcaggttcaaaaaggagattgtcgtcgacggtcagtcctatctgcttctaataagggatgaggggggacctccagagctacagttcgctgcgtgggtggacgcagtggtcttcgtcttctcacttgaggatgaaatctccttccagacagtctacaactacttcctgcggttatgttcctttcgaaacgcatccgaagtcccgatggtgttagtgggcacccaggatgccattagtgctgctaaccctagagtcatcgacgacagcagggccagaaagctttccaccgacctgaaacgctgtacctactatgaaacatgtgccacatacggcctgaatgtggaaagggtcttccaagacgtggcacaaaaggtggtagccctgagaaagaagcagcaactggcaatcgggccttgtaaatctctgcctaactcaccaagccactccgccgttagtgctgccagcattcccgccgttcatattaaccaggccaccaacggtggcggctcagccttcagtgattacagctccagcgttccctctacgccgtccatttctcagagggaattacggatcgaaaccattgcggccagtagtacgccaaccccaatcagaaagcagagcaaacgtcggagcaacattttcacaagcagaaagggagctgacttggatcgagaaaaaaaagccgctgagtgcaaggttgactctattggttctggcagggccatccctatcaagcaaggtatcctgctaaagcgctcaggtaaatccctaaacaaagagtggaaaaagaaatacgtgacactgtgtgataacgggctcctgacctatcatcccagcctgcacgactatatgcagaacatacatggaaaggagattgatctattgcgtacgacagtgaaagttccaggcaagcgtcttcctcgggcgaccccggccacagcacctggtacatcccctcgggctaacggcttgagcgtcgagcgcagtaatactcagctggggggcggcacgggagctccgcatagcgcgtcatctgcgtccctacacagcgaaagacccctgagctcaagtgcttgggcaggcccgagaccggaaggccttcaccaaagaagctgctctgtgagcagcgccgatcagtggtccgaagctaccacttctttgcccccgggcatgcagcaccctgccagtggtcccgctgaagtgctgtcttcaagtccaaagctggaccctcctccttcccctcacagcaatcggaagaagcaccgccgaaagaaaagcaccggaacacccaggcccgacgggccctcttctgctactgaagaagctgaggaatccttcgaattcgtggttgtgtctctgactggccagacctggcatttcgaggcttctaccgcagaggagagggaactgtgggtacagagtgtacaggctcaaattctggcatctcttcaaggatgccgctctgcaaaagacaagactcggcttggcaatcagaacgccgccctagccgttcaggctgtccgaacggtgcgcggtaactctttttgcatagattgcgatgcacccaaccccgattgggcttccctgaatctaggagcccttatgtgtatcgagtgtagcggcatccacaggcacctgggagcacatctgtcccgggttcgttccctggatctggacgattggcctcccgagctgttggccgtgatgactgcgatgggcaacgccctcgccaatagtgtatgggagggcgcgctggggggatacagcaagccaggaccagatgcatgccgagaggagaaggagcggtggatccgagccaaatacgaacaaaagctgtttctggctcctttgccttccagtgacgtacctctggggcagcagctgctgcgtgcggtggtagaggacgacctgaggctgcttgttatgctgctggctcatggctccaaggaggaagtgaatgaaacctatggagatggcgatgggaggactgccctgcatctgtcaagtgcgatggctaatgtggtatttacccagctcctgatttggtatggggtagatgttagatctcgagatgctaggggactaactcccctggcctatgcacgtagggccggatctcaagagtgcgccgacatcctgatccagcatggctgccccggcgagggttgtgggctcgcccctacgccaaatcgggagcctgccaacgggaccaacccctcagcggagttgcatcggtccccctcgctgctgtag

SEQ ID NO: 25045 - DNA, 1059 bp, Artificial Sequence
  Description of Artificial Sequence: Synthetic coding sequence
atggacatcgacaaggacctggaggcccccctgtacctgacccccgaggggtggagcctgttcctacaacgctactaccaggtggtacatgagggagctgaattgcggcatttggatacccaggtccagagatgtgaggacatactgcagcagctgcaggctgtggtgccacagattgatatggagggagaccgtaacatttggatagtaaagcccggggccaagtccaggggacggggtatcatgtgtatggatcatctggaggaaatgttgaaattagtgaacgggaatcctgttgtgatgaaggatggaaagtgggtggtgcagaagtatattgagaggcctctattgatatttggaacaaagtttgatctgaggcagtggttcttagtcaccgattggaatcctttgaccgtgtggttctatcgggactcctatatccgcttttcgactcagccattttctctgaaaaatctggataactcagtgcacctttgtaacaatagcatccagaagcacctagaaaacagctgccaccgccatccccttctcccccccgataacatgtggagttcgcagaggtttcaggcccacttacaggagatgggagcacccaacgcttggtccaccatcattgtacccggaatgaaagacgcagtgatacacgcgctccaaacttctcaagatactgttcagtgcaggaaggcttcttttgagctatatggagctgattttgtgttcggcgaagacttccaaccttggttgatcgagatcaatgcctctccaacaatggccccttccactgcggttaccgcgcgtctctgcgcaggcgtccaggcggacacgctgcgggtcgtgatcgaccggatgctggatcgaaattgcgacaccggtgcctttgagctgatctacaagcagcccgtcacaacctcccctgcctcaacaccacgcccctcatgtctactcccgatgtattctgatacaagggcccggtccagcgacgatagcaccgcttcatggtgggctctgcgcccctgtagaccacaagcacgcccctag

SEQ ID NO: 25046 - DNA, 507 bp, Artificial Sequence
  Description of Artificial Sequence: Synthetic coding sequence
atgaccgccaccctgcggccctacctgagcgccgtgcgggccacccttcaggcagcactttgcctggagaacttcagctcacaagtggtagagaggcataataaacccgaggtggaagtacgctcaagtaaggaactcctccttcaaccagtgacaatctctagaaatgagaaagagaaggtattgatcgagggctctattaattccgtccgggtgagtatcgccgttaagcaggccgacgagattgaaaaaatattgtgtcataaattcatgagattcatgatgatgcgtgcagagaacttcttcatcttacgaaggaagcccgtggagggctatgacatttctttcctcataacaaacttccatacagagcagatgtacaagcataagctcgtcgactttgtaatacactttatggaggaaatcgacaaggagatttctgagatgaagctgagtgtgaacgctcgggcccggatcgttgctgaagagtttctgaaaaacttttag

SEQ ID NO: 25047 - DNA, 993 bp, Artificial Sequence
  Description of Artificial Sequence: Synthetic coding sequence
atggagcggttcatggagcaggtggtgttcaagtacctgcgggccgaaccagaagatcactatttcctgatgacagagcctcctctcaatactcccgagaatagggaatacctggcagaaataatgttcgaaagcttcaatgttcccggcctctacatagctgtgcaagcagtgctcgctcttgctgccagttggaccagtcgacaggtgggcgagcgtaccctgacgggtattgttattgacagcggggacggagttacacacgtgataccagtcgctgaggggtatgtaatcgggtcatgtatcaaacatatcccaattgccggccgcgacatcacctactttattcagcaactcttacgtgagcgcgaggttggtatcccgccggagcagtctctcgagactgccaaggcgattaaggagaaatactgttacatctgtccggacatcgtcaaggaatttgccaagtatgatgtcgatccgcggaagtggattaagcagtacacaggcattaacgcgatcaatcagaaaaaattcgttattgacgtgggttacgaacgctttctgggccccgagatttttttccaccctgagtttgctaacccagattttatggagtccatcagcgatgtcgtggatgaggtgatccaaaactgccctatagatgtccgcagacccctctacaaaaacgtggttctgagtgggggcagcaccatgtttagagattttggacgcaggctgcagagagacctgaaacgggttgttgacgcgcgtctccgactgtcagaagagttaagtggcggccgcatcaaaccaaaaccagtggaggttcaagtggttacccaccacatgcaacggtacgccgtgtggtttggagggtctatgctagccagtacacctgagttcttccaggtgtgccacaccaagaaagactatgaggaatatggacctagtatctgccggcacaatccagtgtttggcgtaatgagctag

SEQ ID NO: 25048 - DNA, 894 bp, Artificial Sequence
  Description of Artificial Sequence: Synthetic coding sequence
atgaagaccctgagccccgaccggatccagccccacatcatgaccgacgtgcctgcaacatttacacaggccgaatgtaacggcgataaaccacctgagaacggccaacagacaatcacgaagatctccgaggagctgactgatgtcgactcacccctgccacactatcgagttgaaccctccctggagggcgcgctcactaagggatcacaggaggaacggcgcaaactacaagggaacatgctactaaactccagtatggaggataagatgctgaaggaaaatccagaggagaagctctttatcgttcataaggctattactgacttgagtttacaggagacttcggcggacgaaatgacattccgcgaaggccaccagtgggaaaagatcccccttagtggttcaaaccaagaaattagaagacagaaagagcgcattacagaacagccacttaaagaagaggaagacgaagaccgaaagaataaaggacaccaggctgctgaaattgaatggctcggatttcgaaagccctcccaggcagatatgctacattcaaagcatgacgaggagcagaaggtctgggacgaggagatcgatgacgatgatgacgataactgcaataatgatgaggacgaggtgagggtcatcgagtttaaaaagaagcatgaagaggtttcccagttcaaggaagagggcgatgcatctgaggacagtcccctcagcagcgcctcgtcccaggcggtaaccccagacgagcagcccacactggggaaaaaatccgatatctctagaaatgcatatagtagatataatacaatctcctatagaaagattaggaagggcaataccaagcagaggatcgacgaatttgagagcatgatgcacctgtag

SEQ ID NO: 25049 - DNA, 1074 bp, Artificial Sequence
  Description of Artificial Sequence: Synthetic coding sequence
atggtgcagcccttcaccaccatccccttccccccccccccccagaacggaatacccaccgagtacggagttccgcacactcaggattacgccggacagaccggggagcacaatttaacactgtacggaagtacccaagcacacggagagcagagttccaacagtccctccacacagaacggctctctgacgcagactgagggtggtgctcagaccgacggacaacagtcccagacacagtcctccgaaaacagcgaatcgaagagtactcctaagcgcttacacgtgtcgaacattccttttcgatttagagatccggacctgaggcagatgtttgggcaattcggcaagatcttggatgtcgagatcatcttcaacgagagagggagcaaggggtttggtttcgtcacgttcgaaaattccgccgacgccgatagagcgcgggagaaactgcatggaacagtggtggagggtaggaaaatcgaggtgaataatgccaccgcaagggtcatgacaaataagaaaatggtgacaccatacgccaacgggtggaagttgagccctgtggtgggcgccgtgtacgggccggaactgtacgcagctagttccttccaggccgacgtctccttgggcaacgatgctgctgtccccctctccggcaggggcgggatcaacacatacatccctctcattatcccggggttcccctacccaacagcggctactactgccgccgcgttcagaggggcgcatttgagaggccgcggacggacggtctacggtgcagtgagggccgtacccccaacagcaattcccgcttacccaggcgtcgtctaccaggacggcttttacggcgccgatctatacgggggatacgcagcttatagatatgcccaacctgccaccgcgacggccgctaccgccgctgccgcagcagccgccgcttactctgatggctacgggagggtgtatacggccgatccttatcatgccctggcccctgcggcctcttatggcgtgggggcagtcgcttccctgtaccgtgggggatatagcagatttgccccctactag

SEQ ID NO: 25050 - DNA, 387 bp, Artificial Sequence
  Description of Artificial Sequence: Synthetic coding sequence
atggtgcagcccttcaccaccatccccttccccccccccccccagaatggaatccctacagaatacggtgtccctcatacccaggactacgcaggccaaaccggtgagcataacctcacgctgtatggcagcacacaagctcatggggaacagagctctaactctccaagcacccagaatggatctctaacaactgaggggggggctcaaactgacggacagcagagtcaaacccagagtagcgagaactcagaatctaagtccacccctaaaaggttgcatgtatccaacatcccatttagattcagggaccccgaccttagacaaatgtttggatttggcaagattctggatgtggagattatctttaatgaaagaggtagctag

SEQ ID NO: 25051 - DNA, 1071 bp, Artificial Sequence
  Description of Artificial Sequence: Synthetic coding sequence
atgcagggcatcctgctgctggtgttcgccaagtaccagcacctgccttatatccagattctttctaccaaaagcactcccaccggtctctttggctattgggggaacaaaggaggcgttaacatttgccttaagctgtacggttactacgtgagcatcattaactgccacctacccccacacatatctaacaactatcagcggctggagcactttgacaggatcctggagatgcagaactgtgaaggccgggacatccccaacattctggaccacgatctgatcatctggtttggagatatgaatttccggatagaagattttggcttacacttcgtgcgagaatctatcaagaaccgttgctacggaggcctgtgggagaaggaccagctgagtatcgcaaaaaagcacgacccgttgctccgcgaattccaagaggggcggctcttgtttcctccaacctacaagttcgatagaaactctaacgactacgacacctccgagaaaaagcggaagccagcctggaccgaccggattttgtggaggcttaagaggcaaccatgcgccggccctgacacacctattcctccggcttcacatttctccctgtctttgaggggctatagtagccacatgacgtacggcatcagtgatcataagccagtctccggcaccttcgacctggagctgaagcccctggtctcagccccacttatagtccttatgcccgaagacttatggacagttgagaacgatatgatggtgagctacagttcaaccagtgattttccctcaagtccatgggactggattgggctgtacaaggtggggcttagagacgtcaatgactatgtgtcatacgcctgggtgggggactctaaagtgagttgttccgacaatctcaaccaggtttatatcgacatctccaatattcctacaactgaagatgaatttcttctgtgctactattctaactccctgcgttccgtagtgggcatatccaggcccttccaaatcccccctggatcacttagagaagatccactcggcgaagcccagccccaaatttag

SEQ ID NO: 25052 - DNA, 1752 bp, Artificial Sequence
  Description of Artificial Sequence: Synthetic coding sequence
atgctgagcgagagcaaggagggcgaggagaaggaggaggtgaccatggacacaagcgagaataggcccgagaacgacgtgcccgagcccccgatgcccatcgccgatcaggtaagcaacgacgaccggcctgagggatctgttgaggatgaggaaaaaaaagagagctccctacctaaatctttcaagaggaagatttctgtcgtatcagcaaccaagggcgtacctgctggcaatagcgacaccgagggcggccaacctggccgtaagaggcgatggggcgcgtcaaccgccaccacacagaagaaaccctcaatctccatcaccacagaaagtctcaaatctctcatcccggatataaagccgctcgcaggtcaggaggccgtggtggaccttcatgctgacgattcacgaatttctgaggacgagacagagcgaaacggggacgatggaacacatgacaagggtctcaaaatctgcagaacagttactcaggtggtaccggctgagggccaggagaatggacagagggaggaagaagaggaagagaaggaacctgaggctgaacctcctgtacctccccaggtgtctgtcgaggtggcccttcccccccctgccgagcacgaggtcaagaaggtgacactgggggacactttgacccgaaggagtattagtcagcagaaatctggagtttctatcaccattgacgaccccgtgagaaccgctcaggtcccatctccacccaggggaaagatctcaaatatagtacacataagtaaccttgtcagacctttcacacttggtcagctgaaggagctgcttggaaggacaggaaccctggtggaggaagccttctggattgataaaataaaatcgcactgttttgtgacttactccactgtggaggaggcggtagctacaaggacagctctgcacggtgtgaaatggcctcagagcaatccgaagtttttatgtgctgattatgccgagcaagatgagctggactaccatagggggctcctggtcgaccgaccgtctgaaacaaagactgaggagcagggtatcccacgcccacttcacccacctcctcccccacctgtgcagcccccacagcacccacgtgccgagcaaagagaacaggaacgcgccgtcagagagcaatgggcggagagggagagagagatggaacggcgcgagaggacacggagcgagcgtgagtgggaccgcgataaagttcgagagggaccacgcagtcggagtagatcgcgggataggcggcggaaagaaagagcaaaatccaaggagaagaagtccgagaaaaaagaaaaggcacaagaggagccacctgcaaagctcctcgacgatctgttccggaagaccaaagctgctccctgtatctattggcttccgctgacagatagccagatcgtgcagaaggaagccgagagggccgagagagctaaggaacgggaaaagagacgtaaagaacaagaagaggaggaacagaaggagcgcgaaaaagaagccgaacgagaacgtaatcggcagttagaacgcgagaaacgaagagagcactctcgagaacgggaccgtgaacgcgaaagagagagggagagggacagaggcgacagagaccgggaccgggagcgggaccgggagcggggcagggaacgcgatcgtcgtgacactaagcgccactctcggtccaggtcgagaagtactcccgtgagagatcgcggaggccggcgctag

SEQ ID NO: 25053 - DNA, 1329 bp, Artificial Sequence
  Description of Artificial Sequence: Synthetic coding sequence
atggccaacagcttcgccgcccggatcttcaccaccctgagcgacctgcaaacaaatatggcgaatctcaaagtgattgggattgtgatcggaaaaaccgacgtcaagggctttccggatcgcaagaacatcggttcagaacggtacactttttcattcactattagagattcacccgcacactttgtgaatgccgctagttggggtaacgaagactacataaaaagtctttccgacagttttagggtcggagattgtgtgatcatcgagaatccactgatacagaggaaagagatcgagcgtgaagagaagttttcgccagccactccctctaattgtaagctccttctctcggaaaatcactccacagtgaaggtctgttcctcctatgaggtggataccaaactgctctcactgatccatcttccagtaaaggaaagccatgattactacagcctcggcgatatagtagctaatggacacagcttaaacggaagaattatcaatgtgctcgccgcagtgaagagtgtgggagaaccaaaatacttcactacatctgaccgacgcaaaggacagagatgtgaagtgcggctctacgacgagactgagagttccttcgctatgacatgctgggataacgagtcaattttgcttgctcaatcatggatgcctagggagaccgtgattttcgcctccgatgttcggataaacttcgataaatttcgtaattgtatgaccgcaaccgtcatctccaagactatcattaccacaaatcctgacattcccgaggcaaatatcctgctgaatttcataagggaaaataaggagacgaatgtgcttgatgacgagatcgacagttacttcaaggagtctattaatctgtccacgatcgtggacgtctacaccgtcgagcaattaaaaggaaaagctctcaagaacgaaggcaaggcagacccgtcctacggaatcctttatgcctatatatcaaccttaaacattgacgacgagaccaccaaggtcgttcggaacaggtgcagctcctgcggctacattgtcaatgaggccagtaatatgtgtactacttgtaacaaaaattcgctggattttaaatcggtctttctctctttccatgttctgatcgatctcacggatcacaccgggaccctgcattcctgttcattaacgggctccgttgctgaagagacactgggctgcacattcgtgctgtcccacagagctcgctctgggcttaagatctccgtcctctcctgcaaactggccgaccctacagaggctagtaggaacctttcaggccagaaacacgtgtag

SEQ ID NO: 25054 - DNA, 627 bp, Artificial Sequence
  Description of Artificial Sequence: Synthetic coding sequence
atggccggcaccgcccggcacgaccgggagatggccatccaggccaaaaaaaaactgacaactgcgacagacccgatcgagaggttgcggctgcaatgcttagcacggggatccgccggcattaaaggtttaggacgggtcttccgcatcatggatgatgataataacaggacattggatttcaaagagttcatgaagggtttgaatgactacgctgttgtcatggagaaagaagaggtcgaagagttatttcgccggttcgataaggacggcaacggaaccatcgatttcaatgagtttctgttgacgctccgcccacccatgagccgtgctaggaaggaagttattatgcaggcattcaggaagctcgataagactggagatggagttatcaccatagaagacctccgggaagtatacaatgcgaaacaccacccgaagtaccagaatggcgagtggtcggaggagcaggttttccgaaagttcctagataactttgactccccctatgacaaggacggactggtgactcctgaggagtttatgaattattacgcgggggtatcagccagcatcgacaccgacgtgtactttataattatgatgagaaccgcctggaagctgtag

SEQ ID NO: 25055 - DNA, 627 bp, Artificial Sequence
  Description of Artificial Sequence: Synthetic coding sequence
atggccggcaccgcccggcacgaccgggagatggccatccaggccaagaagaagctaactacggctaccgaccccatcgagcgcctccggctgcagtgcttagccaggggtagtgctggcataaagggactgggacgagtgttccgcataatggatgatgacaacaataggaccctagacttcaaagaatttatgaaagggcttaatgactatgcagtggtcatggagaaagaggaggtggaagaactgttccgccgattcgataaggatggaaacggaaccatcgattttaatgagtttctgctcaccctgagaccccctatgtcaagggcacgcaaggaggtgattatgcaggcctttcgcaagcttgacaagaccggagatggagtgatcaccatcgaggatctgcgtgaggtctacaacgcgaagcaccaccctaagtatcagaatggtgaatggagtgaggaacaggtattccgcaagttcctagataatttcgactccccctatgataaagacggactagtgactccagaggagtttatgaattactatgcaggtgttagcgctagtatcgacactgatgtctatttcatcatcatgatgcggactgcttggaaactgtag

SEQ ID NO: 25056 - DNA, 789 bp, Artificial Sequence
  Description of Artificial Sequence: Synthetic coding sequence
cacagctacagcgagggcctgggccacccccgggtgagccaggccctggtgacctttcatcagcagaagccaattgagccaagacgcgagctcctgacacagccctgccgacaaaaagatccagccaacgtggattacgaagatctttttctttactcaaatgctgtcgcagaggaagctgcttgtccagtaagtgctcctgaggaggcttctcccaaacctgtgttgtgtcaccagtcaaaagagagaaagccctccgccgagatgaatcggatcacgaccaaggaagccacttcctcttgcccacccaaatcaccactcggggaaacacgccagaagttatggaggtctttgaaaatgcttcccgaacgaggacagagggtgaggcagcagaagagtcatctcgcaactgtgaacctgagttcacttctcgacgtgagaagaagcacagtgataagtgggcctggcacgggtaaagggagtcaggaccactccggggaccctacgtctggtgacagaggttatacagatccttgtgtcgccactagcttaaaatcaccaagccagccacaggcccccaaagataggaaggttccaactcggaaagctgagagatcagtcagctgtatcgaagtgaccccgggcgataggagctggcaccaaatggtcgtgcgcgccctttccagccaggaatctaaaccagagcatcagggattggctgaaccagagaacgaccagctgcccgaggaataccagcagccccctccatttgcacccgggtattgttag

SEQ ID NO: 25057 - DNA, 1941 bp, Artificial Sequence
  Description of Artificial Sequence: Synthetic coding sequence
atgagctacaccggcttcgtgcagggcagcgagaccaccctgcagtccacatacagcgatacttcggcccagccgacctgtgactacggttacggcacttggaactccggcaccaatagaggatacgaagggtatggttatggttacggctacggccaggacaacacgaccaattacggctatggcatggcaacctcacatagctgggaaatgccttcatccgatactaacgccaatacaagtgcgtccggcagtgcctcagcagattctgtcttatcccgcataaaccagaggctcgatatggtgcctcaccttgagaccgacatgatgcagggaggcgtctatggctccgggggggagaggtacgatagttacgagtcctgtgacagccgagcggttctgtcagaaagagatttgtacaggtctggctacgactattcagaattggaccctgagatggaaatggcctacgagggccagtacgatgcttatcgcgatcaattccgaatgcggggtaacgatacgtttggaccacgcgcccagggctgggcgcgcgatgccaggtcagggcgacccatggccagcggatacggcagaatgtgggaggacccaatgggggccaggggccagtgcatgtcaggtgctagtcggctgccttcccttttctcgcagaatatcattcctgagtatggaatgttccaggggatgcgcggtggaggcgccttccccggagggtcgagattcgggttcgggttcggaaatggcatgaagcagatgcggcgtacgtggaagacatggacgaccgctgatttcaggacaaaaaagaaaaaacgaaagcaggggggctcccctgacgaaccggatagcaaagcaactcgaacagactgctctgataatagtgatagcgacaacgacgagggtacagaaggagaagctacagaaggattggagggaacagaagcagttgaaaaagggtcgcgagtcgacggcgaagatgaagagggaaaggaggacgggcgtgaggaaggtaaggaggacccggaaaaaggcgccctgactacacaagacgaaaatggacagacgaagcggaaacttcaggctggcaagaagtctcaggataagcagaagaaacgacaacgggatcgcatggtagagaggatacagttcgtttgctctctgtgtaagtatagaacattctatgaagatgaaatggcgtctcatctggacagcaagttccacaaggagcatttcaaatatgtcgggacgaagctgccaaaacagaccgctgatttcctccaggagtacgtgaccaacaaaactaaaaagactgaggaactccggaaaaccgtggaggacctggacggcctgatccatcagatctatagagatcaggacttgacccaagagatcgcgatggagcacttcgtgaaaaaagtggaagcagcacactgcgcagcttgcgatctgtttatccctatgcaattcggcatcattcagaaacatctgaagaccatggatcacaaccgcaaccggagactgatgatggagcagtcaaaaaaaagctctctgatggtggccagatccatcctgaataacaaactgatatcaaaaaagctcgaacggtatttgaaaggagagaatccttttactgacagccctgaagaagaaaaagagcaggaagaagccgaaggcggggcactggacgagggagctcagggcgaggccgcaggcatatccgagggcgcagaaggagtgccagcccagccccccgtcccccccgagcccgctcccggcgctgtaagccctcccccaccacctcctcctgaagaggaagaagagggagccgttcccctcttggggggagctttacagagacagatccggggtatccccgggctggatgtcgaggacgatgaggagggggggggaggcgctccttag

SEQ ID NO: 25058 - DNA, 1401 bp, Artificial Sequence
  Description of Artificial Sequence: Synthetic coding sequence
atgcggggccccaacagcggcaccgagaagggccggctggtgatccccgagaaacagggattcgattttctctgtatgcccgtgttccatcctcggtttaaacgggaattcatccaggaacctgcgaaaaatcgccccggtcctcaaacaaggtcagatctgcttttgtccggacgggattggaatactctcatcgttggtaagctgagtccctggatccgtcccgattccaaggtggagaagattcggagaaacagtgaggcactggaagtacagtttattattacgggcacaaatcaccactccgagaaggagttctgcagctatttacagtacttagagtacctatctcaaaataggccacctcctaacgcttacgaactgttcgccaaggggtacgaggactatttacaatccccgctgcagcccctgatggacaaccttgagagtcaaacttacgaggtgttcgagaaagaccctatcaaatattctcagtaccagcaggccatttataaatgtctgctggaccgagtcccggaagaggagaaagataccaacgtgcaagtgctgatggtgcttggggccggcagaggtcccctcgttaatgcgtccctccgcgctgcaaagcaggccgatagacgcattaaattatatgctgtagaaaaaaatcctaacgccgtcgttacgctagagaattggcaattcgaagaatggggatctcaggtcaccgtagtttccagtgacatgcgcgagtgggttgcacccgagaaggccgacatcattgtaagtgagttgctgggaagtttcgcggacaatgagttgtccccagaatgccttgacggcgcacagcactttctgaaggacgatggagtgtctattccaggagaatataccagctttctagctccaatctccagttccaagctgtacaacgaggtaagagcctgccgagagaaggacagggaccccgaggctcagttcgagatgccttatgtcgtgaggctgcataactttcatcagctgtcggcgcctcagccatgcttcacatttagccatccgaatcgggatccgatgattgataataacaggtattgtacactggagtttcctgtcgaggtaaacactgtcttacacggttttgccggatatttcgaaacggtgctttaccaggacatcacattgagcattcgcccagagacccactcaccaggcatgttctcttggtttccaatcttatttccgatcaagcagcccattaccgtccgggaagggcagacgatctgcgtcaggttctggcgatgcagcaattccaagaaagtgtggtatgagtgggcagtgaccgcgcctgtgtgttccgccatccacaacccaacagggaggtcctacacgattggtctctag

SEQ ID NO: 25059 - DNA, 1863 bp, Artificial Sequence
  Description of Artificial Sequence: Synthetic coding sequence
atgcggggccccaacagcggcaccgagaagggccggctggtgatccccgaaaagcagggctttgattttctgtgcatgcctgtctttcacccacggtttaaacgagaattcattcaggaaccagcaaagaacagacccggccctcagacgcggtccgatctgcttctcagtggcagggactggaacaccttaatagtggggaaactctccccatggattagacccgattctaaagtggaaaagataaggaggaactctgaagctgctatgcttcaggagctgaatttcggggcctacctcggactccccgcatttctgctgccactgaaccaggaagacaacaccaaccttgccagagtactgaccaaccacattcacacaggacatcacagctctatgttctggatgcgggtccctctggtggctcccgaggaccttcgagatgatatcatcgagaacgctccaaccacccacacagaagaatatagcggagaagagaaaacatggatgtggtggcacaatttccgcactctctgcgattacagtaaaagaattgccgtcgcactggagataggagctgatctgcccagtaaccacgtgatcgaccggtggttaggcgaacctataaaggcagctattctcccaaccagtatttttctgaccaataagaagggattcccagtgttgagcaagatgcaccaacgcttaatcttccgcctgctgaagctggaagtgcaattcatcatcaccgggacgaaccatcactctgagaaagagttttgtagttacctccaatatcttgagtacctctcacagaaccggccaccccccaacgcctatgagctgtttgcaaagggctatgaggactatttacagagccccctgcagcctctcatggacaaccttgagagtcagacatatgaagttttcgaaaaagaccctatcaagtacagccagtaccagcaggcaatctacaagtgtttattagacagagtgcccgaggaagagaaggataccaacgtgcaggtactcatggtgttgggggctggacggggccccttggttaacgcttcactacgtgccgcgaaacaagctgatcggcggatcaagctgtacgccgtggagaagaatcccaatgccgtcgtcacactagagaattggcagtttgaggaatggggatcccaggtgaccgttgtgtcctccgatatgcgagagtgggtggcccccgaaaaggctgatatcatagtgagcgaactcctgggctcattcgctgataacgagctgtccccagaatgtcttgacggcgcccagcatttcctcaaggatgatggtgttagtattccaggagagtatactagcttcctcgcccctattagttcttcaaagctgtacaatgaagttagagcatgcagggagaaggaccgcgaccctgaagctcagttcgaaatgccttatgtggtgcgcctgcacaattttcatcagctttccgctccacagccatgttttactttctcccatccaaaccgtgaccctatgatcgacaataaccggtattgtactctggagttccctgtggaggtgaacacggtgctgcacggctttgccggttacttcgagactgtgttgtaccaagatatcaccctcagtattcgacccgagacccacagtcctggaatgttcagctggttcccaatcctgtttccaatcaaacaacctattacagtgagagagggacagactatatgtgtgaggttctggcggtgttccaattctaagaaggtctggtatgagtgggctgtcactgcgccagtttgctcagcaattcataacccaaccgggagatcttacacgatcggtttgtag

SEQ ID NO: 25060 - DNA, 2271 bp, Artificial Sequence
  Description of Artificial Sequence: Synthetic coding sequence
atgcccagcgtgagcaaggccgccgccgccgccctgagcggcagccctcctcagacagagaaaccgactcattacagatacctgaaagagttcaggacagagcagtgcccccttttctcccaacataaatgtgcccagcacaggccgtttacctgcttccattggcatttcctgaaccagagacgacggcgtcctctgaggagaagggacggcacattcaattactcgcctgatgtgtactgctctaagtacaacgaagcgactggcgtttgccctgatggcgatgaatctctgctaggagtgttatatcccctctgggcccccccccccgtccctgcccccgtgggcgctcccactgttcatcccttcctcgccaggtggtttagccatgtgccctgggagcctgccggctccgcagaccctagagccagctcaactcccgcaggcgggacaacatgggctaccggactgctgggagactttgacgcctgtggatcacagtccagagagtgtgtaaagggcgtctggtggactttgctaggattccgatgcccgtacctgcatcgcacaaccggagatacggaacggaagtaccacttgcggtactacaagactggcacatgtatccacgaaaccgacgcaagggggcactgtgtgaagaacggccttcactgcgcattcgcacacgggccattagacctgcgcccccccgtctgcgacgtgcgggaacttcaggcacaggaagcactccagaatggtcagctaggaggcggagaaggagttcccgatttgcaacccggcgtactggctagtcaggccatgatcgagaaaatactgagcgaggatccccgctggcaggcattgctgcccgtagcgctactgcggcaccgagtggcgcacttttcggacgcaaattttgtcctcggaagctacaagaccgaacagtgcccaaagccgccaaggctgtgcagacaggggtatgcttgcccccactaccacaatagtagggaccgccgcagaaatcccaggcgattccaataccgcagcacaccatgccctagtgtgaaacacggggacgagtggggcgagccttcacgctgcgatggcggtgacggatgccagtattgccactccagaactgaacagcaattccatcccgagggcccagttgggagccctgtgtcgggcgccttctcggttttttcacatgcaggactagtggctgacccatctctgtggtaccccgccgagtggagctggcatcatgtggggcacagccggacaattaaccccgagggggataaaccttctcgccttggccccgctccagaaaacattaagcgcggcaatgatttcgcctgcgatggacgcgcagacgctgcaggaatggccccacacgtgtgtgtcttccccatctacaaatccacaaagtgtaatgatatgagacagactggctactgccctcggggacctttttgtgcttttgcccacgttgagaagtccttaggaatggtaaatgagtgggggtgccatgacctgcacctaacaagcccttcaagcacagggagcggccagcccggaaatgccaagagacgggattcccctgcggagggagggccccggggaagcgagcaggactctaaacagggagtgcgggcccatggagtctacgtgttcgagcagaaccacctagctgtgttcgctgcagtgcatcctccagcaccatccgtttcatcttcagtagcatccagcctggcatcatctgctggatcaggctcatctagccccaccgcactcccagcgccccctgccagggctctgccactgggtccagcctcttctactgtcgaggctgtgttggcccttgagcccacaccctcttcccctactagctccgcagtacagggcgttgctggcgagctggggatgggttccggagggcagggctgttggtctcacgtggttggcgccctggcggcagttcccgcttggactcacagcggggacctcgaatgggatcctagcacaattaggaccagagtaaatgtgggtggcgggcccgctgcaagacccgcaatgaccctggcccgtgaaccccagctcttggtggtgggtggatgtcccacccggaattgttccggcccagctgcgagccctcagcagctgctcgatgacgccggccaggggggccgcggcgaacgagactcctctcaaaggcccctgcgcccacagactacccacagacaagatacaaggccggtgccatcttag

SEQ ID NO: 25061 - DNA, 549 bp, Artificial Sequence
  Description of Artificial Sequence: Synthetic coding sequence
atgacccccccccagcagcccccccccctgcggagcgagcccggcaccctcgggagcgccgccagcagctacagtcctttgggacttaacggggtacctggcagcatctgggactttgtgtccggatccttttctccgagccccagcccgattttgtccgctggacctcccagctcaagctcggcctctccgaacggtgccgagcttgcacgcgttagacgccaactggacgaggccaaacgcaaaattagacagtgggaagaaagttggcagcaagtgaaacaggtctgcgacgcctggcagcgcgaagcccaggaagcgaaagagagggctcgggtggcggattcggataggcagctcgccctgcagaagaaggaagaggtcgaggcgcaggtgatctttcagctgagggctaagcagtgcgtcgcatgcagagaacgcgcccacggagccgttctacggccatgccagcaccacatcttgtgcgaaccctgcgctgccacagccccagaatgcccgtactgtaaaggacagccactccagtggtag

SEQ ID NO: 25062 - DNA, 444 bp, Artificial Sequence
  Description of Artificial Sequence: Synthetic coding sequence
atggagggcgagcccccccccgtggaggagcggcggcggctgcaggaggaactgaacgagttcgtcgaaagtgggtgccggactctcgaagaagtgacagcttcgttagggtgggacttggactccctggatcccggtgaggaagaggcggccgaggacgaggtggtgatctgtccatacgattctaaccatcacatgccgaaatcatcactggcgaaacacatggccagctgcagactgcggaagatgggctacactaaagaagaggaagatgaaatgtacaacccggaatttttctatgagaacgtcaagattccatctatcactctgaacaaagatagccagtttcagatcatcaaacaggcacgaaccgctgtcggaaaagactcagattgttataaccagattatcggcgtctccatcaagagaaattacaagatctag

SEQ ID NO: 25063 - DNA, 522 bp, Artificial Sequence
  Description of Artificial Sequence: Synthetic coding sequence
atgggcaccttcgacctgtggaccgactacctgggcctggcccacctcgtgcgagcactgtcaggaaaagaggggcctgagacccgcctgagcccccagccggaacccgaacccatgctggaacccgaccagaaacggtcattggagtccagcccagcccctgagagactctgctcattttgcaagcacaatggcgaaagccgagccatctaccagagtcatgttttgaaggatgaagctggaagggttctgtgcccgatcctcagggattacgtctgtcctcaatgtggagccactcgggagagggctcacacccgacgtttttgcccactgaccgggcagggctatacttcagtttacagccacacgacaaggaactccgccggaaagaagctggtacgacctgataaggccaagacacaggacacaggacaccggcgcgggggggggggcggtgccgggttccgcggtgcaggtaagtcagaaccttccccttcttgctcaccttccatgtctacttag

SEQ ID NO: 25064 - DNA, 1722 bp, Artificial Sequence
  Description of Artificial Sequence: Synthetic coding sequence
atgagcgccttctgcctgggcctggtgggccgggccagcgcccccgctgagcccgactctgcttgttgtatggagctgccagccgcggcaggcgatgcggtcagatctcctgcggctgctgccgccttaattttccctggcgggagcggcgagcttgaactcgctcttgaggaggagctggctctgctggctgcaggggagcgtccaagcgacccaggagagcacccacaggcggagcccggcagcctcgctgagggcgctggtccccagcccccccctagccaggaccctgaactgttaagtgtcatccgacagaaggaaaaggatcttgtattggcagctcggctgggaaaggcactcctggaaagaaaccaggatatgtcacgccaatacgagcagatgcacaaggaattgacagacaaactggagcatctcgaacaggagaagcatgagttacggcgcaggtttgagaaccgtgagggggaatgggaggggcgcgtgtcggagctcgagagcgacgtgaagcagcttcaggatgaactagaacggcaacaaattcacctgagagaggccgatcgcgaaaaaagccgagcagtccaagagttatctgaacagaaccagaggctgctggatcagttgtctagagcaagcgaggtggagcgacagctgtctatgcaggtacacgcattgcgtgaggacttccgggagaagaatagcagcaccaatcagcatatcattcgactggagagcctccaagcagaaattaagatgctctcagatagaaagagggagctggagcatcgtctgagtgcaactttggaggagaacgacttgctgcaggggaccgttgaggaattacaagaccgtgtgcttatcctcgaaaggcagggccatgataaggacctccagctgcatcagtcacagctggagctacaggaggtaaggctcagctgtcgccaactgcaggttaaagtggaggagctgacggaagaacggagcctgcaaagctcagccgcgacttccactagcctgttgagtgagatcgaacaaagtatggaggccgaggagttggagcaggaaagggagcagctcagactgcaattatgggaagcctattgccaagtgcgatacctgtgctctcatcttaggggcaatgatagcgccgactccgctgtttctactgactctagcatggatgagtcaagcgagacaagctccgcaaaggacgtcccagctgggtccctgagaaccgccttaaacgagctgaagcgcttgattcaaagtatcgtggatggtatggaaccaaccgtaaccctgctttctgtcgagatgacagccttaaaagaggaacgtgatagactgcgggtgaccagcgaagacaaagaacccaaggagcagttgcaaaaagctattcgggaccgcgacgaggccatcgcgaagaagaatgccgtagaactagagcttgcaaagtgcagaatggatatgatgtccctgaattctcagctgcttgacgccattcaacagaagctgaatttatctcagcagctggaagcttggcaagacgatatgcaccgcgtcatcgacagacagctgatggatacccacttgaaagagcggagccagcccgctgcagctctttgccggggtcactctgcaggccgcggcgatgaaccatccattgctgaaggcaagagactgttctccttcttccggaagatctag

SEQ ID NO: 25065 - DNA, 1086 bp, Artificial Sequence
  Description of Artificial Sequence: Synthetic coding sequence
atggccctgaacgtggcccccgtgcgggacaccaagtggctgaccctcgaggtgtgtcgccaatttcagcgaggcacgtgttccaggtccgacgaagagtgtaaattcgctcatcctcccaaaagctgtcaggtagagaacgggcgagtgattgcttgtttcgactcactgaaggggcgctgctcacgggaaaattgcaaatatctccacccgcccacccacctgaaaacccaactggagattaatgggaggaacaatctgatccaacagaagacagccgctgctatgctcgcccagcagatgcagtttatgttcccaggaacccctcttcacccagtccctacctttcctgtgggccccgcgataggcaccaacaccgcaatctcgttcgcaccgtacctcgcccccgttacccctggagtcggtttggtgcctactgagattctgccgactactcccgttattgtccctggttcaccccccgtgacagtcccgggatccacagctacacaaaagctactgcgcacggacaagttagaggtctgtagggaattccagcggggcaactgtgcacggggagaaactgactgccggttcgcacaccccgcagacagcactatgatagatacctcagataatacagtgaccgtgtgcatggattacatcaagggaaggtgtatgagggagaaatgcaaatatttccacccgccagctcacctgcaagcaaagattaaggctgcacagcaccaggccaaccaggccgcagtcgctgcccaagccgccgccgctgcggccacagttatggcattccccccgggggccctgcaccccctgccgaagagacaggccctcgagaagtctaatgggacaagcgccgtgtttaatccgtctgtgctgcattaccaacaggcattgacctcagcgcagctccagcagcacgccgccttcataccaacagacaattccgagattattagcagaaatgggatggaatgccaggaaagcgctcttcgtatcactaaacattgttactgcacttactatcccgtgtcctcatccatcgaactcccacaaacagcatgctag

SEQ ID NO: 25066 - DNA, 3099 bp, Artificial Sequence
  Description of Artificial Sequence: Synthetic coding sequence
atggccttcaccaactacagcagcctgaaccgggcccagctgaccttcgaatacttgcacacaaactcgaccacccacgagtttctgttcggggctctggctgagctcgtggataatgcacgcgacgctgacgctacgaggatcgacatctatgcagagcggcgagaggacttgaggggcggcttcatgctgtgtttcttagacgacggcgctggcatggacccctctgatgcagctagtgttatccagttcggcaaatctgccaaacgaacgcccgaatcaacccagatagggcaatatggcaatggcctgaaatcaggatctatgcgcattggaaaggatttcatactcttcactaaaaaagaggacacaatgacctgcctgtttttgtcacgaacatttcacgaggaagagggcatagacgaggtgattgtccctttacccacttggaatgcccgaacaagagaacccgtgactgataacgtcgagaagttcgcaattgaaaccgagttaatttacaagtattctcctttccgcacggaggaagaggtgatgacccagttcatgaagatccccggagattcaggaacactcgttattatctttaaccttaagctgatggacaacggagaaccggaactggatatcatttctaaccccagagatatccaaatggccgagacctctccagagggaaccaagccagaaaggcgttcttttagagcatatgctgcagtgctctacatagatcccaggatgcgaatcttcatccacggacataaggtacagaccaagcgactatcatgctgtctttacaaacctcgcatgtacaaatatacctctagtaggtttaagacccgagccgaacaagaagtgaaaaaagcagaacacgtggcccgaatcgctgaagagaaggccagggaagccgaatccaaagcccgcaccttggaagtgaggctgggcggagacctgaccagagactcccgcgtgatgctgcgccaggtgcagaacagagcaattaccttgcggagagaggcagacgtgaaaaagcggattaaagaagcgaaacagagggctctcaaggagcccaaggaattgaactttgtctttggcgtaaacatcgaacaccgtgacctagatggaatgtttatttacaactgtagcagactcatcaaaatgtacgaaaaggtaggcccacagctcgaaggtggaatggcatgcggaggagtcgtaggcgtggtcgacgtcccatatttagtgctggaaccaacccacaacaagcaggattttgctgacgcgaaagaatacagacaccttcttcgcgctatgggggaacacctggcgcagtactggaaagatattgccatcgctcagcgcgggattataaaattctgggacgagtttgggtatttaagtgccaactggaaccagcccccctcctccgagctccgttataaaagacgtcgcgccatggagatccccaccaccattcagtgcgacctctgtctgaaatggagaacacttccattccagctgtccagcgtcgaaaaagactacccggacacttgggtgtgcagtatgaaccctgaccctgagcaggataggtgtgaagcttccgaacagaagcagaaggttcccctgggcacattccgcaaggatatgaagacacaagaggagaaacagaaacagcttacagagaaaattcgtcagcagcaggagaagcttgaggccctgcagaaaacaactcctataagatcccaggcagatctgaagaagctgccattggaagtaaccacaagacctagcacagaagaacccgtgagaagacctcagcgccctaggagcccaccactcccggcagtgatcaggaatgcaccctctagacccccctcactgccaacccctagaccagcaagccaacctaggaaagcaccagtgatctcctccaccccaaagctccctgctttggccgctcgggaggaggccagtacttcacgcctgcttcagccacctgaggcccctcgtaagcccgccaacaccctcgttaagacagcctctcgccccgctccactggtccaacagctgagcccaagcctgttgcccaattcaaagtcacccagggaagtccccagtccgaaagttattaagacacccgtggtcaaaaagacagaatcgccaataaagctcagcccagcaacgccaagccggaaacggtcggtagctgtgtccgatgaggaggaggtggaggaggaagctgagcgtcgcaaagagcgttgtaagcgcgggcgattcgtggtcaaggaggagaagaaagattctaacgagttaagtgattcagcaggggaagaggattccgcggatctgaagagggcccagaaggataagggcctgcatgtggaggtgagagtaaatcgggagtggtataccggccgggtgacagccgtggaggtgggtaagcacgtcgtgcgctggaaggtgaaatttgattatgtgcccacagataccacacccagggatcgctgggtggaaaagggcagcgaggatgtgagattaatgaaacctccctctcccgaacatcagtctcttgacactcagcaggaaggcggcgaggaggaggtgggccccgtcgcgcagcaggccattgccgtggcagagccatcaacatccgagtgtttacgtattgagccagacacaactgccctgagcacaaatcacgagaccatcgacttattagtgcagatcttgaggaactgtctccgctatttcctgcctccttcgtttccgataagtaaaaagcagctgtcagctatgaactctgacgagctgatatcgtttccactgaaagagtatttcaaacagtatgaagtgggtctgcagaatttgtgcaacagctaccagagtcgagcagactcccgagctaaggctagtgaggagtccctgagaacgtccgagcggaaactgcgtgagaccgaggagaagctccagaagctgaggacaaatattgttgcgctcctccagaaggtgcaggaagatatcgacatcaatacagatgatgagctggatgcatacatagaggacctcattacaaagggcgactag

SEQ ID NO: 25067 - DNA, 5943 bp, Artificial Sequence
  Description of Artificial Sequence: Synthetic coding sequence
atgaaccccaccaaccccttcagcggccagcagcccagcgccttctcagcatcctcctctaatgtgggtacactacccagcaagccccccttccggttcggtcagccaagtttgttcggacaaaattccacactatctggcaagagctctggtttcagccaagtgagttcattcccagccagctctggtgtaagccactcctctagcgtccaaacgttgggctttacacaaaccagctccgtgggacctttttctgggttggagcacacatccacattcgtggctacgtcaggtccatcatcatcaagcgttctgggcaacaccggatttagtttcaaaagccccacttctgtaggagcgttcccttctactagtgcgttcggccaggaggcaggggaaattgtgaactcaggcttcggcaagaccgagttctcttttaaaccgctggagaatgccgtctttaagccaatcctgggagctgaaagtgagcccgagaagacgcagtctcaaattgcctcgggcttcttcaccttttcccatcctatttcaagcgctccaggaggcctagcaccattttcatttccgcaagtaactagttcgtcagccaccacctctaactttacattctccaagccggtctcttccaacaacagtctttcagcctttacccctgcactgtcgaaccagaacgttgaggaagagaaacgtggcccgaaaagtatcttcggcagcagcaataattcctttagctcattccccgttagtagcgctgttctgggagaaccttttcaagcctccaaagccggcgtaaggcagggatgcgaggaggccgtgagccaggttgagccactcccatctctcatgaaaggcttgaagcgaaaagaagatcaggatcgatcccctcggcggcatgggcatgaaccagcagaagatagtgatccgctcagtagaggagatcacccgcctgacaaacgacccgtgcggctaaacagaccaagaggtggtacactgttcggacgcacaatacaagatgtctttaagagcaacaaggaagtgggccggttgggcaataaagaggctaaaaaggaaacgggcttcgtggaaagcgccgaatcagaccatatggccattccaggtggcaaccagtcggtgctagccccttcacggattcctggcgtgaataaagaggaggagaccgagagcagagagaaaaaggaagatagtctgcgaggcacccccgcgagacagtccaaccggagtgaaagtaccgacagcctgggtggacttagcccgagcgaagttaccgctatacagtgtaagaatatacccgattatctcaatgaccgcactattctggagaaccattttggtaagatcgccaaggtgcaacggatcttcacacgacggtctaagaagttggcggtcgtccacttttttgaccatgcctccgccgccctggcacgtaaaaagggcaaatctcttcacaaggatatggctatattctggcacagaaaaaaaatttcacctaacaagaaacctttttctctgaaagaaaagaagccaggcgatggagaagtatcacccagcacagaggacgcaccttttcaacattctccattgggaaaggccgctggccgcacgggggcgtcttcactgttaaataagtcttctccagtgaaaaagccctctctgctcaaggcacatcagtttgagggagacagcttcgactccgcttctgagggcagcgaaggccttgggccgtgcgtgctgtccctttccaccctcattggaactgtcgctgagaccagcaaggagaaatatcgccttttggaccagagagacaggatcatgcgacaggcgcgggtgaagaggactgatctggataaggctcgtacatttgtgggaacgtgcctcgacatgtgccccgaaaaagaacgttacatgagagagactcggtcacagctgtccgtgttcgaggtagtgcctggcacagatcaggtggaccatgcggcggccgtgaaggagtattcacgtagttctgcagaccaagaggagcccctgccacacgaactcagacccctgcccgtcctgtcccgcaccatggactacctggtcacccagatcatggatcaaaaagaaggatccctgcgtgactggtacgattttgtatggaacaggactcggggtatccgaaaggacattacacagcaacacctgtgcgaccctttgacagtatctttgattgaaaagtgcacccggtttcatatccattgtgcccatttcatgtgcgaagagcctatgtcctcgttcgatgcgaagataaataatgaaaacatgaccaaatgtcttcagagccttaaggaaatgtatcaggacctgcgcaacaagggggtcttctgtgcgagcgaggcggaattccagggttataatgttctgctgagtctcaacaaaggtgatattctgagagaggtgcagcaatttcatcccgcggtgcgaaatagctccgaggtgaagtttgccgtgcaggcctttgctgccctaaactccaacaactttgttcgcttctttaagttggtacagagcgcttcctacctgaatgcgtgtctattacattgctatttctctcagatcagaaaagatgccctgagagcactgaattttgcatatactgtgtcgacccagcgctccacaatctttcccttagatggagtggtgcgcatgctgctatttcgagactgcgaagaggctacagacttcttaacatgccacgggttgacggtatcagatggttgtgtggagctcaacaggtctgctttcttggaacctgaggggctgtccaaaacacgaaagtcagtgtttataactcgaaagcttaccgttagcgtgggcgagatcgtgaacggtggacctttgccgcccgtgcccagacacactcctgtctgctcgtttaatagccagaataagtacataggcgagtcgttagccgctgaacttcccgttagtacccagcgtccaggatcagacacagtagggggcgggaggggggaagaatgtggagtcgaaccagacgcccccctgagctccctgccacaatccttgcctgcacccgctccaagccccgtgcctctccctcctgtgctggcccttacccctagcgtagccccatctttattccagcttagcgttcagccagagccaccaccccccgagccagtccctatgtactctgacgaagatttagctcaagtcgtggacgagctgatacaggaggctctgcaacgggactgtgaagaggttggcagcgccggggcagcctacgcggcagccgctttgggcgtgtctaacgctgccatggaagaccttctcacggccgctactacaggaatcctgcgccacattgctgctgaagaagtctcgaaagaaagagagcgcagggagcaggaacgtcagagggccgaggaagaacgcctgaaacaggaacgcgaactcgttctgagcgaactgtcgcagggccttgctgtggaactcatggaacgtgtgatgatggagttcgtgagggagacttgctcccaggagctcaagaatgctgtggaaactgaccaacgtgtgagagtagctaggtgttgtgaggacgtctgcgcacatctggtcgacctgtttttagtggaagaaatcttccagactgctaaggaaacactgcaggaactgcagtgcttttgtaaatacctgcagcgatggcgcgaagctgtgacagcccgcaagaagctccgacgtcaaatgagagcctttcccgcggctccgtgttgtgttgatgtctcggatcgtctgagggctctggcaccttctgctgagtgtccgatcgccgaagagaaccttgccagggggctcctggacctaggtcatgcaggccgtctcggcatctcatgcaccaggctccgcaggctgagaaacaagacagctcatcagatgaaagtgcagcacttttaccagcaactgctctccgacgtggcctgggcgagtctggatctgcccagcctagtggccgaacatctcccaggcaggcaggagcacgtcttctggaaactcgtgctcgttttaccggatgttgaggaacagagtcctgagagttgcggcagaatactggccaattggctcaaagtcaagttcatgggcgacgagggatccgtcgatgacacctcctcagacgcaggggggattcagaccctttcgctgtttaatagcttgagctccaaaggtgaccaaatgatcagcgttaatgtttgcattaaggtcgcccacggtgccctttctgatggggccatagatgccgtggagacccagaaagacttgttaggcgccagcggcctgatgctgcttttacctcccaagatgaagtccgaagacatggccgaagaggacgtgtactggctctccgcgcttctgcagctcaagcagctcttgcaggctaagcctttccagccagccttgcctctggtggtccttgtcccatcacctggcggagacgccgtcgagaaagaagtagaggacggattaatgcttcaggacctggtgtcagccaagctgatctccgactataccgtcacagaaatccccgatacaatcaacgacctgcaggggagcactaaggtcctgcaggctgttcagtggctggtgtcgcactgtccgcactccctagatttgtgctgtcagaccctcattcaatacgttgaagacggtattggacacgaattcagcgggcggtttttccatgaccggcgcgaaagacgccttggaggtcttgcttctcaagagcctggagcaattattgagctctttaactccgtgcttcagttccttgccagcgtcgtctcctccgagcagctttgtgacctgtcttggcccgtgacagaatttgccgaagcaggcggcagcaggttactaccacacctacactggaatgcccccgagcaccttgcctggcttaaacaggccgtcctgggcttccagttgccccagatggacctgccccccctgggtgccccatggttaccagtgtgcagtatggtcgtccagtacgcaagccagatcccttcttcacgccagactcagccagtgctccaatctcaggtggagaacttgctccaccggacatattgcaggtggaagtctaaatctccttcaccagtacatggagctggacccagcgtgatggaaataccttgggacgacttgatcgcgttgtgtataaaccataaactccgcgattggacccctcctcgactgcctgtaacttccgaagccctttccgaggacgggcagatctgcgtttattttttcaagaacgacctcaagaaatacgatgtccccttgagctgggaacaagcccgcctccaaacccagaaggagctgcaactgcgagaggggcgtctggctatcaaaccatttcatccgtcggctaacaatttcccaatcccactcttgcacatgcaccgcaactggaagcgtagtactgaatgtgcccaggagggcagaataccgtctacagaagatctgatgcgcggggcctccgcggaggagctgctggcacagtgtctttcttccagtctcctcctagaaaaagaagagaataaacggtttgaagatcagctgcaacagtggctcagcgaggattctggcgcctttactgacttaaccagcctgcctttgtaccttccacagaccctggtgtccctgtcccatacaattgagcccgtgatgaaaacctcggttaccacaagcccccagtccgatatgatgagggaacagctgcagttgtccgaggcaactggcacgtgcctcggcgagcgcctcaaacacctggagagactcatccggagttccagggaagaggaggtagcaagcgagcttcatctgtctgccctgctggacatggtggatatttag

SEQ ID NO: 25068 - DNA, 513 bp, Artificial Sequence
  Description of Artificial Sequence: Synthetic coding sequence
atgggcaagcggtacttctgcgactactgcgaccggagcttccaggacaatctacataacagaaagaagcatctgaacggcctgcaacacttaaaggctaaaaaagtttggtacgatatgtttcgggacgctgcagccatcctgctagatgagcaaaacaaaaggccttgccgcaagtttctcctgaccggccaatgtgattttggctcaaattgtagattcagccatatgtccgaacgggacctgcaggaattgtccattcaggtggaggaagaaagaagggcgcgggaatggctgctagatgcgccagagctccccgaaggtcacctcgaggactggctcgaaaagcgggcaaaaaggctcagctcagcaccttcctctcgggccgagcccatccggaccactgtgtttcagtatccagtgggctggccccctgtccaggagcttcctccatcgctgcgtgccccaccgccaggcgggtggccactacagccaagagtccagtgggggtag

SEQ ID NO: 25069 - DNA, 291 bp, Artificial Sequence
  Description of Artificial Sequence: Synthetic coding sequence
atgtgccacaccagctgcagccccgcctgccagcccacctgctgcatccacagtccttgccaggctagttgctacgtaccggtttcttgccaaagctcggtctgcatgcccgtgagctgcaccagaatcgtgtgcgtagcgccatcgtgccaacctagtgtttgtgtgcctgtgagttgtaggccaatcatatacgtcactcctagctgccaaagttctggctgttgtcagccgccttgcacaacagcactctgcaggcctatctcatgctctacccccagctgctgttag

SEQ ID NO: 25070 - DNA, 879 bp, Artificial Sequence
  Description of Artificial Sequence: Synthetic coding sequence
atggccgccagcaccatgagcatccggagcagcgcctacagcgactcttggcaggtggatgattgtcctgagtcttgctgcgaaccgccatgctgcgctacctcatgctgtgcccccgctccatgcttaacccttgtctgtacacccgtgtccagagtgtcaagcccatgttgccaggttacttgtgagcctagcccgtgtcagtccggctgtacttcatcttgcacaccatcgtgctgccaacagtcctcctgccagcccgcctattgcaccagctcaccatgtcagcaggcttgctgcgttcccgtctgttgcaagccggtgtgctgtgtgccagtttgctgtggcgctagcagctgttgccaacaaagcagttaccaaccggcgtgctgtgcgtctagttcatgccagccagcttgttgtgtgcccgtttgttgcaagcccgtgtgttgtgccccgacctgttcagaggactcatatagctgctgccagcagagttcatgtcagcccgcctgttgcacatccagcccttgtcagcagtcctactgtgtgcccgtctgctgcaagccagtttgttgtaagccgatatgttgcgttcctgtgtgctcaggcgcaagctcgttgtgctgtcagcagtctgggtgccaacctgcgtgttgtaccacttcctgctgtagaccatcatcttctgtgagtctgctgtgtaggccagtgtgtcggccagcatgctgtgtccctgtgagctcctgttgtgcccccacgtcctccagacagccatcttattgtcgccaggcctcgtgcgtgtctttgttgtgccgccctgtgtgctccaggcccgcgtgttactctttttcctcagggcagaagtcctcatgttag

SEQ ID NO: 25071 - DNA, 1608 bp, Artificial Sequence
  Description of Artificial Sequence: Synthetic coding sequence
atgaagaagatcagcctgaagaccctgcggaagagcttcaacctgaacaagtcaaaggaagaaactgatttcatggttgtccaacaaccttctttggcttctgacttcggtaaagatgactcactttttggctcatgttatgggaaagatatggcgtcatgcgacattaatggggaggacgagaagggcggcaaaaaccggtccaaaagcgaatccctcatgggaacactgaaacgacggctatcggccaaacagaagtcaaagggtaaggccggaactcctagcggctcctcagctgatgaggatacattcagttccagctcagctccgatcgtgttcaaagatgttagagctcagaggcccattcgaagtacgagcttgaggtctcaccactacagtccagcgccctggccccttcggcccaccaatagtgaagaaacatgtatcaagatggaagtccgggtgaaggcactcgtgcactcctcctctccgtcacctgctctgaatggagttagaaaagactttcatgacctgcaatcggagaccacctgccaggagcaggctaattccttaaagagttcagcttctcataatggtgacctgcatcttcaccttgacgaacacgtgccagttgtgataggattgatgccacaggactacattcagtacactgtgcccctcgatgaagggatgtacccactggagggaagtcggtcctactgtctcgacagtagtagtcccatggaagtttccgccgttcccccacaggtgggtggcagggcatttcccgaagatgagagtcaggtggatcaggaccttgtggtggcccctgagatctttgttgaccagagtgtaaatggacttctgattggaacaactggcgtgatgttgcagtcgccccgtgctgggcacgatgacgttccacccctctctccattactgccccctatgcagaataatcagattcaaaggaacttctccggactcaccggtaccgaagcacacgtggccgagtcgatgcgctgccaccttaactttgaccctaattctgcaccaggagtcgctcgcgtgtatgacagtgtccaatcctccggcccgatggtagtgaccagccttacggaggaactgaagaagctggccaagcagggttggtattggggcccaatcacccgttgggaggccgagggcaagctagccaacgtgccagacggttcttttcttgtgcgcgattcttccgacgatcggtacttgctctcactgtctttccgcagccacggtaaaacgctgcataccagaatcgagcactccaatggaaggttctccttctatgaacagcctgatgttgaagggcacacgagtattgtggacctgatcgaacattcaattcgcgactctgaaaatggcgcattctgctactcccggtcacggctgcccggtagtgctacttatcctgtaagactgaccaatcctgtaagccgttttatgcaggtcagatcacttcaatacctatgccgatttgtgattcgccaatacacgcgcattgacctcattcagaaactgcccctacccaataaaatgaaggactatctgcaggaaaagcactattag

SEQ ID NO: 25072 - DNA, 1260 bp, Artificial Sequence
  Description of Artificial Sequence: Synthetic coding sequence
atggccgccagcagcctggagcagaagctgagccggctggaggccaagttgaagcaggagaaccgggaggccaggcgccggatagatctcaacctggacatctcaccccagcgtccccgtccaacgttacaacttcccctggctaatgatggaggttcaaggagcccctcctcagagtcttcaccacagcaccctacaccccccgctcggcctagacacatgctcggactgccttccacactcttcaccccaaggtcaatggagtccattgagattgatcaaaagctgcaggaaattatgaaacagaccgggtatctgaccatcgggggccagcgctaccaggctgagatcaatgatctagagaacctcggagaaatgggtagcggcacatgcgggcaggtttggaagatgaggtttagaaagaccgggcacgtcattgccgtgaaacaaatgcggagatcgggcaataaagaggagaacaagcggattctgatggacctggacgtggttctcaagagccatgactgcccctacatagtacagtgctttggtacattcatcaccaacaccgacgtgttcatcgctatggaactgatgggaacgtgtgccgagaaactcaaaaagcgaatgcagggaccaatccccgaaagaatactcggcaagatgacagtggcgatcgttaaagccttgtattacttgaaagaaaagcacggcgtgatacacagggacgttaaacctagtaatattctgcttgacgaaaggggacagattaagctttgcgattttggaattagtggacgtctggtggattctaaagcaaagacccggagtgccggatgcgcggcttatatggcaccagagcgcatagaccctcctgatcccacgaagccagattatgatatccgtgccgacgtctggtcactcggtattagtctcgtggagcttgctaccggccagtttccatacaaaaactgtaagaccgattttgaagtgctgaccaaggtgctgcaggaagaaccacccctgttacctggccacatgggattctccggggactttcagagctttgttaaggattgtcttactaaagaccaccggaagaggccgaaatacaacaaactgctcgagcacagtttcatcaaaagatacgagaccctggaagtggatgtagccagctggtttaaggacgttatggcgaagacggagtctccacgcactagtggtgtgctgtctcagcctcatctgccttttttccgctag

SEQ ID NO: 25073 - DNA, 963 bp, Artificial Sequence
  Description of Artificial Sequence: Synthetic coding sequence
atgagcaagagcgccagccccaaggagcccgagcagctgcggaagttgtttatagggggccttagtttcgagaccacagatgaaagtctccgctcccatttcgaacagtggggtacactgactgattgtgtagtgatgcgcgatcctaatactaagcgttcccgcgggtttggcttcgtaacatacgcaactgtcgaggaggtggatgccgccatgaacactaccccacataaagtggacggtcgagtggtggagcctaagcgtgctgtgtccagagaggatagccaacggcccggcgcccacctgaccgtgaaaaagattttcgtgggcgggataaaggaggataccgaggagcatcacctgagagactacttcgagcagtatgggaaaatcgaggtgatcgaaataatgactgatcgcggtagcggaaagaagagaggctttgctttcgtgactttcgacgatcacgatagcgtggacaagattgtcattcagaaatatcacactgttaaggggcacaattgcgaagtgcgaaaggccttgccaaagcaggagatggcctccgcctcttcaagtcagcgtggtcgtagggggagcggcaactttggaggcgggagaggggacgggttcgggggaaatgacaactttgggcgagggggcaatttcagtggtagaggcggttttggcggatcctgtgggggcggaggctacggaggctccggtgacggctataatggattcggaaacgacggaagtaacttcggggggggaggatcttataatgatttcggaaattacaataaccaatcaagcaacttcggccccatgaagggcggaaactttgggggtcggagttccggcccctacggggggggcggtcagtacttcgcaaagccacaaaatcagggcggctacggagtctcatccagcagctccagttacgggtcgggccggagattttag

SEQ ID NO: 25074 - DNA, 1737 bp, Artificial Sequence
  Description of Artificial Sequence: Synthetic coding sequence
atggagctggagaacatcgtggccaacagcctgctgctgaaggccagacagggaggatacggaaaaaaaagcggcaggtctaaaaaatggaaggaaatcctaaccctgccacctgtcagccagtgtagcgaactgcgccatagcattgagaaggattactcttccctctgcgacaaacagcctatcgggcggcgcctgtttcggcagttctgtgatactaaacccactctgaagcgacatatcgaatttctcgatgcagtcgctgagtacgaagtagcagacgacgaagaccgatctgattgcgggctgtcgatactggatcgctttttcaacgataaactggctgccccgttacccgagatcccccccgatgtggtcactgagtgtaggctgggtttgaaagaggagaatccaagcaagaaggccttcgaagaatgcacaagggtggcccataactacctgcgcggggaaccattcgaagaataccaggagtcttcttactttagtcagttccttcagtggaaatggctggagcgccaacctgttaccaaaaacactttcagacattacagagtccttgggaaaggggggttcggcgaggtttgcgcatgtcaggttcgggctacggggaagatgtatgcctgtaagaaactacagaagaaacgtatcaagaagcgcaagggagaggccatggctctgaatgagaagaggatcttggagaaggtccaatctagattcgtggtatcattggcttatgcttatgaaaccaaggacgcactgtgcctggtcttaaccattatgaacgggggggacctgaaattccacatctacaatctgggtaacccggggttcgatgaacagcgcgcagttttctatgcggcagagctctgttgcggactggaggacttgcagcgggaaagaattgtgtatagggaccttaaacccgaaaatattctcctcgacgaccgcggacacatcagaatctctgatctcggcctggccaccgagattcccgaaggccaacgggtcagaggccgcgtcggcactgtgggatacatggcgccggaggtggttaacaacgaaaaatacacattcagtccagattggtgggggctggggtgtctgatctacgagatgatccaaggacattccccgttcaagaagtacaaagagaaggtcaagtgggaggaagttgatcagcgtattaagaacgacactgaggagtatagcgaaaaattcagcgaggatgctaaatctatctgccgaatgctactcaccaagaacccaagcaaacggctgggctgccgtggcgagggagccgccggcgtgaaacagcacccggtttttaaggatatcaattttcggcgcctggaggccaatatgctcgagcctcccttctgtccagacccccatgcagtctactgcaaagatgtgttggacatcgagcagttcagtgtggtaaaaggcatatacctggataccgctgatgaagatttttatgcccgatttgccacaggctgtgtgagcataccatggcaaaacgaaatgatcgaatccggatgctttaaggatattaataagagcgagtcagaagaagccctcccgctggatttagataagaacatccatactccggtttcacggcccaatcggggcttcttctaccgcctttttcgccgggggggatgcctgactatggttccatctgagaaagaggtagagcccaagcagtgctag

SEQ ID NO: 25075 - DNA, 2625 bp, Artificial Sequence
  Description of Artificial Sequence: Synthetic coding sequence
atgaaccagcggagccacctgggcaccacctacctggacaccgccaaaggagctgtggaaacgttcatgaaactgcgtgcgagggacccagcttctcggggtgataggtatatgctcgtgacattcgaggaaccaccctatgctattaaggcgggctggaaagaaaaccacgctaccttcatgaacgagttgaagaatctgcaggcagaagggctgaccactttaggacagagtttgagaacagcctttgacctcctaaacttgaatcgcctggttacaggaatcgacaactacggtcaggggcgtaaccccttctttctggagcccgcaatcattatcactataacagacgggagcaagctgactacaacctctggagtccaggacgagctgcacctaccattaaacagtccccttcccggatccgagttaacaaaagaaccttttaggtgggaccagaggttgtttgctcttgttctgcggctacctggaaccatgtctgttgagtctgagcagctaactggggtacctcttgatgattctgctattactccaatgtgtgaagtaacaggtggacgatcttattccgtctgctcacctcggatgcttaaccaatgtctggagtccctggtgcagaaggtccagtctggcgtggttattaactttgaaaaggctggacccgatccgagcccggtggaggatgggcaacctgatatttcccgcccgttcggatctcagccatggcactcttgccataagctaatctatgtgaggccaaaccctaagactggtgttccaattggtcattggccagtgccagaatctttttggccagatcagaattccccaaccctgcccccgaggacctctcacccagtggtaaaattcagttgcacagattgtgaaccaatggtgatcgacaaactgccatttgacaaatatgaactggaaccatctccactgacgcagtttatcctggaacggaaatcccctcagacctgttggcaggtgtacgtctctaactccgctaagtattccgagctggggcaccctttcgggtacctcaaagcctctactgccctcaattgtgtgaatctgtttgtgatgccctataactaccccgttctcctcccactccttgacgatctgtttaaggttcataaggccaaacctaccctgaaatggcgccagtcctttgagagctacttgaagactatgccaccctactatctgggacctctgaagaaagctgtgagaatgatgggcgcacccaacttaatcgctgactccatggagtatggcttgtcctattcggtaatctcgtaccttaagaaactctcccagcaggccaagatagaaagtgatagggtaatcggtagcgtaggcaagaaagtggtccaggagaccggaatcaaagtgaggtcgcgcagccacgggctatcaatggcctatagaaaagactttcagcagcttctgcaaggcatctcagaggacgtaccccacagacttttggacctgaatatgaaggagtatactgggttccaggtggcgctgttaaacaaggacctcaagccgcagaccttcaggaacgcctatgacataccacggagaaatctgcttgaccatctcactcggatgagaagtaatctgctgaagtcaaccaggagattcctgaaaggccaggacgaggaccaagttcactcagtgcccatcgctcagatgggcaactatcaggaatatctcaaacaggtgccctcacccctcagagagctggaccctgatcagcccaggaggctgcacacctttgggaatccatttaagctggataaaaaaggtatgatgattgatgaagccgatgaattcgtcgcaggcccccagaataagcataaacggccgggcgagccaaatatgcaggggattccgaaaaggcgcagatgtatgagccccttgttaagaggcaggcagcagaaccccgttgtgaataatcatatcggcggtaaagggcccccagctcccactacccaagcccagccagatcttataaaaccactgcctttgcacaaaataagtgaaacgaccaatgattctattattcacgatgtcgtagagaaccacgtcgctgaccaactgagctccgatattactcccaatgccatggacactgagtttagtgcaagtagccccgcaagcctactggagcgcccaacaaaccacatggaggccctgggacatgaccatttaggcactaatgatttaactgtgggcgggttccttgaaaaccacgaagagccccgcgacaaggagcagtgtgccgaggaaaacataccagcatcttccctaaataaagggaaaaagctaatgcactgccgctctcacgaggaggtcaatactgaactgaaggcacagatcatgaaggagattagaaagcccgggcgcaagtacgagagaatcttcaccttgctcaaacacgtccagggaagcctgcagacgagacttattttcctccaaaatgtgataaaagaggccagtcgatttaagaagagaatgcttatcgagcagctcgaaaattttcttgacgagatccatcgtcgtgccaaccagatcaaccacataaactctaattag

SEQ ID NO: 25076 - DNA, 2340 bp, Artificial Sequence
  Description of Artificial Sequence: Synthetic coding sequence
atggccgactacagcaacaagctgtactaccagctggagcaggagacaggcattcaaaccgggtatactaggacgggatccatcttcctggcccaaacacaggatcggctgatttcattaaagcgcattaacgccggccttaacgtgattggaatccccagcgagatcatttctccgaaaaaggtcgctgagctgcatcacctgctgaatgtccacgacttagttggagcaatgcatgtgcctgaggatgcggtggtctcctcagccgacgtcgcacttgcactggctagtgctgcatcccagaacggcgtgcagatctacgatcggaccagcgtgcttcacgtgatggtcaagaagggccaggtcacgggagtcgagaccgacaagggccagatcgagtgccagtactttgtgaactgtgcggggcaatgggcctatgagctgggactttcaaatgaagagcctgtgtccattcccctgcacgcatgtgaacacttttaccttttaactaggccactggaaactcccctacaaagctccacgccaaccattgtggacgctgacgggagaatctacataagaaattggcagggcggaattttgagcgggggtttcgagaaaaatcccaaaccaatctttaccgaggggaaaaatcaattagagatccaaaatctccaggaggattgggaccacttcgaaccccttctgtctagcctgctgcggaggatgccggagctggagactctcgagataatgaagttggtcaactgccccgaaacttttacgccagatatgcggtgcatcatgggcgaatctcccgccgtgcagggctacttcgtcctggccggaatgaacagcgccgggctgtcgttcggtggaggggcaggcaaatacctcgccgaatggatggtgcatgggtacccttccgagaacgtgtgggaattagacctgaagaggttcggagcacttcagtctagccggactttccttcggcaccgtgtgatggaagtcatgccattgatgtatgatcttaaagtccccaggtgggatttccagactggccgtcaattgcgtacctcccccctttacgaccggctggacgcacagggagcaagatggatggagaaacacggttttgaacgacctaagtacttcgtgccaccagacaaggacctgctggccctggagcagagcaaaacgttttataagcctgactggttcgatatcgtggagagcgaagtgaagtgttgtaaggaggcagtctgtgtgattgacatgagctctttcacaaagttcgaaatcacatctaccggagatcaggcccttgaggtgttacagtatctcttctctaacgatcttgatgtgccagtaggccatatcgtccacactggcatgcttaacgagggcggtggctacgaaaatgactgcagtatcgcccgtttaaacaaaaggtcttttttcatgatttctccgactgatcagcaggttcactgctgggcttggttgaagaagcatatgcctaaggactctaatctgcttctggaggatgtgacttggaagtataccgcactgaacctaatcgggccacgcgctgtcgacgtgctcagcgagctgtcctacgcaccaatgacacccgatcattttccgtctctcttttgtaaggagatgagcgttggctatgcaaatggtatcagggtgatgagcatgactcacaccggagaaccaggtttcatgctgtatatccccatcgagtacgcattgcacgtctataatgaagtgatgtctgtaggacagaagtacggcattcgcaatgctgggtactacgctttgcggagccttcgcatcgaaaaattcttcgctttttgggggcaagatatcaataatcttactacccccttggagtgcggaagagagtcacgcgttaaacttgagaaaggaatggactttatcggccgggatgccctactgcaacagaagcaaaacggagtctataaacgactcactatgttcatcctggacgaccacgattcagacttggatctgtggccctggtggggggagccgatttaccgcaacggacaatacgtgggcaaaaccacgagttccgcatacagttatagtctggaacgccatgtgtgtttgggcttcgtgcacaatttctctgaagacacgggtgaggagcaagttgttacagctgacttcattaataggggtgaatacgagatcgatatcgccggatacaggtttcaagcaaaggcaaagttgtaccctgtcgcgtccctcttcactcagaagcgacggaaggatgatatggagctttccgatctgcacgggaaatag

SEQ ID NO: 25077 - DNA, 1191 bp, Artificial Sequence
  Description of Artificial Sequence: Synthetic coding sequence
atggccacccgggtggaggaggccgcccggggccggggcggcggcgccgaggaggcaaccgaggccgggcgcggaggacgcagacgctctcccagacagaagcttgaagagtcccgttcggtccagaagcagatgaagatactgcagaagaagcaggctcagatagttaaagaaaaggttcatctgcagtccgagcactctaaagccatactcgctcggagcaagctggagtcactgtgccgcgaactgcagcggcacaataagacactgaaggaggagaatatgcagcaagctcgcgaggaggaggagaggagaaaggaagctactgcccatttccaaattacccttaacgagatccaggcccaattagaacagcacgatatacataatgctaaactacgtcaggaaaacatagaactgggggaaaagctgaagaagctaattgaacagtatgccttaagggaagagcatattgacaaagtattcaagcataaagagctgcagcagcagctcgtggatgcaaaactccaacagacaactcaacttataaaggaagctgatgagaagcatcagcgcgagcgggagttcctcctcaaagaggccacagagagcaggcacaagtatgaacagatgaagcagcaggaggtgcagttgaagcagcagctttctttatacatggacaagtttgaagagttccagacaacaatggcaaaatccaacgaattatttacaacctttaggcaagagatggaaaaaatgacgaagaagatcaaaaagttggaaaaagaaacaatcatctggaggacaaaatgggagaacaataacaaagcgcttttgcagatggccgaagagaaaaccgttcgcgacaaagaatacaaggccttgcagatcaaactagaacggttagaaaaactgtgccgtgcccttcagactgagcgtaatgaacttaacgagaaggtggaagtactgaaggagcaggtcagcatcaaggcagctatcaaggccgcgaacagggacctcgccacccctgtcatgcagccttgtacagcacttgatagtcacaaggagcttaacacatccagcaagcgagcgctgggagctcatttagaagccgagccaaagtcacaacgatcagccgttcaaaagccaccctcaactggttcggctccagctatcgagtccgtcgactag

SEQ ID NO: 25078 - DNA, 1443 bp, Artificial Sequence
  Description of Artificial Sequence: Synthetic coding sequence
atggccggctacctgagcgagagcgacttcgtgatggtggaggagggcttttccacaagggacctactgaaagaactcacgcttggggcctcacaggctacaacggacgaagttgccgcgttctttgtggcggatctcggcgcgattgtcaggaaacacttctgttttttgaaatgcctccccagggtccgaccattttacgcggttaagtgcaactcaagtcccggagttctgaaggtactggcccagttaggcctgggtttttcatgtgccaacaaagccgagatggagctcgttcaacacatcggcatacctgcctccaagatcatttgcgcgaacccctgcaaacaaattgcgcagatcaagtacgcagccaaacacggaatccaactcctctccttcgacaatgagatggaactggcaaaggtggtgaaatctcatcctagcgcaaaaatggttctctgtatcgcgacagacgacagccatagtctttcctgtttgtcgctgaagttcggcgtatccttgaagtcgtgtcggcacctgttagagaatgccaaaaagcaccacgtagaggtcgtcggtgtctccttccacattggctcgggctgcccagatccccaggcctatgcacagtctattgccgacgcccggttagtgtttgaaatgggcaccgagctcggacacaagatgcatgtcctggacctgggcgggggcttccctggcactgagggcgcaaaagttagattcgaagagattgccagcgtcatcaatagtgctcttgacctgtactttcctgaaggatgcggagttgacatatttgctgaactgggacgctactacgtgacttcagcctttacagtggctgtctcaatcattgccaaaaaggaggtgctgctagatcagcccgggcgggaagcgcctctccctccccctcacattgcaacatgcgcagctagcgaaccttcccctcctgctgaagagaatggctctacttcaaagactatcgtgtaccatctcgatgaaggtgtttacggcatcttcaattccgtgcttttcgataacatttgtccaaccccgatccttcagaagaaaccctccaccgagcagccactctattcctcaagtctatggggccctgcagtcgacggatgcgactgtgtagcagagggactctggctgccccagttacacgttggggattggctggtttttgacaacatgggtgcatacacggtgggtatgggaagccccttctggggaacacaggcttgccatattacctacgcgatgtcccgggtggcctgggaagccctccgccgccagctcatggcagcagaacaggaggacgatgttgaaggagtttgcaagcccctgagttgtggctgggagatcacggacaccctctgtgtggggcccgttttcacccccgccagcatcatgtag

SEQ ID NO: 25079 - DNA, 3774 bp, Artificial Sequence
  Description of Artificial Sequence: Synthetic coding sequence
atggcccacttcagcagcgaggaccaggccatgctgcaggccatgctccgacggctgtttcaaagtgttaaggagaaaataaccggcgccccaagtctggagtgtgccgaggaaatccttctccatctcgaagaaaccgacgaaaacttccacaactacgagtttgtaaagtatctccgccagcatatcgggaacactttgggtagcatgatagaggaggaaatggagaagtgtacgtctgatcggaaccagggagaggaatgcggttatgacactgtagtgcagcaggttacgaaaaggacccaggaatctaaggaatataaggagatgatgcactacctaaaaaacatcatgatagcagtggtcgagtctatgatcaacaaattcgaagaagacgagactagaaaccaagagcgccagaagaagatacaaaaggaaaaatcacattcctaccgtactgacaactgcagcgatagtgattcatccctgaaccaatcttacaagttctgtcagggcaagctccagctaatcctggaccagcttgacccgggacagcctaaagaagtaagatatgaggcccttcagactctgtgttcagcccctccgagcgacgtgttgaattgtgaaaactggactacactatgcgagaaacttacagtttcactttcagaccccgaccctgttttctccgacaggattctgaagttctgtgcacagaccttcttgctgagccccctgcacatgactaaggagatctacacctctctggctaaatatctggagtcctactttctctcgagagagaatcacattcccactctgagcgctggggtggatataacaaatcctaacatgaccaggttgctgaagaaagtccgactgttaaacgagtatcagaaagaagcaccaagtttctggattcgccatcccgagaagtacatggaagagatcgtcgaaagcacactttccctgttaactgtgaaacataaccagagtcatgttgttagtcagaagatattggacccaatatatttcttcgccttggttgacacaaaggccgtctggttcaagaagtggatgcatgcacactactcaagaactacagtccttaggctattggagaccaagtataagtctctggttaccactgccatccagcagtgcgtacaatatttcgagatgtgcaaaactcgaaaggccgacgaaactctgggtcacagtaagcattgcagaaacaagcagaaaaccttctattacctcggccaggagctgcaatatatctatttcattcactcattgtgcctgctcggtcgattactgatctataagcagggaaggaaactgttccctatcaaactaaaaaacaaaaaaggcctagtaagcctcatcgacctcctagtgctgtttacccagctgatttattattctccctcttgccccaaaatgacttctgctgcacatagcgagaattatagtccagctagcatggtgactgaagtgctgtggattctatctgatcaaaaggagtgtgctgttgagtgtctctacaataacatagttatcgagacactgctccagcccatccataatcttatgaagggcaatgaagcttccccgaactgtagcgagacagccctcatccacatcgccgggatcctcgctcgcattgcctcagtggaggagggcctgatcttgctgctatatggggctaatatgaacagctccgaggagagccctaccggagcacatattattgcgcaatttagtaaaaaactgttagacgaggacatctcaatattctccggttcggagatgctcccagtagtgaagggggcatttattagcgtctgtaggcacatctatagtacatgcgagggacttcaggtgctcatcacatataatcttcacgagtctatcgccaaagcctggaagaaaacctcccttctctcagagcgcatccctacacctgtggagggctctgacagcgtcagctccgtatctcaggagtcccagaatattatggcttgggaggacaacctgctcgatgacctgttgcacttcgctgcaacacctaagggcctcctactccttcagcgaactggtgccattaatgagtgcgtcactttcatatttaacagatacgctaaaaagctccaggtctccaggcacaaaaagtttgggtacggcgtgttagtaacccgagtggcctccactgcagcagggggaatagccctgaaaaagagtggttttattaatgagttaataactgaactttggtcaaacctcgaatacggccgagacgatgttagggtgacacatccaagaaccacccctgtggaccctatcgatcgctcatgtcagaagagttttctggcgctggttaacttactttcgtaccctgcgatctacgagctggtgcgcaatcaagacctgccaaacaaaactgagtacagcttacgtgaagtcccaacctgcgtgatagacattattgatcgcctaatcattttgaactcagaggccaaaatcagatccctgttcaactatgaacagagtcacatttttgggcttcgtgacttcatcatcgacggactatctgttgaacgcaatcatgtgctcgtcaggatcaatctcgtcgggggacctctggagcgtattctcccaccacgcctgttagagaagtcagataatccttacccctggcccatgttctccagttatcccctgcccaattgttatctgtccgacatcacccgcaatgcggggatcaagcaggataacgatctggataaactcctcttatgcctgaagatttcggataagcaaactgagtggatcgaaaattgccagaggcagttttgcaagatgatgaaagccaagccagacataatctccggagaagccctgattgagcttctggagaagtttgtattgcacttaaccgaatctccatccgaatgctactttccgtccgtagagtatacggccacagacgccaatgtgaagaatgaatctctgtccagtgtgcagcagctagggatcaaaatgaccgtgcgatacggtaagtttctgtctctcctgaaggatggtgccgaaaatgatctgacatgggtgttgaaacattgtgaacgcttcctgaagcagcaacaaacatctattaagtctagcctgctttgcttacagggtaactatgcggggcatgattggttcgtctccagcctttttatgattatgttgggcgacaaagaaaagacattccagtttttacatcagttcagtcgattgctgacatccgctttcctgtggctgccccggttgcatatcagctcttacctcccaaacgataccgtcgaaagtggaatccatccagtatacttttgtagcacacattatattgagatgctgttaaaggccgagctaccattggtgttcagcgctttccacatgagcgggtttgcaccttctcaaatctgcctccaatggattacccagtgcttctggaactatctggattggattgaaatctgccactatatcgccacatgcgtgttcctgggtcctgactatcaggtgtacatctgcatagcagtttttaagcacctgcagcaggatatcctgcagcacacccaaacacaggacctccaagtctttctgaaagaagaggccttacatggattccgggtgtccgactatttcgagtacatggagatcttggaacaaaactaccgaacagtgttgttgcgggacatgcggaacataaggcttcagtcaacgtag

SEQ ID NO: 25080 - DNA, 612 bp, Artificial Sequence
  Description of Artificial Sequence: Synthetic coding sequence
atggccaccccctacgtgaccgacgagaccggcggcaagtacatcgccagcacccagagaccggacgggacctggagaaaacagaggagggtgaaagaaggctacgtgccccaggaagaagtgcccgtttacgaaaacaaatacgtgaagttctttaagagtaaacccgaacttccccccggactgtctccggaagccacagccccagttactccaagccgccccgagggaggcgagcctggcttgtcaaagactgctaagagaaaccttaagcggaaggagaagaggcgtcaacaacaagagaaaggcgaggctgaagccctatcccgcacactggacaaagttagcctggaagagaccgcacagttgccctcagcccctcaaggctcacgggcggccccaaccgctgcgtctgatcagcccgattctgccgccactacagagaaagctaagaagatcaaaaacctgaagaagaagctgcgccaggttgaggagctccagcaacggatccaggccggagaggtttcccagccaagcaaagagcagctggagaagcttgcacgacgccgggctctggaggaagagttggaggacctcgaactcgggttatag

SEQ ID NO: 25081 - DNA, 729 bp, Artificial Sequence
  Description of Artificial Sequence: Synthetic coding sequence
atggccgccgtgaaggccagcaccagcaaggccacccggccctggtattctcacccagtgtatgctagatactggcagcactaccaccaggccatggcttggatgcagagccatcataatgcgtaccgcaaggctgtggagtcctgttttaacctcccctggtatctgcccagcgcccttctgccacaatcttcttacgacaatgaggccgcatatcctcaaagcttttacgatcatcacgttgcctggcaggattacccttgctctagttctcactttaggaggtctggacagcatccccgctattctagcaggattcaggcgagcaccaaggaagaccaggcactgtccaaggaggaggagatggagactgagtctgacgcagaggtggagtgcgacctctccaatatggagattactgaggagcttcggcagtacttcgccgagacagagagacaccgtgaggagcggcggagacaacaacagctcgacgccgagaggctggatagctacgtgaacgccgaccacgacctgtactgtaacacaaggcgctccgtagaggctccgactgagaggcccggtgaaagaagacaagccgagatgaaaagactttacggagactccgctgctaaaattcaggccatggaggccgccgtgcagttgtctttcgacaagcactgcgacaggaagcagccaaagtattggcccgtgattccattgaagttctag

SEQ ID NO: 25082 - DNA, 738 bp, Artificial Sequence
  Description of Artificial Sequence: Synthetic coding sequence
atgatcggcgtgagcttcgaggaggccaagagcatcatcaccggcgcgaaactatctacgcgtttggagtccgcttgggaaattgctttcattcgccagaagtctgataacatccagcctgagaatctcagctgtacatcccttatcgaagcttccggtgagtacggaccccaagcgagtacactgtcactgttctcttcacccccggaaatcctcatccctaagacatccagcacaccgaaaactaacaacgatattctgagcagctgtgaaatcaaaaccgggtacaacaagacggtgcagatccccatcaccagcgagaatagcactgtgggtttgagcaatactgacgttgcatcggcatggaccgagaattatggcctccaggaaaagatatccctaaatccctctgtgagattcaaagctgagaagctggagatggctctgaactatctgggcatccagccaacaaaggagcagcaccaggcccttagacagcaggtgcaggcggactccaagggaacagtgagtttcggcgattttgtgcaggtcgcccggaaccttttttgcctgcaactggatgaagttaatgtcggtgctcatgaaatttccaatatcctcgactctcagctactcccctgcgatagctccgaggctgacgagatggaaaggctcaagtgtgagagggacgatgccctgaaagaggtcaataccttgaaatggcctggtcagaactag

SEQ ID NO: 25083 - DNA, 1020 bp, Artificial Sequence
  Description of Artificial Sequence: Synthetic coding sequence
atgatggacagccagctggtggccggcgtggccttcaagaagaccttctcctatgcaggttttgagatgcaacccaaaaaatatcataaccccaagatcgcccttcttaatgtggagttggagctgaaggctgagaaggacaacgcggagatccgggtccatacggttgaggattatcaggctatcgttgacgcagagtggaatattctgtacgataagttagagaaaatccaccattccggagcgaaggttgtcttgtccaaacttcctattggtgatgttgccacgcaatatttcgcagaccgggacatgttctgtgcgggccgggtgccagaagaagaccttaagcgcacgatgatggcctgtgggggctccattcagaccagcgtcaatgcactgtccgctgatgtgttgggccgttgccaggtctttgaggaaactcaaataggaggggagcggtacaattttttcactggttgtccaaaagccaagacttgcacattcattctgcgtgggggtgccgagcagtttatggaagaaacagagagatcacttcacgacgcgatcatgatagtgagaagggctattaagaacgatagcgtcgtggccggtgggggcgcaattgagatggaattgtcaaaatatctcagggattactcccgcaccatacctgggaagcagcagctgctgatcggcgcctacgccaaggctctcgagatcataccgagacaactctgcgataacgctgggttcgacgctaccaacattctcaataaactgagggcacgccacgcccagggcggtacatggtatggcgttgatattaacaacgaggatattgccgacaactttgaggcgtttgtttgggaaccagccatggtccggataaatgccctcacagcagcatcagaggctgcttgcctgattgtatcagtcgatgagactataaaaaaccccaggtctacagtggatgctcccactgcagccggtcgggggcgaggccgcgggcggcctcactag

SEQ ID NO: 25084 - DNA, 768 bp, Artificial Sequence
  Description of Artificial Sequence: Synthetic coding sequence
atggccagcagcgacctggagcagctgtgcagccacgtgaacgagaaaattgggaatataaagaaaaccctgtcccttcgtaactgtggccaagagcccaccctgaagacggtacttaacaagattggggacgaaataatcgtgatcaacgagctgctgaacaagctagagctcgaaatccagtaccaagaacagactaataatagcctaaaagagctctgcgaaagtctggaagaggactataaggatatagagcacctcaaggagaacgtgcccagccacctgccacaggtgacagtaacccaatcgtgcgtgaaaggtagcgacttggatcccgaagagcctatcaaagtagaggagccagagcctgttaaaaaacctcctaaggagcagcgatcaattaaagagatgccttttatcacctgcgatgaattcaacggggtgcctagttacatgaagagccgcctgacctataaccaaatcaacgacgtgatcaaggaaattaataaggctgttatctcaaaatataagattctacaccagcctaaaaagagcatgaatagtgtgactcgaaatctctaccatcgttttattgatgaagaaaccaaggatactaaaggcagatactttattgtggaagcagacattaaggaatttacaactctgaaggccgacaagaagttccatgtgctgctgaacatacttagacactgcaggagactcagcgaagtgcggggtggcggccttaccaggtatgtaatcacctag

SEQ ID NO: 25085 - DNA, 441 bp, Artificial Sequence
  Description of Artificial Sequence: Synthetic coding sequence
atggtgaacagctgctgcggcagcgtgtgcagcgaccagggctgcgaccagggactatgccaagaaacttgttgccggccctcatgttgtcagactacttgttgctgtccttcgtgtgtcgtctcaagctgctgccgtccgtcatgtagccagacgacctgttgccagacaacttgctgccggccttcctgttgccacccagtgtgctgccaaaccacatgccgaccaagttgcggcgtctctagctgttgtagacccctgtgttgtcagaccacctgccatccttcttgcgggatgagctcctgctgtcgccctctatgctgtcagacaacctgccggcctagctgtggggtatccagctgttgtcgacccttgtgttgtcagaccacgtgttgcagagcaacctgttgtaggccatcatgttgtggctcctcatgctag

SEQ ID NO: 25086 - DNA, 1296 bp, Artificial Sequence
  Description of Artificial Sequence: Synthetic coding sequence
atgaccagcgactgcagcagcacccactgcagccccgagagctgcggaaccgcctcaggctgcgccccagcctcaagctgcagcgtcgaaactgcatgtctgcctgggacatgcgccacatcccgctgccagactcctagctttctgtctagaagcagaggtttaaccggctgtctgcttccctgctatttcactggcagttgtaacagtccttgcctggtgggcaattgtgcatggtgcgaggacggggttttcacttcaaacgaaaaggaaacaatgcagtttttaaacgacaggctcgctagttacctggagaaagttagaagccttgaggagactaacgcagagctggaatcacgcattcaggagcagtgcgagcaagatatccccatggtctgtccagattaccagcgatacttcaacacaattgaggatctacagcagaaaatcttgtgcacaaaggccgaaaactcacgtcttgcagtacagctcgacaactgtaagctggccacagacgactttaaatccaagtacgaaagcgaactcagtctgaggcagctcctggaagccgacatatcctcgcttcacggcattctggaagaattgaccctctgcaaatctgatctggaggcacatgtcgagtccctaaaggaagatcttctttgcttaaaaaagaaccatgaggaggaggtcaatctcttgcgcgaacaactcggcgacagactctctgtcgagctggatactgcacccactctcgacctgaaccgtgttctcgacgagatgcgctgtcaatgtgaaactgtgctggccaataatcgtcgggaggccgaggagtggctggctgtccagacggaagaacttaaccagcagcaactgtcttctgccgaacagcttcagggatgccagatggagatcctcgagctcaagcgcaccgcctcggctctggaaatcgagctccaggcccagcaaagtttaactgagtcattagaatgtaccgtcgccgagaccgaggcccaatatagcagccagctggcccagatccagtgtctgattgacaacctggaaaatcagctagccgagatacgctgtgatctcgaacggcagaaccaggagtaccaggtgctcctggacgtgaaggctcggttggaaggtgaaattaatacatactggggtctgctcgacagtgaggattccaggctgtcatgcagcccgtgttctacgacctgtacttcatccaacacgtgtgagccatgctccgcgtacgtcatttgtacagtggagaactgctgcctatag

SEQ ID NO: 25087 - DNA, 471 bp, Artificial Sequence
  Description of Artificial Sequence: Synthetic coding sequence
atgggctgctgcggctgcagcggcggctgcggcagcggctgcggcggatgcggaagcggaagcggcggctgcggcagtggctgcggggggtgtgggagctcatgttgcgtgccaatctgctgctgcaagccggtttgctgctgtgtacccgcgtgcagctgctctagctgcggatcatgcggcgggtcgaagggtgggtgtggaagctgcggatcatctaaaggcgggtgcggatcatgcgggtgttcgcagagtaactgttgtaagccctgttgcagcagtagcggatgcggcagtttctgctgccagagttcctgtagtaagccctgttgctgtcagtcatcctgctgccagagctcctgctgcaagccatgttgttgccagagcagctgctgtcagagctcatgtttcaagccttgctgctgtcaatcgagttgctgtgtccctgtttgctgccagtgcaagatctag

SEQ ID NO: 25088 - DNA, 609 bp, Artificial Sequence
  Description of Artificial Sequence: Synthetic coding sequence
atgggctgctgcggctgcagcggcggctgcggcagcggctgcggcggctgcggtagtggatgtggcggttgtggttctggatgtggcgggtacggctcaggttgtggaggatgcgggtcttcttgctgcgtaccagtgtgctgttgcaagcctgtgtgttgctgcgttccagcctgttcctgtagttcctgcggcagctgcggcgggtcgaaaggagactgcgggagctgcggcggcagcaagggcgggtgcggatcctgcggaggctccaagggaggctgcggctcatgtgggggatcaaagggggggtgtgggtcatgtgggggctccaagggtgggtgcggctcctgtggcggaagcaagggtggatgtggctcctgcggcgggagcaaaggaggatgcggatcctgcggatgctcccagtgtaactgctgtaaaccctgctgttgcagtagcggctgcggctcttgttgccagagttcctgctgcaatccttgctgctgtcagtcgtcatgttgcgtcccggtgtgttgccagagtagctgttgtaagccttgttgttgccagtcgagctgttgtgtgcctgtgtgctgccagtgtaaaatatag

SEQ ID NO: 25089 - DNA, 498 bp, Artificial Sequence
  Description of Artificial Sequence: Synthetic coding sequence
atgggctgctgcggctgcagcgagggctgcggcagcggctgcggcgggtgtggatcaggatgtggcggatgtggaagtggttgtggtggctgtgggtcatcatgctgtgtcccagtatgttgttgcaagcccgtctgttgctgcgtcccggcatgcagttgcagctcctgtggctcctgcggcggttccaaaggcggatgtggctcatgcgggggctctaagggtgggtgcgggtcttgtggcgggtctaaaggtgggtgcggttcttgtgggtgtagtcagtgctcgtgctacaaaccatgttgctgctcatctggctgtggtagctcctgctgccagtccagttgctgcaaaccttgctgctgccagagctcatgttgcaagccatgctgctgcagctctggatgcggcagctcgtgttgccaatcgagttgctgtaatccctgttgttcccagagcagctgttgtgtgcctgtttgctgtcagtgcaagatctag

SEQ ID NO: 25090 - DNA, 3105 bp, Artificial Sequence
  Description of Artificial Sequence: Synthetic coding sequence
atggccagcgtgttcatgtgcggcgtggaggacctgctgttcagcggcagtcgctttgtttggaatctgaccgttagcacactgcgtagatggtacactgagcgtttacgggcttgccaccaggttctgcggacctggtgtggcctgcaggacgtgtatcagatgaccgagggacggcattgccaggtccacctgctggacgataggcggctggaactcctggtccagcccaaactcctcgcccgcgagttgctcgatcttgttgcctcccattttaacttaaaggaaaaagagtacttcggaattacattcatcgacgatacaggccaacagaactggctccagttagaccacagggtcctggatcatgatctgccgaaaaagcctggaccaaccatcctgcacttcgcagtccggttctatatcgaaagcataagttttctcaaagacaaaacaaccgtggagctgttctttctgaatgctaaggcctgtgtgcataaaggtcagattgaagtagagtctgagaccattttcaaacttgcagcttttatcctacaggaggccaagggggactatacctcagatgaaaatgcacggaaagacctcaaaaccctgcctgcattccctaccaagaccctgcaggaacatcctagtcttgcatactgtgaggaccgagtgatcgagcattatctcaagatcaaaggactgacgcgaggacaggccgttgtccagtacatgaagatcgtggaggcactgccaacgtatggagttcactattacgcagttaaagataaacagggtttgccgtggtggctcggaatcagctacaagggcatcggtcagtacgatatccaggacaaagttaagccgcgcaagctctttcaatggaagcagctcgagaatctgtactttcgcgagaagaaattcgcagttgaggtgcatgacccgcggagaattagcgtgtcacgcagaacttttggacagtccgggttgttcgttcaaacttggtatgcaaattcttcgcttatcaagagtatctgggtaatggccatatctcagcaccagttttacctcgatagaaaacagtccaaggctaagatacctagcgcccgttcactggatgaaatcgcgatggacctaacggagacgggcacccaacgcgcctcaaagctggtcaccctcgagactaaatcacagtttatcatggcctctaacggctcattgattagctctgggtcccaagattccgaagtgagtgaggagcaaaaaagggagaagatactagagctgaagaagaaggagaaactcctgcaggaaaaactattaaaaaaggttgaagagctgaagaagatctgcctgcgtgaggcagagctcacaggcaagatgcctaaagaatatcctttaaatattggggagaaacccccgcaagtgcgtagaagagtgggaacagcgtttaaacttgatgacaaccttctaccatccgaggaggatcctgctctccaagaactggagtcgaattttctcatccagcagaaattagtggaagctgcaaagaaacttgctaacgaaccggacctgtgtaaaactgttaaaaagaaaagaaaacaagactatacagacgcaatgaagaaacttcaagagatagaaaacgcaataaacgagtacaggatcagatgcggcaaaaaaccgtcgcagaaggccaccgttttgcctgaagatataattcctagtgagagcagtagcctgtccgacaccaccacgtatgatgatccatcggatgcctttaccttccccgggcagcgctcgtcgagtgtgccccattcacccagaatactgccccccaagtccctgggtatcgaaaggatccattttcggaagagtagtattaatgagcaattcgtggacacccgccagtcgagggaaatgctgtctactcactcgtcgccctacaagaccctagaacggcgtccccagggaggccgttccatgcctactacccccgtgttgactcgaaacgcctatagctcaagtcacttagagccggaaagcagtagtcagcattgtcggcagcgcagtggtagcctcgaatctcagtctcacctgttgtctgagatggattccgacaaacccttcttctctctctcaaaatctcaacgatcctcatcaacagagatcttagacgatggcagtagctacacaagtcaatccagtaccgagtattactgtgtgactcccgtgaccggaccctactacacaactcagacgcttgacactagaacccgcggtagacggagaagtaagaaacagaatgtctccacgtctaactctggctctatgcccaacctggcccagaaggattcgctgcgaaatggggtttacagtaagtcacaggaacctcccagcagttcatactatatcgctggttatacaccctacgctgaatgcgacttttactactccggaggatacgtatacgagaatgacaccgaaggccaatatagcgtgaatcctagctacagatcttccgcccactacggctacgagcggcagagggactactcgcgctcctttcatgaggacgaggtggatcgcgtcccgcacaacccgtatgccaccctgcggctgccgaggaaggccgctgctaagtcggaacacatcacaaaaaatattcacaaagctctggtggctgaacacctgagaggctggtatcaacgggcttctgggcagaaggaccagggccacagtccacagacttccttcgattctgacagaggtagccagcgctgtctgggattcgctggccttcaggtgccatgcagcccttctagtcgggcaagcagctattcttcagtgtcttctacgaacgccagtggaaactggcggactcagctcactatcggactatcggactacgagactcccgcccattctagctatacttcttgctacggtaatgtctataatccacttccttctccaagtcgccagtacacagagatctcccagctggacggcacagatggtaatcaattagaggacaatctcgagtcaagtgagcaaaggttgttttggcacgaggactccaagccagggacgctggtctag

SEQ ID NO: 25091 - DNA, 501 bp, Artificial Sequence
  Description of Artificial Sequence: Synthetic coding sequence
atgctgagccagagctgcaacctggaccccctgaccgagacctacggaattcctttctatctacagtacctggcgcattggcccgaatattttattgtggcagaagctcctggcggcgaactcatgggatacatcatgggaaaagctgaggggagcgttgcaagagaggagtggcatggtcacgtcaccgccctttcagtggcacctgagtttaggaggctgggcctggctgccaaactgatggaactcctagaggagatttcagagaggaagggtggatttttcgtggacctcttcgttcgagtatctaaccaggtggcggtaaacatgtataaacagttgggctactctgtctacagaactgttatcgagtactactctgcgtccaatggtgagccagacgaggatgcctacgacatgcggaaagcactatccagagacactgaaaaaaagagtatcattcctctgccccatccagtgcgtccagaagacattgagtag

SEQ ID NO: 25092 - DNA, 399 bp, Artificial Sequence
  Description of Artificial Sequence: Synthetic coding sequence
atgcgggccagcccctgcatcagccagcccgccgccagctggcaccccagacctagcgccctccggcctacggcgggctcaggaccagacacaagaaccccagggactgtcgaagacggttcagcaccttgtccggcgttcaggtctcctgcggtgtccccctgcggtgaagagccgtgttgcttccagatctcgcctgccgaggagacgctcgagctggggaggcttgtgtcacccggaaattgcgacactttgtcaccccgcgccgccggattctacgcctgccacgtaagatcacttatcccctgtcgttcaacgaaagggcggtggccattgacggcaagtgctgccggtctgtcccggcacgctcagtgcgggccctccttaggcctgggatag

SEQ ID NO: 25093 - DNA, 375 bp, Artificial Sequence
  Description of Artificial Sequence: Synthetic coding sequence
atgcgggccagcccctgcatcagccagcccgccgccagctggcacccaagaccaagtgctctgcggcccacagccggaagcggaccggacaccaggaccccgggcactgtggaggacgggtccgctccctgccctgctttcaggagcccggcagtgagtccctgcggggaggagccttgctgtttccagatatctcctgcggaggagacacttgagctcgggagactggtctccccagggaattgcgacaccctgtcaccacgcgcagccggcttttatgcgtgtcatgtcagatccctgataccatgtaggtccactaaaggcagatggccccttacagcctcggccgccggactgagcagtttctcagggtag

SEQ ID NO: 25094 - DNA, 336 bp, Artificial Sequence
  Description of Artificial Sequence: Synthetic coding sequence
ctgatggacctggacagcggcgacgtgaagcggcgggtgcacctgttcgaaactcagcgacgcactaaggaagaagaccctataatccctttctccgatgggcccatcataagcaagtggggggcaatcagccgatcgtcaaggactggctaccatacaacggatcccgtgcaagcaacagcgtcccaggggtctgcgacaaagcccatatccgtcagtggaggagtgcacatggccacacgcccacatcatcaacacactatgttgaaaggtaccgactcactcctcctgatttacctggtgattgagagcatcccggttctcggcacattctag

SEQ ID NO: 25095 - DNA, 399 bp, Artificial Sequence
  Description of Artificial Sequence: Synthetic coding sequence
atgcgggccagcccctgcatcagccagcccgccgccagctggcaccctaggccatccgccttacgacctacagccggctctggccctgatacgcggacgcctgggacagtggaagacggctcagcaccctgtcccgcttttaggtctccagcagtctctccgtgcggcgaggagccatgttgcttccagatctcaccagcagaagaaaccttggagttaggccggctagtatcacctggaaattgtgatactttatctccccgggcggccggattctatgcttgtcatgtccgatctctgataccttgccgatccacaaaggggcgatggccattaactgcgagcgccgccggcctgagccggcacgcacaatgcggcccttccctggggctcgggtag

SEQ ID NO: 25096 - DNA, 375 bp, Artificial Sequence
  Description of Artificial Sequence: Synthetic coding sequence
atgcgggccagcccctgcatcagccagcccgccgccagctggcacccacgtcctagcgcccttcggccaacagcaggatctggacccgacacgcgaactcctggcacggtagaagacggctcagccccgtgtcccgccttccgctcaccagccgtctcaccgtgcggggaggagccttgctgctttcagatctccccagcagaggagaccctggagctcggccgcctggtatcccccggaaactgtgatacactgtccccccgagcagctgggttttatgcctgtcacgtaaggagcttaattccatgtagaagcacaaagggacgttggcctttgaccgccagtgctgctggactgagctccttttctggatag

SEQ ID NO: 25097 - DNA, 1038 bp, Artificial Sequence
  Description of Artificial Sequence: Synthetic coding sequence
atgctgcccaacaccggccggctggccggctgcaccgtgttcatcacaggcgccagtcgcggaattgggaaggccatcgccctaaaagccgcgaaagatggggccaatatcgtcatcgcagctaagacagctcagccacatcccaagctgctcggcactatctatacagcagccgaagagatcgaagcagtcggcggcaaggctctaccatgcatcgtcgatgtaagggatgaacagcagatttcagcagccgtggaaaaggccatcaagaaattcggcgcctacaccatagctaaatacggcatgagtatgtacgtgctcgggatggcggaggagttcaagggagagattgcggtcaatgctctgtggcccaagaccgcgattcacacggccgctatggatatgttgggcggccctggtattgaaagtcagtgtaggaaggtagatatcatcgctgacgcagcttactccatctttcagaagcctaagtcattcaccggaaattttgtgatcgatgagaacatattgaaggaagaagggattgaaaactttgatgtctatgcgatcaagccaggccaccctctgcagcctgatttttttcttgacgaataccccgaggccgtgtcaaaaaaagtcgagtctacaggcgccgtcccggaattcaaggaagaaaaacttcagctccaacccaagccacgctcaggagccgtagaggagacatttaggatcgtgaaggacagtcttagcgatgacgtggttaaggcaacccaggctatttacctttttgagctatccggggaggacggcgggacttggttcctggacctaaagtcaaaaggtgggaatgtggggtatggcgagccctccgaccaagccgacgtcgtcatgagcatgacgaccgatgattttgtgaagatgttttccggaaagctcaaacctaccatggcctttatgtcaggcaaattaaagatcaaaggaaatatggcactggccataaaactggagaaacttatgaatcaaatgaatgccaggctctag

SEQ ID NO: 25098 - DNA, 1257 bp, Artificial Sequence
  Description of Artificial Sequence: Synthetic coding sequence
atgctgcccaacaccggccggctggccggctgcaccgtgttcatcacaggcgcgtctcggggcattggtaaggccatcgcactgaaggccgcgaaagatggagccaatattgtaatcgctgctaaaacggcccaaccccacccaaaattgcttggaacaatttatacggccgctgaagaaatagaggccgtaggcggaaaagccctgccctgcattgtggacgtgcgggacgagcagcagatctctgcagcagtggagaaagctatcaagaaattcggagggattgatatcctcgttaacaatgcatccgccatctccctgactaacaccctggatacacctactaagcgtctggacctcatgatgaacgtcaacaccaggggcacttacttggcaagcaaagcctgtataccttatctaaagaagagcaaagtggcacacatactgaatatttctcctcccctcaatctgaacccagtctggttcaagcagcactgcgcttatactattgcaaaatatggaatgagcatgtatgtgttggggatggctgaggaattcaagggggaaatagcagtgaatgcgctgtggccaaagaccgctatccatacagccgctatggacatgctgggcggccccggtatagagtctcagtgcaggaaagtggacattatcgccgacgcggcttactctattttccagaagcccaaaagcttcaccgggaatttcgttattgacgagaacatcttgaaagaagagggaattgaaaattttgatgtttacgctatcaaacctgggcatcccctccaacccgacttctttttggatgagtatccggaagcggtgtccaaaaaggttgagtccaccggagcggtcccagagtttaaggaggagaaattgcagctgcaaccaaaacctcgctctggggccgtcgaggagacctttcgcattgttaaagattcactgagtgatgacgtcgtgaaggcaacccaggctatttatttattcgaactatcgggggaggatggcggcacctggttcctcgatcttaaatctaaaggcggtaacgtgggatacggcgagccatcagatcaagcagacgttgtaatgagtatgaccaccgacgatttcgtgaagatgttttcaggcaaattgaaacctaccatggcctttatgagcggcaaattaaagataaaaggtaatatggctctggctataaagttggaaaagttgatgaaccaaatgaacgcgcggttatag

SEQ ID NO: 25099 - DNA, 1077 bp, Artificial Sequence
  Description of Artificial Sequence: Synthetic coding sequence
atgcccggctgcgagctgcccgtgggcacctgccccgacatgtgcccggcagcggagagggcccaacgggaaagggaacatcgactgcaccggttggaggttgtgcctggatgtcgtcaagatccgccaagagctgacccgcagagagccgtcaaggagtattcaaggccagcagctggcaaacccagaccccctcctagtcagttacggcccccttccgttctcctggctaccgttcgatatcttgcgggggaggtagcggaatcagccgatatcgctagggccgaagtcgcatcatttgtcgcagaccggctccgcgccgtgctcctcgatttggcattacaaggagccggggatgcagaggcagcagtggtgctggaggctgcacttgccactctcctgaccgtcgtagcccggttgggccccgatgccgcccgcggccccgcagacccagtgctactccaagcacaggtacaggaaggcttcggatccctccgaagatgttacgcccggggcgcgggccctcaccccagacagcccgcatttcagggcctgtttctgctctacaatctggggagcgtagaggcccttcacgaggtgttacagctgcccgcagccctgcgagcctgcccccccctgcgcaaagctctcgcagttgatgccgccttcagagaggggaatgcagctcgcctgttccggctcctgcagaccctgccttacctgcccagttgcgcggtacagtgccacgttggacatgcccggagggaggctctcgcccggttcgctagagcctttagcaccccaaaaggccagaccctccccctcggcttcatggtcaacctgttggctcttgacggcctgcgcgaggcaagggacctgtgccaggcgcatggactgcctctggatggggaagaaagggtagtgtttctacggggaaggtatgttgaggaaggactgccaccagcctcaacatgcaaagtactggtcgagtccaaactgcgaggcagaacgcttgaggaagtggtcatggcggaagaagaagacgagggcacggataggcccggcagtcccgcttag

SEQ ID NO: 25100 - DNA, 150 bp, Artificial Sequence
  Description of Artificial Sequence: Synthetic coding sequence
atgagcagctgcgtgagcagccagcccagcagcaaccgggccgccccccaggacgaactgggaggccggggatcatcttcctctgagtcccagaaaccatgcgaagctctaaggggcctgtccagcttgagcatacacctggggatgtag

SEQ ID NO: 25101 - DNA, 2598 bp, Artificial Sequence
  Description of Artificial Sequence: Synthetic coding sequence
atgcccgccgtgagcctgccccccaaggagaacgccctgttcaagagaatcctgagatgttacgagcacaagcaatatcggaatggccttaagttctgcaagcaaatcctgagtaaccctaaatttgcagagcatggcgagacactggcaatgaaaggacttactcttaactgtttaggaaaaaaagaggaagcttatgagttggttagaaggggactgaggaacgaccttaagagtcacgtctgctggcatgtttatggtctgttgcagcgcagcgacaaaaagtacgatgaggccattaagtgctaccggaacgcactgaagtgggacaaagacaacctccaaatcttgcgtgacctgagcttgctgcagatacagatgcgcgatcttgagggataccgagaaactagatatcagctgttgcagttgagacctgcacagcgggcctcctggatagggtacgccattgcctaccatcttctggaggactatgaaatggccgcaaaaatcttggaggagtttaggaagactcagcagaccagtccggacaaagttgattacgaatatagcgagttactgctgtatcagaatcaggtcctcagggaagcaggtctgtaccgagaggccctggaacacctctgtacatatgagaagcaaatctgtgataaactggccgttgaggaaaccaagggggagttattattgcagctctgtcgcctggaggatgccgccgacgtctaccgcggccttcaggagaggaatccggagaattgggcctactacaaaggcctcgaaaaggctctcaagccggccaacatgctagagaggttgaaaatctacgaagaggcatggaccaagtatccaagaggactcgttcccaggaggctgccactgaattttctcagcggcgaaaagttcaaggagtgtctcgataagttcctgcgaatgaacttttccaagggatgtccccccgtgtttaataccttaaggtctctatataaggacaaggaaaaggtcgctattatcgaggagctggtggtaggctacgagacctctctgaagtcttgtaggctctttaaccctaatgatgatgggaaggaggagccaccaacaacactgctttgggtacagtattatctggctcagcattatgataagatcggacaacccagcatcgctctggagtacatcaacaccgctattgagtctacacccaccctcattgagctcttcttggtaaaggcaaaaatctacaagcatgccggcaatattaaggaagcagctcgctggatggacgaggcacaggcccttgacacagctgatcgctttatcaatagtaagtgtgccaaatatatgctaaaggcaaacttaatcaaggaggctgaagagatgtgctccaagtttacaagagaggggactagcgccgtggagaacctgaacgagatgcagtgcatgtggtttcagacagaatgtgcacaggcatataaagccatgaacaaatttggggaagcactgaaaaagtgtcacgaaatcgagcggcacttcatcgaaataacagacgaccaattcgatttccacacctattgtatgcgtaaaatcacactccgaagctacgtcgatctccttaagctagaggatgtgcttaggcagcatcctttctattttaaggcagctcgcatcgcgattgaaatctaccttaagcttcacgataatccgctaactgacgaaaacaaagagcacgaggctgatacagctaacatgtctgataaggaactgaaaaaactccggaataagcagcgaagggctcagaaaaaggcacaaatcgaggaagagaaaaagaatgccgaaaaagagaagcaacaaagaaatcagaagaaaaagaaagacgatgacgatgaagaaataggtggacccaaggaggagttgatcccggaaaagcttgcaaaggtggagacacccctggaggaggctatcaaattcctgaccccattgaagaatctcgtcaaaaacaaaattgaaacccatctctttgcgtttgagatctattttcgaaaagagaagttcctgctgatgttgcagtcagtgaaacgagcattcgccattgacagtagtcacccttggctgcacgaatgtatgatcagactattcaacacggtctgcgaaagtaaggacctgtctgataccgtgcggacagtgctgaagcaggagatgaacagactctttggcgccactaatcccaaaaacttcaatgaaacatttctgaagcggaattccgatagtttaccccatcggctgtcagccgcaaaaatggtatactacttagaccctagttcccagaaacgcgcgattgagctggctactacgctggatgaatccctgacgaatcgaaacctgcaaacatgtatggaagtcctcgaggccctgtacgacgggagtctgggagactgcaaggaagcagccgagatatatcgggctaattgtcataaattgtttccatacgcccttgccttcatgcctccaggctatgaagaagatatgaaaatcacagtgaatggagactcaagtgccgaagccgaagagctggctaatgaaatttag

SEQ ID NO: 25102 - DNA, 1797 bp, Artificial Sequence
  Description of Artificial Sequence: Synthetic coding sequence
atgggcggctgcttcagcaagcccaagcccgtggagctgaagatcgaagtggtcctccccgaaaaagagcgagggaaagaagagctgtcagcctccgggaaaggcagccctcgggcctaccaggggaacggaacagcccgtcacttccacaccgaggaaagactgagcaccccacatccatacccttctccccaggactgtgtcgaggccgctgtgtgtcatgttaaagacctggagaacgggcaaatgcgcgaagtggagctgggctggggtaaggtgctgctggtgaaggataatggagaatttcatgccctggggcataagtgcccgcactacggcgcaccacttgtaaaaggtgttctgagcaggggtagggtccggtgtccgtggcacggtgcttgtttcaacattagcacaggcgacttggaggattttcccggcctcgactcactccacaagttccaggtgaagattgagaaagagaaagtttacgtacgcgcttcgaaacaggccctccagttgcagagaagaacaaaggtgatggcaaaatgcatttcaccttccgccggctactctagttccactaacgtcctgatagtgggcgcgggtgccgctggactggtgtgcgcagaaaccctccgccaggagggtttttccgatcggatcgtgctctgtactctggatcgtcacctgccttacgaccgccctaaactaagcaagtccctggacacacagccagagcagctggccctgcgccccaaagaattcttcagagcctatgggatcgaggtgctgacagaggcgcaagtggtgacggtcgatgtgagaaccaagaaagtggtttttaaagacggattcaagctggaatattccaaactgcttcttgctccaggatcaagccccaaaaccttatcgtgtaagggcaaggaagtggaaaatgtattcacgatacgaactcctgaggacgccaacagggtagtgcgcctggcacgcggccgaaacgtggtggtggtcggcgccggcttcctgggaatggaagtggcggcttaccttactgagaaggctcacagtgtatcagtggtggaactggaggaaaccccttttcggcgattcctgggcgagcgcgtgggccgcgctctcatgaaaatgttcgagaataatagagtaaaattttacatgcagaccgaggtgagtgagctcaggggccaagaaggcaaactgaaggaagtggtgttgaagtcctccaaagtggtacgggcggacgtgtgtgtggtgggtatcggtgccgtgccagccaccggcttcctcagacagagtggtatcggactcgattctagaggttttatacccgttaacaagatgatgcaaactaacgtgcccggagtgtttgcagcaggcgacgctgttaccttccctttagcctggaggaacaatagaaaggtcaacattccccattggcagatggctcacgctcagggtcgggtggcagcacagaacatgctggcgcaggaagctgagatgagtacggtcccatacttatggactgccatgttcgggaagtctctgagatatgccggctatggcgagggattcgacgacgtcattattcagggtgacctggaagaacttaagttcgtggccttctacaccaagggagatgaggtgatcgccgtggcctccatgaactatgatccaatcgtttctaaggtggcggaggtcctcgcgagtggccgagcaatccggaagagggaggtggaaactggtgacatgagctggctgaccggcaagggctcctag

SEQ ID NO: 25103 - DNA, 1818 bp, Artificial Sequence
  Description of Artificial Sequence: Synthetic coding sequence
atgggcggctgcttcagcaagcccaagcccgtggagctgaagatcgaggtcgtcctgccagaaaaggaacgcggtaaggaggaactctctgcatccggaaagggctccccacgcgcttaccagggcaacggtacagcacggcacttccacactgaggaacgtcttagtacccctcatccctaccccagccctcaggattgcgttgaggcggctgtgtgtcatgtcaaagatctggaaaatggccaaatgagggaagtggagctggggtgggggaaagtgctcctagtcaaggacaacggtgagtttcatgctctgggccataaatgtccacattatggcgcgcctctggtcaaaggggtattatcaaggggaagagtgcggtgcccgtggcacggcgcctgttttaatatctcgaccggcgaccttgaagacttccctggcctggactctctccacaaatttcaggtgaaaatcgaaaaagagaaagtgtatgtccgagcgagcaagcaggccttgcagctccagaggcggacaaaggtgatggccaagtgcatctcaccatccgcaggctattcgtcttctacaaatgtcttaatagtgggagcgggggcagccgggctcgtgtgtgcggagactctgcgccaggaaggattctccgaccggatagtcctctgtaccctggacaggcatctgccatacgaccgacccaaacttagcaaatctctcgacacccaacctgagcaactggcactgagacctaaagagttcttcagagcttatggaattgaggttctcacagaggcgcaggtggtgaccgtggatgtaagaaccaagaaagttgtgttcaaggatggttttaagctcgagtacagcaagctgctcctcgcccccgggagcagccctaaaaccttaagctgcaaaggtaaggaagttgagaatgtgtttacaatccgcacccccgaagatgctaaccgcgttgtgcgactggctcgggggcggaacgtggtggtagttggggccggctttcttggaatggaggtggccgcctacctgaccgaaaaggctcacagcgtgtccgttgtggagttggaggaaacaccctttagaagattcctaggggaacgcgtgggtcgcgctttaatgaaaatgtttgagaataacagagtcaaattctatatgcagacagaagttagcgagttacgcggtcaggagggcaagctgaaagaagtcgtcctgaaatcttcaaaagtggtcagagccgacgtgtgtgttgtgggaatcggggcagtcccagctactggattcctgcgtcaatccggaatcgggttagattctcgaggtttcatacccgttaataaaatgatgcagaccaatgttccaggtgtcttcgccgcaggagacgcagtaacatttccgttggcttggagaaataaccgcaaagttaatatcccacactggcagatggcccatgcacaggggcgagtggcagcccaaaacatgctggcgcaggaagctgagatgagcacagtcccctacctttggacggcgatgtttggcaaaagccttcgctatgcagggtatggggaagggtttgatgatgtaatcatacagggagacctagaagagctcaagttcgtggccttctacaccaagggtgatgaagttatcgccgtggcgtcaatgaattatgatccaatcgtcagtaaggttgccgaggtcctcgcaagcggacgcgccatccgtaaaagagaagtggagctttttgtgctgcattccaagacaggtgacatgagttggctgacaggcaaaggatcctag

SEQ ID NO: 25104 - DNA, 1374 bp, Artificial Sequence
  Description of Artificial Sequence: Synthetic coding sequence
atgaaccagccctgcaacagcatggagccccgggtgatggacgacgatatgctcaaactggcagtgggggatcagggacctcaggaagaagccggacagctggctaagcaggaagggattctctttaaggatgtgttgagtctgcagctcgactttaggaacatcctgcgaatcgacaatctttggcagttcgaaaaccttcggaaactgcagctcgacaacaatataatagagaaaattgagggtctcgaaaatctcgcccacctggtgtggcttgatttgtcattcaacaacatagaaaccattgagggcctcgatactctcgtgaacctggaggacctctctctgtttaataataggatctcaaaaatagactcccttgatgcgctggtgaagctgcaggtcctgtcactaggaaataatcggattgacaatatgatgaacataatctatcttagaagattcaaatgcctcaggacgctgagcctgagtaggaatcctatcagcgaagccgaagactacaagatgttcatttgcgcctacttgcccgatcttatgtaccttgattaccggagaattgacgaccacactaagaaactcgccgaggcaaagcatcagtactcgatcgacgaactgaagcatcaagagaaccttatgcaagcgcagctcgaagatgaacaggcgcagagggaggagttagagaaacacaagacagcgtttgtcgaacatttgaacggctctttcctcttcgacagcatgtacgcagaagactccgaagggaataacctgtcctacctgccaggagttggagaactcctggagacctacaaggataagttcgttatcatctgtgtgaacatctttgaatacggcctcaagcagcaggaaaaacgcaaaacagagttggacaccttttctgagtgcgtgcgggaggccatccaggagaatcaggaacaggggaagaggaagatcgctaagttcgaggagaaacacctatcttcactgtcagctattagagaggagctagaattaccgaacatcgagaagatgattctagagtgctctgctgacatctctgaactcttcgacgctctgatgacactggaaatgcagctggtggagcaactggaggagacaatcaatatgtttgagcgaaatatcgtggacatggtcggactatttattgagaatgtgcagtcattgatggctcagtgtagggatttggagaatcatcaccacgagaaacttttggagatctctatcagcacgctcgaaaaaattgtggagggcgacttagatgaggacctccccaatgatctccgcgcgggaagatttcagaagttcaattacgttgaagcttccggtacattctag

SEQ ID NO: 25105 - DNA, 1374 bp, Artificial Sequence
  Description of Artificial Sequence: Synthetic coding sequence
atgaaccagccctgcaacagcatggagccccgggtgatggacgacgacatgctgaagttggctgtgggagaccaggggcctcaggaggaggcagggcaactggccaagcaggagggaatcctgtttaaggacgtcctcagtctccagcttgactttagaaacatcctacgcatcgacaacctttggcaatttgagaacctccggaagttgcaacttgataacaatataatcgagaagatcgagggactggagaacctggcccacttagtgtggttggatctgagttttaacaacatcgaaaccattgaaggcttggataccctcgtgaacctggaagacttaagtctgtttaataacagaatctcgaaaatagattccctagacgctcttgtgaaactacaagtactatccctggggaacaacagaatcgataatatgatgaatatcatctacctgcgtcgctttaagtgcctccggaccttatcactgagccgcaatccaatttccgaggccgaagattataaaatgttcatatgcgcctacctccctgacctcatgtacctggactataggcgaatcgacgaccacacaaagaaactagcagaagcgaagcatcagtactctattgacgagcttaaacatcaggaaaacctgatgcaggcccagctggaagacgagcaagcccagcgggaggaactggagaagcacaagactgcatttgtcgaacacctcaacggctctttcctcttcgacagcatgtatgcggaggactccgaggggaacaatttgtcttacctacctggagtgggagaattattggaaacatacaaggataaatttgtaattatctgtgtgaatatttttgagtatggtctgaagcagcaggaaaagaggaagacagagctcgacacattttccgaatgcgtgagagaagccatccaggagaatcaggaacagggcaaacgcaagattgccaaatttgaagaaaagcatctttcctccctttccgccatccgggaagagctggaactgcccaacatcgagaaaatgattcttgagtgctccgcagacatttccgagttattcgatgccctgatgacgctggaaatgcaattggttgaacaactcgaggagacgatcaatatgttcgaaagaaacatcgtcgacatggtggggttattcatcgagaacgtgcagtctctgatggcacagtgccgcgacctcgagaaccatcaccacgagaaattgttagagatctccatttcaactttggaaaagattgtcgagggtgacctcgacgaagatctccctaatgacctccgagcaggccggtttcagaaattcaattatgtggaagctagcggcacattctag

SEQ ID NO: 25106 - DNA, 1572 bp, Artificial Sequence
  Description of Artificial Sequence: Synthetic coding sequence
atgaaccagccctgcaacagcatggagccccgggtgatggacgacgacatgttgaagttagcggtgggagaccaaggcccacaggaagaggccggacagctagcgaagcaggaaggcatcctctttaaggacgttctgagtctacaactagactttcgcaacattctacgtatagataatctctggcagttcgaaaatctgcgaaaactgcagcttgataataacatcatcgaaaaaatcgagggcctcgaaaacttagcacacctggtgtggctggatcttagcttcaataacattgaaactatcgaaggtctggacactctggtgaatctagaggacctgagcctgttcaataacaggattagcaaaattgatagcctggacgctttagtcaaattacaggtgctgtctctcgggaataaccgcatagacaacatgatgaacataatttacttgaggcgctttaaatgcctaaggactctttcactgagccgaaatcccattagtgaagccgaggattacaagatgtttatttgtgcctaccttcctgatttgatgtacctagactaccgcaggattgatgatcacacaaaaaagctcgctgaggctaagcaccagtattccatcgacgaacttaaacatcaagagaacctgatgcaggcacagctcgaggacgaacaggcccagagggaggaacttgaaaagcataagacagccttcgtggaacacctgaacggctccttcctgttcgattcaatgtacgccgaggactccgagggcaataatttgtcttacctgccgggagtaggagaactgctggaaacctacaaagacaagtttgtcatcatctgtgtgaatattttcgagtatggactcaagcagcaagagaaacgaaaaacggagctggacacattcagtgaatgtgtccgggaagcgatccaggagaatcaggagcagggcaagcgcaaaatcgctaagtttgaggagaaacacctgtcgtccctgtcagccatccgcgaagaactggagctccccaatatagagaaaatgatcctggaatgttcagccgatattagcgaactcttcgatgccctgatgaccctggagatgcagctggttgaacagctggaggaaacaatcaacatgtttgagcggaacatagtagacatggtcggtttgttcatcgaaaatgtccaatctttgatggcacaatgtagggacctagaaaatcaccaccatgaaaagttattggagatatccatttcaacactagagaagattgtggagggcgacctggacgaggatctgccaaatgatctaagggctctgttcgtggataaggacaccattgtgaacgccgtcggggcatctcatgacatccatctcctgaagatagacaatagagaagacgaactcgtcactaggattaactcctggtgtactaggcttattgatcgaatccacaaggatgagataatgagaaatcggaaaagagtaaaagaaattaaccaatatatagatcacatgcaatctgagttggataatctggagtgcggcgacattctagattag

SEQ ID NO: 25107 - DNA, 1572 bp, Artificial Sequence
  Description of Artificial Sequence: Synthetic coding sequence
atgaaccagccctgcaacagcatggagccccgggtgatggacgacgatatgttgaagctcgctgttggggaccagggaccacaagaagaagcaggacaactggccaaacaggagggaatcttgtttaaagacgtcctgtccctgcagcttgacttcaggaacatactgaggatagacaatctgtggcagttcgagaatctgcgcaagttgcaactcgacaataatattatcgagaagatcgaaggactggagaatctagcccatcttgtgtggttagatttgtctttcaataatatagaaacaatcgaaggcctggatactctggtgaacctggaggacctgagcttgtttaataatcgaattagtaagatcgattcactggatgcactggtaaaactacaggtactgtccttgggtaataatcgaatcgataatatgatgaacatcatctatcttagacggtttaaatgcttacgaaccctttcactgtccaggaatcctatttctgaagccgaggattataaaatgttcatctgtgcatacctcccggacctgatgtatcttgattatcggcgtattgacgaccacaccaagaagcttgccgaggctaagcaccagtatagtatcgatgaactgaagcaccaggagaacctaatgcaggcacagctcgaagatgaacaggcacagcgggaggagcttgagaagcacaaaactgcattcgtggagcacctcaatggcagttttttgttcgactccatgtacgcggaggactccgagggcaataacctgtcttatctacccggggtaggcgaacttctagagacatataaggataagttcgtaattatctgcgtaaacatttttgagtacggtcttaaacaacaggagaaacggaagactgagctggacactttttccgaatgtgtcagagaagcaattcaggagaatcaggagcagggaaagcgcaaaatagctaagtttgaggagaagcacctgtcttcactgtcggcaatccgtgaggagttggaactgccaaatatagaaaagatgatcctcgaatgctcagcagacatctccgagctgttcgatgctttgatgacacttgaaatgcagctggtcgaacagcttgaggagacaattaacatgttcgaacgcaatatcgtggatatggtcggtctcttcatcgagaatgtacagtcactgatggcacaatgcagggaccttgaaaatcatcaccacgaaaagttgctcgagatctcaatctccaccctcgagaaaatcgtcgagggagatctcgatgaagatctccctaacgatctccgagccctgttcgtggataaggacaccattgtgaacgccgtgggagccagtcacgatatccacctactcaagattgataatagggaggacgaactagtgactagaattaacagttggtgcacccgtttgatagaccggattcacaaggacgaaatcatgagaaacagaaagcgtgtaaaagaaataaaccagtatatagaccacatgcaaagtgaactcgacaatctggagtgtggggatattcttgattag

SEQ ID NO: 25108 - DNA, 1842 bp, Artificial Sequence
  Description of Artificial Sequence: Synthetic coding sequence
atggccaccatccccgactggaagctgcagctgctggcccggcggcgccaggaagaggccagcgtgcgcggcagagaaaaagcggaacgggagcggctgtcccagatgccagcatggaaacgcggactcctcgagagacggagggcgaagctaggtttgagtccgggtgaaccctccccagtcctgggcaccgtggaagctggccctccggatcctgatgagtcagcggtgttattagaagccattggaccagtccatcaaaatcggtttatcaggcaagagcgccagcagcagcagcagcagcaacagcgcagtgaggaactactcgccgaaagaaaacctggcccccttgaggctagagaacgtagaccttcccccggcgagatgagggatcagagccccaagggacgggagtcccgggaagagaggctcagcccacgagagactcgcgaaaggcggttgggaatagggggtgctcaggagctgtccctgaggccacttgaggctcgggattggaggcagagtcccggtgaggtgggcgaccgatcctcccgccttagtgaggcttggaagtggagactcagccctggcgagacacctgagaggagcctgagactggccgagtcccgggaacaaagtcctaggcggaaggaggtcgaaagtagactcagccctggcgagtcagcgtaccagaaacttggcctgaccgaagcccataaatggaggcctgattctcgagagagtcaggagcagtctcttgttcaactcgaggcgactgagtggcgcttgcgcagcggagaggagcgtcaggattatagtgaagaatgtggtcggaaggaggaatggcctgttcctggcgttgctccgaaggagacagccgagttgtctgaaacgttgacccgagaagcccaggggaactcatcagccggagtggaggccgctgaacaaagaccagtggaggatggcgagcggggcatgaagccgactgagggctggaaatggacactgaattccggtaaagctcgggagtggacgccgagagacatcgaggcccaaacacagaaaccagagccaccggagagcgcagagaagctcttagagtctcctggggtagaggccggcgagggggaagccgaaaaggaagaggccggcgcccaaggcaggccactgagggccctgcaaaactgttgttcggtaccatccccattgccacccgaagatgccggaacaggaggcctccgacaacaggaagaagaggctgttgaactccagccaccccccccagcccctctctcccctccaccacccgctccaactgcaccccagccgcctggcgatcctctcatgtccaggttgttctatggtgtgaaagcgggccctggagtcggcgccccccgcaggtccggtcatacgtttactgttaacccgaggcggagtgtcccaccggctacacccgcaacgccaacatctccagcaacggtggatgctgccgtgccaggagcaggcaagaagcgctaccccaccgccgaggaaattctggttctgggtggctatctacgactgtccaggtcatgtctagccaaaggaagcccagagcggcaccataaacagctgaagatcagtttctcagagactgccctcgaaacaacctatcagtacccctccgagagcagtgtactggaagaactgggtccagagcccgaagttccatctgcccctaatcctcctgccgcccagcctgatgatgaggaagacgaagaggagcttctgcttctgcagcctgagctacagggggggctacgaacaaaggcgctcatcgttgacgagagctgtaggaggtag

SEQ ID NO: 25109 - DNA, 390 bp, Artificial Sequence
  Description of Artificial Sequence: Synthetic coding sequence
atggccgagctgatccagaagaagctgcagggcgaggtggagaagtaccaacagctccagaaagacctatctaaatctatgtcaggacgccaaaagctggaagctcagctgacggaaaacaacattgtaaaggaggaattggcactgcttgatggttcaaatgtagtgttcaagctcctggggcctgtgttagtgaagcaggagctgggagaagcacgggctacagttggcaaacgtctagactacataacggccgagatcaaaagatacgagtcccaacttcgggatcttgaacggcagagcgaacagcagcgagaaacacttgcccaactgcagcaagagttccagagagctcaggccgctaaggctggggcccctggaaaggcctag

SEQ ID NO: 25110 - DNA, 390 bp, Artificial Sequence
  Description of Artificial Sequence: Synthetic coding sequence
atggccgagctgatccagaagaagctgcagggcgaggtggagaagtaccaacagttacaaaaagacctgtcaaagagcatgagcgggcgccagaaattggaagcccagctcacggagaacaatattgtcaaggaggagctcgctctcttggacggtagcaacgtggtctttaaattgttaggacccgttcttgtgaagcaggaattgggtgaggcacgggcaaccgttggcaagaggttggattacattaccgctgagattaaaaggtatgaaagccagttacgagatctcgaacgccaatccgagcagcagagggagaccttggcccaactgcaacaggaattccaacgcgcccaggctgctaaagcaggggcgcctggcaaagcttag

SEQ ID NO: 25111 - DNA, 4128 bp, Artificial Sequence
  Description of Artificial Sequence: Synthetic coding sequence
atggtgcccggcgaggagaaccagctggtgcccaaggaggacgtgttttggaggtgcagacagaatatttttgacgagatgaagaagaaatttctgcaaatagaaaacgccgccgaagaaccgcgagtgctctgcattattcaggacaccaccaatagcaaaaccgtcaatgagcgcataacccttaatttgcccgccagcacacccgttaggaaattgttcgaggacgtggcgaacaaggtgggatatataaacggcaccttcgatctggtgtggggtaatgggataaacacagccgatatggcccccctggaccatacatctgacaagtctttgctagacgccaactttgaacctggcaagaagaattttctccatctgacggacaaagacggcgagcagccacagatcttattggaggacagctcagccggagaggatagcgtgcacgaccggtttattggcccgctgccccgtgagggttcagggggctccacaagtgactatgttagtcaatcctattcgtattcctcaatcttaaataagtccgagacaggttacgtcggacttgtaaaccaggccatgacctgctacttaaactccctgctgcagaccctctttatgacccctgaattcaggaacgctttgtacaagtgggagtttgaagagagtgaggaggaccccgtgacttccatcccctaccagttgcagcgcctgttcgtgctccttcagacatcaaaaaagcgcgccatagagacaacagacgtgactcgaagcttcgggtgggactcctccgaggcctggcagcagcacgatgtccaggaactatgcagggtgatgttcgatgctctagagcagaagtggaagcaaaccgaacaagctgacctgataaatgagttataccagggaaagttaaaagactacgttaggtgtttggagtgtgggtacgaaggctggcggattgacacttacctcgacatcccactcgtcatacgaccttatgggtcgtcacaggccttcgcttccgtcgaggaggccctgcacgctttcatccaacccgagattctggacggacccaatcagtacttctgtgaacgatgtaaaaagaagtgtgatgcccggaaaggacttcgatttctgcatttcccttacctgttaacactacaactcaaaagattcgacttcgattacacaaccatgcatcggattaagctgaacgaccgcatgacgttccccgaggagcttgacatgtctacatttattgacgtggaagacgagaaatcccctcagacagagtcctgcacagattctggtgctgaaaatgaaggaagctgccattccgatcagatgagtaatgatttcagcaacgacgatggtgttgacgaagggatctgtttggagaccaactctgggacagaaaagatctcaaaatctggcctggagaaaaacagtcttatctatgagctgttctcggtgatggtgcattccggaagcgccgccggcgggcactattatgcttgcattaaatccttcagtgacgaacaatggtattccttcaacgatcaacacgtgtccagaataactcaggaggacataaagaaaacacacggcggcagtagcgggtcccgaggttactactcctcggcgtttgccagcagtacaaatgcgtatatgcttatttatcgcttgaaagatccagcgcgtaacgcgaagttcctggaagtggacgaataccctgagcacattaagaatctggtgcagaaggaaagggagcttgaggaacaggagaaacggcagcgggagattgagcgcaacacctgcaaaattaagctgttctgcctgcacccaacaaaacaggtgatgatggagaacaagctggaggtgcacaaggacaaaactctgaaggaggccgtggaaatggcatataagatgatggatctggaggaggtgattcctcttgactgctgcaggctcgtaaaatacgatgagtttcacgactatctggaacgtagctatgagggggaagaggatacacctatggggttgctgttagggggggtgaagagtacgtacatgttcgacctcctgttagagactagaaaacctgatcaggtgttccaaagttacaagcccggtgaagtcatggttaaagtgcacgtcgtggatctcaaagcggaaagcgtcgccgcccctatcaccgtacgagcttacctgaatcagacagtcacggagtttaagcagctgatatctaaagcaatacacctgccagccgagactatgagaatcgttctggaaaggtgttataatgacttaagactgctgagcgtgtcatccaaaactctcaaggccgaagggttcttccgctctaacaaagtgttcgtggagtctagtgagacccttgattaccagatggcctttgccgattctcatctttggaaactcttggatcgacacgctaacactatcaggctgttcgtactgctgcccgagcagagcccagtctcatactccaaacgtacagcatatcagaaagccggcggcgatagcggaaacgtcgacgatgactgtgaacgggtgaaaggacccgtaggatccctgaaatctgtcgaagccatcttggaggagtcgacagagaagctgaagtctttgagtctacagcagcagcaggacggagacaatggggattcttctaagagcactgaaacgagcgattttgaaaacatcgagtctccccttaatgagcgagattcttcagcgtccgttgacaatagggaactggaacaacatatccagacaagcgaccccgagaacttccagagtgaagaacggtctgactccgacgtcaataatgaccggtctacctcaagtgtggacagcgatatcctgtcatcctcgcattcatccgatactctgtgtaatgcagataacgcgcagataccactcgccaatggactagatagccattcaataacctctagtcgacggacaaaagccaacgagggaaaaaaggaaacctgggacactgcggaagaggactcgggcacagattctgagtacgacgaaagcggaaaatctagaggtgagatgcagtacatgtacttcaaggcagaaccgtacgccgcagacgagggatccggtgagggacataagtggctgatggtgcatgtcgacaagcgaatcaccctggccgcgttcaagcaacacctggagccctttgttggggtattgtccagccacttcaaggtgtttcgagtgtatgcttcaaaccaggaattcgaaagtgtccggctgaatgagactctcagcagcttttcagatgataacaagataacgattcgcttgggaagggcccttaaaaagggcgagtaccgggtgaaagtataccagctgctcgtgaacgaacaggagccctgcaagtttctgctcgacgccgtctttgctaagggcatgactgttaggcagtcaaaagaggaactcatcccccaactgagggagcagtgtggcctggagctgtccattgatcgctttcgcctccgcaaaaagacgtggaagaaccccggcactgtatttttagactatcatatttacgaggaggacattaacatttctagcaattgggaggtatttcttgaggtcctggatggcgttgagaaaatgaagtcaatgtctcagttagcggtgcttagtaggaggtggaaaccctcagaaatgaagctggacccattccaggaagtcgtgctggagtctagttccgtagatgaactgagggagaagcttagcgaaatctcaggaatcccccttgatgacatcgagtttgccaaaggaaggggcacgttcccgtgtgacattagcgtcctggacatccatcaggacctggactggaatccaaaagtaagcaccctgaatgtatggccactctatatttgcgatgacggagcagtcatcttttacagagacaagactgaggagttaatggagcttactgatgagcagcgcaatgaactaatgaaaaaagaatcttcaaggttacagaaaaccggccacagagttacgtatagtccccgcaaggagaaggccctgaaaatttaccttgacggagcccccaacaaggatttgacccaggactag

SEQ ID NO: 25112 - DNA, 600 bp, Artificial Sequence
  Description of Artificial Sequence: Synthetic coding sequence
atgcggaccgccgaccgggaggcccggcccggcctgcccagcctgttgctcctcctattagcaggtgcgggactgtcagcagccagcccaccagctgccccccggttcaatgtatctctcgacagcgtgcccgagttacgctggctgccggtcctccgccattatgatcttgacctggtgagagccgcaatggcacaggtcatcggagaccgggtgcctaagtgggtccacgtcttgataggaaaagtggtgctggaactggagcgttttttacctcagcccttcacaggcgaaatcagaggaatgtgtgatttcatgaacctgtctcttgccgactgcctgctcgtaaaccttgcttacgagtcaagtgtgttctgcacctctatagtcgcccaggattctcgtgggcatatctaccatggaagaaatctggactatcccttcggtaacgtgttgaggaaactgaccgttgacgtgcagtttcttaagaacggccaaatcgcattcaccggaacaactttcatcgggtacgtgggcctgtggacagggcaatccccacacaaatttaccgtctcaggagatgaaagggacccacactag

SEQ ID NO: 25113 - DNA, 972 bp, Artificial Sequence
  Description of Artificial Sequence: Synthetic coding sequence
atgcggaccgccgaccgggaggcccggcccggcctgcccagcctgctcctgctgctgcttgccggcgctggcttgtcagccgcgtctcctccggcagccccccggtttaatgttagccttgattctgtccctgaactgagatggctccctgtgctgagacattatgatcttgacctagtgagggctgccatggctcaggtcatcggggatagggtgccgaaatgggtgcacgtgcttatcggcaaggttgtcctcgaattagaacgctttctgccgcagccttttaccggcgagattcgcggcatgtgcgacttcatgaacctgagcctggccgactgccttctcgttaacttggcctacgaatcctctgtgttctgcacctccatagtcgcccaagattcccgcggacatatttatcacgggagaaatttggactaccccttcggcaacgttcttcgcaagctgacagtggatgtacagtttttgaagaatggacagatcgcatttaccggcaccaccttcattggctacgtgggcctgtggaccggacagtccccacacaagttcacagtgtcaggagacgaaagagataaggggtggtggtgggaaaatgctattgcagcactctttagaaggcacatcccagtgtcttggctgatccgagctaccttaagtgaaagtgagaacttcgaagctgccgtaggaaagctggccaagacgcccctcatcgccgatgtctactatatcgttggcggtacgtcccctcgcgagggagtggttattacaagaaaccgggatggtcccgcggatatatggcctttggatccactcaacggtgcttggttcagggtggaaacaaactacgaccactggaagccagcacctaaggaggatgacaggaggacgtcagctattaaggcccttaacgcaaccggacaggctaatctttccctggaggccctgttccagtag

SEQ ID NO: 25114 - DNA, 4539 bp, Artificial Sequence
  Description of Artificial Sequence: Synthetic coding sequence
atggccgccgccgccggcaaccgggccagcagcagcggcttccccggtgccagggctaccagtccagaggcgggaggaggaggcggcgctctcaaggcatcctctgcccccgctgccgccgctggcctcctgagggaggccggatccggtggacgagaacgcgctgactggaggcgcaggcagctccgcaaagtacgaagtgtggaacttgaccagttgccagaacagccgctgtttctcgccgcgagtccccccgcctctagcacttccccctctcctgagcccgccgatgcggccggctccgggaccggctttcagcccgtggcagtgccaccgccccatggtgccgcctctcgcggaggcgctcacttaaccgagagtgtcgcagcccctgactctggagccagctcccctgcggccgccgagccaggagagaaaagggctcctgctgccgagccatcccccgccgctgctcccgcaggccgggaaatggaaaataaggaaactctgaaggggctgcacaagatggacgacagacccgaggagcgtatgattagagaaaagctaaaggccacttgtatgcccgcttggaaacatgaatggctggaaagaaggaaccggcgaggacccgtcgtggtgaagccaataccggtgaagggcgatgggagcgaaatgaaccacctggctgcagagagcccaggagaagttcaggcttctgccgcgtccccagcgtcaaagggacggcgaagccccagcccagggaacagcccctccggaagaactgtcaagagcgagagcccaggggtgaggaggaagcgggtaagtcccgtgcccttccagagtgggagaattacccccccgcggagagcgccatcgccggatggcttttccccatacagtccagaagaaactaatagacgcgtcaataaagtgatgagggcaagactctacctgctgcagcagattggccccaacagtttccttatcgggggggatagtcccgataacaagtatcgggtttttatcggcccccagaattgctcatgcgcccgcgggaccttttgtattcaccttctgttcgtgatgttgagagtatttcaactcgagccaagtgatcccatgttatggcggaagaccctgaaaaactttgaggtggaaagtctgtttcaaaaataccacagtcgcagatcctcaaggataaaggctccttcaagaaacaccattcaaaaattcgtctccaggatgtcgaattcacatactctgagcagctctagtacctccactagctcctctgagaacagcatcaaggacgaagaagaacaaatgtgtcccatctgcctgctgggtatgctggacgaggagagtctcacagtttgcgaagatggttgcagaaataaactccaccaccactgcatgtccatctgggccgaggaatgcagaaggaatcgcgaacccctgatttgtcccctctgtaggagcaagtggcgcagtcatgatttctatagccacgaactgtcttcacctgtcgactcgccatcctccctgagagccgcacagcagcagactgtgcagcagcaacctctggccgggagccgaagaaaccaggagagtaattttaacctcacacattacggaacacagcagatacccccggcatacaaagatctggcagaaccttggattcaagtgttcggaatggagctcgtcggatgcctgttttccaggaattggaatgtgagggagatggctcttcgccggctgagtcatgacgtatcaggcgccctactgctggcgaacggggagtccacagggaactcaggagggtccagtggttcaagtccaagcggcggtgcgacctccggttctagccagacttcaatctctggtgatgtagttgaagcctgctgtagtgtgctgtccatggtatgtgcggacccagtttacaaggtttacgttgccgctctcaaaaccctcagggcaatgctcgtatatactccatgccattcgttggctgagcggataaagctgcagagactcctgcaacccgtggtcgacaccatacttgttaaatgcgccgatgcgaattcgcgcacatcccagttatccatcagcaccctgctggaactctgtaagggccaggcgggggaactggctgtgggtagagagattttaaaggctggttccattgggatcgggggagtggattatgtgctaaattgtattctggggaaccagactgaaagtaacaactggcaagagttgctcgggagactgtgtttgattgaccgcctccttctggaattcccagccgaattttaccctcacattgtgtccacagacgtgagccaggccgagcccgtcgagattagatataaaaaactactgtccctgttaacctttgcgctgcaatcaatcgacaactcccattctatggtggggaagctcagccgccggatctatctctcatccgccaggatggtgacaaccgtgcctcatgtgttctccaaactgttggagatgctcagcgtttcatcctctacccacttcactcgcatgaggcggcgcctgatggccatcgcagatgaagtggagattgcagaggccatacaactgggggtggaagatacccttgatggccaacaggacagctttcttcaggccagcgttcctaataactatctcgaaacaactgagaatagttctcctgaatgtacggtacacctggaaaagaccggtaaggggctgtgcgcaactaaactttctgcatcttcggaagacatcagcgaacgcctggcctccatctccgtcgggcccagctcttccaccaccacgacaaccacgacaaccgagcaacctaaacccatggtccaaactaagggaagaccccacagccagtgcctaaattcaagtcctctcagtcaccacagtcagctcatgtttccagccttgtctactccctcgagctctactcccagtgtccccgcaggcacagctacagatgtgtccaagcaccgcctgcaggggttcatcccttgcagaattccatcggcaagcccccagacacaacggaagttctcattgcaatttcacagaaactgtcctgaaaacaaagattcagacaagctctcgcccgtgttcacccagtcgcgcccactgcccagcagtaatatacatagaccgaagccatctcgcccaactcccggaaacacgtcaaaacagggcgatccgagcaaaaatagcatgacacttgacttgaactcatcctctaaatgcgacgatagctttggttgttcgtctaatagctccaacgccgtcatcccatccgacgagacggtgttcacccccgttgaggaaaaatgtcgtttagacgtcaacaccgaactcaactcatcaattgaggatctgctggaagccagcatgcccagctccgacacaaccgtgacattcaaaagcgaggtggccgtactctcacccgagaaggctgagaacgacgacacgtataaggacgatgtaaatcataatcagaagtgcaaagagaaaatggaggcagaagaggaggaagctctggccatagctatggcaatgtcagcttctcaggacgccctgcccattgttccccagctgcaagtggaaaatggcgaagacattatcatcatccaacaagacactcctgaaacgcttcctggacatactaaagctaagcagccctatcgcgaagacactgagtggctcaaaggccagcagattggactgggtgccttctcaagctgttatcaagcccaggatgtggggaccggaaccctgatggcagtaaagcaggttacatatgtgcgcaatactagcagtgagcaagaggaggtagtcgaggccctccgggaagagatcagaatgatgtcccaccttaaccacccgaacatcattcggatgttgggtgcaacttgcgagaagtcgaattacaacctgttcattgagtggatggcaggaggctccgtggcacacttgctcagcaaatatggagcgttcaaagagtcagtggtgattaactatacggagcaactgctccgagggctgagctatctgcatgagaatcagatcatccacagggatgtgaagggcgctaatcttctcatcgactcaacggggcagagactgcggattgcagacttcggggccgcggcacggctcgcatccaagggtactggcgcgggcgagttccaggggcagctgttagggaccattgcatttatggcccccgaagtgttacgtggccaacagtatggacggtcgtgcgacgtatggtcagttggatgcgccataattgagatggcctgcgcaaagccaccatggaacgcagagaagcactcaaatcacctggccctgatctttaaaatcgcttctgcgaccacggcaccttccatccctagccacctgtccccaggtctgagggacgtggccctgcgatgtctggagctgcagccccaagacagacccccgtctcgggaactgctgaaacatcccgtgtttaggacaacctggtag

SEQ ID NO: 25115 - DNA, 2274 bp, Artificial Sequence
  Description of Artificial Sequence: Synthetic coding sequence
gccgacggcggcgacagccaggccttccggtgcaccagctgcggccatgccgggacaactcccgcccctcgcgaagccctctcacctgccgacgcccacgtgggccgagggttcgcggagagggagccaatcccagctcagggactactggttttggctgtcctctcagatggagcaggcgaccacatccgccagcgactgctgcctccactcctgcagatcgtgtgcaagggcttagaagacccaagccaggtggtgagaaatgccgcactgtttgcactgggccaattttccgagaaccttcagccacacattagctcttattcacgagaagttatgcctctgttactggcttatctcaagtcagtgccgttggggcatacacaccatctcgcaaaagcttgttacgccctcgaaaatttcgtcgagaatctaggtccaaaagttcagccttatcttccggaactcatggagtgcatgcttcaactcctgcgcaatccaagcagcccacgcgcaaaggagttggcagtctccgcactgggtgccatcgccacagcagcccaggcatccttactgccgtacttccctgctattatggagcacctcagggaattcctgctcacagggagagaagacctgcagcctgtgcaaatacagtctctggaaactctcggcgtgctggcaagagcagtgggagaacctatgcggcccctcgccgaagagtgctgccaactgggtctcggcctgtgcgatcaggtggacgaccctgacctccggcggtgtacctactctctctttgccgctttgtccggcctcatgggcgaaggcctcgcgccacacctggaacaaatcactaccttaatgttgttatcattgagaagcactgaaggtatcgtgcctcagtatgacggctctagctcatttttgctgtttgatgacgaatctgacggggaggaggaggaggaactcatggatgaggacgtggaggaggaggatgatagcgaaatttcgggatactcagtggaaaacgcctttttcgacgagaaggaggacacatgtgcagccgtgggcgaaatctcagtgaacacatcagttgctttcctcccatacatggagtcagtcttcgaagaagtgtttaagttgctggagtgtccccacttgaacgttcgcaaggcagctcatgaggcacttgggcagttttgttgtgctctgcacaaggcatgtcaaagctgcccaagcgagcctaacaccgccgccctgcaagcagcccttgcccgcgtggtccctagttatatgcaggcggttaaccgagagagagagagacaggttgtcatggcggtgcttgaggccttgactggcgtcctgagatcatgcggtacattgactctgaagccgcctggcagacttgccgagctgtgtggggtcctgaaggcagtgttgcaacggaagacggcatgccaagataccgatgaagaagaagaagaggaagatgatgaccaggctgaatacgatgcaatgcttctcgagcacgctggagaagccatccctgccttggccgccgctgccggcggcgactcctttgcccctttcttcgcaggtttcttacctttgctggtgtgtaaaacgaaacaggggtgtacagtcgccgagaagtccttcgctgtcgggacccttgccgagactatccaaggcctgggcgctgcttctgcccaatttgttagcagactgttacccgtgctgttaagcactgcgcaagaagcagaccctgaagtgcggagtaatgcaatttttggaatgggagtgcttgcggagcacggggggcatcctgcacaagagcacttccccaagttgctgggactactcttccccctgctggctcgcgaaagacatgatcgcgtgcgcgacaacatatgcggagccctggcacgcctactgatggcctcgccgaccagaaagcccgagccacaagtgctggccgccctgcttcacgccctccccctgaaggaagacctggaagagtgggtcacgattgggagactatttagcttcctgtaccaatctagtcccgatcaagtcatcgacgtggccccggagctcctaaggatttgtagccttatcttagccgacaataagatcccacccgatacgaaggcagctctgctgctgctgctgacttttctcgctaagcaacataccgattcatttcaggctgcgctgggaagcctgccagttgacaaggcccaggagctgcaggctgtactcggactctcctag

SEQ ID NO: 25116 - DNA, 1812 bp, Artificial Sequence
  Description of Artificial Sequence: Synthetic coding sequence
atgggcgtgatccccgagggccccctgtgggtgagcggcagcgacgataacctgtcaggaacatccgggatggaggttgatgaccgtgtgtctgcattggagcagaggctgcagttgcaggaagatgaacttgccgtgcttaaggcagccctcgccgacgcccttagacgtttacgcgcctgcgaggagcaaggagcggccctgagggcccgcgggacccccaaaggcagagcccctccccggctgggaacaactgcatcagtgtgtcagctccttaaggggctcccaactaggacgccactgaatggctccggaccgcctcgacgggtgggtggatatgctactagcccatccagccctaaaaaagaagccacctcaggcaggtccagcgtgagacgatacttgagcccagagagattagcatcggtaagacgagaagatccccggtcacgtactacatcctcatcctccaactgttctgccaagaaagaaggcaagacaaaggaagtgatttttagcgttgaagatgggagcgtcaaaatgttcctgcgtggaagaccagtgcctatgatgattccagatgagcttgccccgacctactctctggacaccaggtctgagctcccctcctgccggcttaagctggagtgggtctacggttataggggtcgcgactgtagagctaacctctatctgctcccgaccggggaaatagtgtacttcgtggcctctgtggcagtgctgtattctgtggaagagcagcgccaacgacactacctgggtcacaacgacgatataaaatgcttggctattcaccccgatatggtgacgatagcaacaggacaggtcgccggtacaactaaggaagggaagccactaccgcctcatgttagaatctgggatagtgtgtccctgagtactctgcacgtcttaggccttggtgtattcgacagagccgtatgctgtgttgggtttagcaagagcaacggagggaaccttctgtgcgcagttgacgagtccaacgaccacatgctgtcagtttgggattgggccaaggagacgaaggttgtggatgtaaagtgttccaacgaagccgtcctggtggcaacattccaccccaccgacccgactgtcctcattacgtgtgggaagtctcacatttacttctggaccctggaaggtgggtccctgagcaagagacaggggctgtttgagaaacatgagaaacctaagtacgtgttatgcgtgacattcttggagggaggagatgtggtaacgggtgactccggcgggaatctgtacgtctggggtaagggcggtaaccgcatcacccaggctgtgctgggtgcgcacgacggcggtgtgtttggtctttgtgcgctacgagatgggactctggtttccggaggcgggcgcgaccgccgtgtagtgctctgggggagcgactacagtaagcttcaggaggtcgaagtacccgaggacttcgggcctgtgagaactgtcgcggagggacacggcgacaccctgtatgtgggaacaacccggaacagcatcctgcaggggagcgtgcatacaggtttctccctcttggtacaaggccacgttgaggagctttggggcctggccacacatccaagccgcgcccaattcgtgacatgtgggcaggataagctagtacacctctggagttccgactcacaccagccactgtggagcagaattattgaagtcgagagtcggagtgtgactcaggcgggtggccagtggcacgatcttggctccctgcagcctccgcccccaggatttaaatag

SEQ ID NO: 25117 - DNA, 996 bp, Artificial Sequence
  Description of Artificial Sequence: Synthetic coding sequence
atggccgagggcggcggccccgagcccggcgagcaggagcggcggtcaagcggtccccgacccccgtccgccagagacttacagttagccttggctgagttgtatgaagatgaagtcaagtgcaaatcatctaagagtaacaggcctaaagctacagtatttaaatctccaaggacacctccccagaggttctattctagtgagcacgaatactccgggctcaatatcgtgagaccaagtacagggaaaatagttaacgagttgttcaaagaggctcgcgagcacggggccgtgccacttaacgaggctactagagcgtcgggcgatgacaagagcaaaagttttacaggtggcgggtatcggctaggttcatccttctgtaagcggtctgagtacatttacggcgagaaccaactacaagacgtgcagattctccttaagctgtggagtaatggtttttcactggacgatggggaacttaggccttacaatgagcccacgaatgcacagtttttagagtccgtgaaaagaggtgaaatccctttggagttacaaaggttggtccacggtggccaggtgaacctggacatggaagaccaccaggaccaggaatatataaagccacgattaagatttaaagccttcagtggtgagggccaaaaactgggatcactcactcccgagatcgtgtcaaccccaagcagtcctgaggaagaggacaagagcatcctgaatgctgtggtgttgatcgacgactctgtccccaccactaaaatccagatccgattggctgacggctcaagactgatacagcgtttcaacagcacacacaggatcctggacgtgcgtaattttattgtccagagcagaccggagttcgccgctttggactttattctcgtcactagtttccctaacaaagagctgaccgatgaatcactcacactgctggaggccgacattttgaacactgtcctactccagcagctcaagtag

SEQ ID NO: 25118 - DNA, 2064 bp, Artificial Sequence
  Description of Artificial Sequence: Synthetic coding sequence
atggacggcggcgccctgaccgacaccagcctgaccgacagctacttttccaccagtttcattggggtgaatggatttggttcccctgtcgagacaaagtatcccctgatgcagcggatgactaattcaagctcatctccctcactcctaaatgatagcgcaaagccttatagtgcgcacgacccccttacctctccagccagctcacttttcaatgacttcggtgccctcaatatcagccagcgccgaaagacacccaaccctaccgcctcggaattcataccaaagggtgggtccacgagtcggctctccaatgtcagccagtctaatatgtctgcattcagccaggtgttcagtcatccatccatgggaagtccggctaccgcaggactggcaccaggcatgtctttatccgctggcagctcgcctctccactctccaaaaattacgccccacacgagcccagctccgcgacgcagaagccacacacccaatcccgcctcttacatggtgcctagctcagcgagcacctccgttaacaacccagtgtctcagactcctagctccgggcaggtcattcagaaagagacagttggggggacaacctacttttacacagataccacccccgcaccgctgacaggtatggtattcccaaactatcacatctatccacccactgctccgcatgttgcttatatgcagcccaaggcaaacgccccatcctttttcatggcagatgaacttcgccaggaactcattaatcgccacctcatcactatggcgcagattgaccaggcagacatgcccgcggtccccactgaagtagacagctaccactcattattccccctggaaccactgccgccaccaaatagaatccagaaatcctcaaactttggctacatcacctcctgctacaaggccgtgaactccaaggacgatctgccttattgcttgcgtagaatccacggcttccgcctcgtgaacactaagtgcatggtgcttgttgatatgtggaagaaaattcagcacagtaacatcgttacgctgcgagaagtgttcaccactaaagcctttgccgagccttcactggttttcgcatacgattttcacgcaggcggggaaaccatgatgtctagacatttcaacgatcccaacgcagatgcttattttaccaaaaggaagtggggacaacacgaggggcccctccccagacagcacgccgggctgctgcccgagtcactgatctgggcttatatcgtgcagctctctagtgcattgagaactatacataccgccggcctcgcttgtagggtaatggacccgacgaaaatcctgatcacggggaaaactcgtctccgggtgaattgtgtgggggtattcgacgtacttacgtttgataacagccagaacaacaaccccctggcactcatggcacagtatcaacaggccgatctgattagtctagggaaggtcgttctggcgctggcatgcaacagtctggcagggatacagcgagagaacctgcaaaaggccatggaactggttaccataaattattcctcagacctgaagaatctcattctgtacctgttgaccgaccagaataggatgagatcggtgaatgacataatgcccatgataggagctcggttctatacacagctcgacgcagcgcagatgcgtaatgatgtcatcgaggaagatcttgcgaaagaagttcagaacggtcgcctattcagactgcttgctaaattaggcaccatcaacgagcggcccgagttccagaaagacccaacatggagcgaaactggcgatagataccttctgaagttatttcgggaccatctgttccatcaagtgacagaggcaggggctccctggatcgacttgtcacacattatcagctgcctcaacaaactagatgcaggagttccagaaaagatatcactcataagcagagatgagaagtcagtgctggtggttacctatagtgacctaaagcgctgttttgagaacactttccaggaattaatagccgccgccaatggacagctgtag

SEQ ID NO: 25119 - DNA, 6951 bp, Artificial Sequence
  Description of Artificial Sequence: Synthetic coding sequence
atggacggcgtgagcagcgaggccaacgaggagaacgacaacatcgagcgccctgtcaggcgtaggcacagctcaattctaaagccgcctaggagcccactccaagacctccggggcggaaacgaaagagtgcaggagtccaatgcactgcgtaacaaaaaaaattcccggcgtgtgagctttgctgacaccattaaggtattccaaacagagtcccatatgaaaattgtacgaaagagcgaaatggaggagaccgaaaccggggagaacctactactgatccagaacaaaaaacttgaagacaattactgcgaaatcacaggcatgaacactttgctgtccgctcctattcacacacaaatgcagcagaaggagttttctattatcgaacacactcgagaacgaaaacacgccaacgaccagaccgtaatcttctctgacgaaaaccaaatggatcttacgtctagccataccgtgatgattactaaaggacttctggataatcctatctctgagaagtcaacaaaaattgacactacctcgttcctggccaacttaaaactgcacacagaagacagtaggatgaaaaaggaggtgaacttctcagtagaccaaaatactagctccgagaacaaaatcgactttaatgacttcattaaacggttaaaaacaggcaagtgtagcgcctttcctgacgtgcccgacaaggagaactttgaaattcccatctatagcaaagaacccaacagtgcatcgagcacgcatcagatgcacgtgtccctcaaggaagacgaaaacaactctaacataacaagattgttccgggagaaggacgatggcatgaacttcacccagtgccacacagcaaatatacagacgcttattcctacaagctcggaaacgaactcccgggaaagcaagggcaatgacataactatatacgggaacgactttatggatttaaccttcaatcatactttacagattttacccgcaaccggcaactttagcgaaatcgaaaaccagacacagaatgcaatggatgtgacgacagggtacggcactaaggcctctggcaataagactgttttcaagtctaagcagaacaccgcctttcaggatctgtctatcaactcggccgataaaattcacatcacgagatctcacatcatgggggctgagacacatatcgtctcacagacctgcaaccaagacgctaggatcttggctatgacacccgagagcatttacagcaacccctctatacaaggctgcaagaccgtgttctacagtagctgcaatgatgccatggaaatgactaagtgcctatccaacatgagagaagagaagaatcttctcaaacacgactcgaattacgccaaaatgtactgcaatcccgatgctatgagctctttaacagagaaaacaatatactctggcgaggagaatatggatataaccaagagtcatactgtggcgatcgacaatcaaattttcaagcaagaccagtcaaacgtgcagatcgcagccgctcctacccctgagaaggagatgatgcttcaaaatctaatgaccacaagtgaagacggaaaaatgaatgtcaactgtaattcagtacctcacgtgagcaaggagcgcatccagcagtctctgagtaatcctctgtccataagcctgactgataggaagaccgagcttttgagtggagaaaacatggatttgacggaatcgcacacaagcaatctggggagccaggtgcctcttgctgcttataacctggcccccgaaagcacctctgagtcccactcccagtccaagtcttcttccgacgagtgcgaggagatcacgaagagccggaatgaacccttccagcgctcggatatcatcgcaaaaaatagcttgacggacacctggaacaaagacaaggactgggtgctgaaaattctgccctatctggataaagattcaccacagtccgctgactgcaatcaggaaattgccacctcccataacattgtgtactgcggaggggtgcttgataagcagattaccaatcgcaatactgtgagctgggagcaatctctgttttctacgaccaaacccctatttagctccggccagttttccatgaagaaccatgacaccgccatatcaagccatactgtcaaatcggtgctgggccagaacagcaaacttgcggagcctcttcgtaagagcctgagcaatcccacgccagactactgtcacgacaaaatgataatttgtagtgaggaagagcagaatatggatcttacgaaatcccataccgtggtgataggcttcgggccttccgagctacaggaactggggaaaacgaaccttgagcacactaccggacagttgaccaccatgaataggcagattgctgtgaaagtggagaaatgtgggaagtcacctatcgaaaaaagcggtgttctgaaatccaactgcattatggatgtcctcgaggatgagtctgtgcagaagcccaaatttccgaaggagaagcaaaatgtaaaaatctggggaagaaagtccgtaggcggtcccaagatcgacaaaactattgtgttttccgaggacgataaaaacgacatggatatcacaaagtcttatacaattgagattaatcataggccgctgttggagaagcgggactgccacctcgttccacttgcaggtaccagtgagacaattctgtacacgtgcagacaggatgacatggagatcacacgcagccacaccaccgcgctcgagtgcaagactgtcagcccagacgagatcacaaccaggccaatggacaagaccgtggtgtttgtcgacaaccacgtggagttagagatgactgaatctcacaccgtgttcatcgactatcaagaaaaagagagaacagaccggccaaactttgaacttagtcaaaggaagagcttaggaacacctaccgttatctgtactcccacggaggagagtgtgttttttccaggtaacggggaatccgaccggctggtggctaatgattctcaactgacccctctcgaagagtggtccaataaccggggcccagtggaagtcgctgacaacatggagcttagcaaatcagctacatgtaaaaacattaaggacgttcagagcccaggatttctaaacgagccccttagctcgaagagccaacgacggaaaagcctgaagctcaagaatgacaagactattgtattctctgagaatcataagaacgacatggacattacgcaatcgtgcatggttgaaatcgacaacgagtccgcactagaggacaaggaggacttccatctggccggcgcatcaaaaaccattctatattcttgcggtcaggatgatatggaaataaccagaagtcacaccacagctctcgagtgcaagacactgctgcctaacgagatcgccatccgacctatggataaaactgttctcttcacagacaactactctgacctggaggtgaccgattcacatactgtgtttatagattgtcaggcgacagaaaaaattttggaagagaaccccaagttcgggatcggcaagggaaaaaatttgggggtgtccttcccaaaagacaacagctgtgtgcaagagattgccgaaaaacaggcattggccgtgggaaataagatcgttctgcacaccgaacagaagcagcaactattcgctgcaacgaatcgaaccacaaacgaaatcataaaattccactccgccgctatggatgaaaaagtcatcggcaaggttgtggatcaggcctgtaccctggagaaggcccaagtcgagtcgtgccagttgaacaatcgggataggaggaatgtggattttacatcttctcatgcgacagcggtgtgtgggagtagcgacaactactcctgtctacctaatgtgatttcctgcactgacaatctggaaggtagcgctatgctgctgtgtgacaaggatgaggagaaggccaactactgtcccgtgcagaacgacctggcctacgcaaacgacttcgcaagcgaatactatctggaatcggaggggcagcctctgagcgcaccctgccctctcctggagaaggaggaggtgattcaaacttctaccaagggccagctcgattgcgtcatcactctgcataaagaccaggacctcatcaaggatccccggaacctcctggccaaccaaactctcgtgtactcccaggacctcggagagatgaccaaattaaactctaaacgggtgagctttaaactgccgaaggatcagatgaaggtctatgttgacgacatctatgtcatcccacagcctcacttttccacggatcagcctccattacctaagaagggccagtcaagtataaacaaggaagaggtgatcctgagcaaagccggcaataaaagtttgaacattatcgagaactcctctgctcctatttgtgaaaacaaaccaaagattcttaatagcgaggagtggtttgcagctgcttgtaaaaaggagcttaaggaaaatatccagaccacaaattataacaccgccctggattttcactctaattccgatgtgacaaaacaagtgattcagacacatgtcaacgcaggagaagctccagaccccgtcattacctccaacgtgccttgctttcattccataaagccaaatcttaataatcttaatggaaagaccggggaattcctggccttccagacggtacacctccccccccttcccgagcagctcttggaacttgggaataaagctcataacgacatgcatatcgtgcaggccactgagatccacaatattaatataataagttccaatgcaaaggactccagagacgaggagaacaagaagagccacaacggggcagagacaactagtctccctccaaaaacggtgttcaaagacaaagttcgcaggtgcagtttgggtatctttctgcctcgtctgccaaacaagcggaactgcagtgtgacgggaatagacgatctggagcaaatccctgccgatacgacagacattaaccacctcgagacccaacccgtctcatcgaaggattctggaattgggtccgtggcagggaagctaaacttgtctccaagccaatatatcaacgaagaaaaccttcctgtgtacccagatgagatcaacagctccgattccattaatatcgagaccgaggaaaaagcactaatcgaaacataccagaaagagatctcgccatatgagaataagatgggcaaaacatgtaacagtcagaagcgaacgtgggttcaggaggaggaggatatccacaaagagaaaaagatccgtaagaatgagatcaagttctccgatactacccaggatagggaaattttcgatcatcacactgaggaggatattgacaagagcgcgaattctgtgcttatcaagaatctgtcaaggaccccatcaagctgctcctccagcctggattcgatcaaggctgatggcacttcactcgacttctctacctaccggagtagtcagatggagtcccagttcctgagggacacaatttgcgaagaatctctaagagaaaaattgcaggacggccggattacaatccgggagttctttatcctgctccaggtgcacatactcatccaaaaacccaggcaaagcaatctgccaggtaactttaccgtcaacacaccaccaactccagaagacctcatgttgtctcaatatgtgtaccgccccaagatccagatttatagagaggactgcgaagctaggcgtcagaagattgaagagctcaagctctccgccagcaaccaggataagctcctggtggacatcaataagaatctttgggaaaagatgagacactgctcggacaaggagcttaaagcgttcggtatctacctgaacaaaatcaaatcatgttttacaaaaatgacgaaagtgttcacccaccaagggaaggtagccctctacggcaagcttgttcagtccgcacagaatgagcgggagaagctgcagataaagatagacgaaatggataaaatcctcaagaagattgacaattgtcttacggagatggagacggaaaccaaaaatctggaagatgaggaaaagaacaatcctgtcgaagaatgggacagcgagatgagagctgccgagaaggagttggagcagctgaaaaccgaagaggaagagctgcagaggaacctgctggaactggaggttcagaaggaacaaacactggcccagattgactttatgcagaagcagagaaataggacagaagagcttttggaccagctgagcctgagcgaatgggatgtcgtagagtggtctgatgatcaggccgtgttcacattcgtgtacgacacaatccagttgaccattacatttgaagagtctgtcgtcggtttccctttccttgacaagaggtaccggaagatcgtagatgtaaattttcagtctctgctggacgaggaccaggccccacccagctcactgttggtgcataagctgatcttccagtacgtagaggaaaaagagagctggaagaaaacttgcaccacacagcatcagctgcccaagatgctcgaggagttcagtctggtggtgcatcattgcaggctcctcggcgaagagatcgagtacctgaagaggtgggggcctaattacaacctcatgaacattgatatcaataataacgaactccggttgctgttcagctcgtccgctgcattcgctaaattcgagatcaccctgtttctgtctgcctactacccatctgtaccattaccctctaccattcagaatcacgtcggcaacactagccaggacgacattgctaccattttatccaaggtgccactcgaaaacaactatcttaaaaacgtggtcaaacagatttaccaagacctgttccaggactgtcacttttaccattag

SEQ ID NO: 25120 - DNA, 714 bp, Artificial Sequence
  Description of Artificial Sequence: Synthetic coding sequence
atgggctgctgcggctgcagcggcggctgcggcagcggctgcggcgggcgtggcagcgggtgcggcggctgcggatcagggtgtggtggttgcggtagtggctgtggcggttgtggatccggatgtggaggttgtggcggttgcggatccggttgcgctggatgtggcgggtgtgggtctggctgctgcgttcccgtctgctgctgcaagccaatgtgctgttgtgtgcccgcctgttcgtgctctagctgtggcaaaggtgggtgcggatcttgcgggggcagcaaacgcggctgtgtctcctgcggcgtgtccaagggagcatgcggatcttgtggtggctcgaagggaggctgtgggagttgcggaggctctaaagggggatgtggaagctgtggcggaagcaaagggggctgcgggagctgtggaggaagtaagggaggatgcggctcatatggttgctcccaatcgtcatgctgcaagccttgctgctgttctagcggatgcggctcaagctgctgtcagagctcctgttgcaaaccttactgttgccagagcagctgctgtaaaccctactgttgtcaaagtagctgctgtaagccttgttcttgcttttcaggctgtgggtcctcatgctgccagagctcttgctataagccgtgctgctgccagtcgtcctgctgtgtccctgtctgctgccaatgtaaaatttag

SEQ ID NO: 25121 - DNA, 717 bp, Artificial Sequence
  Description of Artificial Sequence: Synthetic coding sequence
atgggctgcagcggctgcagcggcggctgcggcagcagctgcggcggctgcgggtccagttgcggcggttgtggctccgggtacggcgggtgcggatcaggctgctgtgtgccggtatgttgttgtaagcctgtctgttgctgcgtacccgcttgctcttgctcaagttgtggatcctgcggggggagtaaaggcgtttgtggttcctgtggcggctgcaaaggtgggtgcggcagttgtggcggatccaaaggtggctgcggcagcagctgctgcgttcccgtatgttgttctagctcttgcgggagctgcggtggttcaaagggagtgtgcgggttccgcggcgggagcaagggcgggtgtggtagctgcggctgctcccaatgctcgtgctacaagccgtgctgctgttcctcagggtgtggctcctcctgttgtcaatcttcttgctgcaaaccaagctgcagccagagctcatgctgcaagccatgctgctcccagtccagctgctgcaagccatgttgctgctcctctggttgcggctctagctgctgtcagtcttcctgttgtaagccctgttgctcccaatctagttgttgtaagccttgttgctgcagtagcggttgtggcagtagctgctgtcagtcgtcctgctgcaaaccttgctcttcccagtctagctgctgtgtgcccatatgctgtcagtgtaaaatctag

SEQ ID NO: 25122 - DNA, 1473 bp, Artificial Sequence
  Description of Artificial Sequence: Synthetic coding sequence
atgaacggcgccctggaccacagcgaccagcccgaccccgacgccatcaaaatgtttgtggggcagattcctagatcgtggagcgaaaaggaactgaaggagctgttcgaaccttatggggcggtgtaccagatcaacgtactgcgggacaggtctcaaaacccacctcagtccaaaggttgctgtttcgtgacgttttatacccggaaggctgcgctagaagcacagaatgcactgcacaatattaagacgctgcccggcatgcatcacccaatccaaatgaagccagccgatagcgagaaatctaacgcagttgaggaccgcaagctgttcattggaatggtgtctaagaagtgtaatgagaatgacatccgggtcatgtttagtccattcggccagatcgaggagtgccggatactgagaggtccagacggcctgtctaggggttgtgctttcgtgacgttctccacacgggccatggcgcagaacgctatcaaggccatgcatcagtcacagactatggagggctgctctagtcccatcgtagtgaagtttgcagacacacaaaaggacaaagaacagagaaggttacagcagcagcttgctcagcagatgcagcagctcaacacggccacctggggaaaccttactggtttgggaggactgacccctcagtatctcgccctgttgcagcaagctacctcaagtagcaatctgggggccttttctggaattcagcagatggctggcatgaatgccctccagctgcagaatctcgcaacactcgctgccgccgccgccgcagcccagacctccgccacctcaacaaatgcgaaccccctgtccaccacaagtagcgctctcggtgctctgactagccccgtggctgctagcactccaaacagcactgcgggtgctgcaatgaatagcttaacaagccttgggactcttcagggattagcaggcgctaccgtgggcttgaataacatcaacgccttagcagtagcgcagatgttaagtgggatggcagctctcaacggaggcctgggggcaaccggcctgacaaacggtaccgccggcacgatggacgccctcacccaggcctactcagggatacagcagtatgctgcagccgctttgccaactctttacagccagtctctgcttcagcagcagtcagcagccggatcccagaaggagggcccggaaggagcaaatctattcatttaccatctgcctcaggagtttggagatcaagacatattacagatgttcatgccatttggcaatgttatcagcgccaaggtcttcattgacaagcagacgaacctctcaaagtgtttcgggtttgtctcatatgataaccctgtctctgctcaggccgccatacaggccatgaatgggtttcagataggaatgaaacgattgaaggtgcagcttaaaagatccaagaacgactccaagccatactag

SEQ ID NO: 25123 - DNA, 5826 bp, Artificial Sequence
  Description of Artificial Sequence: Synthetic coding sequence
ctgctgaccagcgtgctgatgcccagcttcggctacttcatccggtcaccggaaaagcgggagcctattgccttaatacgcaaatcagacgtctcaaggggcaatttggaaaaagaaatggcccatcttaatcacgatctctacagcggagacctcaacgaacaatctcaggctcagctgtctgaagggtctatcaccctgcaagttgaggctgtagagtccacatctcaagtggatgagaacgatgtaaccttaacagccgacaagggtaagactgaggacaccttctttatgagcaataaacctcagcgatacaaggataaactccctgactctggagattctatgctgcgtatctctaccatagcatccgcaatagccgaagcctcggttaatactgatcccagtcagctcgccgctatgataaaagccctgagcaataagactcgcgacaaaacgtttcaagaggatgaaaagcagaaggactatagccacgtaagacacttcctccccaacgacttggagaaaagtaacgggagcaacgcactggatatggagaaatacctcaaaaaaacggaagtgagtagatacgagtcagcattggaaaacttttcccgagcaagtatgtcagatacatgggacctctcacttcccaaagagcagacaacccaagatatccatccagttgacctttcagcgactagtgtctctgtgcgggccccagaagagaatactgccgctatagtgtacgttgaaaatggtgaaagtgaaaaccaggaatcctttcgcacaataaattcatcaaattccgttaccaatcgcgagaataactccgccgtggtggatgttaaaacgtgctccatcgacaataagctgcaggacgtggggaatgacgaaaaggccacttctatcagcacccctagtgacagctatagcagtgtgaggaacccacggatcacctctctctgcctactgaaggactgcgaagagatacgcgataatagagagaaccagcgccagaatgaatgtgtgagcgagatttctaattccgagaaacacgtcaccttcgaaaatcaccgcatcgtatccccgaaaaacagtgacctcaaaaacacgtcccccgaacatgggggccgcggatctgaagatgagcaggagtctttccgaccatctacgtcaccgctctctcactccagcccttcagagatttccggaacctcctcatctggttgtgccctggaaagctttgggagcgccgcccagcagcagcaacctccctgcgaacaggaactaagccctctggtttgctcgccggcaggtgtcagtcgtcttacctatgtttcggaacccgaaagctcttatccgactacagcaacagacgatgccctggaggacagaaagagcgatatcacatctgagttgtcgaccactatcatccagggcagtccagcggctctggaggaaagagctatggaaaagctcagggaaaaagtccctttccagaaccgcggaaaagggaccctaagctccattattcagaacaacagcgatacaaggaaggccactgaaaccacctccctgtcgagcaaaccagagtatgtgaagccggatttccgctggtccaaagatcccagcagcaaaagtggaaatctgctcgagacaagcgaagtcggctggactagcaatccagaggagctggacccaatcagacttgctttactgggaaagagcggcctctcatgccaggtgggaagcgccacgagccacccagtcagctgtcaggaaccaatcgacgaggaccagagaatctcccctaaggacaagagcaccgcggggcgcgagttcagtggccaagtctctcaccagacgacttcagaaaaccagtgcacccctattcctagcagcacggtgcattcatccgttgctgacatgcagaatatgccagccgctgtgcacgccctgctcacacaacctagtctgtcagccgcccctttcgcccaacggtacctgggcaccctgccaagcacaggatctaccacgctccctcagtgccacgcgggaaacgcaacagtgtgtggattctctggggggcttccttatccagccgtggccggagagcctgtccagaatagcgttgccgtcggaatctgtctcggctcaaatattggctcaggatggatgggaacgtcttcactctgtaacccatactctaacaccctgaaccagaaccttttatccactacaaaacccttcccagtcccgagcgtcgggacaaactgcggaatcgagccatgggatagtggcgtaacgtcgggtctaggcagcgtgcgggtgccggaagaactcaaactaccgcacgcgtgttgtgtgggcattgcttcacagacgctgctgtccgtgctgaacccaacagacaggtggctgcaagtttctatcggcgtactgagcatttccgtcaatggagaaaaggttgacctgtccacctataggtgtctggtgttcaagaataaggccattatccgtcctcacgcgacagaggaaattaaggtcttgtttattccgtcgagcccaggcgtgttccgatgcactttcagcgtcgcttcttggccatgttcaaccgatgccgagacaatcgtgcaagccgaagcactggcctcaactgtcacactgactgctatcgctgagtcccccgtaattgaagtcgaaaccgaaaaaaaggatgtgctcgacttcggcgacttgacctacggggggtggaaggcactgccactcaagttaatcaatagaacccacgccaccgtcccaattcgcctgattataaatgcaaacgcagtggcttggcgctgcttcaccttctctaaggagagcgtgagagcccctgtggaagtggccccctgcgcagacgttgtgacaaggcttgctggcccttcagttgtgaatcacatgatgccagcaagttacgacggccaagaccctgaattcttaatgatctgggttcttttccactcacccaagaaacagatctcatcaagcgatatcctggatagcgcggaggagttttcagccaaggtggacattgaggtggacagccctaatcctacccccgttctgaggtctgtatctctgcgggctcgggctggcatagcaaggatccacgccccccgagatcttcagactatgcatttcctggccaaggttgcatccagtcggaagcagcacctccccttgaagaacgccggcaacattgaggtgtaccttgatatcaaagtccctgaacagggatcccatttctctgtggacccaaaaaacttgctgctgaaaccaggtgaagagcatgaagtgatcgtgtcattcacaccgaaggatcctgaagcatgcgaggagcgcatcctcaaaatctttgtgcagcctttcggccctcagtacgaagtggtccttaaaggcgaagttataagctctggctcaaaaccactgagccctggcccctgcctggacattccgagcattctgagcaataaacagtttctggcttgggggggcgttccactgggcagaacgcagttgcagaagcttgccttgcggaacaactcagcctccactacccagcatttgcggctgttgattcgggggcaagaccaggattgttttcagttgcagaacaccttcggaagtgaacagcgtcttaccagcaattgtgagatccgcatccatccgaaggaagacatattcatctctgtcttgtttgcgcccactcggctgtcatgcatgctggctaggctcgaaattaagcagcttggtaaccgcagccagcccgggatcaaatttacaattcccctgtcaggctacggggggacctccaacctcattctagagggagtgaaaaagttgtctgatagctacatggtgaccgttaatggcttagtccctggtaaggaatccaagattgtgttcagcgtacgtaacaccggttcacgcgccgccttcgtgaaggcagttgggttcaaagatagccagaaaaaagtactcctcgatccaaaagtgcttcgaatattccccgataagtttgtccttaaagagagaacccaggaaaatgtgacgttaatctataacccatcagatagaggcatcaacaataaaaccgctaccgagctgtctaccgtgtacctgtttggaggagacgagatttcccggcaacaatataggagggcactcctccacaaacctgagatgattaagcaaatcctgccggagcattcagtcttacagaacatcaatttcgttgaggcgtttcaggacgagctcctagtgactgaagtgtacgacctgcctcaaaggccaaacgacgtccagttattttatggatccatgtgtaagataatcctgtccgtgattggagagttcagagactgtatcagctccagggagttcttacagccaagctccaaggcctcactggagtctacgtctgatctgggagcctccggtaagcacggaggcaatgtgagcctggacgttctcccggttaaaggcccacagggatccccattactttctagggcagcaagaccccccctggaccagctggcatcagaagagccttggacagtattgccagagcacctgattctcgttgcccctagcccgtgtgacatggcgaaaactggcaggtttcagatcgtcaataacagtgtgcgcctcctaagatttgagctgtgctggccagcacattgccttacagttactccacagcatggttgcgttgcccctgagagcaagttgcaaattttggttagccctaattcgtcgctgtcgaccaaacagagcatgttcccatggtctgggctgatctacattcactgtgacgatgggcagaaaaagatagtaaaggtccagataagggaagatctgacacaggttgagctcctaacaaggcttacatcaaagccttttggaatcttaagcccggtatctgagcctagcgtatcgcatttggtcaaacctatgaccaaaccacccagcactaaagtcgagattaggaacaaatctatcaccttccccactaccgagcccggcgagacctccgaatcttgcctcgagttagaaaaccatgggaccaccgacgtgaaatggcacctgtctagcctggccccaccttacgtcaaaggagttgacgagtctggcgacgtgttccgagccacctacgccgcctttaggtgttctcccatctctggattattagaatcacacggcatacagaaggtgtctattacgtttttgcctcggggtagaggagattatgcacagttctgggacgtcgagtgccaccccctcaaggagcctcacatgaaacataccctgagatttcagcttagtggccagagcatcgaggccgagaacgagccggagaatgcgtgccttagcaccgactcgctcataaagattgaccacctggtaaaacctcggagacaggctgtgagcgaagcgtcagcccgcattcccgaacagctggatgtgactgccagaggtgtgtatgcaccagaggacgtttaccggtttaggccgacctctgtgggcgagtctcgcaccttgaaggtcaatctgaggaataatagttttattacccatagcttgaagtttttatctcctcgggaacccttttacgtgaagcactctaagtactctctccgagcacagcactacataaacatgcctgtgcaattcaagccgaagagcgcgggaaagttcgaagctctcctcgttattcagacagatgaggggaaatccattgcaattcgcctaatcggagaggccctgggtaagaactag

SEQ ID NO: 25124 - DNA, 111 bp, Artificial Sequence
  Description of Artificial Sequence: Synthetic coding sequence
atgtgctactacggcaactactacggcggctacggctacggcggcctgggatgcggatatggatcctgctgcggttgcggcttcagacgcttgggctgtggttatggatag

SEQ ID NO: 25125 - DNA, 528 bp, Artificial Sequence
  Description of Artificial Sequence: Synthetic coding sequence
atgagctacaactgctgcagcggcaacttcagcagccggagctgcggggactacctgcgctatcccgcaagtagccgcggcttcagctacccaagcaacctggtctacagtaccgatctctgcagtcccagcacatgtcagcttggaagttccctgtaccgcggctgccaagaaatttgttgggaacctacatcttgtcagactagctacgttgagtcaagtccatgtcagacatcatgctatcgtccacgtacgtctctcctctgtagcccttgtaaaaccacatacagtggttctttagggttcgggtcttcttcctgtcggagcctgggttatggatcaaggtcttgctacagcgtaggatgcgggagctctggggtgagatccctgggctatgggtcctgcggatttccttccctgggttacggctccggattttgcagacccacttatctcgccagtcgcagttgtcagagcccatgttaccgacccgcctatggatccacattctgcagatccacctgttag

SEQ ID NO: 25126 - DNA, 324 bp, Artificial Sequence
  Description of Artificial Sequence: Synthetic coding sequence
atgggcaagaagcggaccaagggcaagaccgtgcccatcgacgactcatccgaaactctcgagccagtctgtagacacatccgaaagggcctcgaacagggtaacctgaagaaggccctcgttaacgtcgagtggaatatctgccaggactgtaagacagacaataaggttaaagacaaagcagaggaggagacagaagagaagccctcagtttggctgtgcctgaagtgtgggcatcaggggtgtggtcggaattcacaagaacagcacgccttgaagcattacctaacacctcggagcgagccacactgccttgtgctgtag

SEQ ID NO: 25127 - DNA, 2469 bp, Artificial Sequence
  Description of Artificial Sequence: Synthetic coding sequence
atgggcaagaagcggaccaagggcaagaccgtgcccatcgacgactcaagtgagactctggagccagtctgtcggcacatccgcaaaggcctcgagcagggcaacttaaaaaaggccctggttaacgtggaatggaacatctgccaggactgcaaaacagacaataaagtcaaagataaggccgaggaggaaaccgaggaaaagccatcagtgtggctgtgccttaaatgcggacaccaaggatgtggacgcaatagtcaggagcaacacgcacttaaacattatcttactccccgttccgaacctcactgtttggtattgtccctggataactggtctgtctggtgttatgtgtgtgataacgaggtgcagtactgctccagcaaccaactgggacaggtagtcgactacgtccgcaaacaagccagcatcaccacccctaaacccgagaaagacaatggcaacatagaactggagaacaagaaactcgagaaggaatctaagaacgagcaagaaagagagaagaaggaaaacatggctaaggaaaatccacccatgaattccccatgccagatcacagtgaaagggctgtctaacctgggaaacacttgcttctttaacgctgtgatgcagaacctgtcccagactccagtgctacgcgaattgctcaaagaggtgaagatgtccgggactattgtgaagatcgagcccccggacctagccctcactgagccactggaaattaacctcgagccgcccggacccctgactctcgccatgagccagtttctcaatgagatgcaagaaacgaagaaaggcgtggtgacaccaaaggaactgttttcacaggtgtgcaaaaaggccgtgcggtttaagggatatcaacagcaagactcccaggaactgttgaggtatctgctggatgggatgcgagcagaggagcaccagcgagttagcaagggcattttgaaggcattcggtaatagcacggaaaagctggatgaagagttaaaaaataaggtgaaggattacgagaagaaaaagtccatgccttcctttgtggacaggatatttggcggggaattaacttccatgattatgtgcgaccaatgtaggactgtgtctctcgtgcatgaaagcttccttgacttgtccttgccagtcctagacgaccagtctggtaaaaagtcggtgaacgataaaaacctcaagaagacagtagaagacgaggaccaggattctgaagaggaaaaggataatgactcctatatcaaagaacgctccgacatcccatccggcactagcaaacacctccagaagaaggcaaagaagcaggcgaagaaacaggccaagaatcaacgacgacaacagaaaattcagggcaaggtgctccatctgaatgacatctgcacaatcgatcaccctgaggattccgaatacgaggctgaaatgtcccttcaaggggaagtcaacattaagagtaatcacatttcacaagaaggtgtcatgcacaaagaatactgtgtgaatcagaaggacctcaacggacaagccaaaatgattgaatcagttaccgacaaccagaagagtaccgaagaggttgatatgaagaacattaatatggacaacgacctggaggtcctgacgtcctcaccgacgagaaacctgaacggcgcctatctgactgagggatcgaatggcgaggtggacatctccaacggatttaagaacctaaatctcaatgctgcccttcacccagatgaaatcaatattgagatcttgaacgactcgcacacacctggaacgaaggtgtacgaagtcgtgaatgaagatccagagactgcattctgtaccctggccaaccgggaagtatttaatacagacgaatgtagtattcagcactgcctatatcagtttactaggaacgagaaactgagggatgccaataagttactctgcgaggtgtgcactcgcaggcagtgtaacggaccgaaggctaacatcaagggcgagcgaaagcacgtatacacaaacgctaagaaacagatgcttatctctctggcacctccagtcctgaccctgcacctgaagaggtttcaacaggcgggattcaacctgcgcaaagtgaacaagcacatcaagttcccagaaatcctggatcttgccccattctgcacactgaagtgcaagaacgtggctgaggaaaatacaagagtgttatactccctgtatggcgtcgtggaacacagtggcacgatgaggagcgggcactacacggcttacgctaaggcaagaacagccaactcccacctgtctaatctcgttctccatggtgacattcctcaggatttcgagatggagtccaaagggcagtggtttcatatcagcgacacccacgtccaagccgtccccactaccaaggtattaaactcacaggcatatctgttgttctacgagagaatcctttag

SEQ ID NO: 25128 - DNA, 2472 bp, Artificial Sequence
  Description of Artificial Sequence: Synthetic coding sequence
atgggcaagaagcggaccaagggcaagaccgtgcccatcgacgactcctcggagaccctcgaacctgtctgtcgacacatcagaaaaggcctcgaacagggcaatctcaagaaggccctggtgaacgtcgagtggaacatttgtcaggattgtaagaccgacaacaaggttaaggacaaggccgaggaggagactgaagagaagccaagcgtttggctgtgcctgaagtgtgggcaccagggctgcggcagaaatagccaagaacaacatgcactgaaacactatcttacaccccgttccgaacctcactgcttggtcctatctctcgataattggtctgtgtggtgttatgtgtgtgataatgaagttcagtattgtagctcaaaccagctcgggcaggtggttgactacgtgcggaagcaagcaagcatcacaacgcctaagcctgccgaaaaggataacggaaatatcgagctggaaaataaaaagctcgagaaggagtcaaaaaacgagcaggagcgagagaaaaaggagaacatggccaaagagaacccaccaatgaatagtccctgtcagatcaccgtcaagggcctgtcaaacctgggcaacacatgctttttcaatgccgtgatgcaaaatctgtcccagactccggttctgagagagctgctaaaggaggttaaaatgtcagggaccattgtaaagatcgagccacctgatctcgctctcacagagcctctagaaatcaatctcgaaccaccaggcccactgaccctggctatgtcacaattcctgaatgaaatgcaggagacaaagaaaggtgtggtaacaccgaaagaactattctcccaggtgtgcaaaaaagccgtgagattcaagggctaccagcagcaggactctcaggagctcttgaggtatctgctagacggcatgagagcagaggaacaccagagagtcagcaagggaatcctcaaggccttcggaaactctacggagaagctggacgaagagcttaaaaataaagtgaaggattacgagaaaaagaaaagcatgccaagtttcgtcgacaggatatttggcggagagttaacctccatgataatgtgcgaccagtgccggacagtatctctggtacacgaaagcttcctggacctctccctccccgtgctcgacgaccaaagcggtaagaaatctgtcaatgataagaatttgaaaaaaaccgtggaagacgaggaccaggacagtgaggaagaaaaggataatgattcttatatcaaggaacgtagcgacattccctctggcacttctaaacatctgcagaagaaggccaaaaagcaggccaagaagcaggcaaagaatcagagaaggcagcaaaagattcagggcaaggttctgcaccttaacgacatctgcacaattgaccacccggaagactctgaatacgaggccgagatgagcttacaaggcgaagtgaatattaagtccaaccacatttcacaagagggcgtgatgcataaggagtattgcgtcaaccaaaaagacctcaacggacaagctaagatgattgaaagtgtgacggacaatcagaagtcgacagaggaggtggacatgaagaatattaatatggacaacgacctcgaggtcctgacgagttcccctacacgcaatctaaacggtgcatacttaactgaaggctccaacggcgaggtggacatttctaatggattcaagaacctcaatctgaatgccgcactgcacccggacgagatcaatatcgagatcctgaatgacagccacacccccggaacaaaggtgtacgaggtggtgaacgaagatccagaaaccgccttctgtactctggctaatcgtgaggtgttcaacaccgacgagtgttctattcaacactgtctctatcaattcactcgcaatgaaaagcttcgcgacgccaataagcttctgtgcgaagtgtgcacacggcggcaatgtaacgggcctaaggctaacattaaaggcgagcgcaagcacgtctacaccaatgccaagaagcagatgttgatctctctggctcctccagtgttgactctccacctcaaacgctttcaacaggccggatttaatctgcgcaaggtcaataaacatataaagttcccagaaatcctggacctcgctccattttgtacattgaaatgcaaaaatgttgctgaggagaatactagagtgctgtattccttatacggagttgttgagcactcaggcaccatgagaagcggccattacaccgcgtatgctaaagcacgcactgccaactctcacctctccaacctggtgttgcacggagacattccacaggattttgaaatggaatccaaggggcagtggttccatattagcgacacacatgtgcaggcagtcccaaccaccaaagtactcaacagccaggcgtacctcttgttctatgagcgcatcctatag

SEQ ID NO: 25129 - DNA, 1167 bp, Artificial Sequence
  Description of Artificial Sequence: Synthetic coding sequence
atggaccccatccggagcttctgcggcaagctgcggagcctggcctctactcttgactgtgagactgcacgcctccagagggccctggatggagaagaatccgactttgaggactatcccatgcggatcctgtatgacctgcactccgaggtacagacgctgaaagatgatgtcaatatcctactggacaaggccagactggaaaaccaggaaggaattgactttatcaaagctacaaaagtcttgatggagaagaacagtatggacattatgaaaatcagagaatatttccagaagtacggttattcccctagagttaaaaaaaattcagtgcacgagcaggaggccattaactctgatcctgagttgagtaactgcgaaaatttccagaagaccgacgttaaagatgacctttctgacccacctgtggccagtagctgtatctccgaaaaatctcctcgaagcccacagctctctgactttggtcttgaacgatacattgtgagccaagtcctgccaaatcccccgcaggcagtgaacaattataaggaggagccagtgatcgtgacccccccgaccaagcagtcactggtgaaagtgttaaagacacctaaatgtgctctgaaaatggacgattttgaatgcgtcactcctaagcttgagcacttcgggatttccgagtatacgatgtgtctcaatgaggactacacaatgggcctgaaaaacgcccggaataacaagtccgaggaggccatcgatactgaatccagactgaacgacaacgtctttgcaactccaagccccataatccagcagcttgagaagtctgacgcagagtatactaatagtccactggtgcccaccttttgtacccctggcctgaagattcctagtactaagaacagtatcgctctggttagcactaactatccactgtctaagaccaatagctcctctaatgatctagaagtcgaggacaggacttctttagttctaaattccgacacgtgctttgagaacctgactgatcccagtagtcctaccatctcttcatacgagaatctattgagaacccccactccacctgaagtaacgaaaatacccgaggatattttgcagaaatttcaatggatttatcctacacagaaactgaataagatgaggtag

SEQ ID NO: 25130 - DNA, 1353 bp, Artificial Sequence
  Description of Artificial Sequence: Synthetic coding sequence
atgcgggagtgcatcagcatccacgtgggccaggccggcgtgcagatcggcaacgcatgttgggaactctattgcctggagcatggaatccaacctgatggacagatgccctctgataagaccatcggaggaggcgatgactcttttaacaccttcttctctgaaacaggggccggcaaacacgtcccaagagcagtgttcgtggacctggagcctactgtcgtggacgaagttcgcacaggaacatatcgccaattatttcatcctgagcagttaatcaccggtaaagaggatgcggcgaataactacgcacgcgggcactatactattggtaaggaaatcgtcgacctggtgctggaccgcatccgcaagctcgctgatctgtgcaccggccttcaggggttcctcattttccacagcttcggaggggggaccggatccggcttcgctagtctcctaatggagaggctgagtgtggattacggtaagaaatccaagctggaatttgcaatctacccagccccccaggttagcaccgccgtggtggagccttacaatagcatactgacaacccacactaccttggaacacagtgactgcgctttcatggtcgataatgaagcgatttatgacatttgcaggagaaatctcgacattgaaagacctacctacaccaaccttaataggctaattggtcagatcgtgagcagtatcacagcgagcctgagatttgatggagctttgaacgtggatcttaccgagttccagactaatctcgtcccatacccacgaatccacttcccccttgccacctatgccccagtgatcagtgctgaaaaagcgtaccacgaacaactctccgtagcggagataactaacgcctgttttgagccagctaatcagatggtgaagtgcgacccacgccatggaaagtatatggcatgttgcatgctctatcgtggagacgtggttccaaaagacgtaaacgcagcaatagccaccatcaagaccaaacgaaccattcagtttgtcgattggtgtccgacaggatttaaagtgggaatcaactaccagccaccaactgttgtgccgggcggcgatttggctaaggtacagcgggccgtgtgtatgcttagtaacaccacagcaattgccgaagcctgggccagactcgatcacaagttcgatctgatgtacgcaaagagagcgtttgtccattggtatgtcggcgaaggaatggaggagggcgaattctctgaggcccgggaggacctcgccgcgctggaaaaagattacgaggaggtcggcgttgactccgtggaggccgaggccgaagagggcgaagaatattag

SEQ ID NO: 25131 - DNA, 3378 bp, Artificial Sequence
  Description of Artificial Sequence: Synthetic coding sequence
atgaccgtggagcagaacgtgctgcagcagagcgccgcccagaagcaccagcagaccttcctgaaccagctgagagaaattacggggatcaacgacacccagatactacagcaagcactgaaagactcaaacgggaacctggaattggccgtggccttcctgacagctaaaaatgccaaaaccccacagcaagaggagactacatactatcagactgccttgcccggtaacgatcggtacataagcgtagggagccaagccgacactaatgtcatcgacctgacgggcgatgacaaggacgatctgcagagggcaattgctttaagtctggctgagagcaatcgagcattccgtgaaacagggattactgacgaagagcaggctatttcgcgcgtcttggaggcatccatagcggaaaacaaggcatgtcttaaacggacaccaaccgaggtctggcgggattcacgtaatccttatgatcgtaagcggcaggacaaagccccagtgggtctgaagaatgttggaaatacctgctggtttagcgctgtgatccagtctctgtttaacctgctggagttccggaggctcgtgcttaactataagcctccatcgaatgcccaggacctccctaggaatcagaaggaacaccggaatcttcccttcatgcgcgagctccgctacctgttcgctctgctcgtaggtactaaacggaagtatgtggaccccagcagggccgtcgaaatactgaaggacgcctttaaatccaatgacagtcaacagcaggatgtgagcgaattcacacacaagctcttagattggctggaggatgccttccagatgaaggctgaggaagaaactgatgaggagaaacctaagaaccccatggtcgaactgttttacggcagatttcttgctgtaggcgtcctagaaggaaagaaatttgagaacacagaaatgttcgggcagtacccactgcaagtgaacgggttcaaggacctgcacgagtgcctcgaggctgccatgatcgagggggaaatagagtccctccacagcgaaaattccggtaaatccggacaagaacattggtttacggagcttccccccgtgctgactttcgagctgtcgcggttcgaattcaaccaagccctgggcaggccggagaagatccacaacaagctggagttcccgcaagtgctataccttgatcggtacatgcatcgcaaccgggagattacgcgtataaaaagagaggaaattaagagactgaaggattaccttaccgttctccagcagcgactagaacgttacttgtcctatggatctggaccaaagaggtttccccttgttgatgttttgcagtacgccctcgaatttgcatccagcaaacccgtttgcacttcccctgtcgacgacatcgacgcttcctccccccccagtggcagcatcccttcgcagacgctgcctagtaccaccgagcaacagggtgcgctgagctccgaattacctagtacttccccctctagcgtcgccgccatttcctcccgatccgtgattcataagccctttacgcagtcacggataccccctgacctgcccatgcatcccgcaccccgccatattactgaggaggaactttctgtgctggaaagctgcttacatcgctggcgcaccgaaatcgaaaacgacacacgtgacctgcaggagtcgatctcccggattcaccgtacaatcgagctcatgtattcggacaagagcatgatccaggtcccttatagactgcatgccgttctggtgcacgagggacaagctaacgccggacattactgggcgtacatctttgaccatcgagaatcgcggtggatgaaatataacgatattgcagtaacgaaatcctcctgggaagagcttgtgcgggatagctttggaggatataggaacgccagcgcctattgcctcatgtatataaacgacaaagcacagttcctgatccaggaggagttcaataaggagaccggtcagccactagtaggcatcgagactctcccccctgaccttcgcgattttgtcgaagaggacaaccagcggtttgaaaaggaactagaggaatgggacgcccagttagcgcaaaaggcattgcaggaaaagcttttggcttctcagaagctgcgcgaatccgagacttccgttactaccgctcaggcagccggggatcctgagtaccttgagcaacccagccgaagcgacttctccaagcatttgaaagaagaaacaattcagattatcacaaaggcctctcatgagcatgaggacaagtctccagagacagtactgcagagtaagcctgagaatactactagccagcccctgagcaaccagagggtggttgaggtggcaattccccatgtggggaaatttatgatcgagtccaaggagggaggatacgacgatgaaatcatgatgaccccaaacatgcagggaatcattatggccattggtaagtcaaggagcgtttacgatagatgcggtcctgaggccggcttcttcaaggcaatcaaactcgaatacgctcgactagtcaaactggctcaagaggatacccctccagagacagactacagattacatcatgttgttgtgtactttatccagaatcaggcaccaaagaagattatagaaaaaactctcctggaacagtttggcgaccggaatcttagctttgacgagcgatgccataacatcatgaaggtggcccaggctaagttagaaatgatcaagcccgaggaggtgaacctcgaagaatatgaggaatggcaccaggattaccggaagttccgcgagactacgatgtacctgatcatcggtctggagaacttccagagggaatcctacattgactccttattgtttctaatctgcgcctaccagaataataaggagctgctttccaagggactgtatagggggcatgatgaggaactcatcagtcactacagacgggagtgcctgctaaagttgaatgagcaggcagcagagctgttcgagtcaggagaggatagggaggttaataatggactgattatcatgaacgagtttatagtgccctttctcccattgctcctggtggacgaaatggaggaaaaggatattctggcagtagaagatatgcggaaccgttggtgtagctacctagggcaggagatggagcctcatctccaggagaaacttactgacttcctccctaagctgctggactgttcaatggagattaaaagctttcacgagcccccaaagttgccctcatactccacgcacgaactatgcgagaggttcgctagaataatgctgtcattaagcagaaccccagcagacgggagatag

SEQ ID NO: 25132 - DNA, 1608 bp, Artificial Sequence
  Description of Artificial Sequence: Synthetic coding sequence
atggacctgcggcaggcctgccggacccccagccgggacgaggccggcgtggaactcctcatgacatatttcattcagttggggtttgttgagagtaggttcttcccacccactcgccaaatgggcctgctgttcacttggtacgacagcctgacaggcgtccccgtgagccagcagaatctgcttctggagaaagcaagcgttttgttcaatactggggccctgtatacccaaattggaacccgatgtgatcgccagactcaagcaggactggagagtgccatcgatgcattccagcgggctgccggtgtgctgaactaccttaaagacaccttcacccacaccccgtcatatgatatgagtccagccatgcttagtgtcctggtgaaaatgatgctcgcccaggctcaggagtctgtgtttgagaaaattagtctcccgggaattcgcaacgagttttttatgcttgttaaagttgctcaagaagcagcaaaagttggggaagtttatcagcagctccatgctgctatgagccaagcccctgtaaaagagaatattccttacagttgggcctctctagcatgcgtgaaagcacaccattacgctgctctcgcacattatttcactgcgatccttttgatagatcaccaggtgaaaccaggtacagacctggaccatcaagaaaagtgcctcagccagttatacgaccatatgcctgagggtctcacccctctcgcaacactcaagaacgaccagcaacgaaggcagctcgggaaatctcacctccggcgggccatggcccatcatgaagaaagtgtccgggaggcaagcctttgcaagaagctaaggagcattgaggtgctgcagaaagtgctgtgcgctgcccaggaacgaagcaggctgacatatgcccagcaccaggaagaggacgatctgttgaatttgatagatgccccttctgtggtggcaaaaaccgagcaggaggtagacatcattctgcctcagttttctaaattgactgtgaccgacttctttcaaaaactggggccactgagtgtgttttctgctaacaagcgctggacaccaccacggagcataaggttcaccgccgaggaaggcgacctggggtttaccctgcgcggtaacgccccagtgcaggtccacttcttagatccctactgctccgcaagcgtggctggcgctagagaaggcgactatattgtcagcatccaacttgtggattgtaagtggctgacccttagcgaagttatgaagctgttgaaatccttcggcgaagacgagattgagatgaaggtcgtttccctgttagatagcaccagtagcatgcacaataagtccgccacttactcagtcggtatgcagaaaacgtacagcatgatatgtctagctatcgacgatgacgacaagaccgataaaacaaaaaaaatctccaagaagttgagcttcttgtcttggggcacgaataagaaccgacagaagtctgcttccaccctgtgtctgccctccgttggcgccgccaggccacaagtcaagaagaaactgccctctcctttcagccttctgaatagcgattcaagttggtattag

SEQ ID NO: 25133 - DNA, 2952 bp, Artificial Sequence
  Description of Artificial Sequence: Synthetic coding sequence
atggccccccggctgcagctggagaaggccgcctggcggtgggccgaaactgtccggcctgaagaggtgtcccaggaacatatcgaaacagcatacagaatttggctggagccttgcatcaggggcgtctgccgccgtaactgcaagggcaaccccaattgcttggtaggaatcggagagcacatatggctgggcgaaatcgacgaaaactcttttcataatattgacgatccaaattgtgagagacgcaaaaaaaactcatttgtcgggttaaccaatctcggcgcgacatgctatgtgaacacctttttgcaagtgtggtttctcaacttagaattgcgccaggctctatatctctgcccgtccacctgctctgattatatgttgggagacggcattcaggaagagaaagattacgaacctcagaccatctgcgaacacttgcagtatcttttcgccctgctgcaaaactccaaccggaggtatattgatccctctggcttcgtgaaggcactgggattagacaccggccagcagcaggacgctcaggaattttcaaaactctttatgtccttgctcgaagatactctgagtaaacagaaaaatcccgatgttcgcaacatcgtgcaacagcagttttgcggggagtatgcgtatgttaccgtgtgtaaccagtgcggcagagagtcaaagctcctcagcaaattttatgaattggagttgaatatccagggacataaacagcttactgactgtatttcggagttcttgaaagaagaaaagctcgaaggagacaataggtacttttgtgaaaattgtcagagcaagcagaatgccacaaggaagattcgcctcctgagtctgccttgtacgctgaacctgcagctaatgagatttgtctttgatagacaaacgggccataagaagaagctgaatacttacatcgggttctcagaaattctagacatggaaccctatgtagagcataagggggggagctatgtatacgagctctccgcagtcttgattcaccgtggggtgagcgcctatagtggtcactacattgcccatgtcaaggacccgcagtctggggagtggtacaaattcaacgacgaggatattgagaagatggagggcaaaaagctccagctgggcattgaggaagacctggcggagccgtctaagtctcagacaaggaaacctaaatgtggcaagggaactcactgcagtaggaacgcttacatgttggtgtacagattgcagacgcaggaaaagcccaatactacggtgcaggtgccggctttcctccaggagcttgtggacagggacaactcaaaatttgaggagtggtgtattgagatggcagagatgaggaagcagtctgtcgataaaggcaaagcgaagcatgaagaagttaaggaactgtaccagaggctcccagcgggagctgaaccgtacgaatttgtgagcttggaatggctccaaaagtggctggatgagagcactccaaccaagcccatcgacaaccacgcttgcctgtgttctcacgacaagcttcacccagataagatttcgattatgaagcgcatctcagaatatgcagcggatattttctactcccggtatggcggtggcccacggctcacagtgaaagccctttgtaaagagtgcgtcgtggaaaggtgtcgcatcttgagacttaagaatcagcttaatgaggattacaagacagtgaataatctgcttaaagctgcagtcaagggctcagacggattctgggtcggaaagtcttcattgaggtcgtggcgacaattagcccttgaacagctagacgagcaggatggtgatgcggagcagagcaatggcaaaatgaatggctcaacactgaacaaagacgaatcgaaggaggagcgcaaggaggaggaggagttgaactttaacgaagacatcctttgtcctcatggagagctttgcatttccgaaaacgagcggagactcgtgagcaaagaagcatggtctaagctccagcagtacttccctaaggcccctgaatttcccagttataaggaatgctgttctcagtgcaagattctggagagggagggggaggagaacgaagcccttcataaaatgattgcgaacgagcaaaaaacctctctaccgaacttatttcaagataagaacaggccctgcctttcaaactggcctgaagatactgacgtcttgtacattgtctcccagtttttcgtcgaagaatggcgtaaattcgtgcgaaagccgactcggtgttctcctgtgtcgagcgtgggtaactcagctctactctgtcctcatggcgggctcatgttcacattcgcctcgatgacaaaggaggatagcaaactcatcgcacttatctggccaagtgaatggcagatgatacagaaactttttgtcgtcgaccatgttatcaaaattacacggatcgaagtaggggatgtgaacccttccgagacccagtatatcagtgagccaaaattatgtcccgaatgtcgcgagggcctgttgtgtcaacagcaacgcgatctgagggaatacacacaggcaacaatttatgttcacaaagtggttgataacaagaaagtaatgaaggattctgcccccgagctgaatgtcagctccagcgaaactgaagaagacaaggaagaggccaaacctgacggcgaaaaagaccctgacttcaatcagatcatgcacgcattcagtgttgccccttttgaccaaaatctctccattgatggaaagattctgagcgacgattgtgcgactcttggtacgctaggcgtgatacctgagtcagtcattctgctgaaggcagacgagccaattgcggattacgccgcgatggatgatgtgatgcaagtgtgtatgccagaggaggggttcaaaggtaccggcctactcgggcactag

SEQ ID NO: 25134 - DNA, 738 bp, Artificial Sequence
  Description of Artificial Sequence: Synthetic coding sequence
atgagcgtgtgcagcagcgacctgagctacggcagccgggtgtgcctccctggatcctgcgactcctgttcagacagttggcaagtcgatgactgccctgagagctgctgtgagcctccatgttgcgctccagccccctgcctgtctctcgtgtgtactcctgtgagtcgcgtaagcagcccctgctgccgggtgacttgcgaacccagcccctgccagtccggttgcacgagtagttgtacaccgagttgctgccagcagtcatcctgccaacccgcctgctgcacgagcagcccatgccagcaagcctgctgcgtccccgtgtgctgtaagaccgtatgttgcaagccagtgtgctgcatgccagtgtgttgcggcccttcttcttcttgctgccagcagtcgagttgtcagccagcttgttgtatcagttctccttgccagcaaagctgctgtgtcccagtgtgttgcaaacccatttgctgtgtgcccgtttgctccggcgcaagttcgctttgctgccaacagagctcctgccagccagcttgctgcactaccagctgctgccggcccagcagctctgtttcacttttgtgtcgtccagtctgtcgtccagccagaagggtacccgtgccctcctgctgcgtgccaacgagcagctgtcagccctcctgtgggcgcctggcaagttgcgggtctctgctttgtaggccaacatgttcccggcttgcttgttag

SEQ ID NO: 25135 - DNA, 1098 bp, Artificial Sequence
  Description of Artificial Sequence: Synthetic coding sequence
atggccgccagcaccatgagcgtgtgcagcagcgacctgagctacgggtctcgggtgtgcctgccgggctcatgtgattcctgcagtgacagctggcaggtcgatgactgccccgagtcctgttgcgagcctccatgctgcgcacctgccccctgtcttagtttggtttgcaccccagtctcacgcgtgagcagcccttgttgccctgtgacttgcgaaccttctccatgccaaagcggatgcacctcatcttgtactccctcttgctgtcaacagtcatcctgtcagctcgcatgttgtgcctcctctccgtgccagcaggcgtgttgtgtccccgtttgttgtaagactgtgtgttgtaagccagtgtgctgcgtgtctgtgtgttgcggcgattcctcatgctgtcaacagtcaagttgccaaagtgcctgctgtacaagctccccatgccagcaggcgtgttgcgtccctgtatgttgcaagcctgtgtgcagcgggatcagctcatcttgttgtcagcaaagctcatgtgtcagctgcgtgagtagcccttgctgccaggccgtttgcgagccatccccctgtcagagtgggtgcactagttcctgcaccccttcttgttgtcaacagtccagttgtcagcccacctgttgcaccagctccccttgtcagcaggcttgctgcgtgccagtgtgttgcgtcccggtatgctgcgtccctacttgcagcgaggatagcagcagttgttgccagcaatcttcatgccagccagcctgttgcacaagctcaccttgccaacatgcgtgctgtgtgcccgtgtgttccggggcctcgacatcttgttgtcagcagtccagctgccagcccgcctgctgtacagcttcttgttgcaggccttcgagctccgtcagtctgctctgccatcccgtgtgcaaaagtacatgttgtgtcccagtgccctcgtgtggggccagcgcaagttcttgtcagccctcatgctgcagaaccgcctcttgtgtgagcttactgtgccgtcctatgtgtagtcgaccagcttgctattctctctgcagcggacagaagtccagttgttag

SEQ ID NO: 25136 - DNA, 816 bp, Artificial Sequence
  Description of Artificial Sequence: Synthetic coding sequence
atggccgcctgcaccatgagcgtgtgcagcagcgcctgcagcgactcatggcgggttgacgactgtccggaaagttgctgtgaacccccttgcggaacagcgccatgcctcacattggtctgcactcccgtgagttgtgtgagttcaccctgctgccaggccgcctgtgagccaagcccatgccagtccggttgcacttcctcttgcacccccagttgttgccagcctgcatgctgtgcctcctctccctgtcagcaggcctgttgtgtccccgtgtgttgcaaaccagtttgctgcttaccaacatgctcaaaagacagctcctcctgctgccagcaatctagctgccaaccaacatgttgcgcgtcctctagctgtcaacagagctgctgtgtgccggtgtgctgcaagcccgtgtgttgcgtgccaacctgcagtgaagactcttctagttgttgtcagcactcaagctgccagcccacctgctgcacttcatcaccatgccagcaaagctgttacgtgccagtgtgttgcaagccggtgtgctttaaaccgatatgctgtgtgcctgtctgctcaggagcctctacgagctgttgtcagcaatccagctgccaaccagcgtgttgtacaactagctgctgtaggccgtcctcaagcgtaagccttctgtgtaggcctatttgccgtccggcgtgctgtgtgcccataagcagctgttgcgcgcctgcgtcatcctatcaagctagctgctgccgccccgcgagctgcgtgtcattgctctgcaggccagcctgcagccgcctggcttgttag

SEQ ID NO: 25137 - DNA, 1206 bp, Artificial Sequence
  Description of Artificial Sequence: Synthetic coding sequence
atgagcgtgtgcagcagcgacctgagctacagcagccgggtgtgcctgcctggaagttgcgatagttgttccgactcttggcaggtggatgattgccccgagagttgttgtgagccaccttgttgtgcaccatcatgctgcgcacccgccccctgtctgtccttggtttgcaccccggtgtcccgcgtttccagcccctgttgcccggtcacctgcgagccaagcccctgccagtccggctgcacaagctcttgcacaccttcatgttgtcagcaatcttcctgccagttggcctgttgcgctagcagcccatgtcaacaggcttgctgtgtgcccgtctgttgcaagactgtgtgttgtaagccagtgtgttgcgtgcccgtctgttgcggcgattcttcttgttgtcagcagagttcatgccagtcagcctgttgcacatcctcaccatgtcaacaggcgtgttgcgttcccatttgctgtaaaccagtgtgttcgggtatctcctctagttgctgccagcaaagcagttgcgtcagttgcgtatcaagcccttgttgtcaggccgtctgtgaacccagcccctgccagtccggctgcatttcttcgtgtaccccttcttgttgtcaacagagctcttgccagccagcgtgctgtacaagcagcagctgccagcaggcatgctgtgttccagtatgctgcaaaacagtctgctgtaaacctgtctgcagtgaagattcctcctcttgttgtcagcagtcctcctgccagcctgcttgctgcacctcaagcccttgtcagcaggcctgctgtgtaccagtgtgttgtaaacccgtatgttgcaagccagtgggaagtgtcccaatatgcagcggggctagctctttgtgttgccagcaatcctcgtgccaaccagcttgttgtacatctagccagtctcagcagggttgctgtgtgccagtctgttgtaagcccgtctcttgtgtgccggtctgcagcggcgcgtcctcatcttgttgccagcagtcttcctgccaacctgcctgttgtacaacttcctgctgtcgacctagtagctccgtgtctctgctctgcaggcctgtctgtaggccagcttgttgtgtgccagtgccctcctgttgtgcccccaccagttcatgccagccaagctgttgtaggccggccagctgcgtgagtctgctgtag

SEQ ID NO: 25138 - DNA, 849 bp, Artificial Sequence
  Description of Artificial Sequence: Synthetic coding sequence
atggccgccagcaccatgagcgtgtgcagcagcgcctgcagcgactcctggcaggttgatgcctgtcccgaatcctgctgtgagccacactgctgcgcgctttcatgctgtgctccggctccgtgtctcaccctggtgtgtacccctgtgtcccgcgtgtcctcaccctgctgccaggctgcttgcgagcctagcccctgtcagtcaggttgtacatccagttgcacgccatcatgttgccaacagagttcttgccaaccagcctgctgcaccagctctccttgtcagcaagcttgctgtgttccggtgtgttgcaagcccgtttgttgtctgcccacttgcagtaaagatagtagcagttgttgtcaacaatcctcatgccagccgacctgttgtgcatcatccagcagccagcaatcctgctgtgttccagtttgttgtaaacccgtttgctacgtgcctacatgctccgaggactcaagctcatgttgtcaacagagctcctgccaccctgcttgttgtacctcgtccccttgccaacaggcttgctgtgtccccgtgagatgcaagcccgtgtgctgtaaacccatttgttgcgtgcccgtgtgttccggagccagcacatcttgttgccaacagtctagctgccaaccggcgtgctgcactacgtcctgttgccgaccgagcagttctgtgagtttgctatgtcgccctgtctgtcggccagcctgctgcatgccagtgtcgtcttgctgtgccccagcgtcttcctgccaggccagttgttgtcggccagccagctgtgtcagcctgctatgtcgcccagcttgcagccggccggcatgctag

SEQ ID NO: 25139 - DNA, 891 bp, Artificial Sequence
  Description of Artificial Sequence: Synthetic coding sequence
atggccagcagccccctgcccggccccaacgacatcctgctggcctctccaagctcagcatttcagccggacactctctcacagccccgccctggccacgcaaatttgaagccgaatcaggttggacaagtgatcctctacgggatacctatcgtctcattggtcatcgatgggcaggagaggttatgcctcgcacagatcagtaacacattactgaagaactttagctataacgagattcataaccgacgcgtggccttagggatcacctgcgtccagtgcacccccgtacagttggagatactgagacgtgccggcgcaatgcctatttcaagccggaggtgcggcatgataactaaacgagaagctgaaaggctttgtaagagcttcctgggtgaaaaccgacctcccaaactccccgataacttcgccttcgacgtgagccacgaatgcgcttgggggtgtcggggcagcttcattccagctagatacaacagctcgagggccaaatgcataaaatgttcgtattgcaatatgtatttttcaccaaacaagtttatttttcatagtcatcggacacccgatgctaaatacacccagcccgatgcggccaacttcaatagctggaggagacacctcaagctgaccgataaatcgccgcaggatgaactggtgtttgcttgggaggatgtcaaggccatgttcaacggagggtcccgcaaacgtgcactcccgcagcctggtgcacaccccgcctgccaccccttgtcgtccattaggacccgaagcattgcctttagctcccagaccttaatgctgctggaggaaatcttcggtgaaaaggatcaggaagattatatgcgaattaacgaggacaatatctggctctag

SEQ ID NO: 25140 - DNA, 5346 bp, Artificial Sequence
  Description of Artificial Sequence: Synthetic coding sequence
gtgaagaagatccaccggcaccggctgagccccgccaccgagaagggagccgcttcctccggcgagggcgataaagaccctcccccaccagctcacgaggacatcgccgtgaaagggacagccaccgcagccggcaccggacctggaaccggcgctgccgccgctgccgcagccgccgtgccccccccacatcctgccgcagcagccgcggcagctgcagctgcagccgctgcggcggctgctgccgtgccacccccccatcccaatattagagcactgcagacgcaggccccgcagcagatacctcggggccctgtgcaacagcctctggaggataggatttttacaccagccgtatcagctgtgtactcaaccgtgacacaagtggcgcgccagcctggaacaccaacgccttctccatattctgcgcacgagatcaacaaaggacatcctaaccttgctgctacccctcccgggcacgccagtagtcccggcctctctcaaactccataccccagcgggcaaaacgccgggcctacaacactcgtgtacccacagacaccacagaccatgaactctcagccccagacccgatcccctgtgatcttctctccttcccagttctttcagcgacctcagattcaaccacctagagctaccatacctaatagctccccaagcatccggcccggcgcccagaccccgaccgcagtctaccaggccaatcagcacatcatgatggttaatcacctgcctatgccctaccctgttcctcagggaccgcagtactgcattcctcagtataggcacagtgggcctccttacgtcggccccccgcagcagtacccagtgcagcctcctggaccgggcccattttaccctggccccggaccaggtgattttccaaatgcctatggtacacctttctatccatcgcaacccgtgtatcagtctgcacccataatagtgcctacacagcagcagccccccccagcaaagcgtgaaaagaagactattcgaattcgggaccccaaccagggtggtaaggacatcaccgaggaaataatgagtggagggggctcccgcaatccaacccctcccatcggcagacctacaagcaccccaactccccctcagctgccaagccaggtgcctgagcattcccctgtcgtgtacgggaccgtcgaaagcgcccacctggccgccagcacccccgtaacagctgcctccgaccagaaacaggaagaaaagcccaaacctgatccggtgctgaaaagccctagtccagtcttaagattagtcctgtccggggaaaaaaaggaacaggaggggcagacatccgagacgaccgcaatcgtgtctattgccgagctgcctctgccacctagtccaactaccgtctcctctgtagcacggagtactattgccgctccgacttcttctgccctctcttctcagcctatcttcacgacagccattgatgacagatgtgagctatcgagccccagggaggataccattccaatcccctcgctgacaagctgtacagagacctcagaccctctgccgacaaatgaaaatgatgacgatatctgcaagaaaccatgttccgtggctccgaacgacatacccctggtgtcatctacgaatctgataaatgagatcaatggtgtgagcgagaaactttctgcgactgaatccatcgtggaaattgtgaagcaagaggtgcttcctctcactctcgaattagagatcctggagaaccccccggaggaaatgaagctggaatgtatccccgctcctatcacaccaagcacagtccctagttttccaccaactcctccgaccccacccgcttctcctccacatacgcctgtcatcgtaccagctgccgctactacagtcagctctccatctgcggcgatcaccgtgcagcgcgttctagaggaagacgagtcgatccggacttgcctcagcgaggacgctaaggaaatccagaacaaaatcgaagtcgaggcggatgggcaaaccgaggaaattctagactcacagaatctgaacagcaggcgcagccctgtccccgcacagatagcaatcaccgtgcccaagacgtggaagaaacccaaggatcgcacaaggactactgaggaaatgctggaagccgagttggaactaaaggctgaagaagagctttccatcgataaagtgctggagtctgaacaggacaagatgagccagggattccatccggagagggacccatcagatctcaaaaaagtcaaggcggttgaagagaatggagaagaggctgagcctgtgaggaacggagccgaatccgtaagcgaaggagagggaattgacgcaaactcaggatccaccgacagctccggcgacggtgtgacctttccattcaagcctgagtcttggaaaccaacggacaccgaaggcaagaagcagtacgatagagagttcttgctcgattttcagttcatgccagcgtgcattcagaagcctgaaggtctgccacctatctccgacgtggtgctcgacaagatcaaccagccgaaacttccaatgaggaccctggacccccgaatcttgccccgcgggccagatttcaccccagccttcgctgacttcggccggcaaaccccaggcggacgtggcgtccccctgcttaatgtcggctcccggagaagtcagcctggacagcgcagggagccccggaagatcattaccgtgtcggtaaaggaagacgtgcatctgaaaaaggcagagaatgcctggaaaccatcccagaaaagggatagccaagcggacgatcccgaaaatattaaaacccaggagctgtttagaaaagtccgatccatccttaataaactgaccccgcagatgttcaaccagttaatgaagcaggtctccggattaacggtggatacggaagagcgtttgaagggggtcattgatctggtgtttgaaaaagccatagatgagccttccttcagcgtcgcctacgccaacatgtgcaggtgtctggtgacactcaaagtgcccatggcggacaaacccggcaacaccgttaattttagaaaactgcttctcaacagatgccaaaaagagttcgagaaggacaaggcagatgatgacgtgtttgaaaagaagcagaaagaactggaggccgcatcagccccggaggaaaggacgaggctgcacgacgagctggaggaggcaaaggacaaggcccgccggcgttccattgggaatattaagttcattggtgaactcttcaagctgaagatgcttactgaggctatcatgcatgactgtgtggtcaaactgctcaagaaccatgacgaagagtccttggaatgtctgtgcagactgctcacaaccattggaaaggatctcgattttgaaaaagctaaacccaggatggatcagtacttcaaccagatggaaaaaattgtaaaagagagaaaaacctcctctagaattcgattcatgctccaggatgtcattgatcttaggttatgcaattgggtgagtcgacgcgccgatcaaggccccaaaaccattgagcagattcacaaggaggctaagattgaagagcaggaggagcagaggaaggttcagcagctgatgacaaaggagaagcggcgcccaggtgtccagcgggtcgacgaaggaggttggaacactgtgcaaggcgccaagaactctagagttctggacccgtctaagttccttaagataacgaaacctactatcgacgaaaaaatccagctggtgccaaaagcacagctcggcagctgggggaagggcagtagcgggggcgcgaaagcctccgagaccgatgccctcagaagtagtgcttcatcgctgaaccgatttagcgcactgcaaccaccagccccaagcggttcaacaccgtcaacgccggtggaattcgattccaggcggacactcacatcacgagggtcgatggggagggaaaaaaatgataaaccactgccatcagccaccgctagacccaacaccttcatgcgggggggatcctctaaggacttactggacaaccagagccaggaagagcagagacgagaaatgttagaaactgtcaaacagctcactggcggtgttgatgttgaaagaaactcaacggaggccgaaaggaataaaacccgagagtcggctaaacccgaaatcagcgcaatgtcagcccatgataaggcagccctttccgaagaggagctagagcgcaaatccaagtcgatcattgatgagttcctccatattaacgattttaaagaagctatgcagtgcgtggaagaacttaacgcccagggccttcttcatgtctttgttagggtcggcgtggagtcaaccctagagagaagtcaaattactcgcgatcatatgggacagcttctctaccaactagtgcagtctgagaaactgtctaagcaagacttcttcaaaggcttcagcgaaacattggagttggcggatgatatggccattgatatacctcacatatggctttacctggccgaactggttactcctatgctcaaggagggagggatttctatgagagaactgacaattgagttctctaagcccctgttgcccgtggggagagcgggagtgctgctgagcgagatcctacacctgctttgtaaacaaatgagtcacaagaaggtcggcgcattatggcgggaggccgacctcagctggaaggacttcctccccgaaggtgaggacgtccataatttcctccttgagcagaagctggattttatagagtcggattccccttgcagctccgaggccctgtcaaaaaaggaactatctgctgaggaactttacaagcggctcgagaaactcatcatcgaggataaggctaatgatgagcagatcttcgactgggtggaggcaaatctcgacgagatacaaatgtcatccccaacctttcttagggcactgatgaccgctgtatgcaaggctgccattatcgcagactcttccaccttccgggttgatactgcggtgatcaaacagcgggttcccatcttgcttaagtatcttgattcagataccgaaaaagagttgcaggctttgtatgccctgcaggcatccattgttaagctggaccagccagcaaacctactcaggatgttcttcgactgcctgtacgatgaagaagtgatatcggaggacgcgttctacaaatgggagtcatccaaggaccccgccgaacaaaacggcaaaggtgtagcactcaagtccgttaccgccttttttacatggctgcgagaagcagaggaggaaagcgaagataattag

SEQ ID NO: 25141 - DNA, 4758 bp, Artificial Sequence
  Description of Artificial Sequence: Synthetic coding sequence
atgaacagccagccccagacccggagccccttcttccagcggccccagattcagcctcccagagccacaattcccaactcttcaccttccattcgtcccggcgcacagacacctacagctgtgtaccaagcgaaccagcacataatgatggttaaccatctgccgatgccataccccgtaccccaaggaccccaatactgtatcccccagtataggcattccgggcctccctacgtgggtccaccacagcaatacccggttcagccgccaggacctgggccgttctaccccggacctggccccggagatttcccaaacgcctatggcactccgttctatccctcgcagccagtgtaccagagcgctcccatcatcgttcctacccaacagcaacctcctccagccaagcgcgagaagaaaactatccgcattagggaccccaaccagggcggtaaagacatcaccgaagaaatcatgtccggaggcggcagcagaaaccccaccccaccaatcgggcggcccacatccacccccaccccacctcaacaattacccagccaggtgcctgagcactcaccggttgtgtatggaacagtcgaatcagcgcacctggctgcaagtactccagtcacagcagcatccgatcagaagcaggaggaaaaacctaagccagaccccgttctcaagtccccatcacctgttttgaggctagtgctttccggtgagaaaaaagagcaggagggtcagactagcgaaacaaccgccatcgtttccattgctgagctgcctctgcctccatctcccactacagtcagctccgtggcccgaagcacaatagctgccccaactagctcagcactttctagtcaaccgatcttcacaacggcaattgatgaccgctgtgaacttagttcaccgcgggaagacaccatcccaattccttccctgacgtcatgtacagagacaagtgatccgttgcctactaatgaaaatgatgacgacatttgcaagaaaccttgttctgttgccccaaatgatatacccctggtgtccagtaccaatctgatcaacgaaatcaatggcgtgtccgaaaaactttcagccaccgaatccattgtagagatcgtaaagcaggaagtgttaccccttacgctggaattggaaatcctcgagaacccccctgaggaaatgaagctcgaatgcatcccagctccaattacgccgagcaccgtgccaagcttcccacccactcctccaactccaccagccagcccgccacatactcctgtcattgtgcccgccgctgcgaccacagtgagcagtccaagtgctgcgattaccgtacagagggttctggaggaggacgaatccataagaacatgcctgagcgaagatgctaaagaaatccagaataaaatcgaagtcgaggccgacggccaaaccgaggagattcttgacagccaaaatctcaacagtcgacgatcacccgtcccggctcagatcgcaatcactgtgcccaaaacatggaaaaagcccaaggaccgaactcgaaccactgaggaaatgctggaagcggaattagaattgaaggcggaggaggaactttctatagacaaggtcttggagtccgaacaagacaaaatgtctcaagggttccatccggaacgcgacccctctgatttgaagaaagtaaaagctgtcgaggaaaatggcgaggaggctgagccagtgagaaatggagccgagagcgtttctgaaggcgagggaatcgacgcgaactcggggagcacagactcttccggcgacggtgtgacctttccgttcaagcccgaatcttggaaacctacagatactgagggcaaaaagcagtatgacagagaattcctgttggatttccagtttatgccagcgtgtatccagaagcctgaggggctcccaccgatctctgatgtcgttctagacaaaatcaatcagcccaagctccctatgcggactctggacccccggatcctgcctaggggtccagactttacgcctgcgttcgcggacttcggtaggcagacccctggcggaagaggagtgccgctgctcaacgttggtagtagaaggtctcagcccggccaacggagggagccacgtaaaataatcacagttagtgttaaagaagatgtgcacttgaagaaggccgagaacgcatggaagccgtcccaaaaacgcgacagccaggctgatgacccggaaaatatcaagacccaggaactgttccgcaaggtgagatcgatactgaataaactgaccccacagatgttcaaccagttaatgaagcaggtgagcggactaaccgtggacactgaggagagactgaagggcgtcatcgacctggtcttcgagaaagctattgacgagcccagttttagtgtggcatatgcaaacatgtgtcggtgcttggtgacccttaaagtacctatggccgacaagcccgggaacaccgtcaacttcagaaaactgttgctaaaccggtgtcagaaggagttcgaaaaggacaaggcagacgacgacgtgtttgaaaagaaacagaaagagctggaggccgcatctgcccctgaggaaagaacgcggctgcacgacgaactggaagaagccaaagataaggctaggaggagaagcatcggcaacattaaattcatcggcgagctttttaaactcaaaatgctaaccgaagcaatcatgcacgattgcgtggtcaagttactaaaaaatcacgacgaagaaagtttggagtgtttgtgtcggctattgaccacaattggcaaagatctggacttcgagaaggctaaaccccgaatggaccaatatttcaaccaaatggaaaagatcgttaaagagagaaaaacttccagcagaattcgattcatgctccaagatgtgatcgacctcagattgtgcaattgggtgagtagacgcgctgaccagggaccgaagacaattgaacaaattcataaggaagctaaaatagaagaacaggaagagcagcgtaaagtgcaacaactgatgacaaaagaaaagcggcgtcctggggtgcaacgggtggacgagggcggttggaacaccgtacagggtgccaagaacagccgtgtgctcgatccgtccaaattcttaaagatcaccaagccaacaatcgacgagaaaattcagctggtaccgaaggcccagctcgggagctggggaaagggcagcagtggcggagctaaggcgtcagagaccgatgctctacgatccagcgcttcttctctcaatcgattcagtgctctccagcctcccgcccctagcggctctacacccagcacgcccgtggagtttgactctaggagaacattgacatcccgaggcagcatgggccgagaaaaaaacgacaaaccactgcccagcgctaccgcccgacctaacacgttcatgcggggcggatcttcaaaggacttgctggataatcagtcccaagaggagcagcgtcgcgagatgctggaaacagtcaagcagttgacgggtggcgttgacgtggagagaaatagtaccgaggccgaacgcaataagacccgcgaaagcgcgaagcctgaaatttctgccatgagtgctcatgataaggccgcgctctcagaggaagagctggaacggaagtctaagtccataattgacgagtttttacacattaatgacttcaaagaggcgatgcagtgcgttgaagagctgaatgcccaaggcctccttcatgtcttcgtgagagtcggagtggaatctactctcgaaagatcacagataactagagatcacatggggcagctgctgtatcagttggttcagtcagagaagctgtcaaaacaggatttttttaagggcttcagtgagacgctggaacttgcagatgacatggccattgatatcccgcacatctggctgtatcttgctgaactggtgaccccaatgctgaaagagggcggaatcagtatgcgcgaactaacaatcgagtttagcaagcccctgcttcctgtggggcgcgccggagtcctcttaagtgaaatcctccatctactctgtaaacagatgagccataaaaaggttggtgctctgtggcgggaagccgacttgtcttggaaggactttctgcccgagggagaagatgtccacaattttctgctggagcaaaagttggactttattgaatctgactccccatgttcctccgaggctctcagcaaaaaggagttgtccgctgaagagctctacaagcgcctcgaaaaactgattattgaggataaagctaacgatgagcagatttttgactgggtggaagcgaacctggatgagattcaaatgagctcccctacgttcctgcgagcgctgatgaccgctgtgtgtaaggccgctattatcgccgattccagcacctttcgggttgatacagctgtgataaaacagagagtcccgattctgctgaaatacctggattccgatacagagaaagagctccaggcactgtacgccctgcaggcctccattgtcaaacttgaccagccagcgaacctgctcagaatgttttttgattgtctttatgatgaggaggtgatctccgaggatgctttctacaagtgggagtcttcaaaagatccagccgaacagaacggtaagggggtggctctaaagtccgtcactgccttttttacctggctccgggaagcggaggaggagtccgaagacaactag

SEQ ID NO: 25142 - DNA, 3087 bp, Artificial Sequence
  Description of Artificial Sequence: Synthetic coding sequence
atggccagcgaggccgtgaaggtggtggtgcggtgccggcccatgaaccaacgggaacgtgaactgcgctgtcaaccagtggtcacagtcgactgcgctagggcccagtgttgtattcagaatcctggcgccgctgacgagcctcccaagcaattcacatttgatggcgcgtatcacgttgatcacgtaactgaacaaatttataacgagatcgcttaccctctagtggaaggggtgacggaaggatacaacggtacgattttcgcatacgggcagacgggttcgggcaaatctttcaccatgcagggcctccccgatcctcccagtcagaggggaattataccaagggcctttgagcatgttttcgagagcgttcagtgtgccgagaacaccaaattcttggtgagggcatcttacctggaaatctacaacgaggatgtgagggacctcctgggggctgataccaagcagaaattagaactgaaagaacaccccgaaaagggagtgtacgtgaaggggttgagtatgcacaccgtccattccgtggcacagtgtgagcatatcatggagaccggttggaagaacagatccgtgggatatacactcatgaataaagatagcagtcgttcacatagtatcttcaccatctcaatcgaaatgtctgctgtggatgaaaggggcaaagaccatttgcgtgccggtaagctgaatctagtcgacttggccggctctgagcgccagagcaagacaggggcaacgggtgaaagactgaaagaagcgactaagatcaacttaagcctctccgccctggggaatgtaatttccgcactcgtggacgggcgctgtaaacacgtgccatatagggattcaaagctcacaaggctcttgcaagattccctgggtggtaacacaaagaccctcatggttgcgtgcctcagccccgctgataacaactatgatgaaacgttaagcacccttcggtatgctaaccgtgcaaagaacattcgaaataagccgcggattaatgaagaccctaaagatgccctccttcgtgaatatcaggaggaaatcaaaaaattaaaggcaatcctgacccagcagatgtctcccagtagtctgtctgcattgctgtcgcgacaagtgcctcctgatccagtacaggttgaggaaaagcttctgccccagcctgttattcagcatgatgtagaggctgaaaagcagctaattagagaggagtacgaagaaagattggctaggctcaaggccgactacaaggccgagcaagaaagccgggcccgtctcgaagaagacatcaccgccatgaggaactcctacgatgtccgactctctacacttgaggaaaatctgaggaaggagactgaggctgtgttgcaagttggggtcctctacaaagcagaagtgatgtctagggccgagtttgcctctagcgccgaataccctcctgcttttcagtacgaaaccgtcgttaaacctaaggtgttctctacaaccgacaccctgccgtccgatgatgtgtcaaagacacaggtgtcatcccgcttcgccgagctgcccaaagtcgaaccatcaaagtccgagataagcttaggatccagtgaatcttccagtctggaagaaacttccgtgagcgaagcgttccctggcccagaagagcctagcaatgtggaggtgagcatgcccactgaggaatcgaggagcaggtacttcctagacgagtgtcttgggcaggaggccgccggccacttgctgggcgaacagaattatctcccacaggaggagccgcaggaagtgcctctacaggggctgctgggactgcaagacccctttgccgaggtcgaggctaagctggcgcgactcagttccaccgtggcgcggactgatgcaccacaggccgacgtgcctaaggtcccggtgcaggtgccagcccccacagatctgctggaaccatcagacgccagaccagaggccgaggctgctgatgatttccctccacgtccggaggtggatttggcttctgaggtggctttggaagtggtgaggacagccgagccgggagtgtggttggaggcccaagctccggtggctttggttgctcagccagagcctctgcccgccaccgctggcgtcaagagggaaagcgtgggaatggaagtcgccgtgctcaccgacgatccactgcctgtggtcgatcagcaacaggttcttgcacggttacaactgttagagcagcaggtcgtgggcggggagcaggcaaagaataaggacctgaaggagaagcacaagaggcgcaaacgatacgccgacgagcgcaggaagcaactggtggccgctctccagaattccgacgaggattccggtgactgggttcttttgaatgtttacgacagcatccaggaggaggtgcgagctaagtccaagttgctcgagaaaatgcaacggaagttgcgtgcagcggaagtggagatcaaggacctccagtcagagttccagctggaaaaaatcgactatcttgccaccatccgacgccaagagagggattccatgctgctgcaacaactgctcgaacaggtgcaacccctgatcagaagggattgcaactactccaacctggagaagattctgagggagagctgctgggacgaagacaacggattctggaaaatcccgcaccccgtgatcaccaaaacaagtcttcctgtggtttccaccggcccccagaacaagcctgcacgcaagactagtgccgccgacaacggtgagccaaacatggaagacgatagataccgcctcatgcttagcagaagtaattcggaaaacatcgccagtaactacttcaggtctaaacgtgccagtcagatcctctctacagacgcaagaaagtctcttactcatcacaactcacccccaggactgagttgccctctgtccaataatagcgccatacctcccactcaggctcctgagatgcctcagccacggcctttccggctcgagtctctggatatcccattcacaaaggccaagagaaaaaaatctaagagtaactttggctctgagccactttag

SEQ ID NO: 25143 - DNA, 921 bp, Artificial Sequence
  Description of Artificial Sequence: Synthetic coding sequence
atgcggcagcacgacacccggaacggccggatcgtgctgatcagcggtaggcggagcttctgctctatcttctcggtgttgccttatcgagactccactcaggtcggagaccttaaactggacggggggagacaatcaaccggggccgtgagcttgaaggaaatcatcggcctggaaggagtcgagttgggagcagatgggaagactgtgtcctatacacaatttctcctgcctacaaacgcgtttggggccaggcggaacactatcgacagcacaagctctttttcccaattccgcaacctgtcccaccggtcattgtctatcggccgcgcttccggcacgcaaggcagtctcgacaccgggtctgacctgggggactttatggattacgaccccaacctcctcgacgatcctcagtggccctgtgggaagcataagcgtgtcctgatctttccaagctacatgactaccgtgattgattacgttaaaccctccgaccttaaaaaggacatgaatgaaacgttcaaagagaagtttcctcatattaaactcacactgtcaaagatccggtcacttaaacgcgagatgcgcaaactggcccaggaggactgcgggctggaggagcctaccgttgctatggccttcgtttattttgagaagctcgccttaaagggcaagcttaacaaacagaatcgcaaactgtgcgccggtgcttgcgtgcttcttgcagccaaaattggttctgatctcaaaaaacatgaagtgaagcacttaatcgataaactggaggagaagtttcgcctcaaccggagagagctgattgcattcgagtttcctgtgctggttgcgctcgagtttgcactgcaccttcccgaacacgaggttatgccacactaccgccggcttgtccagagctcctag

SEQ ID NO: 25144 - DNA, 2820 bp, Artificial Sequence
  Description of Artificial Sequence: Synthetic coding sequence
atggccgcccagcccccccggggcatccggctgagcgccctgtgccccaagtttctgcacacaaattccacgtcacatacttggcccttcagtgccgtggccgaattgattgataatgcctatgaccctgacgtcaacgctaagcaaatctggattgacaagacagtcatcaacgatcacatctgcctgacttttactgacaatggcaatggaatgaccagtgacaagcttcataaaatgctgagttttggattcagtgacaaagtaaccatgaacggccacgtaccagtcggtctctatggaaatgggttcaaatcaggctccatgcgcctgggtaaggacgcgatagtgttcacaaagaatggtgaatctatgagcgtgggactgctgagccagacatacttggaggtcataaaagccgagcacgtggtggtccccatcgtagccttcaacaaacatcgccagatgatcaatttggctgagagcaaggcatccttagcggctatcctggaacatagccttttctccactgaacagaagttactggctgaactggatgccatcattgggaagaaggggactagaatcattatttggaatctgagatcatataagaacgcaaccgagttcgatttcgagaaagataagtatgacattagaatccccgaagatctggatgaaatcacgggtaaaaagggctataaaaaacaagagagaatggaccagatagccccggagagcgactacagtctgcgagcctactgcagcattctgtacctgaaacccagaatgcagatcatcctgcggggccaaaaagttaaaacccagttagtttccaaatctctggcctacatcgagcgggacgtctaccgtcccaagttcctgagcaagactgttaggatcacctttggcttcaattgtcgaaacaaagaccactatggcataatgatgtaccacagaaacagattaataaaggcctatgagaaagtgggctgtcagctgcgtgcgaataatatgggagtcggagtcgtgggaatcatcgaatgcaattttctcaagccaacacacaacaagcaggatttcgattacaccaacgaataccggcttacaataaccgcacttggggagaagctgaatgattactggaatgaaatgaaggtaaagaaaaatacagagtatccattgaacttgccagtagaagacattcagaagaggcctgaccagacttgggtccaatgcgacgcctgtctaaaatggaggaagctgcctgatggcatggaccagcttccggagaagtggtattgtagcaataaccccgatccccaatttaggaactgcgaggtgcctgaggagcctgaggacgaggatctcgttcaccccacctacgagaagacctacaaaaagacaaataaggagaagtttaggatcaggcagccggagatgatccctcgaatcaatgctgaactcttgttcaggcctactgccttgtcaacaccttcgtttagctctcctaaagaatctgtgcccaggcgccatctgtctgagggcacgaacagctacgcgacccggctgttaaacaatcatcaggtacccccacagtcagagccggagtcaaatagtctgaaacgcagactttctactcggtcgtcaatactgaacgcaaagaatcgtcgcctgtcatctcaattcgagaatagtgtttataagggcgatgacgacgatgaggacgtcatcatactggaggaaaacagcacacctaaaccagcagtggaccatgatattgatatgaagtctgaacagtcacacgtcgagcagggaggggtacaggttgagtttgtcggggattctgaaccatgtgggcagacagggtctactagtacatcctcctcaagatgcgaccagggaaacacggccgcaacacaaactgaggtccctagtctcgttgttaaaaaggaggaaaccgtagaggacgagattgatgtcaggaacgacgccgtgattctgcccagctgtgtggaagccgaagcaaagattcatgagacgcaggagacaactgacaagagcgcggatgacgccggctgtcagctgcaggaattgcgtaatcagctcttactcgttacggaagagaaggagaattataaacgccagtgccacatgtttactgatcaaatcaaggtactccagcagaggatactcgaaatgaatgataagtacgtgaagaaagagacgtgtcatcaaagcaccgaaacagatgctgtgtttctgctcgagtccataaatgggaagtcggagtctccagatcacatggtctcccagtatcagcaagcactggaagaaattgagcgattgaagaaacagtgctccgccttgcagcatgtcaaggcggagtgcagccagtgtagcaataatgagtctaaatcagaaatggacgaaatggctgtgcagctggatgacgtgtttaggcagctggataagtgctccattgaaagggatcagtataagtcagaagtagagctgctggaaatggaaaagtcccaaatcaggagccagtgtgaagaactgaaaacagaagtggagcagctcaaaagcactaatcaacaaacagctacggatgtgagtacttcatccaacatagaagagtcagtgaaccacatggatggcgaaagccttaaacttcggagcctccgtgtgaatgtggggcagctgttggctatgatcgtgccggacctcgatctgcaacaggtgaactatgacgtcgacgtggtcgatgaaattcttggacaagtggttgagcagatgagtgagatttcaagcacctag

SEQ ID NO: 25145 - DNA, 1149 bp, Artificial Sequence
  Description of Artificial Sequence: Synthetic coding sequence
atgagcgccgccaaccccgagacccccaacagcaccatcagccgggaagcatctactcaatcaagctctgcagccgcaagccaggggtgggtcctgcccgaggggaaaatcgtgcccaataccgtatttgtggggggaatcgatgcccgcatggacgagacagagatcgggtcctgtttcggtagatacgggtccgtgaaagaagtgaaaatcatcacaaatcgcacaggtgtaagtaagggttatgggttcgtgtcttttgttaacgacgttgatgtgcaaaaaatcgtgggatcccagatccatttccacggcaaaaaactgaagctcggaccagctattagaaaacagaaactgtgcgcacggcacgtgcagcccaggcctttagtagtgaacccccctccaccgcctcagtttcagaatgtatggcgcaatcccaacactgaaacctacctgcaaccccaaatcacacctaacccggtgacccaacatgttcaggcctatagcgcctacccccatagcccaggacaagtgattaccggatgccagttactggtgtataattatcaggagtaccccacgtatcccgattccgcctttcaggttacaacgggctaccaactccccgtgtacaattaccaaccttttcccgcatatcccagatctccatttcaggtcactgccggataccaactccctgtgtacaattaccaggcattccccgcttatcctaactcaccctttcaggtggctactgggtaccagttcccggtttataactatcagcctttcccagcatatccttcctctccattccaggtaactgccgggtatcaattacccgtgtacaattaccaagctttcccagcatacccgaacagtcccttccaagttgccaccgggtatcagttccccgtgtataattatcaggcattccccgcctaccccaactctcctgtgcaagtgacgactggctatcagttgcctgtgtacaattatcaggccttccccgcttatcctaattctccttttcaggtggcgactggatatcagttccccgtatacaattatcaagccttcccggcttatcccaactcccccgtccaggtgacaacaggttaccaacttcccgtgtataattaccagtag

SEQ ID NO: 25146 - DNA, 5058 bp, Artificial Sequence
  Description of Artificial Sequence: Synthetic coding sequence
atgagcctgcccttctaccagcggtgccaccagcactacgacctgagttaccgcaataaagacgtgcgatccaccgtatcacattaccagcgcgagaagaagagaagtgccgtgtatacacaggggagcacagcctactcatcccggtcgtcagcagcacatcgcagagagtctgaggcgttcagaagagcctctgcatcctcatcccaacaacaagcctctcagcacgccctgtccagcgaggtgtcgcgtaaggccgcctctgcctacgactatggcagctcccacggcctcactgacagtagtctgcttctggacgactattcttccaagctctcacccaagcccaaaagggcgaagcatagcctgctctccggtgaagagaaagagaacctcccgtcagactatatggtacccattttctctgggcgacagaaacatgtgtctggcatcacagatacggaggaagaaagaatcaaggaggctgctgcctacattgcccagagaaatctgctcgctagtgaggagggaatcaccacatccaagcagagtaccgccagcaagcagaccacggctagtaaacagtctacagcctctaagcagtccactgcctccaaacagagcactgcttcaaggcagagcaccgcctcccggcagagtgtagtgtccaaacaagcaaccagtgcgctgcaacaggaggaaacatccgagaagaaatcccgaaaggttgtgatccgagaaaaggccgagcgcctctcacttagaaaaaccctggaagagacagaaacgtaccatgccaaactcaatgaagaccacttgctgcacgccccagaatttatcatcaaaccaagatctcatacagtgtgggaaaaggaaaacgtgaaactacactgttcaatcgctggatggcctgagcccagggtgacatggtacaagaaccaggtgcccattaatgttcacgccaacccaggtaaatacatcattgagtccaggtacgggatgcacactctcgagataaatggctgcgatttcgaagacaccgcacaatacagagccagcgctatgaacgtaaaaggtgaattgagcgcgtatgcgtcagtggtggttaagcgctacaagggggagttcgacgaaacaaggtttcacgctggagcgtcaacaatgccactttcctttggggtgaccccctacgggtatgcaagccggttcgagattcacttcgatgacaaatttgacgtctcatttggccgggagggcgagacaatgtccctgggatgtcgggtggtaattactcccgagataaagcattttcagccagagatccagtggtatcggaatggggtccctttgagcccctctaagtgggtgcaaacgctctggagcggagaaagagctacattgacttttagccatctgaataaggaagatgaaggcctgtatacaattagagtgcgtatgggtgaatactatgagcaatatagcgcatatgtctttgtcagagatgccgacgccgagatcgaaggcgctcctgccgcccccctggacgtgaaatgcctggaagcgaacaaagattacatcataatcagttggaagcagcccgccgtcgatggagggtccccgattctgggatactttattgacaagtgtgaggttggtacagactcatggtcacagtgtaacgacactcctgtgaagttcgcccgattccctgtaactggtttaatcgagggtcggagctatatttttagggtgcgcgccgtgaataagatggggatcggctttccatcccgcgtctctgagcccgtcgccgccctggatccagccgagaaggcacggcttaagtcccgcccgagcgcgccgtggacgggccagattattgtaacggaagaagagccatcagaggggattgtgccaggccctcctaccgacctgagtgtaaccgaggccaccagaagttatgtggtactctcttggaagccgccgggccagcgggggcatgaaggcatcatgtatttcgtggaaaaatgcgaggctggcacggagaattggcaacgggtaaataccgagctccccgttaaaagccctcgcttcgctttgttcgatctggcagaaggaaagagctactgctttcgggtgcgttgcagcaattcggcaggggtgggagagccaagcgaggctaccgaagtcactgtagtcggcgacaagcttgatatccctaaggcccccgggaaaatcattccatcaaggaatactgacacctctgttgtggtgtcatgggaggagtcaaaggacgccaaggagttggttggctactacattgaggcttctgtcgcaggctcaggaaaatgggaaccctgcaacaataatcccgtgaagggaagccgtttcacatgtcacggcctcgtcacaggtcaatcctatatttttcgggtgagagctgttaacgcagccggtcttagtgaatacagtcaggacagtgaagctatcgaagtgaaggctgctatcggtggcggagtctctcctgacgtttgccccgctttatctgacgagccaggcggtctgaccgccagtcgaggccgggtccacgaagccagcccccccacctttcaaaaggacgcgctcctgggatccaagcctaacaagcctagtcttccatcctccagccagaacctgggccaaaccgaggtttcgaaagtttccgaaaccgtgcaggaagagctgaccccacccccccaaaaagctgctccacagggcaaatctaaaagcgacccgctcaagaagaaaactgatcgagctcctccctctcctccatgtgatattacctgtctagaatcttttcgtgacagtatggtgttgggatggaaacagccagacaaaattggaggcgctgagataacaggctattacgtgaattaccgggaggtcattgatggcgtacccggaaaatggagggaagcaaatgttaaggctgtgtccgaagaggcttacaagatctcaaacctgaaagaaaatatggtgtatcagttccaggttgctgccatgaacatggcaggcttaggcgcgccatctgccgtttccgagtgctttaagtgtgaggaatggaccatcgcagtccctgggcccccacacagtcttaagtgctccgaggtgagaaaagattcccttgtgctccaatggaagcctcctgtccacagtggcaggacccccgtcactggatacttcgtggaccttaaagaagccaaggctaaagaggatcagtggcggggcttgaacgaggccgcgattaagaacgtgtatctgaaggtacgcgggcttaaggaaggggtttcttacgtgttccgtgtgcgtgcaattaatcaagcaggcgtcggcaaaccttccgacctggccggccccgtcgtagccgaaacccgacccggtaccaaagaagtggtcgtgaacgtcgatgatgacggagtgatttcactcaacttcgagtgtgataagatgactcctaagtccgagttcagttggagcaaagactacgtgtctactgaggactcccctcgcctggaggttgagtcaaaaggcaataagaccaagatgacgtttaaggatctggggatggatgatttgggcatttattcctgcgacgtcactgataccgatggcatagcatcctcctacctgatcgatgaggaggagttgaagcggcttctcgccctttcacacgaacataagttccctacagtgccagttaaaagtgagcttgctgtggaaatcctcgagaaagggcaggtgagattctggatgcaagccgagaaactcagtggtaacgctaaggtcaactacatatttaatgagaaagagatctttgaagggcccaagtacaagatgcacatcgacagaaacacaggcatcatcgaaatgttcatggaaaagctccaggacgaagacgaggggacatatacatttcagctccaggatggtaaggccactaatcacagcaccgtagtgctagttggcgatgtgttcaagaagctccaaaaggaagccgaattccagaggcaggagtggattcgcaaacagggaccccactttgttgagtatctcagttgggaagtgacgggagaatgcaacgtgctcctcaagtgtaaagtcgctaatataaaaaaggagactcatatcgtgtggtataaagacgaaagagaaattagtgtcgacgaaaagcacgacttcaaagacggcatttgcacactgcttataaccgaatttagcaaaaaggacgccggtatttatgaggtgatcttgaaagacgaccgcggcaaggacaagtctcgcttgaaactggtggatgaggcgttcaaagaactcatgatggaagtgtgtaaaaagatcgcgctgtccgctaccgaccttaaaatccaatctacggcagaagggatccaactgtactctttcgtcacatattacgttgaagatttgaaggtgaactggagccacaacgggtctgcgatacgctattctgatagggtcaagacgggggtcaccggagagcaaatttggttacagataaatgagcctacaccaaatgataagggcaagtacgtgatggaattgtttgatggtaaaactgggcaccagaagacggtggacctatcaggccaagcctatgatgaagcctacgccgagtttcagcggttaaagaagtccctgctattccaaaaagacagggcaagagttctgggcggtctgccagatgtcgtgaccatccaggaagggaaagccctcaacctcacatgcaatgtgtggggcgaccctccgcctgaggtgtcttggttgaaaaacgagaaggcccttgcaagtgacgatcactgcaaccttaaattcgaggcgggacgcacagcctacttcacaataaatggcgtgtcgactgccgatagcgggaaatatggtctggtagtgaagaataaatatggtagcgagacctccgattttaccgtaagcgtatttatccctgaggaggaggcaagaatggcagctctggaaagccttaaggggggaaagaaagcaaagtag

SEQ ID NO: 25147 - DNA, 3456 bp, Artificial Sequence
  Description of Artificial Sequence: Synthetic coding sequence
atgatggccgccgccctgggcccccccgaggtgatcgcccagctggaaaatgcggctaaggtgctgatggctccgccgtctatggtgaataacgagcagcgccagcatgctgaacacatattcctgtcgtttcgaaaatccaaatcaccgtttgcagtttgcaaacatattctcgagacaagcaaggtcgattacgtgctgtttcaggcagcaacagcaattatggaagcagtagttagggaatggattctgttagagaaaggctccatcgagagccttcgaacgtttctcttaacgtatgtgctgcagagacctaatcttcaaaaatatgtgcgcgagcagatactactagctgtggcagtcatcgtgaaacgcggctctctagacaaatctattgactgcaagtccatattccacgaggtatctcagctcatatcatccggcaacccaaccgtacagactctcgcttgcagcattctcaccgctcttttgagtgagttttcatcttcgagcaaaacatccaacatcggactgagcatggagtttcacggcaactgcaagcgcgtttttcaagaagaggatctcaggcagatttttatgctcacggtggaggtccttcaggaatttagtagacgcgagaacctgaacgcccagatgagtagcgtcttccagcgctacctcgcactggctaaccaggtcctcagttggaacttcctgcctcctaagctgggacgacattacatcgcgatgttcgagtcaagtcagaacgtcctgctcaaaccaacagagagctggcgtgaaacacttcttgatagtcgcgtgatggagctattttttacagtgcacaggaaaatacgggaagattccgacatggctcaggacagcctgcaatgcttggctcaattggcgagcttacacgggccaatatttcctgatgagggatcgcaggtggactatttggcccacttcatcgagggcctgctcaacactatcaatggtatcgaaattgaggacagcgaggccgtcggcatctcttccatcatttccaacctgatcaccgtgtttcctaggaatgtgctaaccgctatcccttctgagcttttctcatcatttgtgaattgcctcacccaccttacgtgctcattcgggaggagtgccgctctcgaagaggtgctcgataaagacgatatggtttatatggaagcctatgacaagctgctggaatcatggctgacactggtccaggacgataagcacttccataaagggtttttcacacaacacgccgtgcaggtgtttaattcatatatacaatgccatctggcagcaccagacggtacacggaatttaacggcaaatggggtcgctagccgagaagaagaggagatttcagagctgcaagaggatgacagggaccagttcagcgatcagctcgcatcagtcgggatgctcggaagaatcgctgccgagcactgcatcccactgcttacatccttgttggaggagagagtcaccagactccatggacagttgcagcgacaccaacagcagttacttgcttcccctggatcctctaccgtcgacaataagatgctggacgatctgtacgaggacatccattggttaattcttgtcaccggctacctgctggccgatgacacacagggcgagaccccgctgataccaccagagataatggaatatagtataaaacactccagcgaggtcgatatcaataccacactgcaaatacttggctcccccggcgagaaagcttcgtctattccaggctacaacaggacggacagtgtgattcggctactttctgcaatactgcgggtgtctgaagtcgagagcagggccatacgcgcagatctgacacaccttttgagcccccagatgggcaaggacatcgtctggtttctgaagcggtgggctaaaacttacttactggtggatgaaaagctgtatgaccagatttcgctgccattttctaccgctttcggtgcagacacagaggggagccagtggataattggctacctccttcagaaagtcatctctaatttatctgtgtggagttccgagcaggatctggcaaacgacacggtgcaactgctggtcaccctcgtggagcggcgggaacgagccaacctggttattcagtgtgagaactggtggaacctggcaaaacagtttgcaagcagatcaccacccctgaactttctgtccagcccagtgcagcgaaccctgatgaaagctctagtcttgggtggtttcgctcatatggacacagaaacaaagcagcaatactggaccgaggttctgcagccccttcagcagcgttttcttagggtgataaaccaggaaaattttcagcagatgtgtcagcaagaagaggtgaagcaggagatcacagccacgctggaggctctgtgtggaattgccgaggcaacacagatcgataacgtcgcaatattattcaactttttgatggacttcctgacaaactgcatcgggttaatggaggtgtataaaaacactccggagaccgtgaacctcattatcgaggttttcgtggaggttgcccataaacagatctgttatctgggggagagcaaggccatgaacctatacgaggcctgcttgaccctcctgcaggtttatagtaaaaacaatctgggacgtcagaggattgatgtgacagctgaggaggaacagtaccaagatcttctgctcattatggaactactcacaaatctgttgtctaaggagtttattgacttttccgacacagatgaggtattccgtggacatgaacccgggcaggctgccaatcgatcagtgtcagccgcagacgtagtgctctacggtgtcaacctgatcctgccgctcatgagccaggacttactgaagtttccgacgctctgtaaccaatattacaagttaataacctttatctgtgaaatatttccagaaaagatcccccaactgccagaagatctcttcaaaagcttgatgtactcactcgagctcggtatgacatccatgtcatccgaggtgtgtcagctgtgtttggaggccctgacacctctggcagagcagtgtgcaaaagctcaagagactgactcacccttatttctcgctacaaggcacttcctcaaactcgtcttcgacatgctggttctgcagaagcacaacactgaaatgactaccgccgctggagaagcattttacaccctagtgtgtctccaccaggcggagtatagcgaattggtcgaaactctcttgtcttcacagcaggatccagtaatctaccaacgcttggcagatgcttttaacaagctgaccgcttcgtccactccccccaccttagacaggaaacagaaaatggcctttttgaagtccctcgaggaatttatggcaaatgttggtgggctcctgtgcgtcaagtag

SEQ ID NO: 25148 - DNA, 420 bp, Artificial Sequence
  Description of Artificial Sequence: Synthetic coding sequence
atgggcggcggcgagcggtacaacatccccgccccccagagccggaatgtgtcaaagaaccagcagcaactgaacaggcagaagactaaggaacagaattctcagatgaagatcgtacacaagaaaaaggaaagggggcacgggtacaactcatctgcagcagcctggcaggctatgcagaacggtgggaagaacaaaaacttcccgaacaaccagtcgtggaactcatccttaagcggcccgaggctcctattcaaaagccaggcaaatcagaactacgctggggccaaattctccgagcctccgtcgccgtctgtgctgcccaagcccccttcacactgggtaccagtgagcttcaacccttctgacaaggaaattatgacattccagttaaagacacttctgaaggtgcaagtttag

SEQ ID NO: 25149 - DNA, 984 bp, Artificial Sequence
  Description of Artificial Sequence: Synthetic coding sequence
atgaaggagatgctggccaaggacctggaggagagccagggcggcaagtcatctgaggtgttaagcgccaccgagctgagagtgcaactggcacagaaagaacaagagcttgcccgcgcgaaagaggcacttcaggccatgaaggcagaccgtaaacgcctcaaaggggagaagacagatttagtttcgcagatgcagcagctgtatgcgacgctggaaagccgtgaggaacagctgcgcgactttatccggaattatgaacaacataggaaggagtctgaggacgccgtaaaagcactggccaaagaaaaggatctcctggaacgcgagaaatgggagcttcggcggcaggccaaggaggcgactgatcacgcaacagcactgaggtcacagctcgacctcaaagacaataggatgaaggagctcgaagccgagttagccatggccaagcaatccctcgcaacattaaccaaggacgtacctaagcggcacagcctcgccatgcccggcgaaaccgtgttgaacgggaatcaggaatgggtggtgcaggccgatctacctttaaccgccgccatcagacaatctcaacagactctataccattcacaccccccccacccagcagataggcaagcggtgagggtcagtccttgtcacagccggcaaccctcggtcattagcgatgccagcgcggccgaaggagatcgctcttcaacaccaagtgatattaattcaccacgccaccggacacactcactgtgcaacggcgatagccccggtcctgtccaaaagaatctgcataatccaatcgtgcagagtctcgaagacctggaggatcaaaaacggaagaaaaaaaaggaaaagatgggttttggttccattagtagggtgttcgccaggggcaagcagaggaaaagcctcgatccgggattgtttgacggaacagctcctgattactatattgaggaggacgccgattggtag

SEQ ID NO: 25150 - DNA, 984 bp, Artificial Sequence
  Description of Artificial Sequence: Synthetic coding sequence
atgaaggagatgctggccaaggacctggaggagagccagggcggcaagagcagcgaagttttgtcagcaacagagctcagggtgcagctggctcaaaaggagcaggagctggcaagggctaaagaagcattgcaggctatgaaggccgaccggaagagactgaagggcgagaagaccgacctcgtgtcacaaatgcagcagctctacgcaacactggagtcccgcgaggagcaactccgggacttcatccggaactatgagcagcatcggaaagaaagcgaggacgccgtcaaggctttagccaaggaaaaggacctacttgaacgtgaaaagtgggagctgcgacggcaagcgaaggaggccacagaccatgccaccgcactaaggagccagctggacctcaaggataatcggatgaaagaactggaagccgagctggccatggccaagcaatccctggccaccctgaccaaggacgtgcccaagcgccatagcttggcgatgcccggtgagacagtactcaatggtaatcaggagtgggtcgtgcaggctgatcttcccctgaccgctgccatccggcagtctcagcagacactttaccactcccacccccctcatccagcagacaggcaagcggtgcgggtttcaccatgtcatagtcggcaaccctccgtgatcagcgacgctagtgctgccgaaggcgatagatcttcaacgccctccgacataaattcaccacgtcataggacgcactcgctctgtaatggcgactcgcccggtccagtgcagaagaatctgcataatccaatagtgcagagtctagaggacctcgaagatcaaaagagaaaaaaaaagaaggaaaaaatgggattcgggtctatctcgagagtcttcgcaagggggaagcagcgtaagtcactggaccctggtttgtttgatggaactgcacccgactattacatcgaggaagacgcggattggtag

SEQ ID NO: 25151 - DNA, 609 bp, Artificial Sequence
  Description of Artificial Sequence: Synthetic coding sequence
atggacgagcaggccctgctgggcctgaaccccaacgccgacagcgattttcgccagcgagccttggcctactttgaacagctcaaaatctctcctgatgcatggcaggtgtgtgcagaggccttggcccaaagaacctatagcgatgatcacgtgaaattcttctgttttcaggttcttgagcaccaggtgaagtacaagtattccgaactgactaccgtgcagcagcagctgatccgagagactttgatcagttggctgcaagcccaaatgctcaatccccagccagagaaaacctttatccggaacaaggctgcccaggtgtttgcgttattgttcgtgacagaatacctgactaagtggcctaagtttttcttcgatatccttagtgtggtggacctcaaccccaggggagttgatctctatctcagaatccttatggccatcgattctgagctagtggatagagacgtggtgcatacatcagaggaggccagaagaaacacactgataaaagacaccatgagagaacaatgtatccctaatctcgtggagagctggtatcagatactgcagaattatcagttcacaaattccgaagtgacctag

SEQ ID NO: 25152 - DNA, 1803 bp, Artificial Sequence
  Description of Artificial Sequence: Synthetic coding sequence
atgagccgggtggccaagtaccggcggcaggtgagcgaggaccccgatattgattctctactcgagactttgagcccagaggaaatggaagaattggaaaaggagctcgatgtggtggaccccgacggctctgttcctgtcgggctgcgacaacgtaatcaaaccgagaagcagagtacaggtgtttataacagagaggccatgttgaatttctgcgaaaaggagaccaagaaactgatgcagcgtgaaatgtctatggatgaaagtaaacaggtagagacgaagaccgacgccaaaaatggcgaggaaaggggacgcgacgcctcgaaaaaggctcttggcccaaggcgggatagcgacttggggaaggagcccaaacgtgggggccttaaaaaatcttttagtagagatagagatgaggctgggggcaagtcaggcgaaaagcccaaagaggaaaaaatcatacgggggatcgataaggggagagtgagagctgccgtggacaaaaaagaggctggtaaggacgggagaggcgaggagagagctgtagccactaagaaggaagaggaaaaaaaaggaagcgatcggaatacaggtttgtcgcgggataaagacaaaaagcgtgaagagatgaaagaagtggcaaagaaggaggatgacgaaaaggtaaagggtgagaggcggaatacagataccagaaaggagggtgaaaagatgaagagagccggggggaacacagacatgaaaaaggaggacgagaaagtgaagcgtggaacgggtaatactgacaccaaaaaagatgacgagaaggttaagaagaacgaaccactgcatgagaaggaagctaaagacgactccaaaacgaagacaccagaaaagcagactccaagcggccctaccaagccaagtgagggacctgctaaggtagaggaagaggccgcaccaagcatcttcgacgagccgctggagcgcgtgaaaaacaacgatcccgagatgacagaagtcaacgtgaataatagcgactgtattaccaatgaaatcttagtgcgctttactgaggcgctcgagttcaatactgtggtaaagctcttcgcactcgctaacacaagggctgacgatcatgtggcattcgcaatcgctattatgcttaaggccaataagacaatcaccagtctgaatctagattcaaatcatatcaccggcaaaggcattctggccatctttagggcccttctacagaacaatactcttactgagctgaggttccataaccagaggcatatatgcgggggcaagacagagatggaaatcgctaagctgttgaaggaaaacaccaccttactaaagctgggatatcattttgagcttgcggggccccggatgactgttaccaaccttctgtcacgcaatatggataaacagcgccaaaagcgcctccaagagcaaagacaggcccaggaagccaaaggcgagaaaaaggacttgctggaggtccccaaggctggtgctgtggccaagggatctccgaaaccatcccctcagccatctccaaagccttcgcccaaaaatagccctaaaaagggaggcgccccagctgccccgccccccccacccccaccactagccccccccctcataatggaaaacttgaagaacagtttaagccctgcaacccagcggaaaatgggtgacaaagtcctgcctgctcaggaaaagaactcgagggatcaacttctggcagctattaggtcctccaatctcaagcagctcaaaaaattggaactccctctgctacttcagtag

SEQ ID NO: 25153 - DNA, 201 bp, Artificial Sequence
  Description of Artificial Sequence: Synthetic coding sequence
atgatcggcaccaccgaggtgccctgctgcggccccagcgccacctgggccttacggtggtccgaccagatcacgctgccgtccctcccgtggacaatgtcgagcctgtggtgcatcccactgaaaggcatgctggctacgtgcccagttagcctcctggaacacgcttactcaaacgctctccgggggtggaagccttag

SEQ ID NO: 25154 - DNA, 2121 bp, Artificial Sequence
  Description of Artificial Sequence: Synthetic coding sequence
atggccaccgccaacttcggcaagatccagatcggcatctacgtggaaattaagcgtagtgatggtcggatccaccaggcgatggttacatctctcaacgaagataacgaatcagtgactgtggaatggattgagaatggtgacactaagggcaaggagattgacctggaatcaatcttcagtctgaatcctgacctggtgcccgacgaggagatcgagccgtcccctgagactccccctcctcccgcttcaagcgctaaagttaataaaattgtgaaaaaccgccggaccgtcgcatccattaagaacgatccccccagtcgcgataatcgcgtcgtgggctccgcaagagcacgaccgagtcagttccccgagcagtcttcctccgcgcagcagaatggttcagtatctgatatcagccctgtgcaggctgctaagaaagagtttggcccccccagccgcaggaagagtaactgcgttaaggaggtagagaaactgcaggaaaaaagggagaagaggaggctgcagcagcaggagcttagggaaaagcgagcccaggacgttgatgctaccaatcctaactatgaaatcatgtgtatgattcgtgacttccggggttctctggactacagacccctgacaacagctgaccctatcgacgagcatcgtatctgtgtctgtgtccgcaaaaggccacttaataagaaagagacccagatgaaagatctggacgtcattacaatcccctcgaaggacgtggtgatggtgcacgagcccaagcaaaaagtggatttgaccagatacctcgagaaccaaacattcaggttcgattatgcgtttgatgatagtgcccccaacgagatggtatatcggttcacggctcgtcctctggtggagaccattttcgagcgaggaatggctacctgcttcgcatacggccaaacaggaagtggcaaaacccacacgatggggggcgactttagtgggaagaatcaggattgcagtaagggtatctatgctctggccgctagggatgtgttcctcatgctgaaaaagccaaactataagaagttagagttgcaggtctatgccacttttttcgaaatctacagcggtaaagtcttcgacctgttgaatcggaagactaaattacgagttctcgaggatgggaagcagcaggtgcaggtagtgggcctacaagaacgcgaagtgaagtgcgtggaggatgtgctcaagctgatcgacatcggtaattcgtgtagaacaagcggccagaccagtgccaatgcccattcttctaggtcgcacgctgtgtttcaaattatcttgcggcgaaaagggaagctccatgggaaattttccctaatcgacctggccggtaacgagcgaggcgcagatacttccagcgcagataggcaaaccagattagagggcgctgagatcaacaagtccctgctggccttaaaagaatgtatcagggctctgggccgaaacaaaccccatactcctttcagagccagcaaactgacccaggttctgcgcgattcttttatcggcgagaatagccgcacctgcatgatcgcaactatctctccaggaatggcttcgtgcgagaacactctgaataccctcaggtacgccaacagagtgaaggagttaaccgtcgatcctaccgccgctggggacgtgcgccccattatgcatcacccaccaaatcagatcgacgacttagagacacagtggggagtgggatcctccccacagcgcgatgatcttaaactgctgtgcgaacagaatgaggaggaagttagccctcaactgtttacatttcatgaagcagttagccaaatggtcgaaatggaggaacaggtggtcgaggaccatcgcgctgtgtttcaggaatcaattcggtggctggaggatgaaaaagcccttctggagatgaccgaggaggtggattatgatgtggacagctatgcaacccaattggaggccattttggagcagaagatcgatattctgaccgaactgcgagacaaggttaagagcttcagagccgcgctgcaggaagaggaacaggcttcaaaacaaattaacccaaagcgccctagagctctatag

SEQ ID NO: 25155 - DNA, 1281 bp, Artificial Sequence
  Description of Artificial Sequence: Synthetic coding sequence
atggcccacctgcggggcttcgccaaccagcacagccgggtggaccccgaagaactgttcactaagttggaccggatcggcaaagggtcattcggtgaagtttacaagggaattgacaaccatactaaagaggtggtggcaatcaagataattgacttggaagaggcagaagacgagatcgaagacatccagcaagagatcacagtactgagccagtgcgactccccttacatcacccgttactttggttcatacctgaagtccactaagttgtggattatcatggagtatctgggaggcggaagcgccctggacttacttaaaccaggccccctcgaagaaacctatatcgccacaatcttaagagagatcctgaagggactcgattatctccacagtgagcgcaaaatacacagggatattaaggccgcaaacgtgctgctttccgagcagggcgatgtgaagctggctgatttcggggtcgccggccagctcacagacactcaaattaagcgtaacacattcgtcggaacgccattttggatggctccggaagtgataaaacaatctgcctacgacttcaaggccgacatctggtccctgggtatcaccgccatcgaattagcgaagggagagccccccaattccgatcttcaccccatgcgcgtattgtttctgattcctaagaattccccaccaactctggaagggcagcatagtaagccgtttaaggagttcgttgaagcctgtctcaataaggatccaaggttccgtccgacagcgaaggagctgttgaaacataaattcatcacgcggtataccaaaaaaacttcttttcttaccgagcttatcgatagatataaacggtggaagagcgaaggccacggagaggaatcatcctctgaggactcagacattgatggcgaggccgaagacggcgaacaggggcccatctggaccttccctccaaccattaggccgagccctcacagcaagctacataaaggaaccgccctgcattcatctcagaaaccagcagagcccgttaaaaggcagccccggagtcagtgcctttccactttagttcggcccgtctttggggagctgaaagagaagcacaagcagtccgggggaagcgtcggggcactggaggaactggagaacgccttctctctcgctgaagaatcgtgccccgggatttcagacaagctcatggtgcatctggttgaaagggtgcaacgcttttctcacaacaggaatcacctaacatcaaccagatag

SEQ ID NO: 25156 - DNA, 996 bp, Artificial Sequence
  Description of Artificial Sequence: Synthetic coding sequence
atgctgcggtgcggccagatgatcttcgcccaggccctggtgtgccgacatctgggacgggattggcggtggacacagagaaaacgtcaacctgacagctactttagcgtgttgaatgcatttattgatcgtaaggactcctattattctatacaccaaattgcccagatgggggtgggcgaaggaaagagtatagggcaatggtacggacccaatacagttgctcaggtcctaaaaaagctggcggtatttgacacatggtcttcgctggcagtgcacatcgccatggataacaccgttgtgatggaagagattcgccgactgtgtcggaccagcgttccttgcgctggtgcgaccgcttttcccgctgactccgatcgtcattgtaatgggtttccggcaggcgcagaagtcactaataggcctagcccctggcgtccgctagtccttttaatcccattgcgtctcggcctgactgatatcaatgaagcatacgtggaaacactgaagcattgctttatgatgccccagagcctaggagtgattgggggcaaacctaattccgcccactacttcatagggtatgtgggggaagagctaatctacttagatccacacaccacgcagccagcagtcgagccaacagatggctgctttatcccagacgaaagtttccattgtcagcatcccccatgccgcatgagcatagccgagctcgacccgtccatcgccgttggatttttttgtaaaaccgaagacgattttaacgattggtgtcagcaggtcaaaaaattatctttgttgggcggtgcactgcctatgttcgaactagtggagctccagccatctcatctggcctgtcccgacgtgcttaatttgtcactgggggagtcctgtcaggttcaagttggcagcctgggggacagcagcgacgtagagcgactcgaacgattttttgattctgaggatgaggacttcgagattctgtcgctgtag

SEQ ID NO: 25157 - DNA, 1461 bp, Artificial Sequence
  Description of Artificial Sequence: Synthetic coding sequence
atgagcgtgacctacgacgacagcgtgggcgtggaggtgagcagcgacagcttctgggaggtcgggaattacaaaaggactgtgaaacgtatagacgatgggcaccgtctctgctctgatctgatgaattgcctgcatgaaagagcaagaattgaaaaggcttatgcccagcagcttaccgagtgggcacggaggtggcgacagctggtggaaaaggggccacagtacggcacagtggaaaaggcatggatggcatttatgtcggaggctgagcgagtgtctgagctccatctagaggtgaaggccagcttaatgaatgacgatttcgagaaaatcaagaactggcaaaaagaggctttccacaagcaaatgatggggggctttaaagaaaccaaagaagctgaggacggcttccgaaaagctcagaagccctgggcaaagaaattaaaagaggtggaggccgccaagaaagcccaccatgccgcctgcaaggaggagaagctcgccattagccgcgaggctaacagcaaggccgatcctagcctcaaccccgagcagctgaaaaaactccaggacaaaatagaaaagtgcaaacaagacgtgctgaagactaaggagaaatacgaaaaatcactcaaggagctcgaccagggcactccccagtatatggagaatatggagcaggtcttcgaacaatgccaacagtttgaggagaaaagacttcggttcttcagagaggtcctgttagaggtgcagaagcatctggacctctctaacgttgccgggtataaagctatataccacgacttggaacaatccatccgcgctgctgatgcagtcgaggacctccgctggttcagggcaaatcatggtccaggtatggctatgaactggccgcaattcgaggaatggagcgcggacctaaatcggacactgtccagaagagagaaaaaaaaggctactgatggagtaactttgaccggaataaaccaaacaggcgatcagtccctcccatccaaaccatccagtacactgaacgtgccatctaaccccgcccaatccgcacaaagccagtcatcctataacccgtttgaagatgaggatgataccgggagtacagtcagcgaaaaagacgacaccaaagccaagaacgttagcagctatgaaaagactcagagctaccctaccgattggtctgacgacgaaagcaacaatcctttttcaagcactgatgcaaacggcgactctaacccttttgacgacgatgccacaagcggcaccgaggtgagagtgcgcgccctgtatgactacgagggacaggagcacgacgaactgtcgtttaaagccggcgatgagctcacgaagatggaagacgaggatgaacagggttggtgtaaaggccggctcgataacggccaggtggggctgtacccggccaattatgtggaggcgatccagtag

SEQ ID NO: 25158 - DNA, 3075 bp, Artificial Sequence
  Description of Artificial Sequence: Synthetic coding sequence
atgaacttcatcaaggacaacagccgggccctgatccagcggatgggcatgacggtgattaagcagattaccgacgacctcttcgtttggaatgtactgaacagggaggaggtgaatataatttgctgcgagaaggtggagcaagatgccgctagaggcattattcacatgattcttaaaaaaggttctgagtcgtgcaatctgttcctgaagagcttgaaggagtggaactaccccctattccaggacctgaacggccagtccttatttcaccagacctcagagggcgacctggatgatctagcgcaggatctcaaggacctgtatcacacaccttcttttctgaatttctaccccctgggcgaagatattgatataattttcaacctgaagtcaaccttcacggaacctgttctctggagaaaggaccagcaccaccacagagtagagcagcttactctgaatggcctgttacaggcgctgcaatccccttgtattatagagggggagtccggcaaaggcaagtccaccttacttcagcgcatcgcaatgctttggggatccgggaaatgtaaagcactcaccaaatttaaatttgtgttttttctccgtctcagtcgcgcccaagggggactctttgagacactgtgcgatcagctactagatataccaggcaccatccggaaacagacattcatggccatgctactgaagttgcgccagcgcgtgttgtttctcctggacggctacaatgagttcaaaccccaaaattgtcctgaaatcgaggctttaataaaggagaaccaccgttttaaaaacatggtcatagtcacgacgacaaccgaatgtctgagacacattaggcagtttggcgccctgactgcagaagtaggggacatgaccgaagacagcgctcaggccctcattcgagaggtcctcattaaagaactcgccgaaggattgctcctccagattcagaagtcccggtgtttacgtaatctgatgaagacacctctatttgtggttatcacctgcgctatccagatgggagagagtgaatttcattcacatacccaaacgaccctcttccatacattttacgacctgctaatccagaaaaacaaacacaaacacaagggagttgccgcctctgattttatccgatctctggaccactgcggggatttggccctggaaggcgtgttttcgcacaagttcgatttcgagcttcaggatgtatctagtgtcaatgaagatgtgctgttgacgactggcttactgtgtaaatacaccgctcagcgattcaaaccgaaatataaatttttccataagtcctttcaggaatacacggctggtagacggctctcatcccttctgacatctcatgagccagaagaggtgaccaaaggtaatggatatttgcaaaagatggtgtccatcagcgacatcactagtacatattcttcgctgttgcggtatacttgcggctcctcagtggaggctacccgggctgtgatgaagcacctagctgcagtataccagcatggatgcttgttgggactttcgattgccaagcgccctctgtggagacaggagtccctccagtccgtgaaaaacaccacggagcaggaaatcttaaaagctattaacatcaactccttcgtggaatgtgggattcacctctaccaggaaagtacgagcaagagcgccctgtcacaggaattcgaggccttcttccagggaaaatccctgtacattaactcaggaaatatccctgactatctctttgatttcttcgaacaccttcccaattgtgcttcagcgctggacttcattaagctggacttttacggcggcgcaatggcaagctgggaaaaagcagctgaagataccggaggaatccacatggaggaggcgccagaaacttacattccatccagagcggtctccctgttctttaactggaagcaggagttcagaacacttgaagttacactgagggacttctctaagctgaacaaacaagatatccgctacctaggaaagatcttttctagcgcgaccagtcttcggctgcagattaaaagatgtgccggggtggctggcagtctttctctcgtcctctccacatgtaagaatatatatagcctgatggtggaggccagtccactaaccattgaggatgagcggcacattacatcggtgacaaatctcaagactcttagcatacatgatttgcagaaccagagactccctggggggcttactgacagcctcggcaatttaaaaaacctgactaaattaatcatggataatatcaagatgaacgaagaagacgctatcaagctggcagaaggattaaagaacttaaagaagatgtgcctgtttcatctgactcacctttcagacattggcgaaggaatggactacattgtcaagagcctgtcgagtgaaccctgcgatttggaggagattcaactagtgtcctgctgtctgtctgccaatgcagtcaagatattggcgcagaacctgcacaacctggttaaattgtctatactggatctgagcgagaactatcttgaaaaagacgggaacgaagcgctgcatgaacttattgatcggatgaatgtgctggagcaactcacggctcttatgttgccatggggatgcgatgtccagggctcactgagcagtctgctgaaacatttagaggaagtcccacagttagtgaagctggggctgaagaattggagactcacagacacggagatcagaatcctgggcgccttctttgggaagaatccactgaagaatttccaacaactgaacttagccggcaaccgtgtgtcgtcggacgggtggctggccttcatgggtgtgttcgaaaatctgaaacagctggttttcttcgacttctcgacaaaggaattcctgccagatccagctctggttaggaagttaagccaggtactttccaaacttacctttctgcaggaggctagacttgttggctggcaatttgacgacgacgacctctctgtgatcacaggcgcattcaagctggtgactgcttag

SEQ ID NO: 25159 - DNA, 339 bp, Artificial Sequence
  Description of Artificial Sequence: Synthetic coding sequence
atggacgacaaggccagcgtgggcaagatcagcgtgagcagcgactcagtgagcaccctcaacagcgaagactttgtgctagtatcccgccaaggcgatgagacaccaagcactaacaacgggtctgacgacgaaaagacaggcctcaaaattgtaggcaacggctctgagcagcagttgcagaaggaactggccgacgtgctaatggacccacccatggatgatcagcccggggagaaggaattggttaaaagatcacaattagatggtgagggcgatggtcctctttcaaatcagctcagcgccagctctactattaaccctgtgccgttggtgtag

SEQ ID NO: 25160 - DNA, 441 bp, Artificial Sequence
  Description of Artificial Sequence: Synthetic coding sequence
atgctgaaggaggactgcgccagcgagctgaaggtgcacctggccaagtccctacccctgccctctagtgtaaatcgaccgcgcattgatctgattgtatttgtggtgaatcttcattccaagtacagtctccagaacacagaggagagcctacgccacgtcgatgcatccttcttcctgggaaaagtctgttttctagctacaggtgctggccgcgagtcccattgcagtattcatcgtcatacagtggtcaagctggcccacacctaccagagcccacttctttattgcgaccttgaggtggagggcttccgcgccaccatggcgcagcgcttggttagggtactgcaaatctgtgctggacacgtgcccggcgtgtctgctctcaacctgttgagcctgctgcgctcgtcagagggaccaagcctcgaggatttgtag

SEQ ID NO: 25161 - DNA, 1203 bp, Artificial Sequence
  Description of Artificial Sequence: Synthetic coding sequence
atggccagcgacacccaggccgtgcccgacgtgagcggccggagccgggctaggcgctacgcagaatggtcatctggccttcggtctgggcgcgcaggtggcggggagaccagtgtggagaggcggagaacttgtgctttcgacactcttgaagcctttcttattatggacggggaggatattccagacttttccagcctgaaggaggaaaccgcgtattggaaggagttaagccttaaatacaagcagtcatttcaggaggctagggacgaattggttgaatttcaggaaggctccagagagctggaagccgaactggaagcacagctggtgcaggccgaacagaggaacagggatctccaggccgataatcagagactaaagtatgaggtagaggccctgaaggagaaactggagcaccagtacgctcagtcatacaaacaggtgagcgttctggaggatgacttgagtcagacacgggctataaaagagcagttacacaaatacgtgagagagctggaacaggctaatgacgacctagaaagagccaagagggcaacgattgtgagtctggaggacttcgagcagcgcctgaaccaggccatagaaagaaatgctttcttggagagcgagttggacgagaaagagagcctcctggtgagcgtccagcgacttaaagatgaagcccgggatctgaggcaagagctcgcagtaagagaaaggcagcaggaagttacacgcaaatcagctcccagcagcccaacgttggattgcgagaaaatggacagcgcagtgcaggccagcctgtctcttcccgctacccccgtcggcaagggaacagagaacacttttccctctcccaaggctatacccaatggtttcggcacaagcccacttacaccgtctgcccgaatctcagccttgaatatcgtgggggatcttctgcggaaagtcggggcccttgaaagtaaacttgctgcctgcaggaacttcgctaaggaccaggcctcccggaaatcttacatatcagggaacgtgaattgtggcgtcttgaatggaaacggcaccaagttctccagaagtgggcacacctcattttttgacaaaggggctgtgaatggcttcgaccctgcacctccccctcccggacttggtagctccagacctagtagcgcccctggcatgctcccactgagtgtgtag

SEQ ID NO: 25162 - DNA, 699 bp, Artificial Sequence
  Description of Artificial Sequence: Synthetic coding sequence
atgacccccccccagcagcccccccccctgcggagcgagcccggcacactggggagcgctgcaagtagctattcaccccttgggctgaatggcgtgcctggctcaatttgggactttgtgagtggatcttttagccccagccccagcccaatcctctctgccggtcccccctccagctctagtgcttcacccaacggcgctgagctcgcccgagttagacggcaactcgacgaagcgaaaagaaagatccggcagtgggaagagagctggcagcaggtgaaacaggtgtgtgacgcgtggcagcgtgaggcccaggaagccaaggaacgtgcgcgcgtggcggacagtgataggcagctcgccctgcagaagaaggaggaggtggaagcgcaagtgaaacagctgcaggaggaacttgaagggctgggagtggcctcgaccttgccggggcttcgcggctgcggcgatattggcaccatacccctgcctaagctgcatagcctgcagagtcagctgcggctcgacctggaagcagttgacggcgtgattttccagttgcgggccaaacagtgtgtggcttgccgcgagagggctcacggagccgttctaaggccctgtcagcaccatattctttgtgaaccttgcgccgctaccgcccctgagtgtccttactgtaagggccagccgttgcaatggtag

SEQ ID NO: 25163 - DNA, 1500 bp, Artificial Sequence
  Description of Artificial Sequence: Synthetic coding sequence
atgctgccctggccccccgccctggccatgcccatgcccaccgaggggaccccgccacctctgtccgggacacccattcccgtcccggcttactttcgccacgctgaacctggcttcagtctcaagaggcccagaggcctgtctaggagtcttcctcccccacccccggctaagggcagcattcctatctccaggcttttccctccaaggacccctggctggcatcagctgcagcctaggcgagtctctttccggggggaggcctcagaaacattgcaatctccagggtatgacccctctcgaccggaatctttttttcagcagagcttccaaaggctctctagacttggccacggctcctacggggaggtgttcaaagtgagatccaaggaagatgggagattatatgccgtgaagcgcagcatgtccccgttccgaggaccgaaggatagagctcgcaaactggctgaggtcggcagtcatgagaaggtggggcagcacccttgctgcgtgagattggaacaggcctgggaggaaggaggcattttatacttgcagacggaactctgtggcccgagcctgcagcagcactgcgaggcatggggggcaagcctgccggaagcccaggtgtggggctatctccgagataccctactcgcccttgctcacctgcacagccaaggactcgttcatctggatgtaaaacctgccaacatttttctgggcccgcgaggccgctgcaagttaggagattttgggctgttagtggaactcggaaccgccggggcaggggaagtgcaggagggagaccccaggtatatggcaccagagctactccaagggtcttatggaactgccgccgacgtattctccctgggtctgaccattttagaggtagcttgtaatatggagctgccccacggcggtgagggctggcagcagctgaggcaggggtacctgcctcccgagttcaccgccgggctgagttcagagctgcgttccgtcctcgttatgatgctggaaccagacccaaagctgagggcaaccgcagaagcgctgctcgcactgcctgtactgaggcagcctagagcctggggggtactgtggtgcatggcagctgaggcccttagcagaggctgggccctctggcaggcactgttagctctcttatgctggctgtggcacggcttggcacatcctgctagctggctgcagccccttgggcctcccgccacgccgccaggcagcccaccatgttccctattgctggatagtagcctcagtagcaactgggacgatgactccctaggtcccagtctttccccggaggctgttttggcccgtactgtgggcagcacgagcactccgcgaagccgttgcacacctcgggacgccctggacctgtccgatatcaattccgagccacctcgtggatcattcccctcttttgagccccgtaatctgctgtcactgttcgaagacacccttgaccccacatag

SEQ ID NO: 25164 - DNA, 3153 bp, Artificial Sequence
  Description of Artificial Sequence: Synthetic coding sequence
atgctgtgctggggctactggagcctgggccagcccggcatcagcacaaaccttcaaggaatcgtcgccgaaccacaggtgtgtggtttcatttcggatcggagcgtgaaggaggtggcctgtggcggcaatcattctgtctttctcctggaagatggtgaggtgtacacatgtgggttgaacacgaagggacaactgggacatgaaagggagggcaacaaacccgaacagatcggagcgctggccgaccagcacatcattcatgtagcttgcggggagagtcactcacttgccttaagtgatagaggccaattattttcctggggggctggcagcgatggacagttgggcttgatgactacggaagatagcgtcgcggtgccgcgactgattcagaagctcaatcaacagactatcctccaggtttcatgtgggaattggcactgcctggcactggcagctgatggacagtttttcacctggggtaaaaactcccacggacagctgggccttggcaaggagttccctagccaggcatctcctcaaagggtgaggtccctggagggaatccccttggcccaggtggccgccggcggggcccattcttttgccctcagcttaagcggtgctgtgtttggttggggcatgaataacgctggacagcttggcctgtcagacgaaaaggatcgtgagtctccgtgccacgtgaagttgctcagaacacagaaggtcgtgtacattagttgcggcgaagaacataccgctgtccttacgaagagtggcggagtcttcacttttggcgctggatcgtgtgggcaactggggcacgacagcatgaacgatgaggtgaaccctcgccgcgttctggaactgatgggtagtgaggtgacacagatcgcttgcgggcggcagcacacactggcattcgtgccatcaagcggcctcatctatgcattcggttgcggagcgagaggacaattaggaactgggcacacatgtaacgtaaagtgtccgagccccgttaagggatattgggctgcacactccgggcagctgtctgctcgggcggatcgtttcaaatatcacattgtgaagcagatcttttcagggggtgaccaaacattcgtattgtgttccaagtatgagaactactctccagccgttgatttccgcacaatgaatcaagcccactatactagtctgatcaacgatgagacaattgcagtgtggcgccagaaactttcagagcataataatgcaaataccattaacggcgtcgtgcagatcctgtctagtgccgcatgttggaatggatcttttctggaaaaaaaaatcgacgaacattttaaaacaagtcccaagatcccagggatcgatcttaactccacccgagtcctgtttgaaaagctgatgaatagccaacattcaatgattctagaacagatactcaactcctttgagagctgcctgatccctcagctctcatcgagcccccctgacgtcgaggctatgagaatatatctgatcctgcccgaatttccccttcttcaggactctaaatattacattaccctcactatcccattggccatggcaatcctgcgtctagacacaaaccccagtaaggtcctcgacaactggtggtcacaagtgtgcccgaagtatttcatgaaactcgtgaatctctataaaggtgcggtgctttacttactgagaggcagaaagacattcctgattcccgtcctttttaacaattatataaccgccgccctcaagcttctggagaagttatacaaggtcaatctgaaagtcaagcacgtagagtatgatactttctatattcccgagattagcaatctggtcgatatacaggaggactacctaatgtggttcctccatcaagctgggatgaaagccagaccctccattatacaagatactgttacgttatgcagttatccttttatctttgacgcacaggcaaagacaaaaatgctgcagacagatgctgagctccagatgcaggtcgccgtaaacggagctaacttacagaacgtgtttatgctgctaaccttagaaccactcctcgcccggtctccctttctagtgctccacgttcggaggaacaatctagtaggagatgcactgagggaattgagcatacacagtgacatcgatcttaagaaacccttaaaagtcatctttgatggcgaagaagccgtggatgccggcggtgttactaaagagttcttccttctgctgcttaaggagctgctgaatcccatttatggaatgtttacatactaccaggatagtaatctgctctggttttccgacacatgcttcgtggagcacaactggtttcatttgattggtattacctgtggcttggcgatctataattcaactgtggtggacctgcactttcccctggctctgtacaagaagttactgaacgtcaaaccaggattagaagatctgaaggaactgtcgccgaccgagggtcgctctctccaagaacttctcgattatccgggggaggatgtggaggaaacattctgtttaaacttcaccatctgcagagaatcttatggggttatcgaacagaaaaagctgatccccggtggggacaatgtaaccgtatgcaaagacaaccgccaggaatttgtcgatgcctatgtgaactatgtgttccaaatatctgtgcatgaatggtatacagccttcagcagtggcttcctgaaggtgtgcggtgggaaggtgctcgaactattccagccaagcgagttgcgggctatgatggtgggaaacagcaactacaactgggaggagctcgaagagaccgcaatctataagggggattatagcgctactcaccccaccgtgaaattgttctgggaaactttccacgaatttcctttagaaaaaaaaaaaaaatttcttttgttcctgacaggtagtgatcggataccgatctacggtatggcctctctgcagatcgtgatacagtctaccgcttccggagaggaatacctccccgtggctcacacctgttataatctcctcgaccttccaaaatattcttccaaggagatactgtccgcccgcttgacccaagcactggataattacgagggatttagcctggcttag

SEQ ID NO: 25165 - DNA, 363 bp, Artificial Sequence
  Description of Artificial Sequence: Synthetic coding sequence
atgagcatcggcgtgcccatcaaggtgctgcacgaggccgagggccatatcgttacgtgtgaaaccaataccggggaggtgtatcgtggcaagctcattgaggcggaagacaatatgaattgtcagatgtccaacatcaccgtgacttatagggacgggcgcgtagcacaactggagcaggtttacattagaggcagtaagatacgatttctgatactacctgacatgctgaaaaacgcaccaatgctaaagtctatgaaaaacaagaaccagggctctggcgccggtagaggaaaggctgccattctaaaggcccagggctacctctcgagtctcgaatgggtactcgttcacatttgctag

SEQ ID NO: 25166 - DNA, 1182 bp, Artificial Sequence
  Description of Artificial Sequence: Synthetic coding sequence
atggaggagaacaacctgcagtgcagcagcgtggtggacggcaactttgaagaggtcccccgggagacggctatccaatttaagccaccactgtaccgacaacgataccagttcgtcaaaaatctggtcgatcagcacgaaccgaagaaagtggccgatcttggttgtggggataccagtttacttaggttattaaaagtgaatccctgtatagagctgctcgtgggagttgacattaacgaagataagctgaggtggaggggcgattccctggccccttttttaggggacttcctgaagccacgcgatctgaatctcacgatcactctctaccacggcagcgtcgtggaaagagattcccggctcttggggtttgatctgatcacatgtatagagctgattgagcacctagatagcggggacctcgccagatttcctgaggtggttttcggctacctttcacctagcatgattgtgatcagtacccctaattcggagtttaacccactgttcccttcagtgacactgagagatagcgatcacaaattcgagtggacccgcatggaatttcaaacctgggctctgtatgtggcaaataggtatgactattccgtcgaatttaccggcgtgggtgaacctcccgcgggagcagagaatgtgggatactgcacgcagatcggcatcttcaggaagaacggtggcaaagccacagaatcctgtctatcagagcagcatgatcagcatgtctacaaggccgtttttactacaagctaccccagcctgcagcaggaacgcttcttcaaactggtcctggtgaacgaagtgtcccagcaagtcgagtccctgagggtcagccacttaccccggcgcaaagaacaagccggagaaagaggggataaaccaaaggatatcggtggctctaaggcacctgtcccttgttttgggcccgtctttaccgaagtcgaaaaagcaaagattgagaattctccgacacccttctgcgtgggcgataagttttttgtgcctctgcagcgcttactggcctatcctaagttaaatcggttgtgcgccaatgaggagatgatgagatccgtaatcgccgacagcatccctctgtcctcagatggatctgctgtcgtggctgacctcaggaactatttcgatgagcagtttgagttctag

SEQ ID NO: 25167 - DNA, 228 bp, Artificial Sequence
  Description of Artificial Sequence: Synthetic coding sequence
atgagcccccagaagcgggtgaagaacgtgcaggcccagaaccggacaagccaaggatcctcaagtttccagaccaccctcagcgcatggaaagtgaaacaggatcccagcaatagtaagaatatcagcaagcatggccaaaataatcctgtgggcgattacgagcacgccgatgaccaggctgaggaggacgctttgcagatggcagttgggtattttgagaaatag

SEQ ID NO: 25168 - DNA, 996 bp, Artificial Sequence
  Description of Artificial Sequence: Synthetic coding sequence
atggccttcgtgacccggcagttcatgcggagcgtgagcagcagctcgacagcctccgcctccgcaaagaagataattgtgaaacatgtgacggtaattggcggaggactaatgggagctggaatcgcgcaagtggctgcagctaccggccataccgtggtcctggtggatcagacagaggacatactcgcaaaaagcaaaaaggggatcgaggagtcactacgaaaggtggcgaagaaaaagtttgcggagaatcttaaagcgggggatgagtttgtggagaagactttgagcacgattgcaaccagtacagatgccgccagcgtcgtgcattccaccgacctggtggtggaagcaattgtagagaaccttaaggtcaagaatgagctctttaagcggctggacaagttcgccgctgaacacaccatcttcgcatcaaacacttcatcccttcagatcaccagtatagccaacgccactacaagacaagacaggttcgcagggctgcacttctttaatccagtccccgtgatgaagctggtggaagtgataaaaactccaatgacgtcccaaaagacgttcgagagtctcgtagatttttctaaggctttaggcaaacaccccgtgtcctgtaaggatactccaggctttatagtgaatcgcctcctcgttccttacctgatggaggcgatcagactttatgagcgggactttcagacttgcggcgacagcaatagcggcttgggtttttctctgaagggagatgcaagtaaggaggatattgacaccgcgatgaaattaggtgctggctatccaatgggacccttcgaacttttagactatgtgggacttgatacgacaaagttcattgtagatgggtggcacgagatggatgccgagaaccctttgcatcaaccaagccctagcctcaacaagctggtggccgaaaacaagttcggtaaaaaaaccggcgaggggttttacaagtacaagtag

SEQ ID NO: 25169 - DNA, 1281 bp, Artificial Sequence
  Description of Artificial Sequence: Synthetic coding sequence
atggcccacctgcggggcttcgccaaccagcacagccgggtggaccctgaagagctgtttacgaagctcgaccgaatcgggaaagggtccttcggggaggtttacaaaggaatcgacaaccacacgaaggaagtagtggcaatcaaaattattgatcttgaggaggccgaagatgagattgaggatattcagcaggagatcacagtgttatcccagtgtgattccccatacatcactaggtatttcggcagttacctgaaatctacaaagttatggataattatggaatatcttgggggtggaagtgccctggatctgctcaagcccggtcccctggaggagacatacatagctacaatcctgcgagagattctgaagggactcgattatctgcactcagagaggaaaatccaccgagatatcaaagccgcaaacgtgctgctgagtgaacagggtgacgtgaaattggcagacttcggagttgccggacagctgactgacacacagattaagcggaatacatttgtcgggaccccattttggatggctcctgaagtgattaaacaaagcgcttacgatttcaaagccgatatctggagccttgggataacagccattgagttggccaagggggagccccctaacagcgatctccatcccatgagagtacttttcttaattcctaagaattcccccccgacccttgaagggcagcactcaaagccttttaaggagtttgtagaagcctgtttaaataaagaccctaggtttaggcctaccgcaaaggaactgctgaagcataaatttatcactcggtacaccaaaaagacatctttcctgactgaactgattgatcgatacaagcgttggaagtctgaaggtcacggcgaggagagctcgagcgaagattccgacatcgacggcgaagcagaggacggtgaacagggccccatctggacattcccacctaccatccgtcctagcccacacagtaagttgcacaaaggtactgccttgcacagcagccagaaacccgccgagccagtgaagcgtcagcccagatctcagtgtctcagtacgctcgtgcgccccgtgttcggcgagctaaaggagaagcacaagcagtcgggcggctcggtgggagcccttgaggagctggaaaatgcgttcagccttgcagaggaaagctgtccaggtataagcgataaattgatggtgcacctggttgaacgcgttcaacgcttttcccacaacaggaaccacctgactagtaccagatag

SEQ ID NO: 25170 - DNA, 1290 bp, Artificial Sequence
  Description of Artificial Sequence: Synthetic coding sequence
atgcccaacgtgctgctgccccccaaggagagcaacctgttcaagcgaattctaaagtgctacgagcaaaaacagtataagaacggtctgaagttctgcaaaatgattctctcgaatcccaagttcgccgagcatggggaaactctggccatgaagggcctgactcttaactgtctgggaaagaaagaagaggcttatgaatttgtgcgcaagggcctcagaaacgacgttaaatcccacgtgtgttggcatgtttacggactgctccagcggagtgacaaaaaatatgacgaagccatcaaatgttatcgcaatgctctgaaactggataaagacaacctccaaattctgagagacctgtctttgctacagattcagatgcgtgatcttgagggctatagagagactagataccagctcctacagctacgtccaacacagcgcgctagctggatcgggtatgccattgcctaccaccttctcaaggattatgacatggccctcaaattgctggaggagttcaggcaaacccagcaggtaccaccaaacaaaatcgattacgagtattctgaactaatcctctaccagaatcaggtaatgcgcgaggcggatttactgcaggagagcttagagcacatcgaaatgtatgagaagcagatatgtgataagctgttggttgaagaaataaagggagaaattctgttgaaattgggcagacttaaagaggcctctgaagtattcaaaaatctaattgatcgaaatgcagaaaactggtgttactatgagggtcttgaaaaggctttacagatcagcacgcttgaggaacggctgcagatatacgaggaaatcagtaaacagcatcctaaggctattactcctcgcaggttgccgcttaccctggtcccaggagaacgatttcgcgagttaatggataagttcctgcgggtcaatttctcaaagggttgcccaccactgtttacaactctgaagtcattgtattacaacaccgagaaggttagcatcattcaggagctggtgaccaattatgaagccagtctcaagacctgtgacttcttctcaccatatgagaacggcgaaaaagagccccccaccacactactgtgggtgcagtacttccttgcccagcattttgacaaactggggcagtattctcttgcccttgactatattaacgccgcgatcgccagtactcccactctgatagaacttttttacatgaaagccaagatatataaggttaagagtgaatcttgtttcttgtcttcttag

SEQ ID NO: 25171 - DNA, 360 bp, Artificial Sequence
  Description of Artificial Sequence: Synthetic coding sequence
atggacaagaacatcggcgagcagctgaacaaggcctacgaggccttcagacaggcctgcatggatcgagacagcgctgtgaaagagctacaacagaagacggagaactacgagcaacggattcgcgagcagcaggagcagctctccttgcagcagactatcatagacaaattaaaaagtcagctcctgctcgtcaactcaacgcaggataataactacggctgtgtgcctctgctggaagacagtgagacaaggaagaataacttgacactggatcaaccacaagacaaagttatctccggcattgcaagggaaaagctgccaaaagtagacattgcttccgctgagagctccatctag

SEQ ID NO: 25172 - DNA, 699 bp, Artificial Sequence
  Description of Artificial Sequence: Synthetic coding sequence
atgacccccccccagcagcccccccccctgcggagcgagcccggcactctggggagcgcggccagctcatactcccctctaggcctgaacggcgtgcctggcagcatctgggacttcgtgagcggaagtttttcaccctcaccttctcccattctaagcgccggcccacccagctctagtagcgcgagtcctaacggggccgagctggcccgagtgcgacgccaactggatgaagccaagcggaaaatccggcagtgggaggagagctggcagcaagtaaaacaggtctgcgacgcatggcaacgtgaggcacaggaggcaaaggaacgggcacgcgtggcggatagtgacaggcagctagctcttcaaaaaaaggaggaggtggaagcccaggtgaagcagctgcaggaggagctcgaggggttgggagtcgcctctactctccccggtcttcgtgggtgtggtgatataggaaccattcctctgccaaaacttcatagcctgcaaagccaactgagacttgacctggaggccgtggatggcgtgattttccagctgagggctaaacaatgtgtagcttgcagagaaagagctcacggcgccgttctgaggccctgccaacaccacattctgtgtgaaccctgtgctgccaccgctcccgagtgcccgtactgcaagggccagccactgcagtggtag

SEQ ID NO: 25173 - DNA, 1461 bp, Artificial Sequence
  Description of Artificial Sequence: Synthetic coding sequence
atgagcgtgacctacgacgacagcgtgggcgtggaggtgagcagcgacagtttttgggaagtggggaattataaacggactgtgaagagaatcgacgatgggcatcggctgtgctctgatttaatgaactgcttgcatgaacgggcaagaattgagaaggcatacgctcagcagctaactgaatgggcccggaggtggcgccaactggtagagaagggcccgcaatatggaaccgtcgagaaagcatggatggccttcatgtccgaggcggagcgcgtgtccgaactacatctggaagtgaaggctagcctcatgaatgatgatttcgagaagatcaaaaactggcagaaggaagcgttccataaacagatgatgggtgggtttaaggaaacaaaggaggctgaagatggcttccgcaaagctcaaaaaccttgggcaaaaaagctgaaggaagtggaggccgccaagaaagcacaccatgccgcatgcaaggaggagaagttggccatcagccgtgaagcaaactccaaggcagatccatctttaaaccccgaacagctgaaaaaactgcaggacaaaatagagaagtgtaaacaggatgtgttaaaaacgaaagaaaaatacgagaaatccctgaaagagctggatcaagggacgccccagtatatggagaacatggaacaggtctttgaacagtgccagcagtttgaggaaaagaggttaagattcttcagagaggtgctgcttgaagtgcagaaacatctggacctgagcaatgtcgctggatacaaagctatctaccacgacttggagcagtcaattcgggcggccgacgccgttgaggatctgcgctggttcagggccaaccacggacccggtatggccatgaactggccacagttcgaagaatggagcgccgatttgaataggacgctgagccggcgggaaaagaaaaaggctacagatggcgttacgctcactggcatcaatcagactggcgaccaatcactgcccagtaaaccatcctctactctcaatgtgccctccaaccccgcccagtctgcccagtcccaatcttcttacaatccgtttgaggatgaggatgatacgggttctactgttagcgaaaaggatgatactaaagccaaaaatgtgtcatcctatgagaagactcagtcctatcctactgattggtcagacgacgagagcaacaacccgttctctagcacagatgcaaatggcgactctaatcctttcgacgacgacgctacatctgggacagaagtgagggtccgcgccttgtatgattacgagggccaggagcatgacgaacttagcttcaaagccggcgatgagttgactaaaatggaggacgaggacgagcagggttggtgtaaagggcgtttggataacgggcaggtgggtctgtaccccgccaactacgtggaagccattcagtag

SEQ ID NO: 25174 - DNA, 3075 bp, Artificial Sequence
  Description of Artificial Sequence: Synthetic coding sequence
atgaacttcatcaaggacaacagccgggccctgatccagcggatggggatgaccgtgattaaacaaatcaccgacgacctgttcgtctggaacgttcttaaccgcgaggaggtgaacattatttgctgcgagaaggtggagcaggacgccgcacgaggcatcattcacatgatcctcaaaaagggaagtgagtcatgcaatctgtttctgaagagcctcaaagaatggaattaccccttgtttcaagatttgaacggccagagtctgtttcaccagacctcggaaggcgacctggatgacctggcccaggatttgaaagacctgtaccacaccccctctttcctcaacttttacccattaggagaagatatcgatatcattttcaacttgaaaagcacgttcactgagcctgtcctctggagaaaggaccagcatcaccatcgtgtcgagcaacttacactgaatggtctactacaggcgctgcagagcccttgcattattgaaggtgagagcgggaagggtaagagcacactcttgcagaggatagcaatgctctggggaagcggcaaatgtaaagccttgacaaagttcaagttcgtgttctttctccgactctcacgggcacagggcgggctctttgaaaccttgtgcgaccagcttctggatatcccaggcactatccggaagcagacatttatggcaatgctgctgaaactgcggcaaagagtgcttttcctgcttgatgggtacaatgagttcaaacctcaaaactgcccagagattgaggctctgataaaggagaaccaccggtttaagaatatggtgatagtgacgaccacaacagaatgcttacgccacatcaggcagtttggcgctttgaccgctgaagtcggtgacatgacggaagactccgctcaggccctgatcagagaggtgcttattaaggagctggccgagggcctgctcctgcagatccagaagagccgatgtttacggaatttgatgaagaccccactgtttgtggtgatcacatgtgccattcagatgggcgaatccgagttccatagccacactcagactacgctgtttcacactttctacgacctactgattcagaagaacaagcacaagcataaaggagttgcagccagcgattttattcggtcgctcgaccattgcggagacctggcacttgaaggcgttttcagtcacaagtttgactttgaattacaggatgtgagttcagtgaacgaggatgtccttctaaccaccggcctcctgtgcaaatacaccgctcagcgtttcaaacctaagtacaaatttttccacaagagtttccaggagtacaccgcaggccgccgattaagcagcctgttaacgagccacgaacccgaagaggtgaccaagggaaatgggtatctgcaaaaaatggtctctatcagtgacattacatctacctattctagcctgctccgatatacctgcggctctagcgttgaggccactcgagctgtcatgaagcaccttgccgccgtttatcagcacggttgcctgctcggcctgagtattgccaagcgtcccttatggaggcaagaaagcttgcaaagcgtgaagaatactacggagcaggagatcttgaaggccatcaatatcaatagtttcgttgagtgtggtatacacctctatcaggaatcaactagtaaatccgctctttcccaggagttcgaggctttcttccagggtaagtcgctgtatataaattccggcaatatacccgattacctgttcgattttttcgagcatctgccgaactgcgcttccgccctcgattttatcaagctcgacttttacgggggagccatggcctcttgggagaaagccgccgaggatacgggtgggatccatatggaagaagccccagaaacctacataccaagcagagccgtcagcctgttttttaattggaagcaggaatttcgaacccttgaggtgacattacgagatttcagtaagctcaataagcaggacatccgctacctggggaaaattttttcgtcagccactagcctaaggttgcagatcaagcgctgcgccggtgtcgccggctcccttagcctggtccttagcacatgcaaaaatatttacagtttgatggtggaagcttctcctttgacgattgaggatgaacgacacatcacaagcgtgacgaacttaaagacacttagcatccatgatctgcagaatcagcgactgccaggtggcctaacagacagcctcgggaacctgaaaaacctcaccaaactcattatggacaacataaaaatgaatgaagaggacgctatcaaactagcggaagggctgaagaatctcaagaagatgtgcctcttccacctcacgcaccttagtgacattggcgaaggcatggattatatcgtaaagtccctcagctccgaaccgtgcgatcttgaggaaatccagctcgtgtcatgttgcctgtctgctaacgccgtcaagatccttgctcagaatctgcacaacctcgtgaagctctctatccttgacctgagcgagaattacctggagaaagacggcaacgaagcgctgcatgagctcattgataggatgaacgtgttagaacagctgacagcgctaatgttaccttggggctgcgatgtacagggctccctgagctccctcctgaagcaccttgaggaggtccctcagcttgtaaagctgggcctgaagaattggcgactaactgatacggagattaggatcctcggggcttttttcggaaagaatccactgaaaaacttccagcaacttaacctggccggtaatcgagtttcttcggacggctggctggcttttatgggcgtgttcgagaacctcaaacagctggttttcttcgacttctctaccaaggaattcttgcccgatcccgccctggtgagaaagctgtctcaggtgctcagtaagctgacatttctgcaagaggctcggcttgtggggtggcagtttgacgatgacgatctctcggtgatcacaggagccttcaagttggtgacagcttag

SEQ ID NO: 25175 - DNA, 1767 bp, Artificial Sequence
  Description of Artificial Sequence: Synthetic coding sequence
atgagcagctgcgtgagcagccagcccagcagcaaccgggccgccccacaggacgaactggggggcagaggctctagttcctccgaatctcagaagccatgcgaggctctgcggggcctaagctcgctgagtatccaccttggtatggaatcgttcatagtggtgaccgagtgcgagccgggttgtgccgtcgatctaggcctggcacgagatcgacccctcgaggctgacggtcaggaagtgccactggacacgtccggatcccaagcacgaccccacctctcaggccgcaagctgtcacttcaggagcggtcacagggaggtctggcagccggaggttccctggacatgaacggtcgctgtatttgcccatctttgccttacagtcctgtgagctcaccgcagtcaagcccaaggctgccccgcagaccaaccgttgaatcacaccacgtctccattacgggtatgcaggattgcgtgcagctgaatcaatacactttaaaggacgagatcggcaagggcagctatggcgtggtaaaacttgcttataatgagaacgacaacacttactacgctatgaaggtcctcagtaaaaagaaacttattcgacaggctggtttcccacgcagaccaccacctcgggggactcgacccgcacctggcggatgcatccaaccccgtggtcccatagaacaggtctatcaggaaatagctatcctcaaaaaacttgaccaccccaacgtggtgaaacttgtggaggtgttagacgatcccaatgaagatcatttgtatatggtttttgagctggtcaaccagggccctgtgatggaggttccgactcttaagcccctgagcgaagaccaggcgaggttctatttccaagacttaatcaagggtatcgaataccttcactaccagaaaattatacatcgggatattaagcctagcaaccttctcgtgggagaggacggtcatattaagatcgcagacttcggcgtgagtaacgagtttaagggttcagatgccctcctttccaacacagtaggtactcctgccttcatggcacctgaaagtctctccgagacccgaaagatttttagcgggaaagccctggacgtgtgggccatgggcgtgaccctgtattgctttgtttttggacaatgtccctttatggacgagcgtattatgtgtctgcacagcaagataaaatctcaagccctagagttccccgatcaacctgatattgcagaagatctgaaggacttaattaccaggatgctcgataaaaatccggaatctcgaatagtggttccagaaatcaagcttcatccatgggtgacccgccacggggctgagcctctgccatcagaggacgagaactgtaccctggtcgaggtgaccgaagaagaagttgagaactcggtgaagcacatcccttctctggcgaccgtcattttggtgaagacaatgatccgtaaacggtcattcgggaatcccttcgaaggatcccgcagagaggaacggagcctaagcgcaccgggcaacttgcttaccaaaaaacccaccagggagtgcgagtcactttccgagctcaaagaggctaggcagcggcgacaacctcctggccaccgccccgcaccccggggcggaggtggatctgcactagttagaggttcaccctgcgtggaatcttgttgggcgcccgcacctgggagcccagctcgtatgcaccccctgagaccggaagaagctatggagcccgagtag

SEQ ID NO: 25176 - DNA, 666 bp, Artificial Sequence
  Description of Artificial Sequence: Synthetic coding sequence
atgctgaagaacaagggccacagcagcaagaaggacaacctggccgtgaatgccgttgcactgcaagatcatattcttcatgatcttcagctccgcaatctgtccgtggctgatcactcgaagacccaggttcagaaaaaagagaacaaatctcttaaacgcgacactaaagccatcatcgatacaggcctcaagaagacaactcagtgcccaaaactggaggacagtgaaaaggagtacgttcttgatccaaagccaccaccgctgactctcgcccaaaaacttggcctgatcggacctccccctcccccactcagcagtgacgaatgggagaaagtgaaacagcgctcactcctacaaggcgattctgtacagccttgtcccatttgcaaggaggaatttgaactccgcccacaagtgttgctctcttgctcacacgtttttcataaggcctgtctgcaggccttcgagaaattcaccaacaaaaaaacttgccccctatgccgcaagaatcagtaccaaacccgtgtcatccacgacggagctagattatttagaattaaatgtgtaacgcgcattcaagcatattggagaggctgcgtggtgagaaagtggtaccgaaatctgaggaagacggtacctcccacagatgccaagctgcgatag

SEQ ID NO: 25177 - DNA, 900 bp, Artificial Sequence
  Description of Artificial Sequence: Synthetic coding sequence
atggtggacaagaagctggtggtggtgttcggcggcaccggcgcccagggcggttctgtggctcgtacactcttggaggacgggaccttcaaagtgcgcgtcgtgactcggaacccccggaagaaagcagccaaggagctcagactgcagggggctgaagtggtgcaaggtgaccaggacgaccaggtgatcatggagttggctttaaacggcgcctacgctacttttatcgtaaccaactattgggagagctgctcccaggagcaggaggttaagcagggaaagctgctggccgatctggcccggaggttggggttacactatgtggtgtattccggtctggagaatatcaagaagctgacagctgggcgtttggctgctgctcacttcgacggtaaaggtgaggttgaagaatactttagggatatcggagtgcctatgaccagcgtgagactcccttgctacttcgagaatctgctgtcgcactttctccctcagaaagcccctgatgggaagagctacctactcagtttaccaactggtgacgttcctatggacggcatgtctgtctctgacttgggtccggtcgtcctgtctcttctgaaaatgcctgagaagtacgtggggcagaacatcggcctgtccacctgcaggcataccgctgaggaatatgctgccctgttgactaagcacacacggaaagtggttcatgacgctaaaatgactcccgaagactacgagaagctgggattccccggggccagggacctagccaatatgttccggttctatgcacttcggcccgaccgcgatatcgaactcaccctcagactcaacccaaaagccctcactctggaccagtggctagagcagcacaagggtgattttaacctgctatag

SEQ ID NO: 25178 - DNA, 2193 bp, Artificial Sequence
  Description of Artificial Sequence: Synthetic coding sequence
atggaggacctgttcgagaccttccaggacgagatgggcttcagcaacatggaggatgatggtccagaggaagaggagcgagtcgctgaacctcaggctaattttaacacgcctcaagcccttaggttcgaggagctgctcgctaatttgctgaacgaacagcaccaaattgcaaaagaactgtttgaacagttaaaaatgaaaaagccctccgccaagcagcagaaggaggttgaaaaggtgaaaccgcagtgcaaggaggtgcaccagacactcatcctggatccggcccagaggaaaagattacagcagcagatgcagcagcatgttcagctgctcacacagatccaccttctcgccacctgtaatccaaacctcaacccagaggcaagcagcaccaggatctgcctgaaggaattaggtacctttgcacagagctccattgcgttgcaccaccagtacaatcccaaattccaaaccctctttcagccctgtaacctaatgggggcgatgcagcttatcgaagatttctctacacatgtcagtattgattgctcccctcacaagaccgtcaaaaaaactgctaacgaatttccctgtttgcccaagcaagtggcctggattttagcaacctccaaagttttcatgtacccagagctgctgccggtgtgcagcctgaaggcgaaaaatccccaggataagatcttattcacaaaggccgaggacaataaatacctgctcacgtgcaagactgctaggcagttgacagtacgcatcaagaacctgaacatgaatagagctccggacaatatcattaagttctacaaaaaaaccaaacagctgccagtcctgggaaagtgctgtgaagagatccagccacaccaatggaagccgcctatcgaacgcgaggagcatcgcttacccttttggctgaaggcttcattacccagcatccaggaggagctacggcatatggccgatggcgcccgagaggtgggcaatatgacaggcaccactgaaattaattccgatcagggactagagaaggataactctgagctggggagcgaaaccagatatccgctactcctgcccaagggggtcgtgttgaagctgaagccggtcgccgaccgcttccctaagaaagcttggcgtcagaaacgatcttcagtgttgaaacctttgttgattcagccaagtccttctcttcagccctctttcaacccaggcaaaacaccggcacagagtacgcactctgaagcacctcctagtaagatggtgttaaggattccccaccctatccaacccgctaccgtcctgcaaaccgtgcccggagtccctcctctcggtgttagcgggggagagagctttgagagcccagcagcactccccgcaatgccccccgaggcccgcaccagctttcctctaagtgaatcacagacactgctgagcagcgccccggtgccgaaagtgatgatgcctagtccggcgtcctctatgttccgcaaaccatacgtgcgcaggaggccaagcaagagaagaggggccagggcttttcgctgcataaagcccgccccagttattcaccctgcgtctgtcattttcactgtcccggccaccacagtgaagattgtttccctaggggggggttgcaatatgatccagcctgtgaacgctgccgttgctcagtcaccacagactatccctatcgccacactattggttaacccaacgtcattcccctgcccgcttaaccagcccctcgtcgccagttctgtgagcccgctcattgtctctggaaacagcgtcaatctaccaatccccagcacacctgaggacaaggcacatatgaacgtagacattgcctgcgctgtcgcagatggagagaacgcgtttcaggggctggagcccaaactggaaccacaagagctttcacccttgagcgccacagttttcccgaaagtggaacactcaccagggccccccccagtcgataaacagtgccaagaaggcctgtctgagaactccgcatatagatggacggtcgtaaaaacggaggaaggtaggcaagccctggaaccattgccgcagggaattcaggagtccttgaataatagttctccaggagacttggaagaggtagtaaaaatggagcctgaagatgccacggaagagataagcggctttttgtag

SEQ ID NO: 25179 - DNA, 1563 bp, Artificial Sequence
  Description of Artificial Sequence: Synthetic coding sequence
atgttcgtgagcgacttccggaaggagttctacgaggtggtgcagagccagcgagtactcctgttcgtcgctagcgatgtggatgccctctgtgcatgtaaaatcctgcaggcgcttttccagtgcgaccacgtgcagtatacattggtaccggtatccgggtggcaggaattggagacagccttcctcgaacacaaggaacagatcaaacttctgataaagcaagatgacgacttggaggtcccagcatatgaggatattttccgagatgaagaggaggatgaggagcattcaggaaacgacagtgatggcagcgagccaagcgagaagcggacgcgtctggaagaagaaatcgtagaacaaactatgcgccgcagacagcgtcgggagtgggaggctcgcaggagagacattctgtttgactatgaacagtacgagtatcacggcacgagctccgcgatggttatgttcgagctggcttggatgctgagcaaggatctgaatgatatgctctggtgggcaatcgtcggcctgactgatcaatgggttcaggataaaatcactcaaatgaaatatgtcacagacgtgggggttctacagcgtcacgtcagcagacacaaccatcgtaacgaagacgaagaaaataccctctcggtcgattgtacgagaatctcctttgagtatgatcttcggctagttctgtatcagcactggtccctgcacgactccttgtgcaacaccagctataccgctgctaggtttaaactgtggtcagttcatgggcagaagcggctccaggaattcctcgcggatatgggcctgccactcaagcaggtgaaacagaagttccaggccatggacatttcgctaaaagagaacctccgcgagatgattgaggaaagtgcgaacaaatttgggatgaaggatatgcgggttcagacattctctatccatttcgggttcaaacacaagttcctggcatcggatgttgtgtttgctacaatgtctctaatggagtcaccagagaaggatggatccgggacagaccatttcattcaagcgttggactctctttcacgtagtaacctggacaaactgtaccatggcttagagcttgcgaagaaacagcttcgcgcaacccaacagacaatcgcatcgtgtttatgcaccaatctggtgatttctcaggggcccttcttgtactgtagcttgatggagggcacccctgatgtgatgctgttcagccgacccgcgtctctgtccctcttgtcaaaacaccttctgaagtcttttgtctgttcaacaaaaaataggaggtgtaaacttttaccactagtgatggctgcccccctatccatggagcatggtaccgtcaccgtcgtggggatcccacctgagaccgatagctcagaccgtaagaacttctttggcagggccttcgaaaaagccgccgagagcacatcgagtcgaatgctgcacaatcatttcgatctatctgtgattgaattgaaggccgaagatagatcaaagttcctggatgccctgatttccctgctcagctag

SEQ ID NO: 25180 - DNA, 567 bp, Artificial Sequence
  Description of Artificial Sequence: Synthetic coding sequence
atgaccgcccccagctgcgccttccccgtgcagttccggcagccctctgtgtctgggctgtcacaaattacgaagagcctctatatctcgaacggcgtggctgctaacaacaaactgatgctttccagtaatcagatcaccatggtgataaatgtctctgtggaggtcgttaacacactttacgaggacatacaatatatgcaggtccccgtagccgactcccccaattctcgactgtgtgacttttttgacccaattgctgaccacattcatagtgtggaaatgaaacagggcaggaccctcctgcattgcgctgccggcgtgagcaggtctgcagctttgtgcctggcatatctgatgaaatatcacgctatgtcactattagatgcccatacatggactaaaagctgtaggccgattatccggcccaacagcggtttctgggaacaactcattcactacgaatttcagctgtttggcaagaatactgtgcacatggtgtcgtcgcctgtcggcatgatccccgacatctacgagaaggaggtgcgtctcatgattcccctgtag

SEQ ID NO: 25181 - DNA, 1182 bp, Artificial Sequence
  Description of Artificial Sequence: Synthetic coding sequence
atggacgccgccaccctgacctacgacaccctgcggttcgccgagttcgaagattttcctgagacatctgaacctgtgtggattctagggcgaaagtacagtatatttacagagaaggatgaaatactgagtgatgtcgcctcaagattgtggttcacgtaccggaagaatttcccagccattgggggtacagggccgacctccgatactggatgggggtgcatgctccgatgcggacagatgattttcgcccaggctctagtctgccggcatctgggccgagactggagatggacgcagaggaagaggcagcccgactcttacttttcagtgctcaatgctttcatcgaccggaaagactcctattactctatacatcagattgcccagatgggggttggagaaggaaagtctatcggccagtggtacggaccgaataccgtggcccaggtgcttaaaaagctcgccgtgttcgatacctggtctagtctcgcagtccacattgccatggacaacacagtggttatggaagagatccggcggctatgccggacttctgtaccgtgcgcaggggccaccgcatttcccgctgactcagaccgccattgtaatgggtttccagccggggcagaggtcaccaatcgccctagcccttggaggcctttggttctcctcatccctctgcgtttaggcctgaccgatatcaatgaggcatacgtggaaaccctgaagcactgttttatgatgcctcagagcctgggcgtcatcgggggaaagcccaatagcgcacactacttcataggttatgtaggcgaggagttgatttacttagatccacataccactcagcctgcggtggagcccacagatggatgttttattcccgacgagtcattccactgtcagcacccaccctgtcggatgagtatcgccgagctggacccttctatcgctgtagggttcttctgcaagaccgaggacgacttcaacgactggtgtcaacaggttaagaaactgtccctgcttggcggcgctctgcccatgttcgagttagtggagctccagccatctcacttggcctgtcctgatgtattgaacttaagcctcgactcctccgacgtcgagcgactggaaagattcttcgatagcgaggatgaggacttcgaaattctgagcttgtag

SEQ ID NO: 25182 - DNA, 780 bp, Artificial Sequence
  Description of Artificial Sequence: Synthetic coding sequence
atgaaggacgtggacaacctgaagagcatcaaggaggagtgggtgtgtgaaaccggcagcgataaccagcccctggggaacaaccaacaatcaaactgcgagtatttcgtggattcgttgttcgaagaagctcagaaagtctcctctaagtgcgtgagtcccgccgagcagaagaagcaggtggatgtcaacattaaactgtggaaaaatggttttacggtgaatgatgacttccggtcatattccgacggggcaagccaacaattcctgaattccatcaagaagggcgagctgccttccgagcttcagggaatcttcgataaggaggaagtcgacgtaaaggttgaggacaagaagaacgagatatgcctgagtacaaagcccgtgttccagccattctcgggccagggtcatagactcggctcggcaaccccgaagatcgtctcgaaagccaaaaatatcgaggtggaaaataagaataacctcagcgcagtgcctttgaacaaccttgaaccgattacgaatattcagatttggctcgcaaacggcaagcgaatcgtacagaagtttaatataactcaccgtgtcagccacatcaaggacttcatagaaaaataccagggaagtcagaggagcccaccattttcactggctactgcactgcctgtactgcggctcctagacgagacattgaccctcgaagaagctgatttacaaaacgctgtgattatccagcgcctacaaaagactgccagctttagggagttaagcgaacactag

SEQ ID NO: 25183 - DNA, 852 bp, Artificial Sequence
  Description of Artificial Sequence: Synthetic coding sequence
atgatccccccccaggaggccagcgcccggcggcgggagatcgaggacaagctcaaacaggaagaggaaacactgagttttatacgcgactccttggagaagtcagaccaactgaccaagaatatggtcagcattctcagtagcttcgaaagtcgactaatgaaactagaaaatagtataatccctgtgcacaaacagacggagaacctgcagcgtctgcaggaaaacgttgaaaaaaccctgagctgcctagatcacgtgatctcttattaccatgtggcgagcgataccgagaaaatcatcagagaaggtcccactggccgactggaggaatacctggggtccatggccaaaatccaaaaggccgttgaatatttccaggataattcccccgactctcccgagctgaacaaagttaagctcttatttgaaagggggaaagaggcactcgaatccgagtttcgttccctgatgacccgccactctaaagtggtctcacccgtcctaattctggacttaatcagcggagacgacgatctagaggcacaggaagatgtgaccctggagcacctgcccgagagcgttttacaggacgtgatcagaatctcaaggtggttggttgaatacgggcggaaccaagatttcatgaacgtgtattatcagatcaggtcatctcagctggacagatcaattaagggactgaaggagcacttccacaagagctcaagctcaagtggcgtcccttattcccccgcgatccccaataaaaggaaagacactccgacaaagaaacccgtgaagcgccctggggagccgcctagctggcccatttctgcaacggcaaggggctag

SEQ ID NO: 25184 - DNA, 2121 bp, Artificial Sequence
  Description of Artificial Sequence: Synthetic coding sequence
atgaacgaggccatggccaccgacagcccccggcggcccagccggtgcaccgggggggtcgttgtccggccacaggcagtaacagaacagtcgtatatggagtcagtggtgacgttccttcaagatgtggttcctcaggcctactcaggcacaccattgacggaggaaaaagaaaagattgtgtgggtgcggttcgagaacgcggatctgaatgatacgagccgaaatctcgagtttcacgagatacatagtactggtaacgagccaccactgttgataatgattggctattccgacggtatgcaggtgtggtccatacctatcagtggagaggctcaggagttatttagcgtccgccatggccccatccgggccgcccggatacttcctgctccccagttcggggcccagaagtgtgataactttgccgagaagagacccctactgggcgtgtgcaaaagtatagggagttcaggtacatcacctccctattgctgcgtggacctatattcattgcggactggcgaaatggtgaagagtatacagtttaagacccccatttatgatttgcactgtaataaacggattcttgtggtggtccttcaggagaaaattgccgcattcgacagctgtacattcaccaaaaaattcttcgtgaccagttgctacccctgccccggtcctaacatgaaccctatcgccctgggttcccgatggctggcttacgccgaaaacaagttaatacgctgtcatcagagtcgtggaggcgcttgtggggacaatatccagtcctacaccgccacggtgatttccgccgccaagaccttgaaatcgggtctgactatggtggggaaggtcgtgacacagcttaccggtactttgccatcaggggtgactgaagatgatgtcgcaatccacagcaattctaggcgcagtcccctggtgcctggcatcattaccgtcattgatacagaaaccgttggtgaaggacaggtccttgtgagcgaagattcagactctgatggaatcgtggcccactttccagcccatgagaagcccgtgtgctgtatggccttcaataccagtggcatgctcctggtcactaccgatacactgggtcatgatttccatgtgtttcagattctcacccacccatggtccagtagccaatgtgcggtgcatcacctgtatacactgcatcgcggagagacggaagctaaagttcaggacatctgtttcagccacgactgtagatgggtggtggtatctaccctgcgcgggactagccatgtgtttccgataaatccatacggcggccagccttgcgtgaggacgcatatgtcacctagagtggtgaacagaatgagcagatttcagaagtctgccggcctcgaagaaatcgagcaggaacttacttcgaagcaagggggacgctgctctcccgtccccggcttaagctccagcccttcaggcagtccacttcatggcaaactgaactcacaagactcatacaataattttacaaacaataacccgggcaatcctaggctgtctcccctgcccagcctgatggtcgtcatgccactcgcccagattaaacagccgatgaccctcggtactattacaaaacgtaccggaccctacctctttggcgctggctgtttctccataaaagccccatggtcatatatcatgaccaagtatattttttacattaaacccccaaacaaggtcaagcctccacctcaaatttctccctcaaagtctatgggcggagaattttgcgtagcagctatattcggaacttcacgatcatggtttgccaataacgctggcttgaaacgagagaaggaccagtctaagcaagtggttgttgagtcactgtatattatttcctgttatggtacccttgtggaacatatgatggaaccccgtcccctgtcaacagcgccaaagatctcagacgatactccactggagatgatgacttccccacgggcatcttggaccctcgtgcgaactccacagtggaatgagctgcagcctccgttcaatgccaatcacccattgctgctggccgccgatgccgtccagtattaccagttcctactggccggctag

SEQ ID NO: 25185 - DNA, 1815 bp, Artificial Sequence
  Description of Artificial Sequence: Synthetic coding sequence
atgggcggctgcttcagcaagcccaagcccggcgccgccctgcccactgtcgagctgaagatcgaggtggttctacctgaaaaggaaagagggaaggaggagctgtcagcatccggcaagggaagcccaagagcgtatcaaggcaatggaaccgcccgacatttccatactgaagaacgactgagcacaccccacccctacccgtctccccaggactgtgtagaggcggccgtgtgccatgtgaaggatctcgaaaatggccagatgagagaggtcgagctggggtgggggaaggttctgctggtgaaggacaatggcgagtttcatgcactcggccacaagtgtcctcactacggagctccactcgttaaaggtgtattgagccgcggtcgggtgcggtgtccctggcacggagcctgtttcaacatctctaccggggatctcgaagactttccaggattggactcccttcataaatttcaggtgaagatcgagaaagagaaggtctatgtccgggccagcaagcaggcactgcagcttcagcgccgaaccaaggtgatggccaagtgcatctcaccttcagccgggtacagttctagcacaaatgtactgattgtcggggcaggggcggccggcctggtttgcgccgaaactctgcggcaggaaggcttcagcgaccgcatcgtcttgtgcaccctcgatagacatttaccctacgacaggccaaaacttagcaagagcctcgacacccagccggaacagctggctctgcgcccaaaagaattttttagagcgtatggcatcgaggttctcacagaggcacaggtagttacagtggatgtgcggacgaaaaaggtagtgttcaaagacgggtttaagctggagtacagtaagctcttgcttgccccaggctcctcacccaagacactttcttgcaaggggaaggaagtcgaaaatgtgtttaccattaggacgcctgaggatgccaacagggttgtaagactggcgcgaggtagaaacgtcgtggtcgtaggagccggattccttgggatggaggtcgccgcctaccttactgagaaggctcatagcgtatccgtggtggagctggaggagaccccgttccgccgttttctcggggaacgagtaggtagggccctgatgaaaatgtttgaaaataacagagttaagttttacatgcagactgaagtgtcggaattacgcggccaggaaggcaagttgaaagaagtggtacttaaatccagcaaggtggtaagggctgatgtctgcgttgtcggcatcggggctgtgcctgctactggcttcctgcgacagtctggcatcggactcgactcacgcggatttatccccgtcaataagatgatgcagactaacgttccgggagtctttgcagccggagacgcagttacatttcctctggcctggaggaacaacagaaaggtgaatattcctcactggcagatggcccacgcacagggacgcgtcgcagctcagaatatgctcgctcaggaggccgagatgtcaactgtgccctacctgtggaccgctatgtttggtaaaagcctaagatacgcaggctacggggagggcttcgatgacgtgatcattcagggtgacctggaggagctcaagttcgtagccttctacacaaaaggagatgaagtcatcgctgttgcctcaatgaactatgaccccattgtgtcaaaagttgcagaggtgctggcctctggccgcgcaattcgaaaacgggaagtggagaccggggacatgagttggttgaccgggaagggctcatag

SEQ ID NO: 25186 - DNA, 744 bp, Artificial Sequence
  Description of Artificial Sequence: Synthetic coding sequence
atgagcaccgccgccgtgcccgagctgaagcagatcagccgggtggaagcaatgcgtctcggcccaggctggtcacactcctgccacgccatgctgtatgcggcaaacccaggccagctgttcggaagaataccaatgagatttagcgtgctgatgcagatgcgattcgacgggctcctggggttccccgggggatttgtggaccgtcgcttttggtctctggaggacggtttgaaccgcgtattaggcctgggcttaggctgcctgcgcctcactgaggcagattatttgtcgtctcacttgactgaagggccccatcgagtggttgctcatctttacgcccgtcagctcaccctggaacagctgcacgccgttgagatctcagcagtccactcaagggatcacggcctggaagtgggtccacctccagggccccgcccccccccacggggtctcgccctggctccctggaaggccccgatgggaaacacctcccctgaaggaccactcgccggactcgggagggtgtctttatcccccgcgatgggctggggggagggtagcggtgctgggagacccggcaaggaaggccgcgggtggggtccggcactcggacttcctcagggatgtgtgactagcgcacttctgcctgcaattgctaaccctgggagcgggggcgtgggtagcgtcggaagaaagggatggggacggtccggagactgcctgggcagttgggaaacatag

SEQ ID NO: 25187 - DNA, 1338 bp, Artificial Sequence
  Description of Artificial Sequence: Synthetic coding sequence
atgtaccccaaccccctgatctactgcacctgctgggacccctggaacctagggccaagaaagttaatcaagaccccccagctgccgcgcaagaactccacgggttcatccaagctcacacccttagtacctgctccaaagaaccacaattacctgcagcctacaaaacctgttgtctcacccaagatgaagatccacagcgctagacaggaagagaccaacaaatccttttatgaagtgataaatgtgtcgccaggctaccagctagtacgcaacagggagcaaattagcgtaaccctcggggatgaaatgtttgacagaaaaaaaagatgggagagcgaaataccagataagggccgattctctaggaccaacatcatttcagatctggaagagcagatatcagagctgaccgctattatcgaacagatgaatcgggatcaccagtctgcgcaaaaattgttatccagcgagatggacttacgttgtgcggagatgaaacagaacttcgaaaataaaaatcgcgaacttaaggaagcccacgaggcagagctgagcgaattggagaataactacaaggcggccctgaaggcagagaagcttgctgctcaggagaagctggaggagatgggtaaggagtacaaatacctcaagaatatgttccgcacttatcaggattccatttacgatgagatggaggaaaaatggtctaagcaaaaggccaaatggaagaaagatgagaagtttgagcgtgagaacatcctgctgcaacagaaaaagaagatgaccaagaaatttgagatggagtcaggagaggaagacaaaaagataaacgagtcatgttcagctgtgtttgagaactttatccaggaaaaggaagaactgctgaagcagcatcaatccgataccctgcagctggaggagttaaggaaaactaaggaagtcccttggaggcgtgatcaaatcaataggcactggcacgatgttctgcagcaactgctcctgatgcaggtcatgcaagaagaactgcacgctcaggccctgatccttgagtcactgaatactaacctctactacacgcagctggagctccaaaaagaaaaggcaattgtggggaacctagaaaaaatgctccaaaccaaatttgcggagactgaggaaaaatacaaacacacaatccaaatcctgacagaagaaaatatccacttgaagcagaaaataatcagcaaaaacgaagagatctgcgagggatgcagcggtcgtctggcttcaatcactgtttcaaaggatgactccgacactgttcaggacggcagcaagaaaggacaggagtcctag

SEQ ID NO: 25188 - DNA, 1335 bp, Artificial Sequence
  Description of Artificial Sequence: Synthetic coding sequence
ttccgggtgcccgccgccggccggcggtgccccctggcccggggcgcccggagaccccccgactctgcatgcggtcggttcccgccagatccggggtcccctccagaggaagaggacgctgacctctcagagcgcgaagaaagttggttgcttgcagagcgggaagaaaaccaggaagctgagttccctggtctgcggagagccgtgcagctgaacctgtcacgccctatcgaagagcagggaccactagatgtgatcatccacaagcttactgacgttattctcgaagcagatcagaatgattctcagtccctggaactggtgcaccgatttcaggaatatatcgacgcacatcccgagactatcgtcctcgaccccctgcctgcaattcggaccttgttggacaggagcaaatcatatgagttaatccggaaaatcgaggcctacatggaagatgacagaatctgttctcccccttttatggagctcacctccctgtgcggtgacgacactatgaggctgcttgagaagaacgggttgacattcccatttatttgcaagaccagagttgcccacggtactaatagccacgagatggccattgtatttaaccaggagggcttgaatgccattcagccgccatgcgtcgtgcaaaatttcatcaatcataacgccgtgctatacaaggtttttgtggtcggagagtcatacaccgttgtgcagagaccaagtttgaagaacttttccgccggcactagcgatcgagagagcatcttttttaattcccataacgtgtcgaagcctgagtcttcgtccgtgctgactgagctggacaagattgaaggtgtgttcgaacgtccctccgacgaagtcatccgcgaactctccagagccctaaggcaagccctgggcgtgtcgctgttcggaatcgacatcattataaacaaccaaaccggacagcacgctgtcatagatatcaatgcgtttccagggtatgaaggggtaagcgagtttttcaccgatctactcaaccacatcgcaaccgtgctccaagggcagtccacagccatggctgccactggagatgtggcgctcctgcgtcattccaagctgctggctgaaccagctggcggacttgtgggagagcggacttgctctgctagccctggttgttgcggctctatgatgggacaggacgcgccctggaaggctgaagctgacgctggcggaactgccaagttgccgcaccaacggttgggctgcaacgctggagtatcaccttcgttccagcagcattgcgtggcctccttggcaacaaaagcctctagtcagtag

SEQ ID NO: 25189 - DNA, 864 bp, Artificial Sequence
  Description of Artificial Sequence: Synthetic coding sequence
atgtgcggccggcggcggcggcagcgggccgccctgctgagccactgggatccaaccctatccagcgattgggacggggaacgcacggcccctcaatgcctgctgcgcatcaaaagggatattatgtcaatctataaggagcccccaccgggtatgtttgttgtgccagataccgtggacatgacaaagatccacgcgttgattaccggcccattcgataccccctacgaagggggattcttcctctttgtcttccgttgtcctccggactaccccatacacccaccacgggtaaagctgatgacaaccgggaacaataccgtgagatttaaccctaacttctatcgaaatggaaaagtctgtctgtccatactcggcacatggacaggtcccgcctggagtcctgcccagtcaatctcatccgtactgatcagtattcagtcattaatgactgagaacccatatcataatgaaccaggttttgagcaagaacggcatccgggcgactcaaagaactataacgagtgcatccgccatgaaaccatccgtgttgctgtctgcgatatgatggagggaaagtgtccatgcccggaacccctgaggggcgttatggagaaatctttcctggagtattacgacttttacgaagttgcctgcaaagataggttacacttacagggtcaaacaatgcaggacccgtttggggaaaagcggggtcacttcgattaccagagtcttctaatgcgactgggactgatccgccagaaggttcttgagcgactgcataacgaaaatgctgaaatggacagcgattcaagctcctccggcactgaaacggaccttcatggaagccttcgcgtatag

SEQ ID NO: 25190 - DNA, 852 bp, Artificial Sequence
  Description of Artificial Sequence: Synthetic coding sequence
cccccctgcagcctgatcagcgactgctgcgccggcaaccagcgggactcagtgggcgtcggccctagcgagccaggatgctacccttgtcccggccccaacatgaaccctattgccctgggatcccgatggctggcctacgctgagaataagctcatcagatgccaccagtccagaggcggggcctgtggagataatatccaatcttataccgcgactgtgatctcagccgcgaagaccctgaaatccggactcactatggtcggtaaagttgtgacccaacttactggcacgctcccatcgggagttactgaagatgatgtggctatccactccaactccagaaggagtcctctcgtgccaggaattataaccgtgatagataccgaaaccgtgggagaaggtcaagtcctcgtaagcgaagattccgatagtgacggtatagtggctcactttcctgcccatgaaaagcctgtgtgctgtatggccttcaacacttccggaatgttactcgtgacaaccgatactctgggccacgacttccacgtcttccagatacttacacatccgtggagcagttctcaatgcgctgtgcatcatttgtacactcttcataggggtgaaacagaagctaaagtgcaggacatctgtttcagccatgattgccgctgggtggttgtctccaccctgcggggcacgtcccatgttttcccaattaacccatatgggggacagccttgcgttcgcacgcacatgagtcctcgcgtggtgaacaggatgtccaggtttcaaaagtctgccggtctagaggagattgagcaggaattaacaagtaaacagggagggaggtag

SEQ ID NO: 25191 - DNA, 2235 bp, Artificial Sequence
  Description of Artificial Sequence: Synthetic coding sequence
atgagcgccgccaaccccgagacccccaacagcaccatcagccgggaagcttccacccaaagctcgtctgctgccgcctctcagggatgggtcttgcctgagggaaagatcgtgccaaataccgtttttgtaggggggatcgacgcacgtatggacgaaaccgagatcggaagttgcttcggacgctacggatcggtgaaagaggtcaagatcataaccaacaggacaggcgtctccaaggggtatggttttgttagctttgtcaacgatgtggatgttcagaagattgtaggctctcaaattcactttcatggcaagaaattaaaacttgggcccgccattagaaaacagaagctgtgcgcacggcatgtccagccccgccccctggtcgtgaacccgcccccccctccacagtttcagaacgtgtggcggaatccaaacaccgagacctatctgcagccccagatcacaccgaaccccgttacccagcacgtgcagtctgccgctaaccctgaaacaccaaacagcacgatctccagagaggcgagtacccagagtagtagtgctgccgcgagccaagggtgggtgctgcctgaaggcaaaatagtgcccaataccgtgttcgtgggggggatagacgcacgaatggacgagacagagattggctcctgcttcggaagatatgggtcagtgaaggaggtgaagatcattactaaccgtactggtgtgagtaagggatatgggtttgtgtccttcgttaacgatgtcgacgttcagaaaattgtcggctcacagatccactttcatgggaagaagctgaagctgggccctgctatcagaaagcagaagctgtgcgctcgacacgtccagccaaggcccctcgtcgttaaccccccgccccctcctcagttccaaaacgtatggcgcaacccaaacacagagacttatcttcaaccccagatcacccccaaccccgtgactcagcacgtccagtccgccgccaatcctgagacccctaactctactattagtcgtgaagcctcaacacagtccagttctgctgcggcctcacagggatgggtgctgcctgaaggcaaaattgttcccaacactgtattcgtggggggcattgatgcacggatggacgaaacagagattggatcatgctttggacgttacggttctgtgaaggaagtgaaaatcataacaaataggactggtgtctccaaaggctacggattcgtgagtttcgtgaacgatgtcgatgtgcaaaagattgtgggtagccagatccatttccacggaaagaaattaaaactcggccctgcaataagaaaacagaagttgtgtgcccgccatgtgcaaccccgacctctggtcgtgaaccctccgccgcctcctcagttccagaatgtctggcggaacccaaacacagagacttatcttcaaccgcaaattacacccaacccagtgacccagcacgttcaggcctattccgcctacccacattcaccaggccaggttatcaccggctgtcagttattggtatacaattatcaggaatatccaacctatcctgactccgcattccaggtgaccacaggctatcagctgccagtatacaattaccagccattccctgcatacccccgaagtccgttccaggtcactgccggatatcaactgcctgtgtacaattatcaggccttccctgcctatccaaattctccatttcaggtcgccaccgggtatcagttccctgtctacaactaccagcccttcccggcatacccgagttccccatttcaggtaaccgctggttatcagctacctgtttataattaccaagcattcccagcctacccaaactcacccttccaagttgccaccggataccagtttccagtctataactaccaagcttttccggcttaccccaactcgccggtgcaggtcaccacaggataccagctccccgtttataattaccaggcttttcccgcttatccaagctccccattccaggtgacgaccggctaccagttgcccgtatacaactaccaagcattccccgcctacccaaactccgcggtgcaagttactactggataccagttccatgtctacaattaccaaatgccacctcagtgtcctgtcggagaacagcggaggaacttatggaccgaagcttataagtggtggtacctcgtctgtctgatacaacgcagggactag

SEQ ID NO: 25192 - DNA, 1089 bp, Artificial Sequence
  Description of Artificial Sequence: Synthetic coding sequence
atgctgaagaacaagggccacagcagcaagaaggacaacctggccgttaacgcggtggcactccaggatcacatactccatgacttacaactgaggaacctgagtgtggccgatcacagtaaaacacaggtgcaaaaaaaggagaacaagagcctgaaaagagatactaaagcaataatagatacaggtctaaagaagactacacagtgcccaaaactagaggattccgagaaagaatacgtactggaccccaaaccgccacccttgaccctcgcccaaaagctcggattgatcggccctcctccccccccactgtcttcggatgaatgggagaaggtcaagcagaggagccttctccagggcgactcagtgcagccctgtccaatctgtaaggaggaattcgagttgaggccacaggtgctcctttcctgcagtcatgtctttcataaggcctgtctccaggcttttgagaaattcacaaacaaaaaaacgtgtccactctgccgaaaaaaccagtatcagacccgggtaatacacgatggtgctcgattgtttagaatcaagtgcgtcactcgaatacaggcctactggcgtggctgtgtggtacgcaagtggtataggaaccttcggaaaactgtccccccaactgacgctaaactccggaagaaattctttgagaagaagtttaccgagatttctcatcgcatcttgtgtagctacaatacaaacattgaagagctgtttgccgagatcgatcagtgcctggccattaaccgaagtgttttacagcagctggaagaaaagtgcggacatgagattaccgaggaggaatgggaaaagatccaagttcaggctctcagacgagaaactcacgagtgctcaatctgtcttgccccactgagcgctgccggtggccagcgggtgggggctggccgacgatcacgcgagatggccctacttagctgttctcacgtcttccaccacgcctgcctcctggccctggaagaatttagtgtcggagataggccgccttttcacgcctgtccactatgccggtcctgttaccagaaaaagatactagaatgctag

SEQ ID NO: 25193 - DNA, 2130 bp, Artificial Sequence
  Description of Artificial Sequence: Synthetic coding sequence
atggccgacgccggcatccggcgggtggtgcccagcgacctgtacccgctggtcctgggttttctgcgggacaatcagctctcagaggtggccaataagttcgcaaaggccaccggcgccacccaacaggatgcaaacgcctctagccttctagacatttactctttctggctgaagagcgcgaaggtgccggagaggaagttacaagctaacggccccgtcgcaaaaaaggccaaaaagaaggcttccagctccgactctgaggattcatccgaggaagaggaagaagttcagggtccacctgcgaagaaggccgcagtgcccgccaaaagggtggggttgccgccgggcaaagccgcagccaaggcttcagaatcctcatccagcgaagagtcatcagatgacgatgacgaggaggaccagaagaagcagcccgtgcaaaaaggcgtgaagccacaggccaaggcagccaaagctcctccgaaaaaagctaagtccagcgactcagatagcgactcttcttcagaagatgagccccctaagaatcagaaaccaaagattactccagttactgtgaaggcccagaccaaggccccacccaagcccgcgcgagcagcgcctaagatcgccaatggtaaggcagcaagttcctcctcaagctcctctagctcctctagtagcgatgacagcgaggaagagaaagccgctgccacccctaagaaggtatggactatcacctcagtcagggcagaaaccgtacccaaaaaacaggttgtcgcaaaggcacccgttaaagctgctacaacccctactcgcaaatccagctcatcagaggactcgagctccgatgaagaggaagaacagaaaaagcccatgaaaaacaaaccaggaccttatagctccgttccccctccgtcagcccccccgcccaaaaaatcgctggggacacagccacccaaaaaagccgtcgagaaacagcagccagtcgagtcttctgaagatagtagtgacgagagtgattccagcagcgaagaagaaaaaaaaccccctacaaaagctgtcgtgtccaaggcgactacaaagccacccccagcgaagaaagcggctgaaagcagctcagacagtagcgactccgattcaagcgaagacgatgaggcccctagtaagcccgccggaactaccaagaactcaagcaataagccagcagttactaccaagagtcctgctgtgaaaccagccgcagcccccaaacagcccgttggaggcggtcagaaacttctcacccggaaggccgacagcagtagctctgaggaggagtcttccagcagcgaggaggagaaaactaaaaagatggtcgcaacaacaaaacctaaggcgactgcgaaggccgcccttagcctgcccgcgaagcaagctccacaagggtctagagatagctcctcagattccgacagctcttcatctgaggaggaggaggaaaagaccagtaagagcgcagtcaagaaaaagccccaaaaagtggcaggtggggccgccccgtccaagcctgcttccgccaaaaaaggcaaagccgagtcctccaactcaagctctagtgatgatagttccgaggaggaggaggagaaactgaagggcaaaggcagtcctaggccccaggctcctaaggccaacggcacctccgccctcacggcgcagaatggaaaggccgctaagaacagtgaagaagaagaggaagagaaaaagaaagccgccgtagtcgtctccaagtctggcagtcttaaaaagcgcaaacagaatgaggcggccaaggaggccgaaactccacaggctaaaaaaatcaagttacagacccctaacacgttccctaagagaaaaaagggtgagaaacgcgctagtagcccattccgcagggttcgcgaggaagaaatagaggtggattctcgtgtggccgacaacagcttcgatgccaagagaggtgccgcaggagactggggggaaagagcaaaccaggttctgaaattcactaagggcaaatctttcagacacgagaagacaaagaagaaaagaggatcttatcgcggcgggtcaatatctgtgcaagtaaactccattaaattcgatagtgagtag

SEQ ID NO: 25194 - DNA, 558 bp, Artificial Sequence
  Description of Artificial Sequence: Synthetic coding sequence
atgcagcagaagagccagaagaaggccgagctgctggacaacgagaagcctgctgccgtggtggcccccatcaccactgggtacacagtcaagatctcaaactacgggtgggaccagtccgacaaatttgtgaaaatctatatcacgctgactggggtgcaccaagttccaaccgaaaatgtccaggttcatttcactgagagaagcttcgacctcctggtaaagaatctgaacgggaagagctacagcatgattgtcaacaatcttttgaagccaatcagcgttgaaggaagctctaaaaaggtcaaaacggacacagtgctgatcctttgccgaaagaaagtcgaaaacacacggtgggactacttgacacaggtcgagaaagaatgcaaggagaaggaaaaaccttcttatgacactgaaacagacccatccgagggcctcatgaacgtgctgaagaagatatacgaggatggggacgacgacatgaagcgtaccatcaacaaggcctgggtggagtcacgggaaaaacaggctaagggggacaccgagttttag

SEQ ID NO: 25195 - DNA, 1764 bp, Artificial Sequence
  Description of Artificial Sequence: Synthetic coding sequence
atggccagcgaggacatcgccaagctggccgagaccctggccaagactcaggttgccgggggccaactctcttttaaagggaagagcctcaagcttaatacagccgaagacgccaaagacgtaatcaaggagattgaagactttgattccctagaggctcttcggctcgagggaaacacagtgggggtggaagccgcccgagtcattgcgaaagccttggaaaaaaaatcggagctgaagagatgccattggtcagacatgttcacaggtcgcctccggaccgaaatcccgccagccctcatcagcctaggcgagggcctaatcactgcgggagcacaacttgttgaactggacctctctgataacgctttcgggcctgacggagtgcagggatttgaggcgttacttaagtcgtccgcctgctttactctgcaggagctgaagctcaacaattgtggtatgggcatcgggggcgggaaaatcttggccgcagccctgacagagtgccaccgaaaaagctccgctcagggaaagcctttggcgctcaaggtgtttgtcgccggccgaaacaggctggaaaatgatggtgctacggctcttgccgaggcatttcgggtgatcggcacgctcgaagaggttcacatgccccagaatggaatcaaccacccagggattaccgctctcgcgcaagcattcgcggtaaaccccctcctgcgggtgataaacctgaacgacaacacattcaccgagaagggagctgtcgcgatggcagagaccttgaagaccctgcgccaggtggaggtgataaacttcggcgactgtctggttaggagtaaaggcgctgtggccattgcagatgcgatcagaggtggcttgccaaagttaaaggaactgaacctatcattctgtgaaattaagcgagacgctgcactagcagttgcggaagctatggccgataaggccgaattggaaaaattggacttgaacggcaacaccctgggcgaggagggttgtgagcaactacaagaggtcctggagggtttcaatatggcaaaggtgcttgcttctctctcggacgatgaagatgaggaagaagaggaagaaggggaggaagaggaggaagaggcagaggaggaggaggaggaagacgaagaggaggaggaggaggaagaagaggaggaagaagaggagccgcagcagcggggacagggagaaaaatccgccaccccatctagaaaaatacttgatccaaacacaggcgaacctgcacctgtgcttagttcccctcctccggcagacgtttccactttcctagcctttcctagtcccgaaaagctcctgcgcctaggacctaaaagctcagtgctaatcgcacaacagaccgatacatccgaccccgaaaaggtggtctctgctttcctgaaagtgtcctcagtgtttaaggatgaagccaccgttcgaatggctgttcaggacgcggtggatgccctgatgcagaaggctttcaattccagctcttttaactccaatactttcttgacacggttactcgtccacatgggtctccttaagagcgaggacaaggtgaaagccattgccaatctgtatgggccattgatggcgctcaatcacatggttcagcaggactatttcccaaaggctcttgcgccactgttgttagccttcgtcaccaagcctaactccgcccttgaatcttgctcattcgcacggcacagtcttcttcagacgctgtataaagtatag

SEQ ID NO: 25196 - DNA, 1098 bp, Artificial Sequence
  Description of Artificial Sequence: Synthetic coding sequence
atgaaggagctgtggtgcgtgatggactgggccgtgcccggcctgttagggtcaggaacttacttcaaaaaacaatttagcgatccagtagagcatggccagagacataccgctacaaaacgagaactggcaacaggcagaaaagccatgcagcgactggccaagaagatgagtgggtggtttctgaggcgcactaagacgttaattaaggatcagctaccgaagaaagaagaccggatggtctactgttccttgaccgatttccagaaggctgtctaccagaccgtgctggaaactgaggacgtgacgctgatcctccagtccagcgagccatgcacatgtcgatcggggcagaagcgacggaattgttgctataagaccaatagtcacggcgagaccgttaagacattgtacttatcgtatcttaccgtgttgcagaaagtggcaaaccatgtggccctcctccaggccgcatccaccagtaaacaacaggaaacactcattaagcgcatatgcgatcaggtattctcccggtttcctgattttgtgcagaaaagcaaggatgcagctttcgagaccctgagtgaccctaagtacagtgggaaaatgaaagtactgcagcagcttctgaatcactgccgaaagaatcgcgataaagtgttattattcagtttcagcacgaagctccttgatgtccttcagcagtattgtatggcctcaggactggactaccggcgccttgatggatccacaaaaagcgaagaaaggctcaagatcgtgaaggagttcaacagcacacaggacgtaaacatttgtctggtgagcaccatggccggaggtctcgggttaaacttcgtgggagccaacgtggttgtgctcttcgatccgacgtggaacccggcaaacgacctgcaggccatcgacaggactcagacgcattgccgtcgcgaacgggacgcggaacctctgtcttccgcgccgggcctccagaatggcagcgagaatgctgttccatacccttggtggtgctgtgtaaccggggccagtatcagttgttggcgatgcgagatttgtcgcatccaggacgtcctggagtag

SEQ ID NO: 25197 - DNA, 1104 bp, Artificial Sequence
  Description of Artificial Sequence: Synthetic coding sequence
atggagaagaagaagatggtgacccagggcaaccaggagcccaccacaacacctgacgccatggtccagcctttcaccaccatccccttccctcctccacctcagaacgggatcccgactgagtacggtgttcctcacacccaggactatgctgggcagaccggagagcacaacctcactctctatgggtccacccaggcgcatggggagcagagttctaatagcccaagtactcaaaacggttccctgacacagaccgagggaggtgcacagactgacgggcaacagtcccagactcagagcagtgagaatagtgaaagcaaatctacacctaagcggctgcacgtgagtaatatccctttcaggttccgggatccagatctgcgccagatgttcggccagttcgggaaaattctcgacgttgaaattatttttaacgagcgaggttccaagggcttcgggttcgtgacatttgaaaatagcgctgatgcagatagagctagagagaagctgcatggaaccgtcgtggagggccgcaagatcgaagttaacaacgctaccgctcgggtcatgacaaacaagaaaatggtcacaccctacgctaacgggtggaaactcagtccagttgtgggagctgtatacggccccgagctttacgcggcctcatcatttcaagccgatgtcagcttaggtaacgacgccgcagtaccactgtccggaaggggtggcataaacacatatattcctctgataatccctgggtttccgtacccaacagcagcaactaccgcggccgcttttcgcggtgcccacctccggggcagggggcggaccgtgtacggggcggtccgcgccgtgccccccacagctatacccgcctaccccggggttgatatgcagcctacggacatgcattcactgctgctgcagcctcagccacctctgctacagccgcttcagccgctgacggtgacggtaatggctggttgcactcaacccactccaaccatgcctctaccccttccccttgcaatggagcttgcactctggcgggtatacacggaggtcgcgactgcagacctgcccccaaccgaggttacctag

SEQ ID NO: 25198 - DNA, 1764 bp, Artificial Sequence
  Description of Artificial Sequence: Synthetic coding sequence
atggccagcgaggacatcgccaagctggccgagaccctggccaagactcaggtggcaggtggtcagctctcttttaagggaaagagtcttaagcttaatacagccgaagacgccaaagatgtcattaaagaaattgaggattttgattcactggaggcccttcggctggaaggcaacaccgtgggagtcgaggcagccagggtgatcgcgaaagctctcgaaaagaaatctgagctgaagcgttgtcactggagcgacatgttcactggaaggctgcgtaccgagattccgcccgcgctgatatcgctcggggaagggctgattacggccggagcgcagctggttgaactcgatcttagcgacaatgccttcgggccagatggcgttcaaggtttcgaggcactcttgaaaagctccgcatgcttcacactgcaggagctcaagctgaacaactgcggcatgggtatcggcgggggaaagatactggccgcagccctgactgagtgtcacaggaaaagctccgcacagggaaagcccctggccttgaaagtgtttgtggctgggaggaacagactggagaacgacggggctaccgccttggccgaggccttccgggtcatcggaacgctcgaggaagtgcacatgcctcagaacggcatcaatcatccaggaattaccgctctcgcccaagccttcgccgtgaaccccctcttacgcgtgatcaatctaaacgataatacatttacagaaaagggggcggtcgctatggcagaaacgctgaagaccctaaggcaggtggaagtcatcaatttcggcgactgtctcgtgcgttcaaaaggcgctgtcgccatcgccgacgcaattagaggggggctaccgaaactaaaagagctgaacctcagtttctgcgaaattaagagggatgctgcactggccgtcgctgaagctatggcagataaggcggagctagagaagctggatcttaacgggaacacattgggtgaagagggatgtgagcagctgcaagaggtactcgaaggattcaacatggccaaagttctggcatctctctcagacgacgaagacgaggaggaagaggaagaaggtgaggaggaagaagaggaggccgaagaagaggaggaggaagacgaggaggaagaggaagaagaggaggaggaggaagaggaagaaccgcagcagcgagggcaaggcgagaagagtgccaccccgtcccgaaaaatcctcgacccaaatacaggtgagccagcaccggtcctgtcaagcccaccgcctgctgacgttagcacattccttgccttcccttcccctgagaagctgctccgtctgggcccaaaatcctctgtgctgattgcccaacagacagatactagcgacccagaaaaagtggtgtctgctttcctgaaggtctcttctgtcttcaaggacgaggctactgttagaatggctgttcaggacgcagtggacgctttgatgcaaaaagccttcaatagttcttcctttaacagcaacacatttcttaccaggcttctcgtgcacatgggcctgctgaagtctgaggataaagtcaaagccatagcgaacctttatggaccactcatggctctgaatcacatggtgcagcaagactacttccctaaggcactagcacctttactccttgccttcgtcacgaagcctaatagtgcattagaatcatgttctttcgcacgacattccctgctgcagacactttacaaggtgtag

SEQ ID NO: 25199 - DNA, 1143 bp, Artificial Sequence
  Description of Artificial Sequence: Synthetic coding sequence
atggacgccgccaccctgacctacgacaccctgcggttcgccgagtttgaggatttccctgagactagtgaacctgtgtggatcttgggcaggaagtactccattttcacagagaaggatgagatcctgagtgacgttgcatcccgcctgtggttcacgtaccgcaagaacttccccgccataggcggcacaggaccaacttccgacaccggttggggatgcatgctgcgatgcggccaaatgattttcgctcaggccctcgtttgtcggcatcttgggcgagactggcggtggactcagagaaagaggcagcctgactcatatttctcggtcctgaacgcgtttatcgacagaaaggatagctattactctatccaccagattgcccagatgggcgtgggggaaggtaagagcatcggccagtggtatggcccaaatacagtcgctcaagttctgaaaaagctggccgtgttcgacacatggagctcgttagccgttcatatagctatggacaacacagtggtgatggaagagattaggagactgtgtcggacatctgtgccctgtgctggcgccactgcattccccgctgactcggataggcactgtaacggattccccgccggcgcagaggttaccaaccggcctagtccatggagacccctggtgcttctaattcccctaaggcttggactgaccgacatcaacgaagcatatgtcgagacactgaagcactgtttcatgatgccacaatccctaggggttataggcgggaagcctaatagtgcgcactatttcattggctacgtgggcgaagagctaatctaccttgatccccatacgacccaaccggcggttgaacccaccgatggctgttttatcccagacgagagcttccactgccaacaccccccttgtagaatgagcattgcggaattagaccccagcatcgccgtcggatttttttgtaaaacagaggatgactttaatgattggtgccagcaagtgaagaagctgtcattattaggcggcgcacttcccatgttcgagctggtggaactgcagcccagtcatctggcttgcccggatgtgctgaacctgtctctgggcgagtcttgccaggtgcagatcctgttaatgtag

SEQ ID NO: 25200 - DNA, 2124 bp, Artificial Sequence
  Description of Artificial Sequence: Synthetic coding sequence
atgatccccccccaggaggccagcgcccggcggcgggagatcgaggataagctgaaacaggaggaggagacactgtccttcatccgggactctctagagaagtcagatcaattgacaaaaaacatggtttccatccttagttccttcgaaagtcgcctgatgaagttggaaaactcaatcatccccgttcacaagcagactgaaaacctgcaaagactgcaggagaatgtggagaagacacttagctgtttggaccacgtaatcagctactaccatgtggcctctgatactgaaaagattatacgagagggcccgacaggacgactcgaagagtacttaggctccatggctaagatccagaaagccgtggagtattttcaagacaactcgccagacagccctgaactgaataaggttaagttgctgttcgaacgaggaaaggaggcccttgagagcgagtttcgcagtctgatgacacggcatagtaaggttgtgtctccggtactaattctcgatttgatctccggagatgacgaccttgaggctcaagaggacgtcaccctcgaacacttacccgagtccgtccttcaggatgtcattagaattagcaggtggctggtggagtatggccggaaccaggacttcatgaatgtgtattaccagatccgctcatcacagctggatcggtctatcaaaggcctgaaagagcactttcataaaagctcatcctcttcgggagtgccatacagtccagccatccctaacaaacgtaaggatacccccacgaagaaacctgtcaagcgacccggcacaattagaaaggctcagaatcttctgaaacagtacagccaacacggccttgatgggaaaaagggggggtccaaccttatacccttggagggacatgagcacgatttcagggtaaaacacctgagtgaagctttaaatgataaacatgggccccttgccggtagagatgacatgcttgatgtggagacagacgcctatattcactgcgtctcggccttcgtgaagctggcacagagcgagtaccagctcctcgccgatataatccctgaacatcaccagaagaagacattcgacagcctcattcaggatgccctggacggcctaatgttggaaggcgagaacatcgtgtccgccgctagaaaggccatcgtgcgtcatgattttagcacagtactcactgtcttcccaatcttgcggcatttgaaacagacaaaaccagagtttgaccaggtgctgcagggaacagctgcatctacaaagaataagctgcctggactgattactagcatggagactattggggctaaagccctggaggattttgctgacaacattaaaaacgaccccgacaaggagtacaatatgccaaaggacgggacggtccacgaactcacgtcgaacgcaatcctctttctgcagcaacttctggacttccaagaaactgcaggagccatgctagcatcccaagagacttcctcttcagcaacctcttactcttcagagtttagcaaaaggcttttgagtacttacatttgtaaggtcctggggaatctgcaattaaacctgctgtccaagagtaaggtttatgaagacccagccctgagcgcaatcttcttgcataacaactacaattatattctcaagagcctcgagaagtccgagctgattcaactcgtggccgttacccaaaaaacagccgaaagatcataccgggaacacatcgaacagcagattcagacctaccagagaagttggctcaaagtgactgactatatcgccgagaagaatcttcccgtgtttcaaccgggagtcaaactcagagataaggagagacagatcattaaagagaggttcaaaggattcaacgacggactcgaggaattatgcaaaatccagaaggcgtgggcgatccccgataccgagcagagagaccgaattaggcaggcccaaaagaccatcgtcaaggaaacatacggagcatttctccagaaatttggatcagtgccatttacgaagaatccagagaagtacattaaatatggtgttgaacaggttggagatatgattgataggctcttcgatacaagtgcctag

SEQ ID NO: 25201 - DNA, 1026 bp, Artificial Sequence
  Description of Artificial Sequence: Synthetic coding sequence
atggcccaggagagccccaagaacagcgccgccgagatccccgtgacaagcaatggcgaagtggatgatagtagagaacactcatttaatcgagacctcaagcattccctgccctcagggcttggcctttctgaaacacagattacctcccacgggttcgacaataccaaagaaggagtcatcgaggccggggccttccaggggggccagagaactcagaccaagtccgggcccgtcatcctcgctgacgaaattaagaacccagccatggaaaaattggagttggtgcggaagtggtctcttaacacctacaagtgcacgagacagattatcagcgaaaagctaggcagaggatcaaggaccgtggaccttgaattggaggcacagattgacatcttgcgagacaacaagaagaagtatgaaaacattcttaagcttgcccagacactttctacccaactttttcagatggtccacacacagcgtcagctgggtgacgcctttgccgacctgagtttaaagagtcttgagctgcatgaggagtttgggtataacgctgacacccagaaacttcttgctaaaaacggtgagactctgttgggcgcaatcaattttttcattgcatccgttaacacactggtgaataagaccatcgaggatacattgatgaccgtcaagcagtatgagtctgcacgtattgagtacgatgcatacaggaccgatctggaggagctgaatcttgggccaagggacgcaaacaccctgccaaagatcgaacagagccagcacctatttcaggcccacaaggaaaagtacgacaaaatgcgcaatgacgtctctgtgaaactgaagttccttgaggagaacaaggtcaaagtgctacataaccagcttgtcttatttcataacgccattgctgcttatttcgctggaaaccagaagcagttggagcagacactaaagcagtttcatattaagctgaagacccctggggtcgacgcaccgtcatggctcgaagaacagtag

SEQ ID NO: 25202 - DNA, 1488 bp, Artificial Sequence
  Description of Artificial Sequence: Synthetic coding sequence
atggccggcgtgggccggagcggcggcccctggggccggacccgggggggtcggagtggtcggctgggagtgagtctgggagctctgtcatcactgccacttgaagaactgcctcgcccgttgtgctgtcggcgatgtcggcgtcatttcggctttgctctcagaggcgagacaattcccgtgtcagtggctgggagcgcttctagccaattcgcgccactcgccctgcacctttcattactgctgtctcggatatccgcctcccggctcacccgttggccaccccctgataagcgtgaaggcagtgccgtggaccccggcaagaggaggagtttggccgctactccatcctcaagtctcccctgcaccctcatcgctctggggctgcggcatgaaaaggaggctaacgaactgatggaggatctctttgagacgttccaagatgaaatgggtttttctaatatggaggatgacggccctgaggaagaggagagggtcgcggagccacaggccaatttcaacaccccgcaggcattgcggttcgaggagctgctagctaatctgttaaatgaacagcatcagattgccaaggagttgttcgagcaactcaaaatgaagaagcccagcgccaaacagcagaaagaggttgaaaaggtgaagccacaatgcaaggaggttcatcaaaccctaattctcgatcccgcgcagagaaagagactgcagcagcagatgcagcagcatgtgcagctgctcacccagattcatctgctggctacttgcaatcctaatctgaacccagaagcgtcttctacacgaatttgcctgaaagagctcggtacatttgctcagagctccatcgccctgcaccaccagtacaacccaaaatttcagactctgtttcagccgtgtaacctgatgggcgcaatgcagctgattgaagattttagtacacatgtgagcattgattgctccccccacaagacggtgaagaagaccgcaaacgaattcccatgcctgcccaagcaggtcgcgtggattctggctacttcaaaggtcttcatgtaccccgaattgctgcccgtgtgctctcttaaagctaagaaccctcaggacaagatcttatttacgaaggcagaagataacctgctggctctggggcttaaacactttgagggaaccgagttcctcaatccactgatcagcaagtatctgctcacatgcaagaccgccaggcaacttacggtgaggattaagaatcttaatatgaaccgagccccagacaacatcatcaagttctataaaaaaactaagcagctacctgtgcttggcaaatgctgcgaggaaattcagccccatcagtggaagccgccaattgagagggaggaacaccgtcttcctttttggctgaaagtacagccttccagctctaagagcgtcggtggcagacgctccttaaaagtgctacgggagtatcaaggtttgccatag

SEQ ID NO: 25203 - DNA, 180 bp, Artificial Sequence
  Description of Artificial Sequence: Synthetic coding sequence
atggccgcccccggcgccctgctggtgatgggcgtgagcggcagcggtaattgggacggcaacagtatgatgctgatgatcatcactcgtcgcaagattgagggcaggtgggagaaggcttatcgatctatgacccggaccggtttccacgggtcagtgacatgtatgacattctactag

SEQ ID NO: 25204 - DNA, 207 bp, Artificial Sequence
  Description of Artificial Sequence: Synthetic coding sequence
atgggcgagaccgagggcaagaaggacgaggccgactacaagcggctgcaaacctttccccttgttcgtcacagtgacatgcccgaggaaatgcgcgtcgaaacaatggagctctgcgttaccgcatgcgagaagttcagtaataataacgaagtccttcccgctgttcaagcagcccctagggcattcgatggaccctgcgggtag

SEQ ID NO: 25205 - DNA, 2451 bp, Artificial Sequence
  Description of Artificial Sequence: Synthetic coding sequence
atggtgctgatgttccagatccggtacatcagccagacccagggcctacctgcggaatacctgcttagcgccggaacgaagactactagattttttaacagagacccaaacctgggctacccgttgtggcgactcaaaactccagaggagcacgagctggagactggcatcaagagtaaagaagcccggaagtacatttttaattgtctggacgatatggcgcaagtaaacatgtccactgacctagagggcactgacatgttggcagagaaggctgatcgacgcgagtatatagatctgctcaaaaagatgctgacaatagacgctgacaaaaggatcacgcctcttaaaaccctcaatcatcagtttgtgaccatgacccatctcctcgattttccacactccaatcatgtgaagagctgcttccagaatatggagatctgcaagcgacgcgttcacatgtacgatactgtttcccagataaaaagcccgtttaccacccatgtggctccaaatacgtctacaaaccttacgatgtcgttcagtaaccagctcaacaccgttcataaccaggcctcggttctggcaagttcatcaacagctgctgcggcaactctgagtctggccaattcagacgtgagcctcctgaattaccaatccgctctatacccttcgtccgctgcgcccgtgccgggagtggcacaacagggagtgtcattacagccggggaccacccagatatgcacacaaaccgacccctttcagcagaccttcattgtttgtccaccagccttccagactggccttcaggccacaaccaagcatagcggattcccggttaggatggacaatgcggtcccaattgttccacaggcccccgcagcgcaacctctgcagattcagtccggagtccttacacagggcagctgcacccccttgatggtggccactttacacccacaagtggcaacaattactccacagtatgccgtacctttcaccctgagttgtgccgccggccgaccagcactggtggaacagactgccgcagtccttcaggcatggcccggcgggacacagcagattctgttaccatccacctggcagcagctgcctggtgttgcccttcataactctgttcagccaaccgccatgatcccagaggctatggggtccgggcaacaactagccgattggcggaacgcccattcacacggtaaccagtactctaccatcatgcagcaaccttccctgttaacgaatcacgtgaccctggctaccgctcaaccactcaacgtaggggtggcacatgtggtcagacagcagcagtcaagtagtctcccaagcaagaagaacaaacaaagcgcgcctgtatcaagtaagtcttctctggacgtgctgccaagtcaggtgtactctctggtcggcagttcccctctcaggacaaccagctcatataattctctcgtaccagtgcaagatcagcaccagccgatcatcatcccagacacaccatcaccaccagtgagcgtgatcacaatcaggtctgatactgatgaggaggaggacaacaaatacaagcccagcagtagcggcctgaagccacggtctaatgtgatctcctacgtgactgtgaatgattcgcccgactccgactcgtctctgagttccccatacagtacagatactctctctgctctgcgaggtaacagcggatccgttcttgaggggcctggccgagtggtagcagacggaactggcacgagaacgatcattgtccccccgctgaagacccaactaggtgactgcacagtggctacacaagccagtggccttctctccaataaaacaaagcccgtggcatcggtgagcggacagagttcaggatgttgcatcacccccacaggctatcgggctcagagaggcggcaccagcgcagcacagcccttgaatctgagccagaaccagcagagctccgctgctcctacatcacaagagaggagcagcaatcctgcccctcggcgccagcaagccttcgttgctcccctgtcccaggcaccctacacattccagcatgggagccccctccactccacaggtcaccctcacctggcgccggcaccggcacacctgccatcacaggcacacctgtacacctacgccgcacctacctcagctgctgccctcggctctacaagtagcatcgcgcatctcttctcaccccaggggtcctctcggcacgccgcagcttacaccacacacccttccactcttgtgcaccaggtgcctgtaagtgtgggcccttctctcctcacctcggcgagcgttgcaccagctcagtatcagcatcagtttgccacgcagtcctatatcggctcatctcgggggtccaccatatataccggctatcctctgtcccccaccaagattagccagtattcttatctgtag

SEQ ID NO: 25206 - DNA, 1119 bp, Artificial Sequence
  Description of Artificial Sequence: Synthetic coding sequence
atggacgtgctgagccccctgagcttcatcaaggtgagccacgtgagaatgcaaggtattctcctactagtgtttgcaaagtaccagcatctaccatacatccagatcctgtccacaaagtcaacacccacaggattgtttgggtattggggaaataagggcggagtgaacatttgtttgaagctgtacggctattacgtctcaatcatcaattgccacctcccaccgcatatcagcaataactaccagcgattagagcactttgatagaatcttggaaatgcaaaattgcgagggtcgtgatattccaaatatattagatcacgatcttataatctggttcggcgatatgaattttcgtatcgaagactttggcctacactttgttagggaatccattaaaaataggtgctatggtggcctgtgggagaaagatcagctgtccatcgcaaagaaacatgatccactgctgcgtgagttccaggagggtcggctgcttttccctccaacatacaaattcgacagaaatagcaatgactacgatacatccgagaagaagcggaagccagcttggaccgatcggattttgtggcgactgaaacgacagccctgtgccggacccgacaccccgataccacctgccagccacttctctctaagtctaagaggctattcaagccacatgacatacgggatctcagaccataaacctgtgtccggcacgtttgacctggagctgaagcccctggtgagtgcacccctaatcgtccttatgcctgaggatctgtggacagtggagaacgacatgatggtgtcatattcatccacttccgactttccatccagcccctgggattggataggactgtataaggtgggactccgggatgttaacgattatgtgtcctatgcatgggttggtgattccaaggtgtcatgtagcgataatctgaaccaagtgtacattgacatttcaaatatcccaaccactgaagatgagttccttctctgttactatagcaattctcttcggtctgttgtgggtatcagtcgcccgttccagatcccgcccggcagcctgagggaggaccccctcggggaagcacagccgcagatttag

SEQ ID NO: 25207 - DNA, 480 bp, Artificial Sequence
  Description of Artificial Sequence: Synthetic coding sequence
atgatccccccccaggaggccagcgcccggcggcgggagatcgaggacaagctgaagcaggaagaagaaaccctgagctttatcagagactcactcgaaaaatcagaccagctgacaaaaaatatggtgtctatactgagcagtttcgaatcccggctaatgaaactggagaatagtatcataccagtgcacaagcagactgagaatcttcaaagactgcaagagaacgttgagaaaacactgtcatgcctggaccacgtgatcagctactatcacgtggcttccgacaccgagaaaattatccgcgaggggcccacaggtcgtctggaggaatatctggggtccatggccaagatacagaaggcggttgagtacttccaagacaacagccctgattccccggagctaaataaggtcgtgaggggcccccagaataatgtgcggagcttgggaattagtgtatcggctctcgtgtcatag

SEQ ID NO: 25208 - DNA, 243 bp, Artificial Sequence
  Description of Artificial Sequence: Synthetic coding sequence
atggccagcgaggagctgcagaaggacctggaggaggtgaaggtgctattggagaaggcaaccaggaagcgggtccgagatgctctgactgccgaaaagagcaagattgaaactgagatcaaaaacaagatgcagcagaaaagtcagaagaaggccgagctgttagacaacgaaaagcccgctgcagttgttgcgcctatcacgaccggatatacggacggaatatcccagatatccttgtag

SEQ ID NO: 25209 - DNA, 606 bp, Artificial Sequence
  Description of Artificial Sequence: Synthetic coding sequence
atgcccagcgagaccctgtgggagatcgccaaggccgaggtggagaagaggggtatcaacggaagcgaaggcgatggcgccgagatagctgagaaattcgtgttcttcataggtagtaagaatggaggaaagaccacaattattctccgctgcttggacagggacgaacccccaaaaccaaccttggccctcgagtatacttacggacgccgagccaaaggtcacaacacccctaaggacatagctcacttttgggagttaggaggagggactagtctgttggacctgatttcaattcctattactggggacacgctccgcacttttagtctggtgttggtcctggatctgtccaagcccaatgatttgtggcctacgatggaaaacctgctgcaggcaacaaagagtcatgtcgacaaagtgatcatgaaactaggcaagacaaacgctaaggctgtttctgagatgagacagaagatctggaacaacatgcccaaagatcatcccgtgtcctgttgtcttgggttgttattggagtccctagtgccgttcatcgtgaacgacaatatcacaaacaacttttttagattcctgtgcatgacatag

SEQ ID NO: 25210 - DNA, 1401 bp, Artificial Sequence
  Description of Artificial Sequence: Synthetic coding sequence
atgagctaccggcccgtggtgagccccgtgatgagcctgacccggcgctgtatgcgtagccgcacgagcatgcgcacagatgcagtgtttctgatcctgtacaaggagctatactaccgacacatatatgctaaagtgtcaggggggccgtctctggagcaaaggttcgaatcgtactataactactgcaatctcttcaactacattttgaacgccgatggtccagccccgttggagttgccgaaccaatggctgtgggacattattgatgagttcatatatcaatttcagtctttctcacagtacagatgcaaaacagccaagaaaagtgaagaggagatcgactttttgcgctctaatccaaaaatctggaacgtacacagcgtactgaacgtgctgcactctctggtcgacaagtctaacatcaatcgccagctggaggtgtatacctcgggcggtgatcccgaatctgtcgctggcgagtacgggcgacactcgctatacaaaatgctaggctacttctcactggtgggtcttctaagacttcacagcttgcttggcgattattaccaggcaatcaaggttctggaaaacatcgagttaaacaaaaaaagcatgtacagcagagtgccggagtgccaggtgacaacgtactattatgtaggcttcgcctacctcatgatgagacggtatcaagatgcaattcgggtgtttgctaatattctcttatatatccagagaacgaaaagcatgttccagcggactacatataaatacgagatgataaacaaacagaatgaacagatgcatgcactcctggcaatcgccctgacaatgtatcctatgcgcattgatgaatcaattcacctccaactcagggaaaagtatggggataagatgttaagaatgcaaaagggcgatccgcaggtgtacgaggagctttttagctattcctgtcctaagttcctgagtcccgtggtacctaattacgacaatgtgcaccccaattaccataaggagccctttctgcaacagctaaaggtgttctccgacgaggttcagcagcaggcacagctctcaacaatccgaagtttccttaaactctataccactatgcctgtggctaagctggccggtttcttagacctgaccgaacaggagtttcgcatccagctactcgtgttcaagcataaaatgaagaacttagtttggacttctgggatcagcgcgctagatggggagtttcagagcgcttcagaggtggacttttacatcgacaaggatatgatccatatcgctgacaccaaagttgccaggaggtacggtgacttctttattcggcaaatccacaaattcgaggaactcaaccgaactctgaaaaaaatgggccagcgtccttag

SEQ ID NO: 25211 - DNA, 597 bp, Artificial Sequence
  Description of Artificial Sequence: Synthetic coding sequence
atgagccgggccgtgaccatcgccgaggccttctgccacatcctgttcaggattataagcgaaatcctgatgaggatgctcgaagagcaatgcctgttccccctacccgaacctcaggatctgttccaagcgagccagatgaagtttgaagactttcagaaggacctgcggaagctgaagaaggacttgaaggcttgcgaagtggaagcgggcaaggtttaccaggtgagtagcaaagagcatatgcagccttttaaggaaaacatggagcagtttataattcaagccaaaattgaccaggaagccgaagaaaattcactcactgagacccataagtgctttctcgaaacgacggcttactttttcatgaagccgaagctgggtgagaaagaggtcagcccaaacgcctttttctccatctggcatgagttcagctcagacttcaaagatttctggaaaaaggaaaacaagctcctgctgcaggaacgggttaaagaagcggaggaggtatgccgtcagaagaaagggaagtcgttgtacaaaattaaacctcgacacgactcaggtataaaagccaagatctccatgaagacctag

SEQ ID NO: 25212 - DNA, 441 bp, Artificial Sequence
  Description of Artificial Sequence: Synthetic coding sequence
atggagcccacccgggactgccccctgttcggcggcgccttcagcgcaatcttgcccatgggcgcaattgatgtcagcgatttgcggcctgtacccgataatcaggaggtgttttgccaccccgtaaccgatcaatccctgatcgtcgaattactggaactccaggcccacgtgaggggggaagctgcagcacgatatcatttcgaagatgtcgggggcgtgcagggggcgagggcagtgcacgttgagagcgtacaaccattgtccctcgagaacctagcactccgcggaaggtgtcaggaagcatgggtattatctggcaagcagcaaatagccaaggagaaccagcaagttgcaaaagacgtcacgctccaccaggcactgttgagactgccccaataccagactgacctgcttcttaccttcaaccagcccccatag

SEQ ID NO: 25213 - DNA, 1584 bp, Artificial Sequence
  Description of Artificial Sequence: Synthetic coding sequence
atgagcctgtgcggcgcccgggccaacgccaagatgatggccgcctacaatggtgggaccagtgccgcagccgcaggtcaccaccaccatcaccaccaccacctcccacacctccctcctcctcatctgcaccaccaccaccatcctcagcatcacttgcaccccgggtccgccgccgcagtccaccctgtgcagcagcatacttcttccgctgcagccgcggccgccgccgcagccgcagctgctgctatgttgaaccctggacagcagcagccttacttcccttcacccgcgccaggccaggcacctggcccggccgctgccgcacccgctcaggtccaagcagcagctgcggcaactgtcaaagcccaccaccatcagcacagccatcatccacagcagcagcttgacatcgaacctgatcgcccaatcggatatggagccttcggggtggtgtggtccgtgactgatcccagggatggtaaacgggtagcgctcaagaaaatgcctaacgttttccaaaatctggtgtcttgtaagagagtgttccgcgagttaaagatgttgtgcttttttaaacacgacaacgtgttgagtgccttagatatcttgcagccacctcacatagactacttcgaagagatctacgtcgtcaccgagctcatgcagagcgatctgcacaaaataatcgtctcacctcagcccctgagttcggaccatgttaaagtgtttctgtatcagatcctgcgcggattgaaatacctccacagtgccggcattctccacagagacattaagccaggaaatctactggtaaatagcaattgcgtactgaagatttgcgacttcggactcgcgcgagtggaggaactggacgagtcacgccatatgactcaggaggtggtgacacagtattatagggcacctgagatcctgatgggctctcgccattactctaatgcaatagacatctggtcagtgggatgcatcttcgcagaactgttgggcagacgaatcctctttcaggcccaatcaccaattcagcagttggacctgatcaccgacctattgggcactccatctttagaggcaatgcgcaccgcgtgtgagggagcaaaggctcatatccttcgggggccccataagcagccatccctgcccgtcctttacactctgtcctcacaagctactcacgaggcggtccatttgctatgcaggatgctggtgtttgatccttccaaaagaatcagtgccaaggatgcgctcgcgcacccttaccttgacgagggccggctgcggtaccatacttgtatgtgcaaatgctgtttctccacctcaaccggcagagtgtatacttcagacttcgaacctgtgacgaaccctaaattcgacgataccttcgagaagaacttgtctagtgtgagacaagtgaaggaaataatccaccaattcatattggagcagcaaaaaggaaatagagtacctctctgtattaatccacaatcagcagccttcaagtcttttatatcatcgacagttgctcaaccatctgagatgcccccttcaccattggtctgggaatag

SEQ ID NO: 25214 - DNA, 2742 bp, Artificial Sequence
  Description of Artificial Sequence: Synthetic coding sequence
atgaacgaggccatggccaccgacagcccccggcggcccagccggtgtaccgggggagtcgtggttcgtccgcaagccgtcactgagcaatcctacatggaaagtgtggtgacttttctccaggatgttgtgcctcaggcatatagtggcacaccactcacagaagagaaggaaaagattgtgtgggtcaggtttgagaacgctgatttaaacgacaccagccggaatctggagtttcacgagatccactctactggcaacgaacctccattattaattatgatagggtacagcgacggtatgcaggtgtggagcatcccaattagtggcgaggcccaggagcttttctccgttcggcatgggccaattcgtgctgcccgcatcctgccagcccctcagtttggtgctcagaaatgtgacaattttgcagagaagcgccctctcttaggtgtgtgtaaaagcatcggatcgtcaggcacctccccgccctactgttgcgtggatctctactctttgagaaccggggagatggtcaaaagcatccaattcaagacccctatttacgacctccactgtaataaacgcatcctcgtggtggtgctgcaggaaaagatcgccgccttcgattcgtgtacctttactaaaaagtttttcgtgacatcgtgctatccatgcccaggtcccaacatgaatccgatcgccttaggcagcaggtggttggcgtatgcagagaacaagctgatccgttgccaccaaagcaggggtggcgcttgcggtgataatatccagagctatacagccaccgtgatttcagcggccaagaccctgaagtccggactcacaatggttggcaaggtggtaacacaattaacaggaactcttccctctggagtaaccgaggatgacgtggccatccattcgaactcaagaagatccccgttagttcccgggatcattaccgttattgacactgaaactgtgggcgagggccaggtcctggtgagcgaggattctgatagcgacggaatagtcgcacacttccccgctcacgaaaaacccgtgtgttgtatggcatttaatacaagcggcatgcttttagtgaccaccgatacactgggacatgacttccacgtctttcaaattttaacacacccctggagctcatctcagtgcgctgtccaccacctgtacaccttgcaccgaggggaaacagaagcaaaagttcaggacatctgcttttcccacgattgccgctgggtggtcgtcagtacactgcgcgggacaagtcatgtgttcccgattaatccttatggtggacagccttgtgtgaggacccacatgagcccgcgcgttgtgaacagaatgtccaggtttcaaaagagtgccggattagaggaaatcgagcaggaacttacaagcaaacaaggaggaaggtgttctcctgtaccaggattatctagctcacctagcggtagcccactgcacgggaaattgaactcgcaggactcttataataacttcaccaataacaatcctggcaatccccgtctatcacctctgccctccttgatggtggttatgcccctggcccaaataaaacagcctatgacacttggaactataacaaagcgtactggcaaggtgaagcctcctcctcagatttcaccctctaaatctatggggggggagttttgcgtggcagccatattcggcacctctaggagctggttcgccaataatgccggcctgaaacgggaaaaagaccagtctaagcaggtggtggttgaatcgctgtacatcatctcttgctatggcacactcgttgaacacatgatggaacctaggccgctctctaccgctccaaagatcagtgatgatacccccctggagatgatgacctcacccagagcaagttggactttagttagaacgccgcagtggaacgagctacagcccccgttcaacgccaaccacccactcttgcttgccgccgacgctgttcagtattaccagttcctcctcgccggcttagtgcctccaggaagcccagggccgataacaaggcacggatcatatgatagcctggcctctgatcattcaggccaggaagatgaggagtggctgtcccaggtggagatcgtgacgcatactgggccccatcggcggctatggatgggccctcagttccagttcaaaactattcatccctcaggacagacaactgtcatctcctcctcttcgagcgtgctgcaaagccacggaccatccgacacaccccaacctctcctggatttcgacaccgacgatctggatctcaattctctacgcattcagcccgtccggtctgatcctgtctccatgcccggaagctctagaccagtaagcgaccggcgcggcgttagcactgttatcgatgccgccagcggcactttcgatagatctgtaacacttcttgaggtatgcgggtcctggccagagggattcggtctcaggcacatgtcttcaatggagcacacggaagagggactgagagagcgactggcagacgctatggcagaaagcccatcacgcgatgtcgtgggctccggcacagaacttcagagggaaggaagcattgagaccttgtctaacagcagtgggagcacctctggatccatccctcgcaattttgatgggtatcggtctccgctgcctacgaatgaatctcagcctctttcattatttccaacagggtttccatag

SEQ ID NO: 25215 - DNA, 2160 bp, Artificial Sequence
  Description of Artificial Sequence: Synthetic coding sequence
atgggcttcagcaacatggaggacgacggccccgaggaggaggagcgggtggctgaacctcaggccaactttaatacccctcaggcgctgagatttgaagagctcctggctaacctgctgaacgagcagcaccagatagccaaggagttattcgagcagctgaagatgaaaaaaccatctgctaaacagcagaaggaagttgaaaaagtgaaaccccagtgtaaggaagtccaccagactctcatcttagatccagctcagaggaaaagactacaacagcaaatgcagcagcatgtacagctgctcacccagattcatcttctggcaacttgtaatccaaatctaaacccagaggcatcctcaacacgtatctgtttgaaggagctgggcaccttcgcacagagcagcatcgccttgcaccaccagtacaaccctaagttccaaaccctgtttcagccgtgcaaccttatgggggccatgcagctgatcgaggacttttcaacacatgtgtctattgattgctctccacacaagactgttaaaaagacagcgaacgagttcccatgcctgcctaaacaggtggcatggatcttggccacctctaaggtcttcatgtatccagaattgcttccagtgtgcagtcttaaagccaagaaccctcaagacaagatcctgtttacgaaggctgaagataataaatatctgttgacatgcaagacggcacggcagcttaccgtgcgcatcaaaaacctcaatatgaacagagcaccagacaatatcattaagttttacaagaaaacgaagcagctccctgtcttggggaaatgttgcgaggagatacaaccacatcagtggaagcctccaatcgagcgcgaagaacaccgcctgcccttttggctgaaggcatccttaccttctatacaggaggagctccggcatatggccgacggcgctcgagaggttggaaatatgacaggaacgacagagattaactctgaccagggattggagaaggacaattccgagcttggcagcgaaacgcggtacccattgctgctaccgaagggtgtggtgctgaaactgaagccagtggccgatcgctttcccaaaaaggcttggcgacagaaacgatcctccgtgctgaagccactgctaattcagccttcccctagcttgcagcccagtttcaacccaggaaagacacctgcacagagcacccacagcgaggctccaccaagtaaaatggtacttagaatccctcaccccatccagcccgcaacagtgctgcagaccgttcctggagtgcctcctctgggcgtatcagggggggaaagcttcgaatctcctgcagctctccccgcgatgccccctgaggctaggactagctttcctctctcggagagtcagaccttgttgagttccgcccctgttccaaaagtgatgatgccttctcctgcatcatccatgtttagaaagccctatgtccgtcgaagaccctccaagagaagaggcgcgagagccttcaggtgcataaagccggccccggtgatccaccccgcctcagtcatattcaccgtacccgctacaacagtgaaaatagtatcactcggcgggggatgcaacatgatacagccagtcaacgccgctgtagcccagtccccacagacaattccaatcgccactctcctggtaaatccaacatccttcccatgccctctgaatcagcctctggtggcctccagtgttagtcccctgatcgtttcaggaaatagcgtaaatctgcccatcccttccactcctgaggacaaagctcatatgaacgttgacatcgcatgtgccgtggcggacggggaaaatgcttttcagggcttggagccaaaactggaaccacaggagctaagccctctctccgctacagtgtttccaaaagtggagcactcacctggccccccgccagtggataaacagtgccaggaaggcctgagtgagaattccgcctatcgctggactgttgttaaaacagaagaaggcaggcaggcgcttgagcccctcccccagggtattcaggagtctctgaacaactcgtcgccaggggatttggaggaggtggtgaagatggagccagaggatgccacagaagagatctccggctttctctag

SEQ ID NO: 25216 - DNA, 324 bp, Artificial Sequence
  Description of Artificial Sequence: Synthetic coding sequence
atgagcgtgctgcggcccctggacaagctgcccggcctgaacaccgcaacaatactgctggtcggcactgaagacgctctgctgcagcagctcgctgattctatgcttaaggaagactgcgccagtgaattaaaagttcaccttgcaaagagccttcctctcccttcaagtgtcaacaggccaagaattgacctcatcgtttttgtcgtgaatcttcacagtaagtatagcttgcagaacactgaggaatccctacggcacgtggatgcctccttcttccttggaaaggtgtgttttttggctaccggaggaggccggctctag

SEQ ID NO: 25217 - DNA, 1599 bp, Artificial Sequence
  Description of Artificial Sequence: Synthetic coding sequence
atgttcgtgctgggcatccccctgtgccccgccctgagcttcagcggcggagatgatagtcagacccagttgtttgtgtcaagtaaggacgtgatcaaggagattgaggattttgattccctggaggcgctgagactagagggcaataccgtcggagtggaagcggccagggtgatcgctaaagccctggagaagaagtcagaattgaaacgctgccactggtcggacatgtttactggacggctgaggactgagatccccccggctctgatttccctcggcgaagggttaatcactgctggggctcagttagttgaactcgacctctccgacaacgcctttggcccggatggtgtccaaggcttcgaagctctcctgaaaagcagtgcttgctttacactccaagagcttaaattgaacaattgtggtatgggaatcggtgggggaaaggtcatcggcactctagaagaggtccatatgccgcagaacgggatcaatcaccctggtatcaccgctctggcacaggccttcgcagtgaaccctttacttcgcgtgattaatctcaacgataatacattcacagaaaagggcgccgttgctatggccgaaaccttgaagacactgaggcaggtcgaggttattaattttggggattgtctggttcgatctaagggagcagtggccattgctgatgctattagaggcggcctccccaaactcaaagaattaaatctatctttctgtgagataaagagggacgcagccttggctgtggccgaggctatggcagataaggcagaactggagaagttagacctgaatggcaacacgctgggggaagaggggtgcgagcagctccaggaggtcctggagggctttaatatggccaaagtgctggcctcccttagcgatgatgaagacgaagaagaggaagaagagggcgaagaagaggaggaggaggcagaagaggaagaggaggaagatgaggaggaggaggaagaggaagaggaggaggaagaggaggaaccccagcagaggggacagggcgaaaagtccgccactccaagcaggaaaatccttgacccaaacactggggaaccagcacctgtgctgtcctccccaccacccgcagatgtgtcaactttcctggccttcccaagcccagagaaactgctgagactcggccccaagagttccgttttaattgctcagcagactgatactagcgatccagagaaagtcgtgtctgcgtttttgaaggtttccagtgtgttcaaagatgaggctacagttagaatggcggtccaggatgctgtggatgccttaatgcagaaagcattcaatagtagctcattcaactccaacacattcctgactcggctccttgtacacatgggcctgctcaagagcgaggataaagtgaaggccattgcaaacctctacgggccattgatggcgctaaaccacatggtgcagcaagactactttcccaaggccctggccccgcttttattggctttcgtcactaaaccaaattccgccctggaaagttgttcttttgccaggcattctttactccagaccctgtacaaagtttag

SEQ ID NO: 25218 - DNA, 1383 bp, Artificial Sequence
  Description of Artificial Sequence: Synthetic coding sequence
atggacagcgagctgatgcacagcatcgtgggcagctaccacaagcccccagagcgcgttttcgtgcccagctttacccagaatgagccttcacagaattgtcacccagccaatctcgaagtcacctctcctaaaattcttcacagtcccaacagtcaggctcttattctcgccctcaaaaccctccaggagaaaatccaccggctagagctggagagaactcaggcagaagataatcttaatatcctgtctcgggaagccgctcagtataagaaagcgttggagaacgaaactaacgaacggaatcttgcccaccaggaattgatcaagcagaaaaaagacatcagcattcaattgtcatccgcccagagcaggtgcacattacttgagaaacagcttgaatatacaaagagaatggtgttgaacgtggagagagaaaagaatatgatcctcgagcaacaagcccagctgcagagggaaaaagagcaggatcagatgaagctgtatgccaaactggagaagttagatgtattagaaaaagagtgcttcagactgaccacaacccagaaaacagccgaggacaaaatcaaacacctggaggagaaattgaaggaagaggagcaccagcgtaaactatttcaggataaagcctcggagttgcaaacaggcctcgagattagcaagattatcatgtcttccgtctcaaatctgaagcattctaaagaaaaaaaaaagtccagcaagaaaactaagtgcataaaaaggaggcctccttggcaaatctgctccaaattcggcgctctgccgttcgtggctgagaagatgaggcagcatagggatccccatatcctccagaagccatttaatgtcacagagactcgttgtctgccgaaacctagccgcacaacgtcctggtgcaaagccattcctcctgatagtgagaaatcaatttccatttgtgataacctctccgagttactaatggctatgcaagacgaattggatcagatgtcaatggaacatcaggaactactcaaacagatgaaagagacggaaagtcattcagtgtgcgatgatatagagtgcgaactggagtgtctgctgaaaaagatggagatcaaaggagaacagattagcaaactgaagaaacatcaggactctgtctgcaagctccagcagaaagtccagaactctaagatgagtgaggcttccggcatacagcaggaggactcctatccaaaaggatccaagaacatcaagaattctccaagaaaatgtctgaccgatacgaacctctttcagaagaattcgagttttcaccctatacgtgttcacaacctccaaatgaaactgcgcagagatgatatcatgtgggaacagtag

SEQ ID NO: 25219 - DNA, 567 bp, Artificial Sequence
  Description of Artificial Sequence: Synthetic coding sequence
atgaccgcccccagctgcgccttccccgtgcagttccggcagcccagtgtgtctggtctctcccagatcactaaaagtttatacattagtaacggcgtcgctgctaacaataaattaatgctgtcgtccaaccagatcacaatggttatcaatgtgagcgtcgaggtggttaataccctgtatgaggatatccagtacatgcaggtcccagtagcggattcccccaactcccggttgtgtgattttttcgatccaattgccgatcatatacactccgtcgagatgaaacagggccggacgctgctccattgcgctgcgggcgtgtccagatccgcggccctgtgcctcgcatacctgatgaaatatcacgctatgtccttgctggacgctcacacttggacaaagtcctgcagaccaataatccggccaaacagtggtttctgggagcagctcatccactacgagtttcagctcttcggtaaaaacaccgtgcacatggtgtcatctcctgttggcatgattcccgatatttacgaaaaggaggtaaggctaatgattcctctatag

SEQ ID NO: 25220 - DNA, 1596 bp, Artificial Sequence
  Description of Artificial Sequence: Synthetic coding sequence
atgaacaagaccaaccaggtgtacgccgccaacgaggaccacaactcccaattcatcgacgattacagtagctccgacgagtccctaagcgtatcccattttagcttttcaaagcaatcacaccggccacgcacaattcgagaccgcacctcctttagctctaagttaccttcccacaacaaaaaaaacagcactttcattccgcggaagccaatgaaatgctctaatgaaaaggtcgtaaaccaagaacagtcctatgaatctatggacaaatttctagatggggtccaggaagtcgcctatatacacagcaaccagaacgtaatcggaagctcaaaggctgagaatcatatgagtaggtgggcagcccacgatgtgttcgaactgaagcagttttcccagctgcccgcgaacattgccgtgtgttcgagtaagacctacaaggagaaagtggacgccgacacattgccacacactaagaaaggacagcagccctccgaagggtcaatttcacttccgctctacatctccaatcccgtgaatcaaaaaaagaagaaagtataccatactaaccagactacatttattataggagagacaccaaaggggatccggaggaaacagttcgaggagatggccagctatttcaattcttcttctgtgaatgagttcgcaaaacacatcaccaacgcaaccagcgaagagcggcagaagatgctgcgggacttttacgcctcccagtacccagaagttaaggaattctttgttgactcagtgtcacagtttaacaattctagtttcgaaaagggagaacagcgcacccggaaaaagagcgacaagcgcgagagccttatcaagcctaggctgtcagacagcgagacattatcattcaaggattctactaacaagatcagtcaggtgtgctctctgaagacatataaacgcaaatctgtaaaatttcaaaaccacatcagctatcgcgaagaggtgtttttcaacgatgccgaaactaaaaaatccccagtttcctctacccaagaaatcgactccggcaaaaattcacaggccagtgaggacacagtgaccagccggtcacttaactctgagtccgaaacccgcgaacgcaggctcgagaacaccatgaaagaccagcaggacctcacccggaccggaataagcaggaaagaacccttgctgaagctggaaaataagaagattgagaatcccgtactggaaaacacaagcgtgatcagccttctgggggatacctcgatcctggacgacctgttcaaatcccacggtaatagccctactcagctacccaagaaggttctgtctggcccaatggagaaggccaaacaacgaccaaaggacttttgggacattctgaacgagcaaaacgatgagtctctttcaaaactgaccgatctagcagttatcgaaacactgtgcgagaaggctccactcgcagcaccatttaaaagacgggaagagccagcgacaagcctgtggaaatccaacgaaaagtttctttggaagaaatttagccccagcgataccgacgagaatgctaccaacactcagtctactacctag

SEQ ID NO: 25221 - DNA, 1089 bp, Artificial Sequence
  Description of Artificial Sequence: Synthetic coding sequence
atgaccggccacacccggagcagcctgccccggtgcaccggcatcgtcctgttgatcaagctgcgatttagtgaacgtctgacaggacatttgcacgctcagggaaccccgccctatgtaatcaatcttgatcctgccgttcatgaggttccatttccagccaacatcgacatacgtgacactgttaaatataaagaggtcatgaagcagtatggcttagggcctaatggcggaattgtgacaagcctgaatctgttcgctactcggtttgaccaggtgatgaagtttatagagaaggcacagaacatgagcaagtacgtgctgatcgataccccaggacagattgaagttttcacctggagcgcctccggaaccatcataactgaagcgctggcctcctcttttcccaccgtcgttatatatgtgatggatactagccgctctaccaatcccgtgacctttatgagtaatatgctgtatgcttgttcgatcctgtacaagactaagctgcccttcatcgtcgttatgaacaaaactgatatcatcgatcacagctttgctgtggagtggatgcaggatttcgaggcttttcaggacgcccttaaccaggagacgacgtatgtatctaatctgacgcgctctatgagtctcgtcctggatgaattttattccagtctcagagtcgtcggcgtgtcagctgtcttgggtacaggtctcgacgagctcttcgttcaggtaactagtgccgcggaagaatacgagagagagtatcgaccagagtacgagaggctgaagaagtcacttgcgaacgccgaatcacagcagcagagagaacagttagagaggctgcggaaggacatggggtccgtggcgctcgacgcgggcacagctaaggattcactctctcctgtccttcacccgtctgatctgatcttaacaagggggacgctcgatgaagaggatgaggaggctgactccgacaccgatgacatcgaccatcgggtcacggaggagagtcacgaagagcccgccttccagaactttatgcaggagagtatggcgcagtattggaagagaaacaataagtag

SEQ ID NO: 25222 - DNA, 1338 bp, Artificial Sequence
  Description of Artificial Sequence: Synthetic coding sequence
atgagcgtgacctacgacgacagcgtgggcgtggaggtgagcagcgattctttttgggaggttggtaattataagcgtaccgtcaaacgtatcgacgacggccacagactgtgctccgatcttatgaactgccttcacgagagagcacggatcgaaaaggcctatgcgcagcagcttactgaatgggccaggcgctggagacagctcgtggaaaagggccctcaatacggaactgtagagaaagcctggatggcctttatgagcgaggccgagagggtgtccgagctgcacttagaggtgaaggccagcttgatgaatgacgattttgagaaaattaagaattggcagaaggaagctttccacaaacagatgatgggcggtttcaaggaaaccaaggaggccgaagatgggttccggaaggcccagaagccgtgggcaaaaaaactcaaggaggtagaagccgccaaaaaggcccaccatgccgcttgtaaggaggagaagctcgctatctcgcgcgaggcgaatagtaaggccgaccctagcctcaacccagagcagctcaaaaagttgcaggataaaatcgaaaagtgcaagcaggacgtgttaaaaacaaaggagaagtatgaaaaatctctcaaggagttggatcaaggaaccccccagtacatggaaaatatggaacaagtattcgagcaatgtcagcagtttgaagaaaagcggttgagattctttagagaggtgctactcgaggtacagaagcatttggacctaagtaacgtagcaggttacaaggctatttatcacgaccttgaacagtcaatcagagctgcagacgctgttgaagatctgcgctggttcagagctaatcacggaccaggaatggccatgaactggccacagtttgaagaatggagcgccgacctgaacaggacactgagccgccgtgaaaaaaagaaggccacggacggggtcaccctgactgggatcaaccagacaggagatcaatctctaccaagtaaaccctcgtccgtgtcaagttatgaaaaaacccagtcatatcccacagattggtcagacgatgaatctaacaacccatttagctctacggatgcaaacggggattccaaccctttcgacgacgatgccaccagtggcacggaagttcgcgtgcgggcactgtatgattacgagggccaggagcacgacgagctgtcgtttaaagctggtgacgaactgactaaaatggaagacgaagacgaacagggttggtgtaaaggccggctggataacggtcaggtgggactgtacccagccaattatgttgaagcgattcagtag

SEQ ID NO: 25223 - DNA, 405 bp, Artificial Sequence
  Description of Artificial Sequence: Synthetic coding sequence
atgagcgagaacgccgcccccggcctgatcagcgagctgctgctgcagcgcggaacaaccaaagttgccacaggtctcgttctcaatcgtgatcaacgactggcttgggccgaaaactctattgactttatttcacgtgaactctgcgcccacagtattcggaaattgcaggcccacgtgctcttaattaaagcggtgcacgggtactttgatagtcgccagaactatagcgaaaaagagagcctctctttcatgatcgatacgatgaagtccaccctgaaggagcagttccaattcgtggaagtgcccggtaatcactgcgtgcacatgtctgagccgcaacatgtagccagcataatttccagctttctgcagtgtacccatatgcttcctgcccagctgtag

SEQ ID NO: 25224 - DNA, 321 bp, Artificial Sequence
  Description of Artificial Sequence: Synthetic coding sequence
atgagcagcaagggcagcagcaccgacggccggaccgacctggccaatggtagcctctccagcagccctgaagagatgagcggggcagaagaagggagagagacctcatcgggaatcgaggtggaagcaagcgatctctccctttccctcaccggagatgacggcgggccgaatcgaaccagcacagaatctcggggtaccgacactgagagcagcggcgaagataaagactctgactccatggaagacaccggccactactccatcaacgacgagaaccgcgtccatgatcgcagcgaggaagaagaggaggaggagtag

SEQ ID NO: 25225 - DNA, 990 bp, Artificial Sequence
  Description of Artificial Sequence: Synthetic coding sequence
atggtgcggaccaagacctggaccctgaagaagcacttcgtgggctaccccaccaattcagactttgagctcaagaccgccgaactgcctccccttaaaaatggagaagtgctgctagaggccctgttcttgactgtggatccgtatatgcgggtggcggccaaaagattgaaggaaggcgacaccatgatggggcagcaggtggcaaaggtggtcgaaagcaagaacgtggctcttcccaagggaaccatcgttcttgcttcccccggttggaccactcattcgatatccgatggaaaggacttggaaaaactcctcacagaatggccggataccattccattaagtctcgctctaggcactgttggaatgccaggtcttacagcctacttcggcctgctcgagatctgcggggtgaagggtggcgagacagtcatggtcaacgcggcagcaggcgccgtcggctctgttgtagggcagattgcaaaactgaagggctgcaaagtggtcggggccgtgggcagcgatgagaaggtggcatatctgcagaagctggggtttgatgtcgtgttcaattataagactgtcgaaagcctcgaagaaaccttaaaaaaagcatcccccgatggctatgattgttactttgacaatgtcggaggagaattcagcaacaccgtgataggccagatgaaaaaatttgggaggatcgctatctgcggggcgatctccacatataatcgaactggcccactgccgccaggccccccaccagagatcgtgatataccaggagttgaggatggaagcctttgtcgtatatcgatggcaaggggatgccagacagaaagctctgaaggaccttctcaaatgggtattggaagggaagatccagtacaaggaatacatcatagaaggcttcgagaacatgccagcggccttcatggggatgttgaaaggggacaatctcggcaaaactattgtgaaagcttag

SEQ ID NO: 25226 - DNA, 2235 bp, Artificial Sequence
  Description of Artificial Sequence: Synthetic coding sequence
atggccaccgccaacttcggcaagatccagatcggcatctacgtggaaatcaaaagatctgatgggcgcatacatcaggccatggtgacctctctgaacgaggacaatgagagtgtgacagtagagtggatcgagaatggcgataccaaagggaaggagattgatcttgaatcaatttttagccttaatccagacctcgtgcctgatgaggagattgaaccttctcctgaaactccaccaccaccagcctctagcgctaaggtaaacaagattgtaaagaacagaaggacagttgcctcgatcaagaatgatccaccctctagggacaatagggtggtcggctccgccagggccagaccaagccaatttcccgagcagtcctcaagtgcccaacagaacggtagcgtctcagacatcagccccgtccaggcagcgaaaaaggagttcggcccaccctccagacgtaagtcaaactgcgtcaaggaggtggaaaagcttcaggagaaaagggaaaagcgtcgattgcagcagcaggagctgagagagaagcgagcgcaggatgtggatgcaaccaatcccaactatgagataatgtgcatgatccgagatttcaggggtagcttagattataggcctctgacgactgctgatccgattgatgaacatcggatctgcgtctgcgtgagaaaacgacctctgaataagaaggagacacaaatgaaagaccttgacgttattacaattccaagcaaggacgtggttatggtacacgaacccaaacagaaagtggacctgacgcgctatcttgaaaatcagacatttcggtttgactatgcctttgatgattcggcaccaaatgagatggtctatcgatttaccgcccggcccctcgtggagactatatttgagagggggatggcaacatgtttcgcatacggccagaccggcagcggaaagactcatacaatggggggcgacttctctggcaaaaatcaggattgttcgaaaggaatatacgcactggctgcacgtgacgtgtttctcatgctgaaaaagccaaattataagaagctcgaactgcaggtgtacgccactttcttcgaaatttattcaggcaaggtttttgacctcctgaacaggaaaactaagctccgggtcttggaggacgggaagcagcaggttcaggtagtcgggctgcaagagagagaggttaagtgtgtggaggacgtactgaaactgatagacatcggaaatagctgtcgtacctccggccagaccagtgctaacgcacactcatccagatctcatgccgtgttccagatcattctaagaagaaagggcaagttacacggcaaattcagtcttattgacctcgcaggaaacgagcggggagctgatacttctagcgccgaccgtcagacacggttagaaggggccgaaatcaacaagagtctgctggcactgaaagagtgcatcagagccctggggagaaacaaacctcacactccatttagagcttctaaattgacacaggtgctgcgggattcattcatcggggaaaattctagaacttgtatgatcgcaacaatttcccccggtatggcctcatgtgagaacacattaaacaccctgaggtatgctaatcgcgtcaaggagttcggcatcagccctagcgacatccccttcagccaaggaagtggcagcagaccagatctgagcccatcttacgagtatgatgatttcagccccagcgttacgcgggtcaaggagcttactgtagatcctaccgctgccggcgacgtaaggcctatcatgcatcacccacccaaccagatcgatgacctggagactcagtggggcgtagggagctccccccaaagagatgatctgaaactgctgtgtgaacagaacgaagaggaggtcagtcctcagctcttcacgttccacgaagccgtgagccagatggtggagatggaggagcaggttgtcgaggaccaccgcgctgttttccaggagtccataagatggctggaggatgaaaaagcgttgctggaaatgacagaagaagtggattacgatgtggactcatacgcaactcaacttgaggcaatcctggagcagaagatcgacattcttacagagctaagggacaaggtgaaatcgttcagggctgcactgcaggaggaggagcaggcctcaaagcagattaatccaaagcggccaagggctctttag

SEQ ID NO: 25227 - DNA, 1701 bp, Artificial Sequence
  Description of Artificial Sequence: Synthetic coding sequence
atgttcgtgagcgacttccggaaggagttctacgaggtggtgcagagccagagggtattgctgtttgtggctagcgacgtcgacgctttgtgcgcatgtaagattcttcaggccctcttccaatgcgaccatgtgcagtataccttagttccagtgtcaggctggcaagagcttgaaacggcctttctggagcacaaagagcagtttcactattttatccttatcaactgtggggccaatgtcgaccttttagacattctgcagccagacgaggatacgatctttttcgtctgtgatacccaccggcctgttaatgtggtaaacgtgtacaatgatacacaaatcaagctgttgatcaagcaagatgatgacctggaagtcccagcttacgaggacatctttcgcgacgaggaggaggacgaagaacattcaggcaatgatagtgatggttccgaaccttccgaaaaaagaacccgcctggaggaggaaatagtggaacaaactatgagacgccggcaacgaagggagtgggaggccagaaggagagacatcctcttcgattacgaacagtatgagtatcacgggacttcctctgccatggttatgttcgagctcgcttggatgctgtctaaagatttaaacgacatgctgtggtgggcgattgtggggctgaccgatcaatgggttcaagataagatcactcagatgaagtacgtgacagatgtgggggtgctgcagcgtcacgtaagtagacacaaccaccgaaacgaagatgaagagaatacgcttagtgttgattgtactcgtatctctttcgaatacgatcttcgactggttctgtatcaacactggtccctgcacgattcgctgtgcaacacttcctataccgccgcacgttttaagctgtggagcgtccatggccaaaaaagattacaggaattccttgcggacatggggttacccctgaagcaggtgaagcagaaatttcaggcaatggacatctcccttaaagagaacctgcgggagatgatcgaagaaagcgctaacaagtttggcatgaaagacatgagagtgcagactttctctatccatttcggcttcaaacacaaatttttggcttccgacgtagtttttgcaaccatgtcgctcatggagtcacccgaaaaagatggatctggaaccgaccattttatccaggctctggactccctgtcacgctccaatctcgacaaactgtaccatgggctggagcttgcaaagaaacagctgcgggccacacagcagacaattgccagttgcctgtgcacaaacttagtgatttcccagggcccgtttctctactgctccctgatggaggggacacccgatgtcatgctgttcagcaggcccgccagcctctcactgctcagcaagcatctgctcaaatcttttgtgtgcagcaccaaaaacagacgctgcaagctgctccccctggttatggcagccccactctctatggagcatgggaccgtaactgtggttggcatccctccggagaccgacagctcagatcgaaagaatttcttcgggcgcgctttcgagaaggcagcagaatctacgagtagtcgtatgttacataatcatttcgacctaagcgttatagaattgaaagctgaggatcgatcaaaatttctcgatgctcttattagtctattaagctag

SEQ ID NO: 25228 - DNA, 798 bp, Artificial Sequence
  Description of Artificial Sequence: Synthetic coding sequence
atgtgcaccagcgagaccttccaggccctggacaccttcgaggcccgccatgacgatatagtgctggcatcttatcccaagtgcgggtctaactggatcctgcacatcgtgagcgagctcatctacgccgtgtctaagaagaagtacaagtaccccgagtttccagttcttgagtgcggagattcggagaagtaccagcgcatgaaggggttccctagtccacgcattctcgcgacccacttacactatgataagcttcctgggagtatctttgagaataaggcgaagatattggtgatatttcgcaacccaaaggacactgcagtgtcatttcttcacttccacaacgatgtgccagacattccaagctatggctcatgggacgaattttttaggcagttcatgaagggacaggtgtcttggggacggtatttcgacttcgccataaattggaacaagcatttggatggtgacaatgtaaagttcatcctctatgaagacttaaaggagaacctggctgccggcatcaaacagatcgcagaattcctaggtttcttcctgacgggcgagcagatccagacaatttcggttcaaagcaccttccaggccatgcgagccaagagccaagacacccacggtgcggtgggaccgttcctgttcagaaagggtgaggtcggggactggaagaatttgttttctgaaatccagaaccaagagatggatgaaaagttcaaggaatgcctcgccggtacctccctgggggctaagctgaagtatgagtcatattgtcagggatag

SEQ ID NO: 25229 - DNA, 2808 bp, Artificial Sequence
  Description of Artificial Sequence: Synthetic coding sequence
atgaacgaggccatggccaccgacagcccccggcggcccagccggtgtacagggggagtggtggtgcggccacaggcagttacggaacagagctacatggagtctgtagtcacattcctccaggatgtcgtgcctcaggcgtacagtggaactccactgaccgaggagaaagagaagatagtctgggtccgcttcgagaacgctgacttaaacgataccagccgcaatctagaattccatgagatccattctacaggaaatgaaccgcccctgctcatcatgatcggttactccgatggtatgcaggtgtggagtattccaattagcggagaagcacaggaattgttctcagtgagacatgggcctatcagagcagcaaggatcctgcctgccccccaatttggcgctcagaagtgtgacaacttcgccgagaaaagacccttgctgggcgtgtgcaagtccattgggtctagcggaacttctccaccatactgttgcgtggatttatacagcctgcgaactggtgagatggttaagagtatccaattcaagacgcctatttacgatcttcattgtaacaaacgcatcctggtggtggtcttgcaagaaaagatcgccgcctttgattcctgcacattcaccaagaagtttttcgttacgtcctgttatccatgccccggtcctaacatgaatcccattgctctggggagccggtggctcgcctatgctgaaaacaagctgatccgctgccaccagtctagaggcggagcctgcggcgacaacatccagtcatatacggccactgtcatttccgcagccaagacactcaaatcagggctcactatggttgggaaagttgtaacacagctgaccggcacgttgcctagtggtgtgactgaagatgacgtggcgatccatagcaactctaggcgctcaccgctggttcccggcatcatcacagtgattgatactgagacggtcggggaaggccaggtactggttagcgaagatagcgactctgatggtatcgtcgcccattttcccgcgcatgaaaaacctgtatgttgcatggcttttaatacttcaggaatgctgctggtcaccaccgacacactgggccacgatttccacgtctttcagatactaacccatccctggagctcatcacagtgcgcggtgcaccatttatacaccctgcaccggggggaaacggaagctaaagtgcaggacatttgttttagccatgactgccggtgggttgtcgtcagcacgttacgcgggacatcccatgtatttcctattaatccctatggagggcaaccgtgcgtcagaacgcacatgagcccgagggtggtcaatcgcatgtctaggttccagaaaagcgccggtttggaggagatagagcaggaactcacttctaaacagggtggccgttgctcccccgtgcccggattgtcttcatcaccttctggctctcctctgcacgggaaactaaattcacaggatagttacaacaacttcacaaataataaccccggcaatcccagattgagtccccttccatcgctgatggttgtgatgccactggcccaaattaaacagcccatgacacttggaacaattactaaacgaacgggaaaggttaagcctcccccacaaatttcaccaagcaagagcatggggggggagttttgtgtcgctgcaatcttcggaacctcccggagttggtttgcgaacaatgccgggttgaagagggagaaggaccagagcaaacaagtggtagtggagtccttgtacataatttcctgttatggcacactggtggagcatatgatggagcctagacccctttccactgcccccaagatcagtgacgatacgccgctcgagatgatgacctccccacgggcttcctggacactggtccggactcctcagtggaatgaattgcaaccaccttttaatgccaatcatcccctgctgctagccgccgacgccgtgcagtactaccaatttttactagctggacttgtgccacctggctctcccggccctatcacccggcatggaagctatgattctctggcttctgaccattctgggcaggaagacgaagagtggctgtctcaggtggaaatagtcacccacacgggacctcaccggaggctgtggatgggacctcaattccagttcaaaaccattcatcccagcgggcagacgactgtcataagttcgagctccagtgtgctccagagccatggcccaagcgataccccccagccccttctggactttgacaccgacgatctcgatcttaactctctacgcatccagcccgtgcgctctgatcccgtcagtatgcctggatcaagtcgacccgtgtccgacagacggggcgttagcacagtcattgatgccgcgtccggaacctttgaccgttcggtcacactattagaagtttgtggaagctggcccgaaggattcggcctccgacacatgtcttctatggagcatactgaggaaggactgcgggagcgcctggccgacgccatggcggagtctccatccagagatgtggtgggctccgggaccgacactgccttagatgtggccgtgaaaacattcccgcctgagagacacgttgcagtcaagtgctttgaactgcagagggaagggtcgatcgagacactttctaatagcagcgggtcaacatccggcagcatcccccgtaacttcgacggctacagaagtcctctgcccacaaatgaatctcagccactgtcattatttccgaccggcttcccttag

SEQ ID NO: 25230 - DNA, 615 bp, Artificial Sequence
  Description of Artificial Sequence: Synthetic coding sequence
atggaggccgccggcagccccgccgccaccgagaccggcaagtacatcgcctctacacagcgccccgatgggacttggcgcaaacagcgcagagtcaaggagggatacgttcctcaagaggaagttcctgtttacgagaacaagtatgtgaaattcttcaagtccaaaccggagttacctccaggcctctctccggaggcgacagcccctgttaccccctccaggccagaagggggagagcctgggctgtcaaaaaccgccaaaagaaacctgaaacgtaaagagaagaggcgccagcagcaagagaaaggcgaggccgaggccttgtcccgcaccttagataaggtgtcccttgaagagacagcccaactgcccagcgccccgcagggctctagagcggcacccacagctgcctccgatcagcccgattccgcggctaccaccgagaaagctaagaaaatcaagaacttaaagaagaaacttcgtcaggtggaagagctgcagcagcggatccaagcaggagaagtctcacagccctcaaaagaacagttggagaagttagcacgccggagggctctggaggaggaacttgaagatttggagttgggactgtag

SEQ ID NO: 25231 - DNA, 663 bp, Artificial Sequence
  Description of Artificial Sequence: Synthetic coding sequence
atgagcagcggcaactaccagcagagcgaggccctgagcaagcccactttttcagaagagcaggccagtgccttggtcgaatctgtgtttggcctgaaagtcagcaaggtccgtcctttaccatcttacgatgaccaaaacttccacgtctacgtgagtaagactaaggacggtccaacagagtacgtccttaaaattagcaacactaaagccagcaaaaatccggacctcatcgaggttcagaatcacatcataatgttcctcaaggccgctggctttccgacagcctcagtctgccacacgaagggcgataatacagcctcgcttgtgagcgtagattcaggatcagagattaaatcttatctggtgcgtctgttgacatatctgccgggacgacctatcgcagagcttcctgtgtcccctcagctcctgtacgaaattgggaaattggctgccaaactggataaaactctgcagagattccaccatcccaagttaagcagtttgcaccgcgaaaacttcatatggaatcttaagaatgtccccttgctggagaaatacctctacgctctgggacaaaatcgcaatcgcgaaattgtcgagcacgtgattcacctctttaaggaagaggtcatgaccaagctgagccactttcgggagtag

SEQ ID NO: 25232 - DNA, 603 bp, Artificial Sequence
  Description of Artificial Sequence: Synthetic coding sequence
atgagcagcgacagcatggaccagccccggaacccctgcgagaacgaacctctcactcccggctaccacgggttccctgctagagacagtcaggggaaccaggaacctaccactacgccagacgcaatggtgcagcctttcacaaccatccccttcccaccaccacctcagaacggaattcctactgaatacggcgtcccccatacccaggactacgccggacagacaggagagcacaacctgacgctctatggcagcacgcaggcacatggggagcagtcctcaaactccccctcgactcaaaatggtagtctcacacaaactgaggggggagctcagacagacgggcagcagagccaaacacagtcttcggagaacagcgagtctaagtcgaccccaaagcgcctgcatgtgtccaacatccccttcaggtttcgggatccagatctgagacagatgttcgggcagtttggaaaaattctggacgtggagattatttttaacgagaggggctctaaagggttcggcttcgtgacttttgagaactcagcggacgccgatcgggccagagagaaacttcacggtacagtggtggagggctag

SEQ ID NO: 25233 - DNA, 387 bp, Artificial Sequence
  Description of Artificial Sequence: Synthetic coding sequence
atggcccccgccaagaagggcggcgagaagaagaagggccggagcgccattaacgaggtggtcacacgggagtacaccattaacatacacaagcggatccacggggtcgggttcaagaagcgcgcgcctagggccctcaaggagataagaaagttcgcgatgaaagaaatgggcactcccgatgtgagaatcgataccaggctcaacaaggccgtgtgggctaagggcatccgtaacgtgccatacagaattcgagtgcgattgagtcggaaacgaaatgaagacgaagattcacctaacaaattatatacgctcgttacatacgtgccagtgacaacattcaagataagcgttctgaactcagttaccgtggcaaagtctccctag

SEQ ID NO: 25234 - DNA, 393 bp, Artificial Sequence
  Description of Artificial Sequence: Synthetic coding sequence
atggcccccgccaagaagggcggcgagaagaagaagggccggagcgcaattaatgaggtggtgacccgcgaatatacaattaacattcataagcgaattcacggcgtcgggttcaaaaaacgggctccaagagcccttaaagaaattcggaagtttgctatgaaggaaatgggaacgccggacgtgcgcattgatacacgcctgaacaaagctgtttgggctaaaggcataaggaatgtaccttaccggatccgggttagacttagtcgcaaacggaatgaagacgaagatagcccaaataagctttatactcttgtgacttacgtgcccgttacaacatttaaaagcctccagaacgacgatctgttcaagaccgattgccatcatcagtag

SEQ ID NO: 25235 - DNA, 1524 bp, Artificial Sequence
  Description of Artificial Sequence: Synthetic coding sequence
atgtggctgaccagctaccccagccccaacttccccgtgagcgtgctgcagaacggcgtgaaaatgaccaacgaagcccctaagggtcttcgcgcaaatatcattcgatcttacctgatggatcccatctcagatccagagttcttcggtagctgtaaaaaaccagaagaattcaagaaattgctatacggcctctgtttctttcatgcactggtacaggagcgtaggaagttcgggcctctcggctggaacatcccatacgaatttaatgaaacagatttgcgtattagtgtccagcaacttcatatgttcctgaatcagtacgaggaactgccctacgaggccttaaggtacatgaccggtgagtgcaattacggtggtcgcgtcactgacgattgggacaggcggacattaaggtcgatcctgaacaaatttttcaatccagagctcgtcgagaactctgactataaatttgacagcagcggaatatatttcgttccgccttctggtgaccacaaaagctacatcgagtatacaaaaacgctgccgcttactccagctccggaaattttcggcatgaacgctaacgccgacatcaccaaagatcagtcagaaacacagctcctctttgacaatattctgttgacacagagcagaagtgccggggccggggccaagagcagtgatgaggtggtgaacgaggtcgcctccgacattctcggaaaactgccgaataattttgacatcgaggccgcaatgcggaggtacccaaccacctacacccagtccatgaacacagtcctggtccaagagatgggccggtttaacaagctgttaaaaacaatcagagattcctgcgtgaacatacaaaaagctattaaagggctcgctgtgatgtcaacagaccttgaagaggtcgtcagttccattcttaacgtgaagatacctgaaatgtggatgggcaagagctatcccagtcttaagccactgggctcctatgtgaacgattttctggcacgcctcaaattcctgcagcagtggtacgaggtgggcccccccccggtgttttggctgtccggcttcttctttacacaggcatttctgacgggtgcccaacagaactacgctcgcaagtacactatcccaatcgatctccttggattcgattatgaggtaatggaggacaaagagtataaacatccacctgaggacggtgtgttcatacacgggcttttcctggatggagcctcgtggaaccgtaagatcaagaaactcgccgagtcccatccaaagatcctgtatgacacagtgcctgttatgtggctcaagccctgtaagagagcagatatccccaagcgaccgagctatgtcgctcctctgtacaagacaagtgagagacgaggggtgttatccaccactggccatagcaccaacttcgttatcgccatgactttgccatcggatcagcctaaagagcactggatcggtcgcggagtggccctgctctgtcagttaaactcctag

SEQ ID NO: 25236 - DNA, 1683 bp, Artificial Sequence
  Description of Artificial Sequence: Synthetic coding sequence
atggccgccagcgccaagcggaagcaggaggagaagcacctgaagatgttaagggatatgaccggcctccctcacaaccggaagtgttttgattgtgatcagaggggaccaacatatgtcaacatgaccgtgggatcattcgtttgcacctcctgtagtggatctttaagaggccttaatccccctcacagagttaagagcatctcaatgactacattcactcagcaggagatcgaattcctgcagaagcatggcaatgaagtatgcaagcaaatctggcttggacttttcgatgaccggagttccgcgataccagacttcagagacccccaaaaggtcaaagagtttcttcaggagaagtatgagaagaaacgctggtacgtgccacctgagcaggcgaaggtggtggcaagcgtgcacgcctccatctctgggtctagcgcgtcttccacatccagcactccagaggtcaaacctctgaagagtctgctgggggactccgcgcccacccttcatctgaataagggcaccccaagtcagtcaccggtggtcggcaggagtcaaggccaacagcaggagaagaagcagtttgacctgttgtctgatctgggttctgacatttttgccgcgccagcaccacaaagcacagcaaccgctaattttgccaattttgcccacttcaattcccacgcagcacagaactccgcaaacgctgatttcgctaactttgatgcttttggccagtccagtggctcgtccaacttcggaggtttcccaaccgctagccattctcccttccagcctcaaacaacaggagggtctgccgcttctgtgaacgcgaatttcgctcacttcgacaacttccccaagtcatcctctgctgatttcggaacattcaacaccagccagtctcaccagactgcaagcgccgtgtccaaggtcagtacaaataaggcgggactgcagacagcagacaagtatgcggcattagccaatctggataacatctttagcgctggtcaaggaggtgatcagggtagtgggttcggcacgacaggaaaagcacctgttggctcagtggtgtctgtgcctagccagagtagcgccagcagcgacaaatacgccgccttagctgagctggacagcgttttcagctccgccgccacctcctctaacgcctatacaagcacctcaaacgcttcatccaacgtgttcgggacggtgccagtagtggcctcagctcagacgcagcctgcctcctccagcgtacccgcaccctttggggctacccccagtactaacccatttgtggcggctgctggtcccagcgtggcatccagcaccaatccattccagacaaatgccaggggagccaccgcagccaccttcgggacggccagcatgagcatgcctactgggtttggtactccggccccttattccctgccaacttcgttcagtggtagcttccaacaaccagcattcccggctcaagctgcattccctcagcagactgcctttagccagcaacccaacggcttcgctgctttcggacagacaaagcctgttgtcactcctttcggacaggtagctgccgcgggcgtgtcttcaaacccattcatgacaggggcccctactggccaatttccaactgggtcctcctcgactaacccatttctctag

SEQ ID NO: 25237 - DNA, 2403 bp, Artificial Sequence
  Description of Artificial Sequence: Synthetic coding sequence
atgagcagcctgggcgccagcttcgtgcagatcaagttcgacgacctgcagtttttcgaaaattgcggagggggatccttcggttcagtatatcgggccaaatggatctctcaggacaaggaagtcgctgttaaaaaattgcttaagattgagaaggaagccgaaattctgtccgtgctttcgcatcggaacattatacagttttatggagtaatattggagcctccaaattacggcatcgtgacagagtatgctagcctaggaagcttgtacgattatatcaacagtaacagaagtgaagaaatggatatggatcacattatgacctgggccacagatgtggccaagggcatgcactaccttcacatggaggctcctgttaaagtgatccatcgggacctgaagtcacggaatgtcgtcatcgctgctgacggtgtgctcaagatttgcgattttggagccagtaggttccacaatcacaccacccacatgagcctggtaggcacttttccctggatggcaccggaggtgattcagagtctgcctgttagcgagacttgtgacacctattcctatggcgtcgtgctgtgggagatgctaactcgggaagtgccttttaaaggccttgaaggcctacaggttgcctggttagttgtcgagaaaaacgagcgtctcactattccaagctcttgccccagaagcttcgccgagttgctccatcagtgctgggaggccgacgccaagaaacgcccctcctttaagcagatcatttcgatcttggagagtatgagtaacgataccagcctaccagacaaatgcaattcgttcctccacaacaaggccgaatggcgatgtgaaattgaagccaccctcgagcggctgaagaaactagagagggatctgtccttcaaagagcaggagttaaaggagcgagagcgccgcctcaagatgtgggagcagaagttgaccgaacaaagtaatacacctctgctccccagtttcgaaatcggagcatggaccgaagatgacgtgtactgctgggtgcagcagctcgtcaggaaaggagattcctccgcagagatgagcgtgtatgctagcttgttcaaagaaaacaatatcacaggaaaacgactgttgctgctggaggaggaagatctgaaggacatgggcatcgtttctaagggccacataattcacttcaagagtgccatcgagaagctgacgcatgattatatcaacctgttccattttcccccgctcattaaggactccggtggagaacccgaagagaatgaagaaaaaatcgtcaacttggaacttgtattcggattccatctgaagcccggtacagggccacaagactgcaagtggaaaatgtatatggaaatggacggcgatgagatcgcaattacctacatcaaagacgtgacatttaacactaacctgccggacgcagagatccttaaaatgactaaacctcctttcgtgatggaaaaatggatcgtgggaatcgcaaaaagtcagacagtagagtgtacagttacttatgaatcggatgtgcggactcctaaaagcaccaaacacgtgcactcaatacaatggtctagaacaaagcctcaagatgaagtcaaggccgtgcagttggctatccagaccctgttcacaaacagtgatgggaaccccggcagcagaagtgatagcagtgcagattgccagtggttggacacccttaggatgcggcaaatagcttctaatacctcattgcagagatcacagtccaacccaattctggggagtccattcttctcacatttcgatggccaggactcatatgcggcagctgtaagaaggccacaagtgccaatcaagtaccagcagatcacgccggtcaaccagtccaggtctagctcccctacgcaatatggtctgactaaaaacttttctagtctgcatctcaattcgagagattcaggattcagtagtggaaacacggacacctccagcgagagaggccgctattccgaccgaagccgaaataagtacgggagggggtctatttccctcaactcttcgccccgcggaaggtattctgggaagtcccaacacagcacaccgtcccggggtcgttatcctggaaaattctaccgcgtttctcagtcagccctgaaccctcatcagtcccctgactttaagaggagcccccgggatctccatcaaccaaacactatccccggcatgccgctgcatccggaaactgacagtagggcaagcgaagaagattctaaagtgtccgaaggcggctggacaaaggtggagtatcgcaagaagccccatcggccgagcccagcgaaaaccaataaagaaagggctaggggggatcaccggggctggaggaacttctag

SEQ ID NO: 25238 - DNA, 144 bp, Artificial Sequence
  Description of Artificial Sequence: Synthetic coding sequence
atggacgaccagcaggccctgaacagcatcatgcaggacctggccgtactccacaaggcttcccgccccgccctgagcctccaggaaacaaggaaagccaagtccagctctccaaagaaacagaatgacgtgagggtaaagtag

SEQ ID NO: 25239 - DNA, 1272 bp, Artificial Sequence
  Description of Artificial Sequence: Synthetic coding sequence
atggtgagcttcatgaacaaccagaagcagcagaagcccaccctgtccggccagagattcaagacacgtaaacgtgatgaaaaggagaggtttgatcctacacaattccaggattgcatcatccaaggtttgaccgagacaggcacggatcttgaggcagtagccaaattccttgacgcctctggcgcgaaacttgattaccgcagatatgccgagactttatttgacatactggtcgccggtggcatgttggcccccggcggcacactggccgatgatatgatgcgcactgatgtctgcgttttcgcggcccaggaggaccttgaaacgatgcaagctttcgcccaggtgtttaacaaattaataaggcgctacaagtacctggaaaagggctttgaggacgaagttaagaagctcttgctctttctcaaaggatttagcgaaagtgaaagaaataaactggccatgcttacaggtgttctgctggctaatgggaccctgaacgcctcaatactgaattccctgtataatgaaaatctcgtgaaggaaggtgtttctgctgcttttgccgtgaaactgtttaagtcctggatcaatgaaaaagacattaacgccgttgccgctagcctgcgaaaggtatccatggacaaccggctgatggagctgttccccgctaataagcagtcggtcgaacacttcaccaagtactttactgaggcgggattaaaagaactgtccgagtatgtgcgaaatcaacagaccatcggagctagaaaagagctccagaaagagttacaggaacagatgagccggggcgatccatttaaggatattattttatatgtgaaagaagaaatgaagaagaacaatatacccgaacccgtggtgattggtattgtatggtctagcgtcatgtctacggtcgaatggaataaaaaggaggagctcgtggccgagcaggctatcaaacacctgaaacagtactcacccctgctggcggcttttaccactcagggccaatctgaacttacactccttcttaagatccaggagtattgctacgacaatatccacttcatgaaagctttccagaagattgtggtcttgttttataaagcagaagttctgtcagaggaaccaatcctgaagtggtacaaggacgctcacgtcgccaagggcaaatccgtatttttggagcagatgaaaaagttcgtcgaatggttgaagaacgctgaggaagagtcggagtcggaagcggaagaaggagactag

SEQ ID NO: 25240 - DNA, 1119 bp, Artificial Sequence
  Description of Artificial Sequence: Synthetic coding sequence
atgagccggcggcggttcgactgccggagcatcagcggcctgctgactaccacacctcagataccgataaaaatggagaatttcaacaatttttacatcctgactagcaaagagctggggcgcgggaaatttgccgtcgttagacaatgtattagcaaaagcactggacaagaatatgcagctaaattcttgaaaaaaaggagaagaggacaggactgtagggcagaaatcctccacgaaatcgctgtcctggagctggccaagagctgtcccagagtcattaacctgcacgaggtttacgaaaacactagcgagatcattttgattttggagtatgcagcaggtggtgaaatattttcactgtgccttccagagctcgcagagatggtgagtgagaacgatgtgataagactcattaagcagatcctcgagggagtgtattatctgcaccagaacaacattgtacacctggatctcaagccccagaacatactactttcgagcatctatcccctcggcgacataaaaatcgtggattttggaatgtccagaaaaatcggccatgcctgcgaactgagagaaatcatgggaacacctgagtatttggcaccagaaattcttaactacgacccgatcacaaccgcaaccgacatgtggaatatcggcattattgcttatatgctgctaacccacacatcaccatttgtgggagaggataaccaagaaacctacttaaatatctcacaggtcaacgttgattatagcgaagaaaccttttcctccgtgtcccaactggcaacagactttatccagtccctcctggtgaaaaatcccgagaagcgccctaccgccgagatttgcttgagccacagctggctgcaacagtgggactttgagaatctctttcaccccgaggagacatcctcaagttcccagacacaggaccacagcgtgcgatcctctgaggataagacctccaaaagttcatgcaacgggacgtgcggcgatagggaagacaaagaaaacatccctgaggactctagcatggtgagcaagaggttccggtttgacgacagcctgccaaaccctcacgaactggtgtctgacctgctctgttag

SEQ ID NO: 25241 - DNA, 912 bp, Artificial Sequence
  Description of Artificial Sequence: Synthetic coding sequence
atgatggacgtgagcggcgtgggcttccccagcaaggtgccctggaaaaaaatgagcgccgaagaactcgagaatcagtattgcccttcccgctgggtggttcgcctcggggccgaggaggctctgaggacctattcacagattggcatcgaggcaaccacgagagctcgagccacccggaagtctctgctccacgttccatacggagacggcgagggggagaaagttgatatatattttcctgacgaatcctccgaggctctgccctttttcctgttttttcacggtggctactggcagtcgggctcaaaggacgagtctgctttcatggtccatcctttaacagcccaaggagtggctgttgtaatcgttgcgtacgggattgcccccaaaggcactctggaccatatggtcgatcaagtgactcgatccgtggccttcgtccagaagagatatccaagcaacaagggaatttacctgtgtggacactctgctggagcccatctcgctgccatgatgttgctcgccgattggacaaagcatggagtgacaccaaatctgcggggcttctttctggtgtccggtgtctttgatctggaaccaatcgtctacactagtcagaacgtcgctctgcagctgacactcgaagacgcccaacgcaactcgccccaactgaaagtagcccaagcccagccagttgacccaacatgccgcgtcctagtggtggtgggccagtttgactcacccgagttccaccgccagagctgggagttctaccaaaccctctgccagggtgaatggaaggcatctttcgaggaactccacgatgtcgaccattttgaaatcgtcgaaaacctgacacagaaggataacgtcctaacccagattatcctgaagacaattttccaatag

SEQ ID NO: 25242 - DNA, 684 bp, Artificial Sequence
  Description of Artificial Sequence: Synthetic coding sequence
atggccctgcacgacatggaggacttcaccttcgacggcaccaagaggcttagtgtgaattacgtgaaggggatccttcagcctaccgacacctgcgatatctgggataaaatctggaattttcaggcaaaacccgatgacctgctgatctcaacataccctaaggccgggacgacatggacacaggagatcgttgaacttatccagaacgagggggacgtggaaaagtctaagagggcccccacacatcagaggtttccttttctagagatgaagatcccttcccttggcagcgtttgctgggggtcctggcacgagcacgtgaaaggatggtgggaggccaaggacaagcatagaattctgtacctgttttacgaggatatgaagaaaaatccaaagcatgagatccagaaactggccgagttcatcggtaaaaagctggacgacaaggtgttagataagatcgttcattatacatctttcgatgtgatgaagcagaatcctatggctaactatagctctatacccgccgaaatcatggaccatagcatttcccctttcatgcgaaagggcgctgtaggcgattggaagaaacacttcacggtagcacagaacgagcgcttcgacgaagactataagaagaaaatgaccgatacaaggttgaccttccatttccagttctag

SEQ ID NO: 25243 - DNA, 366 bp, Artificial Sequence
  Description of Artificial Sequence: Synthetic coding sequence
atggcccccgccaagaagggcggcgagaagaagaagggccggagcgcgattaacgaagttgtaacacgcgagtataccatcaatatccataaaaggatccacggtgtgggatttaagaaacgcgctccacgcgcgctgaaggagatacggaagtttgccatgaaagaaatgggaacccccgacgtgaggattgacactcgactcaataaagccgtgtgggcgaagggaatcaggaacgtcccttataggatacgagtgagactgtcgaggaagaggaacgaagacgaagactctcctaacaagctctacaccttggtcacctacgtccccgtgactacctttaagagcaagttttccataccctag

SEQ ID NO: 25244 - DNA, 267 bp, Artificial Sequence
  Description of Artificial Sequence: Synthetic coding sequence
ctgagcttccgggccgacagcgcccacgccagcatggtgaacgtgcctaaaactcggcgaaccttctgtaaaaaatgcgggaagcaccaaccgcataaggtaacgcagtacaaaaagggtaaggattctctgtacgctcaagggaagcggaggtacgataggaaacagtctggatatgggggacagacgaagcccattttcagaaagaagcttcaccagaactgtattgaaccaaatctgcctcccagagcccagcaaagtccttag

SEQ ID NO: 25245 - DNA, 582 bp, Artificial Sequence
  Description of Artificial Sequence: Synthetic coding sequence
atggacagcaccctggccgtgcagcagtacatccagcagaacatccgcgcagactgtagcaatattgacaagatactggaacccccggaaggccaggatgagggagtgtggaagtacgagcacttgcggcagttttgtcttgagctgaacggcttggctgtaaaactgcagtcagaatgtcatccagacacctgcacccaaatgacagccactgagcagtggatttttttgtgcgcagcacacaagactcccaaggaatgtcccgcaatcgattatacacggcataccctggacggggccgcatgcctgctgaactctaacaagtattttccatcccgcgtgtctattaaggagtctagcgttgccaaattggggagcgtctgcaggcggatttacaggattttctcccacgcctattttcaccataggcaaatatttgatgagtatgagaacgagacttttctgtgtcaccggttcacaaagtttgttatgaagtataacttgatgagcaaagacaaccttatcgtacccatcctcgaagaggaagtccaaaacagtgtctcaggtgagtctgaagcatag

SEQ ID NO: 25246 - DNA, 4137 bp, Artificial Sequence
  Description of Artificial Sequence: Synthetic coding sequence
atgagcctggagcgggagctgcggcagctgagcaaggccaaggccaaggcgcaacgcgcagggcaaaggagagaggaagctgcactgtgccaccagcttggggagctacttgctggccatggacgttacgcagaagctctcgagcaacactggcaggagctgcagctgcgggaacgggctgatgaccctctgggctgtgccgtggcacacagaaagatcggggaacgcctggcggagatggaagattatcccgctgctcttcagcaccagcatcagtacctcgagcttgcccactccctgcgtaaccataccgaactacagcgggcatgggccaccatcggcaggactcacctggacatttatgatcactgccaatccagggacgcgcttctgcaggcccaagccgctttcgagaaatcattggcgatcgtggatgaagagctggagggcacactggcacaaggggagttgaacgaaatgaggactaggctgtatctcaacctgggcctgacctttgaatcacttcagcagacagccttatgcaacgattacttccgcaagagcatatttttggctgaacagaaccatctgtacgaagacttgttcagggccagatacaatttaggaactatccactggcgcgctggacagcatagtcaggccatgaggtgtttggagggcgctcgcgagtgtgcccacaccatgaggaagagattcatggagtcagaatgttgtgtagtgattgctcaggtgttgcaggatctgggtgactttctggccgcaaagcgagctctgaaaaaggcctaccgcctggggtcacaaaagcctgtgcagcgcgccgccatatgtcagaacctgcaacacgtcctggccgtggtgcggctccagcagcaactagaagaggcagaaggaagggatccccagggggccatggtaatttgcgagcagctgggcgatctgttctcaaaagccggcgacttccctcgcgctgcggaggcctaccagaaacagcttcggttcgctgagctgttggaccgccccggagctgaaagggccatcattcatgtctctctagcgaccacgctgggcgacatgaaggatcaccacggggccgtcagacattacgaagaagagctgaggttacgctcaggcaatgtgctcgaagaggcaaaaacctggttaaacatcgccctctccagggaggaggcaggtgacgcatacgagctactcgccccctgtttccagaaggccctctcttgcgcacagcaagcccagcggcctcagttgcagcggcaggtcctgcagcatctgcacaccgttcagctgagacttcaacctcaggaggctcccgaaacagaaacgagactgcgtgaactgtcagtggccgaggacgaggacgaagaggaggaggctgaggaggctgccgcaacggctgagtccgaggccctcgaagctggcgaagttgagctttctgagggcgaggacgacacagacggactcacaccgcaactggaggaggacgaagaattgcagggtcatttaggccgacgcaaggggtccaagtggaaccgcaggaatgacatgggtgaaaccctgcttcaccgagcctgtattgagggacagttgaggcgggtgcaggatcttgtgaggcagggtcacccactcaatcctagggattactgcggctggacaccattacacgaagcctgcaattatggccacctggagattgtgagattccttttggaccacggcgcggctgttgacgaccctggaggccaggggtgcgaggggattacaccactgcacgacgctctgaattgcgggcacttcgaagtggctgaactgctgctggaacgtggagctagcgtgacgcttagaacacggaaaggtctgtctcctttggaaacgctacagcaatgggtaaagctctatagacgcgatctcgatttagaaacaagacagaaagctcgggctatggaaatgctcctccaagcggcggcttccgggcaggatccccactcgtcgcaagccttccacactccttcctctctgctgttcgatcccgaaaccagcccaccactgagtccctgccctgagccccccagcaattcgaccaggctaccagaggcgtcacaggcccacgttcgcgtgagtccaggccaggccgcaccagccatggccaggccacgtcgatctaggcacgggccagccagctccagcagctcttcggaaggagaggactcggccgggcccgcccggccatctcagaagagaccaaggtgctcagccaccgcacagagagttgccgcctggaccccaggcccagcctctaaccgggaggccgccacagcctctacgagtagggccgcataccaggcagccatcaggggagtggggtccgcccaatcccggcttggtcccggacctccaagaggtcactctaaggccttggccccccaggccgccctcatacctgaggaggagtgcctcgctggtgactggctagaactcgacatgccactgacacgcagcaggcgaccccgcccgcgcggcacgggcgacaacagaaggccctcgtctacctccggaagcgattctgaagaatctagacccagggcccgggccaagcaggttcgtttgacttgtatgcagagttgcagcgcccctgtgaatgccggtcctagcagcctggcaagcgaacccccaggatccccatctaccccaagagttagcgaacccagcggagacagtagcgccgctggccagcccctgggccctgcaccacccccccccattcgggttcgcgtccaggttcaagatcatctttttctcatcccagtgccccactcgagtgatacacactccgtggcctggctggctgagcaggccgcgcaaaggtattaccagacatgtggactgttaccccgtctgaccctgcgcaaagagggcgctctgctagctcctcaggacctgatcccagacgtgcttcaaagcaatgatgaggtgctggccgaggttacatcatgggacttgcctccccttacagaccgataccgtagggcctgtcaatcgttggggcagggagagcaccagcaggtcttacaagcggttgagttacaaggactaggtctgagtttctcagcatgcagcttggctttggaccaggcacagctcaccccattattgagagcactcaaactacacacagctctccgcgagctcaggctggccggaaatcgcctcggggataagtgcgtggcagaattagtggctgctcttggcaccatgccaagccttgcgttgctcgatctgtcatccaatcatctgggaccggagggtctaaggcagttggccatgggactgcccggccaggccacgctccagtccctcgaagagctggatctaagtatgaatcctctcggagacggatgtggacagtctctggccagcttgctccacgcttgccctctcctctcaaccttgcgcctgcaggcctgcggtttcgggccgtcattcttcttgagtcaccagactgcccttggatccgccttccaggacgcggagcatctgaagacactctccctatcatataacgccctcggtgctccggcgcttgctcgcaccctccaaagtcttcctgccggaacgctgctccacctggaactctcgtcggtcgctgctggaaaaggcgattccgacctgatggagcccgtatttagatatctggcaaaagaaggttgtgctctcgcccacctcacactctccgcaaatcatctgggtgataaagcggtgagagatctgtgccgctgcctgagtttatgcccctcactgatatccttagacctgtctgctaaccctgagattagctgcgcttcccttgaggagctcttaagcacccttcagaagcgacctcagggtctttcattcctcgggttgtccggctgcgccgtccaaggtccactcgggctcgggctttgggataagatagcagcccagctgagggaactgcagctgtgttctcggcgcctgtgcgccgaagaccgggacgccctgcgacagcttcagcctagcaggccggggcccggggaatgcacactcgatcacggttctaagctcttttttcgtcgcctctag

SEQ ID NO: 25247 - DNA, 1218 bp, Artificial Sequence
  Description of Artificial Sequence: Synthetic coding sequence
atgaactaccagcagcagctggccaacagcgccgccatccgggccgaaatacagagattcgagagcgtgcaccccaacatctatagcatctatgaattgctggagcgggtcgaagaacctgttcttcaaaaccagattcgggaacatgtaatcgccattgaggacgcctttgtgaactcccaggaatggactctttcgcgcagtgtgcccgaactcaaggtcgggatcgtcgggaatcttgcatctggtaagtctgccctggtacacaggtatctaactgggacgtatgtgcaggaagagagtcctgaggggggtcggtttaagaaagagatagtagttgacggtcagtcctatcttttattgattagggacgaaggcggtccgcccgaagctcaattcgcgatgtgggtagatgccgtgatctttgtattttcattggaggacgagatttcatttcaaacagtttatcattattattctaggatggccaactaccgcaatacttcagaaattccactggtgttggtaggcacacaggacgctatttcaagtgcgaatccacgcgtgatcgatgatgctagggctcggaagttgagtaacgacctcaaaaggtgtacttattacgaaacttgcgctacatatggcttaaacgtagaacgcgttttccaggacgtagcccagaagattgtcgcaacacgtaaaaagcagcagctgtccattggcccctgcaaatctctgcccaactccccctcacactcctccgtatgttcagcacaagtgagcgcagtccatatatcacagaccagtaacggaggcggatccctctcggattatagctccagcgtgccttccaccccctcaacaagccaaaaagaactccggatcgatgtcccacccacagccaacacacccacccccgttagaaagcagagcaaacgacgtagtaatctgtttactagcaggaaagggagtgaccctgacaaggaaaagaaggggctagagtcccgagctgactctatcgggtcaggcagggcaattcctattaaacagggcctgccgttcttcgtgctcgcgctgaccgcatccacttacctgcgccccgcaggagcgagggcccgacaatctagcccttggccaggcccgagaggcggccagacttccccccactgcgctgaaggtcctcagtccgctcagctgtcaggggccatgatgaactag

SEQ ID NO: 25248 - DNA, 1245 bp, Artificial Sequence
  Description of Artificial Sequence: Synthetic coding sequence
atggccgccgccccccccagctactgcttcgtggccttcccccccagggccaaagacggccttgtggtctttgggaagaattctgcaaggccaagggacgaggttcaggaagtagtgtacttctcggccgctgatcatgaacctgaatctaaggtggaatgcacgtatattagcatcgaccaggtgccccgaacctatgccatcatgatctcccggccggcatggctgtggggggccgagatgggggccaacgagcatggcgtttgcatcgcgaatgaggccattaatactcgggagccagcagcagagatagaggccttgctgggtatggacctagtgaggctcgggttagagcgtggagagacagctaaagaggcgctagacgtgattgtttcactgctagaagaacatggacaggggggaaattacttcgaagacgccaactcttgccattcttttcagtctgcgtacctcatagtggacagggacgaggcctgggttctcgaaactatcgggaagtattgggccgcagaaaaggtgaccgagggtgtaaggtgcatatgtagtcaactctccctgactacaaaaatggatgcggaacacccagagcttcggtcatacgcacagtctcaaggatggtggactggagagggggagttcaatttcagcgaggtgttttctcccgttgaggatcacctagattgcggtgctggcaaggacagtctggaaaagcaagaggaaagcataactgtgcagaccatgatgaatacgttgagagataaggcgagcggcgtctgcatcgactctgaattctttctgaccacagcttccggagtgtctgtcctgccgcagaatcgaagcagcccttgcatccactactttaccggcacccctgacccatcccggagcatatttaagcccttcatttttgttgatgatgttaagttggtgcctaagacacagtctccctgctttggtgacgacgacccggcaaaaaaagaacctcggttccaggaaaaaccggatcggcgtcacgagctatacaaagcgcacgaatgggccagggctatcattgagtccgatcaggaacaggggcgaaaactcagatccacaatgttggaactggagaagcaagggctcgaggccatggaggagatcctaacttcaagcgagccactggatcccgctgaagttggtgatttgttctacgattgtgtggacacggaaatcaagttcttcaagtag

SEQ ID NO: 25249 - DNA, 645 bp, Artificial Sequence
  Description of Artificial Sequence: Synthetic coding sequence
atgggccccctgccccggaccgtggagctgttctacgacgtgctgtcgccgtattcgtggctcggcttcgaaatcctgtgccgttatcagaacatctggaatattaacctccagcttagaccaagcctgattactggtataatgaaagactctgggaataagccaccaggcctgctcccacgcaagggactgtacatggcaaatgacctaaagcttctccgccatcatctccaaatacccattcattttccgaaggatttcctttcagtgatgctggagaaaggctccttgtcagctatgcgctttctgactgccgtgaacctggagcaccccgaaatgctggaaaaggcctctagagaactgtggatgagggtgtggtcaagggctgccgagaaagctgggatgtcagcagaacaggcgcagggattgttggagaaaatcgctacaccaaaggtgaaaaaccagttgaaggagaccacagaggccgcctgtaggtacggcgcttttgggcttccaataacagttgctcacgttgatggtcagactcatatgctgttcggctcagatcgcatggaactattggcacatctattgggcgaaaaatggatgggtcctatccctcctgccgtgaacgccaggctttag

SEQ ID NO: 25250 - DNA, 4206 bp, Artificial Sequence
  Description of Artificial Sequence: Synthetic coding sequence
atggccgacaccgacctgttcatggagtgcgaggaggaggagctggagccgtggcagaaaatatccgacgtgattgaagatagcgtggtcgaggattataacagcgttgacaagaccactaccgtctcagtatctcaacagccggtcagcgctcctgtgcccatcgctgcccacgctagcgtcgccgggcatcttagcacttctaccacagtaagcagctcaggcgctcagaacagcgattcaaccaagaagactttggtgacacttatcgctaataataacgccggaaaccccctggttcagcaagggggccagccactcatcctgactcagaatccagcccccggcttgggaacaatggtcacccagcctgtgctccggcctgtgcaggtgatgcaaaacgctaaccatgttacatcctcacccgtggcttcccagcctatattcatcactacccaaggctttcctgtgcggaatgtaaggccggtgcaaaatgcaatgaatcaggtcggtatagttttgaacgtccagcagggtcaaacagttagacccataaccctcgttccagctcccgggacccaattcgtcaagcctacagtaggcgtaccacaggtgttctcccagatgactccagtgcggcccggaagtaccatgcccgtccggccaacgactaatacctttaccacagtgatacctgcaacactaactatcagatcgacagtccctcagagtcagtcccagcaaacgaaatcaaccccgtccacatcaacaacccccactgcgactcagcctacgtctctcgggcaattagccgttcagtcgcctggtcagagtaatcaaaccacaaatcccaagctggtttcaatcgcttcatttgtcacggtcaaacggccgggggtgaccggtgaaaactcaaatgaagtagcaaagctggtgaatactctgaacaccataccatcattagggcagtctccaggtcctgtggttgtgtctaataactcttccgctcacggttcccaacggacttccggccccgaatcaagtatgaaggtaacctcaagcatccctgtcttcgatttgcaggacgggggtcgcaaaatctgcccgcgatgtaacgcgcagtttagagttaccgaggccctccgaggccatatgtgctactgttgccccgagatggtggaatatcagaagaagggaaagtctttggattctgaaccatctgtgcccagtgccgcaaaacctccaagcccagagaaaactgctcccgtggcttccaccccatccagcacccccattcctgccctgtctccccccactaaagtccctgagccaaacgaaaacgtcggagacgctgtgcaaaccaagctgattatgctggtcgacgatttctattatgggagggatggcggaaaagtagcccaactaacgaatttcccaaaggtggccacatctttccgatgcccacactgtacaaaaagactgaagaataacatacgtttcatgaaccatatgaagcaccatgtggagttggaccagcagaacggcgaggtggatggtcatactatttgccaacactgttaccggcagtttagcacacctttccagctgcagtgccacttggagaacgtgcactcaccttacgaatctacaaccaagtgtaagatctgcgaatgggccttcgagagtgaacctctgtttctccaacacatgaaggacacccacaagccaggggaaatgccttatgtatgccaggtctgtcagtaccggtcttccttgtactcggaagtggatgttcacttcaggatgatccatgaagacacacgccatctactatgcccgtattgcctcaaagtttttaaaaacggaaacgcctttcagcagcactatatgagacaccagaagaggaatgtgtaccactgtaataagtgccgcttgcagttcttgtttgctaaagacaagattgagcataaactccagcatcataaaaccttcaggaaacccaaacagcttgagggacttaaacctggaacgaaggtgaccatacgggccagtcgaggtcagcctagaacagtgcctgtatcatccaacgacactccgcctagcgcccttcaggaggccgcccccctcacgagtagcatggacccacttccagtcttcctgtaccctcctgtccaacgctcaatccagaagagagcggtgagaaagatgtccgtgatggggcgacaaacttgtctagagtgttccttcgagatccccgatttccctaatcacttccccacgtacgtgcactgttctctatgtaggtatagcacctgctgtagtagggcttacgcaaaccatatgatcaacaaccacgtgccacgtaagtctccaaagtacctggccctatttaaaaatagcgtttctggaattaagcttgcctgcacctcctgtacatttgtgacctctgtgggggacgccatggcaaaacatctggtgttcaaccctagtcaccgcagttcttctatcctgcctcgcgggttgacatggatagctcactcacgacacgggcagacgagagaccgggtccacgataggaatgttaagaatatgtatcccccacctagtttccctacgaacaaggccgctaccgtaaaatctgccggcgccactcccgcagaacccgaggaattactaaccccgctggcccctgccttgccgtccccagctagcacagccactccccctcctacgccgacccaccctcaggctctagctctgcctcccctggccaccgagggcgcagagtgcctgaatgtcgacgatcaggatgaggggtcgccagtgacccaagaacctgaactagcaagcggcggaggagggagcggcggggtgggtaaaaaggagcaactgtccgtgaagaaacttcgtgtcgtgctttttgctctgtgctgtaatacagagcaggcagccgaacatttccgcaatccccagaggcgaattcggcggtggctgaggcggttccaggcatcccagggcgaaaacctggagggaaaatacctatccttcgaagctgaggaaaagctcgccgagtgggtactaacccagcgcgaacagcagctccctgtcaatgaggagactctgttccagaaggcaactaagattggtcggagcctcgaggggggatttaagatatcctatgaatgggccgtgcgatttatgctgaggcatcacctcacacctcacgcgcgccgtgctgtcgctcataccctgcctaaggatgtcgctgagaatgctgggctctttatagatttcgtgcagaggcagatccataatcaggatctcccattgtccatgatcgtggccatagacgaaatttcattgttcctggacaccgaggtcttgagttctgatgacagaaaggagaacgccttacagactgtcggtactggggagccgtggtgcgacgtggtcctggccattttagccgatggtacggtgctccctacacttgtcttctacagagggcagatggatcaacccgccaatatgcccgattccattctcttggaagcgaaagaaagtggctatagcgatgacgaaattatggaactttggtctacgcgggtttggcagaaacatacagcttgtcagaggagcaagggtatgctggtgatggattgtcatagaacccacctgtccgaggaagtgctcgccatgctgtccgcttcgtctactttacccgccgtagtgcctgccggctgcagtagtaagattcagcctttagacgtgtgtatcaaacgtactgtgaaaaatttcctgcacaaaaagtggaaggagcaggcccgcgagatggccgatactgcctgtgactcagacgtgttgctccagcttgtgcttgtctggcttggtgaggtattgggtgtgatcggggactgcccagagcttgtgcaaaggagctttctagtcgctagcgtgttgcccggacccgacggaaacattaactcgcctacacgcaatgcagacatgcaggaggagcttatcgcaagccttgaagaacaactgaagctctctggtgaacactctgagtcatcaacaccccgccctcgatcctcccctgaggaaactatcgagcccgaatctctgcaccagctgttcgagggcgaatcagagaccgagtccttctatggctttgaagaggccgatctcgacctgatggagatctag

SEQ ID NO: 25251 - DNA, 1398 bp, Artificial Sequence
  Description of Artificial Sequence: Synthetic coding sequence
atggagcccagcagcctggagctgcccgccgacaccgtgcagcggatagcggccgagctgaaatgtcaccccacagatgagagggttgccttgcatctggacgaagaggacaaacttcgccactttcgagaatgtttttatatcccaaaaatacaggatctgccacctgttgacctatcgctggtgaataaagatgagaatgccatttatttccttggcaactcgctggggctgcagcctaagatggtaaagacctatctcgaggaggagcttgataagtgggccaagatcgctgcttacggccatgaggtcgggaagcggccctggatcaccggtgatgagagcatcgtgggtctgatgaaggatatagtgggcgctaacgagaaggaaatcgccctgatgaatgcactgacagtgaacctgcacctactcatgctgagcttctttaaaccaacccccaaacgctacaagatcttgctggaagcgaaagcatttccaagcgatcactacgcaatcgagagtcagcttcagctccatggactcaatatcgaagagtcaatgagaatgataaagccgcgggagggggaggaaacactccgtatcgaagatattctagaagtgatcgagaaggaaggggacagtatagcggtcattctctttagtggcgtccatttttacacaggacaacacttcaatatcccggctatcacaaaagccggtcaggcaaagggctgttacgttggttttgatttagctcacgcggtgggcaatgttgagttatacctgcacgattggggggtagatttcgcttgttggtgctcctacaagtacctcaacgcaggtgctggtggaattgccggggcctttatccatgagaagcacgcccacacaattaaacctgccttagtggggtggttcgggcatgaactcagtacaagattcaagatggacaataaactccaactgattcctggggtctgtggcttccgtatttctaatccccctatccttcttgtatgttccctacacgcatctcttgagattttcaagcaggctaccatgaaagccctacggaagaagtcagtcctgctgactggctacctggagtatctgatcaagcacaattatggcaaagataaggcagcaaccaaaaaacccgttgtgaacattatcaccccatctcatgtcgaagaaaggggctgccaattgaccatcacattcagtgtccccaacaaggatgtgttccaggagttggagaaaagaggcgtggtgtgtgataaacggaacccaaatgggatccgggtggcccccgttcccctgtacaactccttccacgatgtatataagttcacgaacctcttgacctcaatcctggattccgccgaaacaaagaattag

SEQ ID NO: 25252 - DNA, 3210 bp, Artificial Sequence
  Description of Artificial Sequence: Synthetic coding sequence
atgtacctgctggacggcagcggcgagcccgccagcccccccgccgacgctatgccccggggcacacctccccgcaaaaccgtgtacagaataagtgtgactatggtgcggaaggagcagctcgccgctccgggatccggcggccccgatccccggccagttcgccggcctcggccggctcggtcccctgatgcccccggacgcctggaagaagaggcggaagaggctgaaggtgcagaggagcctgaaggtccccggcccagagcttgggacttccgtaccttcagaacacgttcgacgggccaattggaactgggacgactgcgcccctgtgctcgaggtctcgaaccagccgatctggcaggcagtgcgcccgccgaggaggaggggcggggatcacctgcttccggcagccctgacgttgaaggcgccagggcagcaccactgaggcggtccctgtctttcaggcattggagcggcccagaagccccacagggcaggacattagggggcggaaggaggcactcaagctcggggagcctagcctgggctccttgcgatgaggcggccgctgggactacattggagccagctaccgcaacccagcccgccagtgagaagcggaacacactggacgtgggagaggtgctcagtaaaaacgacgccctgtctgatctggagcggtgggagaggagtaagtccaagaatagaacgttggataactccgacctccaacgtctggaacgcgccagggccgcagcgggggccggggccgcctccgagcaccgtttgctgaggttcttctccgggattttcgcccggagagatggaggcccaggcggaggacccagcccccggagcggggcctcccgacctcggggctacttctctctgcgcagggcccctgccgaggcgcacagctcctccgcggagtctatcgacggaagccctaggcgcgatgccttcgtgaactcacaagaatggacactgagccgatccgtcccggagctcaaagtgggaattgtggggaacttggcctcagggaagtcggctcttgtccaccggtacctgaccggcacctatgtacaggaggaatcacctgagggtgggcgctttaaaaaagagattgtcgtggatgggcagtcctacttattgctgataagagacgagggtggccctccggaagcacagttcgccatgtgggtcgacgcagtgatttttgttttctctcttgaggacgaaatcagttttcagacagtctaccattattatagtcgaatggccaattatcggaatacgtcagaaataccacttgtgttggtggggacacaagacgcaatttcgtcggctaatccccgggtgattgacgacgcacgggcccgcaagctgagcaacgatctaaagaggtgcacctactacgagacatgcgcaacctacggactgaatgtcgagagagtttttcaggacgtagcccaaaaaatagtagccacccggaagaagcagcagctgagtatcggaccctgtaaatccttgcctaacagcccctcccattcaagcgtttgttctgctcaggtgagtgcagtgcatatctcccagacatccaacggcggtggatctctttccgactactcaagtagcgtgccctcaacaccatccacttcccagaaggagctgcgtatcgacgtaccaccgaccgcaaacaccccaactccagtccgaaaacagtccaaaaggagatcaaatctttttacaagccggaaagggagtgaccctgacaaggaaaagaagggtctggaatctcgggctgattctatcgggtctggccgcgccatcccaattaaacagggcatgctgctgaagcggtcaggcaaaagcctcaacaaggagtggaaaaaaaaatatgtgaccctgtgcgataatggagtgctcacataccacccgtcactccacgattatatgcagaacgttcatggcaaggagattgatctgctgcggacgaccgtgaaagtacccggtaaaagacctccccgcgccacctcagcttgtgcccccatcagctctccaaagactaatggcttatccaaggatatgtcatcgctccatatctctcctaatagtgatacaggactgggggacagcgtttgctccagcccatctatcagcagcacaacctcccccaaacttgatcctccacccagccctcatgcaaaccgaaaaaaacataggagaaagaaatccaccagcaattttaaagctgatggcctctccggtacggccgaagagcaggaagagaacttcgagtttattatcgtctccctgacaggacaaacttggcacttcgaagcaactacatatgaagagcgagatgcctgggtgcaagccattgaaagccagattttagcatcgctgcagagctgtgagtcctcaaagaacaaaagtaggctgacctcccagtccgaggccatggctctccaaagtatccgcaatatgcgggggaatagtcactgtgttgattgtgaaacacaaaatcctaattgggcttctctcaatcttggagccctgatgtgcattgagtgcagcggaatccaccgaaatttaggcacccacctgagtcgggttcgatcgctggacttagatgactggcccgtggaattgattaaagtgatgagttccattggcaatgagttggctaatagcgtgtgggaagagagttctcaaggccggactaagccttcagttgattcgactcgggaggagaaagagcgttggatacgtgctaagtacgaacagaagctgtttcttgcgcctctgccgtgcaccgaattaagcctggggcaacatctcctgcgtgcaactgccgacgaggatctaaggacggctattttgctcctcgcacacggatcaagagatgaagttaatgaaacctgtggggagggagatgggcgcacggcccttcaccttgcctgcaggaagggcaatgtggttctcgctcaactcctcatctggtacggggtggacgtgaccgctcgggatgcgcacgggaacaccgctctggcctacgcaaggcaggcctccagccaagagtgtatcgatgtgcttctccagtatgggtgcccagatgagcgcttcgtgctgatggcaaccccgaacctctctcgtcggaacaataacagaaacaatagctcgggacgggtaccaactattatctag

SEQ ID NO: 25253 - DNA, 1260 bp, Artificial Sequence
  Description of Artificial Sequence: Synthetic coding sequence
atgaacaaccagaagcagcagaagcccaccctgagcggccagcggtttaagactcggaagcgagatgagaaggaaaggttcgatcccactcaatttcaggattgcatcatccagggcttaacagagaccggaactgatttggaagcagtcgccaagtttttagacgctagcggagctaagctggactatcgcagatatgcagaaaccttatttgacatactcgttgcaggcggcatgctggcccctggaggaacccttgcggacgatatgatgaggaccgacgtgtgcgtatttgccgcacaggaggatctggaaaccatgcaggcttttgcacaggtgttcaataaactgatacgccgctacaaatatcttgagaagggatttgaggatgaggtgaagaaattgctgttgttcctaaagggatttagtgaatccgagaggaataagctggcaatgctgactggtgtgctcctggctaacggcacgctgaacgcctctattttgaatagcctgtataacgagaatctggtcaaggagggtgtctcagccgcttttgcagttaagctattcaaaagctggataaacgagaaagatatcaacgcagtcgcggctagccttcggaaggtatctatggataaccgcctcatggaattgtttccagcgaacaagcaatctgtggagcactttaccaagtactttactgaggctgggctcaaagaactgagtgaatacgttcggaaccaacaaaccattggcgctcggaaggagctccagaaagaactgcaggagcagatgagcaggggcgatcccttcaaggacattattctgtatgtcaaagaagagatgaagaaaaacaacataccagagccggtggtgatcggcattgtgtggtctagtgtcatgagtacagttgagtggaacaagaaagaagagctggtcgctgagcaggccattaaacaccttaagcagtattcccccttgctggccgcctttacaacacagggccagtctgagttaaccttattgctcaaaatacaggagtattgttatgataacatccattttatgaaggcctttcagaaaatcgtggtcctcttctataaggcagaggtgctgtccgaggagcccatcctgaaatggtataaagatgctcatgttgccaaaggaaagtctgtgttcttggaacaaatgaagaaattcgtcgagtggctgaagaatgccgaagaggagtccgaaagcgaagccgaagagggggattag

SEQ ID NO: 25254 - DNA, 2769 bp, Artificial Sequence
  Description of Artificial Sequence: Synthetic coding sequence
atgatcaccagcgccgccggcatcatcagcctgctggacgaggacgagccccagctaaaagagtttgctctgcataagctgaatgcggtggtaaacgacttttgggccgagatcagtgagtctgtggacaaaattgaagtgttatatgaagacgaaggattccgtagcagacagtttgcagcactcgtcgctagcaaggtgttctaccacctgggagcctttgaggaaagtctaaactacgctctgggggccggcgacttgttcaacgtaaacgataactctgagtatgtggagaccatcatcgccaagtgtattgaccactacactaagcagtgtgttgaaaatgcggacctgcccgaaggcgagaagaaacccatcgaccaaagacttgaaggaattgtgaataaaatgtttcaaagatgtctggacgaccacaagtacaaacaggcaatcgggatcgccctggaaacgcgacgcttggacgtgttcgaaaagaccattctggagtctaatgacgtccccggtatgcttgcgtatagtttaaaactgtgcatgtctctcatgcagaacaaacagtttcgcaataaggttctgcgagtgctcgtgaagatttacatgaatctggaaaagccggattttattaatgtctgtcagtgtcttattttcttagacgacccacaagcggtttctgatattttggaaaagttagtgaaagaggataatctgctgatggcctaccagatctgttttgacctgtacgagtcagcctcacagcagttcctttcgagtgtcatccagaatctcagaactgttggaacacctatagcaagtgtacctgggtccacaaacaccggaaccgtgccaggcagtgagaaagattcagatagtatggagaccgaagagaagacctcctctgcctttgtaggaaaaactccagaggcctcccccgaacctaaagaccagaccctgaaaatgatcaaaatcctgagcggcgaaatggcgattgagttgcacctccagttcctgatcaggaataataataccgacctgatgattcttaaaaatactaaggatgccgtgaggaacagcgtatgccataccgccacggtgattgccaattcatttatgcactgcggcactacgtccgatcagtttcttagagataacctcgagtggctggcaagagctacaaattgggctaagttcaccgctacagcttcgctcggcgtgatccacaagggacacgagaaagaggcgctgcagcttatggctacctatctgcccaaggacacatcacccggatcagcttaccaggaaggtggggggctatacgctctcggacttatacatgcgaaccacgggggcgacatcatcgattacctgctaaaccagctgaagaatgcatccaatgacatcgtccggcatggagggtctctcgggctcggccttgccgccatgggcaccgccagacaggatgtgtacgacctgctgaagactaacctgtatcaggacgacgccgtaaccggggaagcagctggactggctctaggtttggtgatgctgggcagcaagaacgcccaggccatcgaggacatggttggttatgcccaggaaactcagcacgagaagattctacgcggattggcggtgggaattgcgctggtgatgtacggcagaatggaagaagcagatgctttgatcgaatctctgtgtagagacaaagatccaatcctgcgcagatcaggtatgtacaccgtcgccatggcttactgcgggtccgggaacaataaggcaatcagaaggctgctccacgtggcagtatctgacgtgaacgacgacgtcagaagggccgctgtggaaagcttaggttttatactctttcgcacacccgagcaatgcccaagcgttgtctctctcctgagcgaatcctacaatcctcacgtacggtatggcgcagctatggctttgggtatctgttgcgccggcactggtaataaagaggctataaacctgctcgagccaatgaccaacgacccagtcaattacgttaggcagggagccctgatcgcatctgcgctgatcatgatccaacaaacggaaattacctgccccaaggtgaaccagttcaggcagctttattccaaagttatcaatgacaagcatgacgatgtaatggcaaaattcggcgctatcctcgcccagggaattctcgacgctggcggtcacaatgtcacaatcagtttgcagagcagaaccggccacacccacatgccgagcgtggtcggggttctggtctttacccaattctggttttggtttcctcttagccacttcctgagtctagcctatactccgacctgtgtcatcggactgaataaggatttgaaggtgagcacggctgtactgtctatcactgcaaaggctaaaaagaaggagaaagagaaggaaaagaaggaggaggagaagatggaggtagacgaagcagagaagaaggaagagaaggagaaaaagaaagaaccagaaccgaatttccagttgcttgacaaccctgccagagtaatgcccgcccagctcaaagtcctgactatgccagaaacttgtcgttaccaaccatttaaaccgctctcaataggcggcattattatcctgaaagacaccagcgaggatatagaggagctggttgaacccgtggcggcccacggccctaagatcgaagaggaggaacaggaaccggagccacccgaaccatttgagtacatcgatgattag

SEQ ID NO: 25255 - DNA, 363 bp, Artificial Sequence
  Description of Artificial Sequence: Synthetic coding sequence
atggcccccgccaagaagggcggcgagaagaagaagggccggagcgctattaacgaggtggtgactcgtgagtacacaataaacatacacaagcgaattcatggggtgggcttcaaaaagagggctccccgcgcactgaaggaaattcgaaagttcgcaatgaaggagatggggaccccagacgttaggattgacacacgactaaacaaagctgtttgggccaagggcataaggaacgttccttaccggattagagtaagattgagtagaaagagaaacgaggatgaggactccccaaacaagctgtacacactggtaacatacgtccccgtcacaactttcaaaaactgtcaccaccagtag

SEQ ID NO: 25256 - DNA, 378 bp, Artificial Sequence
  Description of Artificial Sequence: Synthetic coding sequence
atgagcagcaccctgggcaagctgagcaaccaggtggaggagaccctcccgttactgaagaaggtccccgccaattactttcacatctgctctgccatcctcatggggttctcgctgtccaagtctgcgacacaagtgagtgcaatccacatggatagcaaggtggacgatcaccttatccggggcaccgagaaaagtagactcgaaccagcgacccagcttttccagaacacgaagaagatccgattggaggatacaaatcaggaaaatttcacgagaattgaggggactggtacaggatcgctgagcggaaaagcgcttggatcagtcgtgtatgtcaaggagtcagacggcctggaaatgacggacgtagaatag

SEQ ID NO: 25257 - DNA, 1500 bp, Artificial Sequence
  Description of Artificial Sequence: Synthetic coding sequence
atgagcacccccagcggcatcagcacctggctgagcctgcccgtgagtaccccagcttctataacttctattcgggtcacccaaaaatcgtcagggccgtgggccttttcttcttgtacatatgtgtcgggccctggagtgtgcatctcttcactctcctgttcgcgggtgggctcctcatctttccgggggggcctcgggggcggttacgggggcgcgtccgggatgggcggcataatcgccataatggtgaaccagtccctcctgagcccactgaacctcgaggtggaccccaatatccaagctgtgtgtacacaggaaaaggagcagatcaaaactcttaataataagttcgcatctttcattgataaggtgtggtttcttgagcaacaaaacaaggtgctggagactaaatggagtcttcttcaacagcaaaagatggccagaagcaacatggacaacatgctggagagctacatcaacaatctgcgcaggcagctcgagaccctcggccaagagaagctgaaacttgaggcggaattaggtaacatgcaaggacttggggaagactttaagaacaagtatgaggacgagatcaacaagcatactgaggtggaaaacgagtttgtccttatcaagaaggacgttgatgaggcctacatgaacaaagcagagctagagtctctcctcgagggactcacagacgagatcaattttctgagacagctgtatgaagaggagatcagggagctacagagccaaatcagcgacatgagcatggttctgtctatggattattcatgtagtagggacatggattccattatccccgaagtgaaggtgcaatatgaagagatcgcaaattgctctcgggcagaggccgaatctatgtaccagatcaagtatgaggagttgcagacgctggcggggaagtatggtgacgatttgagcaggactaaaaccgagattagtgaaatgaaccgaaatattagctggttacaggccgagacagagggactgaagggccaacgcgcttccctggaagccgcaatcaccgacgccgagcagagaggagaactagctgttaaagacgcgaatgcgaaactttctgaattggaggcagccttgcagagagccaagcaagatatgatgggccagctgagggaataccaagagcttatgaacgtcggtctcacacttgatatcgaaattgccacgtatcgaaagctgttggagggggaagagagcagactggaatcagggatgcaaaatgtatccattcataccaaaaccacaagctcgtatgcaggcggcctgtcatcagcctacggcggattgacgagtccaggcattatatatcgtctcggttcttccttcggatctgccgccggttcatcatctttcagcaggactagtagcaccagggcggttgtagtacgcaagatcgagacccacgatggcaaattggagagcgaatcttcagatgtactcagcaaatag

SEQ ID NO: 25258 - DNA, 504 bp, Artificial Sequence
  Description of Artificial Sequence: Synthetic coding sequence
atgtacatgggcatgatgtgcaccgccaagaagtgcggcatccggtttcagccgcccgcaataatacttatttacgaatcagaaattaaagggaagatccgccagcgcatcatgcccgtgaggaacttcagtaaattttccgattgtacccgggccgccgagcagttgaaaaataatcctcggcacaagtcgtatctggaacaggtgagcctgagacagttggagaagttattttcatttctccggggatacctgtccggccaatctctggcagagacaatggagcagattcagagggaaacaactatcgatccagaggaggacctgaataaactggacgacaaagaacttgcaaagcgtaagtccattatggacgagctcttcgagaagaatcaaaagaagaaggatgacccaaacttcgtgtacgatatagaagtggaatttcctcaagatgaccaactccagagttgtggctgggatacagaaagcgcagatgaattttag

SEQ ID NO: 25259 - DNA, 378 bp, Artificial Sequence
  Description of Artificial Sequence: Synthetic coding sequence
atggcccccgccaagaagggcggcgagaagaagaagggccggagcgccataaatgaggtcgtgacgagagagtatactatcaacatccataaaagaatccacggtgtaggctttaaaaaacgggcccctcgagccctgaaggaaattcggaaattcgccatgaaagaaatgggcacccctgatgtgagaatcgatacccgccttaataaagccgtgtgggccaaaggcatcaggaatgtcccttaccgaatccgcgtcagactgtccagaaaacgtaatgaggacgaggactcaccaaataagctctatactctggtgacatatgtacccgtcaccacgtttaagaatcttcagactgtgaatgtggacgaaaactag

SEQ ID NO: 25260 - DNA, 1005 bp, Artificial Sequence
  Description of Artificial Sequence: Synthetic coding sequence
atgacccggagcctgttcaagggcaacttctggagcgccgacatcctctccacaattggatatgacaacataattcagcatttgaacaacggcaggaagaattgcaaggagttcgaggacttcctgaaggagcgcgccgctatcgaggagcgttacgggaaggatcttctaaacttgtctcggaaaaaaccctgcgggcagagtgaaatcaatacactgaagcgggccctggaggtattcaagcagcaggtcgacaatgtggcccagtgtcatatccaactggcccagagtcttagagaagaagcgcgtaagatggaggaattccgtgagaagcagaagctgcagcgaaaaaaaactgagttaattatggatgctatccataaacagaagtctttgcagttcaaaaaaacaatggatgccaaaaagaattacgaacaaaagtgccgagataaggacgaggcagagcaggctgtgtcccgcagtgcaaacttggttaaccctaaacagcaggagaaactgttcgtcaaactggccaccagcaaaacagccgtggaggactctgataaagcttatatgctgcacatcgggacgctggataaggtaagggaggagtggcagtcggaacatattaaggcctgcgaggctttcgaggcgcaggagtgcgagcgaatcaattttttccgaaacgcactgtggctgcacgtcaatcagctctcacaacaatgtgtgaccagtgacgaaatgtacgagcaggtccggaagtccctcgaaatgtgtagtatccagagagatattgagtactttgtgaatcagcgcaagacgggccagatcccacccgcgccaattatgtatgagaacttttactccagccaaaagaacgccgtgccggcaggaaaagccactggacctaacctggcacgccgtggtccactgccaattccaaaaagttcaccagatgaccccaactattctttggtcgatgattattctcttctctatcagtag

SEQ ID NO: 25261 - DNA, 597 bp, Artificial Sequence
  Description of Artificial Sequence: Synthetic coding sequence
atgaagaaggtgcggctgaaggagctggagagccggctgcagcaggtcgacggctttgaaaagccaaagctgcttctggagcagtatcccacccggccgcacatagctgcctgtatgttatacaccatacataatacatatgacgacattgaaaataaggtagtcgctgacttaggctgtggctgtggggtcctgtccatcggaacggctatgcttggggctggcctgtgcgttggtttcgatattgacgaggatgcactggaaatctttaaccggaatgcagaggaatttgagctgacaaacatagacatggtccagtgtgatgtgtgcctgctgtctaatcggatgtctaaaagttttgataccgtcattatgaatccaccctttgggaccaaaaacaacaaggggacagatatggccttcctgaaaacagcactggaaatggcccgaactgcagtttacagtctacacaagtctagtacccgagaacacgtacagaaaaaggctgcagaatggaaaataaaaatcgacattatcgcagaactgcgctacgacctgccagcctcgtataaattccataaaaaaaagagcgtgtag

SEQ ID NO: 25262 - DNA, 1125 bp, Artificial Sequence
  Description of Artificial Sequence: Synthetic coding sequence
atgctggcccccggctgcgagctggaccccgaccaggaggtggtgcgtactcgtcccgaggatgttccagcctccccatcaacctccacaatgatcgtgtctgtgctccgcccccctagtcacgcctcttgtactgcctgtgggaccgtgacattccacattgtggagaggatggcctcagtgatccctgctagcaaccgcagtatgagatctgaccgcaatacttacgtgggtaagaggtttgttcatgtgaagaatccatacctggacctcatggacgaggacatcttgtaccatctagatctgggtactaaaactcacaacctccctgcgatgttcggggatgttaaatttgtctgtgtgggaggatcccccaacaggatgaaagcatttgcactgtttatgcacaaggagcttggatttgaagaggccgaagaggacattaaggatatttgtgctggaaccgataggtactgcatgtacaaaactggtccagtactcgccatcagtcacgggatgggtatcccttctataagtatcatgctccacgaactgataaagcttttgcaccacgcccgatgttgtgacgtcacaatcatccggattggcacgtccggtggtatcggaatcgctcccggtactgtcgtcattactgatattgccgtggactcattcttcaagccgcggtttgagcaggtgattctggataatatcgtcactcggagcacggaactagacaaggagctgtcagaggaactgtttaattgtagcaaagaaatccccaacttcccaactctagtcggccacacaatgtgtacctatgacttttacgagggacaaggcaggctggacggcgccctctgtagcttcagtcgcgaaaaaaagctggactacctcaagagagcatttaaagccggagtgaggaacattgaaatggagtcaaccgtgttcgccgccatgtgtggtctgtgtggcctgaaagccgcagtggtgtgtgttaccctgctcgatcggctggattgtgatcaaatcaatctgccccatgacgtgttggtcgaataccagcagcgcccacaattattgatctcgaactttatcaggcgcaggctaggactatgcgattag

SEQ ID NO: 25263 - DNA, 4149 bp, Artificial Sequence
  Description of Artificial Sequence: Synthetic coding sequence
atgctgcggaagctgaccatcgagcagatcaacgactggttcaccattggcaagaccgtgacaaacgtggagctcctcggggctcccccagcttttcccgccggcgcagcccgtgaggaagtgcagaggcaagacgtcgcccccggggctggacctgcagcccaagctccagcactggcgcaggccccagcccggccagcagcagccttcgagcgttccttgagtcaaagaagcagcgaagtagaatacatcaacaaatataggcagctcgaggctcaggagcttgacgtgtgcagatccgtccagccaaccagcggccctgggccccgtccctccctggccaagctttcgagtgtcacctgcatcccaggcaccacctacaaataccctgatctccctatcagccgctacaaagaagaggtggtgagcctgatcgaaagcaactctgtggtcatcatccatggtgcaaccggctcaggaaagagtacccagctgccccagtacattttggatcactacgtgcagagaagcgcttactgctccatcgttgtcacacaaccccgcaaaataggggcatcgagcatcgccagatggatttccaaggaaagggcttggactctgggcggggtggttggataccaggtgggtctggaaaaaatagcaaccgaagatacacggcttatttacatgacaacgggggtactcctacagaaaatcgtctccgccaagtcattaatggagtttacccatattatcattgacgaggtgcacgagcggaccgaggaaatggacttcctactcttggtggtgaggaaactgctgaggaccaatagccgctttgtgaaagtggttttgatgtcagccacaatcagttgtaaagagttcgccgactatttcgctgtccccgtgcaaaataagatgaatcctgcttatattttcgaggtggagggaaaacctcactcggttgaagaatattatctgaatgacctagaacatatacaccacagtaaactgagtcctcatctgctcgaggagcctgtgattactaaagatatctatgaagtggcggtgtcactaattcaaatgttcgacgatttagacatgaaggagagcgggaacaaggcatggtccggagcccaatttgtgcttgagcggtcgagtgtgctggtatttctgcccgggctcggggaaatcaactatatgcatgagctcctcacaagcctggtgcataagcggctgcaagtataccccctccacagctcagtcgcacttgaggagcagaacaatgtatttctgagtcctgtgccagggtatcgaaaaataattttatctacgaacatagccgaatcatccgtcactgtgcccgatgtaaaatacgtgatagatttctgcttgacacgcaccttggtgtgcgatgaggacaccaactatcagtctctcaggctgtcctgggcctctaaaacctcatgcaaccagcgaaaaggcagggccggacgggtctcgagagggtattgctacagactagtgcacaaggacttttgggataatagtatcccagatcacgttgtacctgaaatgttgcggtgccctttaggctcaactatcttgaaggtaaagttactggatatgggggagcccagagccctgctggccacagccctgtctcctcccgggctgagcgatatcgagagaactatcttgctgctgaaggaggtaggagccctggccgttagtggccagcgagaggacgaaaaccctcacgatggggagctaaccttccttggccgggttctggcccaactgcccgtgaaccagcagttggggaaacttatcgtattagggcatgtgtttggctgcttggacgagtgtctgataatcgccgcagcgctttctctgaaaaattttttcgccatgccatttcggcagcatcttgacggctataggaataaagtgaacttctctggatcctccaagagcgactgcattgccctggttgaagccttcaaaacctggaaggcctgccggcaaacgggtgagctgcgctacccaaaggatgagctcaattggggacgccttaattatatccaaatcaaaagaattcgcgaggtggccgaattatacgaagaacttaaaaccaggatctcacagttcaacatgcatgtggatagccggcgccctgtcatggaccaagaatacatttacaagcagcgattcattttacaggtcgttttagcaggggccttttatcctaactactttacttttggccagcccgacgaagagatggcggtaagagaactggcaggaaaggatcctaaaacaaccgtggtgctgaagcacatacccccctacggcttcttgtactataagcagctccagtccttatttcggcagtgtggacaggtgaagagtatagtgtttgacggcgctaaagcttttgtggagttcagcaggaacccaacggagcgttttaaaacattacccgccgtctatatggccattaagatgagccagctcaaggtcagcctcgaattatccgttcattctgcggaggaaatagaagggaaagtacaaggcatgaacgtatctaagctcagaaacacacgggtcaacgtagactttcagaaacaaactgtggatcctatgcaggtatccttcaatacatccgatcgatcgcagaccgttaccgacctgttactcacgatcgatgtcaccgaagttgtggaagtaggtcacttttggggctaccggatcgatgagaataatagcgagattttgaagaagctgactgctgaaatcaatcagctgactcttgtaccccttcctactcaccctcatccagatttggtttgtctcgccccttttgccgactttgacaagcaaaggtattttcgggctcaggtgttatacgtctcggggaactcagccgaagtatttttcgtggactacggaaataaatcccacgtggacctccatctacttatggagatcccgtgccagttcctggagctcccattccaggcgctggaatttaaaatttgtaaaatgagaccttcagctaagagtttagtgtgtgggaaacactggagcgatggggcgtcacaatggttcgcttccctggtctccggttgcactctgttagtgaaggtgttcagcgtagtccacagtgtcctacatgtggatgtgtaccagtacagcggtgtgcaggatgccatcaatattagggatgttctcatacagcaggggtacgcggaactaaccgaggaaagctacgagagtaaacagtctcacgaggtactgaagggcctcttttcaaagtctgtcgaaaatatgaccgatggctccgtccctttccctatgaaagacgacgagaagtacttgatccgcatcctactggagtccttctcgaccaacaagctgggaaccccgaactgcaaggctgagttgcacggccctttcaatccatacgagcttaagtgtcattctctgacacgtatctctaagttcaggtgcgtttggattgagaaggagtctatcaattcggtgatcatcagtgatgctccagaggatcttcaccagagaatgctcgttgcggcttcactcagcattaatgccacagggagtactatgctgttgcgggagacaagccttatgcctcacataccagggctccccgcattgttaagtatgctgttcgccccagtcatagagcttcggattgaccagaacgggaaatattacacaggagttctgtgtggcctgggatggaatccggctaccggtgcgtctatactgcctgagcacgacatggagctggccttcgatgtgcagttctccgttgaggacgtagtggaggtcaacatcctgcgcgctgccatcaacaaattggtgtgtgatggacccaacggatgcaaatgcctgggccctgaacgagttgcccagttgcaggatatcgctcggcagaagctcctgggactgttctgtcaaagtaagcccagggagaagattgtacccaaatggcatgaaaaaccgtatgaatggaatcaagtggatcctaaacttgtgatggagcaggccgatcgcgagtcttctaggggtaagaacacttttctttaccagttacacaagcttgtggtcttggggacatag

SEQ ID NO: 25264 - DNA, 357 bp, Artificial Sequence
  Description of Artificial Sequence: Synthetic coding sequence
atggacgtgttcctgatgatccggcggcacaagaccaccatcttcacagatgctaaggaatcatctaccgtgtttgagcttaaacgtatcgtggagggaatactcaaacgccctccagatgagcagaggctatataaggacgaccaacttctcgatgacggcaagaccctaggggagtgtggttttactagtcagacagcccggccccaggccccagcgacagtaggactggccttcagagccgatgacacatttgaggctctctgcatcgagcccttctctagtccacccgagctgccagatgtgatgaagccccaggactctggctccagcgcaaacgagcaggcagtccagtag

SEQ ID NO: 25265 - DNA, 3228 bp, Artificial Sequence
  Description of Artificial Sequence: Synthetic coding sequence
atggtggtggaggtggacagcatgcccgccgccagcagcgtgaagaagccgtttggactgaggagcaagatgggaaagtggtgttgtcggtgctttccctgctgccgcgaatccgggaaatccaacgtcgggacctctggggaccatgacgatagcgctatgaaaacccttcgcagtaaaatggggaaatggtgtcggcactgctttccttgttgtcgcggttcaggcaaaagcaatgtcggggcctccggggaccacgacgactccgccatgaaaacactccgaaacaagatgggaaaatggtgctgtcactgctttccttgctgcaggggctctagtaaatccaaggtcggtgcatggggagactacgatgatagtgcctttatggaaccacgctatcatgtgcgtggcgaggacctggacaagctgcacagagccgcatggtgggggaaggtcccgcgcaaggatttgattgtgatgctccgtgatacagatgtgaataaacaggataagcaaaaacggaccgccttacacctggcctccgcaaatggcaactcagaggttgtcaagttactcctggaccggcggtgtcagcttaacgtgttggacaataaaaaaaggactgctttgattaaagccgtgcaatgccaggaggatgaatgtgccctaatgttgctggaacacggcaccgaccccaacattccagatgaatacggtaacactaccctgcattacgcaatctataatgaggataagcttatggcaaaagccctgcttctgtacggtgccgacattgaaagcaagaataaacatgggctgacccccctcctgctaggggtccacgaacagaaacagcaggttgtgaagtttctaattaaaaagaaagctaatctcaatgcactcgaccggtatggcagaacggccttaatcctggctgtttgctgcggctcggcttcaattgtttccctgcttctggagcagaacatagatgtatcgtcacaggacctgtccggccaaacggcacgggaatatgctgttagtagtcatcatcacgtgatttgccagcttctgagcgactacaaagaaaagcagatgttgaagataagcagcgagaactcaaaccccgagcaagatcttaagcttacctccgaagaggaaagccagcgttttaagggaagcgaaaattcccagcctgaaaagatgagtcaggagccagaaattaacaaagacggcgacagggaagtagaggaggagatgaagaaacatgaatcaaataacgtgggcctgctagaaaacctgactaatggagtgaccgcggggaacggtgacaacgggttgattccacagcgaaagagcagaacacccgaaaatcaacaattccctgataatgagtccgaggagtatcaccggatttgtgaactgctgagtgactacaaggaaaaacagatgcccaaatattcttcggagaattcgaacccagagcaggacctaaagctgacctcggaagaggagtctcaaaggcttaaagggtctgaaaacggccagcctgagaagcgcagccaggagcctgaaattaataaagatggagaccgcgagctcgagaacttcatggcgattgaggaaatgaagaaacaccgctccacccacgtgggctttcctgagaatctcacaaatggcgcaaccgctggcaatggcgacgatgggctcataccaccaaggaagtctcgcacccctgaatcccagcagttccctgatacagagaacgaagagtaccattcagatgaacaaaatgacacacagaagcagttctgtgaggagcagaacaccgggattctgcatgacgagatcctaatccacgaagagaaacagatcgaggtcgtggagaagatgaattctgagttaagcctctcttgcaagaaggagaaagatattttgcacgaaaattctacgctgcgggaggagatagccatgctgcgactggagttggacactatgaaacatcaatcccagctaagagagaagaaatacctggaagatatcgaaagtgtcaaaaaacggaatgacaacctccttaaggcactccaactcaacgagctgacaatggatgacgatacagccgtgctcgtcatcgacaatgggagtggaatgtgcaaggccggcttcgccggggacgacgcccccagagcagtgtttccatcaatcgtgggaagacctcggcagcaggggatgatgggcggtatgcaccagaaagaatcatacgtaggtaaagaagcacagtcaaagaggggaatcctcacccttaagtaccccatggaacacggaatcataactaactgggacgacatggagaagatctggcaccacacattttacaatgaactacgcgtagcccctgaagagcacccagtgctgcttaccgaggcaacacttaacccgaaagccaaccgagagaagatgactcaaataatgtttgaaacattcaatactcctgccatgtacgtggccatccaggcggtcctctctttgtatacgtcgggacgtactacggggatagtgatggattccggtgatggtgtgacacacactgtccctatctacgagggtaacgccctcccgcacgcaaccctccgtctagacctggcaggcagggaactgcctgactacctgatgaagattctgacggaacatgggtataggtttaccacaatggccgagcgtgaaattgttagagacattaaggagaagctgtgttacgtggctcttgacttcgagcaggagatggccacagtcgcttcttcatcgtctcttgaaaaaagctacgagttaccagacggacaggtgatcacaatcggcaacgagcgtttccgctgtccagaagcactgttccagccctgtttcttgggaatggagtcctgtggcatacacgagacgacttttaactctattatgaaatctgacgtcgacatcaggaaagatctgtacactaatacagttctgagcggcggtactaccatgtatcccgggatggcccataggatgcagaaagaaatcgctgcattggcaccttccatgatgaaaatccgtatcattgcccccccgaagaggaaatactcagtgtgggtggggggcagtatactggcatccctgtctactttccaacagatgtggataagtaaacaagaatacgacgagtccggaccctccatcgtgcatcggaagtgtctgtag

SEQ ID NO: 25266 - DNA, 381 bp, Artificial Sequence
  Description of Artificial Sequence: Synthetic coding sequence
atgaccgccaccgagcagtggatcttcctgtgcgccgcccacaagacccccaaggagtgccccgccatcgattatactcggcatactctggacggtgctgcctgcctgcttaattctaataagtatttcccctcacgagtgagcatcaaagaatcaagtgtggcaaagttagggtccgtctgcaggcgcatttatagaatcttctcccacgcatactttcatcacagacaaatcttcgatgagtatgagaacgagacttttctatgtcatcgtttcaccaaatttgtaatgaagtataacctgatgagcaaggacaatttaatcgtgcctatcctggaagaagaggtgcagaattccgtctctggtgagtccgaggcctag

SEQ ID NO: 25267 - DNA, 2811 bp, Artificial Sequence
  Description of Artificial Sequence: Synthetic coding sequence
atggagcccgacatcatccggatgtacagcagcagccccccccccctggacaatggagctgaagacgatgacgacgacgaattcggcgagttcggtgggtttagcgaggtgagtccctccggagtggggttcgtggacttcgacaccccagactatacccgccccaaggaagaattcgtcccgtctaaccactttatgccaattcatgaatttagcgaaaacgtggattcactcaccagctttaaatctattaaaaacgggaatgataaagatattactgcggaactgagcgctccagtgaaagggcaaagcgatgtgctcctctcaaccaccagcaaagaaatcatatctagtgaaatgctggccacctccatcgacggtatggagcgacccggcaatcttaacaaagtggttgaacagagacaaaacgtaggaaccctggagtcattcagtcctggggatttcaggactaacatgaacgttgtgcaccagaacaaacaacttgaatcttgcaatggcgagaagcctccctgccttgagatactaacgaatgggtttgcagttctggagacggtcaacccacaggggaccgatgatctagacaacgtggctgattccaaagggcgaaaaccactgtccacacattccactgagtataacctggattctgtgccctccccagccgaggagttcgctgattttgccactttttcgaaaaaggaacggatccaactggaagagatcgagtgtgctgtgctgaacgatagagaagccctcacaattagggaaaataacaagatcaaccgcgtgaatgaactaaactcagtcaaggaggtggccctgggccgcagcctagataacaaaggggacacagatggagaggaccaggtgtgcgtgtccgagatctcgatagttacaaatagaggcttctccgtggaaaagcaaggactgcctaccctgcagcaggacgagtttctacagtcaggtgtgcaatctaaggcatggtccctcgtggattccgctgacaactccgaagctatccggcgagagcagtgcaagacagaggagaagctcgatctgctgactagcaaatgcgcccacttatgtatggattcagtaaagacctctgatgatgaagtcggctcgcccaaagaggaatcaagaaaattcactaactttcaatcacccaatattgaccccaccgaagagaacgacctggacgattccctgtccgtcaaaaacggcgacagttcgaacgactttgtaacatgtaatgatataaacgaggatgattttggtgatttcggggatttcggcagcgcatctggatcaactccaccattcgtgactgggactcaagatagcatgtccgatgccaccttcgaggaaagctcagaacatttcccccacttttctgagccaggggacgactttggagagttcggggacattaacgccgtgagttgccaggaagagactatcctaaccaaatctgatctgaaacagacttctgataacctaagcgaagaatgccagctggcacggaagagctcgggtaccggaacagaacccgtcgcaaagctgaaaaatggacaggagggggagattggacatttcgactccgtacccaacattcaggacgattgcaatggatttcaggatagtgatgatttcgccgatttttccagtgccggtcccagccaggtagtcgactggaacgcctttgaagatgaacagaaagatagttgctcttgggctgcgtttggagaccagcaggctacagaatctcaccatcgcaaagaggcctggcagtcccataggaccgacgaaaatatcgacacacccggaaccccaaagacccattctgttccttccgctacatccaaaggcgctgttgcctcaggtcacttacaagaatctgccacctctgtgcagacagctttgctcaacagactggaaagaatcttcgaggcttgctttccaagcatattggttccagatgccgaggaagaggtgacctccctcaagcacctacttgaaacctccacccttcctatcaaaactagggaggcgctgcctgagagtggcgagctgctggacgtctggactgagctacaagacattcacgacgctcacggccttcgctatcagtggggcgggtcccatagtaataaaaagctgctatcttccctcggaattgacacccgcaacatcctttttacaggtaacaaaaagcagcctgttatcgtgccaatgtacgccgccggtctcggcatgttagagcccacgaaagaacccttgaagcctttgtcagccgccgaaaagatagcatcaattggacagactgcaacaatgtccccggacatgaacacatgcacatctgatcagttccaggagtcgctgccccctgtccagttcgactggagctcgtccggactgactaatcccttggatgcatccggaggctccacgctcctgaatctggacttttttggaccagtagatgactcgagctcgtctagcagcactaccatccccggtgtagatccagaactgtatgagctcactacctctaaactagaaatctcaacttcatcattgaaagttacggacgcctttgcacgattgatgagtactgtagaaaagacttctaccagcacccggaagccaaagcgcgaagaacacctctccgaagaggcaattaaggtgatcgcaggtcttccggatctcacctttatgcatgccaaggttctgatgtttccggctactctgacaccatccacttcatctcaggaaaaagctgatggatag

SEQ ID NO: 25268 - DNA, 1860 bp, Artificial Sequence
  Description of Artificial Sequence: Synthetic coding sequence
atggacgaccagcaggccctgaacagcatcatgcaggacctggccgttctgcataaagcatcaaggccagccctgagcttgcaagagacaaggaaggccaagtcatccagtcccaagaagcagaatgacgtgcgcgtcaaatttgagcaccggggagagaagagaatcttacaatttccacggcccgtgaagcttgaggacctgcgctcaaaagcaaagatcgcattcggccaaagcatggatctgcactatacaaataacgagctcgtgattccgctcactacacaggatgacctggataaagccgtcgagcttttggaccgatccattcatatgaaaagcctgaagattctacttgtgatcaacggctctactcaagctactaacctcgaacctctaccgtcacttgaggacctagacaatactgtgttcggcgccgaaagaaagaagaggttgtctattattggccccacgtcccgggacaggagttcgcctccaccaggctacataccagatgaactgcatcaggttgctcggaacgggtcattcaccagcattaactcagaaggagaatttatcccagaatccatggatcagatgttggatccactaagcctttcctcaccagaaaatagtgggagtggtagttgtccctccctcgacagcccgttagatggtgaatcctaccctaaatccagaatgccccgggcccaatcatatcctgacaaccatcaagagttctctgactacgacaaccctatatttgagaagttcggaaagggaggtacttacccaaggagatatcacgtgtcctaccaccaccaagagtacaatgatggaagaaagacattccctcgtgcccgacggacacagggcacctctctcagaagcccagtcagcttttccccaacagatcactctcttagcaccagctctggctcctcaatttttacccccgaatacgacgactcccgcatcaggagacgcggctctgacatagataatcccactctgaccgtaatggacatatctcccccctcccggtccccgcgggcaccaactaattggagattagggaaactgctggggcaaggtgccttcggtagagtgtatttgtgctacgacgtggatactggaagggaattagctgtgaagcaagtacagttcgacccagatagccccgaaacgtcgaaggaagtcaacgccctcgagtgtgaaatccaactcctgaaaaacctactccatgagcgtattgttcagtattatggctgcctgagggacccacaagagaaaacactgtctatctttatggaatacatgccggggggctccataaaggaccagctaaaagcgtacggcgcactgactgagaacgtcactagaaagtacactcgacagatcctggagggtgtccactatttgcactctaacatgatcgttcaccgcgacataaagggagccaacattttgagggactcgaccggaaatgtaaaactcggcgacttcggagcctcaaaaaggctgcagacaatctgcctaagcggaactgggatgaagtctgtgacaggaaccccctattggatgtcccctgaggtcataagcggtgaggggtacggcaggaaggccgacatatggtctgttgcttgtacagtggttgagatgctaacggagaagccaccctgggctgaatttgaggccatggcagcaatattcaaaattgcaacccagcccaccaatccaaagctccccccccacgtgtccgactacaccagagactttttgaaacggatctttgttgaggccaagctgaggccgagtgcagatgagctgttgcggcacatgttcgtacattaccactag

SEQ ID NO: 25269 - DNA, 513 bp, Artificial Sequence
  Description of Artificial Sequence: Synthetic coding sequence
atgacccggggcaaccagcgggagctggcccggcagaagaacatgaagaagcagagcgacagtgtgaaaggtaagaggcgcgacgatggtctatctgcggctgcaagaaagcagcgagtcggcgtccaacagcctaacgctgagctcagccccattcacttccacttgatcctatgcgccttgcacccgcctgcctcatgccctttctgccctttagtccctccctctgctccttcatccctgccccccgggacccgcaggtcctgttctcggtctcggaagcggcagacccggcgtagaagaaatccctcatctttcgtggcttcctgtcctacactgctgccttttgcatgcgtcccgggagcgtccccgaccaccctggcctttccccctgtagtgctaaccggtccatccactgacggaatccccttcgccttgagccttcagcgcgtgccatttgtgctgccttcaccccaggtggcgagcctgcctcttgggcactcgcggggctag

SEQ ID NO: 25270 - DNA, 630 bp, Artificial Sequence
  Description of Artificial Sequence: Synthetic coding sequence
atgaagaaggtgcggctgaaggagctggagagccggctgcagcaggtggacggttttgagaaaccgaaactgctcctggaacagtaccccaccagaccccatatcgcagcatgtatgttgtacacgattcacaatacatacgatgatatcgaaaataaggtcgtggcagatctcgggtgcggctgtggggtgctgtctatcgggaccgccatgctgggcgctggcctctgcgtcgggttcgacatcgacgaagacgccctagagatctttaacaggaatgctgaagagttcgagttaacaaatattgacatggtacagtgcgacgtgtgtctgctctcaaacaggatgagcaagagtttcgacacagttatcatgaacccgccatttggaaccaagaacaataaggggacagatatggctttccttaagaccgctcttgagatggctcggacagccgtgtattccctgcataagagctcaacacgtgaacacgtccagaagaaagcggcggagtggaaaataaagatcgacataatcgccgagctgaggtacgacctccccgcaagttacaagtttcataagaaaaagtccgtagacattgaggtagacctcatcaggttcagcttttag

SEQ ID NO: 25271 - DNA, 1755 bp, Artificial Sequence
  Description of Artificial Sequence: Synthetic coding sequence
atggccgccagcgccaagcggaagcaggaggagaagcacctgaagatgctccgggacatgaccgggcttccacataaccggaagtgtttcgattgcgatcagcgtgggcccacttacgtgaatatgacagtgggctcatttgtctgtactagctgttcaggtagcctgcgaggtctgaatccgccccaccgagtgaaaagtatatcaatgacgacctttacacagcaggagatcgagtttttacaaaaacacggtaacgaagtttgtaaacagatctggctgggtctgttcgatgatcgttcaagtgccatacccgatttccgggatccgcagaaggtcaaggagtttttgcaagaaaagtatgagaaaaagagatggtatgtgcccccggagcaggccaaagtcgtggcctcagtccacgcaagcatttcaggcagtagtgcctcaagcacctcctcaactccagaagttaagcctcttaagagccttctgggggatagcgcgcctacccttcatttgaacaagggcactccttcacagtcaccagtagtaggccggtcacaaggccaacagcaggagaagaagcaatttgatcttctgtcagacctgggctccgacatttttgcagctccagccccacagtctaccgccactgcgaacttcgccaactttgcccacttcaacagccatgctgcacagaattccgcaaacgcggattttgcaaatttcgatgctttcggacagagcagcggttcaagcaactttggggggtttccaaccgcatcacatagccccttccagccccagaccaccgccttcagaatgcttagcagttcttgcagcttcggtgagttcactagcgcctttcctctacaggccacacactcaggttctgctgcatctgtcaacgccaattttgcccatttcgataactttcccaagagtagttcagccgatttcggcacattcaataccagccagagccatcagaccgctagcgctgtaagcaaagtgagcactaataaagcagggctgcagacggccgacaagtatgccgcactagctaacctcgataatatatttagcgcaggacaaggtggggaccaggggagcggcttcggaaccaccgggaaggcccccgtcgggagcgtggtgagcgtcccctctcagtccagtgcttcctctgataagtacgccgccctggcagaactggatagcgtgttcagcagcgcagcaaccagtagcaatgcctacactagcaccagtaacgccagcagcaatgtctttggtaccgtgcccgtggtggccagtgcacagacgcagcccgcctcctcctccgtgccagcaccattcggcgcaaccccatcaactaaccccttcgtggcagccgccggtccctctgtggcgagctcaactaatccttttcagaccaacgccagaggcgccactgctgccacttttggaacagcctccatgtctatgccaacaggtttcggaacccctgcaccttactctttacctacatccttctcaggctcattccagcagcccgccttcccggctcaagcagctttcccacagcaaacggctttctcacagcagcctaatgggtttgctgccttcgggcagacgaagcctgtcgttacaccctttggccaggtggcagcagctggtgtgagcagcaatccgttcatgaccggtgcaccgacagggcaattcccaaccggaagttccagcacaaatccatttctttag

SEQ ID NO: 25272 - DNA, 795 bp, Artificial Sequence
  Description of Artificial Sequence: Synthetic coding sequence
atggccggcgagcagaagcccagcagcaacctgctggagcagttcatcttgttagcaaagggtaccagcgggtcagcactcaccgcgctgatctcccaggttcttgaggcaccgggggtgtacgtgtttggggaactgctggagttggcaaacgttcaggaacttgccgaaggggctaacgctgcttatctccagctcctcaatctgtttgcatatgggacgtacccagactatatcgccaataaggagtcgcttccggaattgtccaccgctcagcaaaacaaactgaagcatttaactatcgtgtcactggcttcaagaatgaaatgtatcccttactctgtcctgttaaaggatctagaaatgcggaatcttcgggagctcgaagacttgattatcgaagcagtgtatacagacataatccagggcaaactggaccagaggaatcagctgttagaggtggatttctgcattggccgtgacatcagaaaaaaggatatcaataatattgtgaaaactcttcacgaatggtgcgacggctgtgaagcggtcttgctgggaattgaacagcaggtcttacgggccaatcagtataaagaaaaccacaaccgaactcagcagcaggtggaggccgaagtgactaatattaagaaaactttgaaagcaacagcatcctccagcgcccaggagatggagcagcagcttgcagagcgcgagtgccccccccatgccgagcaacgacaacccacgaaaaagatgtctaaagtgaaggggcttgtgtccagtaggcactag

SEQ ID NO: 25273 - DNA, 1506 bp, Artificial Sequence
  Description of Artificial Sequence: Synthetic coding sequence
atgagcagcgagcaggacaagagcgccagcaaggagaagagcaagaaaccagtgcggttcctgcctcaactgagcatggagaaactcgcctccaaggagaagttcaaggctccagcacgtgcactccctcagctgtccatggtgtccacgaagcctcattggcagcaagcagcaccatcattccacctaagcgtgaaacaggacgacgagtcaccggagcctttttctgtgaagaacgaacagtcccatgccgagtatatggagcggtttggaaagaagggcaagctccctcatcaggtggatgacagttacgtaggaccgagcacttcaaagagtaaagggaaatccccccacaaagaacgggagaactttcgttccaccctggtcaatgtgattatgcagcaggatgctgacctggatagcgccgtaccagacggatctactattcccaagcccacagcttctgcaatcgagaaagacattcttcgttactactactatatccaccatggcatcgacaccgaccacgttgccccaatggaggattcatggttagagcatgtgctggatttggtgcctcagcatctgaaggttttcacggatagcattgtgactctgagcgacgaaatgagagaagattacttactgagcgtccgaaagtcaattgtcgactttgtgctcaaggatccaagggagaagggtgatgacaagaaaacagacgagctcccagcacatcgcgctgagatggaaatcctgcctaaaccctggagaaagtccttcctggccgcatcttcatatatccgagaccacctcaacgctatgaatccgactatgcttgcggttttggatctttggcacactaactttaagaagctccggctggtagacatcaaggaatttcataattgtcaggacgcacttgagctgtcctcttttcagaatattataatgagacatatggactcagccaaggagacactgcttaaaatgtggtttcctgaggtgcagaacatctattaccagggtaataaaaaaaagcagctgcccacaggggactcttctgccaaactggaaagtttctttaactgtgccgctgcactgatgaccctgcaattgcaagaccttactctcgttagcatgcaagacttcaccgacctgatcgctcagcctcctgattccgtccgagcattcgagcatccaggctttatcatgcgcttgatcctggataacgatactatcaaattcgaaccagaactgagcgattacatcgacatcttcctgaatgtgtacgatgtgatgataaaggccgtgtccttcgtgccgcgggttgagacaaagctatattctaagtggcggaacaaggctaaacctggccacttttattttagccacatacagcgaagcgtgacgttccagcattccgaagtgagctctccccaaaactcgcacttcaagattgtgtccccctttagcgtactaggatttacatggcggtgtcagctgtag

SEQ ID NO: 25274 - DNA, 855 bp, Artificial Sequence
  Description of Artificial Sequence: Synthetic coding sequence
atgaccgacgtgcccgccaccttcacccaggccgagtgcaacggcgataagccaccagaaaacgggcagcagaccatcacaaagatctccgaggagctgactgatgtggatagcccactaccacattatcgcgtggagccttctctggagggtgccctcacaaagggaagtcaggaggagcgacgcaagcttcagggcaacatgctgcttaatagctctatggaagacaaaatgctgaaggagaatcctgaggaaaagttgtttatagtccataaagccataaccgacttgagcctccaggaaacctctgcagatgagatgactttcagagagggccaccagtgggaaaagattcccctgtctggctccaatcaggaaattagacgccagaaggaacgcatcaccgagcagcctcttaaagaggaggaggatgaggacaggaagaataagggccaccaagctgccgagatcgaatggttgggtttccgtaaaccatcgcaggccgacatgctccatagtaagcacgacgaggagcagaaggtttgggacgaggaaattgatgacgatgatgatgataactgtaataacgacgaggacgaagtccgagtgatagagttcaagaagaagcacgaagaggtctcccagttcaaagaggaaggcgacgcttccgaggacagccccctcagttccgcatcttctcaggcagtaactcctgatgagcagccaacactggggaagaagtctgacattagcagaaatgcctattcgcgttataataccatcagctaccgcaagattcgtaaagggaacaccaagcagcgcatcgatgagtttgagtcaatgatgcacctttag

SEQ ID NO: 25275 - DNA, 735 bp, Artificial Sequence
  Description of Artificial Sequence: Synthetic coding sequence
atgaagaaggtgcggctgaaggagctggagagccggctgcagcaggtggacggcttcgagaagccaaagctgctgctagaacagtatcccacacgaccccatatcgcagcatgtatgctgtacaccatccacaacacctatgacgatatcgaaaacaaagtcgttgctgaccttggctgtggatgcggcgtcctgtctattggtacagcaatgttgggcgccgggctctgcgtaggttttgacatagatgaggatgccctggaaatttttaacagaaacgcagaggagttcgagttgactaacattgacatggtccaatgtgatgtttgcctgctgtccaaccgtatgagtaaatcctttgacactgtgattatgaacccgccttttggcaccaaaaataacaagggcactgatatggcattcttaaagacagcactcgagatggcacgaacagcagtgtactccctgcacaagtccagtacacgcgagcacgttcagaagaaggccgcagaatggaaaataaaaatcgacattatcgccgagttaagatacgacctccctgcctcttacaaatttcacaagaagaagtcagtgtcactgctgattctcgccggccttcattcggtcttgaagagcttcctcggcagaatgtggtggttcatgccagttatccctgctactcgcgaggccgaagccagggagtcactcgagctgcgccggcagcggttacaatag

SEQ ID NO: 25276 - DNA, 885 bp, Artificial Sequence
  Description of Artificial Sequence: Synthetic coding sequence
atgaacaaccagaagcagcagaagcccaccctgagcggccagcggttcaagacccgcaaacgggacgagaaggagcgattcgacccgacacagttccaggactgcatcattcagggccttaccgagactggcaccgacttggaggcggtggcaaagtttctggacgcctctggtgcaaagctggattacaggagatatgctgagacactcttcgacattcttgtggccggggggatgttagcccccggcgggacattagcagatgacatgatgagaacagacgtatgcgtgtttgccgctcaggaggacctggaaaccatgcaggcattcgcccaggtgttcaataagctaattaggagatataaatatctggagaaaggttttgaggatgaagtgaagaagctcctgctttttctgaagggctttagcgagtcagaaagaaacaagctggctatgctcactggagttctcttggctaacggaaccctgaatgcgtctatcctgaattcactctataatgagaatctagtgaaggaaggagtatctgccgcattcgccgtaaagctgtttaagtcctggatcaacgaaaaagacatcaatgcagtggcggcttccctgcggaaggtgagcatggataatcgcctcatggaacttttccccgccaacaaacagagcgtggagcatttcacgaagtactttacagaagccgggctcaaggaactgagcgagtacgtgaggaaccagcagacaattggagctcggaaggagcttcagaaggagctacaggagcaaatgtctagaggggacccgtttaaggacatcattctttacgtgaaggaagagatgaagaaaaacaatattcccgagcctgttgtcatcggctag

SEQ ID NO: 25277 - DNA, 1374 bp, Artificial Sequence
  Description of Artificial Sequence: Synthetic coding sequence
atgaaccagccctgcaacagcatggagccccgggtgatggacgacgatatgctgaagctggccgtcggggatcaggggccgcaggaagaagccggccagctcgcgaagcaggagggcatcctcttcaaggatgtgctatccctccagttagattttcgcaatatactccggatcgataatctctggcagtttgaaaacttgcggaagttacagttagataacaacatcattgagaagatcgagggcctcgaaaacctcgcacacctggtttggcttgacctgtcatttaacaacatcgaaacaattgagggtctggatacactggttaacctggaagacttatcgttgtttaataacagaatcagcaagattgattcccttgacgccctggtgaaactacaggtcctgtcccttgggaacaaccgcatcgataacatgatgaatatcatatatctgaggagatttaagtgcctgcgcaccttgtcactctctcgcaacccaatttccgaggctgaggactataaaatgttcatatgtgcttatttgcccgacctgatgtatctggattaccgcaggatagacgatcacaccaaaaaactagccgaagcgaagcatcagtactctatcgacgaattaaaacatcaggaaaacctgatgcaggctcagcttgaagacgagcaggcccagagagaagaactggagaaacataaaacagcgttcgtggagcatttgaacgggagtttcctgttcgactctatgtacgctgaggatagcgagggaaataacctcagttacctcccaggcgttggcgagctcttagagacctataaggataaattcgtgataatttgcgtgaacattttcgaatacggactgaagcagcaagagaaacggaagacggaactcgacacattttctgaatgcgtgcgagaggctatccaagagaaccaagagcagggtaagcgtaagattgccaagtttgaagaaaagcacctgtcatcactgtccgctataagggaagaactggagctgccgaatattgaaaaaatgattctggagtgcagcgcagacatctccgagctgtttgacgcacttatgacattggaaatgcaattggttgagcagttggaggagactatcaacatgttcgagcgcaacatcgttgatatggtggggctgtttatagaaaacgttcagagtttgatggcacagtgtcgcgatttggaaaatcatcatcatgaaaagcttttggagatcagcatatccacgctggaaaagatagtggaaggcgatcttgatgaggatctgcccaacgatttacgggcaggtcggtttcagaagttcaactacgtggaagccagcggtactttttag

SEQ ID NO: 25278 - DNA, 1638 bp, Artificial Sequence
  Description of Artificial Sequence: Synthetic coding sequence
atgagcagcagcggctacccccccaaccagggcgccttcagcaccgaacagtcccggtatcccccccactccgtgcagtacactttccctaatacccgccatcagcaagagtttgccgtgcccgattataggagcagccatttggaagtgagccaggcgagccagctactgcagcagcagcaacagcagcagctccgccggagaccttccctccttagcgagtttcaccctggctcagatcgtccccaagaaagaaggacctcttatgagccgttccaccccggcccatcaccggtggaccacgactcactcgagtcgaaacgcccccggctggaacaagtatctgattcccacttccagcgagtgtcggccgctgtattgccactcgttcaccctctgccggaaggactgagagcctctgcagatgctaagaaggacccggcattcgggggcaaacatgaagccccctccagccccatttccggccagccctgcggggatgaccagaacgctagtccgtcaaaactgagcaaagaggaacttattcagtcgatggacagggtcgatcgcgagattgccaaagtggagcagcaaatcctgaaattaaaaaaaaagcaacagcaactggaggaggaggccgcaaagccaccagagcctgagaaaccagtttctcccccaccagttgagcagaagcatcgttcaatcgtccagattatttacgacgagaacaggaaaaaggcagaggaagcccataagatcttcgagggtttgggcccgaaagtggaactcccactgtacaatcagcccagcgacacaaaagtgtaccatgaaaatattaagacgaaccaggtaatgaggaagaaactgattctttttttcaaaaggcgcaatcatgccagaaagcagcgggaacagaagatctgtcaacgttatgaccagctgatggaggcctgggaaaagaaggtggataggattgaaaataatccacgtcgaaaggcaaaagaaagcaagactagggaatattacgaaaagcaattccctgagatccgtaagcagcgcgaacagcaggagaggttccagcgcgtgggccaaaggggcgccggactcagcgctaccatagcccgctcagagcacgagatctctgagatcatagacgggcttagtgaacaggaaaacaacgagaaacagatgcggcagctctcagttattcctcccatgatgttcgacgcagagcaaagaagggtgaaattcatcaatatgaatggcttgatggaggatcccatgaaggtatataaagatcgccagttcatgaatgtctggaccgaccatgagaaagagattttcaaagacaagtttatccaacaccccaagaacttcggactgatcgcatcttacctggaaagaaaaagcgtgcccgactgtgtactgtactactatctcacaaaaaagaacgaaaactataaagccctggtgagacggaactatggcaaaaggcgagggcgcaaccaacagcaaatcgctagaccatctcaggaggaaaaagtagaagagaaggaagaagataaagccgagaagacagagaagaaagaggaggaaaagaaagatgaagaggaaaaagacgaaaaagaggatagttag

SEQ ID NO: 25279 - DNA, 480 bp, Artificial Sequence
  Description of Artificial Sequence: Synthetic coding sequence
atgacccactgctgcagcccctgctgccagcccacctgctgccggaccacctgctggcagcctaccacagtcacaacttgctccagcactccttgctgccagccttcctgttgcgtatctagctgctgccagccctgctgtcaccccacgtgctgtcagaacacctgctgtagaacgacatgctgccagcccatctgtgtgacgtcctgttgccagccatcctgttgttccaccccatgttgccagccaacttgctgtggaagctcatgcggccagagctcgagctgcgcccccgtctattgccgccggacctgctatcaccccacatcggtatgcctccctggatgcctgaaccaatcctgtgggtcaaactgctgccagccttgctgtaggcccgcctgctgcgagaccacctgctgcagaactacatgcttccagccgacctgtgtgtacagctgttgccagccaagctgctgttag

SEQ ID NO: 25280 - DNA, 1071 bp, Artificial Sequence
  Description of Artificial Sequence: Synthetic coding sequence
atggagggccacgaccccaaggagcccgagcagctgcggaagctgtttatcggtggactcagcttcgaaactaccgacgacagcctccgggagcattttgaaaagtgggggacactgaccgattgtgtggtgatgcgggacccacagaccaagaggtctcgaggctttggatttgtgacctattcctgtgtggaggaggtggatgcggccatgtgtgctaggccccataaggtggacgggcgcgtggtcgaacccaagagagccgtaagcagagaggattcagtcaaaccaggtgcccatctgacagtaaagaaaatcttcgtgggcggcatcaaggaggatacagaagagtacaacctcagagactattttgaaaagtacggaaagattgaaactatcgaagtgatggaggaccggcaatccggcaagaaacgtggctttgcttttgtaaccttcgatgatcacgataccgtagacaaaatagtggtgcaaaaataccacaccattaacggccataactgtgaggtcaagaaagccctcagtaagcaggagatgcagtccgcaggatctcagcggggcagaggcggtgggagtggaaatttcatgggacgtggaggtaactttgggggagggggcggaaacttcggacgtggagggaactttggtggaaggggcggttatgggggagggggggggggatctcgagggagctatggcggaggcgacggcggatataatgggtttgggggggacggcggtaactatggcggtggtccaggatacagttcccgaggggggtatggcggaggagggccaggatacgggaaccagggcgggggatatggcgggggcggcggttacgatggctacaatgagggcgggaactttgggggggggaactacggcggcggaggaaattacaatgattttggtaattacagtggccaacagcagagcaattacggccctatgaaaggcggctcatttgggggccggagctccggatctccctacgggggcggctacggctctggaggagggtccggtggatacggaagcaggaggttctag

SEQ ID NO: 25281 - DNA, 186 bp, Artificial Sequence
  Description of Artificial Sequence: Synthetic coding sequence
atgcccttcttcggcaacaccttcagccccaagaagaccccccccaggaagtccgcatctctgtcgaatctccacagcctggaccggtcaacgagggaggtcgaactcgggctggagtacggatccccaaccatgaatttagcaggccagtccctgaagttcgaaaacgggcagtggatcgcttag

SEQ ID NO: 25282 - DNA, 981 bp, Artificial Sequence
  Description of Artificial Sequence: Synthetic coding sequence
atgccccacctgcccctggccagcttccggccccccttctggggcctgagacactccagggggctgccccgatttcatagtgtctccacccagagcgagccacatggaagccccatctcacggcgcaatcgagaagcaaagcagaagaggttgagggagaagcaagctaccctggaggccgagatcgcaggtgagtccaagtctccggctgagtccatcaaagcgtggaggcccaaggaacttgtcctctatgagattcctaccaaacctggtgaaaagaaggatgttagcgggccgctgccacccgcatattcccctcgttacgtggaagccgcttggtacccatggtgggtcagggagggcttctttaagcccgagtatcaggcccgccttcctcaagccactggcgaaaccttttctatgtgcatcccaccccccaatgtgaccgggtctttacatatagggcatgcactgacagtagccatccaggatgcactggtccgttggcatagaatgagaggggaccaggtcctttgggtgccggggtcagaccatgcaggcatagccactcaggcggtggtggaaaaacagctatggaaagaaaggggagtaagacgccatgagttatcccgggaggcgtttctgcgggaagtgtggcagtggaaggaggctaaaggaggcgagatttgtgagcagcttcgggctctcggagcatcactggattgggacagggagtgttttacaatggatgttgggtctagcgtggctgtgacagaagctttcgttcggctgtacaaagcaggcctactttaccgcaaccatcagcttgtgaattggtcgtgcgctctgcgtagcgcaattagcgatatagaggtcgagaaccgccccctccccggacacacacagttgcgcctgcccggctgcccaacacccgtgtcctttggtttgctcttctccgtggcgttcccagtggacggatag

SEQ ID NO: 25283 - DNA, 2031 bp, Artificial Sequence
  Description of Artificial Sequence: Synthetic coding sequence
atgatccccccccaggaggccagcgcccggcggcgggagatcgaggacaaactcaagcaggaggaggagaccctctcctttatcagagacagcctcgaaaagagcgatcagttaacaaagaatatggtgagcatattatcatccttcgaatcaagacttatgaagcttgaaaattcaattatccccgtgcataagcagacagagaatctacaacgcttgcaagagaacgtcgaaaagacgctcagttgccttgaccacgtaatttcgtattatcacgtagccagtgatactgagaaaataattagagaaggtcctacgggcaggcttgaggagtacctggggagtatggctaaaattcagaaagctgtggaatactttcaagacaactctcctgacagtcctgaattgaacaaggtcaagttgctcttcgagcgcggaaaggaagccctggagagcgaattcagatccctgatgacccggcacagtaaagtggtctcacccgtgctaattctcgatctgatctcgggagatgatgatttggaggcgcaggaggatgttactctcgaacacttgccagagagcgttctccaggatgtgatccgcatttccagatggcttgtggagtatgggcgaaaccaagattttatgaatgtgtattaccagatcagaagttcccagctggaccgcagcataaaaggattaaaggagcactttcataaatccagcagctctagcggagtgccctactcgccagcaatacctaataaacgaaaggatacccctacaaaaaaacccgtgaagcgcccaggtcatgagcatgactttcgcgtcaagcacttgtcagaggccctgaacgacaaacacggccctctagccgggagggacgacatgctcgatgtggagaccgacgcttatattcattgtgtcagtgcatttgtgaaactggcgcaaagcgaatatcagcttttagccgacataatcccagagcatcaccaaaagaaaacttttgacagcctgatccaagacgccctggacggcctaatgctggaaggtgagaacattgttagcgcagctaggaaggctatcgtacgccatgatttctcgactgtgcttacagtattcccaatcctacgacacctgaagcagactaaacccgagttcgaccaggtcttgcaggggaccgccgcctccacgaaaaacaaactccccggactaatcacatcgatggagacaatcggagcaaaagcccttgaggacttcgccgacaacataaagaatgacccagataaggagtataatatgccaaaagatggaactgtccacgaactcacatctaatgcgatcctgtttctgcagcagctgctcgactttcaagaaacggccggcgccatgctagcatctcaggaaacaagttctagcgccacatcttactcttccgaattcagcaaacgactgctgtcgacctacatctgtaaagtactggggaatcttcagctgaacttgttgagcaagagtaaggtttacgaggatcccgcgttatcagccatattcctccataataattacaattatattcttaaatccttagagaagtctgagctaatccagctggttgccgtgacgcaaaagaccgccgaacggtcctatcgcgaacacattgagcagcagatccagacataccaaaggagttggctaaaggtcacggactacatcgctgagaaaaacctaccggtatttcagcctggcgtgaaactcagagataaggaacgacagatcatcaaagagcggtttaaaggattcaatgatggactcgaagaactatgcaaaattcaaaaagcgtgggccatacccgacacggaacagcgcgaccggataaggcaagcgcagaagaccatcgtgaaagagacttacggagctttcctccagaaatttggatctgtgcccttcaccaaaaacccagaaaagtacataaaatatggagtggaacaggtaggcgacatgatagatcgtttgttcgacacctctgcttag

SEQ ID NO: 25284 - DNA, 459 bp, Artificial Sequence
  Description of Artificial Sequence: Synthetic coding sequence
atgaccgacgtgcccgccaccttcacccaggccgagtgcaacggcgacaagccaccagaaaatggtcaacagacaattaccaaaatctcagaagaattaacagatgtggactcacctcttccacactaccgcgtggagccaagcctcgaaggggctctgactaaaggaagccaggaagaaagaaggaaacttcaggggaacatgctcttgaattcatcgatggaggacaaaatgctgaaggaaaaccccgaggagaagctattcatcgtccataaggctattactgacctcagcctccaagaaactagcgctgacgaaatgacgttccgcgaaggccatcagtgggaaaagatccctctgtccggcagcaaccaagagatacgtcgccagaaggaacgcatcaccgaacaacccctgaaagaggaagaggacgaagaccgcaagaataaggggcattag

SEQ ID NO: 25285 - DNA, 768 bp, Artificial Sequence
  Description of Artificial Sequence: Synthetic coding sequence
atgtggcccttccccagccggagcctgttccccccccccacccaggcctggctgcagacagtctcttccgatcctgaggcgcaaggatggggggcttggaacgaaaccaaagagatcctaggcccggaaggaggtgagggaaaagaagaaaaagaagaggaagaagatgcagaagaggatcaggatggcgacgcaggattcctcctgtcccttttagagcaagagaatctcgcggaatgccctcttcctgaccaagaactggaagcaataaagatgaaggtttgcgctatggagcaagctgaaggaaccccacgcccgccaggcgtgcagcagcaggcggaggaggaagagggaacagctgcaggccaactgctcagccccgagacagtgggctgccccctgagtggcacgcccgaagaaaaggttgaggccgatcacaggagcgtgtacgttgggaacgtggattacggagggtccgctgaagagcttgaagctcatttctctcggtgcggcgaggtccacagagtcacaattttgtgcgacaagttctcaggtcacccaaaagggtgctgccgtaaggaacccacatccttaggcagcgcaccccagacagcaggcgccttcgaagatacacaggctcccggagggcatccctcgccaaccgccgcctccagagcagggcccggtagcgatcacaagggccgtactggccctgttgaaaacagccatcacggcttccatcgaataaagggtaagactagattctag

SEQ ID NO: 25286 - DNA, 3561 bp, Artificial Sequence
  Description of Artificial Sequence: Synthetic coding sequence
atggagaaggccaccgtgcccgtggccgccgccaccgccgccgagggggaaggctctccacctgcagtggcagctgtagcaggccctcctgctgccgccgaagtcggggggggtgtgggaggaagttctagggcccgttcagcctctagccccaggggcatggtgcgagtctgcgacttactgcttaaaaaaaaaccccctcagcagcagcaccataaggccaagagaaacaggacttgtcgacctccctctagtagcgagagctcttctgactcagataattctggcggaggaggcggtggaggcggggggggaggaggcgggggggggacaagcagtaacaactctgaggaagaggaagacgacgatgatgaagaagaagaagtgtctgaggtggagtccttcatcttggaccaagacgatctcgagaatccgatgttggaaactgcatctaagctactgctttctggcacagccgatggggcagaccttcgtactgtggatcctgagactcaggctcgcttagaagctctgttggaagcagccggaatcggaaaactgtcaactgctgacgggaaagcctttgcggatcccgaggtcctgagacgcctaacttcttccgtgagttgtgccctggacgaggcagctgctgctctaacacggatgagggccgagtctacagccaacgcgggccagtcggataaccgttccttggctgaggcctgttcggagggggatgtaaatgccgtcagaaagttactgattgaagggaggtccgtcaatgagcacactgaggagggtgagtcactgctgtgcctggcgtgtagtgccgggtactacgaactggcacaggtactgctggccatgcacgctaacgtggaagatcggggcattaagggagatatcacacctttaatggccgcagccaatggcggccatgtaaagattgtcaagctgctgcttgcacacaaggcagacgtgaacgcccagagctctacaggaaacacagccctaacctacgcctgtgccggtggctacgtggatgtggtgaaggttctcctggagagtggagccagcatagaggatcacaatgagaacggacacacacccctcatggaagccggctcagctggccatgtcgaagtcgctaggctgctactggaaaatggggccgggataaacacccacagtaacgagtttaaagaatctgccctgactcttgcatgctacaagggacatctcgagatggtgagattcttgctggaggccggagcggatcaggagcataagacagacgaaatgcataccgctctgatggaggcctgtatggacggccacgtggaagtggcccgcttactactcgactcgggagctcaagtgaatatgcctgccgattcatttgagtcaccacttactctggcagcatgtggcggccacgtcgagctcgcggcactgctgatcgagcgcggggcatctctggaggaggtgaacgacgagggctacacccccctgatggaagccgccagagagggtcacgaagagatggtggcgctgctactcggccagggagccaacatcaacgcacagaccgaagagacacaagagactgctttgaccctggcatgctgtggggggttcctggaggtggcagatttccttatcaaagcaggcgcagacatcgagctgggttgtagcacacctcttatggaggccgcccaggaagggcatctggaactggtcaaatacctccttgcagctggggctaacgtacacgctacaacggccaccggggatacggctttgacttacgcttgtgagaacggccatacggatgttgctgatgtgttactgcaggcgggcgctgacttagaacatgagtcggaaggggggaggactcccctcatgaaggctgcgagggctggtcatgtgtgcacggtgcagtttctgatttccaaaggcgcaaacgtcaatcgaacaaccgcaaataacgatcatacggtgctatctctggcatgcgcaggcggccacctcgctgtggtggaactgctgctcgcgcacggtgctgatccaactcatagactgaaagacggcagcacaatgctcatcgaggctgctaagggtgggcacactagcgtcgtgtgttatctcctggactatccgaacaatcttctgtcagccccgccaccagatgttacacagctcactcctcccagtcatgatcttaacagggccccaagagtgcctgtgcaggcactgcccatggtggtgcccccacaagaaccagataagccgcctgccaacgtggcaacaacacttccgatccggaacaaagcggctagcaagcaaaagagctcatcacacctgccggctaacagtcaggatgtgcagggatacattactaaccagagccccgagtctatcgtggaggaggctcagggtaaactcacggaattggagcagaggattaaggaagcgatagaaaaaaacgcccagctccagtctttggagcttgcccatgcggaccagctgaccaaggaaaagatcgaggaattgaacaaaacgagagaagagcaaatacagaagaagcagaaaatcctcgaagagttgcagaaagtcgagagagagctgcagctcaaaactcagcaacagcttaaaaagcagtatcttgaggtgaaggcacagaggatccagctgcaacaacagcagcaacaatcatgccaacacctcggcctgctcacccccgtgggagtaggtgaacaactatccgagggggactacgcacggttgcaacaggtcgatcccgtgttgctcaaagatgagccacaacagaccgccgctcagatggggttcgccccgatccagccgcttgccatgccccaggctcttcctctcgccgctggaccccttccaccagggtctattgcgaacctcactgaattgcagggagtgattgtgggccagcccgtgctcggccaggctcaacttgccggcctcgggcagggcattttgacggagacgcagcagggcctgatggtagcaagtcccgcacagaccctgaatgatacactggatgatataatggccgcggtgtctggccgagccagcgccatgtccaacacgcctacccactcaatcgcagcttcaatctcacagccacagacaccgactcccagtcccattatttcacccagcgccatgctaccaatttacccagcaattgacatcgatgcccagactgaatcaaatcacgacaccgctctgacactggcctgcgctggcggtcatgaagagttagtccagactttgcttgaaagaggcgcctccattgagcatagggacaagaagggctttacccccctgattttggccgctaccgcgggacacgtgggggtggtagagatcctgctggataatggcgccgacatcgaagctcagagtgaaagaaccaaggatacacccctttccttggcctgtagcggcggcaggcaggaggtcgtggagctgctcctcgcgcggggtgccaacaaaagtacaggcatgtttctgattactcacttatag

SEQ ID NO: 25287 - DNA, 2682 bp, Artificial Sequence
  Description of Artificial Sequence: Synthetic coding sequence
atggccgccaccgtggagggccccgagctggaggccgccgccgccgcaggagacgccagcgaagacagcgacgccgggtcccgcgctctgcctttcttgggcggaaaccgcttgtcactggacctatatcctggcggatgtcagcagctgcttcatctgtgcgtgcaacagcctctgcagctccttcaggtagagttccttcgcctctcaacccatgaggaccctcagcttctggaagcaacactagctcagctgccacagtcacttagctgtttaagaagcttggttcttaagggggggcaaagaagggacactctgggggcctgtttacgaggggccctgacaaacctgcctgccggtcttagcggactcgctcatctcgcacacctggacctgtccttcaactccctggagaccctcccggcctgtgtgcttcagatgaggggcctgggcgccttactcctttcccacaattgtctgagtgagctgcccgaggcactgggtgctctgccggccctgaccttcctcaccgtcacacacaatagactgcaaaccctaccaccagctttgggagccttgtccactctgcagagactggatttgagtcaaaacctcttggacaccttaccccccgaaatcggcggtctcgggagtctgctggagctcaatttggcgtccaacaggttgcagtcactgcctgcttctctcgctggactgcgatctctcagactgcttgtacttcattctaacctgcttgcatctgtgcctgcagatttggctcgactcccactcctgacacgactggacttgcgcgacaaccagctgcgggacttgcctcctgagcttctggatgcacctttcgtgaggctgcagggaaacccgcttggcgaggcctcccctgatgctccctcatctcccgtcgcggcgcttatcccggagatgccaagattattcctgacaagcgatctggattcttttcccgtgaccccgcagggatgctcagtgactttggcctgcggggttcgactccaatttcctgccggcgcaaccgctacaccaataactatccggtacagacttttgctgcccgagcccggcctagtccccctggggccacacgacgcgctattgtcgcacgtgcttgaattgcagccacacggtgtcgcttttcagcaggacgtgggtctgtggttacttttcacgcctcctcaagcacggagatgtcgggaggtggtggtgaggacgcgcaatgataattcatggggcgacctggagacctacctcgaggaggaagcccctcagcggctctgggcgcactgtcaggtgccccacttctcctggttccttgtcgtatctcggccagttagtaacgcctgtcttgtccctcccgagggaacactcttatgctcatcgggacaccctggcgtcaaggtgatctttcccccaggggccacagaggaaccgcggagggtgagtatgcaagtcgttagaatggcggggagggaattacaggcacttctcggggagcccgaagccgccgtgagccctctgctgtgcctgagtcaaagcgggccaccttctttcctacagccagtcacagtgcaactgcccctcccatctggaatcactggtctgtctctggatcgatcccgcctccacctcctgtattgggcccctccagctgccacctgggatgatattacagctcaggtagtacttgagcttacacacctttacgcgcgattccaagtcacacatttcagttggtactggctctggtacacaacaaaaaactgtgttggtgggcttgcccggaaagcatgggagaggttacggctccatagggtgaacttgatcgcactccagcggcgtcgtgacccagagcaggtccttctgcagtgcctcccgcggaacaaggtggacgcgacgctgagacgccttctcgagaggtatcgtggcccagagccctccgatacagtggaaatgttcgaaggcgaggagttttttgctgcttttgagcgggggattgatgtcgacgctgaccgtcccgactgcgtcgaaggcagaatctgcttcgtgttttacagccacctgaaaaacgttaaggaggtgtcattttaccgcggtgcagtcccggtcagagttcccgaggaggctgaggcagcacggcagagaaagggagcagatgcactctggatggccacgctaccaatcaagcttccgcggctcaggggttccgagggccctcgcaggggagctggcctgtctctagcacccttgaacctgggggacgctgaaactggctttctaacacagtccaatttactcagcgtcgcagggcggctaggccttgattggcctgcagttgcactgcatctcggagttagctacagggaagtgcagcggatcagacacgaatttcgggatgacttagatgagcagatcaggcacatgttgttctcttgggcagagcggcaggcggggcaaccaggtgctgtgggcctgctcgtccaagcactcgaacagagtgatcggcaggatgtagctgaggaggtgcgcgccgtcctggaacttggtcggcgcaagtaccaggactcaatacgccgcatgggactcgcgcccaaggacccagcactgcctgggtcgagcgcgccccagccgccggaaccagcacaggcttag

SEQ ID NO: 25288 - DNA, 1482 bp, Artificial Sequence
  Description of Artificial Sequence: Synthetic coding sequence
atggacttcctgctgggcaaccccttcagcagccccgtgggccagaggattgaaaaggcgaccgatggatcattacagtctgaggactgggccctcaacatggagatttgtgatatcatcaacgagaccgaggagggccctaaggacgcgctgagggcagtgaagaagagaatcgtgggtaataagaacttccacgaggtgatgttagccctcacagtcctggagacttgtgtaaagaattgtggacacagattccacgtgttagttgcatcacaagactttgtggagtccgtgctcgttcggacaattctgccgaagaataatcctcctaccatagtccacgacaaggttctaaatctaatacagtcctgggcggatgcatttcgttcaagccccgatctgacaggagtcgtgaccatttacgaagacctccgcaggaagggcctggagtttccaatgaccgatctcgatatgctgagccctatccacaccccccagcggacggttttcaactccgaaactcagtcaggtcaggactctgtgggaaccgactcttcgcagcaggaggactccggacaacacgcagcaccactccctgccccacctatactgtctggagatactccgatcgctcccacccctgaacagattgggaagcttcgctcagaactggagatggtcagtggcaatgtgagggtgatgtccgagatgctgacggagctagttcccactcaggctgagcctgcagacctagaattactccaggaattgaacagaacctgtcgagctatgcagcaaagagtcttagagctgatacctcagatagcaaatgaacaactgactgaagagctgttgatagtgaacgataatctgaataacgtattcttgagacatgagcggtttgaaaggtttagaacaggacagacaactaaagctccatccgaggcagaaccagctgcagacctcatcgacatgggacccgatccggcagccactggaaatctctccagtcagctggcgggaatgaacctcggctcgagctccgtgcgggccggcctgcagtctctcgaggcgagcggaagactggaggacgagtttgacatgttcgcgcttacccgcggctcatccctcgcggaccagcgcaaggaagtcaagtacgaagcccctcaggccacagatggccttgcgggggccctagacgcccgccaacaatcaactggcgcaatcccagttacccaggcttgccttatggaagatatcgagcagtggctgtctaccgacgtagggaacgacgccgaagagcctaaaggggtgaccagtgaggggaaattcgataagttcctcgaggagcgggcaaaggccgcagataggctccccaacctatccagcccctctgccgagggtcctcctggaccacccagcggccctgcccctcggaagaagacacaggagaaagatgatgacatgcttttcgccctgtag

SEQ ID NO: 25289 - DNA, 663 bp, Artificial Sequence
  Description of Artificial Sequence: Synthetic coding sequence
atgaacagccagccccagacccggagcccccccagccggaccgtgcccattcactgcaccgacaattggaagcgaagaaaagtgctggagcagactcctgtgtatcggtcgctagccggtaggggttggatcaaatactgcattttttttcaacggccccagattcagcctcctagggccacaatcccaaactcttccccctctataagacccggtgctcaaaccccaaccgctgtgtaccaggctaaccaacatataatgatggttaaccatctgcccatgccataccctgtgcctcaaggaccacagtattgtataccccaatacagacactctggtccgccgtacgtgggacctcctcagcagtatcctgtccagcctccaggcccagggccgttttatcccggacccggccccggggatttccctaacgcttacgggacccctttttatcccagccagcccgtgtaccagtctgcgcccatcattgtgcccactcagcagcagccgccaccagcaaagcgggaaaagaagacaattcgaatacgcgatcctaatcaaggcggaaaggatatcaccgaggagatcatgtccggtggaggttctcgcaaccctacaccgcccatcggacgtcccacatccacaccaacgcctccacagtag

SEQ ID NO: 25290 - DNA, 414 bp, Artificial Sequence
  Description of Artificial Sequence: Synthetic coding sequence
atgagcctgttcggcaccaccagcggcttcggcaccagcggcacctcaatgttcggtagcgctacgaccgataaccataaccctatgaaggacatcgaggtaacttcttcacccgatgatagtatcggttgccttagcttcagccccccgacgctccccggcaactttctcatagccggcagctgggctaacgacgttaggtgttgggaggtccaagactctggacagaccatacctaaggctcagcagatgcacactgggcctgtattggatgtgtgttggtctgacgatggcagcaaggtcttcaccgccagctgtgataaaactgctaagatgtgggacttatcctcaaatcaggccatacagatagctcagcatgatgcccccgtgaaaacaatccattggataaagtag

SEQ ID NO: 25291 - DNA, 7809 bp, Artificial Sequence
  Description of Artificial Sequence: Synthetic coding sequence
atgaagcggaaggtggtgaacacccacaagctgcggctgagccccaatgaggaggcattcattctcaaggaagactatgaacggagacggaagctgcggttgctccaagttcgtgagcaagagcgggatatcgcgttgcagatcagagaagatattaagcaacggagaaatcagcagttcacccggctcgcagaggaactcagagccgagtgggaagagtcacaaactcaaaagatccaaaacttggaaaaactctatttagcttccctgcgctctatgggggagggtcaccgccaagcaaaggagaacgaaccggatctggacgcattggcccaacgcgctgccgagaggaagcggaaggcggatctgcggcacaaggaggccctgaaggtgcagaagaatcaaaaagagatcctgctgaagcagaaaacatggcatattaaagcacggaaagaagccctgttggtggaaaaggaaagatctgccaaaattacttcactcccaccccccccacctacactgtttgagaacatcgaagttaaaaggatctctgccgtcaagacaaactcctcaacctaccaccacctccacaccttcgtcaacagggaaaccgacacgaagaggccagatgcaaggctggcggcagaggaagaggccaagcggttagaagagttgcagaaacaggccgcccaagagcgcatggagcgttttgagaaagcacatgtgagaggcttccaggccatgaaaaaaatccacctggcccagaaccaggaaaagcttatgaaagaactcaaacagcttcagcaggaggacctggcgcgcaggcggcagactgtcgcacagatgccaccgcagcttgtcgaacttccttataaacggagtgaaatgaaggaggactggcagagggagctcgagtttgcgttcgaagacatgtacaatgccgatcgaaaggtgaaaggtaatctcattctccacctggagcccgagcccctgccgacggtgaccaaccagatccaggacgaagagctggacctgtccatggagcaggagaacttgggggccgctgaagatcttccagtgactgaagccgagatttgtagctctgagacagacgtgcctctggttatgaagacgcagcagattcctagcaaagtgctgttcaagaaactcctgaataagatcaggagtcagaagagtctgtggacaataaagtcaatgagcgaggacgagagtgagatgataactactgtttcagaaattgagtcaaaagctcctactgtggaaagcggcactatcgcatccaaagaaagaaccctctctagcggccaggaacaagtagtggagtctgatacactgactatcgaaagcggccccctggcctccgaggacaaacccttgtcttgcgggaccaactctggaaaagaacaggaaatcaacgaaacgctgccaatcacaacagtggcccagagctcggtgttacttcatcctcaggaggcagcagccagaatcagaatgtcagcaaggcaaaagcagatcatggagatcgaagaacagaagcagaaacagctcgagttgctggagcaaatcgaacagcagaaacttagactggagacagattgcttccgtgcgcagttggaagaagagaaacggaagaagacacagccaacaggggtgggaattgcccccgccagctgcccagtcatatctgacgaagattctcacaggcagatgatcaggaactaccagcatcagctgcttcagcagaaccggctgcacagacagtccgtggaaactgcccgaaagcagcttctggagtaccaaaccatgctgaaagggcgctgccctagcgtgtccgccccctctctgataaccgatagcgtgatttcggtgcctagctggaaaagcgagcgcccgacagcgataagtgagcattgggatcagggccagaggcttaagctttcacccaacaagtaccagcctatccaaccaattcaaacctcaaaactcgagcaggaccattttcaggtggccagacaaaatcacttcccccaacggcaggtcgagacaaccgagacgcttcgagcatccgacatcctgaccaaccaggctctcgagagccaggaacatctgcgtcaatttagtcagactgagacacagcagcgagattacaagctggttcctaaggatagcgagaccctgagtagagctctgagccacgaccgacagctgatctcacaagatgccagaaagattagcgagacctttggggcaaccacatttcagtctctggagtcccagcagctgttttctgagaactcagagaacatctcctatcacctgactgaaccttcaagctttgttccattggttcctcaacattcgttctcatcattacctgtgaaggtcgaaagcggaaaaattcaggagccatttagtgcgatgagcaagagcaccgtttccacctctcatagtatcatctcccagatgcatgaccggccgctactccctagtgagaatatcactgcacagcagggaaacatgaaggccctgcaagagcagctggacttgcagaagaaggtgctgcaagccacccaggaagcgcaggagcagcttctgctgtgtaaacaaaaagaagtggagcagcagacaggtctctctgtgttccttccgctcgtcactccagatagctccgctctgctgccctctgcaaaggctgacctcggacgaattcaggagtcgtctccaactaagaataatattgcagtcagcagcgatcatcacgttatttctcagttgcaggacaaacgactatccctgagtcagcctatcctgagccaacagaacaactttaagtttttacaggaacaactgaatatccagaaagattcattgcaggccagacgtgaagcacaagaggttctctacgtacacaagcagagcgagctcgaccgcagagtttgctctgaacaggctgaaccgtctttcccttttcaggtagcccagcacacattcacgagtctaccttcggcggataccaagtctggcaaaattcaagaacagcatagttctaaatcggaaaaaggcctggtgtcatgccagtccgatattcctatttctcaggacggatctctttccttcttacagcagtttcttcctttgcatgattcactgaaattgctccaggaacaattgaccaagcagagagacacactacaagctagacatgaggcccaggtcgagctgcttctgcaccgccaacgcgatctgggcgattccaaaagcgggctggtctcatcttcttcgagtcctgttgtggtccagcactccgttgcctctcaggctagcgccaaggctgagcccaggcgaatccaagagctctacttaagcgaaaaggagaacgtgggaccttcctgtcacctgataattcccacctttcaggacaaatcactgagcttcccccagcacagtctggcacagcaggagaatctgaccatattgcaggaacagtctcagatacaaagagtcattctgggggcaaaggaaggtacacaggagtttgtgcacacagagtctgaattggagaagcggatcagctcggagcagaccggcacttccagcagtttgtcccaggtggatgagtctgaacggtttcaagaatgcatttctataaaaagcgattctactataccgctgtcccatccaaaaatccctcgctgccaagagcgcctgctgcgagtaagccaacatatgctcccactccaggataatctagaggaacaccaggcttggctggatactgagaaagaagcatttcatttctctcagaagacacaggagaatacaagtagcgaacagactggctcctcatccttcattcctcagctagtacaactgtcctttacatctctggctagtgcagagtccggaaccatccttgagcccctctttactgagagtgagagcaaaatcttttccagtcaccttcagatcccacagttacaggaccgtcttttgagaatttctcagttgatccagccacagcaggacaacctcaaggcattgcaggaacagctcgcaacgcagcgagaggccattatccttgcgcgacaggaggcccgggaagagctgttgttgcaccagtcggaatgggaggggcgcatctcacctgagcaggtcgacacttcctccctgcctctggtgccccagcacagcttcgcttccctgcctctcaacgagagcgaaagaaatcaggaaccttgctctataaacagtgataatatcgtctcctctggccattccgaaattccaactctgcctgacgggctgctgggcctttcccacctcgttctgccacagcaggataatcttatcgcactggaggagcacctgcatgctcaaaccgatttcctcccttccatcgaaaagacccagaaggaactcgttctgtcaaaaccctgcaagtttgaagaaaaggtgagctcagaacattttattcaatcccaccacggcgatctccaagctctacagcagcagctagatactcaaaagaaggccattcgcagtatccaggaggtccaagaggaattgttgctacagcggttgagcgagcttgaaaagagagtgtccagcgagcaggtgtgttccagttctttcgtcagtcaggtccctgtcgccgacagcgaacggactcagaagagttttcctacaaaaagcaatgacacactgccatcatcccaccgagagataccccggctacaagatcgcctactgtcccttagcaagcctatcctccctcagcaggacaatatgacagcacagcttgacgcccaaagggaggtgatgtactcctatgaaaaacctcaggaggagcttagcctgaacaaacagcgcaagctcaacaaaagcgaaagtgcagagcacactattccaagcctcttcttaccgaaagagaccgaacactcctttattcccttgccgtttgcggaagccaagcccaaaagtacttgcgaattgtattcaagccagaatgaacacgcagctccaccatccaacccagtgattccaggattccaagacaggttgctgtccttttcccagtcagtcctgacgcagcaggacaatttgggcctgcaaaaacaattggatctgcagagagaggtattgcactactcccagaaggcacaggaaaagcttttagtgcagagacagaccgcattgcaacagcagatacaaaagcacgaagaaacactgaaggacttctttaaggacagccaaatatcaaagcccaccgtggaaaatgatctaaagacccagaagatgggccagctgagagattggtttcccaatacacaagatctggctggtaacgatcaggaaaatattcgtcatgccgacaggaacaatagtgatgacaaccatctggctagcgaagacacctcagcgaaacaatccggcgagcaccttgagaaggatttggggagacggtcctccaaacccccggtcgcgaaagtgaagtgcgggcttgatttgaatcaacacgagctttccgcaattcaggaagtcgaaagtccagccattgggcgaacctctatccttggcaaacccgggatatacgaggaccgagacccattacgggtttcaatctccagagaacagtctttctttgggtctcccctcgcccacgatccgttctcttgccttcagctggtgggtcaggagaacgtgtgcggcgacgactacgacgaggccgttaagctgaaggaatcggtcgtggaaaatcatgcagtcctgagctatgccgtggaggaggaacacgcctacttgggccctactgtgaaaccggatgacaaagctaaaacactatcttacgagccactgtcctctgcaaccgtgtcaacaggcagcttgctgtcctacgagaacactgatctgtccctcacagatccagagtccttctctgaacacatggatgacagcaagcaggaatccaccacatcaaaagaggaggagaccaacataatttctagtatcgtgccatccacccaggacatctatcagaggcagaacagttccgatgtgcacaagtcactgctgcctgccgttgacgagacaacttgtggccacactcacttccagcagatgatcgataagtatatcaacgaggctaacttgattccagaaaagacagacctgcaggagctagaacacatttttcccaacctacatcatcagctcttcaaaccactagaaccgcaccctgactttgatctctctagctccagctcaggtatatcccctgacaatcgcgacttctaccagaggagtgattcttcatctgagagtcactgtgctaccggcctgtcaaagagcacagtttattttactgctcttagaagaacctctatgcacagcagcctcaatacttcccctaaccaacaacctgatacgaatctggcacatgtcggagctcatagttttgccactgaaaacatcataggagggtccgaacagtgttttgagcagctgcagccggaatattctagccaagaagaaagtcagcatgccgatctacccagtatcttctctattgaggcccgggacagctctcagggcatgaaaaatcagaactaccctagcgaagagcatacggaaatccttcagaataagaagaaaattgtgcattttcaactgagcattggcaatctttcaagcgtgtactccagcagcgacgaggccaacgtgttcgatcagctgaacgtgcagcactctactccatgtggttctaacagctctgagtgtagcacaaagcatcaactggaatctaggaaagagtcaatgggtttcgaggagttgtcgaaaaggggggtggtaacgatgctccagagccagggccttatcgaggacaacaagaatgaaacctgcagggtgctggacataaatcctcaggttgaggaaaccgatagtagactctgtgttcggactgtcgagatgggcacatcaatccaagccccttattctcttactacgcagaacgagaagtattttgagaactccgctgagaccgatatccctaaaataacgaaaaaattgagtcagttgggcgaatctgagctttttgcttccagtggcagcttctcgctgcagtcctccatccctgtgtgggaaactgagacagggcatggtatcatggaagaacccgaactgacattgatttcgacaacagacacttcgattgctgagatggacttcgctaacctgacattggaagagaagtcggagaatgaggctaagtgcttcttccaggtgtcagaatttctaccactggtgtcagcaacagaagcatctgactatcctgcggtctccgagctgtccatcgaaaaacccagaacagctagcacagctgaaacccctcggcgacttaccccagtgccagggtccttacaagaggcatttataaagagaaagaagtcctttatggagcggagtcatcagcgacagaaggaaataagaaataaaatccacgtgtcagaaaatagccagatcaagacggtgaaagaaaaacccagtattagcagcagtgtgagcaggctcaagggggtgaacaaggtgcgcgccagttttcccgaggatagaaagactacacaggcactgcggcaccagaggggcctgagactgtacaaccagctggccgaagtaaagcagcaaaaagaggagaagaccaaacaggaagcctatgcccagaatagggctagggccaaagagttccacaagaaaacactggagaaactcagagccaaaaatacttgctag

SEQ ID NO: 25292 - DNA, 1602 bp, Artificial Sequence
  Description of Artificial Sequence: Synthetic coding sequence
agcgcccccagcgtgggcaacgacatgggcaacgacgacgccatcggcgggaacgtgagcaaatacatcgtattgcccacaggctactgtgggcagcccaaaaaaggacacctaatttttgacgcctgttttgagtctggcaatctgggacgcgtcgatcaagtctctgagttcgaatacgatctgtttatccgaccggatacctgtaaccctaggttccgtgtctggtttaattttacagttgaaaacgtaaaggagtctcagcgcgtgatatttaacattgtcaatttctccaaaaccaaaagtctctatcgggatggtatggcacccatggtgaagagcacttcgcgccctaagtggcagaggctcccccctaaaaacgtttattactacaggtgccctgaccacaggaagaattatgtcatgtccttcgcattttgctttgatcgggaggaggacatttatcaattcgcctactgctatccgtacacatacacccggttccagcactacctggattccctccagaagaggaatatggactatttttttcgcgagcagcttggtcagagtgtacagcagcggaaacttgatcttctaacgatcacgtccccggacaatttacgggagggggcagagcagaaggtggtttttatcacggggcgggtgcaccctggcgagactccaagctctttcgtgtgtcagggtatcattgattttctagtgagccaacatcctatcgcgtgcgttctgagagagtacctggtgtttaaaatcgccccaatgttaaacccagacggcgtctaccttgggaactataggtgtagcctcatgggcttcgatctgaacagacactggctagatccgtcaccttgggtacaccctacccttcatggtgtgaagcagctgatcgtgcagatgtacaatgacccaaagacatcgctggaattctatatagacatccacgctcattcaaccatgatgaatgggtttatgtatggtaatatcttcgaggacgaagagagattccagcgacaggccatatttccgaaactcctatgccagaacgcggaagatttttcttattcttcaacctcttttaaccgggacgccgtgaaagcaggaaccggccggaggttccttggcggcctgctggatcacacttcatactgctacacgctggaggtgagcttctactcctatatcatctctgggacaacagccgctgtaccttacacggaggaggcatacatgaaactggggcggaacgttgcgcggacttttctcgattactaccggctgaacccggtagtggaaaaggttgctattcctatgcctcgtctgagaaataaagaaattgaagttcagcggcgcaaggaaaaatcgcctccgtacaaacacccactgctgcggggacccgcttccaactatccaaatagtaagggcgataagaaatcttctgtaaaccacaaagatccctcaacaccatttaaaactcgaagtccaggccgcagctacggcgaccggagtatgcacttcctgttaggcaacgaaatcaatcacagtagtctggctagcaaggatctctggatcaacgcctag

SEQ ID NO: 25293 - DNA, 1509 bp, Artificial Sequence
  Description of Artificial Sequence: Synthetic coding sequence
atgcccgagatccgggtgacccccctgggcgcctgccccgtgctgtcgtggaatctagttctgccacccgggcgaggcagcagggccccatcctccaccgacacgcgtactggttttcacgtgttgccgcatggcgtggatgacgaacttgagatcaaggcctactacgcagggcatgtcctgggtgctgccatgttccagattaaggtgggttcagaatccgtggtgtacaccggtgattacaatatgacacccgacaggcacctgggcgcggcatggatagacaaatgccgtcctaacctgttaataacagaatccacatacgctactaccataagggactcaaagaggtgccgagagagggactttctaaaaaaggtacatgagaccgtggagcgtggtggaaaggttcttattcctgtttttgcactgggacgcgctcaggaactgtgcatcctcctggagacattctgggagaggatgaacctcaaagtgccgatctacttctccactggactaactgagaaagctaatcactactataagctgttcattccctggaccaatcagaagattcggaagacgtttgtgcaacgcaatatgtttgaattcaaacatatcaaggcttttgaccgtgcttttgccgacaacccaggcccgatggtggtgtttgctacccctggcatgcttcatgccggacagagtctccaaatcttccggaaatgggctggaaatgaaaagaacatggtgatcatgcccgggtattgtgtgcagggaaccgtgggccacaagatcctgtcaggacagaggaagctggagatggagggacgccaagtgttggaagtaaaaatgcaggtggagtatatgagcttcagtgctcacgccgacgcaaaagggatcatgcagcttgtgggtcaggctgaacctgaaagcgtactcttggtgcacggtgaggcaaagaagatggagtttctaaaacagaaaatcgagcaggagctccgtgtgaattgctacatgcccgctaacggagagacagttacactgcccacgagcccctcaatacccgtaggcatctctctgggcttattgaagcgagagatggcccagggccttctgccagaggcaaagaaacctcggttattgcacggaacactgatcatgaaggactctaacttccgactcgtcagtagcgagcaggccctcaaagagctggggctggcggagcatcagttgcggtttacttgccgcgttcatctgcacgacacccgcaaggagcaggagacagcactcagggtttactcacatctaaaatcagttctaaaagatcattgcgtgcaacacctgccagacggctcagtgacggtggagtctgtactgctgcaagccgcagccccttccgaggaccccggcacgaaggtactgttggtttcctggacataccaagatgaagagctgggttcatttctgactagcctgctgaagaaaggcctgccacaggcaccaagttag

SEQ ID NO: 25294 - DNA, 1371 bp, Artificial Sequence
  Description of Artificial Sequence: Synthetic coding sequence
atggccgacagcctggagagcacccccctgcccagccccgaggaccggctggccaagttgcatccatccaaggaattgttggagtactaccaaaagaagatggctgaatgcgaggccgaaaatgaggatttactcaaaaaactggagctgtacaaggaagcctgcgaaggacagcacaaattagagtgtgacctccagcagcgcgaggaggagattgccgaactccaaaaggccctgtctgacatgcaagtctgcttattccaggagcgggagcatgtgttacggctctatagcgaaaacgatcgcttacggataagagagctggaggataagaagaagattcagaacttattggcactagtcggcaccgatgcaggagaggttacctatttttgcaaggagccgcctcacaaagtcacaattctgcaaaaaacaattcaggccgtgggggagtgtgaacagtcagagtcaagcgcgttcaaagcggatcctaagatctccaagcgtcgccctagccgagaacgtaaagaatcaagtgagcactaccaacgcgatatccagacgctgattctgcaagtggaggcacttcaggcccagctcggcgagcaaaccaagcttagtagagaacagatcgaaggcttgattgaagacaggcgtatccatctggaggagatccaggttcaacatcaacgcaatcagaataaaatcaaggagctgaccaaaaacctgcatcacacccaggaactgctgtacgagtccaccaaggactttctccagctgagatcagaaaatcagaacaaagaaaaatcatggatgctggaaaaagacaacttgatgtctaagattaagcagtatcgcgtgcagtgcaaaaaaaaagaggacaaaatcggcaaagtgctaccagtgatgcatgaatcccatcacgctcagagtgaatacatcaaatcactgaaagataaacttgttcaggagaagaaactcagcaacatgtaccaggaacagtgcattagtctggaagaggaactcgcacgcattcgcgaagaggagggaatgaggcgcgagatcttcaaggacaggactaacaagatgggaaaaaggctgcagatcatgactaagcgctacgaggccctcgagcgcaggagaatcctagaggtcgagggattcaagaccgacatcaaagtgctccgccaaaaactcaaggacttggaacagatgctctacaaggccactgtgaacgctagggccaatcaagatctggccctgctgtgcgaagtcagggattctaaccgacgcgcccacaagatccaaggggagttgaaaaacctgaaatccaaagttttcggtctggaaaatgagttacgcttgtgttag

SEQ ID NO: 25295 - DNA, 270 bp, Artificial Sequence
  Description of Artificial Sequence: Synthetic coding sequence
atgagcgagcagggcgacctgaaccaggccatcgccgaggagggcggaacagaacaagaaaccgctacacccgaaaatgggattgttaaatctgagtctttagacgaagaggagaagctcgagctccagagacggctggaagctcagaaccaggagcggcgaaagagtaagtctggagccggtaaagggaagttaacgagatctctcgccgtatgcgaggaatcctcagcccgaccgggcggggagagcctgcaggaccagaccctatag

SEQ ID NO: 25296 - DNA, 453 bp, Artificial Sequence
  Description of Artificial Sequence: Synthetic coding sequence
atgcaccccgaggacagcgtggtgagcagcaaggtgctgggctgctcccatttcccagtagcatctcgacccgcgggctcccacgaccctcagcccggccatagaggtagagtccttggacccgctcgggctccaggatgggtgcgatatgcagaaagggtcctgggccggcccattacagctcatctctgtacagccaagtctccgcagcaagtgatgggatccctggtgaaggattattttgcccggcagcagaatctgagcccagaaaagatctttcatgtcattgttgcgccatgctatgataaaaaactggaggctttacaggagagcctgccgcctgcgttgcacggtagccgcggtgccgattgcgtattgacctccggagaaattgcccaaattatggaacagggcgatctatccgtgcgcgacgcagcagtggataccctgtag

SEQ ID NO: 25297 - DNA, 534 bp, Artificial Sequence
  Description of Artificial Sequence: Synthetic coding sequence
atgggctgctgcggctgcagccggggctgcggcagcggctgcggcggctgtggctcttcctgcggcggctgcggatccgggtgcggtgggtgtggaagcgggaggggcggttgcggatcaggatgcggaggatgcagttcttcctgcggggggtgcggcagtaggtgctatgtgcctgtgtgctgttgtaaacctgtttgcagttgggtgcccgcttgtagctgtacgtcttgtggctcatgcgggggctctaagggtgggtgcggctcatgtgggggatcaaagggcggctgcgggagctgcggcggcagcaaggggggctgcgggtcatgcggttgctcgcagtcctcatgttgcaaaccttgctgttgcagtagcgggtgcggcagtagttgttgtcagtcgtcatgttgtaagccttgctgctgccagtcaagctgttgtgtgccagtatgctgccagagctcttgctgcaaaccttgctgttgccaatcaaactgctgcgtcccagtgtgttgccaatgcaagatatag

SEQ ID NO: 25298 - DNA, 294 bp, Artificial Sequence
  Description of Artificial Sequence: Synthetic coding sequence
atgcccgccgagctgtggctgaccagctacggcgtgcgggaggtggaccaggtaaaacgcttgacgggacctggtctgtccgaaggacccgagcccagcatttctgtcatggtgacaggcggaccatggcctacgcgcctgagtcggacctgcctccactatctcggggagttcggcgaggatcagatctatgaagctcatcagcaaggacggggcgctctggaggctctcctgtgcggcggcccacagggcgcatgctccgaaaaagtgagtgctacaagggaggagctgtag

SEQ ID NO: 25299 - DNA, 264 bp, Artificial Sequence
  Description of Artificial Sequence: Synthetic coding sequence
atggagaaccagctggccaagagcaccgaggagcggaccttccagtaccaggactccctgccatcgcttccagtgccgtcattggaagagagccttaagaagtatcttgagagcgtaaagccattcgccaaccaagaggaatataagaagactgaggaaattgtgcagaaatttcaatccggcattggtgagaagctgcaccagaagctgctggaaagggccaaaggcaagcgcaattgggtgtttgttgtcatcattgaatag

SEQ ID NO: 25300 - DNA, 1881 bp, Artificial Sequence
  Description of Artificial Sequence: Synthetic coding sequence
atgtgcagcaccctgaagaagtgcggcacctaccggaccgaggtggcagagtgtcatgaccacggcagtacctttcaaggccgtaagaagggcggatccagctttcgagacaatttcgacaaaagatcttgtcactatgaacacggaggttacgagagacccccctcacactgtcaggagaacgatggttcagttgaaatgcgcgatgttcataaggaccagcagctgcggcacaccccttatagtattaggtgcgaacgccggatgaagtggcacagcgaagacgagatcagaattaccacctggcgaaatcggaagcccccagagcgaaaaatgagccagaacacccaggatgggtatacgagaaactggttcaaggtgaccattccctatggaatcaaatatgataaggcttggctgatgaatagcatacagtcgcattgcagtgaccgctttactcccgtggatttccattatgtgcggaaccgcgcatgcttcttcgtgcaggatgcctcagccgcctctgctcttaaggacgtatcatacaagatttatgacgatgagaatcaaaagatctgtatcttcgtgaatcattctaccgccccctattccgttaagaacaagctcaaacctgggcagatggagatgttgaagttgacaatgaacaagcgatacaatgtcagccaacaggccttagatttgcagaacctcagattcgatccggacctgatggggcgcgacatcgacatcatacttaatagacgcaactgcatggccgccaccctcaagatcatcgagcgcaacttcccagagcttttgtccctgaacttgtgcaataacaagctgtaccagctggacggcttgtccgacatcacagagaaggctccgaaggtgaagacgctcaatttatcaaagaataaattggagagtgcatgggagctcgggaaggtgaaaggcttaaagctggaggagttgtggctggaggggaatcctttatgctctactttcagtgaccaatcggcctatgtgagtgctattcgggactgcttccctaaactcctacggctggatggaagagaactgtccgcccccgttatagtggacattgacagctctgaaacaatgaaaccttgcaaggagaactttaccggttcggaaacactaaagcatcttgttctccagtttctgcagcaatactatagtatatacgatagtggcgatagacagggcttgctaggcgcctaccatgatgaggcctgcttttccctggcaataccattcgaccccaaagacagcgctccctccagtctttgcaagtactttgaagattccagaaatatgaagacgcttaaggacccttacctaaagggtgagctcctgagaaggactaaacgggacatcgttgactccctctcagcactgccaaagacccagcatgatctgtcaagtatcttggtggacgtgtggtgccagaccgagcggatgctgtgcttctccgtaaatggcgtctttaaagaggtcgaggggcagtctcaggggtcagtactcgcgttcacaaggacattcattgccactccaggaagttcatccagtttatgtatcgtgaatgacgaactcttcgtgagagatgctagcccgcaagagacccaaagcgcattcagtatccctgtctcgaccctctcctcctcttccgagccttcactgagccaggagcagcaggaaatggtgcaagcctttagtgcccagagtggcatgaagctggaatggtctcagaagtgtctgcaggataacgaatggaattacactcgagctggacaggccttcaccatgctgcagacggaagggaagatcccagcggaggcattcaaacaaatcagttag

SEQ ID NO: 25301 - DNA, 2940 bp, Artificial Sequence
  Description of Artificial Sequence: Synthetic coding sequence
atgctgtgctggggcaacgccagcttcggccagctgggcctgggcggtattgatgaggagatcgtgctggagccgaggaagagtgacttcttcattaataagcgcgtgcgggacgtgggatgtggcctgaggcatacggtattcgtgttggatgatggaaccgtgtatacctgtggctgcaacgacctcggacagttgggacacgaaaaatcacgaaaaaagcccgaacaggtggtggcactcgatgcgcagaatatcgtagctgtttcctgtggcgaagcccataccctggccctcaacgacaaggggcaggtgtacgcgtggggccttgattccgacggtcagctgggactcgttgggtcggaggagtgcatccgcgtgcctagaaacatcaagtccctctcagatattcagatcgtgcaggtggcttgcggatattaccacagccttgcgctgtccaaagcatcagaggtcttttgttgggggcagaacaagtacggccagctcgggctgggtacagactgtaagaagcagaccagcccacagctgctgaagtctcttctgggtattccctttatgcaagtcgctgcaggtggtgcccactctttcgtgctaacactgagtggagctatatttggatgggggagaaacaagtttggtcagctgggcctcaacgatgaaaatgacaggtatgtccctaacttgctcaagagcctgaggtctcaaaaaatcgtctacatctgctgcggggaggatcatacggccgcactgactaaggaggggggcgtgtttaccttcggggctggaggatacgggcaacttgggcataacagtactagtcatgaaattaaccccaggaaagtattcgaactcatgggttctatcgttactgagatcgcctgtggaaggcagcacaccagcgccttcgtcccttcttctggccgcatctattccttcggcctgggaggcaacggtcagctgggaacgggaagcaccagtaaccggaagagtcctttcacggttaagggcaactggtatccttacaatggccaatgtcttcctgatattgactccgaagagtacttttgcgttaagagaatcttttcggggggtgaccagagctttagccactattctagccctcagaattgtggaccacccgatgattttcgctgcccaaatccgaccaagcaaatctggacggtaaacgaggctctgatccagaaatggctgtcgtatccttcaggccgcttccccgtggagatcgctaacgagattgatgggactttttctagttcaggctgcctgaacgggtctttcctagccgtcagtaacgacgaccactacaggactggtactcgcttttcaggggttgacatgaacgcagctcgactattgttccacaagttgatccagccagatcatcctcaaatcagtcagcaggtggccgcatcactagaaaaaaatcttatccccaagctgacatcctcacttcccgacgttgaagcccttagattttatctgactttgccagagtgtcctttgatgagtgactcaaataactttacaaccatcgcaatccccttcggcaccgccctggtgaatttggagaaagccccactgaaagtcctcgaaaattggtggtccgtgctggagcccccactgttccttaagatcgtggagctctttaaggaggtggtggtgcacctgttaaagctctataagattgggataccgcccagtgagcggcgcatctttaactctttccttcataccgcattaaaagtgttggaaattctgcatagagtgaacgaaaagatgggacaaatcatccagtatgacaagttctatatacatgaggtgcaggagctgattgacatacggaacgattacattaattgggttcaacagcaggcatacggcatggatgtgaatcatggccttaccgaactagccgatattcccgttactatctgtacataccctttcgtcttcgatgcacaggccaaaactacgcttctccagaccgatgccgtgctccaaatgcagatggcaatcgatcaagcccacagacagaacgtgagcagtctatttctgcctgtgatcgagtccgtcaatccctgtctgattctcgtagttagaagagaaaacatagtcggggacgctatggaagttctgaggaagacaaagaacatcgattacaagaaacccctgaaggtgatatttgtcggcgaagacgctgttgatgctggcggtgttcgcaaggaattcttcttgctgattatgagagagctgttggacccaaaatacgggatgtttaggtattacgaggactctcgcttgatctggttctccgacaaaattaccgttgagaacttcggggcgacagaggtgaaggagctagtgctcaacggagcggatacagccgttaataagcaaaacaggcaagagtttgttgatgcctatgtggactacatcttcaacaaatcagtggcgtcactattcgacgccttccatgccggctttcataaggtttgtggaggaaaggtactactgctgtttcagccgaatgagctgcaggccatggtcattgggaataccaactacgactggaaggagttggagaagaatacagagtataagggggagtactgggctgagcatccaacaattaagatcttctgggaagtgtttcacgaactgcccctggaaaaaaaaaaacagttcctcctctttttaacagggtcagatagaattccaattctcggcatgaaatcactgaaactagtcattcaaagtactggcgggggagaggaatatcttccagtatcacatacctgcttcaatttgctggatcttcccaagtacacagaaaaggaaactctgcgcagcaagcttattcaggctatcgaccacaacgagggcttttccctcatttag

SEQ ID NO: 25302 - DNA, 1020 bp, Artificial Sequence
  Description of Artificial Sequence: Synthetic coding sequence
atgaagatcttcgtgggcaacgtggacggcgccgacaccacccccgaggagctagctgcgctttttgctccctatggcaccgtaatgagctgcgccgttatgaagcagtttgccttcgtacacatgagggaaaatgcaggggccttgcgagccatcgaggcgctgcacggccatgaactacgccctgggagagctcttgtagtagagatgagccggcccagacctctcaatacttggaagattttcgtcgggaacgtttcagcggcttgtacaagtcaggaactgcgctctctctttgagcgcaggggtagagtgattgagtgtgatgtggttaaaggaaagcgcatgcacgttcagctctctacatcccgcttgcgaactgctcccggaatgggcgatcagtccggatgttaccgctgtgggaaggagggccattggtcaaaggaatgccccatcgatcgctcaggtcgcgtcgccgacctcaccgaacaatataatgagcaatacggcgcagtgcgcactccgtataccatgtcgtacggcgactcattgtactacaataacgcgtacggggctctcgacgcctattataaacggtgtagagccgcccggtcctatgaggccgttgccgctgccgcagcctccgtatataattacgctgagcaaacactcagccagcttccacaagtgcagaatacagcaatggcaagccacctaacttcgacgagcctcgacccctatgacagacatttgctccccacctccggagccgccgctaccgcggcagccgcagcagctgctgccgctgctgtgacggcagccagtaccagctactacggcagggaccgctctcccctgcgtagagctactgccccggtcccgacggtaggagaaggctacggctacggacacgaaagtgaactgagccaggcttcagccgcggcgagaaacagtctatacgacatggcccggtacgagcgtgagcagtacgccgatagggcgaggtacagcgccttttag

SEQ ID NO: 25303 - DNA, 390 bp, Artificial Sequence
  Description of Artificial Sequence: Synthetic coding sequence
atggccgagctgatccagaagaagctgcagggcgaggtggagaagtaccagcagctgcagaaggacctttccaagtccatgagcgggaggcagaagctagaagcccagctgaccgagaataacatcgtcaaagaggagctggccctgttagatgggtccaatgtagtgttcaaactgctggggcccgttttagtgaaacaggagctgggggaggcgcgcgccacagttggcaaacggctcgattatattacagccgaaataaaacgctacgaaagccaacttcgcgacctggagcggcagtctgagcagcagagagaaacactcgcccagctccaacaggagttccagcgcgctcaggccgcgaaagccggtgcacctggtaaggcctag

SEQ ID NO: 25304 - DNA, 1695 bp, Artificial Sequence
  Description of Artificial Sequence: Synthetic coding sequence
atgagctaccccgccgacgactacgagagcgaggccgcctacgacccatacgcctatccgagcgattacgacatgcacactggcgacccgaaacaggacctcgcctacgaaaggcagtatgagcagcagacctaccaggtcatacctgaggttatcaaaaatttcatccaatattttcacaagacagtaagcgatctgatcgaccagaaagtttatgagctacaagcttccagagtgtcgtctgatgtcattgaccagaaggtttatgagattcaggacatctacgaaaacagctggaccaagttgacagagaggttttttaagaacactccttggcccgaggctgaagccattgccccgcaggtcggaaacgatgctgtgttcctgatactgtataaggaactgtattatcggcatatttatgcaaaagtatctggggggcctagcctggagcagcgattcgaatcgtattataattattgtaatctgtttaactatatcctcaatgccgatgggcccgctcctttagagctcccaaaccagtggctgtgggacatcattgatgaattcatttaccagttccaatcattctcgcagtacaggtgcaagacggcaaagaagtctgaggaggagatagactttctgaggagcaaccccaaaatttggaacgtgcactccgtattaaacgtgctccactcactagtagacaaatcaaacattaataggcagctggaagtgtacacatctggaggcgatcccgaatcagtggctggtgagtacggcaggcactccctctataagatgctggggtacttttccctcgttggattgctccggcttcattctctactgggcgactactatcaggccatcaaagtgctggagaacatagaattgaacaagaagtcaatgtatagcagagtacctgagtgtcaggtcacgacatactactacgttggctttgcctacctgatgatgaggcgttaccaagatgccatcagagtattcgcgaacatcttactctatatccagagaactaaaagcatgtttcagaggacaacgtataagtacgaaatgatcaacaagcagaacgaacagatgcacgccttactggccatcgccttaactatgtatcccatgcgcattgacgaatctatccacttgcaacttcgggagaaatatggcgacaagatgctgaggatgcaaaagggcgatccccaggtctacgaggaacttttttcctattcctgtcccaagtttctctcaccggtggtcccgaactatgacaacgtccaccccaactaccataaggagccctttctacagcaactgaaagttttctccgatgaggtgcagcaacaagcccagctttccaccatacgcagctttcttaaactttatacaacaatgcctgtggctaaactggccggctttctcgatcttacagagcaggaattcaggatccagctgctcgtgtttaagcataagatgaaaaatctggtgtggaccagcggcattagcgcgctggatggggagttccagagtgccagcgaggttgacttttatattgacaaggacatgatccacatcgccgataccaaggtcgctaggaggtacggcgattttttcattcggcagatccataagtttgaggaactgaatcggaccctgaagaaaatgggccaacgcccatag

SEQ ID NO: 25305 - DNA, 789 bp, Artificial Sequence
  Description of Artificial Sequence: Synthetic coding sequence
atggccctgagcctgggctggaaggcccaccggaaccactgcggcctgcttctgcaagccctgaggtctagcggtctgctacttttcccatgtggacagtgtccatggcgtggcgcaggttcattcctggaccccgaaattaaggctttcttagaggagaacaccgaggtgacctcatcaggcagcctaaccccagaaatccagctgcgactgctcactcctcggtgtaaattttggtgggaacgagcggatctttggccgcatagtgatccttactgggctatctactggccaggcggccaagctctgtcgcgttacctgctggacaaccctgatgttgtgcggggcaagagtgtactagaccttggatccggttgtggcgccaccgccatcgcagcaaagatgtcaggcgcttcaaggatattagccaatgacatcgacccaatcgctggcatggccataacgctgaactgcgagttgaatcggcttaacccattccccattttgattcagaacattctgaatctagagcaagataagtgggacctcgtggtattgggcgacatgttttacgatgaggacctggctgacagcttacaccagtggcttaagaaatgtttctggacttacaggaccagagtcctcataggagaccctgggaggcctcagttctcagggcattcgattcaacaccatctgcacaaagtcgtggaatactctcttcttgagagcacgcgacaggaaaactccgggctgaccaccagcaccgtgtggggcttccagccctag

SEQ ID NO: 25306 - DNA, 1626 bp, Artificial Sequence
  Description of Artificial Sequence: Synthetic coding sequence
atgagcagctgcgtgagcagccagcccagcagcaaccgggccgcccctcaggacgagctgggcggacgcgggtctagtagtagtgagagccagaagccttgcgaggccctccgcggcctgtcctcgcttagtattcacttgggaatggaatcctttattgtagtgacagagtgcgaaccaggttgtgccgttgacctgggcctggctcgtgaccgcccacttgaggcagatgggcaggaggtgcccttggacacttcagggtcacaagcacggccgcacttgagtggtcgcaagctttcgttgcaggaaagatcacaagggggcctagcagctgggggaagcctcgatatgaatggcagatgcatttgtcctagtctgccttactcaccagtgagcagtcctcaaagttcacccaggctccctaggaggccgaccgtcgaatcacatcacgtttctataacaggaatgcaagattgcgtgcagctgaaccagtacacactgaaagatgaaattgggaaaggatcgtacggggtggtgaagctcgcctataatgagaatgataatacatattacgccatgaaggtgctttctaagaagaagttgattcgacaagccggattcccacgacggcccccgcctagaggcacgcggcctgcacccggtggctgcattcaaccccggggtcccatcgaacaggtataccaggagattgccatactcaaaaagctggaccatcctaatgtggtcaaactggtggaggtgctggacgatcctaacgaggaccacttgtacatggtctttgagctggtcaatcaaggccctgtcatggaagtgccgactttgaagcccttgagcgaggatcaggctcgtttctactttcaagatctcatcaagggtatagaatatcttcactatcagaagatcattcacagagacattaaacccagtaatctgctggtcggtgaggacggtcatatcaagattgccgatttcggcgtgagcaatgagtttaaggggtccgacgctctgctgagtaacacggtgggtaccccagcattcatggcccccgaatctttaagtgaaacgaggaagatcttttcagggaaggccctggatgtttgggcaatgggcgtaaccctgtactgtttcgtgttcggccagtgtccctttatggacgagcgcatcatgtgcctgcattctaagataaagtcacaagccttggagtttccagaccaacctgacatcgccgaagatctcaaggatctcataacccgaatgctggataagaatcccgagtcccgaattgtggtccccgagattaagctacacccttgggtgactaggcatggggcagagcctttgccttccgaggatgaaaactgtaccctggtggaggtcactgaggaagaagtggaaaattctgtgaagcatattccatctttagccacagtgattctggttaaaacgatgatccgcaaacgttcatttggtaatcctttcgagggatccagaagagaggaaaggagtctgtcagcacccggaaaccttctaaccaaacaaggatctgaggataatctacaagggacggacccacctcccgtaggcgaggaagaagtcttgttgtag

SEQ ID NO: 25307 - DNA, 303 bp, Artificial Sequence
  Description of Artificial Sequence: Synthetic coding sequence
atgagcaccatcggcagcttcgagggcttccaggccgtgagcctgaagcaggagggcgacgaccagcctagtgagacagatcacttgagcatggaagaggaagatcccatgcctcgacaaatctctcgtcaatcctcagtaacggagagcacgctctaccccaatccttaccatcagccatacatttcccgcaaatattttgcgacaagacctggggcaattgaaactgcaatggaggatttgaagggacatgtcgccgaaacaagcggagaaaccattcaagggttttggttgctcacatag

SEQ ID NO: 25308 - DNA, 1425 bp, Artificial Sequence
  Description of Artificial Sequence: Synthetic coding sequence
atggagcggagcggccagcgggtgaccacctgggactgcgaccagggcaaacattcagattcagattacagagaagatggaatggacctgggaagtgacgccggaagttccagtagttcttcccgtgctagcagccaatccaattctacaaaggtaacaccctgctcggagtgcaagagtagttcctcccccggcggtagtttagacctggttagcgctctggaggattacgaggagccatttcctgtgtaccagaagaaagtgattgacgagtgggcacctgaggaggatggcgaggaggaggaagaggaagatgagcgggatcagcggggctaccgcgatgaccgcagccccgccagagaaccgggtgacgtgtcagccagaacccggtcaggcggcggaggcggccgttcggctacaaccgccatgcccccaccagtgccaaacggaaacctgcaccagcatgatcctcaggatttaaggcacaacggcaacgtggtcgtggctgggcgcccctcatgtagtaggggcccaaggcgtgctatacaaaagccccagccagctggcggccgccgctctgggcgtggtccagccgccggcggcctgtgcttacagccacctgatggcgggacttgcgtgcccgaggagccgcccgtccctcccatggactgggaggccctggaaaagcacttggctgggctccaatttagggaacaggaagctcagaagaacgagagagagagtattagacagaagcttgccctgggctctttttttgacgacgggcccgggatatatacttcttgctctaaatcggggaagccctctctgagctccagattgcagtccggcatgaaccttcagatatgtttcgtgaacgatagcggctctgataaagatagcgatgccgatgactcaaagacggagacatcgctcgacaccccactgtctccaatgtccaaacagagttccagctattcagaccgggacaccacggaagaggagtctgaaagtcttgacgatatggactttctgaccaggcagaaaaagctgcaggcggaggctaaaatggccctcgcaatggccaaacctatggccaagatgcaagttgaggtggaaaagcaaaataggaaaaaaagccccgttgcggatcttctgccccacatgccgcatattagtgaatgtctgatgaagaggagtctaaagcccaccgacctaagagacatgactatcgggcagctgcaggtgatagtaaacgacctgcattcacagatcgagtctttgaatgaagagcttgttcagctcctgctgattcgcgacgagttgcatactgagcaggacgctatgttggtggacattgaagacttaacccgccacgccgaaagtcaacagaagcatatggctgaaaagatgccagccaaatag

SEQ ID NO: 25309 - DNA, 690 bp, Artificial Sequence
  Description of Artificial Sequence: Synthetic coding sequence
atgcagcagcgggtgctggagctgatcccccagatcgccaacgagcaactcactgaggagctcttgatcgtgaatgacaacttgaacaacgtgtttctgaggcatgagaggttcgagaggttcagaacaggacaaacgaccaaggcaccatctgaggccgagcccgctgctgatttgatcgatatgggcccggatcctgccgccaccggtaatttgagctctcagctggcggggatgaacctggggagctcctcagtgagagcgggccttcagtcccttgaagctagcggacgattggaggatgaatttgacatgtttgcattgacaagaggcagcagcctggccgaccaaaggaaagaggtcaaatatgaggcaccacaggctactgatggtctggcaggagccctggatgctcgccagcaatcaacaggtgccattcctgtaacccaagcctgtctgatggaggacatagaacagtggctttcgaccgacgtaggcaacgacgctgaagagcccaagggggtaacaagcgaggaattcgacaaattcctggaggagagggccaaggccgctgacaggctgcctaacctgtcaagcccaagcgcagagggaccgcctgggcccccttctggccctgccccaagaaaaaaaactcaggaaaaagacgatgacatgctgttcgctctgtag

SEQ ID NO: 25310 - DNA, 1650 bp, Artificial Sequence
  Description of Artificial Sequence: Synthetic coding sequence
atgagccgggtggccaagtaccggcggcaggtgagcgaggaccccgacatcgactcgttactggagacccttagtcctgaggagatggaggagctggagaaagaactcgacgtcgtcgatccggacggatctgtcccggtagggctgcggcagcgaaaccagaccgaaaaacagtccacaggtgtttacaaccgcgaggctatgctgaatttttgtgaaaaggagacaaagaagctcatgcagagggagatgtccatggacgagtctaaacaggttgagacgaaaacggacgcgaaggaggagaaaataatccggggaattgataaggggagagtgcgagctgcagtggacaagaaagaagcaggcaaggacggacgtggcgaagagcgagccgtcgctaccaaaaaggaggaggaaaagaagggaagcgacagaaataccggtctctcgcgagataaagataaaaagcgagaggagatgaaggaggtcgctaaaaaggaagatgacgaaaaggtgaagggagagaggagaaataccgatacccgaaaggagggcgagaaaatgaagagggctggcggaaacacagatatgaagaaagaagacgagaaagtgaagaggggcactgggaacaccgatacaaaaaaggatgatgaaaaagttaaaaaaaacgagccgctgcacgaaaaggaagcaaaggacgattccaaaacaaaaacaccagaaaagcagacacccagtggtcccaccaaaccctcagaaggacccgctaaagttgaggaagaggcagcaccatctatttttgatgagcccctggagagagtaaaaaataacgatccagagatgactgaagtcaatgtgaacaattcagattgcatcacgaatgagattttggtgcgtttcacagaagccctcgaattcaacaccgtggtgaagctattcgccctggcaaacacgcgagctgacgaccacgtggccttcgccatcgcaatcatgctgaaagcgaacaaaactatcaccagtctcaacttggatagtaaccacatcacaggtaaagggatactggctatcttcagggcactccttcaaaataataccctgaccgaactgagatttcacaatcaaagacatatttgtgggggcaagaccgagatggagattgcaaaattattaaaggagaacactacactccttaaattgggttatcactttgaattagcaggcccaagaatgacagtcaccaatctgctaagtcggaacatggataaacagagacagaagcgcctccaggagcagcggcaggcgcaggaggccaagggcgagaaaaaggaccttcttgaggtccccaaggcaggggccgtggctaaaggatcacctaaacccagcccgcagccgtccccaaagccttcacctaaaaattcccccaaaaaaggaggcgcacccgcagcaccacccccacctcccccaccattggccccccctcttattatggaaaatcttaagaactctttgtcacctgccactcagagaaagatgggtgacaaagtcttacctgcacaggaaaagaattctcgggatcagctcttagcagctatccggtcttctaaccttaaacaattgaagaaggtagaagtgcctaaactgctacagtag

SEQ ID NO: 25311 - DNA, 231 bp, Artificial Sequence
  Description of Artificial Sequence: Synthetic coding sequence
atgagcgccagctgcgacggctgcgtgggcagccggccccccgtgcacctggcttccggttactccctcgctgacctactggtgctagagatgggaatgggcacccagtgctggacagaggatcagaggagatggtcatcactatggccctggagtcatctgagcagcgacccgtcgctccctaacgttcaggtcaccaggctgaccttactttcggagcaagccccgtag

SEQ ID NO: 25312 - DNA, 1416 bp, Artificial Sequence
  Description of Artificial Sequence: Synthetic coding sequence
atggccaacagcttcgccgcccggatcttcaccaccctgagcgacctgcagactaacatggctaacctgaaagtgattgggatcgtgatcgggaagactgatgtaaaaggattcccagatcgcaaaaatataggatccgagcgttatacctttagcttcacaatccgggacagccccgcacacttcgtgaatgccgcctcttggggcaatgaggactacattaagtcattatccgactctttcagggtcggtgactgcgtcatcattgagaatccgctgattcaacggaaagagattgagcgcgaagagaagttctctcccgcaacaccctccaactgtaagctcctgctgtccgaaaaccacagcaccgtgaaagtgtgtagcagttacgaagttgatacgaaactgttatcccttattcacttgccagttaaggaaagccacgactactactcactcggagatatcgtcgctaacggacatagccttaatgggagaattattaacgttttggcagccgttaagtcagtgggtgaacccaagtactttaccacatctgacaggcgtaagggccaacgatgcgaggttcgcctatacgacgaaacagagtcctccttcgctatgacttgctgggacaatgaatcaatcctgttggcacagtcttggatgcccagagagactgtaatcttcgcttcagacgttcgaattaattttgataagtttcgtaattgcatgactgcaactgtaatatccaagactatcatcacaaccaaccctgatattccggaggctaacatactcctgaattttatacgagaaaataaagaaacaaacgtgttggacgacgaaatcgattcctactttaaggaatcaattaatctgagtactattgtcgatgtttacaccgtcgagcagctcaaaggcaaagctctcaagaacgaaggcaaagcagatccctcctacgggatcttgtacgcttacatttcaaccctcaatattgatgatgagaccaccaaagtggtgagaaatcgatgtagtagttgcgggtatatcgtgaatgaagcgagcaatatgtgtactacttgtaacaagaattctctggacttcaagagcgtattcctgtctttccatgtccttattgacctcactgaccacaccgggacattacactcttgcagtctgaccgggagtgtggctgaggagaccttggggtgcacggtacatgagttcctggcgatgaccgatgagcagaagaccgccttgaaatggcagttcctgctggagaggtccaaaatttatctgaagttcgtactgtcacatagagccagatcaggactcaagataagcgtgcttagttgcaagctcgcggaccctacagaagcctcccggaatttaagtggacagaagcacgtctag

SEQ ID NO: 25313 - DNA, 747 bp, Artificial Sequence
  Description of Artificial Sequence: Synthetic coding sequence
atggccaccagcgcccccctgcggagcctggaggaggaggtgacctgctccatctgcctggactatctgagagacccagttactattgattgtggtcatgtgttctgtagaagttgtacgacagacgtacgcccaatcagcggtagcaggcccgtgtgcccactctgcaaaaaaccatttaagaaggagaacatccgcccagtctggcagttggcctcattagtggaaaacatcgaaaggctcaaagtcgataaagggcgtcaaccgggtgaagtgactagagagcagcaggacgctaagctctgtgaacggcaccgggagaagctccactactattgtgaggatgacggcaaactgttatgcgtgatgtgccgagagtcccgcgagcatcgcccacatactgcagtgctgatggagaaggccgcccagccgcatagagagaagatacttaaccacctgagtacactcagacgcgatcgggataagatccagggctttcaggcgaaaggggaggctgacatcttggcagccctgaagaagctccaggaccagaggcagtatatcgtggctgaatttgaacagggccatcagttcttacgcgaaagagaagagcacctgctggagcaactcgccaagctcgaacaggagctgacagagggaagagaaaagtttaagtctcgaggcgttggagagctggctagattggccttggtgatctcagagctggaaggaaaggcccagcagtag

SEQ ID NO: 25314 - DNA, 2646 bp, Artificial Sequence
  Description of Artificial Sequence: Synthetic coding sequence
atgttctggaagttcgacctgcacaccagcagccacctggacaccctgcttgaacgcgaagacttgtccctccctgagttactggacgaggaagacgtccttcaggagtgcaaggtcgttaatcgaaagctgcttgatttcctgcttcaaccaccccacttacaagccatggtggcctgggtgacccaggagccccctgattccggcgaggaaagactccgatacaaataccccagcgttgcatgcgagatactgactagcgacgtgccacagataaacgatgcactcggagccgacgaatctctgctcaacaggctgtacggttttctgcaaagcacaggctctttgaatccccttctggcttcttttttttcaaaagtgatgggtatactcataaatcggaaaactgatcagctagtttcttttctgcggaagaaggatgatttcgttgatcttctgctgcaacatatcggcacttctgccatcatggacctcctgctgcgactgctgacttgtgttgaaaggccccagctgcggcaggacgtggtcaactggctgaatgaagagaagatcgtgcagcggctgatagagcagatccatccatctaaagacgaaaatcagcatagcaacgcttcacagagtctgtgcgacataattcgcctctctcgagagcagatgatacaagtgcaggacagtcccgagcccgatcagctactcgctactctcgagaaacaggaaacaatcgagcagctcctctcaaatatgtttgagggggaacaaagtcagagcgtcatcgtctctggtattcaggtcctgctcactctgctggaaccaaggcggccccggagtgaaagcgtcaccgtgaactcctttttcagtagcgtggatggccagctggaattgctggcccagggggcactcgagagtactgtgagttcagtgggtgctttacatgccctgagacccagactttcctgttttcaccaactcctgctggagccaccgaaactagaacctctccaaatgacgtggggcatgctggccccaccccttggcaacacacggctgcacgtggttaagttgctggcatccgccctgtccgctaacgatgccgcgctgacacacgaattgttggccctggatgtccccaacactatgctggatttgttcttccactacgtcttcaacaatttcctccacgcacaggtggagggatgtgtttcaacaatgctgtccctgggcccaccacctgattctagcccagaaacaccgattcagaatcccgttgttaagcacctgttacagcagtgtcgattggtagagcgcatcctgacatcctgggaggagaacgacagagttcagtgtgccggcgggccacgtaagggctacatggggcacctgacacgcgtggcaggggccctggtgcagaataccgaaaaggggcctaatgccgaacagctacgccaactactcaaggagcttccaagtgaacagcaggagcagtgggaggcctttgtttccgggcccctagcggaaaccaataaaaaaaacatggtcgacttggttaatactcaccatctgcattcatctagcgacgacgaagatgacagactgaaagagttcaattttcctgaagaggccgtgcttcagcaagctttcatggatttccaaatgcaacgcatgaccagtgccttcattgatcactttggcttcaacgacgaggagttcggagagcaggaggagtccgtcaatgcccctttcgataaaaccgccaacatcacattctccctgaatgctgacgatgagaacccgaacgccaatcttcttgagatttgttataaggacagaattcaacagttcgacgatgatgaggaagaagaagatgaggaggaggcgcagggtagcggagaatcagacggagaagacggtgcgtggcaaggttctcaactggctcgtggcgcgcgcctcgggcagccccccggagtaaggtcgggcggaagcacggactctgaagatgaggaggaggaggacgaggaagaggaggaggatgaagagggcattgggtgtgccgcacgaggcggcgccacccccttgtcttatccaagtcctgggccgcagcctcccggaccttcctggaccgcgacatttgatccagtgcctaccgatgcgcctacttctccacgggtctccggagaggaagagctccacacgggacctcccgcaccacagggaccactgagtgttccccaggggttacctactcaatcccttgcctctcctccagcccgcgatgctctccagctcagaagccaagatcctactcccccctctgcaccccaggaggccacggaggggagcaaggtgactgaaccctccgcgccttgtcaagcactggtgagtattggggacctgcaggctactttccatggcataagatccgctccgagcagctccgactcagctacaagagatccaagtacttccgtgcccgcatctggggcccatcagcctccgcagacaacagaaggtgagaaaagccctgagccgcttggtttgccccagtctcagtccgctcaagccctgacaccccctccaatacccaacgggtctgcacccgagggacctgcctccccggggagccaatag

SEQ ID NO: 25315 - DNA, 354 bp, Artificial Sequence
  Description of Artificial Sequence: Synthetic coding sequence
atgaagttccagtacaaggaggtgcaccccttcgagtaccggaagaaggagggtgagaaaattcggaaaaagtatcctgacagggtgccactgattgtcgaaaaggcccctaaagctcgcgtgcctgatctcgatcgacgaaagtacctagtgccctcagacctgaccgacggccagttctacctgttaattcgaaaacgcatccatcttcgtccagaggacgctctgttctttttcgtgaataataccattccacccacttctgcaaccatgggacagctgtatgaggacagccacgaggaagacgactttctgtatgtggcatactcgaacgagagcgtgtacggcaagtag

SEQ ID NO: 25316 - DNA, 1089 bp, Artificial Sequence
  Description of Artificial Sequence: Synthetic coding sequence
atgcgggagatcgtgcacctgcaggccggccagtgcggcaaccagattggggccaagttctgggaggttatctccgatgagcacggtattgaccctactgggacgtaccatggcgattcagatttacagctagaaagaattaatgtatactataacgaagctactgggggcaactacgttccacgagcggtactggtggacctagaaccgggaaccatggattccgtgagatccggcccctttggtcagatttttcggccagacaatttcgtgttcgggcagtcaggagccggcaataattgggcaaaaggccattatactgagggcgcagagctcgttgacgccgtgctcgacgtggtgcgtaaagaagccgagagttgcgattgcctccaggggttccagctcactactccaacatacggggacctgaatcacttagtgtccgcaaccatgagcggagttaccacatgcctgcgttttcccggacaacttaacgccgacttgcggaaactcgccgtgaacatggtgccgttccccagactgcactttttcatgcccggctttgcgccactgaccagccgaggaagtcagcaatatagagccctcacggtacccgaactcacgcaacagatgttcgacgctaagaatatgatggctgcttgtgacccacggcacggaaggtacctcactgttgccgccgtttttcgcggaaggatgtctatgaaggaggtggatgaacagatgttgtcagtgcaatcaaagaattcctcatatttcgtggagtggatccctaacaacgtgaagacagcggtctgcgacattcccccacgaggattgaaaatggctgccactttcataggcaattcaacagctatccaggaactgttcaagcgaatctcggaacagtttaccgccatgttcaggcggaaggcctttttgcactggtatactggagaagggatggacgaaatggagttcactgaagccgagagtaacatgaatgaccttgtaagcgagtaccagcaatatcaggacgccacagcggaggagggcgaatttgaggaagaggccgaggaggaagtagcatag

SEQ ID NO: 25317 - DNA, 654 bp, Artificial Sequence
  Description of Artificial Sequence: Synthetic coding sequence
atggaggagaccatgaagctggccaccatggaggacaccgtggagtattgcctcttcctgatccccgacgagagccgcgatagcgataagcacaaagagattctgcaaaagtacatcgaaagaattataacgcgcttcgcaccaatgttggtgccatacatatggcagaatcaaccatttaatctgaaatacaagccaggtaaggggggagtgcccgcccatatgttcggagtgaccaagtttggtgacaacatcgaggacgaatggtttatagtctacgtgatcaagcagattactaaagaatttcctgagttagttgccagtaccaaccgggtgttcttttgccacggggagctgtgcattattccggcccctaggaaaagcggtgcagagtcctggctaccaacaacccccccaacaatcccccaggcactaaatatcattacagcccacagcgagaagattctggcaagcgaatccatccgagccgccgttaaccgtcgaatccgtggttaccccgaaaaaatccaggcgtccctgcacagagcccactgcttcttgcccgcagggattgttgctgtgctcaaacagaggcccaggttggtggccgctgccgtgcaagcattttacctgagggacccgatcgacttgtag

SEQ ID NO: 25318 - DNA, 1188 bp, Artificial Sequence
  Description of Artificial Sequence: Synthetic coding sequence
atggccagcgccgccagcgtgaccagcctggccgacgaggtgaactgcccaatctgccagggcacactgcgagagcctgtgacgatagactgcggacataatttctgtagggcttgtctaactagatactgcgaaattcctggcccagacctggaggagtctccgacttgtcctctgtgtaaggagcctttcaggcccggctcttttagaccaaactggcagctcgctaacgttgttgaaaacatcgaacggttacagcttgtctctactttgggcctgggcgaggaggacgtatgtcaggaacatggcgaaaagatttattttttttgtgaggacgatgagatgcaactgtgcgtggtctgtcgtgaagcaggtgagcatgcaacacacaccatgagatttttggaagacgcagccgccccctacagagagcagatccataagtgcctcaaatgcctgaggaaagaaagagaggagattcaagaaattcaatccagagaaaacaaacggatgcaggtacttctcactcaagtatcaaccaagcggcagcaagtcatttcagaattcgctcacctgaggaaattcttagaagagcagcagagcattttgttagcacaattagaatctcaggacggcgatatcctgagacagcgggatgaatttgaccttctagtagctggtgaaatttgcaggttctcagccctgatcgaagagctcgaggagaaaaacgagagacccgcccgcgaactgctaacagatatacgatcaacgctgatccgttgcgaaacccgaaagtgtcgtaaacccgtcgctgtcagcccagagctaggccagcgtatccgcgatttccctcagcaggccttgcctctgcagagggagatgaaaatgttcctggagaagctctgctttgaattagattacgagcctgcccacatttccctcgacccgcagacatcgcatccgaagctgttgctctccgaagaccatcagagagcacagttctcttacaaatggcaaaacagcccagataacccccagcgatttgatagagcaacatgtgtcttggcacatacgggtattaccggtggaaggcacacgtgggtctggatggcgagggtgccaggtgattcggggtgctgtcaattctgttcacctcctagcgtgttgggaaccgaggtggcggcatag

SEQ ID NO: 25319 - DNA, 102 bp, Artificial Sequence
  Description of Artificial Sequence: Synthetic coding sequence
atgagcatcagcagcgacgaggtgaacttcctggtgtaccggtacctccaggagtctggcttctcccatagcgccttcaccttcggcattgagagtcattag

SEQ ID NO: 25320 - DNA, 1242 bp, Artificial Sequence
  Description of Artificial Sequence: Synthetic coding sequence
atgttcgccagcgacctgctgcgggccctggactgctgccccggcgccgggagcagcggcctcttaccacagctcggaccccgtcagttgttggctttcacagtgaactgtctggggaaccatcggtatcttggcttttttgaagatctagagcagaggcataaagctcaggtgctggtggaagacatctctgacattctcgaggagcatgcggagaaacactttcacccatacatcgcgtactgcagcaacgaagtctaccaacaaaggactcttcaaaaactgatctcttccaacgccgctttccgagaagccctccgtgagattgaacgacgacctgcttgcggtggcctgccaatgctctcttttttgatactgccaatgcaaagggtgacaaggctgcccctcctgatggatacattgtgcctgaaaactcagggacactcagaaaggtataaggccgcctccagagccctgaaggcgatcagcaagctggttcggcagtgtaatgagggcgcccacagaatggagaggatggaacaaatgtacaccttgcatacccagctggatttttctaaagtcaaatcacttcctctcattagtgctagcaggtggctgctcaaacgcggggaactcttcctggtcgaggagacaggtctgttccgcaaaatcgccagcaggccaacctgctacctgttcctcttcaatgacgtgttggtcgtgaccaagaaaaaaagcgaggagagttacatggtacaggactacgcgcagatgaaccacatccaggtcgaaaaaattgagccgtccgaattacctctcccaggggggggtaaccgtagttccagcgttcctcaccccttccaggtgactctgctgcgaaattccgagggacgacaggagcagcttctcttgagctctgattccgcctctgatcgtgcccggtggatcgtcgcattgactcactccgaaagacaatggcagggcctcagcagtaaaggagacctaccccaggtcgagatcacaaaagcttttttcgccaaacaggcggatgaggtgaccctgcagcaagccgacgttgttttggttctgcagcaggaagacggctggctgtacggagagcgcttacgggatggcgaaacagggtggttccctgaagattttgcaagatttataacctcccgagttgcagtggaaggcaacgtacgacggatggaaagacttagggtggagaccgacgtgtag

SEQ ID NO: 25321 - DNA, 1890 bp, Artificial Sequence
  Description of Artificial Sequence: Synthetic coding sequence
atggaggagagccccctgagccgggcccccagccggggcggcgtgaacttcttgaacgtcgcacgtacttacattccaaatacaaaggtggaatgtcactatactctacctccaggcaccatgccttccgccagcgattggattggcatattcaaagttgaagcggcttgcgtgcgcgattaccatacctttgtgtggagtagcgtgcctgaatcgaccaccgacggttctccaatccatacctccgtacagtttcaggcatgcaatcagctcgatgagagtcagcaggaacggaacgaccttatgcagctgaaattgcagttggagggacaagtaacagagctgaggtcccgagtgcaagagttagagcgagcactagcaactgcacgacaggaacacacagaactgatggaacaatataagggtatatctagatcgcatggggagatcacagaagagcgtgatatccttagtcgtcagcaaggcgaccacgttgccaggatcctggagctggaggatgacattcaaaccataagtgaaaaggtcttaacaaaagaggtggaactagatagactacgagacacagtgaaggctctgactagagagcaggagaagctactcgggcagttgaaagaggttcaggctgataaggaacagtcagaggcagaactccaggtggcgcagcaagagaaccatcacctgaacctggacttaaaagaagccaaatcttggcaggaggaacagtccgctcaagcccagagacttaaagacaaggtggcccagatgaaggataccctcggacaggcacagcagagggtggccgagctggagcccctcaaagagcaactgcgtggagcacaggaactagctgccagtagtcagcaaaaggccacactcctcggcgaggagctcgcttcagcagctgctgcgcgcgatcgcaccatcgccgagctgcaccgatctaggttagaagtggcagaggtgaacggacgacttgcggagctgggtcttcacctgaaagaggagaagtgtcaatggtcgaaagaacgcgcagggcttcttcaaagtgtcgaggcagagaaagataagatcctaaaactgtccgcagagatccttaggctggaaaaggcagtccaggaagaacggacgcaaaatcaggtctttaagactgaactcgccagagaaaaggatagctccctagtgcagctgtcagagtcaaagcgcgagttaacagagttgcggtcagcccttcgcgtgttgcagaaagaaaaggagcagttacaggaggagaaacaggagctcttagaatatatgagaaaacttgaggctcggctggagaaggtggcagatgagaaatggaacgaggacgccaccaccgaggatgaggaagctgctgttggactttcctgtccagcagcccttaccgactctgaagacgagtctccagaggacatgcgcctaccaccttatggcctgtgcgaacgaggagatcccgggtcctcacccgccggccctcgcgaagcgtccccactggtggtcatctctcagcctgctccaatttccccgcacttgtccggtcccgccgaagactcttcctccgattcggaggcggaggatgaaaagtccgtcctcatggccgccgttcaaagcggcggagaggaggccaacctgctgctgcctgagctgggctcagccttctacgatatggcttcgggatttacagtgggcaccctatctgagacaagtaccggtggcccagccacacccacatggaaggaatgtccaatctgcaaagagcggttccctgccgaaagcgacaaagacgctctggaagaccatatggatggacactttttcttttcgacccaggaccccttcacgttcgaatag

SEQ ID NO: 25322 - DNA, 2451 bp, Artificial Sequence
  Description of Artificial Sequence: Synthetic coding sequence
atgcccctgagcagccccaacgccgccgccaccgccagcgacatggataagaacagcgggtccaacagcagcagcgcaagcagcggtagctcaaaaggtcagcagccccctcggtccgcttcggccggtcctgctggggaatctaagccgaagtcggatggaaagaatagttctgggtcaaaacggtacaaccgtaagcgggaattaagttaccccaagaatgaaagttttaacaatcagtcccgccggagttcctcccagaaatccaagactttcaacaaaatgcccccacagcgcggagggggatcttctaaactttttagtagcagttttaacggaggcagacgtgacgaagtcgccgaagcccagcgtgccgagtttagtcctgcccaattttcaggaccaaagaagatcaatctgaaccacctgctgaatttcacattcgagcctagaggacaaaccggtcacttcgaggggagcggacacggatcttggggaaagcgaaacaagtgggggcacaaaccctttaataaggagctgttcctccaggccaactgccagttcgttgttagcgaagaccaggattacaccgctcatttcgcagatcctgacactctggtgaactgggactttgtggaacaggtacgcatctgcagccatgaagtaccttcatgccctatctgcctgtatccaccaactgcagccaagataacaagatgtggacatatcttttgttgggcttgcatcctgcactacctctctctgagtgagaagacttggtctaagtgtcccatctgttactccagcgttcacaaaaaagacctcaaaagtgtagttgctacagagagtcatcaatacgttgttggtgataccataactatgcaacttatgaagagagaaaagggcgtacttgtggcccttccaaagtctaaatggatgaacgttgaccaccccatccatctcggagacgaacagcacagccagtactccaaactgttgctcgcaagcaaggaacaggtgctccatagagtcgtacttgaggaaaaggtagcacttgagcagcagctggccgaggaaaagcacacacccgaaagctgcttcattgaagcagccatccaggagctaaagaccagagaagaggccctgtccgggctggccgggagccggcgcgaggtgacaggggttgtggctgcgctggaacagctcgtcttgatggcccccctcgccaaggaatctgtgttccagcctagaaaaagcttgttacagcaaggcgttctcgagtacttgtcagcctttgacgaggagactaccgaggtctgcagtcttgacaccccgtcaaggccactggccttgcctctcgtggaagaagaagaggccgtgagtgagccagaaccagaaggcctccctgaggcctgcgacgacttggagctagcagacgacaatctgaaggaaggaaccatttgcaccgagagtagccagcaggaaccgattacgaaaagcggattcacccggctgtcgagtagcccatgctactacttctaccaggctgaggatggacaacatatgttcctccaccccgtaaatgttcgctgtctggtgagagagtacgggagtctggagcgctctcctgagaagattagcgctactgtggtcgagattgctggctactctatgagcgaggacgtgcggcagcgccaccgttatctctcccatctccctctgacatgcgaattctcaatttgtgagctggcactgcagccacctgtcgtgtctaaagaaactctggagatgttttcagatgatatcgagaaacggaagcggcagcggcagaaaaaagccagggaagagaggcgacgcgagcggaggatcgaaattgaagagaataaaaaacaaggaaagtaccctgaagtgcatattcccttggaaaacctccagcagtttcccgcatttaatagttacacatgtagttcagacagtgcattgggccctacgagtacggagggccacggcgccctgtcaatctctccactaagtagatctccgggatcacacgctgactttttgcttacccccctgtcacctacagccagtcagggatcaccaagcttctgtgtgggctctctcgaggaggacagccctttcccatccttcgcacaaatgctgagagttggtaaggccaaagcggacgtgtggccgaagaccgcccctaaaaaggacgaaaatagtctggtccctccggcaccggtcgattcagatggcgagagcgataacagcgaccgggtgcccgtccccagcttccagaattccttctctcaggctatagaggcagccttcatgaaactagacacccctgccacgagtgatcctttgagtgaggaaaaaggcggcaagaagcggaaaaaacagaaacagaaactactcttctctacctccgtcgtgcacactaagtag

SEQ ID NO: 25323 - DNA, 429 bp, Artificial Sequence
  Description of Artificial Sequence: Synthetic coding sequence
atggccagccccggcaaggacaactaccggatgaagagctacaagaataaagctttaaacccgcaagagatgaggcgccgaagggaggaggagggtattcagctccggaagcagaagagggaggagcagctttttaaaaggaggaatgtctacctcccccggaacgatgagagcatgctggagagcccaatccaagatccagacatatcctcgaccgtccccatccctgaggaggaagttgtcacgacagatatggtccagatgatctttagcaataatgccgaccaacagctgacagccacgcagaaatttcggaagctgctttcaaaagaaccaaaccctcccattgaccaggtcatccagaaaccaggcgtggtccaaaggttcgtgaagttcctcgagcgcaatgagaactgcactctgcagtag

SEQ ID NO: 25324 - DNA, 297 bp, Artificial Sequence
  Description of Artificial Sequence: Synthetic coding sequence
atgagcgagcagggcgacctgaaccaggccatcgccgaggagggcggtaccgagcaggagaccgccacccccgagaacggtattgtcaaatctgagtccttagatgaagaagaaaagctggagctgcagcggcgactggaagcccagaaccaggagcgaaggaagtctaagtccggcgccgggaaggggaagctcacccggagtctcgcagtctgcgaggagtctagcgcacgaccagggggagaatctctgcaggaccaggagagtatacaccttcagttgtcatccttcagctag

SEQ ID NO: 25325 - DNA, 1917 bp, Artificial Sequence
  Description of Artificial Sequence: Synthetic coding sequence
atggagaacctgcagaccaacttcagcctggtgcagggcagcaccaagaagctaaacgggatgggagatgatggctcacctcccgccaaaaaaatgataaccgatattcacgctaatggcaaaacaattaacaaggtgccgacagtgaaaaaggaacacctggacgattatggcgaagcgcccgtagaaaccgatggggaacatgtcaagcggacctgtacaagcgtcccagagactctccatcttaacccgtcactaaaacacaccttagctcagtttcacctgagcagccagtcctctctgggcggccccgcagcctttagtgctcgtcactcccaggagagtatgtccccaaccgtgtttttgcccctcccgagtcctcaagtactaccaggcccgctgttaattccaagtgattcaagcacagagctcacacagactgtgctggagggcgaatctatctcttgcttccaggtcggtggggaaaagcgactatgcttgccccaggtccttaactctgtgcttcgcgagtttacattgcagcagataaacaccgtgtgcgacgagctgtatatttattgctcgcgctgcacgtcggaccagctacacattctgaaagtgctcggaatcttgccctttaacgccccatcttgcgggctcatcacgctgacagacgcacagcggctctgtaatgccctcctccgcccacgtacattcccccagaacgggtccgtgttacccgcaaaatcttcgctcgcccagctaaaagagacaggatcagccttcgaggtggagcacgaatgcctcggtaaatgccaaggcctgtttgctccgcagttctacgtacagccggacgcaccctgtatccaatgcctagagtgctgcggcatgtttgcccctcagactttcgtgatgcacagtcaccggtcacccgataagcgaacctgtcattggggtttcgaatcggcaaagtggcattgttatcttcatgtgaatcagaaatacttgggtacacccgaggagaagaaattgaagataatactcgaagaaatgaaagagaagttttccatgcggagcggcaaacgcaatcagtcaaaaaccgacgctccctctggtatggagctccaatcctggtaccccgttataaaacaggaaggcgaccatgtctcacagacacattcattcctgcatccctcctattacctatatatgtgcgataaagtagtggcccctaacgtttcactgacatccgccgttagccagagcaaggaactcacaaagaccgaagctaatgcctccatttctaacaactcaactagcaaaagaaaatccgagtcagcaacttgtaacctcgtcagggacatcaataaagtcggtatcgggctggtagccgctgctagttctccactgctcgtgaaggacgtgatctgtgaagacgacaagggcaagataatggaagaagtgatgcgcacttacctgaagcagcaggagaagctcaacctcatcttgcaaaagaagcagcagctgcagatggaagtaaagatgctttctagcagcaaatcgatgaaagagctgactgaggagcaacaaaatctacagaaggagttggagtctctgcaaaatgagcatgcacaaaggatggaagagttttatgtggaacagaaggatctcgagaagaagttagagcagataatgaaacagaagtgcacatgtgacagtaaccttgagaaagacaaagaagcagaatacgccgggcagttggcggaactgagacagagacttgaccatgctgaagctgatcgtcaggaactgcaggacgagctacgccaggagagagaggcccgacagaaactggagatgatgatcaaagagctgaaactgcaaatcctgaagagctcaaagacagccaaggaatag

SEQ ID NO: 25326 - DNA, 1530 bp, Artificial Sequence
  Description of Artificial Sequence: Synthetic coding sequence
atgaagcggggccggctgcccagcagcagcgaggacagcgacgacaatgggagcctgagcaccacgtggagtcagaacagtaggagccagcacagaaggtcatcatgctccagacatgaagatcgcaaaccatccgaggtgttcagaacagatctcatcacagctatgaagttgcatgactcataccaactgaacccagatgaatattatgtcctcgccgatccgtggcgccaggaatgggaaaaaggtgttcaggtgcctgtgtctcctggcacaatcccccagccagttgctcgcgtagtgagtgaggagaaaagcctcatgtttatccgcccaaagaagtacatcgtctctagtggcagtgagccgcctgagctgggctatgttgacatccgtaccttggctgatagtgtgtgtaggtatgatctgaatgacatggacgcagcatggctggaactcaccaatgaggagttcaaggaaatggggatgcctgagctggatgagtatactatggagcgagtgctagaggaattcgaacaaagatgctatgacaacatgaatcatgctattgaaaccgaggaaggcctaggcatcgaatatgatgaggacgtcgtgtgtgacgtgtgtcagtctcctgatggtgaagatggcaacgagatggttttctgcgataaatgcaatatctgtgtgcaccaggcctgctacggcattttgaaggtccctgaaggcagttggctctgccgcacctgcgcactgggcgtacaacccaagtgcctgctctgccccaagaagggtggtgccatgaaaccaacccgcagtggtactaaatgggtgcacgtttcatgcgccctctggattccggaggtgagcatcgggtcaccagagaagatggaaccaatcacaaaggtcagtcacattccttcttctaggtgggctctggtgtgctctctatgcaacgagaagttcggggcgtccatccagtgtagtgtgaaaaattgtcggacagccttccatgtgacttgtgcctttgacagaggcctggagatgaagaccatcttggccgaaaatgacgaggtgaagtttaaatcctactgtcctaaacactcctctcataggaagcccgaggaaagtctggggaagggcgccgcccaggagaatggcgccccagagtgttcacctcgcaatcccctggagccttttgcatctctggagcaaaacagagaagaggcacacagagtgtccgttcggaagcagaagctacagcaactcgaggacgagttttacacctttgttaatctcctggacgtggcacgggcccttcggctgccggaagaggtcgtggattttctataccaatactggaagctcaaacggaaggtgaattttaataagcctttgatcactcccaagaaggacgaagaagataatctggcgaagagagagcaggacgtactctttcgccggttgcaactcttcacacatctgagacaggaccttgagagagtgatgattgataccgacaccctgtag

SEQ ID NO: 25327 - DNA, 354 bp, Artificial Sequence
  Description of Artificial Sequence: Synthetic coding sequence
atggccttcagcggccgggcccggccctgcatcatccccgagaacgaagagattccacgcgccgcactgaatacggtacacgaggcaaatgggaccgaggatgagcgcgccgtcagcaagctgcagcgcagacactcagacgtgaaggtgtataaagaattctgcgatttttatgctaaattcaatatggcaaatgctctggccagtgccacttgtgagcgatgtaaggggggctttgcgcctgccgagactatagttaatagtaatggcgagctatatcatgaacaatgctttgtgtgtgctcagtgctttcagcagtttcctgaaggtctcttttacgaggagcggacctag

SEQ ID NO: 25328 - DNA, 1110 bp, Artificial Sequence
  Description of Artificial Sequence: Synthetic coding sequence
atgaaggacacccaggacatccaggaggccagcaaggccatgcagaacaaggtgcatgagcaggaggataaaaatgaaaagcagaagcagagggaagacaagctgggcgtatactctctggtccatttctccccaaaaatgttgggctcagtcgctactacactcccactgtcctcgtctaactcctccggcatgcctttgggctactatctgtcttcacctcagattagtagggttactatttctaccactgggcaactgacttcaaaagccaccgttggcagttgttctcgggtagaaaatagcctggatgctagcccattctccgtgccaaaaaaacaggacgaatctccaatgatcggggacggcgaagactacttcctgtcactgtttggggattctaaaaagcttacagcccacagtaactacacgcaaaaaacgctgaagtacttcagtatgatcctggaggaggtcgggcaattcacctcttcgtctctgggcgacgtcgagattgctgaggtcaacgtgaagggattgtttgtcaagctgattaactcatccttggataaagaaatggcgatcggcgaccacattctacagcagaatgtgaacggtcagacaatttcactctaccgatttctgcctaacattgtgatgcaggccaacagcactgtgactgctatcgcttggtacacgccaattcactggaagcaggcctgggaaaaactagacgctgacgtggagttcaatcggtgttccgtggttagtccaacgtttcgtaagcgcgtatttcagtggaccgctagtactgctaccatcacaaaggagaagcaggaccaacccaagaaggatatttccaactatcaggtggaacaagcacaggtgctgttaaagcgtgagaaggaaattccgcctacagtctttcccaataggtccccatggtgccagaacccctacgtttccgctcatccttactgcccactcattgagccacacaatacaagtacagcgggcgggaggctcgataggcagccacgaactagatcaacacgccctaatagggcatccggaagtaagaagaaaaagacatctgagagtcagaaacagtag

SEQ ID NO: 25329 - DNA, 681 bp, Artificial Sequence
  Description of Artificial Sequence: Synthetic coding sequence
atggaccagagccgggtgctgctgtgggtgaaggccgagcccttcatagtcggagcactgcaggtgcctcctccttcaaaattcagcctgcactacctccgcaagatcagcacatatgtacagataagggcaaccgagggggcttatcccagactgtattggtcaacatggcgacacattgcctgtggcaaattacagcttgctaaggacctcgcttggctctacttcgaaatcttcgattctctcagcatgaagacacccgaggaaagactggagtggtcggaagtgttgtctaactgcatgtctgaagaggaggttgagaagcaacgcaaccagctctcggtggatactctgcagttcctattatttctgtatatacagcagcttaacaaggtatccctgagaacctcactcattggcgaggaatggccgagtccgcgaaataaatcgcaaagtccagatctgactgagaagtcaaactgtcacaacaagaattggaatgactacagccaccaggcttttgtgtacgatcacctgtccgatctcctggagctcttgcttgatcctaaacagctgactgcatctttccactctactcactcatccctcgtgagtcgagaagccgtcgtggccctgtctttcttgatcgaaggaaccatctccagggcccgaaaaatttag

SEQ ID NO: 25330 - DNA, 747 bp, Artificial Sequence
  Description of Artificial Sequence: Synthetic coding sequence
atgaacgaccggctgggcgaggacgagagcctgctgatgaagctgtactctttccttctgaacgatagtcccctcaaccccctgctggctagtttcttctccaaagttctctccattctgatttctaggaaaccagagcagatcgtcgattttctgaagaagaaacatgatttcgtggacctgataattaagcatattggcacttccgcgattatggacttattactacggctattaacatgcatcgaacctccacaaccgagacaggacgtgctgaattggttgaacgaagagaaaataatccagaggctggtggagatagtgcatccgagtcaagaggaggaccgtcacagcaatgcctcacagagcctctgcgaaatcgtgcggctgtccagagaccagatgctccaaatccaaaattcaaccgagcccgatctgctgttagcctctgggttacctgatttgaacggggtcggtcccaggggactgttagtggacaacatgctctggagccggcttgtcgtgtccttcgcttcacatggccagggcctagctccgctagtggcccacgtcgctagcgtcgtgtggacgtggtggctgcttcaccccaccgtggccagcgtagtttggacttggtggctgctgcaccctactcagggaaactctgtgttgctgcacccaaccgattgctgggaacgagcctctgggacatttctgtggggtataattcttttctgcttgtcttag

SEQ ID NO: 25331 - DNA, 1869 bp, Artificial Sequence
  Description of Artificial Sequence: Synthetic coding sequence
atggccatggcccccagccccagcctggtgcaggtgtacaccagcccagccgctgtggccgtctgggagtggcaagatggactcgggacgtggcatccttattcagccacagtgtgtagttttattgagcagcagttcgtgcagcagaagggtcagaggtttgggctgggctcgctggcccacagcataccccttggccaggcagatccctctcttgccccttacattatcgatctgccaagctggactcagttcaggcaggatacaggaactatgcgcgcagtcaggcggcacctctttccccaacacagcgctccaggtaggggggtcgtgtgggagtggctgtctgacgacggatcttggacggcctacgaggcgtccgtgtgcgattatttagagcagcaagtggcgaggggcaaccagctggtcgatctggccccactgggttataattatactgtcaactatacaacccatacacaaaccaataagacatccagtttctgccggtccgttagacggcaagcaggacccccataccctgtgaccactatcattgctccccccggccacaccggggtggcctgcagttgccatcaatgcctcagcgggtctcgtaccggccccgtgtctggaagatatcggcatagcatgacgaacttacctgcctatcctgtaccacagcacccgccccacagaactgccagcgtctttggcactcaccaggctttcgctccgtacaacaagccaagtctctctggggcccggtcggcaccgcgcctgaatacaaccaacgcctggggagctgcgccacccagtctggggtcccagcccctctatagatctagcctgagccatctgggacctcaacacctcccgccaggctcatcaacaagcggggcagtgtctgcctcactgccttccggtccctcctcttctccaggctctgtgcctgctaccgtcccaatgcaaatgcccaagccatctcgagtgcaacaggcacttgcagggatgaccagcgtgctaatgagcgctatcggcctacccgtctgcctgtctcgggcaccgcaaccaacatctccacctgcatcgaggctcgcgagtaagagccacggtagcgtgaagcggctgcgcaagatgagcgtgaaaggagctactccaaaaccggaacccgaacccgagcaggtgataaagaattacacggaagagttgaaagtaccaccggatgaggactgcataatttgtatggagaagctctctacagcatcaggatactctgacgtgacagactcaaaggccatcggttccttagcagtcggccacctcaccaagtgtagccacgctttccacctgctgtgtctgctcgccatgtattgtaatgggaacaaggacggatccctgcaatgtccctcctgcaagaccatctatggtgagaagaccggcacacagccgcagggcaaaatggaggtgctcaggttccagatgagccttcctgggcacgaggattgtggaaccatcctcatcgtatactccattccacatggcatccaaggtcctgagcatcctaacccaggtaaaccttttactgctagagggtttcccagacagtgctacctcccggacaacgcacaaggtcgcaaggtgttagaactgctgaaggtggcttggaaacgccgcttgatttttaccgttggcacctcctcaactaccggcgaaactgatactgttgtctggaatgagatccatcataaaacagaaatggatagaaacatcacggggcatggctaccctgaccctaactatttgcagaacgttctggcagagctggccgcacagggtgtgactgaggactgccttgaacaacagtag

SEQ ID NO: 25332 - DNA, 4008 bp, Artificial Sequence
  Description of Artificial Sequence: Synthetic coding sequence
atggaggagatccccgtgaaggtggccgtgcggatccggcccctgctgtgtaaagaggctctgcataatcaccaggtgtgtgtccgcgtgatacctaatagtcagcaggtgatcattgggcgagacagggtattcaccttcgattttgtgtttggtaagaatagtacacaagacgaagtctacaatacctgtatcaagcctctggtgttgtctctgatcgagggctataacgcaactgtctttgcctatggccagacaggctcagggaaaacgtataccatcggcggtggacatatcgcttcagttgtagagggccaaaagggaattattcctcgagctatccaggagatctttcagtccatctccgagcacccctctatcgactttaatgtgaaggtcagttacattgaagtttataaagaagatctgcgcgacctgctggagctagaaacctccatgaaagatctccatattcgtgaggacgaaaagggcaacacggtgattgtaggcgctaaagaatgccacgtggaaagcgctggcgaggttatgtcccttctagaaatggggaacgcagctaggcacaccggcaccacccaaatgaacgagcactcctcacggagtcacgctatttttaccataagcatttgccaggtgcataaaaacatggaagccgcggaggatggatcatggtattctccccgccacattgttagtaaatttcattttgttgacctggccggaagtgaaagagtgacaaagacagggaatactggagaaaggttcaaagaatccatccaaatcaactccgggctgctggccttggggaacgttatcagcgctttaggtgaccctagaagaaagtccagtcatataccataccgggatgccaagatcactaggcttctcaaagattctcttggcggatcggccaaaacagtgatgatcacctgcgttagcccatccagctccaatttcgatgaaagcctgaacagtctgaaatacgctaacagagcgcgcaacatcagaaataagcccacagtgaacttctcccctgagtcagaccgcatcgatgaaatggagttcgaaataaagctcctacgcgaggccctacaaagccagcaggcaggggtatcacagaccacccaaattaatagagaaggctctcctgacacaaatcggatccatagcttagaagaacaagtagcgcagctgcagggcgagtgcctcggataccagtgctgtgtggaagaagctttcacctttctggtggacttgaaagataccgtccgtcttaacgaaaagcaacagcacaaacttcaagagtggtttaacatgatacaggaggtaagaaaggctgttctcacttccttccggggcattggagggaccgccagcctcgaagaaggcccccagcacgtgacggtactgcagttgaaacgcgaactcaagaaatgccagtgtgtgcttgccgctgacgaagtggttttcaatcaaaaggagctggaggtgaaagaattaaaaaaccaggtgcagatgatggtgcaggaaaacaaaggccatgccgttagtttgaaagaggctcagaaagttaaccggctccagaatgaaaaaatcatcgagcagcagctgctggtggaccagttgtccgaggagttgacaaaactgaacctcagtgtgacaagctccgccaaggagaactgcggggatggcccagatgctcgaatccctgaaaggcgcccctacaccgtaccctttgacacccacctcggccactacatctacatcccctcacggcaggattcaagaaaggttcacacaagtcccccaatgtattcacttgatcggatcttcgccgggttcagaacaaggagccaaatgcttctgggtcacatagaggagcaagacaaagtgctgcattgccagtttagcgacaacagtgacgacgaggagagtgagggtcaggaaaagagtggcacacgctgtaggtccagatcctggatccaaaaaccggactctgtttgtagcctggtggagctatcagacacccaggacgaaacgcagaaatcagaccttgagaacgaggacctcaagatagattgcctgcaagagtcacaggaactcaatttgcagaaactgaaaaactcggaaaggatactcaccgaagccaaacaaaagatgagagagttgactatcaacattaaaatgaaggaagatcttatcaaagagctcatcaaaacagggaacgacgctaaatcggtgagtaaacaatactcccttaaagtcacgaagcttgagcacgatgcagagcaagctaaagtggaattaatcgagactcagaagcagctccaggaactcgagaataaggatttatctgatgtcgcgatgaaagtgaaactccagaaggaatttagaaaaaagatggatgcggccaagctgcgggtacaggaaatccagctaaaaactggacaggaggaggggttaaaaccgaaagccgaggatctcgatgcttgcaaccttaagcggagaaagggctcctttggctcaatagaccacttgcagaagttagacgagcagaaaaaatggttggatgaagaagtcgagaaagtgctcaaccagcgccaggagctcgaggagctcgaggcagaccttaaaaagagggaagccatcgtatccaaaaaggaagcactgttgcaagaaaagtcacatctcgagaataaaaaactgaggagttcacaggcccttaacactgactctctgaaaattagtactagactcaatttgctggagcaggaactcagcgaaaagaacgtgcagctgcaaactagcacagcagaagagaagactaagatcagcgagcaggtggaagtgctgcagaaggagaaggaccaactccaaaaacgccgtcataacgttgatgaaaaattgaagaatggccgagtgctttctcctgaggaggagcatgtgctattccaactggaggagggtatcgaagcccttgaagccgctatagagtacaggaatgagagtattcagaaccgtcagaagagcctgcgcgcctcgtttcacaatttatcccggggggaggctaatgtgctggagaagctggcatgcctctcgccagtagaaatcagaaccatcctattccggtattttaacaaggtggtgaatctgcgggaggcagagagaaagcagcaattgtacaacgaagaaatgaaaatgaaagtcctggaacgggacaatatggtgcgtgagctggagtcagcactcgatcacctgaagttacagtgcgaccggaggctgactcttcaacagaaggaacatgagcaaaaaatgcagctcctactccatcatttcaaggagcaggacggcgaggggatcatggaaactttcaagacgtatgaggacaagatccaacagcttgaaaaggatctctacttctataaaaagacttcacgcgatcataaaaagaagctaaaggaactcgttggcgaggcaatcaggaggcaactagctccttcggagtaccaggaggctggggacggagtcctgaaacctgaaggaggagggatgcttagcgaagaattgaagtgggcatcaaggccagaaagcatgaagctcagtggaagggaacgggaaatggacagtagtgcatcctcgctgcggacgcagccaaacccgcagaagttatgggaggatatccccgaactaccacccatccacagttcactggccccccccagcgggcacatgctgggaaatgaaaacaagacagagactgacgataaccagttcacaaagtcacattcccgtctgtcctcccagatccaagttgtggggaatgtgggcaggctgcatggggttacccccgttaagctgtgcaggaaggaactgcgtcagataagcgccctggaactgagtctgagacggtccagtttgggagtcgggattgggtccatggccgcggactccattgaggtgtctcggaagcctagggacctcaagacctag

SEQ ID NO: 25333 - DNA, 2745 bp, Artificial Sequence
  Description of Artificial Sequence: Synthetic coding sequence
atggaggagcggatcaccaccctggagaagcggtacctggccgcccagcgcgaagctacttcaatccatgacctgaatgacaagctcgaaaatgagctggcgaacaaagaaagcctgcatcgccaatgtgaagagaaggcaaggcacctgcaagagctacttgaggtggcggagcagaagctgcagcaaacaatgcgaaaggccgagacactccccgaggtcgaggccgaactggcacagaggatcgccgctctgacaaaggccgaggaacgtcatggcaacatcgaagagcatctgcgacagctcgaggggcagctggaagaaaaaaatcaggagttggctcgtgtacgacagcgtgagaagatgaatgaggatcataataagagactgtccgacaccgtggaccgacttctaagcgagtccaatgagagactgcagttacacttgaaggagcgtatggcggcgttagaggagaaaaatactctcatccaggagctcgaatcttcccagagacaaattgaagagcagcatcaccacaaggggcgcctgtcagaggaaattgaaaagcttaggcaggaggtggaccagctgaaaggaagaggtggcccctttgtcgacggcgtgcattcgcggtcccatatgggatccgcggctgacgtccggttcagtttagggaccacgacacatgcccctcccggggttcatcgacgttatagtgcacttcgggaggagtcagctaaagattgggaaacaagtcctttgccagggatgcttgctcccgcggccggcccagcctttgattctgatccagaaataagcgatgtggatgaagacgaaccagggggacttgtggggtcagctgatgtggttagcccgtcaggccactccgacgcacagactctcgcaatgatgctgcaggagcagcttgacgccattaacgaggagattaggatgattcaggaggaaaaagaatccacggaactccgcgccgaggaaatcgagaccagagtgacctctggtagcatggaggccttgaacttaaagcagttgagaaaacgcgggtctattcccacctccctgacagcactgagcctagcttctgcttcccctccactttccggccgttccacacctaaactaactagccgaagcgctgcacaagatttagacaggatgggtgtgatgacactgcccagcgacttgaggaagcaccgcagaaagctcttatcacctgtgagtcgagaagaaaatagggaggacaaggccacaatcaaatgcgaaacctcacctccatccagccccagaacacttagactggagaagcttggtcaccctgcactgagtcaggaggaaggaaaatccgccctcgaggaccagggctctaacccctcaagttctaacagtagccaagacagtctgcacaaaggcgcgaaacgtaaaggcatcaagagtagcattggccggctcttcggcaagaaagagaagggacgcctgatacaattatctcgggacggagcaacaggtcatgtgctcctgaccgacagtgaatttagcatgcaagaaccaatggttcctgcgaagctcggcacgcaggcagagaaggataggcgtctgaaaaaaaaacatcagctcctcgaagacgcacgcagaaagggcatgcctttcgctcagtgggacgggcccacagtagttagctggttggaactttgggtcggaatgcctgcttggtacgtggcagcctgtagagccaacgtgaagtccggcgcaatcatgagtgcgttgagtgacactgagatacaaagagaaattggtatatccaatgccctacacaggctgaaacttcgtctggctatccaggagatggtcagtctcacctccccctccgccccccccaccagtcgcacctcaagcggaaatgtgtgggtgacgcacgaggaaatggaaactctcgaaacatcaaccaaaaccgactccgaagagggctcatgggcccagacactggcttatggcgacatgaaccatgagtggattggaaacgagtggctgcctagcctgggactcccacaataccgcagctatttcatggaatgtcttgtggacgccaggatgctcgaccatctgacaaagaaagacttacgcgtgcatttgaagatggtggacagctttcataggacatctctgcagtatggaattatgtgtctgaagcgcctgaattatgaccgaaaagagctggaaaagcgaagagaggaaagtcagcatgagataaaggatgtccttgtctggacaaacgaccaagtagtgcactgggtccagtccatcgggctgcgtgattatgccgggaacttacatgaaagcggagtacatggcgccctgctagccctggacgagaatttcgaccataacacactggcccttatacttcaaattccgacccagaacacccaagctaggcaagtcatggagcgagaattcaacaacctcttggcattgggaacggaccgtaagcttgacgacggtgacgataaagtgtttcggagggccccttcttggcggaaaagattccgtcctcgggagcatcatggacggggtggcatgttgtccgcttccgctgaaactctgcctgccggatttagggtgagcacgctgggaacccttcagccacccccagcccctcctaaaaagatcatgcctgaggcccatagccactatctgtatgggcacatgctgagcgcctttcgggattag

SEQ ID NO: 25334 - DNA, 1494 bp, Artificial Sequence
  Description of Artificial Sequence: Synthetic coding sequence
gacgtgggcggcgaccggccctgggacagcggcaacacccagctgccacctaggaacccggtgaaggccaacgcaatgtttggggctggcgacgaggatgatactgactttctatctccttctggcggcgctcgcctggcctcgttattcggtctggaccaagctgccgccggacacgggaacgagttctttcaatatacagccccaaaacagccaaagaaaggtcagggcacagcagccactggaaaccaggctactccgaagacagcccccgcaacaatgagcacccctacaattttggttgccacggctgtacacgcctacagatataccaacggacagtacgtgaaacaggggaaattcggggctgctgtgttgggaaatcacactgcgagggagtacaggatcctgctctatattagtcagcagcagccagtcaccgtggcacgcattcacgtgaattttgaactcatggttaggcctaataactacagtacattttacgatgatcagagacagaactggtccatcatgtttgagagcgagaaggcagcggtggaatttaataagcaagtgtgtatcgccaagtgtaatagcacttcctcactggatgccgtactgtctcaagacctcattgtggccgacgggcccgccgtggaagtgggggacagcttagaagtcgcctacacaggttggcttttccagaatcacgtcttaggtcaagtgtttgactccaccgcaaataaggacaagctgcttcgcctgaagcttggtagcggtaaggtcataaaggggtgggaggacggcatgctgggcatgaaaaagggcggaaagcgccttcttatcgtgccacccgcttgcgccgtggggtccgaaggcgtaatcggatggacacaggcaaccgacagcatcctggtctttgaagtggaggtcaggagggtgaaattcgcacgcgatagtggatccgacgggcactcagtcagctcgagggattcggccgcaccttctccaatcccgggcgccgataacctttcagccgaccctgtggtatcaccaccaacctctatcccatttaagtcaggtgagccagcgcttcgaaccaaatccaactccttatccgaacaactggctatcaatacttctccggatgcagtgaaggccaagttaatatccagaatggccaagatgggccagcccatgctccccatacttcccccacagctggactccaacgattccgaaattgaagacgtgaataccctgcagggtggaggccagcccgttgttaccccttctgtgcagcctagcctccatcctgcccatcccgctctgccacagatgaccagtcaagcaccgcagcctagcgtcaccgggctacaggccccaagcgctgcgctgatgcaggttagttcactggatagccactctgcggtgagtgggaatgcgcaatcatttcaagtgacgttctacaaccgcatcaattacatcctgtag

SEQ ID NO: 25335 - DNA, 462 bp, Artificial Sequence
  Description of Artificial Sequence: Synthetic coding sequence
atgaacctggccgagatctgcgacaacgccaagaagggccgggagtacgccctactgggtaactacgattccagcatggtgtactatcagggggtcatgcagcaaattcagcgccactgccagagcgtaagagaccctgccatcaaaggcaagtggcagcaggtccggcaggagctcctggaggaatacgaacaggttaaatccattgtctctacattggagtctttcaaaatcgacaagccccccgactttcctgtaagttgtcaggatgagcctttcagggatccagccgtgtggcctcctcctgttcctgccgaacaccgcgcccctccacaaatccggcgcccaaatagagaagtgagacccctgcgaaaagagatggcaggagttggagcaagaggacccgttggtagggcccatcctattagtaaatctgaaaagccctctacttctcgggactag

SEQ ID NO: 25336 - DNA, 627 bp, Artificial Sequence
  Description of Artificial Sequence: Synthetic coding sequence
atgttccaggtgcccgacagcgagggcggccgggccggcagccgggctatgaaaccccctggcggggaatcctctaacctcttcgggagccccgaagaggcaacccctagctccaggccaaatagaatggccagcaacatattcggacctactgaagaacctcaaaatatacccaagcgcactaatcctcctggaggtaagggatccggtatcttcgacgagtccacccccgtgcaaacacggcagcacctgaacccaccagggggcaagacttccgacatttttggctcacccgtgactgcaacgagtcggctggcccatcctaacaagcctacccgcaactccagagaccgggtagccatgttcagttttccctttgcccagatgtctggcgtgggcagaggactcgtgctttgcgagcccggctgttcggctagccccggacgacacgattcttgccttgaaacacgcgcatttcagatggcaggccgatgtttgtgtggggatgaaatgggtcacccatggccatcgctgatgtgtagcccgggcctgcggggcacagggaggggagtgcgcgttgggaggtggggaagggcctggtcattagaccagcaaccagcctcctag

SEQ ID NO: 25337 - DNA, 591 bp, Artificial Sequence
  Description of Artificial Sequence: Synthetic coding sequence
atgcccttcagcaaggagaagtacatcctggacagcagccccgagaagctgcacaaagaactggaggaagaactcaaactgagctctaccgacctccggagtcatgcctggtaccatggtcggatcccacgggaagtgtccgaaacactggtgcagcggaatggcgacttcttgatccgggatagcctcacctccctaggcgactacgtactaacctgccggtggcggaatcaagcgctgcacttcaagattaataaggttgtcgtgaaggcaggtgaatcctacactcatatccaatacctattcgaacaggagagctttgatcacgtccctgcactggtgcgctaccacgtcggaagtcgcaaggcggtatccgaacagagcggggcgatcatatactgcccggtgaacaggaccttccctctgagatatctcgaggcctcctacggactggggcaaggatcctcaaaaccagcctccccagtttccccttctggacctaagggcagccacatgaaacgtcgtagtgtcaccatgactgacgggctaaccgccgataaggtcactcgaagtgatgggtgtcccacctag

SEQ ID NO: 25338 - DNA, 1986 bp, Artificial Sequence
  Description of Artificial Sequence: Synthetic coding sequence
atgcaggccaacggcgccggcggcggcggcggcggcggcggcggcgggggtggtggaggtggaggcggtgggggacagggtcagacccctgaactagcctgcctgtccgctcaaaacggagagagctctcccagtagctcttcttccgctggagacctggcgcacgctaatgggctgctccccagcgctccctctgccgccagtaataacagtaacagcctcaacgtgaataacggtgtccccggcggggccgccgccgcttcctcagctaccgtggcagcagcatcagccactaccgctgcttcatccagtctagctacaccagagctggggagctccctgaagaaaaaaaaacgcctctcgcaaagcgacgaagatgtcatccggctaatcgggcaacatctgaatggactgggccttaatcagacagtggacttgctcatgcaggaaagcggttgcaggctggaacacccttctgctacaaaattccggaaccatgtgatggagggcgactgggacaaggctgagaatgacctgaatgaacttaagcctttagtacactctccacatgccatcgtcgtgcgcggggcccttgaaatctcccagacacttctcggaatcattgtgcgcatgaagttcctgttgctccagcaaaagtacctagaatatctggaggatggcaaggttctggaggccctccaggtgttaagatgcgagctgacgcctctcaagtacaacaccgaacgcatacacgtcctatctgggtatctgatgtgcagccacgcagaggacctaagggctaaagccgaatgggaaggcaaaggtacagctagtcggagtaagctgcttgacaagttacagacatatttgcccccgtctgtaatgctgccccccagacgtctccaaaccttacttaggcaggccgtcgaactccagcgcgatagatgcctgtaccataataccaagctcgataataacttggacagtgtttccctcttgatcgatcacgtctgcagtaggaggcagttcccatgctacacacagcagattttaactgaacactgcaacgaggtgtggttttgcaaattctccaatgacggaactaaactcgccacgggaagtaaggacacaactgttatcatctggcaggttgatccagatactcatctgctcaaactgttaaaaactctggaaggtcatgcttatggcgtgtcatacatcgcgtggtctcctgacgataactatttagtggcatgcggacctgatgactgtagcgagctttggctgtggaatgttcaaacaggtgaactcagaaccaaaatgagtcaaagccacgaggattccctgacctccgtcgcctggaacccagacggcaagcgattcgttactggaggtcagcgaggtcagttttaccagtgcgatcttgacggcaatcttctggactcttgggaaggcgtgcgcgtgcagtgcttgtggtgcttgtccgatggaaagaccgtgctggcctccgatacccaccagcgcattcgtgggtacaattttgaggatctgacggaccgcaatatcgtgcaagaggaccatccaatcatgagcttcacgatcagtaagaacggccggcttgcattgctcaacgttgccactcaaggcgtgcacttgtgggatctgcaggaccgcgtgcttgtgcggaaataccagggtgtgacgcagggtttctacactatccactcttgtttcggcggtcacaatgaggattttatcgcgtctggcagcgaagatcacaaagtgtatatctggcacaaacgcagcgaattgcctattgccgaactcacgggccatacgcggacagtgaactgtgtgtcctggaacccccagattccttccatgatggcttcagccagtgacgatggcaccgtaaggatttgggggcccgcccctttcattgaccaccagaacatagaggaggagtgcagcagcatggacagttag

SEQ ID NO: 25339 - DNA, 1113 bp, Artificial Sequence
  Description of Artificial Sequence: Synthetic coding sequence
atggagaagaagaagatggtgacccagggcaaccaggagcccaccacaacacctgacgctatggtccaacccttcacaacgattccatttcctcccccaccacaaaatggcattccgaccgaatatggggtcccacacacgcaagattacgccggccaaacaggagagcataacctgaccctctatggtagtacccaagctcacggagaacagagtagcaattccccctctacccagaacgggtccttaactactgaaggaggtgctcagaccgatggtcagcaatctcagacacaaagctctgagaattcagagagcaaatccactcctaagagactccacgtttccaatatccccttcaggtttcgcgaccctgacttgcgccagatgtttggtcaatttggcaaaatactggacgtggaaataatttttaacgaacgtggctccaagggcttcggcttcgtcacctttgagaattctgctgatgccgatagggcaagggagaagctccatgggaccgtggtggaggggagaaagattgaggtaaacaacgcaacggctagagttatgacaaataaaaagatggtcactccttatgctaatggctggaaactgagtccggtagtgggcgccgtgtacggtccagagctttatgctgcttcctcatttcaggcagatgtcagtttaggaaacgacgccgctgtgcccctctctggacgcggcgggatcaatacttatatccccctaatctccctgccgctggtgcctggcttcccttaccctaccgccgccacgacagccgccgccttcaggggggctcatctcaggggccgaggccgaacggtatatggtgccgttcgggcagtcccgcccaccgccatcccagcctatccgggcgtggacatgcagcctaccgatatgcatagcctactgttgcagcctcagcctcctctgttgcagcccctacagcctttgacggtcactgtgatggccggttgcacacaacctacccctaccatgcctctgccactcccgttggcaatggagctggccctttggcgggtgtataccgaggtcgccacagcagatctccctccaacagaggtgacctag

SEQ ID NO: 25340 - DNA, 348 bp, Artificial Sequence
  Description of Artificial Sequence: Synthetic coding sequence
atgccccacctgcccctggccagcttccggccccccttctggggcctccgccatagccggggtctcccccgatttcacagcgtgtccacccagtcagagccgcacgggtcccctatttcacggagaaatagggaggctaaacaaaaaaggctgagggaaaagcaggcgactctggaggcggagatcgcgggtgaaagcaagtcccccgccgagtccattaaggcatggcggcccaaagaactggttctatacgagataccgaccaagccaggggaaaagaaagatgtttcaggacctctgcccccagcctacagccccaggtatgtggaagccgcttggtacccctag

SEQ ID NO: 25341 - DNA, 3039 bp, Artificial Sequence
  Description of Artificial Sequence: Synthetic coding sequence
atgctgctgaagagcatcttcatcgtgtacatcttcttctacagcatttccgaattgtccctggatagcaccctgcatgcggtgaatctgcattgtaacaatatctccaagattgaggccattgaccacatctggaatctccaacacctggatcttagtagcaatcaaatttcacgcatagaagggcttaataccctgaccaagctttgcactctgaatctgagctgtaacctgattactaaggtggaagggctcgaagagctgataaatctgactcggctcaatgtgtcttacaatcacatcgatgacctgagcggccttattcccctgcatggtatcaagcataaacttcgctatattgacctgcattccaataggatagattcgatccaccatctgttgcaatgcatggttggccttcactttttgacaaacctgattctggaaaaggatggcgacgataaccccgtttgtagactacctggataccgagctgtgatcctgcaaaccctgccccaacttcgcatactggactgtaaaaacatctttggtgaaccggttaatttgaccgaaatcaactctagccagttgcagtgccttgaggggctcctggacaatctggttagcagcgactctccgcttaacatctctgaggacgagatcatagatcgcatgcccgtaatcactgcccccatcgacgagctcgtgccactcgaacagtttgcctccactcccagtgatgccgtcctgacgtcattcatgtctgtgtgccagtcatctgaaccagaaaagaacaaccatgaaaacgatctgcagaatgaaataaagctgcaaaagctcgacgaccagatcctgcagttgctgaacgagaccagcaatagcattgacaatgtgttggagaaggatcctagacctaaaagggatactgacattactagtgaatccgactatggcaatcggaaagaatgcaatcgaaaggtgcctcgtagatctaaaatcccttatgatgccaagactatccaaactatcaagcatcataataagaactacaatagttttgtttcttgtaaccgcaagatgaaaccaccttatttgaaggagctgtacgtgtcaagctctctcgctaactgccctatgctgcaggagagtgagaagccgaaaactgaaatcattaaagtcgaccaaagtcattctgaagataatacttatcagtccctggtcgaacagcttgaccaggagcgcgaaaagcgatggcgggcagaacaggctgagaacaagttgatggattacattgacgagctccataaacacgccaacgagaaggaggacattcacagcctggccttgctgactaccgatagacttaaagagatcatctttcgggaaagaaatagcaaaggacagctagaggtgatggttcataagttacagaatgaaattaagaaacttaccgtagagctcatgaaagccaaggaccagcaagaggatcacttaaaacacctgcggaccctagaaaagacgctagagaaaatggagcgtcagaagaggcagcaacaggccgcgcaaatccggctgatacaggaggtggagctgaaagcctcggccgccgatagggaaatttatctgctgaggaccagtctccacagggagcgtgaacaggcgcagcaactgcatcagttgctggccctgaaagagcaggagcacaggaaggaattagagacccgagagtttttcaccgacgctgatttccaggacgctctcgcaaaggaaatcgctaaggaagagaagaagcatgagcaaatgattaaagagtatcaggaaaaaatcgacgtgctgtctcagcaatatatggacctcgagaatgagtttaggatcgcccttactgtggaggctagacgattccaggatgtgaaggatggcttcgagaatgtggctacagaactggccaagagtaaacacgccctcatctgggctcagcggaaagaaaatgagtcttcttctttgatcaaagatttgacctgcatggttaaagagcagaagacgaagctggcagaggtcagtaagctgaaacaggagactgccgcgaacctacaaaaccagatcaacaccctagaaatacttattgaggatgacaaacagaagagtattcagatcgaactgctcaaacacgagaaggtgcagctcatttccgaactggctgcaaaagaaagtctgatcttcggcctgcggactgagaggaaggtctggggtcacgagctcgcccagcagggctcatccctggcacagaatcgggggaagctagaggcacagatagagtccctgtctagagaaaatgaatgtctgagaaagaccaacgagtctgacagtgatgctctgcggatcaaatgtaagatcatcgatgatcagactgagacgatcaggaagctcaaggactgtctccaggaaaaagatgagcacataaagagactgcaagaaaagatcacggaaattgaaaaatgtactcaggagcagctcgacgagaagtcctctcagctcgacgaggtgttggagaaactcgagcgccataacgaaagaaaagaaaaattaaaacagcagttgaagggaaaagaggttgagctcgaagagatccggaaggcgtattctaccttaaacaggaaatggcacgacaagggggaattgctgtgccacctggaaacgcaggtaaaggaggtgaaggaaaaatttgaaaacaaggagaaaaagctaaaagctgaacgcgataagtccattgaacttcagaaaaacgccatggaaaagctgcacagcatggacgatgcttttaaacgacaggtagatgctatcgtcgaggctcaccaggcagaaatagcccaactagcaaatgagaaacagaagtgcattgacagcgcaaacctgaaagtgcaccagatcgaaaaggagatgcgcgaacttctcgaggagacgtgcaagaacaagaagactatggaggccaaaattaaacagctggcattcgcgttgaatgaaatacaacaggatatgtag

SEQ ID NO: 25342 - DNA, 4665 bp, Artificial Sequence
  Description of Artificial Sequence: Synthetic coding sequence
atgagcgccaccagctggttcctggtgagcagcagcggcgcccggcataggctgccacgcgagctgatctttgtaggcagagaagagtgcgaactgatgcttcaaagccggagtgtcgacaaacagcatgccgtgatcaactacgatcaggacagggatgagcattgggttaaggaccttggctccctcaacggtacctttgtgaacgacatgaggattccagatcaaaaatatgtaaccttaaagctgaacgacgttatacggttcggatatgactccaacatgtatgtgctcgaacgggtccaacacagggtgcccgaagaagctctcaaacacgaaaaatatacttctcagctgcaagtgtcagtcaaaggattggcacctaagagaagtgaggctctgccagagcacacaccctattgtgaagcgtctaatcctcgaccggagaaaggcgaccggcggcctggcaccgaagctgctagttacagaacgcctttatacggacagcctagttggtggggcgaggatgacggctctacactacctgatgcacagaggcagggcgagccctatccagagcgtccgaagggtccagtacagcaagatggagaactccatggttttagggctcctgcagagccacagggatgcagttttcgacgcgaaccttcctactttgaaatcccaacaaaagaaacacctcagccctcccagcctccggaggtgcccgcccacgagatgccgaccaaggatgctgaggcaggaggtggtggggccgccccggtggttcagagtcatgcctccttcactattgagttcgacgactgcagtcccggtaagatgaagataaaggatcatataacaaaattcagcctccgccagagaaggcccccagggaaggaggcaacccctggagaaatggtttccgctgagacaaaagttgccgattggttagtgcagaacgacccatccctcctgcacagagtagggccaggggacgaccgacatagcacaaagagcgatctcccagtacacactagaacactaaaggggcacaaacatgaggacggaacacagagtgattctgaggaccccttagccaaggcagcctcagccgccggcgtgccccttgaagcatcgggcgaacaggttcgcttgcagaggcagatcaaacgggatccccaggagctcttgcacaaccagcaggcatttgtgattgagttctttgacgaggacacgccacggaaaaaaagatctcaaagttttactcactctccaagcggtgatccgaaggcagacaagcggcgtggcccaacaccagcagatagggacagaccctcagtgcccgcgcccgtccaggccggtggccgatcctctggacctcaaagagccggaagtttgaaaagagagaagactgaggagagactgggttcaccaagccccgccagcagaacaccagctcggcccttcggttccgtgggtcgccgctcacgcctcgctcaggattttatggctcaatgcctccgggagagcagccctgccgccaggcctagcccggagaaggtcccacccgtgctcccagccccgttaacgccacacgggacttcccccgtggggcctcccaccccccccccagcacctacagacccccagctgaccaaagctcgtaagcaggaggaggatgactccctgagcgacgctgggacctacacaatcgaaacagaggctcaagacacagaagtagaggaggctcgaaaaatgatcgaccaggtattcggcgtcctggaaagtcccgagctgtctagagcttcaagcgctacttttcgcccggtcatcagaggagaccgggacgagagcgacgatggaggcgtcgcccaacgaatggcgttgctgcaggagttcgcaagcagacccttgggggcagccccgcaagccgaacaccaggggttacctgtgccgggatcacccggaggccagaagtgggtgtcgcgctgggcctctttggctgattcatactccgaccccggtctgacagaagatggcctgggccggcggggaggtgagcccgaaggctcactgccggtccgcatgagacggcggctgccccaattgcctagcgaaagggccgactcacctgcagggcctgaatcctcacggcggtccggccccggaccacccgagcttgactctgagcagccatcccgcctctttggacaagaagaactggatcccgattctctcagtgatgcttctggctcagacggtggccgtggtccagagcctggcgtggagccccaagattcacggcgccgctcaccccaggaaggccccacctggagccgcggtcggaggagcccacgggccccgggcgagcctacacctgcatctttcttcataggggatcagaatggagacgccgtgctctctcgcaagccactggctgctccaggggacggtgagggcctgggccagaccgcacagccgtctccccccgcacgggacggtgtctacgtgtccgccaatggccggatggttatccaacttagaccggggagaagccctgaacctgacggccctgccccagcctttctgagacaggaaagctttactaaagagccagcctccgggccgcctgcaccaggaaaaccccctcacatttccagccaccctctcctccaggatttagcggctacccgggcggctaggatggattttcacagccaggatacccacctgattctgaaggagacggagaccgccctcgccgcattggaagccagactcctttcgaactctgtagatgcagagtgcgagggaggctccacaccccggcccccagaggatgccctgagcggtgacagcgacgtcgatactgcaagcaccgtaagcctgcgctccggcaagagtggccccagccctacaaccccccagcctcttcgtgcccagaaggagatgagcccgtctcctcccgcagcccaggaccccggaggcacagctctagtgtccgcacgggaacagagctcagagcgtcagcaccacccactcggacctactgacatgggacggggggagcccgtgaggcgtagtgccatcagacgggggcacaggcccagaggttcacttgactggccttctgaagagcgaggacccgtcctggctcaccttcccagcagcgacgtgatggcctccaatcacgagaccccagaagccacaggcgctgggcgcttagggtctcggagaaagccagccgccccaccacctagcccagccgctagggaggagcagtccagatccagcgcctcaagtcagaagggcccccaggcgctgacaaggtccaattcattgtccacccctcgcccaacccgagcttccagactgaggcgcgcgcggctgggcgatgcgagcgatactgaagctgcggacggtgagagagggtcgctgggaaaccctgaacctgtgggtagacctgccgctgagcaggccaaaaagctctctagattggacattttggcaatgccacgcaaaagggcaggaagcttcacaggaacctctgacccagaggccgcccccgcacgaacttcttttagcggacgtagtgtcgagctctgctgcgccagccgcaaaccaacaatggcagaagcccgggctgtgtcacgtaaagctgcgaacactgctacaacgacagggccaagacaacccttcagccgcgcccggagcggctcggcgcggtacacttcaacgactcagaccccacgtgccggaagctcttcccgggctcgcagccgcgccccgggaccgcgggatacagatgatgacgaggaagaacctgatccttacggcttcattgtgcagaccgctgaaatcgcagaaatcgccagattatcgcagaccctagtcaaagacgttgctatactggcccaggaaatccatgatgtcgccggagacggcgacacactcggttcctccgagcctgcacacagcgcctcgctgagcaatatgccaagcactcctgcctccactatttcagcgcgtgaggagctggtgcagcgaatccccgaggcctctctgaactttcagaaagttcccccaggatccttaaacagtcgcgattttgatcagaacatgaatgattcctgtgaagacgcactggcaaacaagaccagaccgaggaatcgggaggaggtcattttcgacaacctcatgctgaatccagtgagccaacttagccaggctattcgcgaaaatacggagcacctggccgagaaaatgaaaatccttttccagaacaccggcagggcttgggaggatctggaagcccggatcaacgccgagaatgaggtgcctatcctaaaaacctctaacaaagagatttcctccatcttaaaggagttgcggagagtccagaagcagctggaggtaattaacgccatagtggatcccagtggatcactggatctcctcaccggaaacagatccctggcctccagtgcgcagccaggactgggcaaggggagagttgctgcacaaagcccaccttcgcccgccagcgccgaggctctgttacccgctcttccactgcggaacttcccacagagagccagctgcggcccccccagccttcccgaccctacttttctgcccgacgctgaaagattcttgatctag

SEQ ID NO: 25343 - DNA, 696 bp, Artificial Sequence
  Description of Artificial Sequence: Synthetic coding sequence
atcatcctgctgctggtgcccagcgaggagaccgacgagaacgacttaattttggaagtgacggcgggggtgggtggcgggctgcgtcacgcttcagcctctataggtggatcggaggcctataggcacatgaagttcgaaggcggcgtccatcgcgtccaaagagttcctaagactgaaaaacaaggacgggtgcacacatctaccatgacggtagctatcctccctcagcccaccgaaataaaccttgtaataaaccccaaggatctgcgtatcgatacaaagcgggccagcggtgctgggggacaacatgtgaatactaccgactccgccgtccgcatagttcacctccccacgggcgtggtctccgaatgccaacaggaaagatctcagcttaagaataaggagctggcgatgactaagctgagggctaagttgtatagcatgcacctcgaggaggagattaataaacggcaaaacgcaaggaaaatccaaatcggatcaaaggggagatcagagaaaatccggacttacaattttccacagaatagggttacagaccataggatcaataagaccctacacgacctggagaccttcatgcagggggactacctcctggacgagctggtgcaatcccttaaggagtatgccgactacgaaagcctagtcgaaatcatcagccagaaagtgtag

SEQ ID NO: 25344 - DNA, 483 bp, Artificial Sequence
  Description of Artificial Sequence: Synthetic coding sequence
atggaggccgagcggccccaggaggaggaggacggcgagcagggccctccgcaggatgaggaaggttggcccccacccaactccaccactcgcccatggcgttctgccccgccatccccaccgcccccagggacaagacatactgcccttgggccacgctccgccagcctactctctctccagactgagctgctgcttgacttagtggccgaggctcagtctcgccgactggaggagcaaagggctactttttatactccccagaacccgagtagccttgcccctgcgcccctgagacccctcgaagatcgagaacagctgtactccactatactttctcatcagtgccagcgcatggaggcacaacggtctgaacccccccttcccccagggggacaagagctgttggagttgctcctgagggttcagggtggagggagaatggaagagcagagatctcgcccccctacccatacgtgctag

SEQ ID NO: 25345 - DNA, 423 bp, Artificial Sequence
  Description of Artificial Sequence: Synthetic coding sequence
atgcagttcggcgagctgctggccgccgtgcggaaggcccaggccaatgttatgctgttcctggaggaaaaagaacaggcagccttatcccaggccaacggtatcaaagcccacctggagtacagatccgcagaaatggaaaaatctaaacaggaactcgagaccatggccgctatttcgaatactgtgcagtttctcgagatgtgtatgacctctcgtagtacgcgcacgcaacacacctccatctcagggtgccgcagaaggactgcacgtagcccaaccccaagaccggggtccattcccacacggacttcgccggctggcagctgcacgggcggacggtgttgccccagccgggtctgcacttgcaccggcaccattttgcggtggcgatcgtcggggcaggctccaatgctcgcatag

SEQ ID NO: 25346 - DNA, 819 bp, Artificial Sequence
  Description of Artificial Sequence: Synthetic coding sequence
atggccagcagcaacaccgtgctgatgcggctggtggccagcgcctactccatcgcccagaaggcgggcatgatagtgcggcgtgtaatcgcagaaggtgatctgggaatcgtagagaaaacatgtgctactgatcttcagacgaaggccgacaggcttgctcaaatgtctatatgctcgagcctggcccggaagttcccaaaactgaccataatcggtgaggagctggtggtttgggtggatccgttagacggcacaaaggaatacactgaaggtctccttgacaacgtaacggtacttatcggcatagcctacgagggtaaggcaatcgccggtgttattaatcaaccttactataattacgaggctggccccgacgccgtattgggacgaacaatctggggcgtgctgggcctgggagctttcggattccagctgaaggaggttccagccggcaagcacatcattactacaaccaggtcacacagcaacaaattagttactgactgcgtagctgccatgaatcctgatgcggtacttcgcgttggcggtgccgggaacaagatcatccaactcattgagggtaaggcctccgcctacgtgtttgcatcgccagggtgcaagaaatgggatacctgtgctcccgaagtcatactgcacgcagtggggggcaagctgactgacatccacggaaacgtgcttcaataccacaaagacgtgaaacacatgaacagtgcgggagttctcgcaacattgcgtaattacgattattacgctagccgggtgccagagagtattaaaaatgccctggtgccttag

SEQ ID NO: 25347 - DNA, 606 bp, Artificial Sequence
  Description of Artificial Sequence: Synthetic coding sequence
atggagagcaaccacaagagcggcgacggcctgagcggcacccagaaagaggctgctctccgggctttggtgcagcgcacggggtattctctggtgcaagaaaacggccagcgtaagtacggcgggccaccccccggttgggacgcagccccaccggagcgcggctgcgagatatttattgggaagcttcctagggacctttttgaagatgagttgatcccactgtgcgaaaaaatcgggaaaatctacgagatgagaatgatgatggattttaatggtaacaaccgagggtatgcctttgtgacattttccaataaagtggaagcaaaaaatgctattaagcagctcaacaactacgaaattcgaaatggccgcttgctcggggtctgcgccagcgtcgacaattgtcgactgttcgtgggggggatccccaagaccaagaaaagggaggagattctcagtgagatgaagaaagtcacagagggtgtggtggacgttatcgtttatccgagcgcagccgacaagacgaagaaccgaggttttgccttcgtggagtacgagagtcacagggctgctgccatggctcggcgcaagctcctgccctag

SEQ ID NO: 25348 - DNA, 1905 bp, Artificial Sequence
  Description of Artificial Sequence: Synthetic coding sequence
atggccctgagcaagcgggagctggacgagctgaagccctggatcgagaagacagtcaagcgtgtactgggcttttccgagcctaccgtggtgacggccgcattaaattgtgtgggcaaggggatggacaagaaaaaggctgccgaccacctgaaaccctttttagatgactcaactcttagattcgtggataaactgtttgaagctgtcgaagagggccgttcctcacgtcacagcaagagctctagcgacaggtcacgcaagagagagttaaaaattaagcagatgatggaggccgctacgcgacagatcgaagagcgcaagaaacaactgtccttcatcagcccccccactccacagcccaagactccatcttcttctcagccagaaagactgccaattggaaacaccatccagcctagccaggcggccactttcatgaacgacgcaattgaaaaagcacgcaaagctgcagaattacaagctcgcattcaggcccagcttgctctgaaacctggcctgattgggaatgccaatatggtggggttggctaacttgcatgctatgggcatagctccgcccaaggtggaactcaaagaccaaacaaagcccacccctctgattctcgatgagcaaggccgcactgtagacgctacagggaaggagatagaacttacacaccggatgccaaccttaaaggcaaacatccgcgcagtcaaacgtgagcagttcaagcagcagttgaaggaaaagccgagtgaggacatggagtctaataccttctttgaccctagggtgtccatcgcaccgtctcagagacagaggcgaactttcaagtttcacgataaggggaagttcgaaaagatcgcccagcgcctacgaactaaggcgcagttagagaaacttcaggcagagatttctcaagcagcgaggaagactggaatccacacgagcactcggctggccctcattgcaccaaaaaaggaacttaaggagggagatatccccgaaatcgaatggtgggacagttacatcattccaaatggctttgatcttactgaggagaatcccaagcgggaggactatttcggaattacgaatctggttgagcacccggcccagctgaatcccccagtagataatgacacacctgtcactctgggtgtgtacctcactaaaaaggagcagaagaagctccgtagacaaacccggagagaagcccagaaggaactgcaagagaaggtccgccttggtctcatgcccccacccgaaccaaaggtgcgcattagcaacctgatgcgggttctggggaccgaagcagtccaagatcccaccaaagtagaagcacatgttagagctcagatggcaaagaggcaaaaggcgcacgaagaagccaatgccgccagaaagctcaccgccgaacaacgaaaagtgaagaaaatcaaaaagttaaaagaggacatatcccagggtgtgcatataagcgtctacagggttcgtaatctatcgaaccccgcaaaaaagttcaagattgaagccaatgctggacagttatacctaacaggagtcgtggtcctgcacaaggacgtgaatgtggtcgtggtggaaggagggccgaaggcacagaagaaattcaagaggctcatgctgcatcgaattaagtgggacgaacagaccagtaacacgaagggagacgatgatgaagagtctgacgaggaggcggtcaaaaaaaccaacaagtgtgtgctggtgtgggagggaactgccaaagaccggagcttcggtgaaatgaaattcaagcaatgccctacagaaaacatggctagagagcactttaaaaaacacggagccgaacactactgggacctggctctgtccgagtccgtcttggagtccacggattag

SEQ ID NO: 25349 - DNA, 3192 bp, Artificial Sequence
  Description of Artificial Sequence: Synthetic coding sequence
atgccccacctgcccctggccagcttccggccccccttctggggcttacgacattctagaggattgccccgatttcactcggtttcaacgcagtctgagccgcatgggtctcctatctccaggaggaacagggaggccaaacaaaagagactgcgcgagaagcaggcaacattagaagctgagatcgcgggcgagtccaagtccccggccgaaagcattaaagcttggcggcccaaggagctcgtactgtacgagattcctaccaaaccaggcgaaaaaaaagatgtctccggtcctttacccccggcctacagtcctcggtacgtagaggccgcctggtacccatggtgggtcagggaagggttttttaagccagaataccaagctcgactaccccaagcgacaggggaaacatttagtatgtgcatccctccaccaaatgtcacaggtagcctgcatatcggccacgctctgacagttgcaatccaggacgcacttgtgcgctggcatcgaatgagaggggaccaagtattgtgggtaccgggctcagaccacgcaggtattgcaacccaggctgtggtcgaaaaacagctatggaaggaaagaggagtgcgccggcatgaactgtcaagggaggctttcctccgggaggtatggcagtggaaggaggcaaaggggggagaaatttgcgagcagttgcgggccttaggtgctagtctagattgggaccgagaatgcttcaccatggacgtggggtccagcgtcgctgtgaccgaggctttcgtgcggctttacaaagctggtttattgtaccgcaatcaccagcttgtaaattggtcttgtgctttgcgaagtgcaatatcggacattgaggtagagaatagacccctccccggacatacccaattacgcttaccaggctgtcccaccccggtaagcttcggcctgctgttctccgtcgcgtttccggtagatggcgaacctgacgccgaagttgtggtgggaaccacaaggcctgagaccctccctggagatgtggccgttgctgttcacccggacgattctagatacactcatctccacggcagacaactgagacatcccctgatgggccagcccctgcctctcatcacagattatgctgtgcagccgcacgtcggcactggggctgtgaaggttactcccgcacattcgccagccgacgctgagatgggagctaggcacggattgtctcccctcaacgtcatcgcagaggatggcacaatgaccagtctctgtggagactggctccaaggattgcaccggtttgtggctagagagaaaatcatgtccgtcctctctgagtggggcctcttcaggggacttcagaaccaccccatggtcctgcctatatgttcccggagcggagacgtcatagaatatctgttgaaaaaccagtggttcgtgaggtgtcaagaaatgggggctagagctgccaaagccgtggagtctggcgctctcgagctatctccttcattccaccagaaaaactggcagcactggttcagtcacattggagattggtgtgtttcgagacagctatggtggggtcatcagatacccgcctatctggttgttgaggatcacgcccagggagaggaagattgctgggtggttggccgcagtgaggccgaggcacgggaggtcgcagctgaactgactggtcgccctggggccgagcttactctagaacgagatcctgatgtgctagatacatggttctcttccgcactcttcccattcagcgctctcggatggccccaggagactcccgacctcgctcgtttctatcccctgagcttattagaaacaggcagtgatctcctcttgttctgggtaggacgcatggtaatgcttggaacacagctgacaggtcaactgccttttagcaaagtcctgctgcatcccatggttagggaccggcaggggagaaagatgtccaagagtctgggcaatgtgctggatccccgggatataatctcaggtgtggagatgcaagtgctgcaggagaagctgcgttcgggaaatcttgaccccgccgaactcgcaatcgtagctgccgcacaaaagaaagacttcccacacggcatccccgagtgcggcaccgatgcccttcggtttacactgtgttcccacggcgtacaagctggcgacctgcacctatctgtgagcgaggtacaatcttgccgacacttctgcaacaaaatctggaacgccctgcgtttcatcctcaacgctttgggagaaaagttcgtgccccagcctgcagaggagctgtcccccagctcacctatggacgcctggatcttgtcccgattagccctcgccgcccaggagtgcgagagaggattcttgactagggaactttctctggtgacgcacgcacttcaccatttttggctgcataatctgtgcgacgtgtatcttgaggccgtgaagcctgtgttgtggcattccccacggccactggggcctcctcaggtgcttttttcttgtgccgatcttggtctcaggcttttagccccgttgatgccattcttggctgaagaactgtggcagcgcctgcctcctcgtcctggatgcccacccgctcccagcatttctgtcgcaccatatcctagtgcttgttcactggaacattggaggcagcccgaactcgaacggaggttttcgagggttcaggaggttgttcaggttctgcgtgccttaagggccacctaccagcttactaaagcgcggccccgcgtactcctgcagtcttcggaacctggtgatcaagggctgttcgaggccttcttggaacccctgggcactctgggatactgtggtgcggtcggactactgcctcctggcgcagccgcaccgagtggctgggcacaagccccactgagcgataccgcacaagtgtacatggagctccaagggctcgtcgacccgcagatccaattgcccctgctggccgcacggaggtataagctgcagaaacagctcgatagcctcacggcccgtacccccagcgagggagaggctggaactcagaggcagcagaagctgagtagccttcagttggagcttagcaagctcgacaaagccgcttctcatttgaggcaacttatggacgagcctcctgcacctggctcccccgagttgtag

SEQ ID NO: 25350 - DNA, 2118 bp, Artificial Sequence
  Description of Artificial Sequence: Synthetic coding sequence
atgatcgacagcgtgaagctgcggcgggacagcgccgccgacttctttagccattacgaatatctgtgtgccctgcagaacagcgtccctttacctgcagtgagggcctgcctgcgtgagggagtcctcgacttcaatgcagaccggctcagaggtgtggactgggctcctcttctgtcaactcttaaaatcaataaggatttacctttggtctctatcaagtcgttcttccagccctggcttggtgacaccggctccgatatgaataaattttgtaggtctagggtgcctgctattaggtataaggatgtcaccttccaactgtgcaaagcccttaagggatgtctctccatcagctcagtgctgaagaacctggagcttaacggcttgatcctgagagaaagggacctgacaatcctggccaaggggttgaacaaaagtgcctctttggtccacctctctcttgcaaactgtcctatcggtgatggagggctcgaaattatatgtcagggaatcaagtcatccattaccctgaagaccgtgaatttcacgggatgtaaccttacatggcaaggggccgaccatatggcaaaaatccttaaatatcagacaatgcggaggcatgaggaaacctgggcagaaagcctaaggtaccggcgtcccgatcttgattgtatggccgggttgaggcgcattacactgaactgcaatacccttatcggggacttgggggcatgtgcctttgcagatagtctctcggaggatttatggttaagagccttagatcttcagcagtgcggcttgacgaacgaaggcgccaaggccctgctggaagctctcgaaacaaacacaactttggtggtgctggacatacgcaagaaccctcttattgaccatagcatgatgaaggccgtgatcaagaaagtgttgcagaatgggcgcagcgccaagtctgagtaccaatggatcacgagtccttctgtaaaggagccatcaaaaacggctaagcagaaaagacgcacaataatcctgggtagcgggcataaaggcaaggcgacaatcaggatcggacttgcaactaagaaaccggtatcatccgggagaaagcactcactgggcaaggaatactacgctccagctcctcttccaccaggggtgtctggattcctcccatggcgtacggcggagcgggccaagaggcacaggggattccccttgataaaaaccagggacatttgtaatcagctccagcaacctgggttccccgtgacggtgaccgtggaatctccctctagctcggaggtcgaagaggtggacgatagttctgagtccgtgcacgaagtgcctgaaaagaccagcattgagcaagaagcactgcaggaaaaactggaagagtgcctgaaacagctgaaggaggagagggtaataaggttaaaggttgataaacgagtgtctgagttggagcacgaaaatgcacagttgaggaacatcaacttttctttgtcagaagctctgcacgctcagtccctgaccaacatgattttggatgacgagggagttctgggcagcattgagaactctttccagaagttccacgcatttcttgacctgttaaaagatgccgggctggggcagctggcgaccatggctggcattgatcaatctgatttccaactgctggggcatccacagatgacaagcaccgtgtctaatccacccaaagaggaaaagaaggcattggaagatgaaaaaccagaacccaaacaaaacgcgctcgggcaaatgcagaatattcaagtaagcatttgcatgcagtctgcttacaatgagggcaccctaatgaaattccagaagatcacaggggatgccaggatcccactgcctctcgatagcttccctgtgccggtgtctacgcctgagggactcgggacatcatcaaataacttaggtgtacctgccactgagcaacgtcaggagtcctttgagggcttcatcgccaggatgtgcagtccctcccctgatgctacgtccgggaccggctcccagaggaaagaggaagagctgtcacggaattcaagaagcagttcggagaagaaaaccaaaactggtagccactag

SEQ ID NO: 25351 - DNA, 1287 bp, Artificial Sequence
  Description of Artificial Sequence: Synthetic coding sequence
atggcctggcagagccggaagggcggccacttccgggaggtggccatgcaatggaaggtgaccttgacatctcggtgggggcttctgaggcattgtcaggtccttgccggcctccttcacttgggaaacatccagtttgccgcctcagaagatgaagcacagccctgtcagcccatggatgacgcaaagtattccgtcaggactgctgcaagtctgctcggactgccggaggacgtactgcttgaaatggtgcagatacggactatcagagcagggcgtcagcagcaagtctttcgcaaaccttgcgcccgagcagagtgcgacactcggagagattgtctggccaagctcatctacgctcggctgttcgactggctagtcagcgtcatcaactcctccatttgtgcggataccgattcatggacaaccttcattggccttctcgacgtctacggattcgagtctttccctgacaacagtctggagcagctgtgcattaactacgctaatgagaaactccaacagcattttgtcgcccactatttgagagcacaacaggaagagtacgccgtggagggactagagtggagctttatcaactatcaagataatcaaccatgtctcgacctcatcgagggatcaccaatcagcatctgtagtctgataaacgaggaatgcaggctaaatcgacccagctctgcggcccagcttcagaccaggatcgagactgccctcgccggctccccttgtctaggacacaataagctgtcgcgagaaccatcttttatagtcgtgcactacgccggccctgtgaggtatcatacagccggactcgtagagaaaaacaaggacccgattcctcccgaactggatggggtggaggagaagcacttctcccaggcaccatgttccctgagtacgtccccacttcagactcgcctcctggaggctatcatacggctttggccacttggtctagttctggcaaatacagccatgggcgttggaagttttcagaggaaactggtcgtatgggcctgcctgcaactccccagaggctctccctcttcgtacacagtccagacagcccaggatcaagccggcgtgacttctattagggcactgccacaaggtagcattaagtttcattgtcgcaaatcccccttgcggtatgccgacatctgtcccgagcccagtccatattctataacaggttttaatcagatcctgctcgagaggcatcggctgatccacgtgaccagcagcgcctttaccgggctcgggtag

SEQ ID NO: 25352 - DNA, 927 bp, Artificial Sequence
  Description of Artificial Sequence: Synthetic coding sequence
atgaaccccatcgtggtggtgcacggcggcggcgccggccccatcagcaaggatcggaaggagcgtgtgcatcagggtatggtgcgggcagccacagtcggctacgggattctgagggagggtggcagcgcggtggatgctgtcgagggtgcggtggtcgccctcgaagatgaccctgagttcaatgccggttgcgggagtgtccttaatacaaacggtgaagtcgagatggatgcttctataatggatggcaaagacctatccgcaggggccgtgagtgccgtacaatgcattgctaacccaataaagctcgccaggctcgttatggagaagacccctcattgttttctcaccgaccagggcgcagcccagttcgccgccgcaatgggagtgcccgagattcccggcgagaagctggtaactgagaggaataaaaaacgcctcgaaaaagagaagcacgagaagggtgcccagaaaaccgactgccagaaaaatttaggcaccgtgggagcggtagccctcgactgtaaaggcaacgtcgcctatgcgacaagcactgggggaatagtgaataaaatggttggacgtgtgggagattccccatgtctaggcgccgggggctatgccgacaacgatataggggcagtgtcaacaactggccacggcgagtccatactcaaagtgaatctcgctcggctaacccttttccacattgagcagggcaaaacagtggaagaggctgccgacctttcacttggatacatgaagagtcgggtgaaggggcttggcgggctgatcgtggtatccaagactggagactgggtggctaagtggacttccacctctatgccatgggccgccgccaaagatggaaagcttcattttggcattgaccccgatgacaccaccatcactgatttaccctag

SEQ ID NO: 25353 - DNA, 429 bp, Artificial Sequence
  Description of Artificial Sequence: Synthetic coding sequence
atgagcctgcacggcaagcggaaggagatctacaagtacgaggccccatggaccgtgtacgctatgaactggtccgttcgccctgacaaacgatttaggctggcactaggatctttcgtggaagagtataacaataaagtggttatcctggatgtgagagtgccatgtacaccggtggcaagattaaacaaccacagagcatgcgttaacgggattgcttgggccccccatagcagctgtcacatctgtacagctgctgacgaccaccaagcactgatatgggacatccaacagatgccccgggccatcgaggaccctattctcgcatataccgctgagggggagattaacaacgtgcaatgggcgtctacccagccagattggattgctatctgttacaataactgtctggagattcttcgagtatag

SEQ ID NO: 25354 - DNA, 1233 bp, Artificial Sequence
  Description of Artificial Sequence: Synthetic coding sequence
atggccgcccccagccccagcggcggcggcggcagcggcggcggcagcggttctggcacgccaggccctgtagggtcccctgctcccgggcacccagcggtcagcagtatgcaggggtttcagatcaacttctgtgagaaagcccagtccaagcgaaaggccctcaagctcaatttcgctaatcctcctttcaaaagtactgcccggtttaccctgaaccctaaccctacaggcgtgcagaacccacatatcgaacggctgaggacccattctatagaatcttccggcaaactcaagattagtcccgaacagcattgggattttaccgccgaggatctgaaggatttgggggagatcggacgcggtgcatacggcagcgttaacaagatggttcataagccctcggggcaaattatggcggttaagcgcattaggagtacagtggatgaaaaggagcagaagcagcttttaatggatctcgacgtcgtcatgcggtcatccgactgtccctacatcgttcaattttatggggctctgttccgagagggggattgctggatatgtatggaattgatgtccacatccttcgacaaattttataagtacgtctattccgtgctcgatgacgttatcccagaagagatcctcgggaagatcacgcttgccaccgtcaaggcacttaatcatctgaaagagaacttaaaaataatccatagggatattaagccgtctaatatccttctagatcggtccgggaacattaagctgtgcgacttcgggatctccggccagttagtagatagtattgccaaaacccgcgacgctgggtgcagaccctacatggctcccgaacgaatagatccgtccgcaagccgccagggatatgatgtcaggagcgacgtgtggtcactggggattaccctatacgagcttgctacaggccgcttcccgtaccccaagtggaattctgtgttcgatcagctgacccaggtcgtaaaaggcgaccctccccagttgtcaaactctgaagaaagggagttttctccttcttttataaattttgtgaacctgtgtctgacaaaagacgaatctaaacgacctaaatataaagaattgcttaaacatccgtttatcctgatgtacgaggagagggcggtcgaagtggcttgctatgtctgcaaaatcctggaccagatgccagccacacctagctcacccatgtatgtcgactag

SEQ ID NO: 25355 - DNA, 687 bp, Artificial Sequence
  Description of Artificial Sequence: Synthetic coding sequence
atgcagctggccgtggtgagcgaggagcaggaccagaacctgaaccgactaatttgttggatcttgatgcagtttatttatatcagctccgactatgtgttcgacgggaccaaccctccataccgagaagaggacatccctgcgcctttgaatctctacgggaagacaaagctcgacggggagaaggctgtcctggagaataacctgggagcagcagtcctgcggatcccgatcctctacggggaagtagagaaactggaggaatcagccgttacggtgatgtttgacaaggtacagtttagtaacaagtccgctaatatggaccattggcagcagcggttccccactcacgttaaagacgttgccaccgtctgccgtcagctagcggagaaaaggatgctggacccctctatcaaaggaacatttcactggtcaggaaacgagcagatgactaaatacgagatggcttgcgccattgccgacgcttttaatttgccctccagtcatttgcgccccattacagactccccagtgctgggagcccagagacctcgaaacgctcagctagattgcagcaagctagagactctgggcatcgggcagagaacgccttttcgaataggtataaaagaatcactctggccttttctcatcgacaaacggtggcgacagacagtcttccattag

SEQ ID NO: 25356 - DNA, 1101 bp, Artificial Sequence
  Description of Artificial Sequence: Synthetic coding sequence
atgagcgccgccaaccccgagacccccaacagcaccatcagccgggaagctagtacacaaagcagttccgcagccgcatcccaggggtgggtccttccagagggtaagattgtccctaacaccgtgttcgtggggggcattgatgctagaatggacgagactgagatcggcagctgcttcgggcggtatggatccgtaaaagaggtcaaaatcattactaaccgaactggcgtcagtaaaggctacggcttcgtctcattcgtcaacgatgttgacgtgcaaaaaatcgtagggagtcagatccatttccacggaaaaaagctcaaactggggcctgccatcaggaagcagaagctgtgtgcacgtcatgtgcagccacgacccctcgttgtcaatccaccaccgcctcctcagtttcagaatgtgtggcgaaatcccaataccgaaacctatcttcagccccaaatcaccccgaatccagtgacccaacatgtccaggcttattccgcgtacccccacagccctggccaagtgataacagggtgccaacttcttgtgtacaactaccaagagtaccccacttaccctgacagcgccttccaggtgaccacaggttatcagttgccggtctacaactatcagccgtttcccgcataccccagttctccgttccaagtaaccgcaggctaccagctgcccgtgtacaattaccaggcgtttccagcttacccatcttccccgtttcaggtgacaactggctaccagttaccagtgtacaattatcaagcctttccagcttatccttcgagccctttccaggtgaccactggttaccagctcccggtgtataattatcaggcgtttcctgcctacccatcttcaccatttcaggttacaacaggttatcagctccctgtttacaactaccaggctttcccagcgtaccccaatagcgccgtgcaggtgacaactgggtaccaatttcacgtgtataactatcagatgccgccccagtgccctgtaggagagcagcgcaggaatttatggacggaggcctacaagtggtggtatctggtgtgcctaatacagaggagagactag

SEQ ID NO: 25357 - DNA, 306 bp, Artificial Sequence
  Description of Artificial Sequence: Synthetic coding sequence
atggccagcgccggcacccagcactacagcatcggcctgcggcagaagaacagcttcaagcagtccggccccagcggcacagttccagctacccctcccgagaaaccatccgaggggcgagtatggccacaggcccatcaacaggtcaaacccatctggaagttagagaagaaacaggtcgagaccttatctgctggtctgggccccgggctgttgggtgtgcctcctcagccagcgtacttcttctgcccaagcacactgtgttctagcggaaccaccgctgtgattgctgggcattcaagttag

SEQ ID NO: 25358 - DNA, 2121 bp, Artificial Sequence
  Description of Artificial Sequence: Synthetic coding sequence
atgatcgacagcgtgaagctgcggcgggacagcgccgccgacttcttttcccactatgagtatctttgcgcgctgcaaaacagcgtccccttgccagccgtgcgtgcatgcttgcgagagggcgtgctcgactttaatgctgacaggctcagaggggtcgactgggctcccctgctgagtacactgaagatcaacaaagacctgcctctagtgagtattaaatccttttttcagccttggctgggggatacgggaagtgatatgaataagttttgccgaagtcgcgtgcctgccattagatacaaggatgtgactttccaactctgcaaagctctaaaaggttgtctctcaatcagttccgtgcttaaaaacctagagctgaacggtctgatcttgcgggagcgagatctcactattctggctaaggggttaaacaaatctgcaagtctggtgcacttgagcctggcaaattgtcctattggagacggcggactggagatcatttgccaaggtattaagagctcaatcacactgaagaccgtcaacttcacggggtgtaacctgacctggcagggagcggaccacatggccaaaattctgaaataccagactatgcgacgccatgaagaaacatgggcagagagcctgagatacaggagaccggatctggactgcatggccgggctgcgaagaataacgctgaactgtaataccttgatcggagacctcggggcatgcgcctttgccgattccctcagcgaagatttgtggctccgggccctcgacctccaacaatgcggtctgacaaatgagggcgcaaaggcattattggaagcacttgagactaacacgaccctggtggttttggatatcagaaaaaatccgcttattgaccatagcatgatgaaggccgtaataaagaaggtgctgcagaacgggagatccgccaaaagcgaatatcagtggatcacaagtccttctgtgaaggagcccagtaagaccgccaaacagaaaaggcggacaatcattttaggatcagggcataagggtaaggccaccatcaggatcgtcgggctggccacgaaaaagcccgtttcttctggtagaaagcacagtctagggaaagagtactacgcgcctgcccctctcccgcccggtgtgagtggattcctgccctggcgcaccgcggagagggccaaaagacatcgagggtttcccttaatcaagactcgtgatatctgcaatcagctccaacaacctgggttcccggtgactgtcactgtggagtcaccttcgagctctgaagtggaagaagttgatgattcctctgagtccgtgcatgaggttcctgaaaagacctcgatcgaacaggaggctctccaggaaaagctggaggaatgcctgaaacagctgaaagaagaaagagtaatcaggctcaaggtggataagagggtatctgagcttgaacatgagaacgctcagctgcgaaacatcaacttttctctgagcgaggcactgcatgctcagtccctaacaaatatgatactcgatgacgaaggggtgctcggcagtatcgagaatagtttccagaagtttcatgcttttcttgacctgctcaaagatgctgggcttgggcagttggccactatggccggcatcgaccagagcgatttccagcttctagggcatcctcagatgacctccacggtgtccaatccccctaaagaagagaagaaagccctggaggatgagaagcccgagcctaaacagaatgctctcggacagatgcagaatatccagtttcagaaaatcactggcgatgccaggatccccctgccgctagactcatttccagttcctgtaagtactcctgaaggtttgggaactagtagtaacaaccttggcgtacctgccactgaacagagacaagagtcttttgagggttttatcgcccggatgtgcagtcccagccctgatgcgacctcgggcacgggttcacagaggaaggaggaggagctgtccagaaatagtagatcaagctccgagaaaaagaccaaaacaggcgaatacacaaagaaacactcggacaagcagcaccctggaaaggacctacattcttag

SEQ ID NO: 25359 - DNA, 1932 bp, Artificial Sequence
  Description of Artificial Sequence: Synthetic coding sequence
atggcctgccagcagagccggtaccacagcttcagcagcgccagcagattacagcctcgcccaagtggcgtcacaatcgatgagtctttcctaaccgaagacaagagcactcagaatcgcaaactgttacaaaaaaggcgtaccttggaactgcccgccgcaccactctcccattgccaggctcccgtgctaggaggtaccggtaagctgccaactcagggcgcaccccctgccggacccggacaccgatttcacccggggactaaggccgccgctcatcaacgtgaaaaaatccgggccctggagcctttaaaggctaagctcgtgacagtgaacgaggactgcaatgaacgaattctggcaatgagagcagaggagaagtacgagatttctttactcaaaaaagagaaaatgaatttactcaagttgatcgacaagaaaaatgaggaaaagatttccctgcaaagcgaggtcactaaactgaggaagaacctggcagaggaatacttgcactacctcagcgaacgcgatgcctgcaagatcctgattgcagatttgaacgagctgagatatcagcgggaggatatgtcactggcacaatcacccggcatctggggtgaagatcctgtaaagctcaccctggcactaaagatgacacgtcaagacttgactagaacccagatggaacttaataacatgaaggccaattttggtgatgttgtaccccgtcgtgattttgagatgcaggagaagacgaacaaagacctgcaggagcagctcgataccctccgggcttcgtacgaggaggtgcgaaaggaacatgaaattttgatgcaactgcatatgtcaaccctaaaagagagagaccagtttttttccgaactgcaggagattcagcggacatcgacaccaagacctgactggacaaagtgcaaggacgtggtagcgggtggaccagaaagatggcagatgctggcagagggcaaaaactccgaccagctcgtagacgtactgttagaggagatcgggtccggactactccgcgagaaagatttcttccccggactgggctatggggaggctatccccgcttttttgcgcttcgatggtctcgtagagaacaaaaagccaagcaaaaaggacgtagtgaacctgttgaaggatgcctggaaagagcgcctggccgaggagcagaaagagactttcccagacttttttttcaacttcctcgaacacaggtttggtcctagcgacgccatggcgtgggcctataccatctttgaaaacataaaaatttttcatagcaacgaggtgatgagccaattttacgccgtgcttatgggcaagcggtctgaaaacgtgtacgtcactcaaaaggaaaccgtcgctcagctgctgaaagagatgacgaatgcagacagccaaaacgaagggctgctgactatggagcaattcaacacagttctcaagtctacgttccccttgaagaccgaagaacagatccaggaactgatggaggctggagggtggcatccgtcgagctccaatgctgacctgttaaattacagaagtttgtttatggaagatgaagaaggtcagtctgagccgttcgttcagaaactctgggagcagtatatggatgaaaaggacgagtatcttcagcagctcaagcaggagctgggaatcgaacttcacgaagaggttactctaccaaaactgagaggggggctgatgacaattgacccctccctggataagcagacagttaatacctatatgtcccaggccttccagttgcccgaaagtgagatgccagaggagggcgatgaaaaggaagaggcggttgtagagatcctccagacagctcttgaacgtctgcaggtgatcgacattcgccgggtcgggccacgggaaccagagcctgcctcttag

SEQ ID NO: 25360 - DNA, 474 bp, Artificial Sequence
  Description of Artificial Sequence: Synthetic coding sequence
atggccaccagcgcccccctgcggagcctggaggaggaggtgacctgttcaatatgtctcgattacctgcgggatcctgtaacaattgactgcggacacgtgttctgtagatcctgtacgaccgacgtgaggcctatctcaggatctaggcctgtctgccctttgtgcaaaaagccgttcaaaaaagagaacattagaccagtgtggcagttagcaagtctcgtcgagaatatcgagagactgaaggttgacaagggtaggcagcctggggaggtcactagggaacaacaggatgcgaagctttgtgaacgccatcgagagaagctgcactattactgcgaagacgatggcaagctgctgtgtgtgatgtgtagagagagccgagagcataggccacacactgcagtgctcatggagaaggcagctcagccacaccgggagaagattctgaaccatcttagcactctgcgctag

SEQ ID NO: 25361 - DNA, 939 bp, Artificial Sequence
  Description of Artificial Sequence: Synthetic coding sequence
atggcccagccctacccccccgcccagtaccccccccccccccagaacgggattccagctgagtacgccccacccccccctcaccctacgcaggactattccggtcagactccagtgcctactgaacacggtatgacactctacacacctgcccagacccaccctgagcaaccaggttcagaggcctccacgcagcccattgccggaacccaaaccgtgccgcaaactgacgaagctgcccagaccgactcccaacccctgcacccttcagatcctactgaaaaacagcagcccaagagactccatgtgagtaacatccctttccgatttcgtgatccagatctgcgccagatgttcggtcagttcggcaagatcttggatgtcgagatcatattcaacgaacgaggaagcaaaggattcggctttgtgaccttcgaaacctcctccgacgcagatcgcgcccgggagaagctcaatggcaccattgtggagggacgcaagatagaagttaataatgctacagctagggtaatgaccaataaaaagaccggaaatccctacaccaacggatggaaactgaaccccgtcgtcggagcagtatacggacctgaattttacgccgtcactggattcccataccccacgactggcacggcagtagcttacagaggcgctcacctaagaggacgtggccgggcagtctataataccttcagggccgccccccccccccccccaattccaacctatggagcagttgtataccaggacggtttttatggagccgagatatacggcggatacgcggcctataggtacgcacagccagccgctgcagctgcggcatactccgattcttatgggagggtctacgccgcagccgatccctatcaccacacaatcggacctgccgccacctatagtatcggtactatgtag

SEQ ID NO: 25362 - DNA, 300 bp, Artificial Sequence
  Description of Artificial Sequence: Synthetic coding sequence
atggccagcctgctgcaggaccagctgaccaccgaccaggacctgctccttatgcaggagggaatgcccatgcgcaaggttagaagcaaaagctggaaaaagctgcgttacttcagactccagaatgatggcatgactgtctggcacgctcggcaggcccgcgggagcgctaaaccaagttttagcattagtgatgttgagacaattaggaacggtcacgactctgagcttttgagatctctcgcagaagaacttcccctggaacagggattcacgatcgtgttccacggccgcaggtag

SEQ ID NO: 25363 - DNA, 1620 bp, Artificial Sequence
  Description of Artificial Sequence: Synthetic coding sequence
atggccaccagcgcccccctgcggagcctggaggaggaggtgacctgctcgatctgcctcgattatctccgagaccccgtgaccattgactgcggtcacgttttttgcagatcttgtaccaccgatgtccggcctatttcagggagtcggcctgtctgtccattgtgcaagaagcccttcaagaaagagaacatacgtccggtttggcagctagcgagcctcgtcgaaaacattgagcggctcaaggttgacaagggcagacagccaggagaggtgacccgggagcaacaggacgccaaattgtgcgagcggcacagggaaaagctgcattactattgcgaagacgatggtaaactgctctgcgtgatgtgccgcgagagccgcgaacataggcctcacactgcagtattgatggagaaagcagctcagccacatcgggagaaaatcctcaaccacctctctacgttgcggagggaccgggataaaatccaggggttccaggcaaagggtgaggccgacatcttagccgcgttgaagaaactgcaggaccagaggcaatatattgttgcagagtttgaacagggccaccagtttttacgggaaagagaggagcatttgttagaacagctcgcgaaattggagcaggagctgacagagggccgggagaaattcaaatcccgcggtgtgggggagctagcccgcctggccctggtgataagtgagttagaaggcaaagcccagcaaccagctgccgagctcatgcaggacacgagggacttcctcaataggtaccctcggaagaaattctgggttggtaaaccgatcgcccgggtggttaagaagaaaacaggcgagttctctgataagctcctgtctctgcagaggggcctgcgagagtttcaaggaaagctgctaagagacctcgagtacaagaccgtcagcgtgacattagacccccaaagtgctagtggctatttgcagttgtcagaggattggaaatgcgtgacctatacatcgttatacaaaagcgcatatctacatccccagcagttcgattgcgagcctggagtcctgggaagcaagggttttacttggggaaaggtgtattgggaggtagaagtggaaagagagggctggagtgaagacgaagaagagggcgatgaggaagaagagggggaagaagaggaagaagaagaggaagcaggctatggggatggttacgacgactgggagacagacgaggacgaggaaagcctcggtgatgaggaggaagaagaggaggaggaagaagaggaggttcttgagtcatgcatggtgggcgtagcgagagactcagtgaagagaaagggagatctctctttaagaccagaagacggcgtgtgggcactcaggcttagcagcagtggcatctgggctaacacctcgccagaggctgagttgttccccgccctgcgccctcggcgggttgggatcgccctggattacgaaggaggtaccgtaaccttcacaaatgcagagtcccaagagcttatctacaccttcacggcaacattcactcggaggttggtgccctttttgtggctgaaatggcccgggaccagattactacttagaccttag

SEQ ID NO: 25364 - DNA, 480 bp, Artificial Sequence
  Description of Artificial Sequence: Synthetic coding sequence
atggccaccagcgcccccctgcggagcctggaggaggaggtgacctgctccatttgtctcgactatctacgcgaccctgtaacaattgactgcggacacgtgttctgccgctcttgtacgacagatgtccgccccattagcggatccagacccgtatgtcccctttgtaaaaaaccattcaaaaaagaaaatattcgacctgtgtggcagctggaaaagatcctgaatcatctctccaccctgagaagggaccgcgacaaaatccaagggttccaagccaagggagaggcagatatcctagccgctctcaagaagctgcaggatcagcgccaatatatcgtggcggagttcgaacagggacaccagtttctgagagaaagagaggagcacctcctggaacagctagccaagcttgagcaggagctgactgaaggtagggaaaagtttaaatccaggggagtgggcgaactggctagatag

SEQ ID NO: 25365 - DNA, 579 bp, Artificial Sequence
  Description of Artificial Sequence: Synthetic coding sequence
atgggcaagggctgcaaggtggtggtgtgcggcctgctgagcgtgggaaagactgccatactggaacagctgctgtatggaaaccatactattggcatggaggattgcgagacgatggaggatgtctacatggcgtcagtcgaaacggaccggggggtgaaggaacaactgcacctgtacgacacaagaggcctgcaggaaggagtcgaactgcctaagcattacttttcatttgcggacgggtttgtcctggtgtacagcgtcaacaacctcgagagcttccagagagttgagcttctgaagaaggagatagataagtttaaagacaagaaagaagtggcgatagtggtcctgggcaataaaatcgatctgagcgagcaaagacaggtggacgcggaagtcgctcagcaatgggcaaagtccgaaaaggtgcggttatgggaggtgaccgttacagaccgcaaaactcttatcgagccattcactctgctggctagtaagttgagccagccccagtctaagtccagtttccctctccctgggaggaagaacaaaggcaactccaatagcgagaactag

SEQ ID NO: 25366 - DNA, 309 bp, Artificial Sequence
  Description of Artificial Sequence: Synthetic coding sequence
atgcacaaccggagccagggcttcttcttcagcagctgccacccccagaaccacgttagctatggatgccagtctccgagcttcattttttgcagatgccagagcctgaactttgtttcccgtacttgttaccctctctcctacttctcctatgggaatcaaactattggatctatatctaacagcttcagatctctaaattacgtatctcacagtttccagcctatctcattcatgcatagcagcttccagcccgcttgttcagattttgtcggatggcagagtcccttcctgaggcggacatgttag

SEQ ID NO: 25367 - DNA, 723 bp, Artificial Sequence
  Description of Artificial Sequence: Synthetic coding sequence
atggacctggtgcggctgggcctggagcggggcgagaccgccaaggaggccttagatgttattgtcagcctgttggaagaacacggccagggcggtaattactttgaggatgccaatagttgccatagcttccagtccgcctacctaattgtggaccgagacgaggcctgggtgctcgagaccattggcaagtattgggcggcagaaaaagtcactgaaagtataactgtccagaccatgatgaataccctccgagataaggctagcggggtttgtattgattccgagttctttctgactaccgccagtggtgttagcgtactgcctcagaaccgctcatccccttgcatccactactttacaggaacacccgatccatcaaggtctatattcaagccctttatcttcgtagacgatgtgaagctggtcccaaaaacccagagcccctgcttcggggatgatgaccctgctaagaaagagcctaggttccaggagaagccagaccggcgacacgagttatacaaagctcatgagtgggcccgggctatcatagagtctgaccaggaacaggggagaaaactgcggagcactatgttggagctcgagaagcagggcttggaagccatggaggaaatcctcacttcttcagagcccctggacccggccgaggtaggtgatttgttctatgactgtgtggataccgaaatcaaattcttcaagtag

SEQ ID NO: 25368 - DNA, 900 bp, Artificial Sequence
  Description of Artificial Sequence: Synthetic coding sequence
tgacgggaggaggacatctaccagttcgcctactgctacccctacacttacacaaggttccaacattatctggattctttgcagaagaggaatatggactacttttttagagaacagcttgggcagtcggtgcaacagcgcaagctcgaccttctcacaattacatcgcctgataacctgcgggagggcgccgaacagaaggtagttttcatcacaggaagagtacatccgggtgagacgccatctagcttcgtctgtcagggaatcatcgattttttggtctcacagcatcccatcgcctgtgtgctgcgggaatatctggtattcaaaatcgcccccatgcttaatcctgatggggtgtatctcggcaactacaggtgctctctcatgggctttgacctgaataggcattggctcgacccttccccatgggtccaccctacactccatggcgtgaagcagctgatagtgcaaatgtacaatgatcctaaaacaagcctcgagttttacatcgatatacatgctcattccacaatgatgaacgggtttatgtatggtaatatttttgaggacgaggagagattccagcgccaagccatttttccaaagctgttatgtcagaatgcagaggatttctcgtactcaagcacgtcattcaacagggatgccgtcaaagctggaaccggacgcaggttcctaggaggcctccttgatcatacttcctactgttatactctcgaagtcagcttctattcctacatcataagtggcactaccgcagctgtcccatatactgaggaagcatgtatcctctccccccatcctgctttgggacagcctagctccagccgtgaatacccctctctaacagggcaggagctgggcccgcagcttaggtag

SEQ ID NO: 25369 - DNA, 1041 bp, Artificial Sequence
  Description of Artificial Sequence: Synthetic coding sequence
atggccgccgccgagcccgccagcagcggccagcaggcccccgccggacagggacagggacagaggccaccaccccaacccccacaggcccaggcgccccagccacccccaccccctcaactcggaggggcgggcgggggatcttcacggcatgagaagtcactaggacttttgacaactaaattcgtgtccctactacaagaagctaaggacggggtgctggacctgaaggccgctgccgatacactcgcagtccggcagaagagacgcatctacgacattaccaatgtgttggaggggatcgacctcatagagaaaaaaagcaaaaactcaatacaatggaagggagtaggggcaggctgcaacacaaaggaggtgattgaccgactgcggtacctcaaggccgagattgaggaccttgagctcaaagaacgtgagctcgatcagcagaagttatggctgcaacagtctatcaaaaacgtcatggatgatagtatcaacaataggttttcatacgtgactcatgaggacatttgcaactgtttcaacggcgacacccttctggcaatccaagctccctctggtactcagctggaagtgccaataccggagatgggccagaacgggcagaagaagtaccaaatcaatctcaagtcccacagcggacctatacatgtccttctgatcaataaggagagctcaagcagtaagcccgtcgtcttccctgttcccccacctgacgatttgacccagcccagctcacagtctctgacaccagtcactccccaaaaaagctccatggcgactcagaatctgcctgaacagcatgtgagtgaaaggtcgcaagcactgcagcagacctccgccacagatatctcatcagccgggtccattagcggagatatcatcgatgagctgatgtcatcggacgtcttccctcttctgagactatcaccgacacccgcagatgactataactttaatctggacgataacgagggggtatgtgatctgtttgatgtccagatcctgaactattag

SEQ ID NO: 25370 - DNA, 396 bp, Artificial Sequence
  Description of Artificial Sequence: Synthetic coding sequence
atgagcaagcggtacctgcagaaggccaccaagggcaagctgctgatcatcatttttatcgtgacactctgggggaaagtggtcagctctgcaaaccatcataaagctcatcacgtgaagacgggaacatgcgaagtcgtcgctttgcaccgttgctgcaacaaaaacaagatcgaggaacgatcccagaccgtgaagtgttcatgtttcccaggccaagtcgccggcaccacccgtgcagctccttcttgcgtggacgctagtatcgtggaacaaaagtggtggtgccatatgcagccatgcttggagggtgaagaatgtaaagtcctccccgaccgcaaggggtggagctgttcatcggggaataaagttaagacaacaagggtcacgcactag

SEQ ID NO: 25371 - DNA, 306 bp, Artificial Sequence
  Description of Artificial Sequence: Synthetic coding sequence
atgcccttcttcggcaacaccttcagccccaagaagacccccccccggaagtccgccagtttatccaatctgcacagtcttgacagatctaccagagaggtcgaactcgggctagagtatgggtcacctacaatgaacttggctggacagtccttgaaattcgagaatggtcaatggatcgcagagaccggtgtgtcaggcggtgtcgacaggcgagaggtacaacggctgcgcagacgcaatcagcagttggaggaagagaataatctcctgcggcttaaagtggacatccttctggacatgtag

SEQ ID NO: 25372 - DNA, 393 bp, Artificial Sequence
  Description of Artificial Sequence: Synthetic coding sequence
atggacatcagcaagggcctgcccggcatgcagggcggcctgcacatctggattagcgagaaccgcaaaatggttcccgttcctgagggcgcctacggcaatttttttgaggaacattgctatgtgatactacacgtcccacagagccctaaggccactcagggtgcgagcagtgacctgcactactgggttgggaaacaagctggcgccgaagctcaaggggcagccgaagcttttcagcagagactccaagacgagcttggcggccagactgtgctccacagggaggctcagggccacgagtccgactgcttttgtagttacttcaggccaggcatcatttaccggaagggcggattagcatccgatttgaagcacgtggagactaattag

SEQ ID NO: 25373 - DNA, 51 bp, Artificial Sequence
  Description of Artificial Sequence: Synthetic coding sequence
atgtgcaccagcgagaccttccaggccctggacaccttcgaggccaggtag

SEQ ID NO: 25374 - DNA, 5553 bp, Artificial Sequence
  Description of Artificial Sequence: Synthetic coding sequence
atggagagcaacttcaaccaggagggcgtgccccggcccagctacgtattttcagcggacccaattgcccggcctagtgagatcaacttcgatggaataaaactggatctgtctcacgagttttccctcgtggcgcccaatacagaagctaattcatttgaaagcaaggattacctgcaagtttgcctgaggatccggccgttcacacagagcgaaaaggaactggaatccgagggttgcgtccacatccttgacagccaaaccgtcgtactcaaggaacctcagtgcatcttaggcaggctgtcagagaaatcctcaggacagatggcacagaaattctcattttctaaagtattcggcccagccacaacccagaaagagtttttccaggggtgtatcatgcaaccagtgaaggacttgttgaaaggtcagtcccgcctaatctttacctacgggctgactaattccggaaagacctatacgtttcagggaaccgaagagaatattgggattctccccaggaccctcaatgtcctgttcgatagcttgcaagaacgactgtacacaaagatgaatctgaagccacaccgtagcagagagtatctgcggctatcctctgagcaagagaaagaggagatagctagcaaatctgccctgctccggcagataaaggaggtcaccgttcataatgattccgacgatacgctctacgggtccctgaccaactcgctgaatatctccgaatttgaagaatccatcaaagattacgagcaggcgaatctgaacatggctaactctattaaattcagcgtgtgggtgtctttttttgagatatataacgaatacatttacgacctgtttgtgccagtgtcttccaagttccaaaagagaaaaatgctgagactgtcccaggacgtcaaaggctacagcttcattaaggacctccagtggattcaagtatccgattccaaggaggcatatcgcctgcttaagctcggcataaaacaccaaagcgttgcattcactaagcttaacaatgctagtagccggtcccattctatcttcacagttaagatcttacaaattgaggattctgagatgtccagggtgatccgcgttagtgagctgagcctctgcgaccttgcaggatccgagagaaccatgaaaacccaaaatgagggggagaggctgcgggaaacaggaaatattaatacgtctctgttaactcttggcaagtgcataaatgtgctaaagaatagtgagaagtctaaattccagcaacacgtgccgttccgcgaaagcaagctgacccactactttcagtcgtttttcaatggtaaggggaagatatgcatgatcgtcaacatctctcagtgctatctcgcttatgatgagaccctaaatgttctaaagttcagtgcaatcgctcaaaaggtctgtgtgcccgacaccctaaactcatcccaggagaaactcttcggtccggtgaaatcctcacaggacgtcagtctggattctaactccaactccaaaatcctgaacgttaaaagggctaccataagctgggaaaatagcctggaggatctgatggaagacgaagatctggtggaggagcttgagaatgctgaggagactcagaatgtggaaacaaagctgctggatgaggatctcgataaaacacttgaggaaaataaggccttcatatcccatgaggagaaacgcaaactgttggaccttatagaggatctgaaaaaaaagctcattaacgagaagaaggagaagcttaccctggaatttaaaatccgggaagaagtaactcaagaattcacccagtattgggctcagcgcgaagccgacttcaaagaaaccttgctgcaggagagggagatactcgaggaaaatgctgaacgaaggttagctatatttaaggacctagttggtaagtgtgatactagagaggaagcagccaaggacatttgcgcaaccaaggtagagacagaagagacacacaactacgtcggatttgaggacattatcgatagcttacaagataacgtggcagatatcaaaaagcaggcggaaatagcacatctgtatatagcctctctgccagatccacaggaggctaccgcctgtttagaactgaaattcaatcagatcaaggcggagttggccaagacgaaaggcgaattgattaagacaaaggaggagttgaagaaacgggagaatgaaagcgattcccttatccaagaactggagacttcaaacaagaaaatcataacgcagaatcagcgaattaaggaactcattaatattatcgaccagaaggaggatactataaatgagtttcagaatctgaagagtcacatggagaatacatttaagtgcaacgacaaggctgacacctcttctctcatcatcaacaataagctgatttgtaacgaaacagtggaagtgccaaaagactctaagtctaaaatttgcagtgaaaggaagcgagttaacgaaaatgaacttcagcaagacgaacctccggctaagaagggcacgacatccgcggcttcaagtaggcggctcaggaagctgatctccaagccggttaacagaaccagacagactgaggggcacagcctggtttcaattcacgtttcaagtgccatcaccgaggaccaaaagaagtccgaggaggtgcgaccaaacattgctgagattgaggatattagagtcctgcaggagaacaatgagggtctccgggcattcctgttaacaatcgaaaatgaactaaaaaacgaaaaggaggagaaagctgagctgaataagcagattgtgcatttccaacaggagttgagcttgtcagaaaaaaaaaatcttacactgagcaaggaggttcagcagattcaatcgaactacgacatcgccatcgccgagctgcatgttcagaaatcgaagaaccaggagcaggaggaaaagatcatgaagttatccaatgaaattgaaacagccactcgctcaatcacaaacaacgtgtcacaaattaaactaatgcatacaaaaatcgacgagctcaggaccctggactctgtgagccaaatcagcaacattgacctgttaaaccttcgggacctgtctaatggtagtgaggaagataacttgccgaacacccaattggacctgctggggaatgactacctggtgagcaagcaggtgaaggagtaccgtatccaggaacctaacagagaaaacagctttcatagctctatcgaagccatatgggaggagtgcaaggagattgtcaaggcaagctcaaagaaaagccaccagatcgaagagcttgaacagcagatcgagaagttacaggccgaggtgaaaggctataaagacgaaaataaccgtctcaaagaaaaagagcacaaaaatcaagatgacctcttaaaggagaaagagacattaattcaacaacttaaagaggaacttcaggagaagaacgtgacattggacgttcagatccagcacgtagttgaggggaagcgcgccctctcagaactcacacagggtgtcacatgttacaaagccaaaattaaagagttggagacaatcctggagactcagaaagtagaatgctcgcatagcgcaaaactagagcaagatattctagagaaggagtccatcatcctgaaactggagcgtaacctgaaagagtttcaggagcacctgcaagatagtgtaaaaaataccaaagacctcaatgtgaaggagctgaaactgaaggaagagatcacgcaactgaccaataatctgcaggatatgaaacacctgcttcagctcaaagaggaggaggaagagacaaacagacaagagaccgagaaactgaaggaagagctcagtgcaagcagcgcccggacccagaatcttaaggctgatttacaaagaaaagaagaggactatgccgacttgaaagagaagcttaccgacgcaaaaaaacagattaagcaggtgcagaaggaggtcagtgtaatgagggatgaagacaaattgctgcgaataaagatcaacgaactcgaaaaaaaaaagaaccagtgtagccaagagctcgacatgaaacaaagaacaattcaacagctgaaggaacagctgaataaccaaaaggtggaagaagctatccaacagtacgagcgagcctgtaaggacttgaacgtgaaagaaaagatcattgaggacatgcggatgaccctggaagagcaggaacaaacacaggtggagcaggaccaggtgcttgaagcaaaattggaagaagtggaacggcttgcgaccgaactcgagaaatggaaggaaaagtgtaacgatttggagactaagaataaccaacgatctaataaagagcatgagaataataccgacgtcctgggaaaactcactaacctccaggacgagctgcaagagtcagagcagaagtacaacgctgaccgaaaaaaatggctcgaggagaaaatgatgctgataacccaggcgaaagaggctgaaaacatccgtaacaaggagatgaaaaagtatgcggaggaccgagagcgattcttcaagcagcagaacgaaatggagattctcacagcacagctgacagagaaggattcagacctacagaagtggcgggaagaacgggaccagctggtggctgccctagagatccagctcaaagctctaatctcctcaaatgtgcagaaggacaacgaaatcgagcagctgaagcgtattatatctgaaactagtaagattgagacacagattatggatattaagcctaaaagaatatcctctgctgatcctgataaacttcagaccgagccgttgagtacgtcatttgaaatatcgagaaacaagattgaggacgggtctgtggtcctggacagttgtgaggtgtccactgaaaatgatcagagcaccagatttccaaagcccgagcttgagattcaatttacaccattgcaacccaacaagatggcggtcaaacaccccgggtgcacaacgcctgtgaccgtcaaaataccaaaagcccgtaagcgaaaatcgaacgaaatggaggaggacttggtcaagtgtgaaaataagaaaaatgccacgccccggaccaatttaaagtttcccatttctgacgatcgaaattcttcagtgaagaaagaacagaaggtggctatacggccatccagcaagaaaacatatagcttgcgctcccaggcttctataattggggtgaatctggccaccaaaaagaaagaaggtacgttgcagaagttcggcgactttctgcagcacagcccctccattctacaatccaaagcaaagaaaattattgaaacaatgtctagctccaaattaagtaatgtggaggctagtaaggaaaatgtgagccaaccaaagagggccaagcggaaactgtacacttccgagatctcctcccccatcgacatcagcggccaggttattctgatggatcaaaaaatgaaggaatcagaccaccagatcataaagaggcgtttaaggacgaagacagccaaatag

SEQ ID NO: 25375 - DNA, 1527 bp, Artificial Sequence
  Description of Artificial Sequence: Synthetic coding sequence
atgcggtgccccaagagcgccgtgaccatgcggaacgaggagctgttgctttccaatggcaccgctaataaaatgaatggcgcactggatcatagcgatcagcctgaccccgatgcgattaagatgtttgtgggacagatccccagaagttggtctgaaaaggagctcaaggagttgttcgagccatacggagcagtctatcagattaatgttttgagagataggtcacagaatccacctcagagcaaaggatgctgttttgtcacgttctatactcgaaaagcagccctcgaggcacagaatgccctacacaatataaagactttgcccggcatgcaccacccaatccagatgaagcccgcagactccgaaaaatcaaacgcagtggaggaccgcaaacttttcattggcatggtgtctaagaagtgcaatgagaacgacatacgagtgatgttttcgcccttcggtcaaatcgaggaatgccgcattcttcgaggccctgacggcctctctaggggatgtgcattcgtcactttttccactagggccatggcgcaaaacgcaatcaaagctatgcatcaatctcagaccatggaggggtgctcttctcccattgtagtgaagtttgctgatactcaaaaagataaggagcagcggagactgcagcagcagctcgcccagcagatgcaacaactgaacactgcaacctggggcaatttgactggactgggcgggctcaccccgcaatacctcgcacttctccagcaagcaacaagttcaagtaacctgggtgccttttccggcatacagcaaatggccggcatgaacgctctgcagctccagaatttggctaccttagccgccgccgccgccgcggcccaaactagcgctaccagcacaaatgctaatccgttaagcaccacctcatccgctcttggggctctgacaagccctgtggccgcctcaactcctaattctaccgcgggggccgccatgaatagcctgactagtcttggcactctgcaagggctggctggtgctactgtggggttaaataatattaatgcactcgcaggtatggccgccctcaacggcggcctgggggcaaccggtctcacgaacgggaccgcggggactatggatgctttgacacaggcctatagcggcatccaacagtacgccgccgccgcactgccgactctctatagtcagagcctgcttcagcaacagagcgccgcaggaagtcagaaagagggcccagaaggcgcgaacctgtttatataccaccttccccaagagtttggcgaccaggacattcttcagatgtttatgccattcgggaatgtgatctccgctaaggtcttcattgacaagcagaccaatctttccaaatgcttcggatttgtgagttacgacaacccggtgagcgcacaggctgcaatccaggcaatgaacgggttccagattgggatgaagcggctgaaagtgcagctaaaacgatctaagaacgattccaaaccctattag

SEQ ID NO: 25376 - DNA, 975 bp, Artificial Sequence
  Description of Artificial Sequence: Synthetic coding sequence
atgttcatcggcggcctgagctggcagaccagccccgacagcctgcgagattacttttccaaatttggcgagattagagaatgcatggtaatgagggatccgaccactaagcgcagcagaggctttggtttcgtcacttttgccgacccagcatctgtggataaagtgctgggccaacctcatcatgaactggacagtaaaaccattgatcctaaagtggcgttccctagaagggcccagccgaagatggttacgagaaccaaaaaaatcttcgtaggagggttgtccgccaacaccgtagttgaagatgtcaagcagtacttcgaacagtttgggaaagtggaagatgcaatgttgatgttcgataaaacaaccaatcgccatcgtggctttggatttgtgacttttgaaaatgaagacgtggtagagaaggtgtgcgagattcatttccatgagataaataataagatggtggaatgtaagaaagctcagcccaaagaagtgatgtttccaccaggtactaggggaagagcacgaggccttccctacactatggatgcgtttatgttaggtatgggaatgttgggctacccaaacttcgtcgccacatacggaagaggataccccggctttgcaccctcttacggctatcagtttcctggcttccccgccgcagcgtacgggcctgtggccgctgccgcggtggctgctgccaggggatcagtgttgaatagttacagcgctcagcctaatttcggcgctccagccagcccggccggcagcaaccctgcccggcccggcggcttccctggagccaatagccctggccctgtggccgatctctacggacccgcatctcaggattccggagtcgggaattatatttccgccgccagcccccagccagggagtgggtttggccatggcatcgccggccctctgatcgcaactgctttcacgaacggctaccactag

SEQ ID NO: 25377 - DNA, 333 bp, Artificial Sequence
  Description of Artificial Sequence: Synthetic coding sequence
tgacacaagccctgctacggcgccctgttcggcccccggggcgtgaatattgggggggtcgggtcgtacttatacaatccaccgaccccctcacccggatgtaccacgcctctgtccccctcaagcttctcaccaccaaggcccaggactggcctgccccaagggaagaagacggagaaggtgatgagtctgggcagaaattggcaccggccctgcttacggtgtcagcgttgccataagaccctaactgccggatctcatgctgagcatgacggtgtgccatactgccacgtgccctgttatggatatctttttggacctaaagccctttag

SEQ ID NO: 25378 - DNA, 411 bp, Artificial Sequence
  Description of Artificial Sequence: Synthetic coding sequence
atgaccgaggacagccagcggaacttccggagcgtgtactacgagaaggttggattccgtggcgtggaagagaaaaaatccctcgaaattttgttaaaagacgacagactagacacagagaaactgtgtacattctcgcagaggttccctctgcccagtatgtaccgagcgttggtgtggaaagtccttttaggcatcctgccgccccatcatgagagtcatgctaaggtcatgatgtataggaaggagcagtacctcgatgttttgcatgctctgaaagtggtgagattcgtgtcggatgctaccccacaggctgaggtgtatttaagaatgtaccaactggaatcaggcaagctgccaagatccccctcttttccattagaaccggatgatgaagtgttcctcgcatag

SEQ ID NO: 25379 - DNA, 1686 bp, Artificial Sequence
  Description of Artificial Sequence: Synthetic coding sequence
atggccagccagttctgcctgcccgagagcccctgcctgagccccccacccttgagcccactggcactggcacctagctccgccattagagaccaaagaactgccaccaagtgggtggcaatgattccacagaaaaatcagacggcctctggcgactcattagacgtgcgcgtgccttccaaaccctgcctgatgaaacagaaaaagagtccttgcctgtgggaaatacagaaattgcaagaacagagagagaagcgcaggcggctgcagcaggaaattagggcacggagagcactagacgtgaatacccggaatccaaactacgaaattatgcatatgatcgaagagtatcgcagacacctggattctagtaagataagcgttcttgagcccccacaggagcatcgcatctgtgtatgcgtgcggaagcggccattaaaccagcgggaaaccacactgaaagaccatgcatttgatgataaagctagtaatgagctggtgtaccaattcacagcacagcccctggtggagtcgatctttaggaaggggatggcaacttgtttcgcttacgggcagactggatctggtaagacttataccatgggcggagacttcagcggcaccgctcaggactgcagcaaggggatctatgctctcgtggcacaggatgtatttttactgctgaggaatagcacttacgagaagctggatctcaaggtgtatggcacattcttcgagatctacggtggcaaagtttatgacctgctgaactggaagaaaaagcttcaggttttagaggacgggaaccagcagatacaggtcgtgggcctccaggagaaagaagtgtgctgcgtcgaggaagtcttaaatttggtggagattggcaattcctgtcggacttcccgccaaactcctgtaaacgctcattcgtcccgttcccacgctgtcttccagatcattctcaaaagcggcagaatcatgcatggaaagttctcccttgtggatctagctgggaatgagcgaggcgctgatactaccaaggcttcgcgcaagcgtcagctcgaaggtgccgagatcaataagagcctattagcgcttaaggaatgcatcctggccctgggacagaacaagcctcataccccattcagggccagtaagttgactctggtgctgagggactcattcattggacagaactcttctacatgtatgatcgctaccatttcccctggaatgacctcttgtgagaatacattaaatacgctgaggtatgcaaaccgagtcaagaagctgaacgtggacgttcgaccataccaccgcggccactaccccattggtcacgaggcgccaaggatgctgaagtcacacattggaaatagcgaaatgtcgttgcagcgggatgagttcatcaagattccatatgttcagagcgaggaacagaaggaaatcgaggaggttgagacacttccgacgctgctgggcaaagataccacaatcagcggcaaaggtagtagccagtggctcgagaacatccaggaacgggcaggaggggtgcaccatgatatcgacttttgtatagcacgatcgctttccatcttggagcagaaaatcgacgcccttaccgaaatacagaagaaactgaaacttctgctggccgacctccacgtgaagagtaaagtggagtag

SEQ ID NO: 25380 - DNA, 375 bp, Artificial Sequence
  Description of Artificial Sequence: Synthetic coding sequence
tgaagcgcctgcatcggcaactgcagcaccgccctggaggagctgaccgatgatatgacagaggatttcttgccggtgctcagagaatatattttgtacagcgattctatgaagagtgttcttaaaaaacgagaccaggtgcaggcagaatatgaggcaaagctcgaagctgtggcattgcggaaagaagaccggcctaaggtgccagccgacgtcgagaaatgtcaggacagaatggaatgttttaacgccgacctgaaagctgacatggagcgatggcaaaataataaaaggcaggacttccgacagcttctgatgggtatggcagacaaaaatattcagtactatgagaaatccatcgccgatttgaagtag

SEQ ID NO: 25381 - DNA, 747 bp, Artificial Sequence
  Description of Artificial Sequence: Synthetic coding sequence
atggccaccagcgcccccctgcggagcctggaggaggaggtgacctgtagcatttgcctggattacctccgtgatcctgtgactattgactgcggacatgtgttctgtagatcttgcacaacggatgtgcggcccatctccggcagtcgccctgtgtgcccattgtgcaagaagccatttaagaaggaaaacattcggccagtttggcagctcgcctcattggtagaaaacatcgagcgcttaaaggtagacaaaggccgtcaacccggcgaagttactagggagcaacaggatgcaaagctgtgtgaaagacaccgagaaaagctgcactattattgtgaagacgacggtaaactgctctgtgttatgtgtagagagagccgcgagcaccgcccccacactgcagtgctcatggaaaaggcagcgcaacctcaccgagagaagatccttaatcacctgtcaactctgcgacgcgaccgcgacaaaatccaaggctttcaggcgaagggagaggcagatatcctcgctgccctgaaaaaactccaggaccagcgacagtacatcgttgccgaattcgaacagggccatcagtttctgcgcgagagagaggaacaccttctggagcaactcgccaaactggagcaggaactgaccgaagggcgagaaaagttcaagtcacggggcgtgggagaactggcgagactggccctggtgattagcgaactggagggcaaagcacaacaatag

SEQ ID NO: 25382 - DNA, 1125 bp, Artificial Sequence
  Description of Artificial Sequence: Synthetic coding sequence
atggacttcaacatgaagaagctggccagcgacgccggcatcttcttcacaagagctgtgcagttcacagaggaaaaattcggtcaggccgaaaagaccgagttagatgcccactttgagaacttgctcgcgagagccgactcaacgaagaactggactgagaagattttacggcagacagaagtcctcctgcagcccaacccctctgcacgtgttgaggaatttctctacgagaagttggaccggaaagttccttcacgtgtgacgaatggggaactgctggcccagtatatggccgacgccgcatcagaactaggtcctacaacgccttacgggaagactctcatcaaggtggctgaggctgaaaaacagctcggagccgctgaaagagatttcatccatactgcaagcatcagctttcttacccctctcagaaattttttggagggcgactggaagacaatctccaaagaacgacggctcctgcagaatcgccgcctggatttggatgcatgcaaggcacggttgaagaaggctaaggcagccgaagcgaaagcaacgctatggaatgatgaggttgataaagctgaacaggagctcagagtcgctcagactgaattcgatagacaagccgaggtaactcggctcctgctggaggggatttctagcacccatgtcaatcaccttcggtgtcttcacgaattcgtgaaatcccagacgacatattatgcacagtgctatcggcatatgcttgacctacagaaacaactaggaaggttccccggcacatttgtcggcactactgagcccgcttcaccccctctcagctccacctccccgacgactgcggctgccactatgcctgtggttccatccgtggccagtcttgcgccccctggcgaggccagcctctgcctggaggaggttgctcccccagcctcaggcactaggaaagcacgcgttctatacgattatgaagctgccgacagctccgaattagcgctgctcgccgatgagctgatcacagtgtattcccttcctggaatggatcccgactggttaatcggagagcgcgggaataaaaaaggtaaggtaccagtgacgtatctggagctgctgtcatag

SEQ ID NO: 25383 - DNA, 1188 bp, Artificial Sequence
  Description of Artificial Sequence: Synthetic coding sequence
atggccagcgccgccagcgtgaccagcctggccgacgaggtgaactgccctatttgccagggcaccctgcgggagcccgtgacaattgactgtggccacaatttctgcagagcctgcctgaccaggtattgtgagatacctggaccggacttggaggagagtccaacttgtccgctctgcaaagaacccttcagacctggatcttttcgacccaactggcagctggccaacgtggttgagaacattgaaaggctacagctggtttcgactcttggactgggcgaagaggatgtgtgccaagagcacggagaaaagatctacttcttttgcgaggacgatgaaatgcagctgtgcgttgtatgcagggaagccggcgaacatgctacccacactatgcggttcctggaggacgcagctgccccatacagggaacagatccacaagtgcctcaaatgcctcaggaaggagcgtgaggaaatccaagagatccagtcccgggagaataagaggatgcaagtgctgctgacacaagtgtctaccaaaaggcagcaggttatctccgagttcgcccatctgaggaaattcctcgaggagcagcagagtatcctgctggcccagttggaaagccaggatggagatatccttcggcagcgggatgaatttgacctgctggtggcaggagagatctgccggttcagcgcactgatcgaagaactggaggagaaaaatgaaagaccggccagagagcttttaactgatatccggtccacacttatccgttgcgaaacgaggaagtgtcgcaagcccgtggcggtttcccccgaattgggtcaacgtattcgcgattttccccagcaggccctgcctctgcaaagagagatgaagatgtttctcgaaaagttatgcttcgagcttgactacgaaccagctcacatctcattggaccctcagaccagccaccctaagttactcctgagtgaagatcaccaaagggcgcaattctcatataagtggcagaattctcccgataaccctcagcgcttcgaccgtgctacatgcgtcttagctcatacaggcattacaggcggccgccatacgtgggtttggatggctagagtgcccggcgatagcggctgctgtcaattctgctcaccaccctcggtcttgggaaccgaagtcgctgcctag

SEQ ID NO: 25384 - DNA, 1131 bp, Artificial Sequence
  Description of Artificial Sequence: Synthetic coding sequence
atggagaagaagaagatggtgacccagggcaaccaggagcccaccaccactccagatgcaatggtccagccctttacaacgatccccttcccaccgccacctcagaacgggattcctacggaatatggtgtgccccatacacaagactacgctggtcaaaccggtgagcacaatctgaccctgtacggcagtactcaggctcacggggagcaaagcagcaactccccaagtacacaaaatggatccttgacgactgaggggggcgcccaaacggacggccaacaaagtcagacccagagctccgagaattcggaatctaaaagcacccccaagagactacatgtttccaacatacctttccgtttcagggatcccgatttgaggcagatgtttggccaattcgggaaaatattagatgtagagatcatcttcaacgagcgcggaagtaaagggttcgggttcgtcacatttgaaaacagtgccgacgcggacagggcgcgagagaagttacacggaaccgtggtcgagggtaggaaaatcgaagttaataacgctacggctcgcgtcatgaccaataagaagatggtaactccctatgctaacggatggaaattgtcgccggtggtcggcgccgtctacgggcccgaactgtacgctgccagttccttccaggctgatgttagcctgggcaacgacgcagcggtgccgctaagcgggagaggcggaattaacacatatattccccttataatccccggattcccctatcctacagccgccacaacagcggctgccttccgcggagcacacttaaggggtagagggaggactgtgtatggagcagtccgcgccgtaccacctactgcgattcccgcctaccctggtgtagtctaccaggacggcttttatggagcagatctctatggcggttatgcggcctaccggtatgcacagcccgccacggctacggccgcaacagcagccgcagctgcggctgccgcctattcagatggctacggcagggtgtacaccgccgatccttaccacgccttggcacctgctgcttcctacggcgtaggggcggttgcctcattgtacagggggggttatagtcgctttgctccctattag

SEQ ID NO: 25385 - DNA, 1638 bp, Artificial Sequence
  Description of Artificial Sequence: Synthetic coding sequence
atgggcaccccctggcggccccccagccggcggccctggcggtggcctaccggctgcactagaaagacctgtggtcctccgacgtggtcacttgagcgtactcgatcatggctttctggcagggagcattccgtcttcacgggcgttgccatagtccattgcagttcaaaggaccaccagcttgatactagggttagcgaattttatgaggaaaccaaggtgaagttttccgagctgtccgaagaactgctttgggaatacgtgcactctggggagccaatggataaggcgggcggttatggcatccaggccctgggaggcatgttggtggaatcagtccacggcgatttcctcaatgtggtgggctttcctctcaatcacttctgcaaacaactggttaaactttactaccccccaagaccagaggacctgcgtcgcagcgtgaaacacgacagcattcctgctgcagacaccttcgaggacctgtctgacgtggagggaggaggttcggagcctacacagagggacgctggaagtcgcgacgaaaaagctgaagctggagaggctggtcaggcgacagccgaagccgagtgccaccggaccagggagacactgcctccattcccgaccagactgcttgaacttattgaaggatttatgctgtctaagggcttgctgacggcatgcaaattgaaagtcttcgatcttctgaaagacgaggcaccccagaaggccgccgacatcgcaagtaaagtggatgcttccgcttgcgggatggaacgtttgctggacatttgtgcggccatgggcttgctggaaaaaactgaacagggctattcgaacacagagacagctaatgtgtacctggcctctgacggagaatacagcctgcacggctttattatgcacaacaatgacctgacctggaacctcttcacttacttggagtttgccatcagggagggaacgaatcagcatcatcgagcactcgggaagaaggctgaggaccttttccaggatgcttattaccagtctcccgaaacccgactgagatttatgagggcgatgcacggtatgacgaaactgacagcgtgtcaggttgctaccgctttcaacttgtctagattctcgtcagcgtgcgatgtaggtggatgtacaggggctctggcgagggagctggccagagagtatcccagaatgcaagttaccgtgtttgacctgcccgatattattgagctcgcggcccatttccaacccccaggaccgcaggccgtccagatccatttcgctgcaggagatttttttcgtgaccctctgccgtcagccgaactgtacgttttgtgtaggatactgcacgactggcccgatgataaggtccacaaacttctctcccgagtcgcggagtcctgtaagccaggagccggtttgcttctcgtcgaaacactgttggacgaggagaagagggtggcacagcgggcgttgatgcagtccttgaacatgctcgttcagactgaagggaaagagcgctctctcggcgaataccagtgcctacttgaattacacggttttcaccaggttcaggtagtgcacctcgggggcgtcttagatgcgattttggccaccaaagtggcgccatag

SEQ ID NO: 25386 - DNA, 621 bp, Artificial Sequence
  Description of Artificial Sequence: Synthetic coding sequence
atgagccagaccagcctgaagcagaagaagaacgagcccggcatgcggtcctccaaagagtctctagaggccgaaaaaagaaaggagtcggacaagacgggagtccgattatctaatcagatgaggcgcgcagtaaatccgaaccatagtctaagatgctgtccatttcagggacattcctcttgcaggcggtgcttgtgtgctgccgagggcactgcattggggccatgccataccattcgcatctatattcacatgtgtctactgtgggagcagggacagcagatcactatgatgcgggttagccgcgatcacaccactgatagtggcggcgaaccacaaactacttggggaagccaagaatcaagccttaggaagactgactccaggggatatctcgttaggtctcagtggtccagaatctcacgaagtccatctaccaaggctcctagcattgatgagccgcgaagcagaaacacttcagctaaattgcccagcagttctactagttcgcggactccctcaacctctccaagccttcacgatagcagcccacctcccctgagcggccagcctagcttgcagccgccggcttcccctcagctacccaggagcctgtag

SEQ ID NO: 25387 - DNA, 414 bp, Artificial Sequence
  Description of Artificial Sequence: Synthetic coding sequence
atggcccccggcacccccaagagcctgctgctgagcgccagcatcaaaagggaaggcgagtcaccgactgcctcaccacactcttcggcaacagacgacctgcatcattccgacaggtaccagaccttcctgagggtgagggccaacaggcaaacgaggttaaacgcccggatcgggaagatgaaacggcggaagcaagacgaggggcaggtgtgcccactctgcaataggcccctggccggatccgagcaagaaatgtctaggcacgtggaacattgtcttagcaaaagagagggctcttgcatggctgaagacgacgctgtagacattgagcacgagaataacaacaggtttgaggaatatgagtggtgtggccagaagcggatccgggcgaccactctcctggagggctag

SEQ ID NO: 25388 - DNA, 570 bp, Artificial Sequence
  Description of Artificial Sequence: Synthetic coding sequence
atgatccccatctgccccgtggtgagcttcacctacgtgcccagcaggctgggcgaagatgcaaaaatggccactggaaattatttcgggtttacacacagcggagctgccgcagctgctgcagccgctcaatactcacagcaacccgcttctggggttgcgtattcccaccccaccacagtggcatcctataccgtccaccaggctcccgttgccgcacatacagtgactgcggcttacgcacccgccgctgccacggtcgctgtcgctcgacccgcacccgttgccgtagccgctgcagctaccgctgctgcatacgggggctaccccacagcacacaccgcaactgactatggatacacacagagacaacaggaggcacctcccccgcctccaccggctacaacccaaaattaccaggactcttactcttacgtacggtctaccgctcctgcagttgcctacgacagcaagcaatactatcagcaacccgccgccaccgaagctggttccagtagctcctgttgttgttgctgcaatagctgcttagatagggaccatctttattag

SEQ ID NO: 25389 - DNA, 387 bp, Artificial Sequence
  Description of Artificial Sequence: Synthetic coding sequence
atggacgccgacagcgacgtggccctggacatcctgatcaccaacgttgtgtgtgtattcaggacacggtgccacctcaacctgcggaagattgctctggaaggggctaacgttatctacaaaagggacgtcggcaaagttttgatgaaattgcggaaacctaggatcaccgctacaatttggtctagtggcaagattatctgcaccggcgcgacaagtgaagaggaggcgaagttcggcgcacgccgtctagcccgcagcctgcagaaactaggattccaagtgatcttcaccgattttaaagtggtgaacgtgttggctgtgtgtaatatgcctttcgaaattagattgcctgagttcaccaagaacaatcggcctcatgcttag

SEQ ID NO: 25390 - DNA, 381 bp, Artificial Sequence
  Description of Artificial Sequence: Synthetic coding sequence
atgtggaccgcccggggccccttccggcgggaccggtggagcagcgaagatgaagaagctgctggaccaagccaggccctctcccccctgttgtctgataccaggaaaatcgtttctgaaggagaattggatcagctcgcccaaattcggccacttattttcaacttccatgagcagaccgctattaaagattgcctgaagattcttgaggagaagaccgcagcatatgacattatgcaggaattcatggcactcgagttgaaaaatctgcccggcgaattcaactcgggaaatcagccctccaatagagagaaaaacagataccgcgacatacttcctttccaacatcatgggtacagtggaccgaacgaaaggacctag

SEQ ID NO: 25391 - DNA, 912 bp, Artificial Sequence
  Description of Artificial Sequence: Synthetic coding sequence
gaggacgagtacatccagagccacaacttcgacagcgccatgaaggtcacctcacaagggcagccatccccggtcgagccacgaggccccttctacttctgtagattgctcttggacgatctgggcatgaattcttgggaccggcgaaaaaattttcatttgctgaagaaaaacagtaagctgctgagggaacttaaaaatctcgattctcgccagtgtcgcgaaactcataaaatagcagtcttctatattgccgaaggccaggaggacaagtgctccatattgagcaacgaacggggctctcaggcctatgaggactttgttgccggtttgggctgggaggtggacctttctacacattgcgggtttatgggggggcttcagcgaaacggatccaccgggcagacagccccctactatgcaacttctaccgtcgaagtgatttttcacgtgtccacccggatgccctctgactccgacgattcactaactaaaaaacttagacacttaggtaatgacgaggtgcatatagtctggtctgaacattctagggattatcgacgcgggatcatccccaccgcctttggagatgtgagcattatcatctatcccatgaaaaaccatatgtttttcatagcaataactaagaagccggaagtgcctttctttggccctctttttgatggcgcgatagtgagcgggaagcttctcccaagtctggtctgcgctacctgtataaacgcaagtagggctgtcaaatgtctgatccctctgtatcagtccttctatgaagagagggctctttacctggaggctatcatccagaatcatcgcgaagtaatgaccttcgaagacttcgctgctcaagtcttcagtccctccccctcctacagcttatccggaaccgattag

SEQ ID NO: 25392 - DNA, 2883 bp, Artificial Sequence
  Description of Artificial Sequence: Synthetic coding sequence
atggaggtgcaggtgagccaggccagcctgggcttcgagctgacctctgtagagaaaagtctccgtgagtggagtcgtctgtcccgggaagtgattgcgtggttatgcccttcctctcctaacttcatcctgaactttccccccccaccatcggcgagcagcgtgagtatggtccagcttttttcctccccatttgggtaccagtcaccatcgggccactccgaggaagagagagagggcaatatgaagtcagctaagccacaggtgaatcattctcagcatggcgagtctcagagggcactttcgccacttcagtccactctctcctctgccgcctctcccagtcaggcttacgagacttatatcgagaatgggcttatctgtttgaagcataagatccggaatatagagaagaaaaaacttaaacttgaggactacaaagatcgcctgaagtccggggagcatctgaatccagatcagctggaagccgttgaaaagtatgaagaggtcttgcataacctggagtttgccaaggaattgcaaaagacatttagcggcctttccctcgatctgctaaaagcccagaaaaaggcccaaagacgggagcacatgctcaagctggaggctgagaagaaaaaactgcggacaatattacaagtgcagtacgtgctgcagaacctcacccaggaacatgtacagaaggatttcaaggggggcctgaatggagcggtgtacttgccatcgaaggaactggattatctcattaagttttccaagctcacctgtccagagagaaacgaatcactgtcagtggaagaccagatggaacagagcagtctatatttttgggatctgcttgaaggatccgagaaggccgtggtgggcaccacttacaagcatttgaaagatttgctgtctaaactgttaaattcaggatactttgagagtattcccgttcctaagaatgcaaaagagaaagaagtgccgctggaagaggagatgctgattcaatcagagaagaaaactcagctgtcaaagactgagagtgtcaaagaatcagaatcccttatggaattcgcgcagcccgagatacagcctcaggagttcctcaaccgacgctatatgaccgaagtggattactctaataaacagggagaggagcagccatgggaggccgactacgcccgcaagcctaacttgcctaagcggtgggacatgctcacggagccagacgggcaggagaaaaagcaagaatctttcaagtcctgggaagctagcgggaagcaccaggaggtctctaagccagctgtgtcactcgagcaacgaaagcaagacacatccaaattacgctctacattgcctgaggaacagaagaaacaagagatctcgaagagtaaacccagtccttcacagtggaagcaggatactccgaaaagcaaggccggctacgtccaagaagaacaaaagaagcaggagacaccaaagttgtggccagttcaactccagaaggagcaggatcccaaaaaacaaactcccaagagctggacacctagcatgcagtcggaacaaaacactaccaaatcttggaccaccccaatgtgcgaggagcaagacagcaagcaacctgagacacccaagtcctgggaaaataacgtggagagccagaagcactctttgaccagccagtcccagatttctcctaaaagttggggggttgcgaccgcatcattgatcccgaacgatcagttgttacctcggaaactgaatacagaacctaaggatgtgcccaagcccgtgcaccagcctgtcggatcaagttcgactctgcctaaagacccagtgttgcgtaaagagaagctgcaggatctgatgacacagatccaggggacctgcaactttatgcaggaatccgttctcgacttcgacaagccatcctcagcgatccctacatcacagcctccctccgcgacacccgggtcccccgtggcctctaaggagcagaacctgtccagtcagagcgactttctgcaggagccattgcaggctacaagcagtccggtgacgtgcagctctaacgcatgcttagtcaccacagaccaggccagctcggggagtgagactgagttcatgacttccgagactcctgaagcggccattccccctggaaagcaaccatcctcactggcctctcccaacccccctatggctaagggatccgagcagggctttcagtctcctcctgcaagctcatctagtgtcacaatcaacacagctcccttccaggccatgcaaacggttttcaacgtgaacgccccactgccccccaggaaggaacaggagatcaaagaatccccttatagtcctggctacaaccagtcgtttacaaccgcctccactcagaccccaccccagtgtcagctgccttccattcacgttgaacagacagtgcactctcaggagaccgcaaactaccatcctgacggtaccatccaggtgagcaacggaagtctcgcgttttaccctgcccagactaatgtcttccctagacctacacagccttttgttaactcgaggggctctgtccgtggatgtaccaggggcgggcgattaattaccaatagctatcgaagccctggtggctacaaaggattcgatacttatcgcggactgccttcaatcagcaacggcaactactcccagctccagtttcaggccagggagtatagcggggccccctattctcaacgcgataacttccagcagtgctacaaacgcggcggcacttcgggcggcccaagggcgaactcccgcgccaattgctttatcatgcgcaacagcctcctgcttattaagcaacagggcggcgtgattctgctccgctag

SEQ ID NO: 25393 - DNA, 1746 bp, Artificial Sequence
  Description of Artificial Sequence: Synthetic coding sequence
aacaacaacggcacctacgacggcatcgcctacttcgagtgcaaggaaaagcacggcatttttgcccctcctcaaaagatttctcacattcctgaaaattttgacgactatgtagacatcaatgaggacgaggattgctattctgatgagcgctaccagtgttataaccaggaacagaacgacaccgagggcccgaaggaccgagagaaagatgttagtgagtatttctatgagaaatctttacccagcgtgaacgacatcgaagcctctgtgaaccggtcgaggagcctcaagatcgagactgacaatgttcaagatataagcggcgttctggaagcgcacgtgcatcagcagagctcggtagactctcaaatctcttcaaaggaaaacaaagacctcatcagcgacgctactgaaaaagttagcatcgccgccgaagacgacactctagataacactttctctgaagaactggaaaagcaacagcagttcaccgaggaggaggataacctctatgccgaagcatcagagaagctttgcaccccattgttggatctacttacaagggagaagaaccagctcgaagctcaactaaagagtagtctgaacgaggagaagaagtctaagcagcaactggaaaaaatatctctgctcacagatagcctgctgaaggtcttcgtcaaggacacggtcaaccagctgcagcagataaagaagacgcgtgatgagaagatccaactgtccaaccaggagctgctgggtgacgaccagaaaaaagtgacaccgcaggatctctcacagaacgttgaggagcagtcgccaagcatctcaggctgtttcctcagttctgagctggaagacgaaaaagaggagatttcatcaccagacatgtgccctcgccctgagtcacccgtgttcggcgcaagcggccaggaggagctcgcgaagcgcctggctgaactggagcttagcagagagtttctgtcggccctcggcgacgaccaggattggttcgacgaggacttcggcctgtctagctcccataagatccagaagaacaaggccgaggaaaccattgtcccactgatggccgaaccaaaaagagtgactcagcagccctgtgaaactcttcttgctgtgccacatacggccgaggaggtggagatcttagtgcacaatgccgccgaagagctttggaagtggaaggagctcggtcatgacctgcattctatttcaattcccacaaagcttctgggctgcgcatcaaaaggactggatattgaatctactagtaagcgcgtgtacaaacaagcggtgtttgacctcactaaggaaattttcgaggagatattcgccgaagaccccaatcttaaccaacccgtgtggatgaagccatgcagaataaacagttcttattttcgacgcgtaaagaaccccaataatctcgatgaaatcaaatctttcatagcatcagaagtccttaagctcttcagcctgaaaaaagaacccaaccacaagaccgattggcagaagatgatgaaattcggccggaaaaagcgggatcgggtagatcatatcctggtacaggaactccatgaggaggaagcccagtgggttaattacgacgaggatgagttatgcgtaaaaatgcagctagcagacggcatttttgaaaccttaattaaagacaccatcgacgtgctgaatcagataagcgagaagcagggtcggatgctactggtttag

SEQ ID NO: 25394 - DNA, 345 bp, Artificial Sequence
  Description of Artificial Sequence: Synthetic coding sequence
atgtggagcctgaccgccagcgagggcgagagcaccaccgcccacttttttctgggcgctggcgacgaagggctgggtacccgtgggattggcatgagaccggaggaaagcgacagcgagctgctggaagacgaggaagacgaggtacccccagaaccccaaataattgtcggtatttgcgcaatgaccaagaagtccaaatcgaaaccaatgacacaaattctggagcgcctttgcaggttcgattatttgactgtggtcatactgggcgaggacgtaatactcaacgagccagtggagaattggcccagctgtcactgcttgatctcttttcattccaaatag

SEQ ID NO: 25395 - DNA, 918 bp, Artificial Sequence
  Description of Artificial Sequence: Synthetic coding sequence
atggaggccgagagcttcccctgcctgctgcggcccttcttcaaggagaggagctgtgcacttcgcccggctttccataccgctaagtgcgagaaactgcagaaggaaaaagaagagttggaacggaggtttgaagccgagatggccaggttacaagaggaacatggagaccagctccttagtattcggtgccaacaccaggagcaggttgaagacctgacagcctcacatgacgcagcactcctggagatggagaataaccacacagtggcgattaccatccttcaggacgaccacgaccataaggtccaggaactgatgagtacgcatgagttggagaagaaggagctggaggaaaattttgaaaaactccggttgtctttgcaggaccaggtggacaccttaacgtttcaatcccagagtttaagagatcgggctcgccgtttcgaggaagccctgcggaagaataccgaggagcagctggaaattgcactggctccataccagcacctggaggaggacatgaagagcctgaaacaggttcttgaaatgaagaaccaacagattcacgaacaggaaaaaaaaatcctggaacttgagaagcttgcggaaaagaacattatcttggaagaaaagatccaggtgcttcaacagcagaatgaagatcttaaggcaaggatcgaccaaaacaccgtggtgacccgccagctgagtgaggagaatgccaacctgcaggagtatgttgaaaaggaaacccaggagaaaaaacgcctgagtcggaccaacgaggaactgttatggaaactgcagacaggagatcccaccagtccaataaagctgtcgcccactagccccgtgtacagggggtctagcagcggccccagtagccccgctagagtgagcaccactcccagatag

SEQ ID NO: 25396 - DNA, 2319 bp, Artificial Sequence
  Description of Artificial Sequence: Synthetic coding sequence
atgcaggagctggaggagctgcggaagcagctgggcagcgtggccacaggatctactttgcagcaatcactggagcttaaacgtaagatgttgcgggataagcagaacaagaagaatagcggccaacaccttcccatctttccagcatgggtgtacgagcggccagctcttattggtgactttcttatcggcgcgggtatttccaccgacactgcactcccaattggaacactccccctggctagccaagaatccgcggtggtggaggacctgttgtacgtcttggtgggtgtcgacggacgctatgtgagtgctcagccactcgccggtagacaatctaggacctttctggtggatcctaacttagacctatccatacgagagcttgtgcaccgtattcttcccgtagccgcgagctatagcgcagtgacccgcttcatcgaagaaaagagttcttttgaatatggacaagtgaatcacgccctagccgctgctatgaggacgctggtcaaggagcaccttatactcgtgagccagttggagcagcttcatagacaaggattgctgtcactgcagaagttgtggttttatattcagcccgcgatgcgcactatggatatcctggccagcctggcaacaagcgtcgacaaaggcgagtgtctggggggaagcacactatccctactccacgacaggtcttttagttacaccggagatagccaggctcaggagctttgtttatacttaacaaaagctgcctccgccccatattttgaagtgcttgagaagtggatttacagaggaattatccacgatccatactctgaatttatggtggaggaacacgaactacgtaaggaaaggatccaggaggactacaacgacaagtactgggatcaacgctatactatcgtccaacagcagattccaagttttctccagaagatggctgacaaaatcctgtctacaggtaagtacctcaacgttgtgagggagtgcggtcacgacgtcacctgtcccgtggccaaagagattatctacacactgaaggagagggcctacgtcgagcagattgaaaaagcgtttaattatgcttctaaggtcctgttggactttctgatggaagagaaggaattagtagctcatctaaggtccatcaaacgctatttcctgatggaccagggcgatttttttgttcatttcatggacctggcagaggaggagctgaggaaacctgtggaagatattacgccccctaggctagaagctctcttagagctcgccctcaggatgagcactgccaatactgatccgtttaaagacgatctgaaaatcgatctcatgccacacgacctgattactcagttgctcagagtactggctatagagaccaaacaggaaaaggcaatggcgcacgcagacccaaccgagctcgctctgtccggcttggaggccttcagttttgactacattgtgaaatggccactgtccctcattataaatcgcaaggccctgacccgctatcagatgctgttcagacacatgttttactgtaagcacgttgaaaggcagctgtgctcagtctggatctccaataagacagctaagcagcacagtctgcattccgcccagtggtttgctggcgcttttacgctgagacaaaggatgctgaactttgtgcagaacattcagtattatatgatgtttgaggtcatggaacccacctggcacatcttggagaagaatctaaagtcagcctctaatatcgatgacgtcctgggacatcatacaggcttcctcgacacctgcctgaaagactgtatgctcacgaatccagagttgctgaaggtcttttctaagctgatgagcgtgtgcgtgatgttcaccaattgtatgcaaaaattcactcagtcaatgaaactcgacggtgagcttggcggacaaactcttgaacattccactgtcctggggctgcctgccggcgctgaggagcgggcacggaaagaactggcaagaaaacatctggccgagcacgcggacacggtgcagttggtgagtggtttcgaggccaccatcaataagtttgacaaaaacttttctgctcacctgttggatctgctggccaggctttcaatctacagcacaagcgactgcgaacatggaatggcctccgtgatctctcggctggatttcaacgggttttacacagagcggctggagcgtttgagcgccgagcggagccagaaggctacgcctcaagtgcccgtactccgggggcctcctgctcctgcacctcgcgttgctgtcaccgctcagtag

SEQ ID NO: 25397 - DNA, 1203 bp, Artificial Sequence
  Description of Artificial Sequence: Synthetic coding sequence
atggacttcaacatgaagaagctggccagcgacgccggcatcttcttcacacgcgccgtgcagtttaccgaggaaaagttcggacaggctgaaaaaaccgagttggacgcccacttcgagaatttgctcgcccgcgcggatagcacgaagaactggacagagaaaattctccgccagactgaggtgctcctacagcccaacccaagtgcccgcgtggaagaatttttgtacgaaaagctggatagaaaggtgccctcacgcgtcactaacggcgagctgctggcacaatatatggctgatgcagcatctgagctcggacccaccacgccctacggcaagacactgattaaggttgccgaggctgagaaacagttgggcgctgcagagcgagacttcatccacaccgcaagcatttcctttctgactccactgagaaattttctggaaggagactggaagaccatcagcaaggagagacgtctgcttcagaaccgcagacttgatctcgacgcatgtaaggcccgcctgaagaaagcaaaggcagctgaggcgaaagcgaccaccgtccccgattttcaggaaacccgcccaaggaattatatcttgtccgcctcagcctcagccctctggaatgacgaagtagacaaagctgagcaggaacttagggtggcccagactgagttcgatcggcaggctgaggtgactcgactgctcctggaaggaatcagctccacccacgtcaaccacctccgatgtctccatgagttcgtgaagagtcagacaacgtactatgctcagtgttaccgccatatgcttgatctgcagaaacagctagggtccagccagggagcaatctttcctgggacttttgtgggaaccactgaacccgcgagtcctccattatcaagcactagccccacaaccgctgcggccaccatgccagtcgtgccgagcgtcgccagtctggctcccccaggggaagcctccctgtgcctggaagaggttgcccctcctgcttcaggtactcggaaggctagggtgctatacgattacgaagccgccgattcgagcgaactcgcactcctggctgacgaacttatcaccgtgtattctctccccggaatggatcctgattggcttattggtgagcgaggtaacaaaaagggtaaggtgcccgtgacatatcttgagctgctaagctag

SEQ ID NO: 25398 - DNA, 1827 bp, Artificial Sequence
  Description of Artificial Sequence: Synthetic coding sequence
atgcccttctggcccatccggtgcctgaagcggagccggcggatgccgaggggtggggccggggagagagaaaaggttccagccaatcccgaggcactactgctcatggcatcttctcagcgcgacatggaggactgggtgcaggccattcggagagtgatctgggcaccacttggtggagggattttcgggcagcgactggaggagacagttcaccacgagcgtaaatatggaccacgattagcccctctgctggtggaacagtgcgtggactttattcgcgagcggggactgaccgaggaaggcctgttccgcatgccgggacaggcgaatctggttcgcgacctgcaggactcatttgattgtggggaaaagccccttttcgacagcacgactgacgtacataccgtggcttcactgcttaagttgtacctgagggagcttcctgagcccgttgtgccctttgcacgctacgaggattttctctcatgtgcccaactcctgacaaaagacgaaggcgaagggaccttagagctggctaagcaggtgagcaatttgcctcaagccaattacaacctgctcagatatatttgcaaatttctggacgaggtacaggcctattccaacgtgaacaagatgagtgtgcagaatctggcgacagtgtttgggcctaatatcttgaggccacaagtggaggatccagtgactattatggaaggcacttctctcgtccagcacctgatgacagttttgattagaaaacactctcaattgtttacggccccagtgccggaaggacctacatctcccaggggcggacttcagtgtgctgtgggctggggatccgaagaagtcacacgggattcccagggggaacccggcggtccaggactaccagcccataggacgtccagtctcgacggcgcagccgtagccgtgctgtccaggactgccccaaccggacctggatcacggtgtagcccgggcaagaaggtgcaaaccctccccagttggaaatcgtcctttagacagcctcgctctctgtctggttcgccaaaaggcggaggttcttctctggaggtgccgattataagctccggcggcaattggcttatgaatggactgtcgagtctcagaggccatagacgggcaagctctggagacagactcaaagactcaggaagcgtgcaaaggctttctacttacgacaatgtgcccgccccgggcctcgtgcctgggattccaagcgtggcttccatggcatggtccggggcgtcatcaagcgagtcaagtgtgggggggagcttgtccagctgcaccgcttgccgcgcaagtgactcaagtgcgcggtccagtctgcatacagactgggctcttgagcccagcccactgccttcaagcagtgaagatccgaaaagcctggacttggatcattccatggacgaagccggggccggagcctctaacagcgaaccctcagagccggatagtcccacacgcgaacacgccagaagatccgaagcactgcagggtctagttactgaactgcgcgccgagttgtgcagacagagaactgagtatgaacggagtgtgaagaggattgaggagggctccgcagatctgcggaagagaatgagccgtctcgaagaggagctcgatcaggaaaaaaagaaatacattatgctggagatcaagctgaggaattcagaacgcgcccgggaagacgccgagcgtcgcaaccagctgctgcagcgggagatggaggaattcttcagcacactgggctccctgacagttggggccaagggcgcaagagcccctaaatag

SEQ ID NO: 25399 - DNA, 708 bp, Artificial Sequence
  Description of Artificial Sequence: Synthetic coding sequence
atgttcagcgaggagtgcatcatggacgtgatcggctgcctggagtatgaccccgcactgtctcaacctcggaaacatcgagaatttctgaccaaaactgccaagtttaaagaagtaatacccatctctgatcccgagctcaagcaaaagattcaccagacatatagggtccagtacattcaggatatggttctcccaacgccctctgtgttcgaggagaacatgctgtccaccctccatagcttcatcttttttaataaagtagagatcgtcgggatgcttcaagaggatgagaagtttttgactgatctttttgcccagttgaccgatgaagccacggatgaggagaagaggcaggagctcgtgaactttctcaaagagttctgtgctttttcccaaacactgcaaccgcagaatcgggatgccttcttcaaaaccctttcaaacatgggaatcttgcccgcccttgaagtgattcttgggatggatgatactcaggtcagatctgcagctacagacatcttctcttacttggtcgagtataatccttctatggtgcgcgaattcgtgatgcaagaggctcagcagaacgatgacgtgagtaaaaaacttactgagcaaaaaatcacgtccaaggttaatatcatctgtacgaattcaaagtacctgtacatcggatcatacaactgcttctactatagcttctag

SEQ ID NO: 25400 - DNA, 3513 bp, Artificial Sequence
  Description of Artificial Sequence: Synthetic coding sequence
gtgtacaagggccggcacgtgaagaccggccagctggccgccatcaaggtaatggacgtaacagaagacgaggaggaggagataaaactcgagatcaacatgctgaagaaatactcacaccatcggaacatcgctacttactatggcgccttcataaagaagagccctcctgggcacgacgatcagctttggctcgtaatggagttttgtggtgccggcagcattactgacctcgtgaaaaacacgaagggaaacaccctgaaggaagactggatcgcctacatctctagggaaatcctgcggggcctggcccacttacatatccaccatgtgatccatagagatattaaaggacagaatgtccttctgacagagaatgctgaagtcaaactggtcgactttggtgtgagcgctcaactggacagaacggtcggtcgaaggaatacttttatcggaactccctattggatggcccctgaggtgatcgcctgtgacgaaaatcctgatgccacctacgattatcggtctgacctttggtcatgcggaatcaccgccatagagatggcggaaggagctccgcccctgtgtgacatgcaccctatgagagcattattcttaataccacgcaaccccccacctcgcctgaagtcaaaaaaatggtccaagaaattcttttcgtttatagaagggtgcctggtgaagaattatatgcagagacccagcactgagcaactgctgaagcatccctttatcagggaccagcctaatgaaagacaagtccggatacagctgaaggaccacatcgatcggacgaggaagaagaggggggagaaggatgagactgagtacgaatacagtggaagtgaggaggaagaggaggaagtccccgagcaagaaggggagccctcctccatcgtgaatgtgcctggtgagagcaccctccgacgcgatttcttgcgactccagcaggagaataaggaaaggtcggaagccctcaggcggcagcaactgctccaagaacagcagctgcgggagcaggaagagtataaacgccagctccttgctgagaggcagaaaaggattgagcaacaaaaagaacaaaggcgcagattagaagagcagcaacggagagaacgagaggccagaagacagcaggaacgggagcaaaggcgtcgcgaacaggaagaaaaacggagacttgaagagctcgaacggaggcggaaggaagaagaggagcggagacgcgctgaggaagagaagcggagggtggaaagagagcaagagtatataagacgtcaacttgaggaggagcagcgtcaccttgaggtgctccagcaacagctccttcaggagcaggcaatgctgctgcatgaccaccggcggcctcacccccagcacagccagcagcctcccccgccccagcaagagaggtctaagccttcctttcacgctccagaaccgaaggctcactatgagcccgccgaccgcgcccgcgaagtcgaagacaggttccgaaaaacgaaccacagttctcccgaagcccaatccaaacagaccgggagggtgctcgaaccaccagtgccttcgcgcagcgaatccttctcgaatggtaactcggagagtgtgcatccagccctgcagaggcctgctgagccgcaggtgcccgtccgaaccacttccaggtctcctgtactcagtcgccgcgattcccccctgcagggctcgggccagcagaattcacaggccggacagcggaattccacaagcattgagcctaggctcctttgggaacgtgtagaaaagctcgtccctagaccaggtagtggcagctcgtctggctcttctaacagcggctcccagcccggcagccaccctggaagccaaagcggctccggcgaacgctttagggtgcgaagcagcagcaaatctgaggggtcaccatcccagagactggagaatgccgtcaaaaagcctgaagacaaaaaggaagtgtttcgaccacttaagcctgcggacctcactgcattagccaaggagctccgtgcagtcgaggatgtccgaccaccacacaaggtcactgattatagctcctctagtgaagaatctggaaccaccgatgaggaagacgatgatgtggagcaagagggcgcagatgaatctacatcaggtccagaggacacccgagcggctagttcactgaatttaagcaacggcgagactgaatctgtcaaaaccatgatcgtgcatgacgacgtggaaagtgaacctgcaatgactcccagtaaagagggcacgttgattgttaggcaaacccagtccgcatcgagcaccctccagaaacataaatcgtccagcagcttcacgccatttatcgaccctaggctcctacagatcagcccatcttcagggaccactgtgacatctgtcgtggggttcagttgcgatggtatgaggcccgaagccatcagacaagaccccactagaaagggatccgttgtgaatgtgaacccgaccaacacaagaccacaatctgatactccggaaattcgcaagtacaagaagcggtttaattctgaaatcctgtgtgctgccctctggggggtgaacctgctcgtaggaaccgagtctggcctgatgctgctggatcggagcggccaggggaaggtgtatcccctcataaaccgacggcgttttcaacagatggacgttctcgaaggcctgaatgtgctcgtcactatatcaggcaagaaggataagcttcgcgtttattacctgtcttggctgagaaacaagattctccacaacgacccagaagtggagaagaagcaggggtggacaacagttggggatctggagggttgcgtgcattacaaagtggtcaaatatgaacgaatcaaattcctggtcatcgccctcaagagcagtgtagaagtgtatgcctgggcaccaaagccttatcacaagttcatggccttcaagagtttcggcgaactggtgcacaaacctctcctggtagacttaacggtggaggaagggcagcggttaaaagtaatctacggatcttgtgcaggatttcacgccgtggatgtggattcaggcagcgtatacgatatttacctgcctacccatattcagtgtagcatcaagccccatgctatcatcatcctgcctaacaccgatggcatggagctcctggtttgttacgaggacgagggcgtgtatgtgaatacatatggtagaatcacgaaggatgtcgtcctacagtggggcgagatgccaacaagtgttgcatatattcggtccaaccagaccatgggctggggggaaaaagcgatcgagatcaggagtgtggaaacaggccatttagacggcgtgttcatgcacaagcgggcccaacgactaaaattcctgtgtgagagaaatgacaaggttttctttgcttcggtcaggagcggaggtagctctcaggtgtacttcatgacattgggtcggacttccctcctctcttggtag

SEQ ID NO: 25401 - DNA, 1476 bp, Artificial Sequence
  Description of Artificial Sequence: Synthetic coding sequence
gtgatcatccaccgggtgctggagaagcaggaggtggaggtgttctacccagattttgggaacataggcatcgtccaaaaatcatcgctcagatttcttaagtgctgctacactaaactgcccgcgcaggccattccctgctccctcgcctgggtccgtccagttgaagaacactggacctcaaaagcgatcttgcagttccagaagttatgcgggttgaaaccactagtgggcgttgtggatgagtacgtggacggaatcctcaacatttttctctgcgacacctcttccaacgaagacgtgtactttcaccatgtccttcggactgaagggcatgccatcgtctgcagggaaaatatctcgagcaaaggattctccgaacttaacccactggcactgtacacaacaagcagtggcgggcccgaggacattgtactgacagaacttggctacccctcccagcagcattacttcaacgaggatcgcaaaatcagcccacaatccaaggagagtgaactgaggattttacaggacatcaacgacgagaagtctctctcacatctaaagtccgaaagcaaagaacccctaaaggactcagagtttgaaagcctgaagacatgtaataagagcttcgaggaggatcctaaatggagcaaccctgaacccaatgatctgaaggaggagaacgaagacgaaatccccacaggtatgccctgtcttgaatctgttactattggcgatgatatctgggacgaaaactggctgcctttacaggccaaaatgggcaagggcggagacgccgctagccatctcttcacagcatctctaggaggcaagaaccagtatagttcttgcaaagagatgccacagaaggactggtgcttctcaactccaaaggatacctgggacgacagctggcagccctccggtttagtgaacggaacaaaggttgaggtgcataaaccagaggtcctgggggcacaggagaaaaacacaggaacaaacaggacgcaaaagcagttggacataaacggtagttccgactcatccacactgcccaagctggaggaattttgtacatcccttactcagtcagagcagagcgctgatgggtcccagagtgaacccaacaattcacagacacagccaaagcaaatacaactcagtaccgccgcgccttgctcaaccaccgctgtggatgactccgcagagaaaccaagcggcagtgtcgaatctagccccgaaatcctgaaaaacgaagacttcagctcctcccgggccatcacactttacaaggacaagaggcaggaatctgtcgaccagctgtctcttatcctgtcctatgaatgccaaatttctcagaagctatacatccctaggtccaccgccacagccgccctgggcgctgccgctcgcctcgcaaccagtaggagcctcttacattggtatcctagtgtaaagaggatggaagcttag

SEQ ID NO: 25402 - DNA, 426 bp, Artificial Sequence
  Description of Artificial Sequence: Synthetic coding sequence
atgcccaccaccagccggcccgccctggacgtgaagggcggcaccagcccagccaaggaagatgccaaccaagagatgagctcggtcgcgtacagcaacctcgccgtgaaggataggaaggcagtggcaatcttacattaccccggggtggccagtaatggcacaaaggcttcaggcgcaccgacgtctagtagtggctctcctatcgggagtccaacaactactcccccgacgaaacctccttctttcaatctgcaccctgctccccacctgctcgccagcatgcatctgcagaagctcaacagtcaatatcagggaatggctgcagcaacccctggacagccaggcgaagctgggcctctgcaaaactgggacttcggcgctcaggccggcggcgccgaaagcctgtcacccagcgcgggctag

SEQ ID NO: 25403 - DNA, 1188 bp, Artificial Sequence
  Description of Artificial Sequence: Synthetic coding sequence
atggccagcgccgccagcgtgaccagcctggccgacgaggtgaactgtccgatctgccaggggactctgcgggaacccgtcaccatcgactgcggacacaatttctgtcgggcttgtctgacacgttactgtgagatccccgggcctgacctcgaggagagtccgacttgtcccctgtgcaaggagcctttcaggcctgggagcttcagacccaattggcagctggctaatgtcgtcgagaacatagagcgcctgcagttagtatccacgctcggcctgggcgaggaagatgtgtgtcaggaacacggtgagaagatttactttttttgcgaagacgacgagatgcagctctgcgtcgtttgtcgtgaggctggcgaacacgcaactcacaccatgcgcttcctagaagatgcagctgctccctatagggagcagatccacaaatgcttaaaatgcctaagaaaagagcgggaggaaattcaagaaattcaatcccgggaaaataagaggatgcaggtcctgctcactcaggtgtcgaccaagcgacagcaagttatctctgaatttgcacatctcaggaagtttttagaagaacagcagagcatactcctggcgcagctggaaagccaggacggcgacatactacggcagcgggatgaatttgatttgctggtagctggggagatctgtcgtttttctgccttaatagaggaattagaagagaagaatgagagacccgcccgcgagttgctgacagacatcaggtcaaccctgataagatgcgagacacgtaagtgccgcaagcccgttgcagtaagccctgagcttggacaacggatacgcgatttccctcaacaagcactgcccttgcagagggagatgaaaatgttcttggaaaaactctgctttgaacttgactatgaacctgctcatatttccctggaccctcagacgtcccaccccaagctgctgctgtccgaggaccaccagagagcccagttcagctataagtggcaaaattcccctgataatcctcagcgctttgatcgcgcaacatgcgtgctcgctcatacaggcattaccggaggtaggcacacatgggtctggatggcaagggtcccaggtgattccggctgttgtcagttctgcagtcccccatcagtcctgggtactgaggttgcagcctag

SEQ ID NO: 25404 - DNA, 1344 bp, Artificial Sequence
  Description of Artificial Sequence: Synthetic coding sequence
atggccaccgacagctgggccctggccgtggacgagcaggaggccgccgtgaaaagtatgacaaacttacagatcaaggaagaaaaggtcaaagccgacacaaacggaatcatcaaaacctccactacggcagagaaaacagacgaggaggagaaggaggacagagctgctcaatcgctgctaaacaagcttatacgctcaaaccttgtggataacacgaatcaggtggaagtcctgcaaagggaccccaattccccactgtacagcgtgaaatcattcgaagagttaagactccctcagaacctgatagctcagagccagagcggcacaggcaaaacggccgcctttgttctcgccatgctctccagggtggaaccatctgaccggtaccctcagtgtctgtgtttgtctcctacctatgaactggccttacaaacggggaaagtgatagaacagatgggcaagttttacccagaactgaaactcgcctatgccgtcagaggaaataaactggagcggggtcaaaagatcagtgagcaaatcgtaattggcacgcctggcacggtcctagactggtgttctaagctcaaattcattgaccccaagaagatcaaggtgtttgtcctggacgaggccgacgtgatgatcgccacccagggacatcaggaccaatcgattagaattcaaaggatgttgcctcgtaactgccagatgctgttgtttagcgcaacttttgaggactccgtctggaaattcgcccagaaagtggtgccagatccaaacgtgataaagcttaagcgtgaagaggagactttggacaccataaagcagtactacgtgttgtgtagtagtcgcgacgagaagtttcaggcactctgtaacctttacggggctatcaccatagcccaggctatgattttctgccacactcgaaaaaccgccagctggcttgcggccgaactctccaaagaaggacatcaggtggctttacttagcggagagatgatggtagagcagcgtgccgcagtgattgaaagattccgagaaggaaaggaaaaagttcttgtaactactaatgtgtgtgcaaggggcatcgacgtggagcaagtgtccgttgtcattaacttcgaccttcccgtggataaagacggcaatcctgacaacgaaacttacctccacagaatcgggcggactgggcgtttcggaaagcgaggcctggctgtgaatatggtcgactctaagcactccatgaatattctgaatagaatacaggagcactttaataaaaagattgaaaggctggacacggatgatctggacgagatcgagaaaatcgcaaactag

SEQ ID NO: 25405 - DNA, 630 bp, Artificial Sequence
  Description of Artificial Sequence: Synthetic coding sequence
atggccagcagcgacctggagcagctgtgcagccacgtgaacgagaagatcggcaacataaaaaagactctcagtttgcggaattgtgggcaggagccaaccctgaaaactgtattgaataagatcggcgatgaaatcatcgtcataaatgaactgctgaacaaactcgagctggagatccagtaccaagagcagaccaacaatagcctgaaggaactgtgcgagtctttggaggaagactacaaagatattgagcatctaaaggagaatgttcctagtcacttacctcaagtgacggtgacccagagctggtatatgaagagcaggctcacctataatcaaattaatgacgttataaaggaaattaacaaggccgtgatcagtaagtacaagatcctgcaccagcccaaaaaatctatgaactccgtgacaaggaatctctaccatcgttttatcgacgaggaaacaaaggacaccaagggccgctacttcatcgtggaggccgacatcaaggaatttaccaccctcaaggccgataagaagtttcacgtgctgctcaatattctgagacattgcagaaggttaagtgaagtgaggggtggaggcctaacacgttacgtcattacatag

SEQ ID NO: 25406 - DNA, 1125 bp, Artificial Sequence
  Description of Artificial Sequence: Synthetic coding sequence
atggacagcgtgcggagcggccccttcggccagctgttccggcccgacaactttatcttcggccagactggagctggcaacaactgggccaaagggcactatacagaaggagccgagttagtagacgccgtgttagacgtggtgaggaaggagtgcgaacactgtgattgtctacagggattccagctgactcactctctagggggcgggacagggtcaggtatggggacgctgcttatcagcaagattcgcgaggaatttcccgacagaattatgaacacctttagtgtgatgcctagtccaaaggtttccgatacagtggtggagccttacaatgccaccctgagcgtgcatcagcttgtggagaataccgacgaaacatactgcattgataacgaagccctctacgatatctgcttccggaccctgaaacttaccacgcctacctatggcgacttaaatcacctggtgagcgccactatgtctggtgttaccacatcactgagatttccaggccagcttaacgcggacttgagaaagctagccgtcaatatggtgccgttcccacgattacatttttttatgcctggttttgcgcctctgacgagtcgcggttcacagcagtatcgtgcactgacagtccccgagcttacccagcagatgttcgacgccagaaatatgatggccgcctgcgacccgcggcatggccgctacctgaccgtcgctaccgtttttcgcgggcccatgagcatgaaggaggtagacgaacagatgcttgcaatccagagtaagaactcatcttactttgtggaatggatccctaacaacgtaaaggttgctgtctgcgacatcccacctcgcggtctcaaaatggcttcaactttcatcgggaattccacagcgattcaggaattgttcaagcgcatcagcgagcagttttcagctatgttcaggcgcaaagcttttctgcattggtttactggagagggcatggacgagatggagttcacggaggccgaatcaaatatgaacgatctggtgtctgagtaccagcagtatcaggacgctaccgcaaacgacggagaagaggctttcgaggacgaggaggaagagatagacggttag

SEQ ID NO: 25407 - DNA, 2289 bp, Artificial Sequence
  Description of Artificial Sequence: Synthetic coding sequence
atggccagcctgctgcaggaccagctgaccaccgaccaggacctgctgctgatgcaggagggaatgccgatgaggaaggtccgatctaagtcctggaagaaactgcggtattttcgtttacagaacgacggtatgaccgtgtggcatgcccggcaggctaggggatctgccaagccctccttttcaatctcagatgtggaaacaatcagaaatgggcacgatagcgaactgctacgctccctcgctgaagaattgcccttggaacagggattcacaattgtgttccatggacggaggtctaatctggatctgatggcaaactctgtcgaggaagcccagatttggatgaggggacttcagctgctggtggacctggtaacgagtatggaccaccaggaacggcttgatcagtggctgtctgactggttccaaagaggagataagaaccaggacggcaaaatgagctttcaagaggttcaacgcctgttacaccttatgaatgtcgagatggaccaggagtatgccttcagcctctttcaggctgcagataccagccagtccgggactctggagggggaggaatttgtgcagttctacaaggcgctgaccaagcgcgctgaggtgcaggagctgttcgagtctttttctgccgacggtcaaaagctcaccttgctagaattcctcgactttctgcaagaggagcagaaggaacgggattgtacatcagaactcgcgctggaactgatcgacagatacgaaccaagcgattcagggaaactccggcatgtgctcagcatggatggtttcctcagttacctgtgctccaaggatggcgacatttttaaccccgcctgcctacccatctatcaggatatgactcagccactgaaccactacttcatttgttcctcccacaatacatacctagtgggtgatcaattgtgtggccagtcgagtgtagaggggtacatccgtgcattgaagagaggttgtcggtgtgtggaagtggacgtgtgggatggtccttcaggagaacccgtagtgtatcacggacatacgctcacttctagaatcttgttcaaggacgtggtggctaccgtagctcagtacgctttccagacatccgactaccccgtgatcctttctctcgagacccattgtagttgggagcagcagcagaccatggcacgacacctgaccgagattttgggcgagcagctgctgtctacaacgctcgacggggttctgccaacacagctgccaagcccggaggagcttcggcgcaagatcctcgtgaaggggaaaaagctgactctggaagaggatcttgaatatgaggaggaggaggcagagcctgagctggaagaaagcgaactagcccttgaatcccagttcgagacggaaccagaaccgcaggagcagaatctgcaaaacaaagataaaaaaaagaagagcaagcccatcttatgtcccgcgttatcttctctcgtgatttacttaaagagcgtgagttttcgctcgttcactcacagcaaagaacactatcacttttacgagatctcttccttcagcgagacgaaggccaagagactgataaaggaagccggaaatgagtttgtacaacacaatacctggcagctgtcccgcgtatacccttccgggctgagaacagacagttccaattataacccccaagagttatggaacgctgggtgccagatggtcgccatgaacatgcaaaccgctggactggaaatggacatctgtgacggccatttcaggcagaatggggggtgtggctatgtgttgaagcctgacttcttgagagacatccagtcctcttttcaccccgagaagcctatctctcccttcaaggctcagacgctcttgatccaggtgatctccggccagcagctgccaaaagtcgacaaaacgaaggagggcagcatagtggatcccctggtcaaagtgcagatttttggtgtgcgtttggataccgctagacaggagaccaactacgtcgagaataatgggtttaacccctattggggtcagactttgtgttttcgcgttctggtcccagagctcgccatgctacgcttcgtcgtcatggactatgattggaagtcaaggaacgattttattgggcagtataccttgccttggacttgcatgcaacaaggataccgacacatacaccttctgtctaaagacggaatcagcctgagaccagcaagcatttttgtgtatatttgtatccaggagggcctcgaaggcgacgagtcatag

SEQ ID NO: 25408 - DNA, 1461 bp, Artificial Sequence
  Description of Artificial Sequence: Synthetic coding sequence
atggccgagctgcagatgctgctggaggaggagatccccggcggcaggcgcgcactatttgactcctacacaaatctggaaagagttgcagactactgtgagaacaattacattcagagcgctgacaaacagcgcgccctcgaagaaacaaaggcttacaccacccagtctctggcctcagtggcttacctgattaacactttggcgaataacgttctgcagatgttagacatacaggcatctcagcttagaagaatggaatctagtattaaccatatatcccagacggtggacattcacaaggagaaggtggctagaagggagatcggtatcctgaccaccaataagaacacttcccgcacgcataaaataatcgcacctgctaacctcgaaaggccagtacggtacatacggaagcctatcgactacacaatcctggatgacatcgggcacggtgtcaaatggctcctacgcttcaaggtctccacccagaatatgaagatgggcggactgccccgaacaacacctccaacacagaaaccccccagtccgcccatgagcgggaaagggaccctagggaggcactccccataccgcaccctggaaccagtacgtccgccggtggtgccgaacgactacgtccctagcccaacaaggaatatggcaccgtcccaacagtcccccgtaaggacagcatcagtcaaccaacgaaatcgcacctactcaagcagtggtagctccggcgggtcacacccaagctcaagatcctcatcacgcgagaattccgggagcggcagtgtgggagtccccatagccgtaccaacaccctctccaccatcagtgttcccagcgcccgccggctctgcgggaaccccaccgttgccggccacgtctgctagtgctcctgcccctctggttccagcaaccgtcccctcctctacggcacccgacgcagccgcaggcggagcccaaacactagcggacggcttcacatcccccacaccgcccgtggtttcctcgactccacccaccggccaccctgtgcagttttactccatgaacagaccagcctcccggcacaccccgccaactattggcggctcattaccttaccgcagaccaccttctattacatctcagacatcgctccaaaatcaaatgaacggagggcctttctatagccagaatcctgtttctgacacgcccccccctcctcccccggtcgaggagcctgtatttgacgaaagtccgccccccccgccaccccccgaggactatgaggaggaggaggcagccgtcgttgaatactcggacccgtacgctgaggaggaccctccttgggcccccaggagttatctggagaaagtggttgctatttatgactacacgaaggacaaagaagacgaactgagtttccaagaaggggctattatctatgttataaaaaaaaacgatgactag

SEQ ID NO: 25409 - DNA, 2145 bp, Artificial Sequence
  Description of Artificial Sequence: Synthetic coding sequence
atgctgagccccaagatccggcaggcccggcgggcccggagcaagtctctagtgatgggagagcagtcaaggtcccctggtcgaatgccctgcccacataggctgggacccgtcctgaaggccggatggcttaagaagcagagatctatcatgaaaaattggcaacagagatggtttgtcctaagaggagaccaacttttctactataaagacaaagatgagattaagccacagggctttataagcctgcagggcacgcaggttacagaactgcctccgggtcccgaggaccctggcaagcacttgtttgagatttccccaggcggcgccggtgagcgcgagaaggtgcctgcaaatcctgaggctctgctactgatggctagcagtcagcgggacatggaggactgggtgcaggctattcggcgggtgatatgggcccctctggggggtggcacagcccggcggtcacatgcccaccccctggagcctcttccaccaggaattttcgggcagcgactggaggagactgttcaccatgagagaaagtacggcccccggcttgctcctctgcttgtggagcaatgtgtggatttcatccgcgagagggggctgaccgaagaaggtctgttcagaatgccaggccaggcaaatctggtgcgagaccttcaagattcattcgactgtggcgagaagcctctcttcgacagcaccaccgatgtgcacacggtcgcaagtctgctcaaactctacctgagagagcttcccgagcctgtcgtgccttttgccaggtacgaagattttttatcttgtgctcagcttcttacgaaggacgaaggagaaggaactctggagctcgccaagcaagttagtaacctgcctcaagctaactacaatctcctgcgctacatctgcaagtttctggatgaagtgcaggcatattctaacgtcaataaaatgtctgttcagaaccttgctaccgtgtttggtcctaatattctgcgtccacaagtagaggaccccgtcacgatcatggaggggacctctttggtccagcatttgatgaccgtgctgatacgtaaacacagccaactgtttacggctccagtcccagaaggcccaacctcgcctcgcggtggtctgcagtgcgccgtcggctggggaagcgaagaggtcaccagagactcccagggtgaacctggggggcctggactgcccgcccatcgaacctcatcactggacggcgccgccgtggcagttctgtctagaaccgctccgactgggccaggatcccgatgctctcccgggaaaaaggttcagaccctgccctcttggaagtcttcattccgtcagcccagatccctttcaggatccccaaaggggggtggcagcagccttgaagtgcctattatttcgagtggcggcaactggcttatgaacggactgtcgagtctgcgcgggcatcggagagcgtctagtggggaccgtttgaaggatagcggatccgtacagcggctgtctacctatgacaacgtcccagcccccggacttgtccccggcatcccctctgtcgcttcaatggcctggagtggcgcctcttcgagtgagtcatctgtgggtggatctctaagctcttgtaccgcttgtcgggcttcagattctagtgcccgcagcagcttacacaccgactgggcgttagaaccaagcccgctcccatcgagttctgaggacccaaagagccttgatctggatcactctatggatgaagccggcgccggcgccagtaactcagagccctctgagcccgactccccgaccagagaacatgcaagaaggtctgaggcgctgcaagggctagtgactgaactgagggcggaattgtgccgtcagcgcaccgaatatgagaggagcgtaaagcgcattgaggagggatctgccgacttacggaagcggatgtcgcgcctagaggaagagctagaccaggaaaagaagaagtatattatgcttgagatcaagctgcggaactccgagagagcaagggaagatgctgaaagaagaaaccagctcctccagagggaaatggaagaatttttctctaccctgggaagtctgaccgtgggtgccaaaggcgcacgcgcccccaagtag

SEQ ID NO: 25410 - DNA, 381 bp, Artificial Sequence
  Description of Artificial Sequence: Synthetic coding sequence
atgtggaccgcccggggccccttccggcgggaccggtggagcagcgaggacgaggaagccgctggacctagccaagcactctctccgttgctgtctgatactaggaaaattgtaagcgaaggagaacttgaccagttggcccaaattcgacctcttattttcaatttccatgagcagaccgccatcaaggactgtttaaaaatcctggaggaaaaaaccgccgcatatgacataatgcaggagttcatggcactggagctaaaaaatttgcccggagaattcaattctggcaatcagccaagtaaccgggagaagaacagatacagggatatactgccgtttcagcatcacggttattccgggcctaatgagcgcacctag

SEQ ID NO: 25411 - DNA, 2442 bp, Artificial Sequence
  Description of Artificial Sequence: Synthetic coding sequence
atgagcgagcagggcgacctgaaccaggccatcgccgaggagggcgggacagagcaggaaaccgccacacccgaaaatggaattgtgaagtcagaaagtttggacgaagaagaaaagctggaactgcagaggcgattggaggctcaaaatcaggagaggaggaagtctaaatccggcgccgggaaaggcaaactgactagatctctcgcagtgtgtgaggaatccagtgccagacctgggggtgaatctctgcaggaccaggagtcaatccacctacaactcagttccttcagctccctgcaggaagaggacaaatcccgcaaggatgattctgagcgggagaaggaaaaggacaaaaacaaggacaaaacctctgagaaaccaaaaattcggatgttgagtaaggattgctcacaagaatatacagactctacaggcatagacttgcacgaattcttgattaataccctaaagaataacagcagagacagaatgatcttactcaagatggagcaggagatcattgactttatcgcggacaacaacaaccattataagaaattccctcaaatgagctcatatcagcggatgctcgtgcaccgtgtggccgcttacttcggcctggaccacaatgtggaccagaccggaaaatccgtgatcatcaacaaaacttcgagcactaggattccagagcagagattttgcgagcatctaaaagacgaaaagggcgaggaaagccagaagcggttcatcttgaagcgggacaacagctcaattgacaaggaggataaccaatcagtgtgtagccaggagtccctgttcgtggagaattctcggctattagaagactctaatatctgtaacgagacatacaaaaagcgtcagttgtttcgtggcaatcgcgatggcagcggccgcacttctggatcacggcagagttcttctgagaatgaactgaaatggtcggaccatcagagagcctggtcaagcactgatagcgactcttccaatcgtaacctgaaaccggcgatgacaaaaacagcgtcgtttggcggaattacagtgttgactaggggcgactcaacatcaagcacccgaagcacaggcaaattgagtaaggctggctctgagagcagttcatccgccggatcaagtggctctcttagtaggactcatcctcccttacaatctaccccactggtctctggtgttgccgccggcagtcccggctgcgtcccatatccagagaatggcataggggggcaagttgccccttcttctacgagctatattctgcttccactcgaggccgcgacgggtataccaccaggttccatcttacttaatccgcacactggtcagccttttgtgaaccctgatggcacccctgccatctataacccgcctaccagccaacaaccccttagatccgccatggttggccagagtcagcagcagccccctcagcaacagccaagccctcagccccagcaacaggtccagccaccccagccacagatggcagggccattagtgactcagtctgtacagggcttgcaggcaagcagtcagtcggtccagtatccagccgtgagcttcccacctcagcatctcctcccagtatcgcccacacagcacttccctatgcgagatgacgtcgccactcagtttggtcagatgacactgtccagacagagttcgggagagacacccgaacccccatctggcccagtgtatcctagctccctgatgccccagccggcgcagcaaccatcttatgtgattgcatccacaggtcagcagctgcctaccggaggattctcaggatcaggcccccccatctcacagcaggtactgcagcccccgcctagcccgcagggattcgtccagcagcctcctcccgcacagatgcccgtctactactatccctcaggtcagtatccgacttccaccacgcagcagtaccggcccatggcaccagttcaatataatgcccaacgctcacagcagatgccacaggctgcccaacaggccgggtaccaaccagtgcttagtggtcagcagggattccagggacttatcggagtgcagcaaccccctcaatcccagaacgtgattaataaccagcaaggaacacctgttcaaagcgtcatggtgagctaccctaccatgagctcctaccaagtacccatgacccagggcagtcagggacttccgcagcaatcctatcagcagccgatcatgttgcccaatcaggctggtcaggggtctctccctgccaccgggatgccggtctactgtaacgttacacccccaacaccccaaaacaatctgcgtcttattggcccccactgcccttcatcaacggtccccgtgatgagcgcctcttgcaggactaattgcgccagtatgtctaacgcaggctggcaagtgaaattctag

SEQ ID NO: 25412 - DNA, 1467 bp, Artificial Sequence
  Description of Artificial Sequence: Synthetic coding sequence
atgaacggcgccctggaccacagcgaccagcccgaccccgacgccatcaaaatgtttgtggggcagatccccagatcttggagcgaaaaggagttgaaggagttgttcgaaccctacggcgctgtgtatcagatcaatgttctgagagatcgatcacaaaatccacctcagtccaaaggctgctgttttgtcaccttttacacacggaaggccgctctcgaggcgcagaacgccttgcacaatattaagacgctccccgggatgcatcaccccatccagatgaagccggcagattcagagaaatcaaacgccgtagaggataggaagctgtttatagggatggtaagcaaaaaatgtaatgaaaatgacatcagggtaatgttctccccatttggccagattgaagagtgccgcattctgaggggtcccgacgggctgagccgcggttgtgcctttgtgacattctccaccagggccatggcccagaatgccatcaaggccatgcaccagagtcagacaatggaagggtgcagctctccgatcgtggtcaagtttgccgacactcaaaaggataaagaacagcgacggctccagcagcaacttgcgcagcaaatgcagcagctgaacacggctacctgggggaacctgactggattgggcggactcactccgcagtacctagctctcctgcagcaggctacctcaagcagcaatctgggggctttctctggtattcagcagatggctggcatgaatgcgctccaactgcagaatttggccacactggctgctgccgcagcagccgcacaaactagcgccacttctaccaacgccaatccactctcaacaaccagctctgccctgggcgcccttacctcccccgtggcggcttccaccccgaatagcacagccggcgctgcgatgaattccctgacatctctggggaccctgcaaggattagccggcgctacagtggggcttaataatatcaatgcactggccggtacaattaatagcatggccgccttgaatggaggacttggagcaaccgggctgactaacggtacggctggcactatggatgcactgacccaggcctactctggcattcagcagtatgctgctgcagccctgcccacattatattcacagtccctgctccaacagcagtccgccgctggttcccagaaagagggtcctgagggggcgaatttgtttatttaccacctcccacaggaatttggagatcaagacatcttgcagatgtttatgccattcggtaatgttatctcagccaaggtgtttatagataaacagacgaacctgtccaagtgttttgggtttgtttcatacgataacccagtgagcgcccaggctgccatccaggccatgaacggctttcagatcggcatgaaacgcctgaaggttcaactgaagcggtccaagaacgatagcaaaccctattag

SEQ ID NO: 25413 - DNA, 474 bp, Artificial Sequence
  Description of Artificial Sequence: Synthetic coding sequence
atggccaccagcgcccccctgcggagcctggaggaggaggtgacctgctctatctgtttggactacttgagagaccccgtgacaattgactgcggtcatgtgttctgtaggtcctgcacaactgatgtgcgccctattagcggtagtagacctgtgtgccctctgtgcaaaaagccttttaaaaaagagaatatccggcccgtgtggcagctagcttcattagtcgagaatatcgagagactaaaagtagacaaaggacgccaacctggcgaagtgactagagaacagcaggatgcaaagctctgcgagcgacatagggaaaagcttcattattactgtgaagacgatggtaagctactttgtgtcatgtgtagagagtctcgagagcacaggccacatactgcagttctcatggagaaagccgcccagccccatcgcgagaaaatcctcaatcacctctccaccctgcggtag

SEQ ID NO: 25414 - DNA, 303 bp, Artificial Sequence
  Description of Artificial Sequence: Synthetic coding sequence
atggccagcgaggacatcgccaagctggccgagaccctggccaagactcaggtggcgggcggccagttgagttttaagggcaaatctctgaaactgaacacagcagaggatgccaaggacgtcattaaagaaatcgaagactttgacagcctggaagcactcaggttggagggtaacactgtgggtgtagaggccgccagagtcatagcaaaggctcttgaaaagaagagcgagctgaaaagatgtcattggagcgatatgttcaccggacgtctcagaacagagattccccccgcattgtag

SEQ ID NO: 25415 - DNA, 459 bp, Artificial Sequence
  Description of Artificial Sequence: Synthetic coding sequence
atgagcgtgacctacgacgacagcgtgggcgtggaggtgagcagcgatagcttctgggaggtcggtaactataagcgaacagtcaagcgaattgacgacggccatcgtctctgttccgatctgatgaactgtctgcatgaaagagcacggatcgagaaagcatacgctcaacagctgacggagtgggcgaggcggtggcgacagctagttgagaaagggccacaatacggaacagttgaaaaggcgtggatggcatttatgagcgaggctgaaagagtgagcgagctccatctggaggtaaaagccagtttgatgaacgatgattttgagaaaataaaaaactggcaaaaggaagctttccataagcagatgatgggcggtttcaaagaaactaaagaggccgaggatggcttcaggaaggcacagaaaccctgggctaaaaagctgaaagaagtttag

SEQ ID NO: 25416 - DNA, 543 bp, Artificial Sequence
  Description of Artificial Sequence: Synthetic coding sequence
atgttcgccagcgacctgctgcgggccctggactgctgccccggcgcaggatcttcagggttgttgccccaacttggcccacgccaactcctggcatttacggtgaactgccttggcaaccatagatacctcgggttcttcgaggatttggagcagagacacaaggctcaagttctggtcgaagacatctcggatattctagaggaacacgcagagaagcatttccacccatacattgcctactgtagcaatgaagtttaccaacagaggacactgcagaagctgatatcttctaatgcagcgttcagagaagccctccgcgagattgagcgccggcccgcatgcggtggcttaccaatgctgagctttttgatcctccctatgcagagagtgacacggttgcccctcctaatggacactctgtgcctgaagacacagggacacagcgaacggtacaaagctgccagtagggctcttaaggcaatatccaaacttgtgcggcagtgtaacgaaggcgcccacaggatggaacggatggagtag

SEQ ID NO: 25417 - DNA, 2487 bp, Artificial Sequence
  Description of Artificial Sequence: Synthetic coding sequence
atggacagcgaggccttccagagcgcccgggacttcctggacatgaatttccaaagtctggccatgaagcacatggacctcaaacagatggagttagataccgccgccgccaaggtagatgagctcactaagcagttagaatccctctggagcgattcccccgctccgcctggaccccaggcagggcccccatccaggcccccaaggtattcatcttcctcaatccctgagcccttcggttccaggggctctccccgtaaggccgccaccgacggagccgacacgccatttggcaggtccgagtccgcccccacactgcatccatacagccctctgagccccaagggacggcccagctcgcccagaactcctctatatctccagcccgacgcctacggcagccttgatcgcgctacatccccccggccacgagctttcgatggagctggatcatcactcggacgtgccccctcgcctagaccaggcccaggcccgctgcggcagcaggggcctcctacccccttcgactttctgggaagagctggaagcccaagaggaagcccactggcagagggcccgcaggcttttttcccagagcgcggaccttcacctagacctccagccacggcatacgacgctccagccagcgcttttggctcatccttgcttggaagcgggggctctgcatttgcgccccccttaagggcacaggacgacctcacccttcggaggaggccccccaaagcctggaatgaatcagatttggatgtggcgtacgagaaaaagccatcccagaccgcatcttacgaaagattagacgttttcgccagacccgctagcccatccttacagttactaccctggagggaatcatccctggatggcctgggaggcacagggaaggacaatctcacaagcgcgactctcccccgtaactacaaggtgtcaccgctcgccagcgacaggcgttctgacgcagggagctaccgtcgttctctgggctccgcaggacccagtgggacactgccacggagctggcagcccgtgagccgcattcccatgccaccgtccagcccacagccgaggggcgcacctagacagaggcccatccctctgagtatgatctttaagcttcagaatgcattctgggaacatggggctagcagagccatgctcccaggatcccccctgttcacacgcgcaccaccccctaaattgcagcctcagccccagccccaaccccagcctcagtcacagccgcagccacaattaccacctcagccccaaacgcaaccccagacccctacgccagctccacagcatccccagcagacttggcccccagttaatgagggccccccaaaaccccccaccgagctggaacctgagccggagattgagggtttactgacccccgtgcttgaagccggggatgtcgatgaggggcctgtcgccagacctctgtcaccaacccgcctccagcctgcccttcctcccgaggcacagagcgtgcccgaattggaggaggttgcaagggtcctggccgagataccccgtcctctgaaaaggagaggtagcatggagcaagcgccagccgtagctctgccgcctacccacaaaaagcaatatcagcagattattagccggctctttcaccggcatggcggaccaggcccagggggcccagaacccgaactttcaccaatcactgaagggagtgaagctcgggcaggcccccccgctcccgcaccgccagcaccaattccgcccccagcaccttcccagtctagcccacctgagcaaccccagtccatggagatgagaagcgtgttgcgcaaagccgggtccccaagaaaagcgaggcgtgcacggctcaaccccttggttctgcttctggacgctgccctgacaggagaactggaagtcgtgcaacaggcagtcaaagagatgaatgatccatcgcagcccaacgaggaaggaattaccgcccttcacaacgccatttgcggggccaactatagtatagtggacttcctgataaccgcgggcgctaacgtgaattcgcccgatagtcacggctggaccccattgcactgcgcagcctcgtgtaacgacaccgtgatatgtatggccctcgtgcaacatggtgccgccatctttgctacaaccctcagcgatggagccaccgcgtttgagaagtgtgacccctaccgcgaaggctatgccgactgtgcgacctacctagccgatgtagagcagtcaatgggcctgatgaattctggcgccgtctatgcattgtgggattattctgccgagtttggggacgaactgtcgttcagagaaggcgagtccgtgaccgttttacgtcgtgacggcccagaagagactgattggtggtgggcagccctccacggtcaggaaggatacgtgcctaggaattacttcgggctgttcccaagagtgaagccccagcgttcaaaggtatag

SEQ ID NO: 25418 - DNA, 4455 bp, Artificial Sequence
  Description of Artificial Sequence: Synthetic coding sequence
atgcggatccccgaccagaagtacgtgaccctgaagctgaacgacgtaattcgattcggttatgattctaacatgtacgtgctggagagggtacagcatagagttccagaagaagctctgaagcatgaaaagtatacaagccagcttcaggtgagcgttaagggcttggcccccaagaggagcgaggcgctgcccgaacatacaccttattgtgaagctagcaacccgcgacctgagaagggcgatcgccgacccggcactgaggccgcctcctatcgcacgccactctacgggcagccttcttggtggggagaagacgacggatcgacactgccagatgctcaaagacagggcgagccctatcccgaacgacctaaaggccccgtgcagcaggacggggaactccacggtttccgcgcccccgccgaacctcaaggctgttcctttcggcgagaacctagctatttcgagatccctacaaaggagacaccccagccttctcagccccccgaggtccccgcccacgagatgccgaccaaggacgccgaagcaggaggggggggggctgcacccgttgtacagagccacgccagtttcacgattgaatttgacgactgtagtcccgggaagatgaaaattaaagaccacataacaaaattctccctgagacagcggcgcccgcctggaaaagaggcaactcctggtgagatggtgagtgcagaaaccaaggtcgcagattggctggttcaaaatgacccgagtctcctacatcgagtgggcccaggtgacgatagacattctaccaaaagtgatctgcccgttcatactaggactttaaaaggccacaagcacgaagatggtactcagtccgatagcgaagacccattggcaaaggctgctagtgccgctggagtgcctctagaagcaagtggggaacaggtgaggctgcagaggcaaatcaaacgcgatcctcaggagctgttacacaaccagcaagcattcgtgattgagtttttcgacgaagacacaccacgaaagaagaggtcccagtccttcacacattcaccctccggcgatccaaaagctgacaaaagaagaggacctacgcccgcggatagggacagaccaagtgtaccggctcctgtgcaagcgggaggtcgcagcagcggccctcaaagggcggggtcccttaaaagagaaaagactgaagaaagactcggatccccaagccccgccagccgcactcccgccaggcctttcggctctgtgggccgcagaagtcggttagctcaggacttcatggcacagtgcctccgcgaaagcagcccagcagccaggccatcccctgagaaagttccccctgtattaccagctcctctaaccccacatggaacctctcccgttggacctccaacgcccccccccgccccgactgatccccagcttactaaggccaggaagcaggaggaggatgacagcctgtctgacgccggaacctacacaatcgagactgaggcccaagacacagaagtcgaagaagctcggaagatgattgaccaggttttcggggtgctggagtcaccagagctgtctcgcgcctccagcgccaccttccgcccggttattcggggagaccgcgacgagagtgacgatggaggagtagcgcagagaatggcacttctgcaggagttcgcgtcccgacctttaggagccgccccccaggctgagcatcagggcctgccggtacccggatccccgggaggccagaagtgggtcagtagatgggcttcactcgccgattcatattccgaccctggcttgacagaggacggactggggcgtagggggggagaacctgaaggaagcctgcctgtgagaatgagaagacggctgccccagctcccatctgaacgggctgactcccccgccggccccgagagtagccgcaggagcggtcccggtccacccgagcttgatagtgaacagcccagtcgactgttcggtcaggaggaattagaccctgattcactaagcgatgcttctggatcggatggcggccggggcccggaacccggtgtggaaccacaggacagccgcaggcgctcgccccaggaggggcctacctggagcagaggacgtcgctcccccagggccccgggggagccaactcctgcgtctttttttattggggatcagaacggagatgcggtgctcagccgcaaacctctggccgcaccgggcgatggagagggactcggccagaccgcccagccctctcctccggcaagggatggagtttatgtctctgctaacggcagaatggtcatccaacttcggcccggacgttctccagaacctgatggtcctgctcccgccttcttacgacaagagtcattcactaaggaaccggctagcggacctcccgcgcctggaaaacccccacacatctcgagccacccattactgcaagacttagccgccacccgagcagcccggatggactttcattctcaagacacgcatctgatccttaaggaaactgaaacagcactggccgcattagaagcaaggctgctgtcaaatagcgtagacgccgagtgcgagggaggaagcaccccacggccgcctgaggacgccttaagcggcgatagtgatgtagacacagcctccacagtgtcactacggagcgggaaaagcgggccctccccaacaacccctcaacctctgagggcgcagaaggaaatgtcccccagccccccagcagcccaagatcctgggggtacagctctggttagtgcgcgcgaacaatcatccgaacgccagcatcacccattaggtccaacagacatgggcaggggggagcccgtcagaaggtctgcgatccggcggggccatcgcccacgcggaagcctcgactggccaagcgaggagagaggaccggtcctcgcacacctgccgtcttcagacgtaatggcttccaaccacgagacacctgaagcaaccggggcaggtcgtctcggttcaagaagaaagccagcggcccctcccccttccccggctgcccgagaggaacagtcacgttcatctgcttcaagccagaagggtccacaggccctgacccgatccaacagtcttagtacaccccggcccacccgggcgtctcgcctccgccgtgccaggttgggcgatgcttcggacaccgaagcggcagacggcgagcgcggttctctaggcaatcccgaacccgttggcagaccagcagccgagcaggccaaaaagctgtctaggctcgacattctcgcaatgccgaggaaaagggccggtagctttaccggcaccagtgaccctgaagcagcccccgcgagaaccagcttttctggaagaagtgtcgagctatgctgcgcaagcagaaagcccactatggctgaggcacgagccgtgagtaggaaggctgccaacactgcgaccactaccggtccgcgacagcctttctcccgcgcccgctcaggaagtgctcgttacacctccaccacccagacacccagagccggaagcagctcacgggcgcgttcccgtgcacctggccctcgggacaccgatgatgatgaggaggaaccggatccctacggtttcatcgtgcagactgccgaaatcgctgagatcgcacgcctgtcccaaaccttggtgaaggacgtcgctattctggcccaagaaatccatgatgtcgccggagatggggacacattaggatcttctgagcctgcacattctgcgagcttgtctaatatgccgtcaactcctgccagcaccatcagtgcacgcgaagagctagttcagcggatccccgaggccagcctgaactttcaaaaagtcccacctgggtcacttaactcgcgggacttcgatcagaacatgaatgactcctgcgaagatgcgctcgctaacaaaacaaggcccagaaaccgcgaggaagtgatattcgacaatctcatgctcaatcctgtgtcccagttgagtcaagctattcgagaaaataccgagcacctggccgaaaagatgaaaattctgtttcagaataccggccgggcttgggaagacctggaagcacggattaacgctgaaaacgaggtgcccatcttaaaaacaagcaataaagagatcagctccattcttaaagagttacggcgggtccaaaagcagctggaagtgattaacgcaatcgttgacccttcggggtcacttgatttacttactggaaatcgctccctggcttcatctgcccagcccgggctggggaagggtcgtgttgcggcgcagtcccctccttctcccgcctccgccgaggccctcctgcccgccttgcctctaaggaacttcccccaaagagccagctgtggacccccttcactgcctgaccctacctttctgcctgatgccgagaggtttctaatctag

SEQ ID NO: 25419 - DNA, 150 bp, Artificial Sequence
  Description of Artificial Sequence: Synthetic coding sequence
atgtaccccaaccccctgatctactgcacctgctgggacccctggaatctcgggccaagaaaattgataaaaacaccccagttacctagaaagaactctaccgggagctccaaactgacacccctggttccagctcctaagaaccattag

SEQ ID NO: 25420 - DNA, 948 bp, Artificial Sequence
  Description of Artificial Sequence: Synthetic coding sequence
atggccttccccgagcccaagccccggccccccgagctgccccagaaaaggctgaagacactagattgtggacagggcgccgtgcgcgcagttcggtttaacgtcgatggaaactactgcctgacctgcggatcagacaaaacactgaagctgtggaatccactgcggggaacactattaagaacctattctggacacggatacgaggtgctggacgccgcaggctccttcgacaacagctccttgtgcagcggcgggggggataaggctgtggtcttgtgggatgtggcctccgggcaggtcgtcaggaagttcagaggccacgcgggtaaagtcaacacggtgcagtttaacgaagaagcgacggtcatcctatccggaagcattgactcgtcgatcagatgctgggactgcaggtcccgaagacccgagcccgtgcagacgctggatgaagcccgcgatggggtctcctcagttaaagttagcgatcatgaaatcctggcgggaagcgttgacgggcgtgttaggcgatacgaccttaggatgggccagctgttcagtgattacgtgggctctcccataacatgcacatgtttcagcagagacggacagtgcacactagtgtcttccctggactcgacactccgtcttctggacaaggatacaggcgagctgctgggagagtacaaagggcataagaaccaggagtacaagttggactgctgcctcagcgagagagatacgcacgttgtgagttgttccgaagatggcaaagtgttcttctgggatctggttgagggcgccctggccctggctctccccgtaggctcaggcgtagttcagtctttggcatatcaccccaccgaaccatgcctgctcactgccatgggcggctctgtgcaatgctggcgcgaagaggcctatgaagctgaggacggagccggatag

SEQ ID NO: 25421 - DNA, 3015 bp, Artificial Sequence
  Description of Artificial Sequence: Synthetic coding sequence
atgaaggccaccacccccctgcagaccgtggaccggcccaaggactggtacaaaacaatgtttaagcaaattcatatggtgcataagcctgggctgtacaacccaccatacagcgctcaaagtcacccggcagctaagacgcagacctataggccactgtccaagtcccatagcgataatagtcctaacgcgtttaaggatgctagcagcccagtgcctcccccacacgtgcctcctcccgttccgcccctccggcctcgggacagatctagtactgagaaacatgactgggacccgccagaccgtaaggttgacacacggaagttcagaagcgagccaagaagcattttcgaatatgagccagggaagagctctatcttgcagcatgaacgccctgcatccttgtatcaatccagcattgatcgctctctcgaaaggcctatgagctccgctagtatggcgtccgatttccgaaaacgccggaaatctgagcccgctgtgggccccccaagagggctgggagaccagtccgccagccgaacatcccccgggagagttgatttgccagggtccagcacaacattgactaaaagttttacttcttcgagtccctcatcaccctctcgggcaaaggggggtgacgacagcaaaatatgcccatctctttgttcctactcaggattaaacggaaatccgagctcagagctggattactgcagcacgtatcggcagcacttggacgtgccccgtgactcccctcgcgctataagtttcaaaaatggttggcaaatggcccggcagaatgccgagatttggagtagtacagaggagacagtgagtccaaagattaaaagccggtcatgcgacgatctccttaacgatgactgcgattcctttcctgatcctaaggtaaagtcagagtccatggggagtctcttgtgtgaagaagattccaaggagagttgccctatggcttggggcagtccttacgtccctgaggtacgctcgaatggtcgctcacgaattagacatagatccgctcgcaacgcacccgggttcctgaagatgtataagaaaatgcaccgtatcaaccggaaggatctaatgaactcggaggtgatttgtagcgtgaaaagcagaattctccagtatgaaagcgaacagcagcataaggacctgctgagagcctggtcacagtgctcgaccgaagaagtgccgagagacatggtgcctacccgtataagtgagtttgagaagctgatccagaaaagcaagtcaatgcccaatttgggagatgatatgctgagcccagtcaccctggaaccaccacagaacggactgtgtcccaaacgtagattctccatcgagtacctgctggaggaggagaaccagtccggtcccccagcacggggtcgaagaggttgtcagagcaacgcactggtcccaatacacatagaggtgacgtctgatgaacagcccagagcacacgtcgagttctctgattctgaccaggacggagttgtatcagaccattctgattatattcatctggagggctcttctttctgttctgagtccgactttgatcatttctcttttacatcttcagaatcattttatggctcttctcaccatcaccaccaccaccatcaccatcaccaccgtcatctcattagcagttgtaagggacggtgtcccgctagttacacccgctttactacgatgctcaaacatgagagagcccgccacgagaacacagaggaaccacggagacaggaaatggatcccggtctgagtaagttagccttcctagttagtcccgttccctttcgaagaaagaagaattctgctccgaagaagcagacagaaaaggccaaatgcaaggccagcgtttttgaagcattagactctgccctcaaagacatttgcgaccagataaaagcggaaaagaaaagaggctctctgcctgacaacagtatcctgcatcgactgatctcagagttgctgcctgatgtgcccgagagaaactcgtccctgagagccctcaggcgatctcctctgcatcagccactgcaccctcttcccccggacggagctattcactgtcctccttaccagaacgattgcggcagaatgccacgtagtgcgtcttttcaggacgtggatacggctaacagctcctgtcaccaccaggaccgcggaggggcccttcaggatagagaatcccctaggagctatagctctacccttaccgatatgggtagaagcgctcccagagagagacggggcacaccagaaaaggaaaaactgcccgccaaggcagtctatgatttcaaagcacagacctccaaggagctctcttttaagaaaggggacacagtgtacatattacgcaagatcgaccagaactggtatgaaggcgagcatcacggcagggtgggcatattcccaatcagctatgtcgaaaagctcacaccccctgagaaggctcagccagccagaccacccccccccgcacagcctggggagattggtgaggctatcgctaagtataattttaacgctgataccaatgttgaattgtcgctccggaaaggtgacagagtgattctgctgaagagggtggatcagaactggtatgagggaaaaatccctggtacaaaccggcagggcatttttccggtgtcttatgtagaagtggtgaaaaaaaacacaaaaggagccgaagactaccccgacccgccgattccccactcctactcctccgatcgaattcatagcctgtcatcaaataagccacagcgacccgtattcacccacgaaaatatacagggcggcggcgaaccttttcaggctctttacaactatacaccacgcaatgaagatgaactcgaactgagagagtcggatgtgatagacgtgatggagaaatgtgacgacggatggttcgtgggcacatcacgtagaacaaaattctttggcaccttccctggcaactacgtgaaacgcttgtag

SEQ ID NO: 25422 - DNA, 981 bp, Artificial Sequence
  Description of Artificial Sequence: Synthetic coding sequence
atggccgccgccgccgccgccgccgccgccaccaacggcaccggcgggagctctggcatggaggtcgacgcggccgtaccttctgtgatggcttgtggcgtaactggaagcgtgtccgttgccctgcatccgttagtgatcttgaacatctctgaccattggattcggatgagatcgcaagaaggccgaccggtgcaggtgatcggtgcactgatcggaaagcaagaagggcgcaacattgaggtgatgaattcctttgagctgctgtcacacaccgtggaggagaaaattatcatagataaggagtactactacaccaaagaggaacagttcaagcaggttttcaaggaactggagtttctcgggtggtataccacaggcggccccccagacccaagcgacattcatgtacataagcaggtttgtgagataatcgagtctcctctgttcttgaagctgaaccccatgacaaaacacactgatctaccagtgtccgtgtttgagtccgtaatcgatattataaatggagaagccactatgctgtttgccgagctcacttatacgcttgccacggaagaggcggaaagaatcggtgtggaccatgtggcacgaatgaccgccactggatctggcgagaatagtaccgtggccgagcaccttatcgctcagcactccgctattaagatgcttcactctagagttaagctaatcctcgaatacgttaaagcctctgaagcaggcgaagttccgttcaaccatgagatcctgagagaggcatacgccctttgtcactgccttccagtactgtccaccgacaagtttaaaactgacttttacgatcagtgtaatgatgttggcctgatggcgtacctgggtacaattaccaagacctgcaatacaatgaaccaatttgtcaacaagttcaatgttctctatgatcggcaaggcattggccgacggatgagaggactgttcttttag

SEQ ID NO: 25423 - DNA, 780 bp, Artificial Sequence
  Description of Artificial Sequence: Synthetic coding sequence
tgattcaccgcccaggcccccagcggccggggcgccgccgtgggctcaggtacacgactcgcaagtctgcggttgctcactgaattagaaagtccagcttggtggcctttctccagcaagttatggaaaaccccccccgaaaccaagcctcgggaagacgttagtatgacctcctgtgagccctttggtaaagagggcatcctgatcaagattcctgctgtgatctcccatcggaccgaaagccatgtgaagcctggacggcttactgttcttgtgtcgggactggaaatacatgactccagtagcctgcttatgcacaggtttgaaagggaggatgtcgacgatataaaagtacatagcccgtacgagatctctatacgacagagattcattggaaaacctgatatggcctacagactaatatccgctaagatgccagaagttattcccatcctagaggtgcaatttagcaaaaagatggaactcttggaggatgccctcgtgctgcgctccgcccgcactagcagtcccgctgagaagagctgtagcgtgtggcacgctgcgtccggactgatggggcgcaccttgcatcgggaacctccggcgggcgaccaggaagggacagccttgcacctgcaaacgtccttaccggctttgtctgaggctgatacgcaggaactgactcagggattccgccccatgtctctcagcacccaaaccgttttggttatgctgtgcagcgagtccgccggcgcactgtggagacagcggctcagctag

SEQ ID NO: 25424 - DNA, 1038 bp, Artificial Sequence
  Description of Artificial Sequence: Synthetic coding sequence
atggccgccgccgagcccgccagcagcggccagcaggcccccgccggacagggacaggggcagaggcccccacctcagccccctcaggctcaagccccgcaacctcctccacctcctcagctgggcggcgccgggggtgggtcctcacgccacgagaaaagtctcggtctgctgactactaaatttgtgtctcttctgcaggaagccaaggatggagttcttgacctgaaggccgctgccgatacgctggccgtcaggcagaagaggcgaatctatgatattaccaatgttctcgaaggtatcgaccttatcgagaagaaatctaaaaatagcatccagtggaaaggagttggggcagggtgcaacactaaagaagtgatcgatcgcctgcgttatttgaaagcagagattgaggacctagagttaaaagagagggagctggaccagcagaagctttggctccagcagtccattaaaaatgtcatggacgacagcataaataaccgcttcagctatgtgacccacgaagatatttgcaattgcttcaacggggatacattacttgctatccaggcaccatccggcacacaacttgaggtgccgatcccagaaatgggtcagaacggccagaagaaataccagatcaaccttaaatctcactccggcccaatccacgtgctgctcataaataaagaatcctcatctagcaagccagtggtgtttccagtgccaccacccgatgatttgacccagccgagttcacagagcctcacccccgtaacccctcagaaatcaagcatggctacccaaaatctgcctgagcagcacgtctccgaaagaagccaggcgttacagcagacttctgctaccgacatttcctccgggtccatctcaggtgacattattgacgaactcatgtcttctgatgtttttcctcttctgcgcctgtcccctacaccagccgacgattataatttcaacctcgatgataatgagggcgtttgtgacctcttcgacgtgcagatattaaattactag

SEQ ID NO: 25425 - DNA, 96 bp, Artificial Sequence
  Description of Artificial Sequence: Synthetic coding sequence
atgaccgtgccctggcggcccggcaagcggcggatcacctacaaggaagaggaagatcttacgctgcagcctcggtcatgtctccagtgtagctag

SEQ ID NO: 25426 - DNA, 489 bp, Artificial Sequence
  Description of Artificial Sequence: Synthetic coding sequence
atgaacaaccagaagcagcagaagcccaccctgagcggccagcggttcaaaaccagaaaacgagacgagaaagaaagatttgatccaacccagtttcaggattgtattattcagggcttgacagaaaccggcacagatctggaggcggtggcgaaatttctcgacgcaagcggggctaagctggattacagaaggtacgccgaaactttgtttgacattttagtagccggaggaatgctggcaccggggggcaccctggccgacgacatgatgaggaccgacgtttgcgtgttcgccgcacaggaggacctggagacaatgcaagcgttcgcccaagtctttaacaagctgattaggcggtacaaatacctcgaaaagggcttcgaggacgaggtgaagaagctccttctcttcttgaagggattttccgagagtgagcgcaataaactagctatgctgactggagttctgctggctaatggcacatag

SEQ ID NO: 25427 - DNA, 270 bp, Artificial Sequence
  Description of Artificial Sequence: Synthetic coding sequence
atggccgccgccaccggcgaccccggcctgagcaagctgcagttcgcacccttttccagcgcactggacgtggggttctggcatgagttgacccagaagaagctaaatgagtatcggctggacgaggcccctaaagacattaagggatactactataacggcgacagtgcaggcttacctgcccgcctgacactggagtttagcgcatttgatatgtccgctccaacacccgcccgctgttgtcccgctatcggaaccctgtataactag

SEQ ID NO: 25428 - DNA, 2025 bp, Artificial Sequence
  Description of Artificial Sequence: Synthetic coding sequence
atgcagaccagcagcagccggagcgtgcacctgagcgagtggcagaagaattacttcgccattacatctggcatctgcactgggccaaaagcagacgcctatcgagcacaaatcttacggatacaatacgcttgggccaattccgagatctcccaagtctgtgctacaaaactcttcaaaaaatatgctgagaaatattccgctataatcgattctgacaacgtagagtccggtctcaataactatgccgagaatattctcacactagcaggttcacagcaaacagatagtgacaaatggcaatccggtctgagcatcaacaacgtgttcaaaatgtcttccgttcagaagatgatgcaagctggcaagaagtttaaggatagcctgttggagcccgccctagcgagcgttgtgatccacaaggaggcgaccgtctttgatctccctaagttcagtgtgtgtgggtccagtcaagaaagtgattcactccctaacagcgcacacgatcgggatcgaacacaggactttccagagtccaaccgtttaaagctgctgcaaaatgcacaacctcctatggttaccaataccgcccgcacctgtcctacattctctgctcctgtcggggagagcgccactgctaagtttcacgtcacgccactcttcggaaacgtcaaaaaagagaaccacagtagtgccaaagaaaacataggtctcaacgtgtttctttcgaaccagtcctgtttcccagcagcctgtgagaatccacaacgaaaatccttctatggcagtggtactattgatgccctgtctaatccaatcctgaataaggcttgttcaaagaccgaggataacggacctaaggaagatagctccttgcctacgtttaagactgccaaggaacagctttgggtggaccagcagaaaaaatatcaccaaccccagcgcgcctccggatcgtcatatggcggcgtcaagaaatccttgggcgcaagccggtcacgtggaatcctggggaagtttgttcctcccattcctaaacaggatggcggagaacaaaatggtgggatgcaatgtaagccttatggcgcaggccccacagagcctgctcaccccgtcgatgagcggctgaaaaacctcgagcccaagatgatagagttgataatgaacgagatcatggaccatgggcctccggtgaactgggaagacattgccggggtggagtttgcaaaagccacaatcaaagagatcgtcgtctggcccatgcttagacctgacattttcaccggcctacgggggccccccaaaggcatcctgctgtttggtccacccgggactggcaagacattgattggcaagtgtattgcctctcagtctggcgctacctttttcagcatctccgcctcgtctttaacttctaaatgggtgggggaaggggaaaagatggtccgcgccttgttcgccgtggctcgatgccagcagccagccgtgatattcattgacgagatcgatagcctgctcagtcagcgaggcgatggtgaacacgagagctcacgaaggattaagacagagttcctagtacagttggacggggccactacaagttccgaggaccggatccttgtggttggggctacaaacagacctcaggagatcgacgaggccgccagacgacgcctcgttaaacgcttgtacatacctctacctgaagcatctgcaagaaagcagatagtcatcaacctgatgtccaaagagcagtgctgtctcagcgaagaggagattgagcagatcgtccagcagtcagatgcgttctccggcgccgatatgacacagctgtgtcgcgaagcaagcctgggcccaatcagatcccttcagacagcggacattgctacgattaccccggaccaggtcaggcccatcgcttatatcgactttgagaatgcttttcgcactgtgaggccctctgtctcgcccaaggatttggaattatatgaaaactggaataagacgttcggttgtggcaagtag

SEQ ID NO: 25429 - DNA, 1923 bp, Artificial Sequence
  Description of Artificial Sequence: Synthetic coding sequence
atggagaaccagctggccaagagcaccgaggagcggaccttccagtatcaagactccttgccgtctctgcccgtccctagtctggaggagtctctgaagaagtatctggagtcagtgacaaggacatgctatcaaatccgaggactagatccagacgccaagcggggctttttggatttgacacgagagggtattcaggtcaagccttttgcaaaccaagaagaatataaaaagacagaggagatagtgcaaaaattccagtcgggcattggtgagaagctgcatcagaagctgctcgaacgcgcaaagggcaagaggaactggctggaggagtggtggttaaatgtagcttatttagacgtgaggataccatcacaactgaacgtaaacttcgcagggccagcagcccacttcgaacactattggccacccaaagagggaacccaactggaaagaggctctatcaccttatggcataatctcaattactggcaactgctgcgcaaggaaaaagtgccagtccacaaagttggtaatactcctctcgacatgaaccagtttagaatgttattctccacctgcaaagttcctggtattacgagggactcaataatgaactacttccgtaccgagagcgaaggacggagccccaatcacatagttgttctctgccgcggccgggcattcgtcttcgacgtcattcatgaggggtgtctggtgaccccccctgaactgctccgtcaattgacttacatccacaagaaatgccactctgaacctgacgggcccggaatagctgctctgaccagtgaagaacggaccagatgggctaaggctcgcgagtaccttattggactcgaccctgaaaacctggcactactcgaaaagatacagtcttccttactggtctacagtatggaggattctagccctcatgtgacccccgaggactacagtgagattatagcagcgattctgataggcgaccctaccgtaagatggggcgacaaatcatacaatctgatcagcttttcaaatggggtttttggctgcaattgcgaccatgcaccttttgacgccatgatcatggtgaatatctcttattacgtggacgagaagatttttcaaaacgaggggcggtggaaaggcagtgaaaaagttcgcgatattccattgcctgaggagctgattttcattgtggatgaaaaggtgctgaatgacatcaaccaagcaaaagcccaatacctgcgcgaggcctctgatctgcaaatcgccgcttatgctttcacatcatttgggaaaaagctcacgaagaacaagatgctgcacccggatacattcattcagctcgctcttcagctggcctattacagattacatgggcacccaggctgctgttacgaaaccgctatgacgcgccatttctaccatggccgcacagagaccatgcggtcatgtaccgtggaggcagtgagatggtgtcagagtatgcaggatccctcagtcaacctgagagaaaggcagcaaaaaatgttacaggctttcgcaaaacacaataaaatgatgaaagattgtagcgccggaaaaggattcgacagacatctgctgggactcttgctaattgcaaaggaggagggacttcccgttcctgaactatttaccgatcccctttttagtaagtccggtggaggtgggaattttgttcttagcactagcctggtaggatatcttcgggtgcagggcgtcgtggtgccgatggtgcacaacgggtacggcttcttctatcacataagagatgatcggtttgttgtggcgtgttccgcgtggaaatcttgcccggagactgatgctgagaagcttgtccagctgacgttttgtgcctttcatgatatgatccaattaatgaatagcacacacctctag

SEQ ID NO: 25430 - DNA, 474 bp, Artificial Sequence
  Description of Artificial Sequence: Synthetic coding sequence
atggccaccagcgcccccctgcggagcctggaggaggaggtgacctgttcaatatgcttggactatctgagggatcctgtcacgattgattgcgggcatgtgttctgcagatcatgtactacagacgtgcggcctatttccgggtcgagacctgtttgccctctgtgtaaaaaacccttcaaaaaggaaaatatcaggcccgtttggcagctggctagcctggtcgaaaacattgagcgactgaaggttgacaaggggaggcagcccggcgaggtcacaagagaacagcaggatgctaaactgtgcgaaaggcaccgcgaaaagttacattattactgcgaagatgacggtaagctcttgtgtgtcatgtgcagagagtcaagagaacatagaccgcataccgcagtgttgatggaaaaggcagctcagcctcatagagaaaagatcttgaatcacctgtccaccctgcggtag

SEQ ID NO: 25431 - DNA, 432 bp, Artificial Sequence
  Description of Artificial Sequence: Synthetic coding sequence
tgaacccggcacttcaaggagagcatcaagttcatccacgagtgcaggctgcgaggcgaaagctgccttgtccactgcctggctggagttagtcgatctgtgacattggtgatcgcctatatcatgacagtaactgatttcggatgggaggatgccctccacactgttagagccggacgttcttgcgcaaaccctaacgtggggtttcagcgccaactgcaggagttcgaaaagcatgaggttcatcagtaccgtcagtggctgaaagaagagtacggcgagtcgccgcttcaggatgcagaggaagccaagaatatcctgggaaaatataaggaacagggccggaccgagccccagcccggcgccagacgttggtcctcattcccagccctggcaccgctgacctacgataattatacaacggagacctag

SEQ ID NO: 25432 - DNA, 495 bp, Artificial Sequence
  Description of Artificial Sequence: Synthetic coding sequence
atggtgaacagcgtgatcttcttcgacatcaccgtggacggcaagccattagggcgcatttccattaaacaattcgcagataagatcccaaagacagcagaaaactttcgggcactctcaactggagagaagggttttagatataaaggatcttgtttccaccgtattattcctggctttatgtgtcagggcggtgactttactcaccccaatgggacgggcgataagagcatatacggtgagaagttcgatgatgagaatctgattaggaagcatacaggttccgggatactctctatggccaatgccggcccaaacactaacggctcacaattcttcatttgcacagcgaagacagaatggctagacgggaagcacgtcgcttttgggaaagtgaaagagcgagtgaatattgttgaagccatggaacactttggttatcgcaatagcaaaacatcgaaaaagattacaattgctgactgcggtcagttttag

SEQ ID NO: 25433 - DNA, 468 bp, Artificial Sequence
  Description of Artificial Sequence: Synthetic coding sequence
atgagcgagggcgagagccagaccgtgctgagcagcggcagcgacccgaaggtggaatcatccagcagtgcccccggcctcacctccgtgagcccacccgtgacctctacaacaagtgcagcttccccagaggaggaagaggaaagtgaagatgaatcagaaattctggaggagtctccctgcggaaggtggcagaagaggagagaagaggttaatcagaggaacgtccctggaatcgattccgcctacttggccatggatacagaagagggagtagaggtggtatggaacgaggtgcagttttccgaacggaaaaattacaagctgcaggaagagaaagttagagccgtttttgataatttgatccagctcgagcacctgaacatcgtaaaattccacaagtactgggcagacatcaaagagaataaggctcgggtaattttcatcaccgagtatatgagttcatag

SEQ ID NO: 25434 - DNA, 837 bp, Artificial Sequence
  Description of Artificial Sequence: Synthetic coding sequence
atgtggcccttccccagccggagcctgttccccccccccacccaggcttggctgcaaactgtcagttctgaccctgaagctcagggatggggagcgtggaacgaaactaaagaaatactgggcccagaagggggcgagggtaaggaagaaaaggaggaagaagaagatgccgaggaggatcaagatggagacgctgggttcttactatcattgctcgagcaggagaacctggcagaatgtcccctccctgaccaggagctggaggctatcaagatgaaagtgtgtgcgatggagcaagccgagggcaccccccgcccaccgggtgtgcaacaacaggccgaagaagaagaaggtactgctgctggccaattactctctccagaaaccgtgggttgcccactttcgggcacgcccgaggaaaaggtggaagccgatcaccggtccgtgtacgtaggaaatgtcgattatggaggatctgcggaggaattagaagctcactttagccgctgtggcgaagtgcatagggtaaccatcctgtgcgacaagttctccgggcatccgaaggggtatgcctacatcgaatttgcaaccaagggctctgtccaggctgccgtcgagctggaccagtccctgttccgaggacgcgttattaaggtcctaccgaaaagaacaaattttccaggcattagctctaccgatcgtggaggactgagaggacatcccgggtccaggggcgcgcccttcccacattcagggctgcagggaaggccgcggctgaggccccagggacaaaatcgggcaagggggaaattctccccttggttttcaccatactag

SEQ ID NO: 25435 - DNA, 132 bp, Artificial Sequence
  Description of Artificial Sequence: Synthetic coding sequence
atgagcgagcagggcgacctgaaccaggccatcgccgaggagggcggcaccgagcaagaaacagcaacccccgaaaacggaatagtcaagtccgaatctctggacgaggaggaaaagctggagctgcagtag

SEQ ID NO: 25436 - DNA, 390 bp, Artificial Sequence
  Description of Artificial Sequence: Synthetic coding sequence
atggccgacgaggagctggaggccctgcggcggcagcggctggccgagttgcaagcaaaacatggcgaccccggggacgctgcccagcaggaagcaaaacacagggaggcggagatgcggaacagcattcttgctcaggtcctggaccagagcgcccgcgcgcgactgagtaaccttgcccttgttaaacccgagaagaccaaagccgtagagaattatttgatacagatggcgcgctatggccagctgtccgagaaggtttcacttgattcgttggaagaactctactgctatttgctctatcaaaatatggcttccaagggacagctgcacctgcactggattaccgagttcctgctgaccctgagaagaaactgttggcgggaatag

SEQ ID NO: 25437 - DNA, 2286 bp, Artificial Sequence
  Description of Artificial Sequence: Synthetic coding sequence
atgcggaagcaggaggtgcggaccggccgggaggccggccagggccacgggaccggctcccccgccgagcaggtgaaggcactgatggacctgttagctggaaagggctcccaggggtcgcaagcaccacaggcccttgaccgtactcctgacgctccactgggaccttgctccaacgattcccgcatacagaggcataggaaagcccttcttagcaaggtgggggggggcccagaactggggggcccttggcacaggctggcaagcttgctattggtggaagggctgaccgatttacaattacgggaacacgatttcacgcaggtagaagcgactaggggaggaggccatcctgcacggactgtcgctctcgacaggctatttctgccgctgtctcgtgtgagtgtcccaccacgtgtgtctattacaattggggttgcagggatgggtaagaccacccttgtacgccatttcgtcagattgtgggcgcatgggcaagtagggaaggatttcagcctggtgctccccttaaccttcagggacctcaacacccacgagaagctttgcgccgaccgattaatctgttcagtattcccccatgttggagagcccagcctggccgtggctgtgccagccagggctctgctcatcctggacggtctagatgaatgcaggaccccacttgatttcagtaataccgtcgcatgtacagaccctaagaaagaaattccagttgatcacctaattacaaatatcattcggggtaatctgtttcctgaggtgtctatttggatcacctcccgtcccagcgcctccggacagataccaggaggtcttgttgatagaatgaccgaaatcaggggcttcaatgaggaggagatcaaagtgtgtcttgaacagatgtttcctgaagaccaagccttgcttggatggatgctgagtcaggtgcaggcagaccgtgctctgtatttaatgtgtacagtgccagcattttgcaggctcacagggatggccctggggcacctgtggcgcagcagaaccggccctcaagacgccgagctgtggcctccacggaccttgtgcgagttgtattcatggtattttcgaatggcactttccggagagggccaagagaagggaaaagctagcccacgcatcgagcaagtcgcccatggaggcagaaagatggtgggtacgctgggtaggctcgcctttcatggcctcctgaagaaaaaatatgtcttctacgagcaggacatgaaggcctttggggtggatctggctctgcttcagggagctccctgtagctgtttccttcagcgcgaggagacacttgccagctctgtagcctactgtttcacacatctgagcctccaggagttcgtggccgcagcttattattatggagcttcacggcgggccattttcgacctgtttacggagagcggtgtgagctggccgcgccttggctttcttactcattttcgcagcgccgctcagagggctatgcaagccgaggacggaagactggatgtatttttgcgcttcctgagcggtctgcttagtccaagggtgaatgcattgctggcaggatccctcctggcccagggcgagcaccaagcgtaccgaacgcaggtggccgagctgttacagggctgcctccggccggatgcggcagtttgtgcccgggcaatcaacgtgttgcactgtctccatgaactgcagcataccgagcttgcccggagcgtagaggaagctatggagtccggcgcgctggcccggctaacaggacctgcccaccgggctgccctggcctacctgctgcaggtgtctgatgcctgtgcacaggaggccaatctttccctgagtctatcgcagggcgtccttcaatcgctacttccacagctgctttattgccgcaagcttcggcttgacacaaatcagttccaagaccctgtcatggagctcctgggaagcgtacttagtggtaaagactgcaggatccagaaaatctcactggccgagaaccaaattagtaacaagggcgccaaagccctggcccgctccttactggtcaataggtccttgacctccctggacttacgtgggaacagcattggaccccagggagcgaaggctctggccgacgcccttaagatcaataggacacttactagcctgagagttaagtttatgtatcacaaaatcgattgtttccgccgcgtgcctgaggctgatgcttgcaaccctagcacgctagggggccagggaagatggatcacttag

SEQ ID NO: 25438 - DNA, 474 bp, Artificial Sequence
  Description of Artificial Sequence: Synthetic coding sequence
atggccaccagcgcccccctgcggagcctggaggaggaggtgacctgctccatctgtttggattaccttagggaccctgttactattgattgcgggcatgttttttgtcggagctgtacaaccgatgtccgccctatttccgggtcacggcctgtttgccctctctgtaagaagccctttaaaaaggagaacattcggcctgtgtggcagctggcttccttagtggagaacattgagagattgaaagtggacaaaggaagacagcccggtgaggttacaagagaacagcaagacgccaagctttgtgaaaggcatcgcgagaagctgcattactactgcgaggatgatggcaagctattgtgcgtgatgtgccgggaatccagagaacaccgtccacacactgccgtcctaatggaaaaggccgcccagccccatagagagaagattctcaatcacctgtctaccttgagatag

SEQ ID NO: 25439 - DNA, 1473 bp, Artificial Sequence
  Description of Artificial Sequence: Synthetic coding sequence
atgaccatcggccggatggagaacgtggaggtgttcaccgccgaggggaaagggcgaggtctaaaggccacaaaagaattctgggccgccgatatcatatttgccgaaagagcatatagcgcagtcgtgttcgactctctcgtgaactttgtgtgccacacctgcttcaaacggcaggagaaactgcacagatgcgggcagtgtaagtttgcccactactgcgatagaacctgtcagaaggatgcttggctgaatcacaagaatgagtgttctgcgattaagcgctacggaaaggtgcccaacgaaaacatccggttggcggcacggatcatgtggagagtcgaaagggaagggacagggttaaccgaggggtgtctggtatcagttgatgacctccagaaccatgtggagcattttggggaggaggagcaaaaagatctgcgagtcgatgtcgacaccttccttcagtactggccaccccagagccaacaattctctatgcagtatatcagtcacatctttggcgtgattaactgtaacggatttacccttagcgaccagcgcggtttgcaggccgtgggcgtcgggatctttcccaacttgggcttagtgaatcatgactgctggcccaattgcacggttatctttaacaacgggaaccacgaggcggttaaatctatgttccatacgcagatgcgtattgaactacgtgccctaggcaaaatcagcgaaggtgaggagctaacagtctcgtacatcgacttcttgaatgttagtgaagagaggaagagacagctgaagaagcagtactattttgactgtacctgtgaacattgccaaaagaaactgaaagatgacctgttcttgggtgtgaaggataatcctaaacctagccaagaagtagtgaaggagatgattcagttctccaaagatactttggaaaaaattgataaagccaggtccgaaggcctctatcacgaggtggtgaagctttgtagggagtgtctggagaagcaggaacccgtcttcgccgacactaacatttacatgctgagaatgttgtccatcgtttctgaagtcctcagctacctccaggcatttgaagaagcgtctttctacgcacggcgcatggtagatggctacatgaaattataccacccaaacaatgcccagctgggtatggcagttatgcgcgccgggcttaccaactggcacgcagggaacatcgaggtcggtcatggaatgatttgcaaggcctatgctatcctcctggtgactcacggcccttcacacccaataaccaaggatctggaggcaatgagggttcagaccgaaatggagctgcggatgttcagacagaacgagttcatgtactacaaaatgagggaggccgctttgaacaaccagccgatgcaggtgatggcggagcctagtaatgagccatcaccggcgctcttccacaaaaagcagtag

SEQ ID NO: 25440 - DNA, 1491 bp, Artificial Sequence
  Description of Artificial Sequence: Synthetic coding sequence
atgtggggccggttcctggcccccgaggccagcggccgggacagcccagggggagctaggagcttccccgcaggcccagactattcctccgcctggctaccggccaatgagagcctctggcaggcaaccacggtgccttctaatcacaggaacaatcacatcagaaggcacagtatagcttctgatagtggcgacaccgggatcggaacaagctgttccgattctgtagaggaccattccacatcttcaggtacattatctttcaaacctagccagagcctgattactcttcctactgcccacgtgatgccaagtaattccagcgcaagtattagcaagctgagagaatctctcacacccgacggttccaagtggagcacatctcttatgcagacgctgggcaaccattcacgaggcgagcaagactcttcactggacatgaaagacttcaggccccttcgcaaatggagcagcttgtccaagctgactgccccggacaactgcgggcagggaggcacggtgtgtcgcgaggagagccgaaacggcctcgaaaagatcggcaaagctaaagctcttacgagccagcttaggaccatcggaccttcctgcctgcatgacagtatggaaatgcttaggttggaagacaaagagattaataaaaagcgatcctctaccctcgattgtaaatacaagttcgaatcttgttctaaggaggatttcagagccagtagctcaaccctgcgaaggcagccagtggacatgacatattcggcgcttcctgagtccaaacccatcatgactagtagcgaggcttttgaacctcctaagtacttgatgctgggtcagcaggcagtaggcggagtccccatccagccctccgttcgtacccaaatgtggctcacagagcaactgcggactaatcccctggaaggaagaaacaccgaggactcttatagcttggcaccctggcagcagcagcaaattgaagatttccgtcagggatctgaaacacctatgcaggtgctcactggatcatcccgtcagagctactctcctggctaccaggatttttccaagtgggagagcatgttgaagatcaaggaaggcctcctgcggcaaaaagaaattgtaatcgatcggcaaaagcaacagattacccacctgcacgagaggatccgagacaacgagctccgggcccagcatgccatgctgggccattacgtgaactgcgaggactcttatgtggcaagcctgcaaccccagtacgagaacacctctctccagacgcccttctctgaagagagcgtctctcactcacagcaaggggagtttgagcagaagctggcctctaccgaaaaggaagtgctccaactcaacgaatttcttaagcagcggctatcactgttctcagaggagaaaaagaaactggaggagaaagttggtttttctaataaagtagaactcggccaacagcactttctctccatatag

SEQ ID NO: 25441 - DNA, 1083 bp, Artificial Sequence
  Description of Artificial Sequence: Synthetic coding sequence
atggccgagctgcagcagctgcaggagttcgagatccccaccggccgggaggccttaaggggcaaccactccgctctcctgcgcgttgccgattactgcgaggacaactatgtgcaagcaacggataaacggaaggccttagaagagactatggctttcaccacacaagccctggcttcagtggcttatcaggtgggcaacttagctggtcacacactgaggatgttggacctacagggggcagctctaaggcaggtggaagctcggatggtgaatatgcacatggagaaagtggcccgaagagaaatcggaactctcgcaaccgtgcagcgcttgccacctgggcaaaaagtgatcgcccctgaaaacctgcctcctttaactccatattgccgacgccccttgaatttcgggtgtctggatgatattggccacggaataaaggacctgtccacgcagctcagccgcacaggcacactaagcagaaagagcatcaaggcccccgccactccagcttcagccacactgggccgccccccacgcataccagagcccgtccacctgcctgttgtccctgacggtcgcctttccgcagctagctccgcattcagcctcgcctctgccggaagcgcagagggggtaggtggagcccctactcctaagggacaagccgctcctcctgcccccccccttcctagctcactcgatccacccccacccccagctgcagtcgaagtgtttcagcggccacctacccttgaagaactatcccctcctccccctgatgaggagttgcccctgcctctggatctgccgccgccccctccccttgatggggatgaactcgggttgcctcctccaccgcccgggttcggacccgatgaaccctcctgggtccctgcttcctacttagaaaaggtggtaacgctgtatccctatacgtcccagaaagataacgagctgtccttctccgagggcacagttatttgcgtgactcgtcggtacagcgatggatggtgcgagggcgtatcatctgagggaactggcttctttccaggaaattatgtcgagccatcctgttag

SEQ ID NO: 25442 - DNA, 201 bp, Artificial Sequence
  Description of Artificial Sequence: Synthetic coding sequence
atgctgcggtgcggccagatgatcttcgcccaggccctggtgtgccgacacctggggcgcgactggaggtggacgcagcgaaaacgacagcctgattcttatttctcggtattgaatgcttttatagatagaaaagactcctattatagcatacatcagatcgcccaaatgggagtgggtgaaggtaagagtatcggctag

SEQ ID NO: 25443 - DNA, 1476 bp, Artificial Sequence
  Description of Artificial Sequence: Synthetic coding sequence
atggagcagccccccgcccccaagagcaagctgaagaagctgagcgaggatagcctgacaaaacagcccgaagaagtgttcgacgttctcgaaaaactgggagagggaagttatggatctgtgttcaaggctatccacaaggagtctgggcaagtcgtagcaatcaagcaggtccccgtggaatctgatctgcaggaaataatcaaggaaattagtataatgcagcaatgcgacagcccctatgttgtgaagtactacggatcctacttcaagaatactgatctgtggattgtaatggaatactgcggcgcgggatccgtgtccgacatcattagactgcgcaataagactttaatcgaagacgagattgcgactatcctgaagagcaccctgaaggggttggagtacttgcatttcatgaggaaaatccacagggacatcaaagcgggcaatattctactgaacactgagggtcacgctaagctcgcggattttggagtggccggtcaactgacggataccatggcaaagcgaaataccgttatcgggacccctttctggatggcacctgaggttatccaagaaatcggctacaattgtgttgccgatatttggagcctgggaattacctccattgagatggcggagggcaaacctccttacgctgatattcatcctatgcgcgctatctttatgataccaaccaatccaccgccaacctttcgtaagcctgaactatggtctgatgattttacagactttgtgaaaaagtgtctggtcaaaaaccctgaacagcgggcgactgcaactcagcttcttcagcatcctttcatcaagaacgccaagcctgtctccatcctgcgcgacctcataaccgaagccatggaaataaaagctaaaaggcatgaagagcaacagagggaactggaggaagaagaggaaaatagtgatgaagacgagctcgattcccatactatggtgaagacatccgtggaatctgtcgggactatgcgagccacgtcaaccatgtctgaaggggctcaaacgatgattgagcataatagtactatgctcgagtcagatctaggcactatggtgatcaattccgaggacgaagaagaggaagacggcactatgaaacgcaatgcaacctccccccaagtccagcgtcccagtttcatggactatttcgacaaacaagactttaagaacaagtcccatgaaaactgcaatcaaaacatgcacgaaccctttccaatgtctaagaacgtgttcccagacaattggaaggtcccccaggatggtgacttcgactttctgaaaaatttaagcctcgaagagcttcaaatgcgtctgaaggcactggacccaatgatggaacgggaaatcgaggagctgagacaaagatatactgccaagcgacaacctattttagacgccatggacgcgaaaaaacggcgtcaacagaacttttag

SEQ ID NO: 25444 - DNA, 126 bp, Artificial Sequence
  Description of Artificial Sequence: Synthetic coding sequence
atgagcagcaagggcagcagcaccgacggccggaccgacctggccaacggcagtctaagttcttcaccggaggagatgtcaggcgctgaggaaggtagggagacatcgtctgggatcgaggtgtag

SEQ ID NO: 25445 - DNA, 945 bp, Artificial Sequence
  Description of Artificial Sequence: Synthetic coding sequence
atgcccaacgtggccgagaccgagcggagcaacgacagcggcaacggggagcataagagcgaacggaagtctcctgaagagaacctgcagggcgccgtgaagtctttctgcacgtcagcctcaggtgcccctctcggtcccaagggggatggacactacccatggtcctgtcctgtgactcacactcgtgagaagatctatgccatctgctcggactatgcctttctaaatcaggcaacttccatatataagacaccaaacccctctagatcaccctgtctccctgacagtacgtccctgagcgccggaaataatagtagcaggtacatagggatccccacatcaacgtcagagattatctataacgaggagaactccctcgaaaatctgtcgaactcccttggaaagctgccacttgcctgggaaatcgacaaatctgagtttgacggagttacaacgaactctaaacataaaagcggtaatgccaaaaagcaggtcagcaagcgcaaaacttccgacaagaaaggccgctatcagaaggagtgtccccagcattctccacttgaagatattaaacagcggaaagtcctggacctccggagatggtattgtatcagtcgtcctcagtacaagacatcttgtgggattagcagcctcatctcatgctggaactttctgtattccactatgggcgcgggtaacctgccgccgataacccaagaggaggccttgcatattctgggctttcaacctccctttgaggacatccggtttggacctttcactggcaacactactttgatgaggtggtttagacagataaacgatcactttcacgtaaagggctgctcttacgtgctttataagccccacgggaaaaacaaaaccgctggggaaaccgctggtgacctgtctcatcaccggaagcttaacatagggtcatag

SEQ ID NO: 25446 - DNA, 1500 bp, Artificial Sequence
  Description of Artificial Sequence: Synthetic coding sequence
atgcccgagatccgggtgacccccctgggcgccggccaggacgtgggcaggtcatgcatactggtgagtattgccgggaagaatgtgatgctcgattgtggcatgcacatgggattcaatgacgacgtggatgacgagctggaaatcaaagcatactatgccggccacgtgttaggcgccgcaatgttccaaatcaaagtaggctcagagagtgtcgtgtatacaggtgactacaatatgacacccgataggcacctcggagccgcctggattgataagtgtcgaccaaacctactgatcactgaatccacatatgcgaccaccatccgggatagcaagcgctgtcgggagagggacttcctgaagaaagtgcatgagaccgtggaacggggcggaaaagtgctcataccagtcttcgcccttggacgagcccaggaattgtgcattctcctcgaaactttttgggaaaggatgaatctgaaggtaccaatatactttagcacgggtctcaccgaaaaagccaaccactattacaagttgttcatcccatggaccaaccaaaaaattcggaaaaccttcgtgcagagaaacatgttcgagtttaagcacatcaaagcgttcgaccgggcttttgccgacaaccccggaccaatggtagtcttcgccacacccggcatgttgcatgctggccagtctctgcagatttttaggaagtgggcaggaaatgagaagaatatggtaataatgccaggctactgcgtgcagggtacggttggccataaaatcttgtcagggcagagaaaactcgaaatggagggtagacaggtgcttgaggtgaaaatgcaggtggagtatatgtccttctccgcccacgctgatgccaagggcatcatgcagttagttgggcaagctgagcctgagagtgtcttactggtccacggggaggccaagaagatggagttcttaaagcagaaaattgagcaagagctgcgcgtgaattgttatatgcctgcgaatggagaaacagtaactctgcccactagtcccagtatccctgtgggaatctctctaggactgcttaagcgggaaatggctcagggtctgctacccgaggcaaagaagcccaggctcctgcacgggacgcttattatgaaagattccaatttcagactcgtgtccagtgagcaagcactgaaggagcttggcctggccgagcaccagttaaggtttacttgtcgcgtccacctccatgacacccgcaaggaacaggaaaccgcactgcgggtctactcacacctaaagtcggtactgaaggatcactgtgtccagcacctcccagacggctccgtaaccgtcgagagcgttctgctgcaagcagcagcgcccagtgaagaccctggaaccaaggtcttgctggtgtcttggacctatcaggacgaggagctgggatctttcctgacttctctgctcaagaaggggctgccccaggcgccgagctag

SEQ ID NO: 25447 - DNA, 396 bp, Artificial Sequence
  Description of Artificial Sequence: Synthetic coding sequence
ggcaccatcagctgcagcaccggcaccctgcagcggcggaacctgggcccagagcggcagacaggtctgctgctgttaggtatgaaggagaaccaggagctgaagacgatccaggcaaacctgtcacggcagcgcgtggaacatcagtgcctgtcttcagaagagctcaaacagagattcccaaacatccgcctccctaggggcgaggtaggcctgcttgataattctgggggagtgatttacgcgtacaaagccctgagagcgctccaggatgctatccggcagttgggtggaatcgtgcgggatggcgaaaaagtcgtagagatcaacccaggtttgctggtcaccgtgaagacaaccagccggtcctaccaggcaaaatcactcgtcatctag

SEQ ID NO: 25448 - DNA, 687 bp, Artificial Sequence
  Description of Artificial Sequence: Synthetic coding sequence
atgagccgggagcggggcagccggagcgaggagcccggcgccggcaacagggaatcggggagccgcgagccaggtctggccgccgcggcaatgtccactgtggacttagccagggtgggcgcgtgcattctgaaacacgcggtgaccggggaggcggttgagctgcggtccctgtggcgggagcatgcctgtgttgttgccgggctgcgtaggtttggttgcgttgtgtgcaggtggatcgcccaggatttaagctctctcgccggcctgcttgatcagcatggagttaggctagttggcgtcggccccgaggcactcggactgcaggagttcctggacggcgactactttgcaggcgagctgtacttggacgaaagtaaacagctgtacaaggaactaggatttaagcggtacaattcactgtcgattttgcctgcagcactgggaaaacccgtgcgcgacgtcgccgctaaggctaaagcggtcgggatccaagggaatctgagtggggacctgttgcagagtggtggcctgctagtcgtgtctaagggaggcgataaagttcttctccatttcgttcagaaatctccgggagactatgtgccaaaggaacatattctccaggttctcgggatttccgctgaggtgtgcgcttccgacccgcctcagtgtgaccgggaagtgtag

SEQ ID NO: 25449 - DNA, 654 bp, Artificial Sequence
  Description of Artificial Sequence: Synthetic coding sequence
atgaacttcagcgaggtgttcaagctgagcagcctgctgtgcaagttctcccctgatggaaaatacctagcctcttgtgtgcagtatcgtttggtcgtccgagacgttaatacacttcagatactgcaactatacacctgtctggaccagatccagcatattgagtggtccgccgactccctcttcatactatgtgccatgtacaagcgagggcttgtgcaggtgtggagcttggaacaacccgaatggcactgcaagattgatgagggttccgccggcctggtcgcttcctgttggtcacctgatggccgacatatcctgaataccacagagttccacttaaggattacggtctggtccctgtgcacaaagtccgtgagttatataaagtaccccaaggcatgcctgcagggcataacctttacacgggacggccgatatatggcattggccgagcgtcgagattgcaaggactacgtcagcatctttgtgtgtagcgactggcagcttctcaggtacaagattctgctctacagcttggacggtcggctgctgagcacttattccgcttacgaatggtctcttggtataaaatcagttgcatggagcccctcatctcaatttctggcggtgggctcatacgatggtaagtag

SEQ ID NO: 25450 - DNA, 483 bp, Artificial Sequence
  Description of Artificial Sequence: Synthetic coding sequence
atggaggccgagcggccccaggaggaggaggacggcgagcagggccctccacaggacgaagagggctggccaccgccaaacagtactacccgaccttggcgcagtgcccctccatcaccacctcctccgggcacacggcacacagcgttaggaccccggtcggcctcactgctgtcgcttcagaccgagctccttttggacctggtcgcagaagctcaaagcaggagacttgaagagcagcgcgctacattctacaccccacagaacccctctagtttggcgccggctcctctcaggcctctggaagaccgggaacagctctactcaaccattctttcccatcagtgccaaagaatggaggctcaacgtagcgaaccacccctgccacccggagggcaggaattactggagctcctgttacgcgtccaaggaggcggccgaatggaggaacagcggagtagacctcccactcatacttgctag

SEQ ID NO: 25451 - DNA, 951 bp, Artificial Sequence
  Description of Artificial Sequence: Synthetic coding sequence
atggaggagaacaacctgcagtgcagcagcgtggtggacggcaactttgaagaagtgcctcgtgagactgccattcagtttaaaccacccctgtacaggcagaggtaccagttcgtgaagaatttggtggatcaacacgaaccgaaaaaggtggctgatctgggctgcggagatacctctctgttgaggctgcttaaggtgaatccatgtatcgagctgctggtcggagtggacataaacgaggataaactccgctggcgcggcgacagcctggccccctttctgggtgacttcctgaaaccaagagatctgaatttgaccatcaccctgtatcacggctctgttgtggagcgagatagcaggcttctggggttcgatctgattacttgtatcgagttgatcgagcatctggacagtggagatctggctcgattcccagaggtggtgttcggctatctgagcccttctatgatcgttatttccactcctaactccgaattcaaccctctgtttccaagtgtcaccttaagagattcagaccataagttcgagtggacgcggatggagttccaaacttgggcactgtatgtggcgaatcgctacgattactcagtggagttcaccggcgtgggcgagccaccagccggagctgaaaacgtgggttactgtacccagattgggattttccgaaaaaacggaggtaaggccaccgaaagttgtttaagcgagcaacacgaccagcatgtgtacaaggctgtattcaccacgtcctatccttcactgcaacaagagagattctttaaactcgttttagtcaacgaagtatcacagcaagttgagtctctgcgagtttcacatctgcccaggcggaaggaacaagcaggcgagcggggtgacaaacccaaagacattggcggatccaaagcccccgtcccttgtttcgggccctag

SEQ ID NO: 25452 - DNA, 1056 bp, Artificial Sequence
  Description of Artificial Sequence: Synthetic coding sequence
atgtggaccccccggcccgccctgcacgtgcacgtgatcctgtactctcccatccaccgctgctacgctcgagcagaccctactatgggccgcatctgggtggatgcagccgtgccctgcctcgaagagtgtggttttctgttacacttccgtgatggctgttaccatcttgagacaagtacccaccatttccttagtcatgttgacaggctcttctcccagccatccagtcagaccgcctttcacatgcaagtgcggcccggcggcctcgtcgctctgtgcgacggagagggtggcatgctctacccccagggaacccacttgttactcggtatgggctgcaaccctatgcgtggggaagagtggttcattctacagcactgccccacctgggttagcctccgcagcaagaccggccggttcattagcgtgatttacgatggcgaggtgagggctgcgtctgagaggctgaacaggatgtcgctctttcagtttgaatgtgactccgagagccccaccgtgcagcttaggtccgccaatggatactacctgtcacagcgaagacacagggctgtgatggctgacgggcaccccctagagtctgataccttctttcgcatgcattggaattgcggccgaatcatcttgcagtcttgtaggggaaggttcttaggtattgctcctaattcccttttaatggccaatgtgatcctacctggaccgaacgaggaatttgggatcctttttgcgaatagaagctttttggtgttacgaggccgatacggctacgtcggctcctcctccgggcacgacctgatccagtgcaaccaggaccagcccgaccggattcatcttctgccgtgtcgccctgggatctaccatttccaaggaggtatacttctcgtaaacaatattctgtggcatctaagcccactcggacaggtgtgtccacagctgctgtatagagctagtggtgagcaattgacccactgtacagggccgcaatggctcctccatgcaagcaggccaaaatggcacccggtcggcaggcagtag

SEQ ID NO: 25453 - DNA, 333 bp, Artificial Sequence
  Description of Artificial Sequence: Synthetic coding sequence
atgcagatcagcagcgagaaggaggaggacgacaacgagaagcggcaggaccccggtgataactgggaggaaggagggggggggggtggggggatggagaagtcaagcggtccctggaacaagaccgcccccgtgcaggctcccccagcccccgttatcgttactgaaactcctgaacctgctatgacatccggcgtgtatcgacctcctggagctcggttaaccaccactcgtaaaactccacagggccctcctgagatatacagcgatactcagttcccctctctgcaaagcacagctaagcacgtagagagccgcaagtacctgaaatag

SEQ ID NO: 25454 - DNA, 972 bp, Artificial Sequence
  Description of Artificial Sequence: Synthetic coding sequence
atggagggccacgaccccaaggagcccgagcagctgcggaagctgtttattggtggcctgtcattcgagaccacagacgactccctacgtgagcacttcgagaaatggggcactctgaccgactgcgtagttatgcgggaccctcaaaccaaaaggagtcgcggttttggattcgtgacctacagctgcgttgaagaggtggatgctgccatgtgcgccagaccccataaagtggacgggcgggtcgttgagcccaaacgcgcagtcagcagagaggattctgttaaacctggagcccatctgaccgtcaagaagattttcgtgggcggtattaaggaagatacagaggaatataatctcagagactactttgagaaatacggcaaaatagagactatcgaggtgatggaagatagacaatccgggaagaagcgaggattcgccttcgtgacgttcgatgaccatgacaccgtcgacaaaattgtggtgcagaagtaccatactattaatggccacaactgcgaggtgaaaaaagccctgtctaagcaggagatgcagtcggctggctcacagcgtgggcggggggggggatccggcaatttcatgggtaggggtggcaattttggcgggggtggcggcaacttcggcagaggcgggggtaattatgggggcggacctggttacagttcacggggaggctacggaggaggcgggccaggctacggcaaccaggggggcggttacggggggggcgggggttacgacgggtacaacgaaggaggtaattttggagggggcaattacggcggtggcggtaattataatgatttcggaaactacagcggtcagcagcagtctaactacgggcctatgaaagggggatcttttggcgggcgatccagtggatcaccctacgggggaggatacggatctgggggtggatcaggggggtacggctcacgcaggttctag

SEQ ID NO: 25455 - DNA, 291 bp, Artificial Sequence
  Description of Artificial Sequence: Synthetic coding sequence
aacatccagctggtggccgacggctgctgcaacctgcagaagcagatacagataactcaactcttcggcgtgccagtagttgtagcactaaacgtgtttaagaccgatacaagggcagaaatagaccttgtatgcgagctggctaaaagagctggggcatttgatgctgtgccttgctatcattggtccgttgggggaaaaggcagtgtcgacctagcacgggcggtgcgggaagccgcatccaagcgctcccggttccagtttctttacgacgtgcagcccttcagttag

SEQ ID NO: 25456 - DNA, 483 bp, Artificial Sequence
  Description of Artificial Sequence: Synthetic coding sequence
atgaccgacgtgcccgccaccttcacccaggccgagtgcaacggcgataaacctccagagaatggccagcagaccatcactaagatttccgaagaactcactgatgtagattctcccttgcctcattacagagttgaaccgagtctggagggcgccctgaccaagggctcccaagaagaacggcggaagcttcagggaaatatgctcttgaactcctccatggaggacaagatgctgaaagagaacccagaagagaagctgttcatcgtacacaaggctatcacggacctgagcctgcaggagacttcagccgacgagatgacttttagggagggccaccaatgggagaagatccccttatctggcagcaatcaggagattcgaaggcaaaaagagcggatcacagaacaacctttgaaggaggaagaagacgaagatcggaagaataaaggtcaccaagctgcagaaatcgagtggctctag

SEQ ID NO: 25457 - DNA, 480 bp, Artificial Sequence
  Description of Artificial Sequence: Synthetic coding sequence
atggccaccagcgcccccctgcggagcctggaggaggaggtgacctgttcaatctgcctggattatctgcgcgatcccgtgaccattgattgcggccatgttttttgcagatcctgcactactgacgtccgacctatcagcggatctagacctgtctgtcccttatgcaagaaacctttcaagaaggagaatatcagacccgtctggcaattagagaaaattctcaatcacctttcaaccttgcggcgtgaccgcgataagattcagggcttccaggctaagggcgaggccgatattttggccgcgctgaaaaaactgcaagaccaacgacagtatattgttgctgaatttgaacaagggcatcagttcttgcgagaacgcgaagagcacctgcttgagcagctcgccaagcttgaacaggaactaactgagggcagggagaagtttaagagtaggggcgtcggggagttggctcgctag

SEQ ID NO: 25458 - DNA, 432 bp, Artificial Sequence
  Description of Artificial Sequence: Synthetic coding sequence
atggacagcagccagcagaagaccttccggggccacgacgcccccgtgttgagcttatcctttgatcccaaggatatcttcttagcgagcgccagttgcgatgggtctgtgcgcgtttggcagatatccgaccagacatgtgcgatcagctggcccctgttgcaaaagtgcaatgatgttattaacgcaaagtctatctgccgcctcgcctggcagccaaagtccggtaagttgctagccatacctgtcgagaagtctgtcaagctgtaccgccgcgagagttggtctcaccagttcgatctgtctgacaacttcattagccaaacgctgaacatagtgacatggagtccatgtggacagtacctggcagctggctctattaatgggctgattatcgtgtggaacgtcgagactaaagattgcatggagtag

SEQ ID NO: 25459 - DNA, 2109 bp, Artificial Sequence
  Description of Artificial Sequence: Synthetic coding sequence
atgaccgagcggtgcagcctgtggagcgccctgagcgccgccgcctgctgcttctatcgcgggtctttcgtccaggttcagttttcaaaggagaaatacatcctggattcctcacctgaaaaattacataaggagctcgaggaagagcttaaactgagcagcacggatttgcgttcccatgcctggtatcatggtcgaattcctcgagaagtgagcgaaaccttggttcaaagaaatggggattttctgattcgggatagtctgacctccttaggtgattacgtgcttacctgccgctggagaaaccaggcacttcattttaaaatcaacaaagttgttgtgaaggcaggggagtcttacactcacatccagtatcttttcgagcaggagagtttcgaccacgtgcctgccctcgttcgctatcatgtggggtcccggaaggccgtgtccgaacagtccggggctattatatattgtccagttaataggacatttcctctccgataccttgaagctagctacggccttggccagggcagcagcaaaccagcctccccggtctcacctagcggacctaagggctcacatatgaagcgacgctctgttactatgaccgacggactgacagcagataaggtaacccgcagtgatggctgccccacctcgacaagccttccaagaccacgcgactccatcaggagctgcgcactctctatggaccaaatccctgacctgcactctccgatgtcacctatttccgaatcgccttctagcccggcctattctactgtcaccagagtgcacgcagctccagccgcgccaagtgctaccgctcttccagcgtccccagtagccaggcggagttctgagccccagctgtgccccgggtcagccccgaaaactcatggcgagtccgacaagggcccgcatacgagcccaagtcatacactaggcaaagctagtccaagcccgtcactctctagctactccgacccagattccgggcattattgtcagctgcagccacctgtaagaggatcacgggagtgggccgcaaccgagacaagctcccaacaggcgagatcctatggcgagcgcctgaaagaactttctgaaaacggcgcacctgaaggagactggggcaagaccttcaccgtcccaattgtagaagtcaccagctcgtttaatcctgccacatttcagtccctcttgattcctcgcgacaatagacctctcgaggtaggactgttgcggaaggtgaaggaactgctcgcggaggtcgatgctcgcaccttggctcgccatgtcaccaaggtagactgcctggtggcccggattctcggagtgaccaaggaaatgcagacactcatgggtgtgaggtggggtatggagttactgacgcttccccacggccgtcagctgaggctggacctcctcgagcggttccatacaatgtccattatgttagctgttgatatcctaggctgcacaggttcggccgaggagagggcagcactgctgcataaaaccatccagctcgcggcagagctgagaggcactatgggcaatatgttttcgttcgctgccgtgatgggagccttggatatggcgcaaataagcaggcttgagcagacatgggtgactctccgacaacgacacaccgagggagcaatactctacgaaaaaaagctgaagccattcctaaagagtttgaacgaaggcaaggagggaccaccgctgtccaacacaacgtttccacatgtgctgccactgattactctgttggagtgtgactcggccccacccgagggacctgagccctggggttccaccgagcacggtgtcgaagtcgtgttggcacacttagaagccgcccgcaccgtggctcaccacggcggcctatatcataccaacgctgaagtgaagcttcagggcttccaagcccgtcctgaactcttagaggtgttttccaccgagttccaaatgcgactgttgtggggaagccaaggtgcatcgagttctcaagctcggcgctatgagaaattcgataaggttctgaccgctctgtctcacaaactagagccagccgtcagatcatcagagctttag

SEQ ID NO: 25460 - DNA, 585 bp, Artificial Sequence
  Description of Artificial Sequence: Synthetic coding sequence
atgaccgaggacagccagcggaacttccggagcgtgtactacgagaaggtgggattccgaggtgtagaagagaaaaagagcctggaaatcctccttaaggatgatcgtctgggcatcctcccacctcaccacgaatcccacgctaaagtgatgatgtatcgtaaggaacagtatcttgatgtcttacatgctctgaaggtcgtcagatttgtttccgacgccaccccacaggccgaagtctacctgcgtatgtaccaactcgagtctgggaaactccctcgctccccttccttcccccttgagccagacgacgaagttttcctggcaattgccaaggccatggaagagatggtcgaagatagcgtcgattgctactggattaccagacgattcgtgaatcagctcaacactaagtaccgggactctcttcctcagctgcctaaggcctttgagcagtaccttaacctggaggacgggagactcttaacacatctgaggatgtgttcagccgccccaaagcttccatacgatctttggttcaagcgatgcttcgctggatgtttaccagaatcatcactgcagtag

SEQ ID NO: 25461 - DNA, 2334 bp, Artificial Sequence
  Description of Artificial Sequence: Synthetic coding sequence
atggagcccaaggaggccaccggcaaggagaacatggtgaccaagaagaagaacctggcgtttctcagaagcagactatatatgctggaacgccgcaagactgacactgtggtcgaaagtagcgtgtcgggtgaccacagcgggaccctgcggcgctcacagtcagacaggactgagtataaccaaaaactccaggagaagatgacaccacaaggcgaatgtagcgtggcagaaacacttacgcctgaggaagagcatcatatgaaaagaatgatggccaagcgggaaaaaatcataaaggaactgattcaaactgagaaagattacctcaatgatcttgagctgtgtgtcagagaggtagtacaaccactccgaaataaaaaaacggatcgcctagacgttgacagcttgttctccaatattgagagcgttcaccagatcagtgctaagctgctgagtctgctggaggaagccactactgatgtagaacctgccatgcaagtcatcggggaggtgtttttgcaaattaagggacctctcgaggacatctataagatttactgctaccaccatgacgaagcgcatagcattctcgaatcatatgaaaaggaagaagagctcaaggaacatctgtcccactgtattcaatctctcaagaagatctatatgcaggaaggaaagccaaacctcctcgatatgggttccttaatgataaaaccaatccagagggtgatgaaatacccactgctgctttgcgaattgaggaattcaacccctcctagccatcccgattaccgggctctggatgacgctttcgccgccgtcaaagacattaatgttaatatcaacgaactcaaaaggagaaaggatctggtcttgaagtataaaaagaacgacgaggacgagagccttaaggataagctgtctaaactgaatatccactccatctcaaagaagtcaaaacgcgttactaaccacctaaaaatactgacacgaggggaatcacaggtcaaagacaacacgtttaacagagaggagaaactgttcagagccctagagaaaacggtccgcctttgcgtcaagaacatctcactctgtttacagcacattcaggatgccatgcctttggcactacaatctgtgatggatcttcaagagatatcttacaacaaagatgatgagatggactactcggaaactctgagcaacgctctgaactcatgccatgacttcgcctctcatctgcagagattaattctgacgcccctgagcgccttgctttcgttgttccctggccctcacaagctgatccagaaacgctatgacaaactgttggactgcaattcttacctccaaagatccaccggggaggaaagcgacctggccaagaaggaatatgaagctctgaacgcccaattggtggaagaactgcaagccttcaaccaggctgcacgtaaaatcctgctcaattgcctgtgcagttttataactctgctacgcgatctgatgctcgtcgcgcagcaggcctactccacactggtcccaatgcccctgctagtgtcttcgatctctgagatccaaaatcaagtgcttgaggaaatccagaatcttaattgtgtgaaggagaacagcgccacctttattgagcgcaaattgtcgttcgagaaaaagaagcccgtccagatccttccagaaatgccacaccagactgatatccatcgctcaaagttgttatccacgtattcagctgaggagctgtaccaggctaaaagaaaatgcaacgctacgcaggagtacgatattaatttactggaaggcgatctcgtggcagttatcgagcaaaaggaccctttaggttccacaagtcggtggctggtagatacaggaaacgtgaaagggtacgtatattccagcttcttgaaaccgtataatcccgccaaaatgcaaaaggtcgacgcagagaacaggttctgtgacgacgattttgagaatatcagcctgtttgtaagttccaggcctgccagcgattccgttaccggaactagtgaatcaagtataggggattctagttcctcgctttcagggacctgtggcaagttcgagactaacggaaccgacgttgacagcttccaggaggtagacgaacagatcttctatgcagtgcacgcatttcaagctagaagcgatcacgagctgagcttacaggagtatcagagggtgcatatcctgcgcttttgtgatctctctggcaataaggagtggtggcttgctgaggctcagggacaaaagggctacgtgccggcaaactacttgggcaagatgacctatgcttag

SEQ ID NO: 25462 - DNA, 543 bp, Artificial Sequence
  Description of Artificial Sequence: Synthetic coding sequence
tgaagccagcccaagagcttcgagaacagccccggcgacctgggcaattcctctctgccaacagccggatataagagggcacaaacttctggcatagaggaggagaccgttaaagagaagaagaggaagggcaataagcaaagcaagcatgggccaggaagaccaaaagggaacaagaatcaagagaatgtctcacacttatccgtgagttctgcttccccgacgagctcggtagcttccgctgccggcagtatcactagctcgagcctgcagaaaagccccaccttgctcaggaacggcagtcttcagtcactcagcgtgggctcatctcctgtcgggtcagagatctccatgcagtaccgtcacgacggagcctgtcctactacatcaatctataattccaatgacgtggccgtgtcgtttcccaatgtggtgagtggttctggcagctcaactccagtgtccagctctcatctgccacagcagtcatcgggtcacctgcagcaagtgggggcattatcaccaagcgctgtctcatcctag

SEQ ID NO: 25463 - DNA, 384 bp, Artificial Sequence
  Description of Artificial Sequence: Synthetic coding sequence
atgaccaccaagaacctggagaccaaggtgaccgtgaccagcagccctattcgcggcgccggtgacggaatggaaaccgaggagcctcctaagtccgtcgaggttaccagtggcgtacaaagtcgcaaacaccattctctgcagagcccttggaaaaaagccgtgccatcggagtccccgggcgtcctgcagcttgggaaaatgctgactgaaaaggctatggaggtgaaagcagtgaggattttagttcctaaagccgccatcacacacgacattcctaacaagaacactaaggtgaaaagtttgggacatcacaagggagaatttctgggccagtcagaaggggtgatcgaaccgaataaagaactgagcgaggtgaagtag

SEQ ID NO: 25464 - DNA, 1683 bp, Artificial Sequence
  Description of Artificial Sequence: Synthetic coding sequence
atgagcgagcacagccggaacagcgaccaggaggagctgctggacgaggagatcaacgaggatgagatccttgcaaacctatctgcagaggagctgaaagagctgcagagtgaaatggaggtgatggcgcctgatccttccctacccgtgggaatgatccagaaggaccagaccgacaaacctccgacaggtaatttcaatcacaagtccctggtggattatatgtattgggagaaggcaagcaggcgcatgctggaagaagaacgagttccggtgacattcgttaagtctgaggagaagactcaagaagaacatgaagagatagaaaagaggaataagaacatggcccagtacttaaaagagaaacttaataacgaaattgtggctaacaaaagggagagcaaaggaagttccaatatccaggagaccgatgaggaagatgaggaagaggaggacgacgatgacgatgatgaaggggaagacgatggggaggaaagcgaggaaaccaaccgtgaggaagaaggtaaagcaaaggagcagatcaggaattgcgagaacaactgccaacaggttacggacaaggcctttaaggaacaaagggaccggccagaggcccaggaacagtccgaaaagaagattagtaaattggaccctaagaagctggccctcgacacatcttttctgaaggtgtccacccggccctccggcaatcagactgacctagacggttcgctgcgtcgggtccggaaaaatgacccagacatgaaggaactcaacttgaataatatcgaaaatatccccaaagagatgctactggattttgtcaatgctatgaaaaaaaacaagcacattaaaaccttctctctcgccaatgtcggcgccgacgaaaatgtggccttcgcgttggccaacatgttgcgcgaaaacagaagtatcaccaccctgaatatcgagtccaattttatcactggcaaaggtatcgtcgccattatgagatgtctgcagttcaacgaaacgctgaccgagcttcgcttccacaaccaaagacacatgctgggccatcatgccgagatggaaatcgcacgactgttgaaagcgaataacactctcctaaaaatgggttatcactttgaattgccaggcccaaggatggtcgtgaccaatctcttgaccaggaatcaagataaacagcggcagaagaggcaggaagaacagaaacagcagcagctgaaagagcagaaaaaactgattgccatgcttgagaatgggctggggctaccacctggaatgtgggaactgctgggcggtccaaaaccagatagccgtatgcaggagttttttcagcctccaccacctcgccctcccaacccacagaatgttccatttagccagagaagtgaaatgatgaaaaagccttctcaagcccccaagtatagaactgaccctgactccttcagggtcgtgaagctgaaaaggattcagcgaaaatcaagaatgcctgaagcgcgggaacctcccgaaaaaaccaatttaaaggacgtgattaagacccttaagccagtaccacgcaatcgcccacctccgcttgtggagattacaccaagagatcaacttttgaacgatatcagacattctagtgtcgcctacctgaagcctgtccagctgcctaaggagctggcgtag

SEQ ID NO: 25465 - DNA, 51 bp, Artificial Sequence
  Description of Artificial Sequence: Synthetic coding sequence
atgtgcaccagcgagaccttccaggccctggacaccttcgaggcccgctag

SEQ ID NO: 25466 - DNA, 513 bp, Artificial Sequence
  Description of Artificial Sequence: Synthetic coding sequence
atgcccatcctgctgttcctgatcgacaccagcgccagcatgaaccagagatcgcatttaggtactacttatctggacacagccaagggagccgtggaaacgtttatgaaattgcgggctagagatcccgctagtagaggcgaccggtacatgctggttacgttcgaggaacctccatatgccatcaaggcaggctggaaggaaaaccacgccactttcatgaacgaattgaagaaccttcaggccgaagggcttacaactctggggcagtctttgagaacagcatttgatctgctcaacttaaacaggctggtgactgggattgataactacggccagggtcggaacccatttttcctcgaacccgctatcatcatcacaattaccgacggatcgaaactgactaccaccagtggtgtccaagacgaagcggtccatatactatgcgtcttgcaagaatgcttgatctccgtttggtccccttggtgccgcaagtacaaagtggggtggtag

SEQ ID NO: 25467 - DNA, 204 bp, Artificial Sequence
  Description of Artificial Sequence: Synthetic coding sequence
atgagccggcggcggttcgactgccggagcatcagcggcctgctgacaaccacaccgcaaatacccattaaaatggagaacttcaataatttttatattctgacatccaaggagctcgggcgcgggaagtttgctgtggtgaggcaatgtatctcaaaaagtaccgggcaggaatacgctgccaagtttctgaaaaagcgttag

SEQ ID NO: 25468 - DNA, 1107 bp, Artificial Sequence
  Description of Artificial Sequence: Synthetic coding sequence
atgctgagcaagcggggctgccacgcccggatctacgccgacttccccatccgcaggttgatctcccagcggagttccctggagaccctggaagatatcgaagagaacgctcctctccggcgatgtcggactctgtccggatccccaagacccaagaactttaagaagattcattttattaagaacatgcgccaacacgacactcgcaacggtaggattgtgcttatttctggcaggaggtctttttgcagtatcttctcagtactgccttacagggattctacccaggtcggagatctgaaactggacggcggtagacaaagcactggagcagtctccctcaaggagataatcgggctggagggggtggagctaggggcagatggcaagaccgtcagctacacccagtttctgctccctaccaacgcatttggcgcgcggcgcaataccatagatagcacatcatccttcagtcagttccgaaatctatcccatcgttcactgagcattgggagggcaagcggcacccagggaagtttggataccgggagcgatctcggagactttatggactacgaccctaacctactggatgacccacagtggccatgcggaaagcacaagcgcgtcctgatcttcccatcttacatgacaacagtcatcgattacgtgaagcccagcgatctgaagaaggacatgaatgaaacctttaaggaaaaattcccgcacatcaagctcacactgagcaagataagatcacttaagagggagatgcgcaagctcgctcaggaagattgtggtctcgaagagcctaccgtggcgatggcgttcgtgtatttcgagaagttggccctgaagggaaagctgaataaacaaaacagaaagctgtgcgcgggcgcctgtgtcctgctggcagctaagatcggctcagacttaaagaaacatgaagtgaaacatcttattgacaaactggaagagaagtttcgcctgaatcggagggagttaatagcctttgagttcccagtgctagtggcgttagagtttgcactccaccttcccgagcatgaggtgatgcctcactatagacggctcgtgcagagcagctag

SEQ ID NO: 25469 - DNA, 795 bp, Artificial Sequence
  Description of Artificial Sequence: Synthetic coding sequence
atgaccgacgtgcccgccaccttcacccaggccgagtgcaacggcgataagcctccggagaatggccagcagaccattactaaaataagtgaagaactcaccgacgtggacagcccacttccacattatagggtggaaccatctctcgagggagcactcaccaagggctcacaagaggagaggagaaaactgcagggcaacatgttactgaactccagtatggaggataagatgcttaaagagacaagtgcggacgagatgacctttcgtgagggccaccagtgggagaaaatccccctgtccggctctaaccaagagattagacgccaaaaggagcggatcaccgaacagccactgaaggaagaagaggacgaggatagaaagaacaaaggtcatcaggctgctgagatcgaatggctgggatttcgcaaacccagccaggcggacatgttgcactccaagcacgatgaagagcagaaggtgtgggacgaggagatcgacgacgacgatgatgataactgtaataatgatgaggacgaggtgagagtaattgagttcaaaaagaagcacgaggaggtaagtcagttcaaggaggaaggagatgcaagcgaggattctccactgtcatccgcgagcagtcaggcagtaacccccgatgaacagccaactctgggtaagaagagcgacatcagcaggaacgcttattctcgctataatacaataagctaccgaaagatccgtaagggtaatactaaacagcggattgatgaatttgagagtatgatgcatctctag

SEQ ID NO: 25470 - DNA, 4302 bp, Artificial Sequence
  Description of Artificial Sequence: Synthetic coding sequence
atgtggagcctgaccgccagcgagggcgagagcaccaccgcccacttcttcctgggcgccggagacgaaggtttaggcacccgcggcataggcatgagacccgaggaatctgacagcgaactgttagaggatgaggaagacgaggtacctcccgaacctcagatcatcgtggggatatgcgccatgacaaaaaaatctaagtctaagccaatgacccagatcctggaaaggctgtgtcgctttgattacctgaccgtggtgattctgggcgaggacgttatcttaaatgagccagtggaaaactggccttcttgtcattgtctcattagttttcatagtaaaggttttcctctcgataaagcagtcgcttactccaagctgcggaaccctttcttgatcaacgacctcgccatgcagtactacatccaggacaggagggaagtttaccgcattctgcaggaagaaggcatagatctgcctaggtacgctgtattgaaccgcgatcccgcccggcccgaggagtgcaacctgatcgaaggtgaggaccaggttgaggtgaacggagcagtgttccccaaacctttcgttgagaagccagttagtgctgaagaccataacgtgtatatttactaccctagttccgctggtggagggtcccagcgtctcttccgaaaaattggatctcggtcatctgtgtattcccctgaatcatctgtccgaaagaccggtagctatatctacgaagagttcatgcccacggacggcaccgacgtaaaagtctacaccgtgggcccggactatgctcacgccgaggctaggaagagccccgccctggatggcaaagtcgagcgggattctgagggcaaggagatccgataccctgttatgttgaccgccatggagaaactggtcgcgcgcaaggtgtgtgtggcttttaagcagaccgtctgtggtttcgaccttctcagggctaacgggcacagtttcgtgtgtgacgttaacggcttctcattcgtaaagaactcaatgaaatactatgacgattgtgccaagatactgggcaatactattatgcgtgagcttgcaccacagttccagataccctggagcatcccaacggaggccgaagacatcccgattgtgcctacaacttctgggacaatgatggaactgcgctgtgtaatcgcaatcattagacacggagatcggacgcccaaacagaaaatgaagatggaagtaaaacaccctagattctttgccttgtttgagaaacatggcggctataaaaccggaaagctcaagctgaaacgccccgaacagctccaggaggtactggacatcacgaggctgctcctggctgagttggaaaaagaaccaggaggcgagatagaggagaagacaggcaaactcgaacagctgaaaagcgtgctggaaatgtacggccattttagtgggattaacaggaaggtgcaactcacctattacccacacggagtgaaagcctctaacgaagggcaagaccctcagagagagaccctcgccccttccttgttgcttgtgctgaagtgggggggagagcttacccctgcgggaagggttcaggctgaggaactcgggagggctttccggtgcatgtatccaggcggccagggcgactacgctggatttcccgggtgcggcctgctgcgcctgcatagcacatttcggcatgacttaaaaatttacgcctctgacgagggccgtgtccaaatgacagccgccgccttcgccaagggcctcctggcactggagggcgagctgactcctattttagtccaaatggttaaatctgcaaacatgaacgggctgttagattctgacggcgactccctgtcgagttgtcaacatcgcgtgaaggcccgcctccaccacatcctgcagcaggatgccccctttggccctgaagactatgatcagttagctcccacccggtctacttcgttactgaatagcatgaccataattcaaaaccctgtcaaagtctgcgatcaagtgttcgccttgatcgagaatctcacccaccagattcgagagagaatgcaggacccaagaagtgtagacctacagttgtaccactcagagactctagaactgatgctccaacggtggagtaaactggaacgagacttccgacagaagtcaggaaggtatgacatcagtaaaatcccagacatatatgactgtgtgaaatacgacgttcagcataacggctcactgggacttcagggaacagccgagcttcttcgtctgtccaaggccctggctgatgtcgttattccccaggaatatggaatttcgagagaagaaaaactggaaatcgccgtggggttttgcctcccactcctccgtaagattctgctggacctgcaaaggacccatgaagacgaaagcgtaaacaagctgcaccctctgtgctacctccgttacagcagaggtgtactctctccagggagacacgtgcgcaccaggctgtatttcacatctgagagccacgtgcactctctcttgagtgtgttccgatatggcggtctgttggacgagacacaggacgcccagtggcagagagcactggactatctcagtgcaatcagtgagctgaattacatgacacaaatcgtcattatgctttacgaagacaacacccaggaccccctgtcggaggagcgctttcatgtggagttacacttttcgccgggcgtgaaaggcgttgaggaggaaggctctgctcctgccggctgtggctttaggcctgcctccagcgagaacgaggaaatgaagacaaaccaaggctccatggaaaatctgtgccccggtaaagccagcgacgaacctgatcgagctctccagacctcaccccagcctcctgaaggacccggccttccgcggagatcgcctttgatcagaaaccgtaaggcaggcagcatggaagtgctctccgagacttctagcagccgaccagggggatacaggctgttctcaagcagcagaccacctacagaaatgaaacagtcaggactggggtctcagtgtaccggccttttcagcaccaccgtcttaggagggtcttcctccgcaccgaatctgcaggactatgcaagatcacacgggaaaaagttgccacccgcttccctcaagcaccgggatgagctgctgtttgtgcccgcagtaaagcggttctccgtttcctttgccaagcaccctaccaatgggtttgagggctgctcaatggtccccaccatatatcccctcgagaccctgcacaacgcattgtccctgcggcaagtgagcgaatttcttagccgcgtttgccagaggcacacagatgctcaggcacaagcttcggccgctctcttcgattctatgcatagctctcaagcatcagacaacccgttcagcccaccccgcacacttcactcgcctccccttcagttacaacagagatctgaaaagcccccatggtattcaagtgggccaagctctactgtttctagcgccggtcctagttctccgactaccgtcgacggcaactcccaatttggctttagcgaccagccgtccttgaattcccacgttgctgaggaacaccaggggctcggcctcctccaggagacaccgggcagtggagcacaggagctgtcaatcgaaggcgagcaagagttattcgagccaaaccagtctccacaagtccccccaatggagacatcccaaccgtacgaagaggtgtcccagccttgccaagaggtgcctgatattagccagccctgtcaagatatctcagaggcactgtctcagccctgccaaaaggtgccggatatcagccagcagtgccaggagaatcatgataacggcaatcatacgtgtcaggaagtcccacatatttcacagccctgtcaaaagtcttctcagctttgccagaaggtatctgaagaagtgtgtcagctgtgcctggagaactccgaagaggtcagccagccctgtcagggcgtgtctgtcgaagtcggcaaactcgttcacaagttccacgttggtgtgggctctttagtgcaggaaacattggtggaggtgggttcccccgcagaagagattccagaggaagtaatacagccctatcaggaattctctgtggaagtgggcagactcgctcaggaaacatcagctataaacctgctctcccaaggtataccggagatcgacaagccctcccaggagtttccagaggagattgatctacaggcacaagaagtgccggaagaaattaactag

SEQ ID NO: 25471 - DNA, 810 bp, Artificial Sequence
  Description of Artificial Sequence: Synthetic coding sequence
atgttccccgccctggagacccacctgaagcagaccatccccgacccttatgaggattttatgtacagacacttgcagtactatggttactttaaagcccagcgcggctctcttcctaactcagccacccaccagcacgtccgcaagaacaacccccaatgtcttctgaatggctcgttgggagagaaggacgacctaattcccgatacactccaaaaagaaaaactgctgtactcgcatatgttgtcactgcctcatctacggtcacgccagctcctctacgatgagctggatgaggtgaatcccaggctgagagagcctcaggaattgttttctattctgtccaccaaaaggccactacaggcccctagatggcccatcgagtgcgaggtcatcaaagaaaacattcaccatattgagtgggctccaccacagcctgagtatttctatcagccaaagggaaacgaaaaggtccccgaaatcgttggggagaagaagggtacagtcgtgtaccagctcgattcagtgccaatcgaaggttcgtattttacaagtagtcgggttgggggaaagaggggaattgtcaaggaactggccgtcacgctgcaagggcccgaagacaacaccctgctgttcgagtctcggttcgagtccgggaacttgcaaaaagctgttcgcgtggaccccatgtcaatgaattccccctgcgagctgacctccacattgaccaacacactgtctggattcatcttcgtcttccggaccccagagaagatgctgccgatagccagtcccctttccacctgctag

SEQ ID NO: 25472 - DNA, 975 bp, Artificial Sequence
  Description of Artificial Sequence: Synthetic coding sequence
atgcccctgcaggtgagcgactacagctggcagcagaccaagaccgctgtatttctctccttgccccttaagggtgtgtgcgtcagagatacagacgtgttctgtaccgaaaactatttaaaagtgaacttcccgccatttctgtttgaggcttttctatatgcaccaattgatgacgagagctctaaagccaaaattggcaacgatacaattgtttttacgttgtacaaaaaagaggctgctatgtgggaaactttatcagtcacaggcgtcgacaaggaaatgatgcaacgtattcgcgagaaaagcatcttgcaggcgcaggagcgcgctaaagaagcaactgaggctaaagccgccgcgaagcgagaggaccagaaatatgcactgtctgtgatgatgaagatcgaggaagaagagcgaaagaaaatcgaagacatgaaagaaaacgaaaggatcaaagctaccaaagctttagaggcctggaaggagtatcagcgcaaggcagaggagcagaagaagatccagcgagaggagaagctttgccagaaggagaaacagattaaagaggagcggaagaagatcaagtacaagagcctgacgcgtaatctggctagccgcaacctggcccctaagggtcgtaacagcgaaaacatctttaccgaaaaattaaaggaagatagcatccctgccccgagaagcgtgggatctatcaagattaattttaccccccgggtctttccaaccgctctccgtgagtcccaggtggcagaagaagaggagtggcttcataaacaggcggaagctcggagggctatgaacacagatattgccgagttatgcgacctgaaagaagaggaaaaaaaccctgagtggctcaaagataaaggcaaacccgaacggtgcctgaagattcctgttaccgtcatccacctggttgttgggctgagcagtgtaatgcgcggtcagatatag

SEQ ID NO: 25473 - DNA, 162 bp, Artificial Sequence
  Description of Artificial Sequence: Synthetic coding sequence
atgcagaccagcagcagccggagcgtgcacctgagcgagtggcagaagaattatttcgctattactagtggaatctgtacggggcctaaggccgatgcctaccgagcgcagattcttcgcattcagtatgcctgggcaaatagcgaaataagccaggtatag

SEQ ID NO: 25474 - DNA, 2079 bp, Artificial Sequence
  Description of Artificial Sequence: Synthetic coding sequence
atggtgaccaccctgggccccaagatggccgccgagtggggcggcggggtgggttatagcggctcaggccctggccggtccagatggagatggagcggaagcgtatgggttaggtctgttctgctgttgttagggggactccgagcttccgctacatctaccccagtttctctgggaagctctccgccctgtaggcatcacgtgccatctgatacggaagtcatcaacaaggttcacctgaaggccaaccacgtggtgaagagggacgtggacgagcacctgaggatcaaaaccgtgtacgataagagtgtggaagaacttctgccagaaaagaaaaaccttgtaaagaacaaactctttccccaggctatctcttacttggaaaagaccttccaggtcagacggccagccggtaccatcctgctctcccggcaatgtgccacgaaccagtatttaaggaaagaaaatgatccacaccggtattgcaccggcgagtgtgcagctcataccaagtgcggacccgtcatcgtgcccgaggaacacttgcagcagtgtagagtatacaggggaggcaagtggccacacggcgcagtgggagttccagaccaggaaggcatttccgacgcagattttgtcctatatgtgggcgctctggctactgagagatgtagtcacgagaatatcatctcatatgcggcctattgccagcaggaggcaaacatggatcgcccgatcgcaggttacgccaatttatgccctaacatgatatcaacacaacctcaggaattcgtcggaatgctttcgacagtaaagcatgaggtgatccatgccttgggcttcagcgctggtttatttgcgttttaccatgataaagacggcaatcccctgacgagtaggtttgccgatggtctgccacctttcaactactctttgggcctttaccagtggagtgataaggtggtgagaaaagtggagagactgtgggatgtacgggacaataaaatagtgcgacacactgtgtacctcctcgtgaccccaagggtagttgaggaggctcgcaagcacttcgactgtcctgtgcttgagggaatggaactcgagaaccagggcggtgtgggcacagaacttaaccattgggaaaaacggctgcttgaaaatgaagcaatgactggatcacatactcagaatcgcgtcctgtctagaatcacccttgcactcatggaagacaccggatggtataaggcaaattattcgatggctgaaaagctggattggggccgtggcatggggtgcgatttcgtccgtaagtcttgtaagttttggatcgaccaacaaagacagaagaggcagatgttgtctccatactgtgatacacttaggtccaatcctttacagctgacctgtagacaggatcagcgagcagtcgccgtatgcaacctgcagaagtttccaaagccgctaccacaggagtaccagtactttgacgaattgtctggaattcctgcagaggatcttccttattacggaggttctgtggagatcgcagactactgcccattcagccaggaattctcatggcatctatctggcgagtaccagcgctcatctgactgccggatactggaaaaccagcctgaaattttcaagaattacggagctgagaaatatggccctcattctgtgtgtttaatacagaagtcagccttcgtgatggagaagtgtgagcgcaagctcagttatcctgattggggaagtgggtgttaccaggtgtcatgctccccccaaggactgaaagtgtgggtgcaggatacaagctacctctgttcccgggctggacaggtcctgcctgtgtctattcagatgaatggttggatccacgacggaaatctcctctgccccagctgctgggacttttgtgaactttgcccgccagaaacagatccacctgcaaccaacctgacacgcgctctccctcttgacctatgttcatgcagcagctcccttgttgtcaccctgtggctgcttctgggcaatctgttcccattactggccggattcctgttgtgcatctggcactag

SEQ ID NO: 25475 - DNA, 3021 bp, Artificial Sequence
  Description of Artificial Sequence: Synthetic coding sequence
atggacagcagccagcagaagaccttccggggccacgacgcccccgtactctcacttagctttgatcctaaggatatctttctcgcctctgcctcttgtgatgggagtgtacgcgtgtggcagattagcgaccagacctgcgccatctcctggcctttacttcagaaatgcaacgatgtgattaatgcgaaaagcatatgtcgactggcatggcagcctaagagcggtaagctgctggcaattcctgttgaaaaaagcgtgaagttgtacaggagagagtcttggtcccaccagtttgatctttccgacaattttatttcccagacccttaatatcgtcacttggagcccttgcgggcagtatctggccgcaggcagcatcaatggtctgatcatagtgtggaacgtcgagaccaaggactgtatggaacgagtgaaacatgagaagggatacgctatttgtggcctggcatggcatccgacctgcggtcgcatcagctacacggacgccgaggggaaccttggtctgctggaaaacgtctgtgatcctagcggtaaaacaagttcttccaaggtatctagcagagtggagaaagattacaacgacttattcgatggggatgacatgagcaatgccggagactttctgaatgacaatgctgtggagatcccatcattctctaagggcatcataaacgacgatgaagatgacgaggatctgatgatggcaagcgggaggcctcgccaaaggtcccacattctggaggacgacgaaaattcagtggatattagcatgctgaaaacagggtcctcacttttgaaggaggaggaagaagacggacaagaaggatcaatccataatctcccattggtgactagtcagcgacccttctatgacggcccaatgccaaccccaaggcagaaaccattccagagtggctctacccccctccatttgactcatcggtttatggtttggaatagcatcggcatcatccgttgttacaacgatgagcaggacaatgccatagacgtggagtttcacgacacaagcattcaccatgctacccacctgagcaatactctcaattacacaatcgctgacctcagccatgaagccattctgcttgcctgtgagagcacggacgagctcgcctcaaagttacattgcctgcattttagctcctgggacagctcaaaagagtggatcattgacctgccgcagaacgaggacattgaggccatatgcctgggacagggatgggccgccgcagccacaagtgccctgctactgcgcctattcacaattggtggggtgcaaaaggaggtcttttccctcgccggacccgtggtgagtatggctggccacggagagcagcttttcatagtatatcatcgagggactggattcgacggcgatcagtgcctgggtgtccagctgctggagctgggtaagaaaaagaagcagatccttcacggcgaccctttgcccctgaccagaaaaagctacctggcttggatcggcttttcagctgagggcactccttgctacgtggattcagagggcatcgttagaatgctgaaccgggggctaggaaatacgtggacgccgatttgtaacacgagggaacattgcaagggcaaatcagaccattattgggtcgtcgggattcatgagaacccccagcagctgagatgcatcccatgcaagggcagtcgcttcccccctaccctgccacgccctgcagtcgctatcctaagtttcaaactgccctactgccagatcgcaacagagaaaggacaaatggaggagcaattctggaggagcgttatctttcacaaccatttggattatttagccaaaaacgggtacgagtatgaggagtccactaaaaatcaggccactaaagagcagcaggagttacttatgaaaatgctggccctaagttgcaaactggaaagggaattccgttgcgtggagctcgctgatttgatgacccagaatgccgtcaatctcgcaatcaaatacgcttctcggtcccgaaagctgatcctggcccaaaagctgtcggaactggccgtggaaaaggcagctgagttgactgctactcaagtggaagaggaagaggaggaagaggatttccgcaagaaactgaatgctggatactccaacacagctaccgaatggtctcaacctaggtttcgaaatcaggtcgaagaagacgcagaagattcgggagaagctgatgatgaggaaaaaccggagattcacaaaccaggacagaattccttttctaagtcaaccaactcctcagatgtttccgcaaagtcaggggctgtgaccttttcaagccagggccgggtgaatccctttaaagtgtctgcttcaagcaaagagcctgcgatgagtatgaattcagcgcggtccacgaatatcctagacaatatgggaaagtcatcaaagaagagcactgcccttagccgcaccacaaataatgagaaatcacccatcattaagcccctgatacctaagcctaaacctaagcaagcctcagcagcaagctacttccagaagaggaattcccagacaaacaagaccgaagaagtgaaggaggagaacctgaagaacgtactgagcgagaccccagccatatgtcctccccaaaacactgaaaaccaacgtcccaagacaggatttcagatgtggcttgaagaaaacagatctaacattttgtccgataatcccgatttcagcgacgaggcagacataattaaggaggggatgattcggttcagggtgctttccacagaagagagaaaagtctgggcaaacaaggcaaagggggagacggcctccgagggaacggaagccaagaagcgcaaacgcgtggtcgacgaatccgatgagaccgagaaccaggaagaaaaagccaaagagaaccttaatctgtctaagaagcagaagcccttggatttcagtactaatcaaaagttatcggcatttgcattcaagcaggaatag

SEQ ID NO: 25476 - DNA, 540 bp, Artificial Sequence
  Description of Artificial Sequence: Synthetic coding sequence
atgaccgaggacagccagcggaacttccggagcgtgtactacgagaaagtggggttccggggagtggaggagaagaagtccttggagattctactgaaagacgaccggctggacaccgagaagctgtgcacctttagtcagaggttcccactgccttctatgtatcgcgccttggtatggaaggtacttttgggaattctgcccccccaccacgaatctcacgcaaaggtgatgatgtaccgcaaggagcagtacctggacgtcctgcatgccctgaaggtggttagattcgtttcagacgccactccccaggctgaagtctacttgcggatgtatcagctcgagagcgggaagttaccgcgctcaccctcctttccactagaacctgatgacgaggtgttcctcgcaatcgctaaagcaatggaggaaatggtggaggattccgtggattgctactggatcacaaggagattcgtaaatcaactgaatacaaaatatagagactccttaccacagttagagggcatcaacgtggggtag

SEQ ID NO: 25477 - DNA, 3189 bp, Artificial Sequence
  Description of Artificial Sequence: Synthetic coding sequence
atgatcagcaagggcggcagcgaggccctgctgcagaccctggtggataccgcacggactgcaccccctgattatgatatcttgctcccactgtttagactcctggccaaggtgggacttagagacaagaaaatcgggaggaaggcacttgagttagaggcacttgatgtgaccctaatccttgcgcgtaagaacctgtcccacggtcagaatctgttacactgcctgtgggccctacgcgttttcgctagcagcgttagtatgggcgcgatgcttggcatcaatggagcgatggaactgctgtttaaagtgattactccatacactagaaaacgaacacaggcgattagagccgctacggaggtcctggccgcactgctgaagagcaagtcaaatgggcgtagagcggtgaatcggggttatgtgacctcgctgctgggcttacaccaggactggcacagccatgacacggccaacgcgtatgttcaaatcaggagaggcttgctcctctgcctgagacacatcgccgcactgagaagcggaagggaggcttttttggctgcgcaaggtatggagattctattcagcacaacacagaattgccttgatgataagtctatggagcccgttatcagcgtggtgctacagatccttcggcaatgctaccctacaagtccactgccacttgtgactgctagttcggcctacgcgttcccggtgcccgggtgcataactacggagcctcctcacgatctccctgaagaggatttcgaggacgatggtgatgatgaagtcgacaaggacagcgacaccgaagacggaaaagttgaagatgacgatctggagaccgacgttaataagttgtcttcgaagcccgggctcgaccgcccagaagaggagttaatgcaatacgaggtgatgtgtttggaactttcttattcttttgaagaactgcagagtaaactgggagacgatctcaattccgagaaaacacagtacgccaatcaccaccacattccggcagccgcgtcgagtaagcagcattgctatagcaaggatcagagtagttgcggccaggagagagagtatgccgttcagacatctctgctttgtagggtcaaaacagggcgctctaccgtgcatctgggatccaagaagaatccaggggtcaacctctaccagaacgtgcagagtaactccctgagaagggattcatcagagtctgaaataccagacatacaggcttccccaaaagccgatgcatgggacgtggatgcaattttttgtcctcgcatgagcgcgtccttctccaacagcacacggactcgcgaagtcgtgaaagttatcgacaaattgttgcagactcatctaaagcgggtcccatttcatgacccttacctgtacatggctaaagcgcggaggacctccagtgttgtcgactttaagatgatggctttcccagacgtatggggacattgcccgccgccaacaacccagccaatgcttgagcgtaaatgcggcgttcagagaatacggatatttgaagacataagaaggctaattcagcctagcgacgtcatcaataaggtggtgttctctctggacgaaccttggcctctgcaagacaatgccagcaattgcctgcgttttttttctaaattcgagtccgggaacttacggaaggcgatccaggtcagggagtttgagtatgatctcctggttaatgcagacgtgaactcgacccagcaccagcagtggttctatttcaaagtgtccggcatgcaggctgctattccttaccacttcaacataatcaattgtgagaagcccaacagccagttcaattacggcatgcagccgacactgtattctgtaaaggaggcacttttaggaaagcccacctggataaggacaggacatgagatttgttactacaagaatcattaccgccagagcacagccgttgccgggggggcatctggaaagtgttactacactttaaccttcgccgtgacctttccccattccgaagatgtatgttatctcgcatatcattacccgtatacctacaccgccctgatgacgcatctcgacatcttagaaaaatcagtgaacctgaaggaggtctactttcgacaggatgtgctgtgtcaaacgctgggcgggaacccctgcccgctggtgactattaccgctatgcccgagagcaactccgatgaacatctggaacagtttcgccacagaccctaccaggtgatcactgcacgggtacatcccggagagtcaaatgcgtcctgggtgatgaagggcacgctggagttcctggtgtcttctgacccagttgccagactgctgcgtgagaatttcatatttaagataatacctatgctaaatcccgatggagtaatcaacgggaaccatcggtgttcactctccggcgaagatctcaacaggcaatggctgtccccatctgcacacctacagccaacgatctaccatgctaaaggcttgttgtaccacctgtcgtcgattggccggagccccgtagttttttgcgattttcacggccactctcaaaagaagaatgttttcctatacggatgctctatcaaagagacactgtggcaagcagcctgcaccgtcgggacatccacaatactggaagaggtgaattaccgtactctgccaaagatcttagacaagctcgcgcccgccttcacaatgtcctcttgctcttttctagtggagaaatcacgtgcctctacagcccgcgtcgtggtgtggcgagagatgggcgtatccagatcctatacaatggagagtagctattgtggctgcaatcaaggcccataccagtgcacacagagattgcttgaaagaaccaagaatgagcgagctcatcccgtggacggcctgcaggggctgcagtttggaacgcgcgagcttgaggagatgggcgcgatgttctgtttgggactactgatcctggaactcaaatctgcgtcatgctcccatcagctcctcgctcaggctgcaaccctgctcagtgctgaagaagacgctctggatcagcacctccagcggctcaagtcctcgaatttcctgcccaagcatatctggttcgcatatcattttttcgctattactaattttttcaagatgaatctactgctccacgtatctccctag

SEQ ID NO: 25478 - DNA, 738 bp, Artificial Sequence
  Description of Artificial Sequence: Synthetic coding sequence
atggccgccgccccccccagctactgcttcgtggccttcccccccagagctaaagacggattggtggtgtttggaaagaactccgctaggccccgcgatgaggtgcaagaggtggtttatttctccgcagctgatcatgaacccgagtctaaggtggagtgtacctatatttccattgatcaggtgccgcggacttacgcaatcatgatcagcaggccagcttggctttggggtgctgagatgggggctaatgagcatggggtttgcattgcgaacgaagcaatcaacaccagggagccagccgctgaaattgaggccttgctggggatggatctagtgcgattaggactcgaaagaggcgagactgctaaggaagccctggatgtcattgtatctttgctcgaggagcatggtcagggagggaattactttgaagacgcaaattcctgccactcgtttcagagtgcatacctgattgttgaccgagacgaggcttgggtgctggagaccatcggaaagtactgggctgcagaaaaagtgaccgagggtgtaagatgcatctgctcacagctgtctcttaccactaagatggatgctgagcatccagagctgcgctcctacgcccagtcacagggatggtggacaggtgaaggcgagttcaactttagtgaggtgttttcaccagtcgaagatcatcttgattgcggggcgggcaaagattcactggagaaacagtag

SEQ ID NO: 25479 - DNA, 99 bp, Artificial Sequence
  Description of Artificial Sequence: Synthetic coding sequence
atgagcgagcagggcgacctgaaccaggccatcgccgaggagggcggaaccgagcaggaaacagcaacaccagagaatggaatcgttaagtcggagtag

SEQ ID NO: 25480 - DNA, 132 bp, Artificial Sequence
  Description of Artificial Sequence: Synthetic coding sequence
tgagtgctgggcagccccaagcccgaggagatccccctgacctggatacagccaggcaccacagtcctcaactgttctcacgactttttgtccgagtctctgataatcatccgccgaatggctatcttctag

SEQ ID NO: 25481 - DNA, 339 bp, Artificial Sequence
  Description of Artificial Sequence: Synthetic coding sequence
atgttcgccaagctgaagaagaagatcgccgaggagaccgccgtggcacaacgcccaggaggagccaccagaatcccacgttccgtgtctaaggaatcagtcgcgtccatgggggcagactccggagacgatttcgccagcgacggatctagcagtcgggaggatctgtcttcccaactgctgcggcggaacgagcagattaggaagctcgaggcacgcctcagcgactacgccgagcaggtaagaaacttgcaaaagatcaaggagaagttggaaatagccctggagaagcatcaggatagctcgatgagaaagtttcaggaacagaatgagacgtag

SEQ ID NO: 25482 - DNA, 579 bp, Artificial Sequence
  Description of Artificial Sequence: Synthetic coding sequence
atgggcaagggctgcaaggtggtggtgtgcggcctgctgagcgtgggaaagactgccattctggagcagctcctttacgggaatcacactatcggaatggaggattgcgaaactatggaagacgtttatatggcttccgttgaaactgatcgaggcgtcaaagagcagctgcacctttacgatacacggggactccaggaaggcgtagagctgcccaagcattatttttcttttgctgacggctttgtgttggtatacagtgtgaacaatcttgagtcattccagagagtcgaattgcttaagaaagaaattgacaaatttaaagacaaaaaagaggtcgccatagtggtgctcggcaacaagatcgatctgagtgagcagcggcaggttgacgccgaagtggctcagcaatgggcaaaaagtgagaaggttcggctgtgggaagtgacagtgactgatcgcaaaactctaatagagccatttacactgctcgcctctaagctcagccaaccccaaagcaaaagctcctttccactgccgggacggaaaaataaggggaacagcaattctgagaactag

SEQ ID NO: 25483 - DNA, 1458 bp, Artificial Sequence
  Description of Artificial Sequence: Synthetic coding sequence
atggccccccggctgcagctggagaaggccgcctggcggtgggccgaaaccgtcaggccggaggaggtttcacaggaacatattgaaaccgcttaccgcatttggctggaaccctgtattcgtggggtatgtaggcgaaactgcaagggcaaccccaattgtcttgttgggatcggggagcacatttggttaggtgagatagacgaaaatagcttccacaatatcgacgatcctaactgcgaacgccgaaaaaaaaacagttttgttgggctaacaaacctgggggctacctgctatgtcaacaccttcctccaggtgtggtttctgaatctggagttacggcaggcgctgtacttatgcccttctacttgcagcgactacatgcttggtgatgggatccaggaagaaaaggattacgaaccccagactatctgtgagcatctccagtatctgtttgcacttctgcagaatagtaacaggcgatatattgaccctagtgggttcgtcaaagcgttgggtctggatacaggacagcagcaagacgctcaagagttttccaaactgttcatgtctctcctggaagacaccctcagcaaacaaaagaatcccgacgtccggaatatcgtccagcagcagttctgtggtgagtatgcctatgtcaccgtgtgcaatcagtgtggccgggaatctaagctcctgtcgaagttctacgagctggagttgaatattcagggccacaagcagctgaccgactgcattagtgagtttctgaaggaggaaaaactggagggggacaaccgatatttttgcgagaactgccagagcaagcagaatgcgacacggaagatcaggctgctgtctttaccatgtactcttaacctccaacttatgaggtttgtcttcgatagacagacagggcacaagaaaaagctgaacacatacatcggcttctccgaaatcttggatatggaaccttatgtagagcataaaggcggctcgtacgtctatgagctctccgctgtcttgatacacaggggggtgagcgcttatagtgggcattacatcgcccatgtcaaagatccccaatcgggggagtggtacaaattcaacgacgaagacatcgaaaaaatggaaggtaagaagctgcagttgggcatagaagaggatctggccgagccctccaaatcccagacccgtaagccaaagtgtgggaaaggcacccattgctcacgaaatgcttacatgttggtgtatcgattgcaaacgcaggagaaaccgaacacgaccgtgcaagttcccgcctttctccaggaactcgttgatagggataatagcaagtttgaagagtggtgtatcgagatggcagaaatgaggaaacaatccgtagacaagggcaaggctaaacacgaagaagtcaaagaactgtaccagaggttacccgccggcgccggtctttag

SEQ ID NO: 25484 - DNA, 1119 bp, Artificial Sequence
  Description of Artificial Sequence: Synthetic coding sequence
atggacgtgctgagccccctgagcttcatcaaggtgagccacgtgaggatgcaggggatcctgttactggtgttcgcgaaataccagcacttaccctacattcaaatcttgtctactaagtccacccccaccggactgttcgggtactgggggaataaaggtggcgtgaacatttgcctgaaattgtacgggtactatgtgtcgatcatcaactgccacctgcccccccatattagtaataactatcagcgactggagcacttcgaccgtatattagaaatgcagaactgtgagggcagggatatccccaacattctcgaccacgacttgattatttggtttggagatatgaatttcagaattgaggatttcgggctgcattttgtaagggaatcaatcaagaacaggtgctatggcggactatgggaaaaagaccagctgagtatcgccaaaaaacacgatcctttgttgcgagagtttcaggagggaagactgctgtttcctccaacgtataaattcgacaggaacagcaacgattacgacaccagcgagaaaaagaggaaacccgcatggacagaccgcattctttggaggctgaagcggcagccttgcgctggacccgatactcccatacctccggcctcccacttctctctgtccctccgcgggtacagttcacatatgacctacggaatcagtgatcacaagcctgttagtggaacattcgaccttgaactcaaacccctggttagtgcccccctcatcgtgttaatgccagaggatttgtggacagtcgagaatgatatgatggtaagctatagctccacatctgattttccatcgtcaccatgggattggatcgggctctacaaagtcggcttgcgggatgtgaatgactatgtgtcctatgcctgggttggggattctaaggtctcctgtagcgataatttgaaccaagtatatatagacatcagcaatattccaaccactgaagatgaatttctgctctgttattattctaatagtctgcgatccgtcgtggggataagcagaccgttccagattcctcctggcagtctgcgggaggacccacttggcgaggcccagccacagatctag

SEQ ID NO: 25485 - DNA, 1548 bp, Artificial Sequence
  Description of Artificial Sequence: Synthetic coding sequence
atgagcgagggcgagagccagaccagcgtgagcccccccgtgacctcgaccacatccgccgcttccccggaggaggaagaagagtctgaggatgagtccgaaatactggaggaaagcccttgcggcaggtggcagaaacggcgggaggaagttaatcaaaggaatgttcctggaattgactcggcatatcttgcgatggatactgaggaaggcgttgaagtcgtgtggaacgaggtgcagttcagcgaacggaaaaattataaattacaggaggagaaagtgagggccgtctttgacaatctcatccagctggagcacctgaacattgtaaagttccataagtactgggccgatattaaggaaaataaggctcgagtcattttcatcacagagtacatgagttctggtagccttaagcagttccttaaaaagacaaagaagaaccataagaccatgaacgagaaggcatggaaaagatggtgcacgcagattctctccgctctgagttacctccattcatgtgacccacctattatccatgggaacttgacctgcgacacgatattcatacagcacaacggactgatcaaaatcggcagcgtcgctcctgatactatcaataaccatgtgaaaacctgccgggaggaacagaaaaacttacacttttttgcacctgaatacggggaggttacaaacgtgaccaccgccgtggacatctattctttcggcatgtgtgcgctggagatggctgtgcttgagattcagggcaacggggagagctcttacgtacctcaggaagctatctcaagcgctatccagcttctggaggatccacttcagcgggaatttatccagaagtgcttgcagtcagaacctgctcgaagaccgacggcacgtgaactgctgttccatccagccctatttgaagtgccctcactaaagttgctggcagcccattgcatcgttggccaccagcacatgataccggagaatgctctggaagagattacaaagaatatggacacctctgctgtcctggcagagatacctgccggcccaggccgggaaccggttcaaaccctgtactcccagagccccgcgctagagttggacaagtttcttgaggacgttaggaatggcatctatcctcttacagcgtttggcctacctcgccctcaacaaccacagcaggaagaggtcactagccccgttgtgcccccctccgtgaaaactcccacaccagagccagccgaagtcgagactagaaaggtcgtgctgatgcagtgtaatattgagagcgtggaggagggcgtcaaacatcaccttacgctcctattaaaactggaggataagctgaaccggcatctctcctgtgacttaatgcccaacgaaaacattcctgaactggctgcagaattggtgcagctgggattcatttccgaggccgaccagtcccgactgacatcactcctggaagagacgctgaataagtttaattttgcacgcaattcaaccctgaactcagctgcagtcactgtgagttcctag

SEQ ID NO: 25486 - DNA, 435 bp, Artificial Sequence
  Description of Artificial Sequence: Synthetic coding sequence
atgagcagccccctggccagcctgagcaagacccggaaggtgcccctgccctcagaacccatgaacccaggcaggcgcggaatacgaatctacggtgatgaggatgaagtagatatgctcagtgatgggtgtggaagtgaagaaaaaatcagtgttccttcctgttatggcggaatcggggctcccgttagtcgtcaagtgcctgcatcacacgattcagaacttatggcttttatgactcggaagctatgggacctggagcaacaagtgaaggctcaaacggatgagattctgagtaaagaccagaaaattgccgcccttgaggatctggtacaaaccctccgcccacaccctgctgaagccaccctgcagcggcaggaagaactcgaaacaatgtgtgtgcagttacagcgtcaggtgagggaaatggagtag

SEQ ID NO: 25487 - DNA, 1047 bp, Artificial Sequence
  Description of Artificial Sequence: Synthetic coding sequence
atgcccgcccccccctgcgccagctgccacgccgcccgggccgccttgcggaggcctctgagcggacaggccctgtgtggggcatgtttttgtgctgcattcgaggcagaagtgttacacactgtgcttgccggcaggctcctgccacccggcgcagtagtggccgtaggcgcctctgggggcaaggactccacagtgttggctcatgtcttacgggctctagccccccgcttaggcatcagcttgcagctggtcgccgtggacgaaggaatcggcggttatagggatgccgcactcgcagccgtccgccggcaggccgccaggtgggagctcccacttactgttgtcgcctacgaagatctctttggggggtggactatggatgccgtggccagaagcaccgccgggtccggccgatcaagatcctgttgtacattctgcggggtacttagaagaagggcacttgaggagggcgccaggcgggtgggcgcaactcacatagtgaccggccacaacgccgatgacatggctgagacagtattgatgaattttctaagaggggatgccggccgccttgcaagaggagggggtctcggctccccaggggaaggaggagccttacccagatgccggccattgcaatttgcttctcagaaagaagtggtgctttatgcccactttagacggcttgattatttcagcgaagagtgtgtgtacgctccggaggcttttaggggacacgcccgagacctcctgaagcggctggaagccgctcgacccagcgccgtactggatctggttcacagcgccgaaaggctggcactggcgcccgccgcaaggcctccccggcctggggcatgttcacgctgcggcgccttagcctcaagggccctctgccaggcctgcgccctgctagacggccttaatcgcggcaggcccagattagcgatcggcaagggcagaagaggactcgatgaggaggccacccctggaaccccaggagatcccgcacggcctcctgcatccaaagctgttccaactttctag

SEQ ID NO: 25488 - DNA, 321 bp, Artificial Sequence
  Description of Artificial Sequence: Synthetic coding sequence
atgcccgaggaccaggtgggcaagctggaggccaccgagaacaccatatccgctatggccgccgctgctgcggagcaacaacagttttacctgctcttgggcaatctgctcagtcccgataatgttgtgaggaagcaagctgaggagacatacgagaatattccaggacagagcaaaattacattcctcctccaggccattcgaaatacgacagctgctgaagaagctcgtcaaatggctgcagtactgctacggcgactactttcatcagccttcgatgaggtatacccggcgctcccctctgacgttcagacggcatag

SEQ ID NO: 25489 - DNA, 198 bp, Artificial Sequence
  Description of Artificial Sequence: Synthetic coding sequence
atggagctgcggtgcggcggcctgctgttcagcagccggttcgacagtggcaacttggcccacgtggagaaagtggagtcactgtcttcagatggagaaggggtaggaggtggcgcctctgctctgacctccggcattgcttcgtctcccgactacgagtttaacgtgtggacccggcccgattgcgccgagacctag

SEQ ID NO: 25490 - DNA, 1371 bp, Artificial Sequence
  Description of Artificial Sequence: Synthetic coding sequence
atggccgacagcctggagagcacccccctgcccagccccgaggaccggctggctaagctgcacccaagcaaagaactgttagaatattatcagaaaaagatggccgagtgcgaagccgagaatgaagatctacttaaaaagctagaactgtacaaggaagcttgcgagggacagcacaagctggaatgtgatttgcaacagcgggaagaggagattgccgagctccagaaagcattatcagacatgcaggtttgcctgttccaggaaagggagcacgtcctgcgcctgtattctgagaatgatcggttgcgtataagagagctggaggacaagaagaaaatccagaatctgctagcactggtcggcacagacgctggtgaggtcacatacttctgcaaggaacccccacataaggtgacgattctacagaaaaccattcaggccgtgggtgagtgtgaacagagtgaatcttccgcatttaaggcggacccgaagatcagcaagaggagaccttcgcgtgagcgcaaagaaagctctgagcactaccagagggatatccagactctgatcctgcaagtggaagccctgcaggcacagctgggggagcaaaccaaattgagtcgggaacagattgagggtctgattgaggaccgcagaattcacctcgaagagattcaagtccagcatcagcggaatcaaaacaagataaaagaacttacaaaaaacctgcatcacacacaggagctactttacgagagcacaaaggactttttacagctgcgaagcgaaaaccagaacaaggagaagtcttggatgctagagaaagacaacctgatgagcaagataaaacagtaccgcgtgcagtgtaagaaaaaggaagacaagattggaaaggtgctgccagttatgcatgagtctcaccatgcccagtcagaatatataaagagccttaaagataagcttgtccaagaaaagaagttatccaacatgtaccaagaacagtgtatctcactggaagaagaactcgctaggatccgtgaggaagaaggcatgagacgcgagatattcaaggaccgcacaaacaagatgggaaaaagactccagattatgacaaagcgatatgaggcactggagcgcaggcgcattttggaggttgagggatttaagacagacattaaggtactgcgacagaagcttaaagacttggaacagatgctgtacaaggccacggtgaatgctcgcgctaaccaggacctcgcactcctgtgcgaagtccgagactctaacaggagagctcacaaaattcaaggagagttaaagaacctgaagtctaaggtgttcggcctagaaaacgagctgcgcctctgctag

SEQ ID NO: 25491 - DNA, 1275 bp, Artificial Sequence
  Description of Artificial Sequence: Synthetic coding sequence
atggaccagcccagcggccggagcttcatgcaggtgctgtgcgagaaatactccccggagaacttcccgtacaggcggggacccggcatgggggtgcatgtgcccgctacgccacagggcagtcctatgaaggaccgcctgaatctgccatccgtcttagttcttaactcatgtgggattacgtgcgccggcgacgaaaaagagattgctgctttttgcgctcacgtatccgagcttgatctctctgataataagttggaggattggcatgaagtgtcgaaaatcgtctccaacgtaccacagctcgagtttcttaaccttagtagcaatccgctcaatctgtctgtactggaaagaacatgtgcagggtccttctccggcgtgcgtaaactggtgctaaacaactccaaggccagctgggaaacagttcatatgattctgcaggagctccctgatctggaggagttgtttctgtgcctcaacgactacgagaccgtgagttgccccagcatctgttgtcactctcttaaactcctacacattacagataataaccttcaggactggactgagattagaaaactcggcgtgatgttcccatctctagacacgctagtgttggccaacaaccacttgaatgccatcgaagagccagatgatagcttagccaggctgtttcccaacttaagaagtatctcactgcacaaatcagggttacaatcttgggaagacattgacaaacttaatagttttccgaaactcgaagaggtgcgcctgctcggtattccgcttttgcaaccatacaccaccgaagaaaggagaaagcttgttattgctcgcttacccagtgtgtccaagctgaatggcagcgttgtcacagacggcgaaagggaggattccgagagattctttatcagatattatgtggatgtgccccaagaggaggttccgtttcgttaccacgagctaattactaagtatgggaagcttgaacctttggctgaggtggacctgcgcccccaaagtagtgcaaaggtcgaagtgcatttcaatgatcaggtcgaagagatgagtattcgactggaccaaacagtggccgaactcaagaaacagctgaaaacactggtccagctcccaacaagcaacatgcttctctactatttcgaccacgaggcaccttttggccctgaggaaatgaaatattcttccagagccctgcattcttttggtatccgggatggtgacaaaatctacgtggagtctaagacgaagtag

SEQ ID NO: 25492 - DNA, 264 bp, Artificial Sequence
  Description of Artificial Sequence: Synthetic coding sequence
atgagcatcagcagcgacgaggtgaacttcctggtgtaccggtacctgcaggagagcggcttttctcattcggctttcacttttggaatagagagccatatatctcaatcaaacatcaacggagcattggtgccccccgctgccctgatctcaatcatacagaagggacttcagtacgtggaggcagaagttagcatcaacgaggacggtaccctgtttgacggaaggccaatcgagtccttaagcctgatcgacgcggtatag

SEQ ID NO: 25493 - DNA, 360 bp, Artificial Sequence
  Description of Artificial Sequence: Synthetic coding sequence
atggtgcggaccaagacctggaccctgaagaagcacttcgtgggctatcctactaatagcgatttcgagctcaagacagccgagctgccgcccctcaaaaacggtgaagtgctgctcgaggccctcttcctcacagtggacccgtacatgcgggtggtcgaatctaaaaatgtcgctctcccgaaagggaccattgttcttgctagccccggctggacaacgcattccatcagcgatggtaaggatcttgaaaaattgttgacggagtggccagatactattccccttagtttggcactgggtactgtcgggatgccgggcctcaccgcttatttcggactgctagagatctgtgggtag

SEQ ID NO: 25494 - DNA, 23907 bp, Artificial Sequence
  Description of Artificial Sequence: Synthetic coding sequence
atggaccagccccagttcagcggcgccccccggttcctgacccggccgaaagcttttgttgtgtctgtgggcaaggacgccaccctcagctgccagatcgtgggcaacccaactccccaggtctcatgggaaaaggatcagcagccagtcgcggctggagcccgttttcgactcgcacaagacggtgacctgtataggctgaccattctcgacctggccctcggggatagcggacaatacgtctgccgcgcccggaatgccattggagaggccttcgcagctgtagggctgcaggtggatgctgaagcagcgtgcgcagagcaggccccccactttctgctaaggcccaccagtatccgcgtaagagaaggctctgaagccacctttcgatgcagggtgggtggcagtcctcgccccgctgtcagttggtccaaagacggtaggcgactcggggaaccagatggacccagagttagggtggaggagctaggcgaggcctccgccctgcgcataagagccgccaggcctagagacggcggcacatatgaagtgcgggctgaaaacccactgggggcggcttcggctgccgcggctctggtggtcgacagcgacgccgctgatactgcgagtcgccctggaacatctactgctgcactcctggctcacctgcagaggagacgagaggctatgcgagccgaaggcgcaccggcctcacccccttctacaggcacccggacttgcacagtcactgagggaaaacatgcaaggctgtcttgttacgtgaccggagagcctaaacctgagaccgtgtggaaaaaggatggccagctggtgaccgagggacgtagacatgtggtatatgaagatgcccaggagaatttcgtcctgaagatcctgttctgcaagcagtccgaccgcggcctgtacacatgcacagctagcaatcttgtcggacagacttactctagtgtgctggtcgtggtcagggaaccagcagtaccctttaagaagaggctccaggacttggaggtcagagaaaaggagtctgctacatttctttgtgaagtgccacaaccatcaacagaagccgcctggtttaaggaggaaacaagactgtgggcctctgcaaagtacgggatcgaggaggaggggacagagcgtagattaaccgttagaaacgtctcagccgacgatgatgccgtttatatctgcgaaactcccgagggctctagaacagtggcggagctcgcagtgcaaggaaacctcctccgcaagctccctagaaagaccgcggtccgagtgggcgacaccgcaatgttctgtgtagaactggctgtcccagtcgggcccgtacattggctgcgcaatcaggaggaggtagtcgccggcggcagggtggctattagcgccgagggtactcggcataccctgactatctcacagtgttgtttggaggacgtcggccaagtggccttcatggccggggattgtcagacctccacccagttttgtgtgtccgcaccaagaaaaccgcctctgcagccacccgtcgaccccgtggtgaaagcccggatggagtcaagtgttatcctgtcctggagcccacccccccatggggagaggccagtcaccattgatgggtatttggtggagaagaaaaaactcggcacatacacctggatacgttgtcacgaagccgagtgggtggcaacacctgagttgaccgttgccgatgttgctgaagaggggaatttccagtttagggtgtctgcacttaactcatttggccagtccccctatcttgaatttcctggcactgtgcatctcgcacctaagctggcggtacgtacccccctgaaagctgtgcaggcagtcgaaggaggagaggtgacattttcagtcgacctgactgtcgcctccgcgggagagtggtttctggatggacaagcactgaaagcatcatctgtgtatgaaattcactgtgatagaactaggcacaccttgacaattagggaagtgccagcctcgcttcatggcgcgcagctgaagttcgtggctaacggaatcgaaagttctatccgcatggaggttcgcgccgccccaggcttaaccgctaataagcctccagcagccgccgcacgagaagtgctagcccggctacacgaagaagcccagttactcgctgaattatcagaccaggctgcggcggtcacttggctcaaggacgggagaaccttgtctcctggcccaaagtatgaagtccaggcatccgccggcagacgcgtgcttctggttcgcgatgtggcccgcgacgacgccggcctgtatgagtgcgtctctcgaggggggaggattgcctatcaactctccgtccagggcctagccaggtttctgcataaggatatggccggtagttgtgtggacgccgtggccggcgggccggcccagtttgaatgtgagacaagcgaagcccacgtgcacgtccactggtacaaggacggcatggagcttggccacagcggagaacgatttttacaagaggacgtgggaactcggcaccgactggtggcggccaccgtgacacgacaagatgagggcacttattcatgccgggtgggtgaagattccgtggatttccgcttaagagtgagtgagccgaaagttgtgtttgccaaggagcagctggctcgcagaaaattacaagccgaggcaggtgcatcggccaccctgtcttgcgaagtagctcaggcgcagaccgaggtgacctggtacaaggacggcaagaagctgagttccagctccaaagtctgcatggaagcaaccggctgcacccgccgactggtggttcagcaagcgggtcaggccgatgccggagagtactcatgtgaggctgggggccagcgcttgagcttccatctcgatgtaaaggagccgaaagtagttttcgccaaagaccaggttgcacattccgaggtgcaggccgaagcaggcgcctccgccacgttaagctgtgaagtagcccaggctcagactgaggtgatgtggtataaggacggaaagaagctaagctccagtctgaaagttcacgtggaggcgaaagggtgtaggcgtcgcctggtggtccaacaagcaggaaagactgacgctggagactatagctgcgaggcccgcgggcagcgagtatcatttaggctgcacattacagaacccaagatgatgtttgcaaaggagcagagtgtgcacaatgaggtccaggcagaagcaggcgcctctgcaatgctctcgtgcgaggttgcccaggcccaaactgaagtcacttggtacaaagatggcaaaaagctgtcaagctcctccaaagtgggtatggaggttaagggctgcacccggagactggtcttacctcaggccggaaaagccgatgcaggcgagtatagctgcgaggctggtggccagagagtgagcttccacctccatatcaccgagcctaaaggagtgtttgcaaaggagcagtcggttcacaatgaagtacaggccgaggctggcacaaccgcaatgctgagctgtgaagtcgctcagccacagactgaggtgacatggtataaggacggaaagaagctctcgtccagctccaaagttaggatggaggtgaaaggctgcactagaaggctcgttgttcagcaggtgggcaaagccgatgcaggcgagtactcttgcgaagccggggggcagagagtgtcgtttcagctccacatcaccgagcctaaagccgtctttgctaaggagcagcttgttcacaacgaagtgagaacggaagcaggtgccagcgcaacattgtcctgtgaagtcgcgcaggctcagacagaggtgacatggtacaaggacggaaaaaagctctccagcagctctaaagtccgaattgaagccgcagggtgcatgcgacagcttgttgttcagcaggcgggccaagccgacgccggggaatatacctgcgaggccggaggccaacgactgtcgtttcatcttgatgtcagtgaaccaaaggccgtgttcgcgaaggaacagctcgctcaccgtaaggtccaggctgaagcgggagccatcgctaccctctcatgtgaggtggcccaggcccagacggaggtcacgtggtataaagatggcaaaaaactgagctcatcttcaaaggttaggatggaagccgtgggctgtacccggcgcctcgtcgtacaacaagcctgccaggctgatactggagagtactcatgcgaagcagggggtcagagactgtctttcagtctcgacgtggctgaacctaaggtcgtcttcgccaaagagcagccagtacatcgggaggtgcaagctcaggcaggggcctccaccaccctgtcctgtgaggtagcccaggcacagaccgaggtcatgtggtataaggacggcaagaaattatccttttcctcaaaggtgagaatggaagcagtgggctgcacacggcgtctggttgttcaacaggcgggacaggctgttgcaggagagtactcatgcgaagcgggttcgcaaagactgagctttcacctgcacgttgccgagcctaaggccgtgtttgctaaggaacagccagcctccagagaggttcaggccgaagccggaaccagcgcgactttatcctgtgaggtggcccaggcgcagacagaggtgacatggtataaggatggaaaaaaactttcctcatcgagcaaggtccgcatggaggccgtcggctgtactaggaggctagtggtacaggaggctgggcaggcagatgctggtgagtatagctgcaaagccggcgaccagcggttgagcttccatctacatgttgcagagcctaaggtggtctttgctaaggagcagcctgcccacagggaggtccaggcagaggcgggggccagtgcaaccctgagctgcgaggtggctcaggcgcagacggaggttacgtggtataaggacggcaaaaagttatcaagcagcagcaaggtccgtgtggaagccgtgggttgcacgcgcagattggttgttcaacaggctggtcaggcggaggccggtgagtactcatgtgaagcgggcggccagcaactcagtttccgcctccaggtggccgaacttgagcctcagatcagtgaacgcccatgtaggagggagcccctggtcgtgaaagagcacgaggacataatactgaccgcgacgctagcaaccccatccgccgccacggtgacctggcttaaggatggggtagagattaggagaagcaagcgtcacgagacggcgtctcagggagacacccacacactgacagttcacggggctcaggtcctggacagcgccatttattcttgcagggtgggtgcagagggccaagacttccccgtacaggtcgaggaggtagcagcaaaattctgcagactcctggaacctgtgtgcggcgagcttggcggcactgttaccctggcttgcgagctgagccccgcttgcgccgaggtagtgtggagatgtggaaacactcagctgcgggtcggcaagaggttccaaatggtcgcggagggaccagtccggagtctaaccgtgttgggccttcgggccgaggacgcgggagagtacgtttgtgagagtcgagatgatcacactagtgcccagctgaccgtgagcgttcccagggtcgtgaagtttatgtctggactctccactgtggtggccgaagagggcggcgaggccactttccagtgtgtagtctctccatcggatgtggcggtcgtatggtttcgtgatggcgcccttctacagcccagtgaaaagtttgccatctcacaaagcggagcgtctcattccctgaccatctcagatttagtgctggaggatgccggacaaatcactgtggaagcggagggggctagctctagtgccgccctccgcgtaagagaagcacctgttctgttcaagaagaaactggaaccacagactgttgaagaaagatcttctgttaccctggaagtagaactgacaaggccctggcctgaattaagatggacacggaacgcaacggctctcgcccccgggaaaaatgtggagattcacgctgagggagcacggcaccgcctggtccttcataacgttggctttgcggatagaggttttttcggctgcgaaacccccgacgataagacccaggccaagctcactgttgagatgaggcaagtgcgactcgtacgggggcttcaggccgtcgaggctagagagcaagggactgctactatggaggtacaactctcacatgccgacgtggacggtagctggacaagagatggtctgaggtttcagcagggccctacctgccatctggcagttcgggggcccatgcacactctcaccctgtcgggtctccggcccgaggatagcgggctgatggtattcaaagctgaaggggtgcacacatccgcccgacttgttgtcactgaactgcccgtgagcttcagtcgacctctccaggacgtagtcactacggagaaagaaaaggtaacacttgagtgtgaattaagtcggccaaacgttgacgttaggtggcttaaagatggcgtggaactgcgggccggtaagactatggccatcgctgctcagggggcatgccgctccttgacaatttatcggtgtgagtttgccgatcaaggagtatatgtctgcgatgcccacgacgcacagtcctcagctagcgttaaagtccagggccgtacatacaccctgatctatagaagggtgctcgccgaagacgcgggagaaatccaatttgtggccgagaacgccgagtctcgggctcagctgcgagttaaggagctccctgtgaccttagttcgaccactgcgtgataagatcgccatggaaaaacatcgcggcgtcttagaatgccaggtgagtagagctagcgcacaagttaggtggttcaaagggtcacaggagctccagccaggacccaagtacgagctggtgtcagacgggctgtaccgaaaactaattattagtgacgtacacgccgaagacgaggacacttacacgtgcgacgctggagacgtgaaaactagcgcccagtttttcgtggaggagcaaagtataactattgtgagagggctgcaggatgtgaccgtcatggaacccgctcccgcatggtttgaatgcgagacatccatccccagcgtgagaccacccaagtggttactgggtaagaccgtcctgcaggcgggaggtaacgtgggtttggagcaggaaggcacagtacacagactgatgctgagacgcacatgcagcactatgacgggaccagtgcactttacagtcgggaaatcccggagcagtgcccgtttggtggtcagtgatattccggtcgtcctgacacgccccctagagccaaagaccggcagagaacttcagtctgtggtgctctcctgcgactttagaccagcgcctaaagcagtgcaatggtataaggatgatacccccctcagtcctagcgagaaatttaagatgtcactagagggacagatggcagagctacgcatcctccgactgatgccagccgacgcaggcgtgtatcggtgccaggctggcagcgcccattccagcaccgaggtgacagtagaagcccgcgaagtgacagtaactggtcctcttcaggatgcggaggctacggaagagggctgggcgtcattcagttgtgaactgtcccatgaagacgaggaggttgagtggtcactgaatggcatgccactctacaacgactcttttcacgagataagccacaaagggcgtcgtcataccctcgtgctcaagtctatccagagggctgatgctggcatcgtgcgcgcgtcatcgttgaaggtctcaacaagcgcccgcttagaggtcagggtcaagccggtggtttttctgaaggccctggacgatcttagtgcagaggagcgcggcacactggcactccagtgcgaggtttccgacccggaagcgcatgttgtgtggaggaaggatggcgtgcagctgggaccatcagacaagtacgacttccttcacaccgccgggacacgcggtttagtggttcatgatgtgtctcccgaggacgctggcctgtatacatgccacgttggctccgaagagactagagccagagttagagtgcatgatttgcatgtgggcatcacgaagcggcttaaaacgatggaagtgttagagggagaaagctgcagttttgagtgcgtgctgtcccacgagtctgcaagcgatcccgccatgtggaccgtgggaggtaagaccgttggctcttcatctaggttccaggcgactagacaaggaaggaagtacattctagtggtgcgtgaggcagccccttcagacgctggagaggtggtattcagcgtgaggggactgacaagcaaggcgagtctcatagtgcgagagaggccagccgcaatcattaaaccattagaagatcaatgggtcgctccgggtgaggacgtggaattacgctgtgagcttagccgcgctggaacccctgtgcattggctcaaggatcggaaggctatcaggaaaagtcagaagtatgacgttgtatgtgaaggcacgatggcaatgctggtgatacggggagcttcccttaaagatgcaggagagtatacctgtgaagtggaggctagcaaaagtaccgcaagtctgcacgttgaggaaaaggcaaattgtttcacagaggagctgaccaatttgcaagtggaggagaaaggaacggctgtgttcacctgtaagactgagcaccctgcggcgaccgtcacctggagaaagggcctgctcgagctgcgggcttctgggaaacatcagccctctcaagaaggccttacgctcagactgacgatttccgcgctcgagaaggcggattctgatacctacacatgcgatattgggcaggctcagtctcgcgcccagcttctcgtgcaaggaaggagggtccacatcatcgaagatcttgaagacgtggacgtgcaggaaggtagctccgcaaccttcagatgcagaataagtccagcaaactacgagcctgtccactggtttctagacaagaccccccttcacgccaacgaactaaacgagatcgacgcccagcctggaggctaccacgtattaacactgaggcagctggcactcaaagattctggcactatctatttcgaggcgggcgaccaacgcgcctctgccgctctccgcgttactgagaaaccatcagtgttctctcgcgagctgacggatgctaccataaccgaaggggaggacttaacgctggtttgtgaaacttccacctgtgatattccagtgtgctggaccaaagatggcaagaccctgcgggggagtgcacgatgtcagttgtcccacgaaggacatagggcccagctgctgattactggggctacgctgcaggacagcggacgttataagtgtgaggcaggcggagcctgcagttcatccatcgttagggttcatgctaggcccgtcagattccaagaagcactgaaggacctggaagtcctcgagggaggggctgctacgctgaggtgtgtgttgagctctgtggccgctcctgtgaagtggtgctatggaaacaatgtactgcgccccggcgacaagtactccctgcgccaagagggagcgatgcttgaactggtagtccgtaatctcaggccacaggacagtggaaggtactcttgctccttcggcgaccaaaccacgtccgctactctgactgtaaccgccctccccgctcaatttatcggcaagctaaggaacaaggaggccaccgaaggggccacagccacgctgcgctgcgagttgagtaaggcagcgcctgtcgagtggagaaagggatcagaaacactgcgagacggagatcgctattgtctaagacaggatggcgcaatgtgtgagctgcagattcgcgggctcgctatggtggatgctgccgagtatagctgtgtttgtggcgaagagagaacctcggcaagtctgaccataagacctatgcccgcccacttcatcgggcggcttcgccaccaggagtccatcgaaggtgcaacagccaccttacgctgtgaactctctaaggcagcacccgtggagtggaggaagggccgcgaatcactccgggacggtgatcggcatagcttaagacaagacggcgccgtctgcgaactccagatatgtggattggctgtagccgatgctggcgagtactcctgtgtctgcggagaggagagaactagtgccacgctcactgtgaaagccctcccagcaaagttcactgaaggattacggaatgaggaggccgtggaaggcgcgacggctatgctttggtgcgaactgtccaaagtggcccctgtcgaatggcgtaaagggcctgaaaatcttcgcgacggggaccgctacatcctgaggcaggaaggtacacggtgtgagctgcagatttgtggcttggccatggctgacgccggggaatacctttgcgtgtgcggccaggagaggacatcggccacgctcacgataagagccctccccgctcggttcattgaagatgtgaaaaatcaggaggcaagagaaggggctaccgcggtgctccaatgcgagttgaacagcgccgcaccagtggagtggagaaaaggctcagagacacttcgcgatggtgatagatacagtctccgccaggacggtacaaaatgtgagcttcagatcagggggttggctatggccgacaccggagaatactcctgcgtctgcggccaagaacgcacgtctgcgatgctcacagtgagagccttgcctattaaatttactgagggacttcgcaatgaagaagcaacggagggggccactgccgtcctgcggtgcgagctctcgaaaatggcccccgttgaatggtggaaaggccacgagaccctgcgagatggtgatcgccattctctccggcaggatggcgctcggtgcgaactccagatcagaggcttggttgctgaggatgccggtgaatacctttgtatgtgcggtaaagagcgtacaagcgccatgctcacagtccgagcaatgccttccaaattcatcgaggggctgcgcaatgaagaagctacggaaggcgacacagccacactctggtgcgagctaagcaaggccgcgccagtcgagtggcgcaagggacatgagactttaagagatggcgaccgccactccttgaggcaggacggttccagatgcgaactccagattcgggggctggcagtggtggatgccggggaatattcatgtgtgtgcggccaagagcggacttccgccacactgaccgtgagagctttgcccgcccgttttatcgaagacgtgaagaaccaggaggctagagagggggcaactgccgtccttcagtgtgaactgtcaaaggcagctcccgtggagtggagaaaaggtagtgaaactctgagagggggcgaccggtattctctgcggcaggatggaacaaggtgcgagttgcagatacacggcttaagcgtcgcagatacaggcgagtatagctgtgtatgcggccaagaacgtactagcgctacactcactgtccgagctccccagccagtttttagggagcctctgcagagtctgcaggcagaggaaggctctacagctaccctgcagtgcgaactgtcagagcccacagcgaccgttgtctggagcaaaggcgggcttcagttgcaagctaatggtagacgcgagcctaggctccaggggtgtaccgctgaactcgtgctgcaggatctgcagagggaggacacaggcgaatatacatgcacatgtggtagccaggctacttctgccacgctaaccgtgaccgccgcacctgtcagattcctccgtgaactccaacaccaagaggtggacgagggcggcaccgctcacctgtgttgcgagctttcccgcgccggggccagcgtcgaatggcgtaaaggttccttacaattgtttccgtgcgccaagtaccaaatggtccaggacggggctgctgccgagctgcttgttaggggggtggagcaggaggacgccggggactatacctgcgatactggacatactcagagcatggcctcccttagtgtgagggtccctcgtcctaaattcaagaccaggctgcagtcccttgagcaagagactggggacattgcccgcctgtgctgtcagctgtcagacgccgagtccggcgccgtcgtgcagtggcttaaagagggtgttgaactccacgctggcccgaagtacgagatgcggtctcagggagcaaccagggagctgcttattcatcagctggaggcaaaagacacaggggagtacgcttgtgtgaccggcggacagaagactgccgccagcttaagggtaaccgaacccgaggtgacaatcgtccggggactcgtagacgccgaagtcacagctgatgaggacgttgaatttagctgtgaggtcagtagggctggcgcaactggcgtgcagtggtgtctgcaaggcctgcctctacagagcaacgaggtgactgaagtcgctgtgcgcgacgggcgtatccatacactccgcctgaaaggcgttaccccggaggacgcaggcaccgtgagttttcacctggggaatcatgctagctcagcccagctgactgtgcgcgctccagaagtaacaatccttgagcccctgcaggatgtacagttgtccgagggtcaggacgcatcctttcaatgcagactctcacgcgcttctggccaggaggcaagatgggcccttggaggtgtgcccttgcaggcaaacgagatgaacgatatcaccgtagaacagggaactttgcacctgctcacgttgcataaggtgaccttagaggacgctggcaccgtttcgttccatgtgggaacttgttcatcggaggcacagctgaaggtcactgcaaagaatactgtggtacgtggactggagaatgtcgaagccctggagggcggcgaagcactcttcgaatgtcagctatcccagcctgaagtggcagcacatacctggttgctggacgacgaaccagtccacacctcggaaaatgccgaagtcgtgttctttgagaacggtttaagacatctgctcctgctgaagaacttgaggccacaagatagctgccgggtaacttttctggcaggcgacatggtaacttccgcctttctgacagtgaggggctggagactggagatcttagaaccattgaagaatgcagccgttagagctggtgcgcaggcttgtttcacttgtacactcagcgaggcagttcctgtcggggaggcttcgtggtatattaatggggctgctgtgcaaccagatgacagcgactggactgtgaccgccgatggttcccaccatgctttgctacttcggagcgcccagccacatcatgctggagaagtcaccttcgcgtgtagagacgccgtagcctccgcccgcctaacagttttgggcctgcctgatccaccagaggacgcggaggttgtggctagatcaagccacaccgtgactctttcctgggcggccccaatgtcagatggaggtgggggactgtgtggataccgagtggaggtaaaggagggagcaaccggccaatggcgcctctgtcacgagctcgtcccaggacccgagtgtgtggtagacgggctcgcaccaggggaaacataccggttccgagtcgccgccgtgggtccagtgggagctggtgagcccgtccatctgcctcaaacagtgaggctcgctgagccacctaaaccagtgccccctcagccaagtgcacccgaatctcggcaggtggctgctggagaggatgtgtctctggaactggaggtcgtggcagaggcaggcgaggtgatatggcataaaggtatggaaagaatccaacccggaggtcggttcgaagttgtatcacagggacggcagcaaatgctggtgattaagggtttcacagccgaggatcagggtgagtaccactgcgggttggcccaaggatcgatctgtcccgccgctgcgacttttcaagtggccctgagtcccgcatccgtggatgaagctccacagcccagcctgccgccagaggctgctcaggagggcgacctgcacttgctctgggaagccttagccaggaagaggcgcatgtcccgagaaccaactctcgactccatcagcgagctcccagaggaggacggacgcagtcagcgcctacctcaagaggccgaggaggttgctccagatctgtcagagggttatagcacagctgacgaactggctagaacgggtgatgctgatctttcccacacttcctctgacgacgagagtagagctggcacacccagtctggttacatacctgaaaaaagccggcagaccaggtaccagtccacttgcctccaaagtgggcgcccctgccgcaccttcggtgaagccccaacaacagcaggaaccactggcagccgtgaggccacctctaggagaccttagcacaaaagacctgggagatccttcgatggacaaggctgccgtaaagattcaagcggcctttaaaggatataaggtgcggaaggaaatgaagcagcaggaaggcccaatgttttcccacacatttggtgacactgaagcgcaggtgggagatgcattaaggctagaatgtgtggtggctagcaaggccgatgtgcgcgccagatggctcaaagacggggtcgagttgacagatggacggcatcaccatattgaccagcttggagacgggacttgttctcttctgattaccggactggaccgtgcagatgctgggtgttatacatgccaggtgtctaacaaattcggtcaagtaactcactccgcatgcgtcgttgtcagtggcagcgagtcggaggccgaaagctcatcaggaggcgagctggacgatgcatttcggcgcgccgcccgaagattgcaccgcttatttcgcacaaagtctccggccgaagtctccgacgaggagctgtttctgtccgccgacgaagggcccgcggagcctgaagagccagcagattggcaaacttatagggaagatgagcatttcatttgcattaggttcgaggcgctgacggaagctaggcaggctgtcacaaggttccaggaaatgtttgccactctaggcattggtgtggagatcaaacttgttgaacaagggccacgaagagtcgaaatgtgtatctccaaagagaccccagcgcccgtagtccctcccgagccattgcctagcctgttgactagcgacgcagcaccagtgttcctgacagaactccagaatcaggaggttcaggatggctatcctgtaagctttgattgcgtggtaaccggccagcccatgccctccgtgagatggttcaaggacggaaagctgctcgaggaggatgatcattatatgatcaatgaggaccagcaggggggccatcaacttatcattacagcggtcgtccctgctgacatgggggtgtacaggtgtcttgccgaaaattccatgggagttagctctaccaaggctgaactgcgagtggatttaacctccacggattacgacaccgctgctgatgcaacggaaagctcatcatatttctccgcgcaaggctacctgtcttctcgagagcaggaggggaccgagtctaccacagacgaggggcagttgcctcaggtcgtggaagagttgagggatctccaggtagctcctggcactcgcctcgctaagtttcagttgaaagtgaaaggatacccggctccacggctctattggttcaaagatggacagcctctgacagcatccgctcacatcaggatgacagacaagaagatcttgcacactctcgagattatcagcgtaactcgagaggatagcggacagtacgccgcctatatcagcaatgccatgggcgcagcctactcaagtgcccggcttctggtcagagggccagacgaacccgaagagaaacccgcctctgacgttcatgagcaacttgtgcctccaagaatgctggaacgattcacccccaagaaggtgaagaaagggtctagcattactttttcagtcaaggtggagggcagacccgttcccacagttcattggctgcgcgaggaggcggaaaggggcgtgttatggatagggcctgacaccccaggctatacagttgcctcctcagcccagcagcactccctggtcctgcttgatgtgggtagacagcatcaggggacgtacacctgtattgcctcgaatgctgctgggcaggccctttgttccgctagcttacatgtgtccggcctccccaaggtagaggaacaagagaaggttaaagaagctttaatatccactttcttacagggcaccactcaggcgataagcgcccagggcctggaaactgctagcttcgctgaccttggcggacagcgcaaagaagagccccttgcagcgaaagaggccctagggcatctctctctcgcagaagtgggtaccgaagagtttttgcagaaactcacctctcagatcaccgagatggtatcagctaaaatcacgcaagccaaactgcaggtgcctgggggcgactccgatgaagacagcaagacacccagtgcctcaccccgccacggcaggtctcggccgagctcttctatccaggagtcctcatccgagtctgaagacggcgacgctagaggagagatctttgacatctacgttgtgactgcggattatctgcccttgggtgcagaacaggacgcgatcactctgcgcgagggacagtatgttgaagtcctcgacgccgcccacccccttaggtggctagttaggactaagcccacaaagtcatcgcccagcaggcaaggctgggtgtctcccgcatatctagacagacggctaaagctgtctccagaatggggagccgcggaagcccccgagtttccaggagaagctgtttctgaggatgagtacaaagcccgcttgtcgagcgtcattcaggaactcctcagctccgagcaggcatttgtggaagagctgcagttcctccagagccaccacctgcaacacctggaaagatgcccgcatgttccaatcgctgtggcggggcagaaggcagtcattttcaggaatgtgcgtgacattgggcggttccacagttcattcctccaagaactccaacagtgtgatacagacgacgacgtcgcgatgtgtttcatcaaaaatcaggctgcatttgagcaatatcttgaattccttgtaggccgagtccaagcagaatctgtggtcgtaagcacggctatccaggaattctacaaaaagtacgcagaggaggcacttctggctggcgacccttctcagcctccaccaccccccctgcagcattacctggagcagccagtcgaaagggtacagaggtatcaggccctcctcaaagaattgatccggaataaagcacggaatagacagaattgtgcgctgttagagcaagcctacgctgtggtgagcgcgttgccccaacgggcggagaacaagctgcatgtgagcctgatggaaaattatcctggcacactccaggcactaggggagccaattagacaggggcacttcattgtgtgggagggcgcccccggggctcgcatgccctggaaaggtcataatagacacgtgttcctctttcgcaatcacctggtgatctgcaaaccccgtcgcgattcgaggactgatacagtgagctacgttttcaggaatatgatgaagctgtccagcattgatctcaatgatcaagtggaaggagatgaccgggcttttgaggtttggcaggaaagagaagactcagtccggaaatatctgctccaagcgaggacagcgattattaagtcatcctgggtgaaagagatctgtgggatccagcagcggctggcactgccagtatggagacctcctgacttcgaagaagaactggcagactgtacagctgaacttggcgaaacagttaaactagcatgccgggtcactggcacccccaagccagtgattagttggtataaggatggaaaggctgtgcaggtggatccccaccacatcctgatcgaagaccccgacggctcatgcgcgctcatcttggactccctcactggcgtcgactctggccagtacatgtgttttgcagcttccgccgccggcaactgctccacactcggaaagatcctagtgcaggtccccccgcgatttgtgaataaggtgcgggccagtccctttgtagagggagaagatgcgcagttcacttgcacaattgagggcgctccctatccacagattagatggtacaaggacggcgccttgttgaccactggaaataagtttcagacactgtccgagccccgttccggcttgcttgtgctggttattagagcagcgtccaaagaggatctgggcctgtacgagtgcgagctggttaaccggttagggagcgcacgagccagcgccgaactgcggattcaaagcccaatgttacaggcacaggaacaatgccatcgagaacagctggtcgctgcagtcgaagacacaactttggagcgtgccgatcaagaagtaacttctgtactcaaaaggcttcttggacctaaagccccggggccaagcactggagacctgaccggaccaggaccttgccctcggggtgcccctgctttacaggaaaccggctcccagcctccggttaccggtacctccgaagcaccggccgttccacctagagtcccccagccactgctccacgagggaccggagcaggaacccgaagcaatagcgcgcgcgcaggagtggacagttcctataaggatggagggtgctgcatggcccggggctggcacgggcgaattactgtgggatgtgcatagtcacgtcgtgcgggagaccacccagcgtacttatacctatcaggccatagacacacacactgctcgccccccaagcatgcaggtgactattgaagacgtccaggcacagactggcgggacagctcagttcgaagcgataatcgagggcgacccgcaaccatccgtcacttggtacaaggacagcgtccagctggtggattcaacccgcctctcacaacagcaagaaggaaccacctattcacttgtattgagacacgtggcttccaaggacgccggagtctatacctgtttggcccaaaatacggggggccaggtgctctgtaaggctgaactgctggttttgggaggggacaacgagcccgactcagagaagcaatcccatcgacgtaagctacattccttttacgaggtaaaagaggaaatcgggcggggagtcttcgggtttgtgaagcgcgtgcagcacaaaggcaacaagattctctgtgccgcgaaatttattcctctcaggagcaggacccgggcccaggcctaccgtgagagagacattttagcggcactttcacatccgctggtgactggcctgttagaccagttcgagaccagaaagacactgattcttatactggagctttgtagtagtgaggagctgctggataggctttatcgcaagggcgtcgtaaccgaggccgaggtcaaggtgtatattcagcagctggttgaaggactgcactatcttcattcccacggggtcctgcatctcgatatcaaaccttccaacatcctgatggtgcaccccgctagagaagatattaaaatttgcgactttggttttgcccagaacatcacaccagcagaattgcagttcagtcagtatggctcccctgagttcgtgagtcctgaaatcatacagcagaatcccgtaagcgaggcgagtgatatttgggcgatgggcgtaatatcttacctttcgttaacatgctcctccccgttcgcaggtgaatccgacagagcaacgcttctcaacgttctggaaggccgcgtgagctggagttcccccatggccgcccacttgagtgaggacgccaaagactttatcaaggcgactcttcagagagccccacaagcccgaccctctgccgcacaatgcctgagccacccatggtttctgaaatcaatgcctgctgaggaggcccacttcataaataccaaacagctcaaattccttctcgccagaagtcggtggcaacggtctctgatgagctacaagtcgattttggtaatgagatctattcctgagctgctgagaggaccacccgattctccctcactgggagtcgcccggcatctctgtagggatacgggcggatcctcttcctcttcttcctcctccgataacgaactcgctccgttcgcgcgagcaaagagccttcccccgtccccagtcacacactctccgttactgcacccaagaggttttcttcgcccgtccgcatccttgcccgaggaggctgaggccagcgagcgcagcaccgaagctcctgctccacctgcttcccctgaaggcgcaggcccaccagcagctcaagggtgcgtgcctcggcactctgttatccgatctttgttttaccatcaagccggagaatcccctgagcatggggccctggcgcctggctcacgacgccacccagcacggagacgacatcttctgaaaggggggtatatagctggggcccttccaggcctgcgggagccactaatggagcaccgcgtcctggaagaggaggcagcccgggaggagcaggcgactcttcttgcgaaagcaccttcatttgagacagcacttcgtctcccagcttcgggaactcacctcgcccctggccactctcactctttagagcacgatagccccagcactcccagaccttcctctgaggcctgtggagaggctcagaggctgccaagcgccccttcaggcggcgcccccattcgcgacatgggccacccacagggcagtaaacagctgccttcaaccggtggccatcccgggactgcccagccagagcggcctagtcctgacagtccttggggtcaacccgcccccttctgccatcctaagcagggaagtgcaccgcaagagggttgctctccacaccccgccgtagccccctgtccgccaggctctttcccccctggatcttgtaaagaggcacctttggtaccttcttcccctttcctgggacaaccgcaggccccgccagcacctgcaaaagcttccccaccactggatagcaagatgggccccggcgatatatcccttcccggtcgccccaaacctggcccttgctcatcacctggcagtgcgtcacaggcatccagcagtcaggtgagttcattgagagttggaagttcccaggttggtacagagcctggcccgagcttggatgccgaagggtggactcaagaggcagaggatttatctgacagcacgcccacactccagagaccacaagagcaggccactatgcgcaagttctccctcggcggaagggggggatatgccggcgtggcaggatatggaacattcgcgtttggtggtgatgcgggtggaatgttaggacaaggccctatgtgggcacggattgcatgggctgtgagtcaatccgaagaggaagagcaagaggaggcccgtgcagagtcacagtccgaggaacagcaggaagctcgcgccgaatctcctctgcctcaggtgagcgccagaccagttcccgaggtggggagggctcctacccggtccagtcctgagccgacaccctgggaggatattggacaggtcagtctggtacagattcgagaccttagcggagacgctgaggccgccgacaccatatctctggatatctccgaagttgaccctgcgtacctgaacctgtcagatctgtacgatatcaaatatttgccatttgagttcatgatatttcgaaaagtccccaagtccgcgcagcccgagcctccatctcccatggcagaagaggaattagcagaattcccagagcccacttggccatggcccggcgaactcggaccacatgctggactggagattacagaagagagcgaagatgtggacgccctgctggcagaggcagcggtgggtcgcaagcgtaagtggtcatctccctcacggtcactcttccactttccaggtagacatctcccactggacgaacccgctgagctcgggctgcgcgagcgagtgaaagctagcgttgagcacatttcccgcattctcaaaggcagacccgagggcttggaaaaggaaggaccaccccggaaaaagcctggcttagccagcttcaggttatcgggtctgaagagttgggaccgcgcccctacatttctgcgggagctgtctgatgagaccgtggtacttggccagtcggtgacactggcttgtcaagtgagcgcgcagcccgcagcacaggcaacatggtcaaaggacggcgcaccactagaaagcagctccagagttcttatctccgcaactttaaagaacttccagctgcttacaattttggtcgttgtggccgaagatctaggggtctacacctgctctgtaagcaatgccctgggtactgtgaccaccaccggggtgctacgcaaagccgagaggcctagcagcagcccatgtccagatattggtgaagtgtacgcagatggcgtgttactggtttggaaacccgtggagagctatgggcctgtgacttacattgtccaatgctctctcgaggggggctcctggaccactttagctagcgacatctttgattgttgctatttgacaagcaagctatctagaggcggaacttacaccttccgaactgcgtgcgtgagcaaagctggtatgggaccctacagcagcccttcggagcaagtcctcctggggggcccaagccatttggcctcagaggaagagtcccagggacgctcagcccagcccttaccatctacaaagacttttgccttccaaacccaaattcagcggggtcgattctccgtcgtacgtcagtgctgggaaaaagcctcggggcgtgccctggctgcaaaaattataccctatcaccccaaggataagactgcagttctccgagagtacgaggcgctaaaaggattgaggcacccacacctggcccagttgcatgccgcatatcttagtccaagacatctcgtgttaatcctcgagctgtgcagcggacccgagctcctaccctgcttggccgaaagggccagttattctgagtccgaggttaaagattacctttggcaaatgctttccgctacccaataccttcacaaccagcacattctgcacctggatctccggtctgaaaatatgatcatcaccgagtacaaccttctcaaggtggtggacctagggaacgcccagtcactcagccaggagaaggtgctgccctccgataagttcaaagattacctggaaacaatggctccggagcttctggaggggcaaggcgccgttccgcagaccgatatctgggcaatcggggtcacagccttcattatgctgagtgcagaatacccagtgagctcagagggtgctcgtgacctgcagcgcgggctgagaaagggactcgtcagactgagccggtgctacgctggcctgagcggcggggctgtggcgtttctgaggtctacgctttgtgcccagccctggggccggccctgcgcgagctcctgcctgcagtgtccctggctaaccgaagagggacctgcttgctcccggcctgcccccgtgacgtttccgacagccaggctgagagtcttcgtgcggaatagggaaaagagacgcgccctgctttataagcgccataacttagcccaggtgaggtag

SEQ ID NO: 25495 - DNA, 750 bp, Artificial Sequence
  Description of Artificial Sequence: Synthetic coding sequence
atgaccgaggacagccagcggaacttccggagcgtgtactacgagaaggttggatttcggggcgtcgaggaaaaaaagtccctggagatcctgctgaaggatgacaggcttgacacagagaaactctgtacatttagccagcggttccctttaccttcaatgtacagagcacttgtctggaaagtattacttggcatactgccaccccaccacgagtcacacgccaaggttatgatgtaccgcaaggagcagtacttggatgtgctgcacgcgctgaaggttgtgcgattcgtcagcgacgcgaccccccaggctgaggtgtatttgaggatgtatcaactagagtctggcaagttgccccgcagcccttcttttcctctggagccggacgatgaagtgttcctcgctatcgccaaggcgatggaggaaatggttgaggacagcgtcgactgttattggatcactagacggtttgtgaatcagctaaacactaaatatagggactctctgccccaactcccaaaagcattcgagcaatatctgaatctggaagatggacggctgctgacccatctgagaatgtgcagtgccgcccctaagctcccctatgatctctggttcaagaggtgcttcgccgggtgcttgcctgagtcatcgcttcagcgcgtatgggacaaagtcgttagtggctcctgcaaaatcctggtcttcgtcgctgtcgaaatattgctcacatttaaaattaaatag

SEQ ID NO: 25496 - DNA, 417 bp, Artificial Sequence
  Description of Artificial Sequence: Synthetic coding sequence
atgagcagcctgggcgccagcttcgtgcagatcaagttcgacgacctgcagtttttcgagaactgcggcggagggtccttcggatctgtgtatagagcaaagtggatttcacaagacaaagaagtcgcggtgaagaaactcctgaagatcgagaaggaagccgagattctgtctgtcctgagtcataggaatatcatccagttctacggcgtgatcctcgagccaccaaattatggtattgttacagagtacgcttcactgggttcactgtacgactacataaacagtaacagatcggaagagatggacatggatcatatcatgacatgggcaaccgacgtcgccaagggcatgcactatctgcacatggaggccccagtgaaggttattcacagagatctgaaatcaagaaactag

SEQ ID NO: 25497 - DNA, 1122 bp, Artificial Sequence
  Description of Artificial Sequence: Synthetic coding sequence
atggccagcagcagcgtgccccccgccaccgtgagcgccgccaccgccggtccgggaccggggtttggttttgcttcgaagacaaaaaaaaagcacttcgtccagcagaaggtgaaggtatttagggcagccgatcccctggtgggtgtgtttctctggggggtagcccactctattaacgagctgtcacaggtgcctccccccgtcatgctgctcccggacgacttcaaagccagctcaaagattaaggtgaacaaccacttgtttcatcgggaaaatctgccctctcactttaaatttaaggaatactgcccccaggtcttccgcaacctcagggaccgattcggaatagacgatcaggactacctgtatatcgtgaagtgccatggcaatacgctgctgccccagttcctgggcatgtatagagtgagcgttgacaacgaggattcctacatgctggtcatgcggaacatgttctcacacaggctgcctgtccatcgcaagtatgatctaaagggttctctcgtctctagggaagcaagcgataaagaaaaagtgaaagagctgcctacgctcaaggacatggatttcctcaacaaaaaccagaaagtatatataggcgaggaggaaaagaagatttttcttgagaagcttaaacgggatgtggaatttctcgttcagctgaaaattatggattactcactccttctggggatccacgacatcatccggggctcagaacccgaggaagaggcccccgtcagggaggatgagtctgaggtggacggtgattgctccctcactggccctcccgccctggtggggagctacggcacctcacccgagggaattggagggtacatccatagccatcgcccattaggacccggggagttcgagagttttatcgatgtctatgcaattcgtagcgccgagggcgccccccaaaaggaagtttacttcatgggactcattgacatcttgactcagtacgatgcaaaaaaaaaagcagcacacgccgctaagacagtcaagcacggcgccggcgctgagattagcacagtccacccagagcagtacgccaagcgattcctggatttcattacaaacatattcgcgtag

SEQ ID NO: 25498 - DNA, 549 bp, Artificial Sequence
  Description of Artificial Sequence: Synthetic coding sequence
atggaggagatccccgcccaggaggccgccggcagcccccgggtgcaatttcagtctctcgagactcagagcgagtgtctctccccagaaccccagtttgtgcaggacacagacatggaacaggggctcactggtggctttcccatatccaaacccgatggtatctcccagctcgaacaggacctccaggtgtttgacctggagacaaaaacacgggaagtgctgagagacgactgttccgatggagagacccgcgaagaaaacaagctcctaatcccgaagcagaaaatctcagaggaggtgcactcatacaaagtccgcgtgggacgtctgaaacacgatatcacacaggtgccggagaccagggaagtatataaatccgaagaccgcctggagcgcctgcaggagattttgcgtaaatttctgtacctagaacgtgaatttagacaaattaccatctccaaagaaacattcacctctgagaaaaacaatgaatgccatgagcctgaaaagagtttttcactggactccactatcgatgccgactag

SEQ ID NO: 25499 - DNA, 2253 bp, Artificial Sequence
  Description of Artificial Sequence: Synthetic coding sequence
atgagcctgggcaaggcctacggcgtggagagccacgtgctgagcccggcagaaaccaaaactttatatccactgatgaatgtggacgatctttatgggaccctgtatgtgcctcacgacggtactatggaccctgcgggcacatgcacaacccttgctcgggctgccagtgcacgcggggcccaagtaatagagaactgccctgttactggaattagggtgtggaccgatgatttcggagtgcgtagagtggctggtgtggagacccagcacggatcgatccagaccccttgtgtagtaaactgcgctggtgtgtgggcaagcgctgtcggtagaatggcgggagtgaaagtgcctctggtagcaatgcatcatgcctacgtagttacagaacgcatcgagggcattcagaacatgccgaacgtgcgagaccacgacgcttccgtttacctgcgtctccagggggatgccctgtccgtgggcggatatgaagccaacccaatcttttgggaagaggtgtcagacaaatttgcattcgggttgtttgatctagattgggaagtgtttactcagcatatcgagggcgctattaacagagtgccggtgctggagaaaactggaatcaagtctactgtgtgtggacctgagtcttttacgccagaccacaagcctctgatgggggaggcaccagaactgcgcggcttttttttagggtgcggctttaactcggccgggatgatgttaggtggaggctgtgggcaggagctggcacactggatcatccatggccggcccgagaaagacatgcacggatacgatattaggcgcttccatcactctctcaccgaccacccccgctggatccgagagcgaagtcacgagtcatatgctaagaattattcagtcgtgttcccccacgatgagcctctcgccgggcggaacatgaggcgcgaccctttgcacgaagaactgttgggccagggatgcgtgtttcaggaaagacacggctgggagagacccggttggttccatccaaggggtcctgcgcctgtgcttgaatacgactattacggcgcctacgggagcagggcccacgaggactatgcttacaggcggctcctggctgacgaatacactttcgcatttccgcctcaccatgataccataaagaaggagtgtctggcttgtcgcggagcagccgcagtattcgatatgtcttatttcgggaagttttatcttgtcggcttggatgctcggaaggccgcagattggctcttcagcgccgacgtctccagaccgcctggatccacggtgtatacttgcatgttgaaccacaggggtgggaccgaaagcgacctgactgtgagccggctggcaccaagccatcaggcctcccccttggctccagccttcgagggtgatggctattacctggctatgggcggggcggttgcacagcacaactggagccatataactaccgtccttcaggatcaaaaatcccagtgtcagttaattgacagcagcgaagacctgggcatgatttccatacagggtccagcaagcagggccattctccaggaagtgttagatgccgacctcagcaatgaagcgttccccttctccactcacaagttactcagggccgcgggccacctcgttcgggccatgcggctgtccttcgtcggagagctggggtgggagctgcacattccaaaggcatcatgtgttcccgtatatagagctgttatggccgcgggcgctaagcatggtctaatcaatgctgggtatcgtgccatcgactctctgtctattgaaaagggttaccgtcattggcatgcagaccttcggcccgatgatagccccctggaggcgggccttgcctttacgtgcaaactaaagtctcccgtaccctttctcggacgggaggctctagagcagcagagagccgcgggccttaggcgccgcctcgtgtgttttactatggaggataaggtacctatgttcggactggaagccatctggcgtaacggccaagttgttggccatgtccgacgtgccgacttcggcttcgctatcgacaaaacaattgcttacgggtatattcatgacccatccggaggtcccgtgagccttgatttcgtaaaatctggagattatgcactggagcgcatgggggtgacatatggcgcacaggctcacctgaagagtccattcgaccctaataacaagagggttaaaggcatatactag

SEQ ID NO: 25500 - DNA, 459 bp, Artificial Sequence
  Description of Artificial Sequence: Synthetic coding sequence
atgagcgtgacctacgacgacagcgtgggcgtggaggtgagcagcgattccttctgggaggtgggcaactataagcgcacagttaagaggatcgacgacggccatcgactctgcagtgacttaatgaattgtttacatgaacgggcccgaatcgaaaaggcgtacgcacaacagctgaccgagtgggcccgacgatggagacagttggttgaaaaaggaccacagtacggcactgttgaaaaggcatggatggcctttatgagcgaggcggaaagagtttccgagttacacctggaggtcaaggcctccctaatgaatgacgactttgagaaaataaagaattggcagaaagaggctttccacaagcagatgatgggtggcttcaaagagacaaaggaggctgaagatggctttagaaaggcacagaagccatgggccaaaaaactaaaggaggtatag

SEQ ID NO: 25501 - DNA, 1620 bp, Artificial Sequence
  Description of Artificial Sequence: Synthetic coding sequence
atggccaccagcgcccccctgcggagcctggaggaggaggtgacctgctccatctgtctagactacctgcgagaccctgtcaccatagattgtggacatgtgttttgccggagctgcacgacagacgttcgacccatctcgggcagccgccctgtgtgcccgttgtgtaaaaaaccgtttaaaaaggagaacataagaccggtgtggcagctggcttccttagtcgagaacatcgaaaggttgaaggttgacaaggggaggcaacccggcgaggtaacacgcgaacagcaggacgctaagctatgcgagagacatagggagaagctgcactattattgcgaggacgatggaaagctgctgtgcgtgatgtgccgagaaagccgggaacacaggccgcatacggcagtgctcatggaaaaggccgcgcagccgcatcgggaaaagatcctcaaccatttgtccactctcagacgtgacagggataaaattcaggggttccaggctaagggcgaggcagacatactcgcagcgctgaaaaagctacaggatcagcgccagtatatagtggcagaatttgagcagggacaccaattcctgagggaaagggaggaacatctcctcgagcagttggcgaagctcgagcaggaacttaccgagggaagggagaagttcaagtctcgcggtgtgggggagctggcccgcttagccctcgtaatttccgagcttgagggaaaggcgcagcagcccgctgcagaactgatgcaggatactagggactttctaaaccggtaccctaggaaaaagttttgggtgggaaagcccattgcccgtgttgtaaaaaagaaaacgggcgaattctcagacaagttgctgtccttacagagaggattaagggaattccaggggaagctgcttcgcgacctggagtataagaccgtgtctgtcacactggaccctcagagcgcgagtgggtaccttcaactgtccgaggactggaaatgcgttacctacactagcttatacaagtcagcgtatttacacccacagcaattcgactgtgagccgggggtcttgggatccaaagggttcacttggggtaaagtgtactgggaggtggaggtagaacgcgaagggtggtctgaggacgaggaggagggcgacgaggaagaagagggggaagaagaagaagaggaagaagaggcagggtacggggatggctatgatgattgggagacagacgaggatgaagagagcctcggcgatgaggaggaggaagaggaggaagaggaggaggaggttctcgagtcctgcatggtcggagtggcccgcgattcagtgaagagaaaaggagatctgtcacttcggccagaagacggcgtctgggccctacgactatcctcctcaggtatttgggcaaatacgtcccccgaggccgagttgttccctgccctgcgtccacgccgtgtcggcatcgcacttgattatgaaggtggtacagtgacgtttaccaacgccgagagccaagaacttatctatacttttaccgcgacattcactagaaggctggtacccttcctgtggctgaaatggcccggaacccgcctgctgctgcgcccatag

SEQ ID NO: 25502 - DNA, 1266 bp, Artificial Sequence
  Description of Artificial Sequence: Synthetic coding sequence
atgatggaggacaacaagcagctggccctgcggatcgacggcgccgtgcaaagcgctagtcaggaggttacaaacttgcgggccgagttgacagctacgaaccgccgtctcgcagaactctccgggggcgggggccctggtccgggccccggcgccgccgcaagtgcatcagcggctggggactccgcggctaccaacatggagaatccgcaactgggagcccaagtgctgttgcgggaggaggtgtccagactgcaagaagaggtgcacctgctgcggcaaatgaaagagatgttagccaaggaccttgaagaatctcagggcggcaaaagttctgaggtcctctctgctactgaactacgagttcagcttgcacaaaaggaacaagagttagcaagagccaaagaagcacttcaggccatgaaagcggaccgcaagcgtctgaaaggggaaaaaacagacctggtctcccagatgcaacaattgtacgctaccctggagtctcgagaggagcagcttagagatttcatccggaactacgagcagcatcgcaaggaatcagaagatgccgtgaaggctttggccaaggagaaggatttactcgagagagagaagtgggagcttcgccggcaggccaaggaggccactgatcatgctacggcattgcgtagtcagctggatctgaaggataatagaatgaaggagctagaagcagagctggccatggccaaacagtccctggcaacactgaccaaggacgttccaaagcgccactctctggctatgcctggtgagactgtcctaaacggtaaccaggagtgggtcgtccaggctgacctgccacttactgcagccatccggcagagccagcaaaccctctatcacagtcaccccccacatcctgcggacaggcaagccgtgcgcgtatcaccatgccacagcagacagccatccgtgatttcagatgcctctgcagcggagggagaccgtagctccactccttctgacattaactccccacgccaccgcactcactcattatgcaacggggactcaccgggcccagtacaaaaaaatctgcacaacccaatagtccaaagtcttgaggacttggaggatcagaagcgaaagaagaaaaaagaaaaaatgggattcggatctatctcaagagtgttcgcccggggcaagcagagaaaatccctcgaccccggtttgtttgacggtactgccccggattattatatcgaggaagacgccgactggtag

SEQ ID NO: 25503 - DNA, 492 bp, Artificial Sequence
  Description of Artificial Sequence: Synthetic coding sequence
atggtgggcggcggcggcgtgggcggcggcctgctggagaacgccaacccactaatttatcaaagatccggggaacgcccagtaacagccggcgaagaggacgaacaggtgcccgactccatcgacgctcgagaaatttttgatttgattcggtccattaacgaccccgaacatccccttacccttgaagagctgaatgttgtggagcaggtaagagtgcaggtcagtgacccagaaagtacagtggcagttgcctttacccccacgattccacactgtagcatggcgacactgattgggctgtctataaaggttaaattgcttagaagcctccctcaacgcttcaaaatggatgtacacattacacctggaacccacgctagcgaacacgctgtgaacaagcagctggcggataaggagagggtcgcagccgcgcttgagaacacacatcttcttgaagttgtgaaccaatgcttatctgctagaagctag

SEQ ID NO: 25504 - DNA, 207 bp, Artificial Sequence
  Description of Artificial Sequence: Synthetic coding sequence
atgagcatcagcagcgacgaggtgaacttcctggtgtaccggtacctgcaagaatctggtttcagccacagtgcattcacattcggcattgaatcacatatttcccaatctaatataaacggcgccctagtgccacctgctgctctgatatcaatcatccaaaaagggctgcaatacgtggaggccgaggtgagcattaacgagtag

SEQ ID NO: 25505 - DNA, 534 bp, Artificial Sequence
  Description of Artificial Sequence: Synthetic coding sequence
atgagcagcaacgagtgcttcaagtgcggccggagcggccactgggcccgtgagtgtccgactgggggaggtcgggggcggggcatgcgctccaggggtcggggaggatttacgagtgaccgcgggttccagttcgtttcttcaagccttccggacatctgttatcgatgcggcgagagtgggcatctcgcgaaagactgcgatctacaagaagatgcctgttacaactgcgggcggggtggccacatcgctaaagactgcaaggagcctaaaagagaaagagaacagtgttgttataattgcggtaagcctggccatctggctcgggactgtgatcatgccgacgaacagaagtgttattcatgtggcgaatttggccacatacagaaggactgcactaaggtgaaatgttatcggtgcggggaaacgggacacgtcgctatcaactgctccaaaacctcagaagtaaattgctaccggtgtggagaaagcggtcaccttgcaagagaatgtactattgaggccacagcatag

SEQ ID NO: 25506 - DNA, 429 bp, Artificial Sequence
  Description of Artificial Sequence: Synthetic coding sequence
atgacccagctgcggcaggtgctggagagccggctgcagcggcccttgccggaggaccttgcgagactgtggcctgtggtgatcctgtgccagctggcgaatcagctacgaccccgtagtgtgccatttatccacgtcccttcaccagctgttccaaaactgtcggccctaaaagcacgcaaaaacgtggaatctttcttggaggcctgccggaaaatgggagttcctgaggcagacctgtgctcaccttccgacctgctgcaggggaccgcacgaggcctcaggacagccttggaggccgtcaagcgggtaggtggaaaggccctgcctcccctctggccccccagtgggcttggtggtttcgttgtattctatgtggtcttgatgctacttctgtacgttacttataccaggttgctcgggagctag

SEQ ID NO: 25507 - DNA, 1296 bp, Artificial Sequence
  Description of Artificial Sequence: Synthetic coding sequence
atggaggacctgaagggccccaccgtgagcagcttcctgagcggcatgaaaacagaactataccccggggtgaccgcaatcgacatgatgtacaaagaagggcttcacggggtggataatggaatactgatctttgacaaagtgcggatcccaagagagaatctcttagataaattcgggagtgtcgccccagatgggcagtatcactcccctatccggaacaagagcgctagatttaatgcaatgttagccgctttgaccccctccaggctggcggtggcatttcaggccatgggcgccatgaagctgggactgacaatcgccatcagatacagccattcccggcggcagtttggccccaagacgaaagaagaagttaaaatcatagaacatcaaacacagacacttcgccttatgccacatctggccactgcactggctctgacctttgtgtcgaggtatgccggcgcattactggacgaagatgtcttccaagggaaggagctggtgaattctcgcagcctccaggcactagttgccggcctgaaggcttatagtacctgggagaacatcaggtgcctccaggattgcagggaatgtacaggcggaatggtagtgggtcgcgagctcttagctcaatacaccaaacagtatgaagagaaacctctctttggactgctgcagaattgggccgaaagtgtcggagacaaactaagaacatcttttcttgcgttcaacatggacaccgtggacgacctagcattcttgctgaaggccgtgaagttcagagagagggttcttcagagaggtttagttgctcgaatctattacaaagtaaagaccaaaaaagaagattttttccacgcttggaacagttgcctgcatcatgtcgcctccctgtcactggctcatacccatcgggtgacactggagcagttctctctggcggtgaagtcctgtcccgaccaggaggaccagaccttactgatgaagttctgcctcctgtacgggactaagctggtgttccaggagagggcatggtacctggaacataagtaccttacacccatggccagtacccgtattagaaatcagctcttggacctttgcgattccgttaaggacgacgcccgcagagtcatcagcactttcaacataccacacacttacctccacgcacccatcgccgggatatccaaccccagggccgcatgggctttttacccagcccccttgcagccacgacctcgtgaggaagcaagatcacgccggccgaaactgggtgccaaactgtag

SEQ ID NO: 25508 - DNA, 1443 bp, Artificial Sequence
  Description of Artificial Sequence: Synthetic coding sequence
atggccgagctgcagatgctgctggaggaggagatccccggcggcagaagagcgctgttcgactcttatactaacttggaacgggtggctgactattgcgaaaataactacatccagagcgctgacaaacagagggcactcgaggagaccaaggcatacaccacccagtctcttgccagcgtggcgtacctgatcaacacgctggctaataacgtcttgcagatgttagatatccaggcttctcagctacggaggatggaatctagcattaaccacatctctcagactgtggacatccataaggagaaggtggcgcgccgcgagattggcatcttgaccaccaataagaatacaagtcggacccataaaatcatcgctccagcaaatttggagcggcctgtcaggtacatcaggaagcccatcgactacaccatcctggacgatatcggacacggcgtaaagtggcttctgcgttttaaagtgagcacacagaacatgaaaatgggcgggcttccccgcacaactcccccaacccagaaaccgccttctccccctatgtctggaaaaggaacattaggccgccattctccttaccggactctggagcctgtaaggccaccagtggtgcctaatgactacgtgccatcccccactcgaaatatggcccctagccagcagtcacccgtgcgtacggcaagcgtcaatcagagaaacaggacatactcgtcaagtgggtcatccggtggcagccatccctcttccagatctagttcgcgcgagaactctggcagcggttccgttggagtaccaatcgcagttcctacaccaagccccccgtccgtgttccctgacgccgcagccgggggtgcacagaccctggccgacgggttcactagtcccacgcctcctgttgtgtcaagtacgccaccaactggacaccccgtccaattctattctatgaacaggccagcctcccgccatacaccccccaccatcggcggctctctcccgtaccgtagacccccatccattacatctcagactagtctgcagaatcagatgaatggtggtcctttctacagtcaaaaccctgtttccgataccccacctccacctccacccgttgaggaaccagtcttcgacgagagcccgcctccaccccctcctcctgaggactacgaggaagaagaagccgccgtggtcgaatacagcgacccatacgccgaagaagacccaccttgggcaccccgatcttacctagagaaagtcgtggccatatatgactacacgaaggacaaggaggatgagcttagcttccaagagggcgcaatcatttacgtgattaaaaagaacgatgacggatggtacgagggcgtgatgaatggtgtgacaggactgttccctggaaattacgtcgagagcattatgcattactctgagtag

SEQ ID NO: 25509 - DNA, 3102 bp, Artificial Sequence
  Description of Artificial Sequence: Synthetic coding sequence
atggacgaggaggagaaccactacgtgagccagctgcgggaggtgtacagcagctgcgataccaccggcacgggatttctcgaccgccaggaactgactcagctctgcttgaagttgcacctagagcagcagctaccagtactcctccagactctgctgggaaatgaccacttcgccagggtgaattttgaagagttcaaagaaggcttcgttgcagtcctatcctctaatgcaggcgtgcgtccatccgacgaggattctagcagtctcgaatccgctgcctcctctgcaatcccccccaaatatgtgaatggaagcaaatggtacgggaggcgtagccgcccggagctgtgtgatgccgctacagaggctcgtagagttccagaacagcagacccaagcatcactgaaatcacatttgtggcgctcagcatctctggaaagtgtcgagtcccccaaatcagatgaggaggcagagtccaccaaggaggctcagaatgagctgtttgaggcccagggccaactgcagacctgggatagcgaggatttcggctcgccccagaagtcgtgtagccccagtttcgacacgccagagagccagatcagaggggtgtgggaagagctcggagtcgggagttccggacatttaagcgagcaagagttagcagttgtgtgtcagtcggtaggacttcaagggctggagaaagaagaactggaggatctgtttaataagctggatcaggacggggatggcaaggtgtccctggaggagttccagctggggctcttcagccacgagcctgccctgctcctagagtcctctacacgagttaaaccttcaaaggcttggtctcattatcaggttcccgaggaatccggctgtcacaccacaactacatccagcttggtctctctttgctcctctctgcgtctatttagttctatcgatgacggctctggctttgccttccccgaccaagtactggccatgtggacccaggagggcatccagaacgggcgggagatcctacagagcctggatttttcagtggatgaaaaggtcaacttgctcgaattgacatgggcgctggataatgagctcatgacagtcgattccgccgttcagcaagcggccctggcttgttaccaccaagagctgagttaccagcagggtcaggtcgagcagctcgcaagggaacgtgacaaggcccgacaggatctggagagggctgaaaagagaaatcttgaatttgtaaaggaaatggacgattgccatagcactctggaacaactcaccgaaaaaaaaattaagcatcttgagcaagggtatagagagcgcctgagtctgctacgatccgaggtggaggccgagcgggaactgttctgggagcaggcccatcgccaaagagcagcactcgagtgggatgtcgggcgcctgcaggcagaggaggcaggcctgcgcgagaaactaaccctcgctttgaaggagaattcacgcttacagaaggaaatcgtggaggtggtggagaagctctccgattctgaacgcctggctctgaagctgcaaaaagaccttgaattcgtgctgaaggacaagctagagccacagagcgcagaactgctggcccaggaagaacggtttgctgcagtcctgaaggagtatgagcttaagtgcagggatctgcaagacaggaacgacgagctgcaggccgaactcgagggattgtgggcccggctcccgaagaacagacacagcccctcttggagcccggacggcaggaggcgacagttgccaggattgggtcccgccggaatttcattccttggtaattccgctccagtttccattgagacggaactgatgatggaacaggtaaaagaacactatcaggatctgagaacgcagcttgagacgaaggtcaactactatgagcgggagattgccgccctgaaaaggaactttgaaaaggagcgtaaggatatggaacaggctcgaagaagagaggtctctgtgctggagggccagaaggccgatctggaggagttgcacgaaaagagccaggaagttatttggggactccaagagcagctccaagacacagctcgcggcccagagcctgagcagatggggttagccccctgctgcacacaagcactgtgcgggctcgccttgcgacatcactcccaccttcagcagatacgcctcgaatttcatcggctcagtgaggaaaacacccttcttaagaatgacctgggcagagtcaggcaggagttggaagcagccgagagcacacacgacgcccagcgcaaagagattgaggtcctcaaaaaggataaagagaaagcatgcagtgaaatggaggtgctgaaccgtcagaatcagaattacaaggaccagctctcccaactcaacgtgagggtgttacagctggggcaagaggcgagtactcaccaggcccagaacgaggaacaccgcgtaacaattcaaatgcttacccagtcactggaagaagtcgttagatccggacaacagcagtctgatcagatccagaagcttagagtggaactggagtgcctgaaccaggaacaccaatctcttcagctcccatggtctgagcttacacagaccctagaagagtcccaggatcaggtgcagggcgctcatttgagactgcggcaagcccaggcccagcacctccaggaggttagattggtcccgcaggatagagttgcagagttgcatcgattgttgtcactgcagggagaacaagcccgtaggaggcttgacgctcagagggaagaacacgagaaacagttaaaagcaactgaggagcgggttgaggaagctgaaatgatcctcaaaaacatggagatgctcttgcaagaaaaagtcgacaagctgaaagagcaattcgagaaaaacaccaaaagcgaccttcttcttaaagagctgtatgttgaaaacgctcatctggttcgcgcacttcaggctaccgaggagaaacagcggggagccgagaaacagtcgcgcctgctagaagaaaaagtcagggccttgaataagctggtgtctaggatcgctcctgcagccctcagcgtctag

SEQ ID NO: 25510 - DNA, 627 bp, Artificial Sequence
  Description of Artificial Sequence: Synthetic coding sequence
tgctgcggctgcagcggcggctgcggcagcggctgcggcggccggggcagtggttgtggaggttgcgggagcggatgcggcggctgcggttctgggtgcgggggttgtggcagcggatgcgggggttgcggggggtgcggttctggttgtgccggttgcggtggatgcaagggtggatgtggatcatgtggcggttcaaaaaggggttgtgtgtcctgtggtgtctcgaagggggcctgcgggagctgtggcggcagtaaaggcggttgcggcagttgcggcggcagtaagggcggttgcgggtcctgtggcggaagcaaaggcggttgtggcagctgtggaggttcgaagggaggatgtggctcatatggctgttcacaatcctcatgctgcaaaccgtgttgctgcagtagcggctgcgggagctcttgctgccagagcagttgttgcaagccctactgctgtcagtcgtcatgctgtaagccttattgttgccaatctagctgttgcaaaccctgttcttgctttagcgggtgcggctcgagctgttgtcaatcaagttgctataaaccttgttgttgccaaagctcctgttgtgtgcccgtctgctgccagtgcaaaatctag

SEQ ID NO: 25511 - DNA, 642 bp, Artificial Sequence
  Description of Artificial Sequence: Synthetic coding sequence
atggccggcagccccgagctggtggtgctggaccccccctgggacaaagagttggctgccggcacagaatcccaggcgctagtaagtgccacccctcgagaggattttagggtgaggtgcacgagcaagcgggccgtcaccgaaatgctgcagctgtgtggcagattcgttcagaagctaggggatgccttgcctgaggaaatccgcgagccggccctgcgcgacgcacagtggacctttgaatcagctgtgcaggagaatatcagcattaacgggcaggcgtggcaggaggcaagcgacaattgctttatggactctgatatcaaggtgctggaggaccagtttgatgaaatcattgtcgacatcgcgaccaagaggaaacagtatccgaggaagatccttgagtgcgtcattaaaactattaaagctaaacaggaaatcctgaagcagtaccaccccgtggtgcatcctcttgacttaaagtatgatccggacccggtcctcaatggaaatgcttttaattttagcccttttaatatgatgttggcggtggacctttcgtatatggtttttattactagctcaccatcctacggaaaattcgaaatgcagagaggcaattcctctaaaggtgatcagtag

SEQ ID NO: 25512 - DNA, 3720 bp, Artificial Sequence
  Description of Artificial Sequence: Synthetic coding sequence
atgaccatctggcagatgcagaagcaggcccagcggggcagccccgcaagaactcattccatgatgtctctcagtgtgcgaccacaacggaggctgcttagcgctcgtgtgaaccggagtcagtccttcgctggagtactgggctcccacgagcgcggaccccgctcatttcctgtgtttagtccccctgggccaccgcgcaaacctcctgcgctttcccgggtgagtaggatgtttagcgttgctcatccagccgctaaagtcccccagccagaacgcttagatttggtgtacaccgcattgaagaggggactgacagcctatctggaagtccaccagcaggaacaagaaaagctgcaggggcagatacgggagagcaagcggaactcccgactgggcttcctgtatgatctggataagcaggtcaaatcaattgagcgctttctccggaggctcgaattccacgcttccaaaatcgacgaactttatgaggcatattgcgtgcagcgtaggcttagagacggcgcgtataacatggttagagcctataccactggcagccctggctcaagagaagcccgcgattctctggcagaagccacccgggggcaccgggagtacacagaaagtatgtgcctgctcgagtctgagctggaggcgcagcttggcgagttccatttgcggatgaaaggattggccggctttgcacgtttgtgcgttggtgaccagtatgagatctgcatgaaatacggccggcagcggtggaagctccgcgggagaatcgagggatctggtaaacaggtttgggacagtgaagagacgatcttcctgcccctcctaaccgaattcctgtccattaaggtcacagagttaaagggcctggccaaccacgtggtggtcggatccgtgagctgcgagaccaaggacctgttcgcagcgctcccccaggtcgtcgcagtagacatcaatgacctaggcaccattaaactgagtctggaggtaacatggtcacccttcgacaaggacgaccagccttctgcagcatcctcagtgaataaagccagtaccgtcaccaagcgcttttcgacatatagtcagtctccccccgacactccctctttacgagagcaggcgttctacaacatgcttagacgtcaggaggaactggaaaatggtacagcctggtctctgtcatcagaatccagtgacgactctagctctccacagttgtctggcactgccagacattcaccagcacccagacctctcgtacagcagccggagcctctccccatacaggtcgcctttagaaggccggagaccccctcttcaggaccccttgacgaggaaggagccgttgcccccgtactggcaaatgggcacgcaccgtactcacggacgttgtctcatatcagcgaggcctcagtcgatgctgcccttgctgaagccagcgtggaggccgtgggcccagagtccctagcgtgggggccaagccccccaacgcatccagcccccacccacggggagcatccctcccccgtgccaccagccctggatccaggacactccgcgacttcgtctacactcgggaccactgggagcgtcccgaccagtaccgacccagcaccgagtgcacacctggactccgtccacaaaagtaccgactctgggccaagtgagctcccgggcccaactcacacaaccacaggtagtacgtactcagcaatcactacaacccattctgctccaagcccgctgacgcacaccaccaccgggtctacccataaacctattatttctacccttacaacaacaggcccaaccttgaatataatcggacctgtgcagaccaccacatccccaacgcatactatgccttcccccacacataccaccgccagccctacccacactagcacatcgcccacccatacccctacctcccctacacacaaaacaagtatgtccccccctacaactacttctcccacaccttccggtatgggcttggtccagacggccactagtcccacccaccccacaacctcacctacacatccgaccacatctccaattctgattaatgtgtcaccttccaccagcctggagttggccacgctgagctccccctctaagcattccgaccccaccctgcccgggaccgattcactcccatgctctcctcccgtgagcaatagctatacccaggccgaccctatggctcctcgtacaccacacccatctcctgcacattcttcccgaaagcctcttacttcccccgcaccagacccctcagagagtaccgtccagtctctttcccccacaccctccccccccactcctgctccccagcatagcgacctttgcttggctatggcagtgcagacacccgtgcccacagctgctggcggctctggagacaggtcgcttgaagaggcacttggggctctgatggccgcacttgatgactatagggggcagtttccggagctgcaggggctagagcaggaagtaaccaggctggaaagcctgctaatgcagcgacagggactaacccgaagccgagccagctccctctcgatcactgtggagcatgctctggagtctttttcattcttgaacgaggatgaagacgaggataatgatgtccccggggaccgtccccctagctcccccgaagcgggggccgaagatagtatcgattccccaagcgccaggcctttgagtactggctgtcccgctctggatgccgccctcgtccgtcacctttaccattgctcccgactgcttctgaaacttggaaccttcggaccacttcgttgtcaggaagcctgggccctggagagacttctgcgggaagccagggtcctggaagccgtgtgtgagttctctagacgctgggaaattccagctagctccgcacaggaagttgtgcagttttctgcctcccggccaggtttcctgacgttttgggaccagtgcacagagcgactaagctgtttcttgtgccctgtagagagagtgctgcttaccttctgcaaccagtacggcgctcgactgagtctgagacaacctggactcgctgaagcagtttgcgtgaagttcttagaggatgcactcggtcaaaagcttccacgccggccacagccggggcccggcgaacaattgactgtgtttcagttttggtcctttgtggaaacactcgactccccgacgatggaggcctacgtgacagagaccgccgaagaagtcttgttagtccgcaacctaaactccgatgatcaggccgtagttctcaaggccctgcgcctggcacccgaagggagactccggagggacgggctgcgggccctgtcgagtttattggttcacggaaacaataaagtgatggccgcagtgagcacccagctgagatccctctcccttggccccacctttagagagagagcgctgctttgctttttagaccaattggaggatgaggacgttcagacgcgggtggcaggctgcctggctctcgggtgtatcaaagcacccgaggggatcgaacctcttgtctatctgtgccagacagacactgaagccgtgagagaagccgccagacagtcactccagcaatgtggagaagaggggcagtcggctcaccggcgcctggaggagtccctagacgccttgcccagaatttttggccccggttccatggcgtcaacagccttctag

SEQ ID NO: 25513 - DNA, 732 bp, Artificial Sequence
  Description of Artificial Sequence: Synthetic coding sequence
atggtgaccgactacggcgccttcatcaagatccccggctgccggaagcaggggctggtgcaccggacgcacatgagctcctgccgcgtggacaaaccgtccgagattgtagatgtgggggacaaagtttgggttaagttaatcgggcgtgaaatgaaaaacgaccggattaaggtgtcattgtctatgaaggtggtgaaccagggcacagggaaagatctcgatccaaacaacgtgattatagagcaagaagagcggcgcagaagatcatttcaggactacaccgggcaaaagattaccctcgaagcagtgctgaacactacgtgcaagaagtgcgggtgtaaaggaagagtcaagccacttcctttcccgaggtttagcccctgtggttggacgctgttttggaagaaggaggccgcacagtgccactttgctaaggactgctttatgcaacccgggggcacgaagtacagtctgattccggatgaggaggaggagaaggaagaggcaaagtcagcagaatttgaaaaacctgacccgaccagaaaccctagtcgtaaaagaaagaaggaaaagaagaagaagaaacatcgtgacagaaaatcatccgactctgatagcagcgactcagagagtgacacgggcaaacgagcacgccatacttctaaagattcaaaggcggctaaaaagaagaagaaaaaaaagaagcataaaaagaaacacaaagagtag

SEQ ID NO: 25514 - DNA, 330 bp, Artificial Sequence
  Description of Artificial Sequence: Synthetic coding sequence
atggaggagatccccgcccaggaggccgccggcagcccccgggtgcagtttcagagccttgagacacaatcagaatgtctgtcccccgagcctcagttcgtccaggatacagatatggaacagggcctgacagggggatttccgatcagtaagcctgacgggatcagtcagctcgaacaggacctgcaggtgtttgaccttgagacaaagacgcgtgaagtgctgagagacgactgtagtgatggggaaacacgagaagagaataaactcttaatccctaagcagaagatctctgaggaggttcactcatacaaggtgagggtggggtag

SEQ ID NO: 25515 - DNA, 4134 bp, Artificial Sequence
  Description of Artificial Sequence: Synthetic coding sequence
atgagcctggagcgggagctgcggcagctgagcaaggccaaggccaaagctcagagagcgggccaaagacgggaagaagcagccctgtgccatcaacttggcgagttacttgcagggcacggcaggtacgccgaagcccttgagcagcactggcaagagctgcagcttagggagagggcagacgacccgttggggtgcgctgtggcccaccgtaaaattggagaacgtctcgccgagatggaagactacccagccgccttgcagcatcagcaccagtatttagaattagcgcatagtctccggaatcatactgaacttcagagagcctgggccaccatcgggagaacacatctggatatttatgaccactgtcagtcaagggatgcgctccttcaggcccaggctgccttcgagaaaagtctcgccatcgtggacgaagagctggaaggcactctggcgcaaggtgaactgaatgaaatgcgtacacggctctatctcaatctgggcctgacctttgagagcctccagcagacagcactgtgcaacgattacttcaggaaaagcatcttcctggctgagcagaatcacctgtacgaagacctatttcgggcacgatataacctaggaacgatccactggagggcaggtcagcacagccaggctatgcgttgcttggagggggccagggaatgcgctcacaccatgcgtaaaaggttcatggaatccgaatgttgcgtcgtgattgcccaggtgttacaagatcttggcgacttcttggccgccaaacgcgctctgaagaaggcttacaggcttggatcccagaagccagtgcagagggccgctatctgtcaaaatctccagcatgtgcttgccgttgtgcgactgcagcagcagctcgaagaggccgagggacgggatccgcaaggggccatggttatctgcgaacaactcggagatcttttctcaaaggcaggagactttccaagagctgcggaggcttaccaaaagcaattgcgcttcgcggaacttctcgaccgccccggggccgagcgagccattatacacgtgagtctcgcaacaacgctgggggacatgaaagaccaccacggtgcggtccgccattatgaggaagagttacggcttcggagtggcaacgttctggaagaggccaagacatggttaaatatcgccctgtctcgcgaagaagcaggagatgcatacgaactgctggcaccctgtttccagaaagccctctcttgtgcgcagcaggcccaaaggcctcagcttcagcggcaagttttacagcacctccacactgtgcagttgcgactccagcctcaagaagcaccagagaccgaaacaaggcttcgggaactctctgtcgctgaggacgaggatgaagaggaggaagcggaggaagccgccgccacggccgaatctgaggcactggaggcgggcgaggtggagttgtctgagggagaagacgatacagacggtctcaccccccagttggaggaggacgaggaactgcaggggcatcttggtcgcagaaagggatctaagtggaataggcggaatgacatgggtgagacactgctccatcgagcctgcattgagggccagctccgccgggtgcaggaccttgttcggcagggccaccccctgaacccacgcgattattgtgggtggacacctttgcatgaggcctgcaattatggccacctggagattgtcaggtttctcttggaccacggagcagccgtggatgacccaggtgggcaaggatgcgaaggaatcacccccttgcatgacgctttaaactgtggccattttgaagtcgcggagctgctgcttgagagaggtgcatccgtgaccctacggactcggaaggcgagcgctcgatggcggaggtgcagctctggcaagctttatcgccgcgatttggatctggaaacacgccagaaggctagagccatggaaatgctgctgcaggccgccgcctccggccaagacccccactctagtcaggcctttcacactccctcctccctgctgtttgacccagaaacaagtcctccattgtctccctgcccagaaccccccagcaactcaacgagactgcctgaggcttctcaagctcatgtgcgggtgagccccggacaagcagcccctgccatggctagaccccgtcgttcacgtcacggcccagctagcagcagtagcagctcagaaggagaagatagtgctggaccagcccgcccatcacaaaaaaggccacggtgcagcgcaacagcacagagagtggccgcatggacaccaggaccagccagtaaccgggaggccgccacagccagtactagcagggcagcttatcaggccgctattaggggcgtgggcagcgctcagtccagactgggaccggggccgccccgagggcattccaaggccctcgccccacaggcggctctgatcccagaagaagagtgcctggccggcgattggttggagttggacatgcccctcaccaggtcacgccgacctcgcccccgcggcacgggtgataacagacggccttcttctaccagcggttccgactcagaggaatcacgcccccgcgcgcgcgcaaaacaggtgagattgacttgtatgcaaagttgctccgcccctgtgaatgccgggccaagttcactcgcgtccgaaccccctggttcaccctccacacctagagtgtccgaaccctcgggggactcatctgcagcgggacagcccctcggcccagctccccctccacccattcgcgtgcgagtacaggtgcaagatcaccttttcctcattcccgtgcctcacagttctgacacacactccgtcgcatggctggcagaacaggccgcccagagatactaccaaacttgtggcttgttgccgcgcttgacacttcggaaggagggggcgttgctggctccacaggatctgataccagatgttcttcagagcaatgatgaagtcttggcagaggttacatcttgggacctgccacccctcacagacagataccgtcgggcttgccagtccttagggcaaggcgaacatcaacaggtgctccaagctgtggaattacagggcctgggcttgtcattcagcgcctgctccctcgccctggatcaggctcagctgacccctctgctacgggcactaaagcttcatacagccctgcgtgaactgcgactggctggcaaccggctgggcgacaaatgtgtcgccgaattagttgccgccctagggaccatgcctagtctcgcgctgctcgatttgagctcaaaccatctcggacctgaaggcctccgacagctggcgatgggcctgcctggacaggctactctgcaaagtctggaggagttggacctcagtatgaaccctctaggagatggttgcggacagtccttggcctcattgctccatgcttgtcctttgctgtccaccctgcgcttacaggcctgcggcttcggcccttcttttttcctcagtcaccagaccgccctgggatccgcattccaggatgccgaacatctcaaaaccctatctctcagttacaatgcgctgggcgcgcccgctctagccaggacgctccagagtctcccggccgggaccctcctgcacctggaacttagctcagtggctgcagggaagggcgacagtgacctcatggagccagtattcaggtacctggccaaggagggatgcgccctggcgcacctgaccctgagcgccaaccacctgggcgacaaggctgtgagggacctgtgtcgctgcctttctctgtgtccttcactgatatctcttgatctgtccgcaaaccccgaaatttcctgtgcctccttagaagaactcctgtccacactgcagaagcggccacaggggttaagctttctgggactgagcggatgtgctgtgcaaggacctctagggctaggcttgtgggacaagattgccgcacagttgagggagcttcagctttgcagccgacgtctatgtgccgaggaccgagatgcactgcgtcagctccaaccctcccggcccggacccggcgagtgcacactcgaccacgggagcaagctgtttttcaggagactgtag

SEQ ID NO: 25516 - DNA, 675 bp, Artificial Sequence
  Description of Artificial Sequence: Synthetic coding sequence
atgcccaccctgttcaagggcgtgtggggcgtggtggagcacagcagggctctcggtaggttttgtccggcatgtctaccctccgggccgcacctacacactcagcctgcactcggaacagcagaaatgactctattgtctagccagagtagttctttagtggccccatcgggcagtgtaagcgctgaaaatcccgagcaaaggatgctagaaaagagggccaaagtcattgaagagctcttgcagacagaacgcgattatataagagacttagaaatgtgtatagagagaataatggtgccgatgcagcaggcccaggtccctaacatcgatttcgaaggactgttcggaaacatgcagatggtgatcaaggtgtctaagcaactgctcgccgcactagagatttccgatgccgtgggcccagtgtttctggggcacagagatgagctggaaggaacctataagatatactgtcaaaatcacgacgaggctattgcgctccttgagatttacgaaaaggacgagaaaattcagaaacaccttcaggactcacttgcggatctcaagtccctctataacgagtggggatgtacgaattacatcaacctggggagttttctcataaagccagtgcaacgcgtcatgcgctaccctctgctgcttatggagctgtag

SEQ ID NO: 25517 - DNA, 354 bp, Artificial Sequence
  Description of Artificial Sequence: Synthetic coding sequence
gtgtgcggcgactacctgctgagccggatggacgtgaccagctgcatctcatacaggaactttgcgtcttgcatgggcgactcaagactactgaacaaggtggacgcgtatattcaagagcatctcctacaaattagcgaagaggaagaatttctaaaactgccccgtctgaaactagaagtaatgttggaggacaatgtgtgtctaccttccaatggtaaactgtatactaaggtgatcaattgggtccagcgctccatctgggaaaacggggactccctggaagaactgatggaggaagtgtcctttaaagttaacggtatccaaccattcctcaaaatcattttactttag

SEQ ID NO: 25518 - DNA, 285 bp, Artificial Sequence
  Description of Artificial Sequence: Synthetic coding sequence
atgctgtgctggggctactggagcctgggccagcccggcatcagcacaaatcttcaaggtatcgttgctgagccgcaggtctgtgggttcatttcagatagaagtgtcaaagaggtcgcatgcggcgggaaccacagtgtctttctgctggaagatggcgaggtgtatacctgtggcttgaatacaaagggccagttgggccacgagagagaagggaacaaaccagaacaaatcggcgctctagccgaccagcatattatacatgttgcttgtggggaaagctag

SEQ ID NO: 25519 - DNA, 747 bp, Artificial Sequence
  Description of Artificial Sequence: Synthetic coding sequence
atggccaccagcgcccccctgcggagcctggaggaggaggtgacctgttctatctgcctagattatctgcgcgacccagtgaccatcgattgtggacacgttttctgcagatcttgcaccacagatgtcaggcctatatccggctcaaggcccgtgtgtcccctgtgcaagaaaccattcaaaaaggagaacattaggccagtttggcagcttgcttccctggtggaaaacattgagcgactcaaagtggacaaagggcgccagccaggcgaagtcacccgcgaacagcaggatgccaagctgtgtgagcggcatagagagaagctccattactactgcgaggacgacgggaagttgctgtgtgtgatgtgcagggagagtagagaacaccggcctcacaccgcggtgcttatggagaaggccgcacagccacatcgggagaaaatcctgaaccatctatctaccctcagaagagacagagataaaatccaggggtttcaggccaagggcgaggctgacatacttgcggcactcaagaagctgcaagatcaaagacaatacattgttgccgaattcgagcaggggcaccagttccttagagagcgcgaggagcatttactcgaacagcttgccaaactggagcaagaactgacggaaggcagagagaagttcaaatcacggggagtgggtgagctggcccggctagctctggtcatttccgaactggagggcaaggcgcagcagtag

SEQ ID NO: 25520 - DNA, 2814 bp, Artificial Sequence
  Description of Artificial Sequence: Synthetic coding sequence
atggagcccgacatcatccggatgtacagcagcagccccccccccctggataatggagcggaggatgacgacgacgatgagtttggggaatttggggggtttagcgaggtcagtccatcaggagttgggttcgtggacttcgatactccagactatacccggcctaaggaggaatttgttccctcgaaccactttatgcccattcatgaattcagtgagaacgtggatagccttacgtcgttcaaatcgattaagaacggaaacgacaaagacattaccgccgagttgtcagctccagtcaaagggcagagcgacgtgttgctgtctaccaccagcaaggagatcatctcaagcgagatgttggccacatccattgacggcatggaacgcccaggcaacctcaacaaagtagttgagcagcgccaaaatgtaggaaccctggaaagtttctctccgggtgacttcagaacaaatatgaatgtcgtgcaccagaacaagcagcttgagagttgtaatggagaaaagcctccctgtctggagatcctgaccaacggcttcgccgtattagagacggtgaatcctcagggaaccgacgatttagacaatgtggccgacagcaaaggccggaagcccctatccactcatagtacagagtacaacttagacagcgtcccgagccccgccgaagaattcgctgatttcgctacattctccaaaaaagagcggattcagttggaagagattgagtgcgctgtccttaatgaccgagaagctttaactattcgtgagaacaacaaaatcaatagggttaatgaactgaactcggtgaaggaagtcgctttgggacgttccctggacaataagggcgacacggacggcgaggaccaggtatgtgtcagtgaaatcagcatcgtgactaatcggggatttagtgtggagaaacaggggctgcctaccctgcagcaggatgagttcctgcagtcaggggtccagtccaaggcttggtctctggtggacagcgcagataatagcgaggccatcagacgggagcagtgcaaaactgaagagaaactcgacctgttaacgtctaagtgcgcccacctttgcatggactctgtcaaaactagtgacgatgaagtggggagccccaaggaggagagtaggaaatttacaaacttccagagccccaacatcgaccccacggaagaaaatgacctcgacgattctctcagtgtcaaaaacggggatagttcaaacgactttgtcacctgcaacgatatcaacgaagacgactttggcgactttggcgattttggctccgctagcgggtctacccctccgttcgttacaggcactcaggacagtatgagcgatgccacttttgaggaaagcagcgaacattttccccacttctctgagccaggtgacgatttcggcgaatttggtgacatcaatgccgtgtcctgtcaggaggaaacgatcttgacaaagtccgacctgaaacaaacatccgataatctgagtgaagaatgtcagctggctaggaagtccagtggaactgggacggagcccgtagccaagctcaagaacggccaagaaggcgaaatcggtcacttcgactctgttcctaacattcaggatgattgcaacggcttccaggacagcgacgacttcgccgactttagttcagccggcccaagtcaggtggtagactggaatgcatttgaagatgaacagaaggatagttgctcttgggctgcattcggagatcaacaggccaccgaaagtcatcatagaaaagaggcatggcagtcccaccggaccgacgaaaatatagatacccccgggacaccaaagacgcattcggttccttccgcaactagcaaaggggctgtggcttctggccatctgcaggaatccgcaacctccgtccaaactgccctgctgaacaggctggaacgaatatttgaagcctgtttcccatcaattctggtccccgacgcggaggaggaggtgactagcctaaagcacctgctcgaaactagcacactgcctatcaagacccgggaggctttgccagaatccggagagctactggatgtttggactgagctgcaggatatccacgacgcccatgggttgcggtaccagtggggaggctcccattctaataaaaagctcctatccagtttgggcattgatacgagaaacatcctgttcaccggaaacaaaaagcagcctgtgatcgttccaatgtacgcagctggtctgggaatgttagagcccacaaaggagcccctgaagccacttagtgcagccgagaaaatcgcatcaataggccagactgccacaatgtccccagatatgaatacgtgtacgtctgaccaatttcaggagtccttgccccctgtccaatttgattggtcaagcagtggactgactaacccactcgacgcttccggcggctcaacacttctgaacttagatttcttcggacctgtggacgattcatctagttccagttctactactatcccaggggtcgaccctgagctgtatgaactcaccaccagcaaactggagatctctacaagcagccttaaggtgactgacgcatttgcgcgtctcatgagcacggtggagaaaacaagtacaagtacttccaggaaaccgaagcgtgaggagcatctttcagaggaggctattaaagtgattgctggactgcccgatctgactttcatgcacgctaaggtgctcatgttccctgctacactgacgccaagcactagctcacaggaaaaggccgacggctag

SEQ ID NO: 25521 - DNA, 114 bp, Artificial Sequence
  Description of Artificial Sequence: Synthetic coding sequence
atggccagcgaggacatcgccaagctggccgagaccctggccaagacccaggttgcagggggccagctgagtttcaaaggaaaaagtcttaagctgaatactgctgaggactag

SEQ ID NO: 25522 - DNA, 309 bp, Artificial Sequence
  Description of Artificial Sequence: Synthetic coding sequence
atgcagaccagcagcagccggagcgtgcacctgagcgagtggcagaagaactactttgcgattacatcaggcatctgtaccggtccgaaagcagacgcctatcgggcacagattctccgcatacagtatgcttgggccaatagcgaaatttctcaagtgtgtgccaccaagctgtttaagaagtacgcggagaaatactcagccattatcgactccgacaatgtggaatctggccttaacaattacgcagagaatattctgactctagctgggtcacagcagacagattcagataaatggcaatcttag

SEQ ID NO: 25523 - DNA, 474 bp, Artificial Sequence
  Description of Artificial Sequence: Synthetic coding sequence
atggccaccagcgcccccctgcggagcctggaggaggaggtgacctgcagcatctgcttggactacttgcgggacccagttactattgactgcgggcacgtcttttgtagaagctgcaccaccgacgtgcgtccgattagcgggtctcggcccgtatgtccactttgtaagaaaccctttaaaaaggaaaatattaggcctgtttggcagctagctagcctcgtggagaacatcgaaaggctgaaggtggacaaaggcagacagccaggagaggttacaagggaacagcaggacgccaagctgtgtgagcgacacagagagaagctccactattactgcgaggatgacggcaagctgctgtgtgtgatgtgtcgagaatcgagggagcaccggccacatacagccgtgctgatggagaaggcagctcaaccacaccgtgagaagatcctgaatcacctatcaacacttagatag

SEQ ID NO: 25524 - DNA, 348 bp, Artificial Sequence
  Description of Artificial Sequence: Synthetic coding sequence
atggccggcgcccccaccgtgagcctgcccgagctgcggagcctgcttgccagtggccgcgcaagattatttgatgtcagaagtcgggaggaagccgcagccgggaccatacctggcgccctgaatatcccagttagtgaactagaaagcgctctacagatggagcccgcagcattccaggctctgtactcggcggaaaagcctaagttggaggatgaacacctggtctttttctgtcagatgggcaagcgaggcttgcaagccacccagttggctcggtctctggggtatacaggcgccaggaattacgccggggcatatcgagagtggttggagaaagaatcatag

SEQ ID NO: 25525 - DNA, 4767 bp, Artificial Sequence
  Description of Artificial Sequence: Synthetic coding sequence
atgctgccccccaagcacctgagcgccaccaagcccaagaagagctgggctcctaacctttacgagcttgacagtgacttgacgaaagagccagatgtaattattggtgaaggacccactgacagcgaattctttcatcagcggtttcgtaacctgatttacgtcgagtttgtggggccacgcaaaaccctgatcaagctcaggaacttgtgtcttgactggctccagcctgagacgcggacgaaggaggaaataatcgagctgctcgtgctcgagcagtacctgactatcattcctgagaaactcaagccttgggtcagagcaaaaaaaccagagaactgtgagaagctggtgactcttctggagaattacaaagaaatgtaccagccagaggacgataacaatagcgatgtgacctcagatgatgacatgacgcgcaaccggagagaatcttccccacctcatagcgtgcactcatttagcgaccgcgattgggatcgtcgagggcgatccagggatatggagcctcgggatcgctggtcccatacacgcaatccaagatcccgcatgcctcctcgagacctgtctcttcctgtggtcgccaaaacatcatttgaaatggatcgcgaggacgatagggattcgagggcttacgagtccaggagtcaggatgcagagtcttatcagaacgtcgtcgatctcgcggaagaccggaagccacataacactatccaagacaacatggaaaattatagaaaactgctttctctggttcagctggcggaggatgacggccacagccacatgacccagggacactcctcccgcagcaaacgcagcgcttatccatccacatcgagaggcttaaaaaccatgcctgaggctaaaaagagcacccaccgcagaggtatctgcgaagacgaaagtagtcacggagtcattatggaaaaattcattaaagatgtgtctcgctcatcaaagagtggaagggctagagagtctagcgaccggtctcagcgcttccccaggatgagcgacgacaactggaaagatatttccttaaacaaaagagagtccgtgatacagcagcgggtgtatgaaggaaatgcttttcgaggaggattcagattcaattccacattggtgagtcgcaagcgggtgctggagaggaaacgacgctatcattttgacactgatgggaagggaagcatccacgaccaaaagggctgccctaggaagaagcctttcgagtgtggcagtgagatgagaaaggcgatgagtgtttcttccctcagtagcttgagcagcccctcctttacggaatcacaacctatcgactttggggctatgccatacgtgtgcgacgagtgcggacgcagtttttccgtcatctccgaattcgttgaacatcaaattatgcacacgcgggagaacctctacgagtatggggaaagctttatacactccgtggccgtctctgaagtgcaaaagtcccaggtcggaggcaaacgtttcgaatgcaaagactgcggcgagacattcaataagtcagcagcactggccgaacacaggaaaatacatgctcggggatatctcgtagagtgcaaaaatcaagagtgcgaggaggcgttcatgccttccccaacgttctcggagctccagaagatctatggaaaggacaagttctacgagtgcagagtttgcaaggagaccttcctgcattcttcagcattgatcgagcaccagaagattcactttggagacgacaaagacaacgaaagagaacacgaaagggagcgcgaaagggaaagaggggagacctttcggcctagtcccgctctgaatgaattccagaagatgtacggtaaagagaaaatgtacgaatgcaaggtgtgtggagagacctttctgcatagtagctctctgaaagaacaccaaaagatccacaccagaggaaatcccttcgagaataaaggtaaggtgtgcgaagagaccttcatcccaggacagtccctgaagcgtaggcagaaaacctataataaagagaaactctgtgactttactgacgggagagatgcctttatgcagtctagtgagctaagtgagcaccaaaaaattcactcaaggaagaatctgtttgagggaagggggtacgagaagagcgtcatccactccgggcctttcacagaaagccagaagagtcacaccatcacccgacctctggaatctgacgaagacgagaaggctttcacaatatcaagcaacccctacgaaaatcaaaagatccccacaaaggaaaacgtgtatgaggcaaagtcctatgaaagaagcgtgatacactctctcgccagtgttgaggcccagaagagtcactcagtagccggtcccagtaaaccaaaagtcatggcagagtccaccattcagtctttcgatgccattaaccaccaacgcgtgcgggctggaggcaatactagtgaaggacgggagtatagccggtctgtcattcatagcctggtggcctccaaacctccgagaagccacaacggcaatgaactggtcgaaagcaatgagaagggggaatcaagtatctacatctcagacttgaacgataaaaggcagaagatccccgctcgagaaaacccctgtgagggcggaagcaagaatcgtaactatgaggattcggttatacaatccgtgtttcgagccaaaccacagaaatccgtgccgggggaaggatcaggcgaattcaagaaagacggcgaattctccgtgccttcctcaaatgtgcgggaataccaaaaagcccgcgccaagaagaagtatatagagcatcgttccaatgagacctcagtgatccatagcctcccttttggggaacaaactttccgcccccgggggatgttgtacgaatgtcaggagtgtggtgaatgctttgcccactcaagcgatctcacagaacatcagaagatccatgaccgcgaaaaaccttccggatcccgtaattacgaatggtccgtgatcagatcactggcacctactgatccgcaaaccagctacgcacaggagcaatacgcaaaggagcaagccagaaacaaatgtaaggactttcggcagtttttcgcgactagcgaagacctcaacacgaatcaaaagatctacgatcaggagaagtcacacggcgaagagtcccaaggtgaaaatacagacggagaggaaacacatagcgaagagacccacggccaggaaactattgaagatccggtgatacaggggtccgatatggaggaccctcaaaaggacgatccagatgacaaaatctacgagtgcgaagactgtggcctggggtttgtcgaccttaccgatttaacggatcatcagaaggtgcattctcgaaaatgtctcgttgactcccgtgagtacacccactcagtaattcacacccactcgatatccgagtatcaacgcgactacaccggagagcaactctacgaatgcccaaagtgcggcgagtcctttattcattcatcatttctgttcgagcatcagcggatccacgaacaggaccagctgtattctatgaagggatgtgatgacgggttcatcgcactcttacccatgaagccccgaagaaacagagccgccgaacgtaatcccgcgctcgctggcagcgcaatcagatgcctattgtgtggacagggcttcatacattctagcgccttaaacgaacacatgaggcttcaccgcgaggatgatctcctcgagcagtcccaaatggccgaagaggcaatcattccagggctcgctctgactgaatttcagagaagccagacagaagagcgcctttttgagtgtgcggtgtgcggcgagtctttcgtaaatcccgcggaactggcggatcacgtgactgtgcacaagaacgaaccctacgagtacggctcttcttacacacatacttcgttcctgactgagcccctcaagggcgccattccattttacgaatgtaaggattgtgggaagtcatttattcactccactgtactcacaaagcacaaagagctgcatttggaagaggaagaggaagacgaagccgccgcggccgccgcagccgcagctcaggaagtggaagctaacgttcacgtacctcaggtggtccttaggatccagggtctcaacgtagaagcagcggaaccagaagtggaggccgctgagccagaagtcgaggccgccgagcctgaggtggaagcagcagagccgaacggtgaagccgagggccctgacggtgaggccgccgagcctattggtgaggcaggtcagcctaatggggaagccgaacagcctaatggtgatgccgatgaaccagatggggcaggaatcgaagatcccgaagaaagagccgaggagccagaaggaaaggccgaggaacccgaaggcgatgctgatgagccggatggagtcggcatagaggaccccgaggaaggagaagatcaggaaattcaagtggaggagccctattacgactgccatgagtgtacagagacgttcacttcttccacagcattctctgagcatctgaagacccacgccagtatgataatcttcgaacctgcaaatgccttcggggagtgttcagggtacattgagcgagccagtactagcactggcggagccaaccaggctgatgagaaatatttcaagtgcgacgtgtgtggccagctcttcaacgacagactgtcgcttgctcgtcaccagaacactcacacagggtag

SEQ ID NO: 25526 - DNA, 381 bp, Artificial Sequence
  Description of Artificial Sequence: Synthetic coding sequence
atggccgccgccaccggcgaccccggcctgagcaagctgcagttcgcgcccttctccagcgctctggatgtaggtttctggcacgagcttacacaaaagaaactgaatgaatatcggctggacgaggctccaaaagatatcaaaggatattactacaacggtgattccgcaggactgccagccagattgacgttggagttttctgcctttgacatgtccgcccccactcctgctcggtgctgccccgcaatagggacactttataacacaaataccttagagagctttaagactgccgacaagaagctgcttttggagcaggccgctaatgaaatctgggagtcaatcaaaagcgggacagctctggagaacccagtctag

SEQ ID NO: 25527 - DNA, 1434 bp, Artificial Sequence
  Description of Artificial Sequence: Synthetic coding sequence
atggccgacggccaggtggccgagctgctgctgcggcggctggaggcttctgatggcggactggactctgctgagctcgctgcggaactcgggatggagcaccaagctgttgtcggagcagtgaagtccctccaggccctaggcgaagtgatcgaagctgaactgcgtagtacgaagcactgggaactaactgctgaaggcgaagagatcgcccgagagggtagccacgaagctagagtgtttcgcagtatacccccagagggcttagcacagagcgagcttatgaggctcccctcaggcaaggtaggcttttccaaggcaatgtcgaacaaatggattagagtcgataagagcgccgcagatggccccagggtctttcgtgttgtggacagcatggaagacgaggtgcagcgtcgactgcaactggtccgaggagggcaggccgaaaaattgggggaaaaagaacggagtgagctcaggaagaggaaactgcttgctgaggtgggttcctggcgggacaggccttttaagccatataacttcctcgctcatggggtactcccagatagcggacatctacacccactgctaaaggtcagaagtcagttccgccaaattttcctcgagatgggcttcacagagatgccaactgataatttcatagagtctagtttttggaactttgacgccctgtttcaaccacagcagcaccctgccagggaccagcacgacacttttttcctccgggaccctgcagaagcactacagctgcccatggattacgttcagcgcgtgaagcgcacacattctcagggcggttatgggtcacagggttacaaatacaattggaagctagacgaagccaggaagaatctgctgcggacccatacaacatctgccagtgcccgggcgctctatcgacttgcccagaaaaagccatttactccagtaaagtacttctctattgacagggtctttaggaacgaaactttggatgcgacgcatctggccgagtttcaccagatcgaaggggttgtcgccgatcatggactgacactcggccacctgatgggagtcctacgggaattctttacaaagctcggaattactcagttgcggtttaagccagcgtataacccttacactgaaccatccatggaagtgttttcatatcatcaaggcctgaaaaaatgggtagaagtggggaacagtggcgtgtttaggcccgaaatgctcttacccatgggccttcccgagaacgtgagcgtgatagcatggggattgtcactggagaggccaaccatgattaagtatggaatcaataatatacgtgaactggtcggacacaaggtcaatctacagatggtgtacgattctccactctgtcgactggatgccgaacctaggcctcctccgacgcaggaggccgcctag

SEQ ID NO: 25528 - DNA, 3195 bp, Artificial Sequence
  Description of Artificial Sequence: Synthetic coding sequence
atgcccgtgcaggccgcccagtggaccgagttcctgagctgccccatatgctacaatgaatttgacgagaacgtgcacaaacctatcagtctgggctgttcccacactgtctgtaagacatgcctaaataagctgcaccgtaaagcctgcccctttgatcaaactgctatcaatacagatatagacgtgctaccagttaattttgctctgttacagctggtcggagcccaggtgcctgatcaccagagtatcaagctgagcaacctcggagagaacaaacattacgaggttgccaagaagtgcgtggaggatctggctctgtatctgaaaccactgagcggcgggaagggtgtagccagtttgaaccagtccgccctctcacgccctatgcagcggaagttggtcaccctggttaactgccaactcgtcgaagaagaaggccgagtacgtgccatgcgagccgctcggtcattaggcgagcgcaccgtcactgaactcatcttgcaacatcaaaatcctcaacagctgtcagccaacctctgggcggcagtccgagcgagaggatgtcagtttctcggaccggccatgcaagaagaggctctgaagctggtgctcctggccctggaggacggctcagccctctcgcgaaaggtactagtgcttttcgtagtgcagcgcttggagccccgattcccgcaagcatctaagacttcaattggacacgttgtgcagctcctgtaccgagcttcgtgctttaaagttactaaacgagatgaggattcaagcctgatgcaactcaaggaagaattccgaagttatgaagccctccggagagagcatgatgcccagatagttcacatagctatggaggctggcctaaggatctctcccgagcagtggtcgtccttgttgtatggagatctcgctcacaagtcccacatgcagagcatcatagacaaactgcagagccctgagagcttcgccaagagcgtgcaggagttgactatagttctgcaaagaactggggatcctgcaaacctaaatcggctgcgtccacacctggagctcctggcgaatatagaccctaaccctgatgctgtgtctccaacctgggaacagttagagaatgccatggttgcggtcaagacggtagtccacggcctggtagattttatccagaactattcacgaaagggacacgagacaccgcagccacaacccaattctaagtacaaaacgagcatgtgcagggatttacggcagcagggcggctgtccaagagggactaactgtaccttcgcgcattcacaagaggagctagagaagtaccgtctgagaaataaaaagataaacgcgacagtacggacatttcctctcctcaacaaagtcggcgtaaataacactgtcacaactaccgctgggaacgtgattagtgtgatcgggtcaaccgagaccacggggaagatcgtgccatccaccaacggtatctccaatgccgagaactccgtctcacagcttatttcccgatctaccgattcaacactccgagcactagagaccgtcaagaaagttgggaaagtgggtgccaacgggcagaacgcagcaggcccatccgccgacagcgtgaccgaaaacaagattggctctccgcctaagacaccagtttcaaacgtcgcagcaaccagcgctggacccagcaatgtgggcaccgagttgaatagtgttccccagaaatcatctccttttctgacgagagtgccagtatatcctccacattccgagaatatccagtactttcaggatcccagaacccagattcccttcgaagttccccagtaccctcagacgggatactacccacctcccccaaccgtgcccgcaggcgtggccccttgcgtgcctcgcttcgtcagatccaataacgttcctgagtcttctctgccacctgcatcgatgccttacgccgatcattattccacattctcacccagggaccggatgaatagtagtccatatcagccccctccacctcagccgtacggaccagtaccgcctgtaccatccgggatgtacgctcccgtttacgattcccgcaggatatggagaccccctatgtaccaacgagacgacataattagatctaattctcttccacctatggatgtgatgcactcctccgtctatcaaacatctttgcgtgaacgctataacagtctagacggatattacagcgtcgcctgtcaaccgccaagtgaaccacgcaccaccgtacctttacctagggaaccctgcggtcacctcaaaacttcctgtgaagaacagatccggagaaaacctgaccagtgggctcagtaccacacacagaaagctccactcgtttcttcaacccttcccgtggccacccagtcccctacgccccccagccccctgttcagtgtggacttcagggcagacttctctgaaagtgtctcgggaaccaagtttgaagaagaccacctcagccactactccccctggtcctgtggtactattggatcgtgtatcaacgctatcgactcagaaccaaaggatgttatcgccaactctaatgctgtgttgatggatctggacagcggggacgtgaagaggagggtccacctgttcgagacccagaggcggacaaaggaggaggacccgattatccccttctctgatggccctattatcagtaagtggggcgcaataagcagatcaagccgcacaggataccacacaacagaccctgtgcaagcaactgcctcacagggcagcgcgaccaagcctattagcgtgagcgattacgtgccttacgtgaatgccgtcgattcaagatggtctagttacggcaatgaagccactagcagcgcccattacgtcgagagagatcgttttatagtgaccgatctatccggtcacaggaaacactcatcaaccggcgacctcctctcgctggaactacagcaggcgaaatcgaattctctcctgctacagagagaagcaaatgctctagcaatgcagcaaaagtggaactccctggacgagggtcggcacctgactctcaacttgctcagcaaagagatagaattgcgcaatggagaagtaaaaaaactcaacttatctgcttcttgtctcatgtatttgttttcagctgcagcctcatggctgtatcattattag

SEQ ID NO: 25529 - DNA, 1548 bp, Artificial Sequence
  Description of Artificial Sequence: Synthetic coding sequence
tgagccggcggcagccccagcgtggtggactacttccccagcgaggacttctacaggtgtggctattgcaagaacgagtcgggtagtcgaagcaacgggatgtgggcccactccatgaccgtgcaggattatcaggaccttattgatcgagggtggagaagaagtggtaaatatgtgtacaagccagtaatgaaccagacatgctgcccacaatacacaatcagatgtcggccactgcagttccagccttccaaatcccataagaaagtcctgaagaagatgcttaagtttttagcaaagggggaggtgccgaagggatcctgtgaagatgagccgatggatagtacaatggacgacgctgtcgccggagacttcgcacttattaacaagctggacattcagtgtgatctcaagacgctttccgatgacatcaaggagagtctcgaatcagagggtaagaattcaaaaaaggaggaacctcaggaactgctgcagtctcaggactttgtgggcgaaaagttaggcagcggtgagccctctcattctgtgaaggtgcacactgttcccaaacctggaaagggagccgacctgtcgaagcctccctgtaggaaggccaaggaaatcagaaaggaaaggaaacgcctaaagttaatgcagcagaatcctgccggggagttagagggattccaggcccaggggcatcctccgtccctgtttcctcctaaagccaaatccaatcaacctaagagcttagaggacctgatctttgagagcctgcccgaaaatgcttcacataaactggaggtgcgggtggttcggtccagcccacctagtagccagttcaaagcaaccctcctggagagctaccaggtctacaagagataccagatggttatacacaaaaatccacccgacactcctactgagagccaattcacccggttcctgtgttcatctccactggaggcagaaactccccccaatggccccgactgtggctacgggagttttcatcagcagtattggctcgacgggaagataatcgccgttggggttatcgacattctaccaaactgtgtgtcctccgtgtacctgtattacgatccggattattcctttctgtctttaggagtctatagtgctctccgagagatcgcttttacacgccagctccacgagaaaacgtcccagctctcctattactatatgggattctacattcatagctgtcccaagatgaagtacaagggacagtatcggccctcagaccttctctgcccggaaacctacgtttgggtacccattgaacagtgtctgcctagtctggaaaactcaaagtactgtaggttcaaccaggaccccgaggcagtggatgaggaccgctctaccgaacccgaccgcctgcaggtttttcataaaagagcaattatgccctacggggtgtacaaaaaacagcagaaggacccatctgaggaagctgcagtgctccaatatgcatcacttgtgggccagaagtgttcggaacgcatgttactgtttaggaattag

SEQ ID NO: 25530 - DNA, 225 bp, Artificial Sequence
  Description of Artificial Sequence: Synthetic coding sequence
atggccatggcccccagccccagcctggtgcaggtgtacaccagcccggccgcagtcgcagtgtgggagtggcaagacggtctgggaacttggcatccctactcagccactgtctgcagtttcattgagcagcagtttgtgcagcagaaaggccagcggtttggactaggaagtctggctcacagtattcccctggggcaagccgatcccagtctcgctccgtag

SEQ ID NO: 25531 - DNA, 594 bp, Artificial Sequence
  Description of Artificial Sequence: Synthetic coding sequence
atggccgccttccgggacatcgaggaggtgagccagggcctgctgtccctgctcggagcaaatcgcgccgaagcacaacaacgtcgcctattggggcggcacgaacaggtcgtagagcgactgctggagacccaggatggagccgaaaaacagctgcgggaaatactgaccatggagaaggaggtggcccagtccctcctgaacgcaaaggagcaggtgcatcaggggggcgtagagctgcagcagttagaagctggtctgcaagaggccggggaggaggacacaaggttgaaggcaagcttactccaactgacacgagagctggaggagttaaaggagatcgaagcagatctggagcgccaggaaaaggaggttgacgaggataccaccgtgacgatcccctccgccgtctacgtggctcagctatatcatcaggtgtcgaagattgaatgggattacgaatgcgaacccggaatggttaaaggcattcatcacgggccatccgtcgcccaacccatacacctggacagcactcagcttagcagaaaattcatctctgactacctgtggagcttagtcgacacagaatggtag

SEQ ID NO: 25532 - DNA, 2271 bp, Artificial Sequence
  Description of Artificial Sequence: Synthetic coding sequence
atgagcccccagaagcgggtgaagaacgtgcaggcccagaaccggacttcccaaggtagcagcagctttcagacaactctgtccgcatggaaggtgaaacaggatccatctaatagcaagaacattagtaagcatggtcagaacaatcctgtgggagattacgaacatgcagacgaccaggccgaggaagacgctctacaaatggctgttggttattttgagaaaggtcctattaaagcttcacaaaacaaggacaagacgctggagaagcatttaaagactgtcgagaacgtggcttggaagaatggactcgctagtgaggagattgacatcttattgaacatcgccctctctgggaagttcggcaatgccgtgaacacgcgtattttgaagtgtatgatacctgccaccgtaatttccgaggattccgtggtaaaagccgtttcgtggctctgtgtgggcaaatgttctggaagtacaaaggtcctcttttacaggtggctagtggccatgttcgactttattgatcggaaagagcagatcaaccttctgtacggcttcttcttcgcttccctccaggatgacgcactgtgcccctacgtctgtcacctgctctatctactgacgaaaaaagagaacgtgaagccattcagggtgaggaagttgctcgacctgcaggcaaagatggggatgcagccccatctccaagcccttttgtctctgtataagttcttcgcacccgctctgatctctgtatcgcttcctgttcgtaagaagatctacttcaaaaattccgaaaatctgtggaagaccgccctcctagctgtcaaacagcgaaaccgcggtccttctcctgagcctttgaaactaatgctggggccagcaaatgtgagaccactcaagaggaagtggaacagcttgtccgtgatcccagtcctgaactctagcagctatacaaaggagtgcggcaaaaaagagatgtcactctccgactgcctgaaccgcagtggatcttttccactggagcaactgcaaagctttccacaacttctccaaaacattcactgtcttgagctgcctagtcagatgggctctgttctgaataactcactgctgctgcactacataaactgtgtcagagatgaaccagtcctattacgcttctattattggctgtcacaaacactgcaggaggagtgcatttggtataaggtgaataactatgagcacggcaaggaatttaccaatttcctcgacacaatcataagggcggaatgtttcttgcaggaggggttctatagctgtgaggccttcctctacaagtccctgccattgtgggacgggctgtgctgtcgcagccagttcttgcagctggttagttggatcccattcagcagcttcagcgaggtcaaacctctgctgttcgatcacttggcccaactctttttcacaagtacgatctactttaaatgttcagtacttcagagcctgaaagaactgttgcagaattggctgttatggctctctatggatattcacatgaagcccgttaccaactcacccttagaaacgactctgggtggatctatgaattcagtgtcgaaacttatacactatgtcggatggctgtccacaacagcaatgcgcctggaatccaacaacacctttctgctgcactttatcctggacttctacgaaaaagtatgcgacatctacattaattacaacctcccgctggtggtcctctttccaccaggtattttttactcggccttactgagccttgatacctccattcttaatcagctatgctttattatgcataggtataggaaaaacctcaccgcagcaaagaagaatgagctggtgcagaaaactaaatcagagtttaacttctcctcaaaaacctaccaagaattcaaccactacctgactagcatggtaggatgtctatggacatccaagccctttggaaagggtatctacatcgaccctgaaatcctcgagaagaccggggtcgccgagtataagaattccctaaatgttgttcaccatccctctttcctgtcatacgccgtgtctttcttactgcaggaatctccagaagaacgcaccgtcaacgtttctagcatcagagggaagaaatggtcatggtacctcgattatctcttttcccaggggctgcaaggccttaagttgtttattcgctctagcgtccaccattcttctattcccagggccgaggggattaactgtaacaatcagtactag

SEQ ID NO: 25533 - DNA, 1941 bp, Artificial Sequence
  Description of Artificial Sequence: Synthetic coding sequence
gcccagggcagcgtgagcttcaacgacgtgaccgtggacttcacccaggaggaatggcaacatctagaccatgcccaaaagacgctgtatatggacgtgatgttggaaaactactgccacctgattagtgtcggctgccacatgactaagcctgacgtgatactcaagctggagaggggtgaggaaccctggacgagcttcgctggacacacttgccttgaggagaattggaaggccgaggatttcttggtgaaattcaaggaacatcaggagaagtactccaggtcagttgtgagcatcaaccataaaaaactggtgaaagagaaatctaaaatttatgaaaagaccttcactttggggaaaaatcctgtcaacagtaaaaatttaccacccgaatatgacacacacggccgcatcctgaagaacgtgtcggagctcatcatcagtaacttaaaccccgctcgaaagcggctcagcgagtacaacgggtatgggaagagcctcctcagtacaaaacaggaaactacccatcccgaagtgaaatctcacaaccagtcagcacgcgcattctctcacaatgaggtcctgatgcagtatcagaagaccgaaacacctgcacaatccttcggatacaatgactgtgagaagtcattcctccagagagggggtcttatcacccacagcagaccttataaaggcgaaaacccttcagtatataataaaaaacgacgggcgactaatattgaaaaaaaacatacatgcaacgaatgcggtaagtcattctgccggaaatcagtgctgatactccatcaaggaatccacagtgaggagaaaccataccagtgccaccagtgcgggaatgcattccgtcgcaaatcctatcttatagatcaccagcgtacgcataccggcgagaaacctttcgtgtgcaatgaatgtggcaagagtttccggttaaagactgctttaacagatcaccaaagaacccatacaggtgagaaatcatatgaatgcctccagtgccgcaacgctttcaggctaaagtcacatcttattaggcaccagcggacgcataccggggaaaagccttatgagtgcaacgattgcggaaagtctttccgccagaagaccacattgtctctgcaccagcgcatccacaccggtgaaaagccgtacatctgtaaggaatgtggaaagtctttccatcagaaagcaaacctcactgtccatcagcgaacacacacaggggaaaaaccctacatatgcaatgagtgtggaaaatccttttcccagaaaacaaccctggccctccacgagaaaacacacaacgaggagaagccatacatctgcagcgaatgcggcaagagctttcgacaaaaaaccactctcgtcgcacatcagagaacacacacaggggagaagagctatgagtgtccgcactgtggcaaggctttcaggatgaaatcatacttgatagaccaccatagaactcatacaggggaaaagccctatgagtgcaatgagtgtggcaagtctttttctcagaaaaccaatctgaatctgcatcagagaatccacaccggggagaagccgtatgtgtgcaatgaatgcggcaaaagctttcggcagaaagccacacttacggtacaccagaaaatccacaccggtcagaaaagttatgaatgcccacagtgtggaaaagccttctctcggaagtcctatttgatacatcaccagaggacccacaccggggagaagccctataagtgttctgaatgtggaaagtgttttcggcagaagaccaacctgatcgtgcaccagagaacccacaccggcgagaaaccttacgtgtgcaacgagtgtgggaagagctttagttataaacgaaatctgatcgtccatcagcgcactcacaagggtgaaaatattgagatgcagtag

SEQ ID NO: 25534 - DNA, 594 bp, Artificial Sequence
  Description of Artificial Sequence: Synthetic coding sequence
atgggcggccggaagcgggagcggaaggccgccgtggaggaggacacctccctgtccgaatccgagggccccaggcaaccagatggcgacgaagaagagtcaactgcactatctatcaatgaagagatgcagcggatgctgaaccaactccgtgaatacgacttcgaggatgattgcgattccttgacatgggaagagaccgaagagacccttcttctttgggaagactttagtggatatgccatggctgccgcagaggctcaaggtgagcaagaggactctctggaaaaggtgattaaagatactgagtcgctgtttaagactagggaaaaagaatatcaagaaacaattgatcagatcgagctcgagctcgccacagccaagaatgacatgaatagacacctgcacgagtatatggagatgtgctcaatgaagaggggccttgatgtccagatggagacctgcagaagactgattacccaatctggcgataggaaaagccccgcctttacggcagtccctctctctgatccccctcctcggcaggcccgcttaaggactccaatcgccatgtctcacttaacagcgccctag

SEQ ID NO: 25535 - DNA, 423 bp, Artificial Sequence
  Description of Artificial Sequence: Synthetic coding sequence
atggccatggcccccagccccagcctggtgcaggtgtacaccagccccgcagcagtggccgtgtgggagtggcaagatgggcttggtacgtggcatccgtattcagctacagtctgctcctttattgagcagcagtttgtgcagcaaaagggccagcgctttggcctgggatctctggcccattccatccccctgggccaggccgatcctagcttagccccatacataatcgatctgcccagctggacccagtttaggcaggacaccggcacaatgcgcgctgtcaggagacacttatttcctcagcatagcgccccggggcggggcgttgtgtgggagtggctttccgacgacggaagctggactgcttatgaagcttccgtctgtgactatctcgaacagcaggtcgccagaggcaattag

SEQ ID NO: 25536 - DNA, 3237 bp, Artificial Sequence
  Description of Artificial Sequence: Synthetic coding sequence
gtgtgcatgcacccccacaacgtgctgagcgacgtggtgaactacactctgtggctgatggagtgcagtcacgccagcggctgctgccacgctaccatgttcttttctatctgcttcagctttcgggcagtcctcgagctattcgaccgctacgatggattacggcgcttggtgaacctgatttctacattggagattttgaatctcgaggaccagggtgctctcttgtctgacgacgaaatttttgccagccgccaaacggggaaacacacttgtatggctctgagaaagtattttgaggcccacctagctatcaagctggagcaggtcaagcagagtctccaacgtacggaaggtgggattctagtgcacccacagcccccatacaaggcgtgcagctatacacatgagcagatcgtagagatgatggaatttttgattgaatacggacctgcccaactttactgggagcctgcagaggtctttctgaagctttcttgtgtgcaacttctcctccagctgatatctatcgcctgcaattggaaaacctattatgcccgaaacgacacggtgaggtttgccctagacgtgctggcgattctcacagtggtcccgaagattcagctgcaattggcagaatcagtggatgttctcgacgaggctggtagcactgtgagcaccgtgggaattagcatcatcctgggcgtggccgaaggcgagtttttcatccatgatgcagagatccagaagtcagccttgcagataattattaactgcgtgtgtgggcctgacaaccgcattagctcaatcggaaagttcatatccggcacccctaggcgcaagttgccacagaacccaaaatccagtgagcacaccctggcaaagatgtggaacgttgtgcaatctaataatggcatcaaggtgctgctgtcattactgagtatcaagatgcctataaccgacgctgaccagatccgggctcttgcctgcaaggcactggttggactatcaaggtcctccacggttagacagatcatttcaaagcttcctctcttcagttcctgccagatccagcagctgatgaaggagccagtgctgcaggataaacggagtgaccacgttaagttttgtaagtacgcagctgagctgatagaacgggtttctggaaagcccttgctcataggcaccgacgtaagcttggccagactccagaaagcggacgtcgttgcccagagccgtatttctttccccgagaaggaacttctgcttctaatccgcaatcacctgatatctaagggccttggagaaaccgccacagtactgacgaaggaggccgatctccctatgactgctgcttcccatagcagtgccttcacaccggtgacggctgcagcgagccccgtgtctttgccacggaccccgcgaattgcaaacggcattgccacacgccttgggtcccacgccgccgttggcgcttcggcgccctctgcacctaccgcgcacccacaaccacgccccccccagggccctctggcccttcccgggcctagttatgctggcaattctccattaattgggaggattagctttatcagggagaggccctcgccctgtaatggccgcaagattcgggtcctgcggcagaagagcgatcatggcgcctatagccagtctcctgctattaaaaaacagctcgacagacacctccccagcccacccacactagactcaattatcacggaatatctgagagagcaacatgcaaggtgtaagaatcccgtcgctacatgtccccccttctccttgttcacaccacaccagtgtccagagcccaaacaaagacgtcaggctcccattaacttcacatcaaggcttaaccgtcgcgcttcatttcccaagtacggcggcgtagatgggggctgctttgataggcacctgattttctcaaggtttcggccgatcagcgtcttcagggaagccaacgaggatgaaagtggcttcacttgctgtgcattttccgcccgcgagcgtttcctgatgcttggtacctgtactgggcaactcaaattatacaatgtcttctctggtcaggaggaggcctcatataactgccacaacagcgccataacccaccttgagccaagccgtgacgggtctctcctgctgacaagtgctacctggtcgcagccacttagcgcgctatggggaatgaaatccgtttttgatatgaagcacagcttcacggaagaccactatgtcgagttcagtaaacacagtcaggatagagtcatcggaacaaagggcgatatagcccatatatacgatatacagactgggaacaagctcctgacactcttcaacccagacctagctaataattacaagcgcaattgcgccacattcaaccctaccgatgatctggttctcaatgatggggtcctctgggatgtaagatccgctcaagcaatccacaagttcgacaagttcaatatgaacatcagcggagtgttccatccaaatggactggaagttataatcaacacggagatttgggatcttaggacattccatcttctgcatacggttcccgccttggaccagtgtcgcgttgtctttaaccatacagggactgtcatgtacggagcgatgctgcaagctgacgacgaagacgatctgatggaggaaaggatgaaatctcctttcggtagtagctttcggacttttaatgccactgattataagccaattgctaccattgatgtgaagcggaacatctttgacctctgcaccgataccaaggactgttatctggcggtgattgagaaccaggggagcatggatgccctgaacatggacacagtttgtagactgtacgaagttggaagacaacgcctggccgaggacgaggacgaagaggaagaccaggaggaggaggaacaggaggaggaagacgatgacgaggatgacgatgacactgacgatctcgacgagttagacaccgaccagcttcttgaggccgaactggaggaagacgataataacgagaacgccggagaggatggtgacaatgacttctcgcctagcgatgaggagctcgcgaacttgttagaggagggagaagatggggaggatgaagactctgacgcagacgaagaagttgagctgattttaggcgataccgactcttcagataactccgatctcgaggatgacatcatcttatctctcaacgagtag

SEQ ID NO: 25537 - DNA, 447 bp, Artificial Sequence
  Description of Artificial Sequence: Synthetic coding sequence
atgctgagcgacggctgcggcagcgaggagaagatcagcgtgccctcatgctacggaggaatcggcgcccctgtctcgaggcaagtgccagcttcccacgactcggagctgatggcctttatgacacgcaagttgtgggacttagagcagcaggtaaaagcccagacagacgaaatcctcagcaaggatcagaagattgctgccctcgaggacctggtgcaaacactgcgaccacaccctgctgaggccactttacagcgccaggaagagctcgaaactatgtgcgtgcaattgcagaggcaggtacgcgaaatggaacggtttctcagcgactatggccttcagtgggtgggggaaccaatggaccaggaagattcggagagcaagacggtatcggagcatggcgaacgagactggatgaccgctaagaagttctggaagccttag

SEQ ID NO: 25538 - DNA, 1755 bp, Artificial Sequence
  Description of Artificial Sequence: Synthetic coding sequence
atgagcctgccccccgagaaggccagcgagctgaagcagctgatccaccagcagctcagcaaaatggacgtgcacggacgcatccgcgagatcctggccgaaaccataagagaggaactcgccccggaccaacaacacttgtctacggaagatctgatcaaggccctacggcgtagggggattattgacgatgttatgaaggagctgaacttcgtgaccgattcagtcgaacaggagcttccctctagccctaagcagcccatttgttttgaccgacaatctacgctcaagaagagcgatggcactcgtatggctgattctactacaatgctttctatctccgacccgatacatatggtgttgattaaaactgacatttttggcgagaccacactggttgcctcctacttcctggagtggcgctctgtgctcgggtcggagaacggtgtgacctccctgacggttgaactgatgggagtcggcaccgaatctaaagtgtctgtggggattctgaacatcaagctcgagatgtacccacccttgaaccaaacacttagccaagaagtggtgaatacgcagctggccctagagcgtcaaaaaactgccgagaaagaaaggctgtttttagtgtatgccaaacaatggtggagagagtatctccaaattcgaccatcacacaattcaagactggtaaaaatcttcgctcaggacgagaacggaataaaccggcccgtatgcagttatgtgaaacctctgcgcgcagggcggcttctcgatacccctcgacaagctgcaagattcgttaatgtcctcggatacgagcgggcaccagtcatcggcgggggggggaaacaagagcaatggtgtacccttctcgccttcttgtgtaggaacaagggagactgcgaggaccacgccaaccttctctgtagcctgctgctcggatacggactcgaagcattcgtgtgtgtaggaactaaggctaagggcgtaccccacgcttgggtgatgacgtgcggcacagacggggccatcactttttgggagtccctgacaggacacaggtacattcataaaccaacaaatcccgacgaacctcccgtcgccgaacagccaaaaccgctctacccttaccgcactataggatgcgttttcaatcatcagatgttccttggaaactgtcagccaagtgatgctgttgagacatgcgtgtttgatctcaatgacgaatctaagtggaagcccatgtccgaggaagccattaagagtgtctgtgcccctggggccacaacctcactcccaccattcccccctttatgcgccagcacaattgacgcgtctgtgacaagcaatgagatcgaaatgcaactgaggttgctggtgtctgagcataggaaagatttaggactcacaaccgtgtgggaagatcaactgagttaccttttgtctcctgctctggcctcatacgagtttgaacgtaccacctccatcagtgcgggaaacgaggagttccaggacgccatcaggcgagctgtgccagacgggcacacctttaaggggtttcccatacatttcgtgtaccggaatgcgaggcgagcgttcgccacctgcttaagatcacccttctgcgaagagatcatttgctgtcggggagatcaggtgcggttggcagtgagagtgagggtattcacctaccctgaatctgcctgcgccgtctggataatgttcgcctgcaagtatcggtcagtgttgtag

SEQ ID NO: 25539 - DNA, 4515 bp, Artificial Sequence
  Description of Artificial Sequence: Synthetic coding sequence
atggtgagcgagagcgacttcagcaaggacgtggccgtgcaggtgctccccctggacaagattgaagagaataacaagcagaaagctaacgacatattcatcagtcagtacactatgggacagaaggacgccctgcgaactgtgcttaagcagaatgtttctctgtgtctgaccgggtggagcgatcacagtggagtgattaccacccactgttctctctatctattacgtctcatgcgctcgagtcacttatccttgccatcttcttgggactacagagcgcagtccatgcctgtgttcaaagaggttaaagttcatcttttggaggatgccggcatcgaaaaagacgccgtgacgcaggagactagaatttcacctagtggcatcgacagcgcaacaactgtcgccgccgccactgcagccgctatcgcgacagccgcccccctgattaaggtgcaatccgatctggaggccaaggttaatagcgtaacagaattgttgtcaaagctccaggaaaccgacaagcaccttcagcgggtgacagaacagcagacatccatccagcgcaaacaggagaaactgcattgccacgatcatgagaagcaaatgaacgtatttatggagcaacatattagacaccttgagaagctccaacagcaacagatagatattcaaacccactttatttccgcagccctgaaaaccagctcctttcagccagtatcaatgccctctagcagagcagtggaaaagtatagtgtgaagcctgagcacccaaacttaggcagctgcaatccaagcctgtataacacattcgcctctaaacaggctcccctgaaagaggtggaagatacctcctttgataaacaaaagtctccactcgaaacacctgccccgcgccgcttcgcaccagtcccagttagtcgcgatgacgaactttcaaagagggaaaacctactggaggaaaaagagaacatggaggtgtcatgccacagggggaacgtgcgattgctggagcagattctcaataataacgacagcctcaccaggaagagtgaaagctctaataccacatctcttacccgcagtaaaatcggatggaccccagagaagactaacagattcccttcgtgcgaggaactggaaactacaaaggtgactatgcagaagagcgatgatgtgctccatgacctgggtcagaaagaaaaggagaccaacagtatggtccagccaaaagagtctctgagcatgctgaagctgcctgatctaccacaaaattctgtcaagcttcaaaccactaatacaacaagaagcgttctgaaggacgctgagaagatattgagaggggtgcagaataataagaaggtactcgaagagaacctagaagccattattagagctaaggacggagcggcgatgtactctctgataaacgccttgtcgaccaacagggaaatgtctgaaaaaatccgtattaggaagactgtggacgagtggatcaaaacaatcagcgcagagatccaagatgagctttctaggacagactatgaacagaaacgattcgaccagaaaaatcagcgcaccaagaagggacaaaatatgactaaggatattagaaccaacactcaggataaaaccgttaataaatcagttataccaaggaaacactctcagaaacagattgaggaacatttccggaatctccccatgcgagggatgccagcgagttcactgcaaaaggaaagaaaagaaggccttctgaaggctaccactgtgattcaggacgaggactacatgttgcaggtgtacgggaagcctgtgtaccagggacaccggtccacactgaagaaggggccctacttgaggtttaactccccctccccaaaaagccgcccacagcgacctaaggtgattgaacgcgttaagggtactaaggtgaaatctattagaactcaaacagatttctacgccactaagcccaaaaagatggattcgaagatgaagcacagtgtgcccgtgttgcctcacggagaccagcagtatctgttcagtcccagcagggaaatgccaacgttttccggaaccttagaaggccacctgatcccaatggccatcctacttggccagacccagtctaactccgacaccatgcctcctgcgggtgttatcgtgtcaaagccccaccctgtgactgttacaaccagcattccaccctcctctagaaaggtggaaaccggagtaaaaaaaccgaatatagccatcgtggagatgaagagcgagaagaaggaccctccacagctcacggtgcaagtacttccgtccgtggacattgactcaattagcaactcgagcgccgacgtgctcagccccctctcctctcctaaggaggcttctttaccccctgtgcaaacatggatcaagaccccagaaattatgaaagtcgacgaggaggaggtgaagttccctgggacaaacttcgacgagatcatcgacgtaattcaggaagaggagaagtgtgacgagatccctgactcagagcctatactggagttcaataggtcagtgaaagcggactctaccaagtacaacggaccccctttccctccagtcgctagcacattccaacccactgcagatattcttgataaggtgattgaaagaaaggagactctggagaactctctgattcagtgggtggagcaggagattatgagtaggattatctctggactctttccagtacagcagcagattgctcctagcatatccgttagcgtgagtgaaactagcgaacctctaacttccgacatagtggagggcacgagctctggcgctttacaattatttgtggatgccggcgtgcctgtaaacagcaacgtgataaaacactttgtgaatgaggcactggccgaaacaatcgcggtgatgcttggagatagggaggctaaaaagcagggtcctgtagctacgggcgtctccggagacgccagcaccaacgagacgtacctccctgcccgagtctgcacccctctaccgacaccacagccgactcccccctgctcccccagttcaccagctaaggaatgtgttctggtgaagacaccagactctagtccatgtgatagcgatcacgatatggctttccccgtgaaggaaatttgcgcggaaaaaggcgacgacatgccagccatcatgctggtaaacaccccaaccgtgactccaactacgacaccacccccggcagccgctgtcttcactccgactctgtccgacatctctatcgataagttgaaagtgtcctcacccgaactgccaaagccttggggagatggagatctaccactggaagaggagaatcctaattcaccccaagaagaactccacccccgggcgatcgttatgtcggtggccaaagacgaagagcctgagagtatggatttccccgcacaacccccgccacccgagccagtgcccttcatgccctttcccgccgggaccaaggccccttccccaagtcaaatgccaggatccgactcttccaccctcgagagtaccctaagcgtgacagtcacagaaactgagacacttgacaaacctatatcagaaggagagatcctgttttcgtgtggacaaaaacttgctcccaagatactcgaagatattggtctttacctgacaaatctgaacgatagcctgtcctctacccttcacgatgcagttgaaatggaagatgaccctccgagtgaaggtcaagtaattagaatgtctcacaaaaagtttcacgccgacgcaattttgagtttcgctaagcaaaatcaagaaagcgccgtctcacagcaagccgtctatcacagtgaagatttagaaaatagtgtaggagagctgtcagagggtcagcggccccagttgacagcggcagcagagaacatcctgatgggccatagcctttatatgcagccacccgtgaccaatactcagagtctcgaccagcaatgtgaccccaagcccctgagccggcagtttgataccgtttcaggctctatttatgaggactcctgcgccagccatggaccaatgagccttggcgaactggaactagagcccaatagcaagttagtccttcctacaacactgctgacagctcaggagaacgatgtaaacttgcctgtggcggctgaagatttttctcagtaccagctgaagcaaaatcaagacgtcaaacaggtggagcataaaccatcccagagttacttgagagtgcgaaataagtccgatattgcaccgagtcagcagcaagtcagtcccggggacatggacaggacccaaatcgagttgaacccttatttgacttgtgtgttctcggggggaaaggccgtgcccctatcagcatcccaaatgccaccggctaagatgagcgttatgttaccatctgtgaacttagaggactgctcacagagcctgagcttgtcaacaatgcaagaggatatggaaagctcgggagccgacacgttctag

SEQ ID NO: 25540 - DNA, 2271 bp, Artificial Sequence
  Description of Artificial Sequence: Synthetic coding sequence
atggtggcccccgtgctggagaccagccacgtgttctgctgccccaacagggtgaggggcgtgttgaattggtctagtggccccaggggtctcctggcctttggaacatcgtgttccgtggtcctttacgacccacttaagcgggttgtcgtgaccaacctcaatgggcatacagctagagtgaactgtatccagtggatctgtaagcaagatggcagtccatccacggagctcgttagtggcggttcggataatcaggtgatacattgggagattgaggataaccagttgctgaaagctgtccacctgcagggtcacgaaggtccagtgtacgcagtgcacgccgtgtaccagaggagaacttctgatcccgcactctgcacgctaatcgtgtctgcagccgctgacagtgccgtcagactgtggagcaaaaagggaccagagggcagagacctgtttttggcctcatgcagccaggactgcctcatacgtatttggaagctctatatcaagtctacatctctggaaacgcaggatgacgacaacattagactgaaggagaacaccttcactatagagaacgagagtgtaaaaatcgctttcgcggttacactggaaacagtgctggccggccacgagaactgggtgaacgccgtgcactggcaaccagtgttttataaagatggcgtcctacagcagccagtgcgtctattgtctgcgagcatggataaaactatgatcttgtgggcaccagacgaggagtctggggtgtggctggaacaagtgcgggtgggcgaggtaggggggaataccctgggtttttatgattgccagttcaacgaggacgggagcatgataatcgcccatgccttccatggagccctgcacctgtggaaacagaatacagtcaatccccgcgagtggacgcccgaaatcgtgatcagtgggcactttgacggtgtgcaggatcttgtgtgggatccagagggggaatttattataaccgtaggaactgatcagacaactagactttttgctccatggaagagaaaagaccagagccaggttacttggcacgagatagcacgccctcagatccacgggtacgacctaaaatgtcttgccatgattaatcgcttccagttcgtctcgggagctgatgaaaaggtccttcgcgtgttttctgcgccccgaaactttgtggagaacttctgcgctataactggccagtccttgaatcacgttctgtgcaaccaggactccgatcttccggagggtgccacagtgccagctttaggattgagcaacaaagcagtgtttcagggcgacatcgctagtcagccttccgatgaagaggaactcctgaccagcaccggctttgaataccagcaggtggcattccagccgtctatcctcactgaaccccctacagaagaccatctgctacagaacaccctgtggcccgaggtccaaaaactgtacggccatggttatgagatattctgtgttacctgcaatagttccaagacactacttgcttctgcgtgcaaggccgccaagaaggagcatgcagcaataatcttgtggaacaccactagctggaagcaggtgcaaaacctggttttccactctctcacagtgactcagatggcattctctcccaatgaaaaatttctcctagctgtgtctagagatcggacttggtccctgtggaaaaagcaggatacaattagccctgaattcgagccagtatttagcctcttcgcctttacaaacaagatcacttctgtccatagccggatcatttggagctgcgactggtctcccgatagcaaatacttttttaccggatcacgggataagaaagtcgtggtctggggcgagtgtgattcaactgacgattgtatcgagcataatattggcccatgtagctcagtcctggatgtggggggagcagtgactgcagtcagcgtgtgcccggtccttcaccccagccagcgctacgttgttgctgtcggtctggagtgcggaaaaatctgcctctatacttggaagaagacggaccaagtacccgaaatcaacgattggacacattgcgtggaaacaagccagagtcagtcacatactctcgcaattagaaaactttgctggaaaaactgctccggaaaaaccgagcagaaggaggctgaaggtgctgaatggctgcacttcgcaagctgtggtgaggaccacacggtcaaaattcatcgcgtaaataaatgtgcgctgtag

SEQ ID NO: 25541 - DNA, 345 bp, Artificial Sequence
  Description of Artificial Sequence: Synthetic coding sequence
atgcaggagatcaaccagaacctggccgaggaggccggcctgaacattactcatatctgtttgccacccgattcctccgaagcagagattatcgacgaaattttaaagatcaatgaggacacaagggtgcatggtcttgcactgcaaatcagcgaaaaccttttcagtaacaaagtgctgaatgcattaaaacccgaaaaagacgttgacggcgttacagatattaacctcggtaagctggtgcgtggagacgcacacgaatgtttcgtgtcacccgtcgccaaggctgttatcgagttgttagaaaagagcggggttaacctggacggaaagaagatattgtag

SEQ ID NO: 25542 - DNA, 747 bp, Artificial Sequence
  Description of Artificial Sequence: Synthetic coding sequence
atggccaccagcgcccccctgcggagcctggaggaggaggtgacctgttcgatctgcctggactatctccgggatcctgtgactatcgactgtggccatgtgttttgcagatcttgcactactgacgttcggccaatttctggcagccgtcctgtgtgtccactctgcaaaaagccctttaagaaggagaatatcaggcctgtttggcaattggcttcactcgtggagaacattgaacgcctgaaggtggacaaaggtaggcagcccggcgaggttacgcgggaacagcaggatgcaaaattatgcgagcggcatcgcgaaaagcttcattactattgcgaggacgatggcaagttgctgtgtgtgatgtgtcgtgaatcaagggaacatagaccccacactgctgtccttatggagaaggccgctcagcctcacagagaaaagatcttgaaccatctgagcacacttcggcgcgacagagacaagattcagggctttcaagcgaagggagaagccgacatcctagccgccctgaagaagctgcaggaccagcggcaatacatcgtggcagagttcgagcagggacaccagttcctgcgagaacgtgaggagcacctcctggaacaattagccaagctagaacaggaacttactgaaggaagggagaagttcaaatctaggggcgtgggagagcttgcacggttagccttagtcattagcgagctggaggggaaggctcagcagtag

SEQ ID NO: 25543 - DNA, 1461 bp, Artificial Sequence
  Description of Artificial Sequence: Synthetic coding sequence
atgacctgcggcagctactgcggcggccgggccttcagctgcatctcagcctgcggcccccgtcctggaaggtgctgcatcacagctgctccttacaggggcatatcatgttacaggggactcactggcggctttggatcccacagcgtctgcggagggtttagagccggctcatgtgggcgtagcttcggatacaggagcggcggcgtttgtggaccgagtcccccctgtattacaacagtgagtgtcaatgaatccctcctgaccccattgaacctggagatagatccaaacgcccagtgtgtgaagcaggaagaaaaggagcagattaaatctctgaattccaggtttgcagctttcatcgacaaggtgcggtttctcgagcagcagaataagctgctagagacaaaactccagttttaccagaacagagaatgttgccaatcaaatcttgagcccctttttgaaggatatatcgagacattgagacgtgaagctgagtgcgtggaggctgactctggccgcctcgcaagcgagttaaaccacgtgcaagaagttttggaagggtataagaaaaagtatgaagaggaggtgtcactcagagccacagcagagaacgaattcgtcgctctgaaaaaggacgtcgactgcgcgtacctgcgcaaatccgacctggaggcaaacgtagaggccctgattcaggaaatagactttttgaggcggctatatgaagaagagattagggttctacagtcccacatctcggacacctcagtggtcgttaaattggacaactcccgcgacctgaacatggattgcataatagctgagatcaaggcccagtacgacgatatcgtaacccggtcaagggctgaagccgagtcgtggtatcgcagcaagtgcgaggagatgaaagcgaccgtaattaggcacggcgaaactctgcgcaggacgaaggaagagatcaacgagctgaaccgcatgatccaaaggctgactgcagaggtcgaaaacgccaagtgccagaattcgaaactggaggcggcagttgcacagtctgagcagcagggagaggccgcccttagcgatgcaagatgtaagctcgcagagctcgagggcgctctgcaaaaggccaagcaggatatggcctgtctgataagggagtaccaagaggtgatgaatagcaagctaggcctcgatattgagatcgctacttatcgccgtcttttggagggtgaggaacagcgcttatgtgagggcgtcggtagcgtcaacgtgtgcgtgtcttcttctcgtggaggagttgtctgcggggacctttgtgcttctactaccgcccctgtagtcagcacacgagtgagctctgtacctagcaactctaacgtggttgtgggaacgacaaatgcatgtgcacctagcgctcgggtcggcgtgtgtggcggttcgtgcaaaaggtgttag

SEQ ID NO: 25544 - DNA, 1710 bp, Artificial Sequence
  Description of Artificial Sequence: Synthetic coding sequence
atggccctgctgagcgagggcctggacgaggtgcccgccgcctgcctaagcccctgtggaccccctaaccccaccgagctgtttagcgagtcacgcagacttgcgttagaggaactggtcgccgggggccccgaagccttcgcggcttttctacgccgagagagattagcaagattccttaaccctgacgaagtgcatgctatattacgagctgccgaaagacccggagaagagggcgctgcagccgctgcggcggcagaggatagttttggtagcagtcacgattgttcctccggaacctacttcccggagcagtctgatctggagcctcccctgctagaacttggctggccagcgttctaccagggggctggggaaggtggcccgtatgggtgcaaagacgcgctccggcagcagctgcgctctgcacgtgaggtgatcgccgttgttatggatgtatttaccgacatagatatctttagggacctccaagagatatgcagaaaacagggggtggccgtttatatactcctggaccaggctctgttgagccagtttttagacatgtgtatggatctgaaagtgcatcctgaacaggaaaagctaatgacagtcagaaccatcaccggtaatatctactacgcgcggtctggaacaaaaattataggaaaagtgcatgagaagttcacattgatcgatggaatccgtgtagctacggggagctactcattcacatggactgatggcaagttgaacagctcaaacctcgttatcctgagtggacaggtggtggagcattttgacctggagttccggatcctgtacgcccagtctaagcccatcagcccaaaactgttatcccacttccagagttcaaataaattcgatcatctcacgaatcgtaaaccacagtccaaggagttgactcttgggaatctgctgcgcatgaggctcgctaggcttagttcgacaccacgcaaagccgatctagatcctgaaatgccggcggaggggaaggccgaaagaaagccacatgattgtgagagttccacggtctcagaggaggattattttagtagtcaccgtgatgagctacagtctcggaaagccatcgatgcagcaactcagactgagcccggcgaagaaatgccaggcctaagcgtctccgaagtgggcacacagacatccattaccaccgcctgcgccggcacacaaacagccgtgattactcggatcgcgtcatcccaaactactatatggtcacgcagcaccacaactcagacagacatggatgaaaacatactgtttccccgcggcacccagagtactgaaggcagccctgtgtccaagatgtctgtgtcccggtcctctagcctgaaaagctccagctcagtttcttcccagggcagtgtggctagcagcaccggctcccccgcaagcattcgaaccacagacttccacaaccctggctatcccaagtacctcggtacaccacacctggaactatacctatctgactccctgcggaaccttaacaaggagcgccagttccacttcgccggcattagaagtcgactgaaccacatgctggcaatgctgagccgcagaaccctgtttaccgaaaaccacctgggtttgcacagcgggaacttttctagggtgaatttactggcagtgcgagacgtcgccttatacccatcctaccaatag

SEQ ID NO: 25545 - DNA, 1224 bp, Artificial Sequence
  Description of Artificial Sequence: Synthetic coding sequence
atggtgctgttcagcgacagcagcctgccccactggcagcagcagcctccccagcccgccccacccccgccattgttcccacgtcaacagcaggtccaggttaacaaagggagagtcaattgccatcctcgttgccgctacatcaagaccaagccctgtcaccagctcagccatcaggtatgggtccagcagaaacctagtcatcgtctgttgtctttacagctgtcaccctcgccaaaaccatctcctagtccacagttgtctttgaagtttaggctcagcttgaaatttaggcctaagcagctgttccaccccatgtctctcctcaaacacaatccacctactcactcccatcccagtcctaaactccaacagtctcagcctcagagcaatgtccaaggccagtcccctgtcagagtccagagcccatcccagacaaggatcaggcctagtactccttctcagctgtcacctggccagcagtctcaggtccaaacgaccactagccagcctattccaatccagccgcatacttccttacaaatcccctctcagggtcagcctcagtcacaacctcaagtggtgatgaaacataatgcagttatagaacacctaaagcaaaaaaagtcgatgacacccgctgagcgggaagaaaatcagaggatgatcgtgtgtaaccaggtgatgaaatatatacttgataagatcgataaggaggagaaacaagccgcaaaaaagagaaaacgtgaagaaagtgtcgagcaaaagaggtccaagcagaatgcgaccaagctgtctgcactgctgtttaagcacaaggagcagttacgagccgaaatcctgaagaaacgcgctcttcttgacaaagacctgcagattgaagtccaagaggagttgaagagagatctgaaaatcaagaaggaaaaggaccttatgcagctggcccaggccacagccgtggccgccccctgcccacccgtaacacctgccccacctgcgcctcccgctcctcctccctccccaccacctcctcctgctgttcaacataccggcttgctttcaacacctactctccccgccgcttcacagaagcggaaacgtgaagaagagaaggatagctcctccaagtccaaaaaaaaaaagatgatctccactacctccaaggagaccaagaaggataccaagttgtactgcatctgcaaaactccctatgacgaatcttag

SEQ ID NO: 25546 - DNA, 480 bp, Artificial Sequence
  Description of Artificial Sequence: Synthetic coding sequence
atggccaccagcgcccccctgcggagcctggaggaggaggtgacctgcagcatatgtctagattacctgcgcgatcctgtaaccatcgattgtgggcatgttttttgtaggagctgcacgacagatgtgaggccaatatcgggaagtaggcccgtttgccctctctgcaagaagccatttaaaaaagagaatattcgccccgtttggcaacttgagaagattttaaatcacctgtctactctcagacgcgaccgtgacaaaattcaagggttccaggcaaaaggtgaggcggacatactggccgcccttaaaaagctgcaggatcagcggcagtacatcgttgccgaatttgagcagggccaccaattcctgagggagcgagaagagcacctcctagaacagttagcgaagctcgagcaagaactcacagaaggccgggaaaagtttaagagcagaggagtaggtgaactcgcgcggtag

SEQ ID NO: 25547 - DNA, 309 bp, Artificial Sequence
  Description of Artificial Sequence: Synthetic coding sequence
atgaacgaggccgagatcgtggacgtggccctgggcatcctgatcgagtcacggaaacaagagaaggcatgtgaacagccagcactcgcaggagccgacaatcccgaacacagcccaccttgtagcgtatcaccacacacatctagcgggagttcctctgaagaagaagattcgggaaaacaggcactggccccggggctgtccccctctcagcgcccaggtggatcttccagtgcatgtagccggtctccagaagaggaggaggaggaggatgtgctgaagtacgtgagagagatcttcttttcatag

SEQ ID NO: 25548 - DNA, 345 bp, Artificial Sequence
  Description of Artificial Sequence: Synthetic coding sequence
atgcagttcggcgagctgctggccgccgtgcggaaggcccaggccaacgtgatgctgttcctggaggaaaaggaacaggccgcgctgagtcaggccaacgggatcaaagcccacttggaataccgctcagccgaaatggaaaaatcaaagcaggaactagaaactatggctgcaattagcaatacagttcagtttctggagcgatctatgacgtccgaactaaagtgcctcccactatttagcgcaaacatagggctccctaacctgagcccagcccctggaaactccagttctaacatgtgtatgacatctcgttctacacggacacaacatacgtcgatatag

SEQ ID NO: 25549 - DNA, 579 bp, Artificial Sequence
  Description of Artificial Sequence: Synthetic coding sequence
atggcccccaagcccggcgccgagtggagcaccgccctgagccacttagtactcggtgtcgtgagcttgcacgccgcggtgtccaccgccgaggcgtctcggggcgcagcagctggattcctcttgcaagtgttggccgccactactactctggcaccaggcctttccacacatgaagactgcttagccggcgcctgggtggcgactgtcattgggctccccttgctggcattcgattttcattgggttaatggggaccgatcgagcgcaaacctgctattgggcggcgggatggtcttggcagtggcaggcgggcatctgggccccgaaggaaggagcgtcgccgggcaggccatgttactggtggtcgctgttaccatcctcatagtcgccgtgttcaccgctaatacctacgggatgtggggaggtgcaatgttaggcgtggccggattgctgtcacgattggaggaggaccgtctcctcctgctcccaaaagaggacgtatgccgctgggcgctggctgtgggctcctgggcctattgtcgggctttgcatactcagcgactccagtgggagtag

SEQ ID NO: 25550 - DNA, 888 bp, Artificial Sequence
  Description of Artificial Sequence: Synthetic coding sequence
atgaagcagtacggcctgggccccaacggcggcatcgtgaccagcctaaacctcttcgcaactagatttgaccaggtcatgaaatttatagagaaagcgcaaaatatgtccaaatacgtcttgatcgatacaccaggacagatcgaagtgtttacttggagcgcgtctggaaccatcattacagaggccctggccagttccttccccaccgtggtcatctacgtgatggacacaagcaggagcaccaaccctgtgacattcatgtctaacatgttgtatgcgtgctctatactgtataagaccaaacttccttttatcgtggtgatgaataagactgacatcatcgaccacagttttgccgtcgaatggatgcaggacttcgaggccttccaggatgcacttaatcaggaaacaacatatgtgtcaaacctgactcgcagtatgtccctggtgctggacgaattttactcctctctccgcgtggtcggtgtgagtgccgtgctgggcacaggcctggacgaattattcgtgcaagtgacctcagctgcagaggaatatgaaagggagtaccgcccggagtacgaaagactaaagaagtcacttgccaatgcagaatcacaacaacagcgggaacaattggagagattgagaaaagatatggggtcagtggcactcgatgcgggcacagcaaaggatagtctgagtcctgtgctccatccgagcgacctaatactgaccagaggaacactggacgaagaagacgaagaggcagactccgacaccgatgatatcgatcaccgggtcacagaagagtcgcatgaggagccagcattccaaaacttcatgcaagagtctatggcacagtattggaagaggaacaataagtag

SEQ ID NO: 25551 - DNA, 1212 bp, Artificial Sequence
  Description of Artificial Sequence: Synthetic coding sequence
atgcccagcgccgaggccaagctgaagaagaaccggtgcgccaactgctttgactgccccgggtgtatgcatactttgtccacccgtgccacatccatttctacacagttgcctgatgatccggccaaaactacaatgaaaaaggcctactacctggcttgcggcttctgcagatggacctcccgtgatgtgggtatggccgacaagtcagtggcatccggcgggtggcaggaacccgaaaacccacatacacagagaatgaataagctgatcgaatattaccagcaactggcccaaaaggagaaagtggagagggatcggaagaaactcgcccggcggaggaattatatgcctttggcctttagtgacaagtacgggcttgggactcgactccagagaccccgtgctggcgcatctattagtactctggcagggctttcgctgaaggagggagaagaccagaaggagattaaaatcgaacccgcccaggcagtcgatgaggtggagcctcttccagaggattactatacacggcccgtgaacctcaccgaagtcaccacccttcagcagcgtttgttgcaaccagatttccagccagtctgtgcctcccagttgtacccacgccataaacacttgcttatcaaaaggtcactcagatgtcgtaagtgcgagcacaatctgtccaaacctgaatttaacccgacctcaatcaagtttaagatccagctcgtcgccgtgaactatattcctgaggtacggataatgtcaatccccaatctgagatacatgaaggagtcccaggtcctgttgaccctgaccaaccccgtggaaaatctgacccacgtgacactctttgaatgcgaggagggagaccctgatgacatcaacagcacagccaaagtggtggtcccacctaaagagttggtgctcgccggcaaggatgcagcggcagagtacgatgaactagcagaacctcaagattttcaggatgaccccgacatcatagccttcagaaaggccaacaaggtgggtattttcataaaagtaacaccccagcgggaagaaggagaggttaccgtgtgctttaaaatgaagcatgactttaagaatctcgccgcccccatccgacccatagaggaatcagaccaaggtaccgaagtgatatggctgacacaacatgtggagctgagtctgggacctctcttaccttag

SEQ ID NO: 25552 - DNA, 1674 bp, Artificial Sequence
  Description of Artificial Sequence: Synthetic coding sequence
atggaccagagccgggtgctgctgtgggtgaaggccgagcccttcatagtgggagctctgcaggtgccccctccttccaagttctcgttgcactatctaaggaaaatctctacttatgtgcaaatccgtgccactgagggagcctaccccagattgtactggtccacatggagacacattgcctgcggcaagctgcagcttgcaaaagacctagcctggctgtattttgagatcttcgacagcctgtccatgaagacgcccgaagaacggctggaatggtcggaggtgttatcaaactgtatgtcagaggaggaggtggaaaagcaacgcaaccagctgagcgtggacacgctgcaatttttactgttcctgtacatacagcagttgaacaaagtgtccctgcgaacgtccctgatcggggaagagtggcctagcccccgaaacaagagccagtcccctgacttgacagaaaaaagcaattgccacaataaaaactggaatgactactcccatcaagcctttgtttacgatcacctaagtgacctgctggagcttctgctggatcccaagcagctaacagcttcattccatagtactcacagctccctagtgagcagagaagctgtcgtcgccctgagcttcctaatagaggggaccattagccgagcccgcaaaatttaccctctccacgagctggctctttggcagccccttcacgccgattccgggtttagcaagatttcaaaaacattttccttttacaaactggagacctggctgaggagctgcttaactgggaacccatttggtacgtctgcttgcctaaagtccgggaaaaagcttgcttgggcacaccaagtagaaggtacaaccaaacgggctaagatcgcctgtaatacccacgtggcacccagaatgcacaggttggtcgtcatgtcacaggtatacaaacaaacactggccaagagttcggacaccctggcaggagctcacgtcaaaatccacaggtgtaacgaatcattcatctacctcctgagccctctcagaagcgttacaatcgaaaaatgccgaaattctatctttgtgctcggcccagtcggaactacactgcatctccactcgtgcgataacgtgaaagtgattgctgtatgccacaggctgtccatttctagcaccacagggtgtatattccatgtgctgacccctacacgcccgctgatcctgagcggaaaccaaaccgtgacttttgctccttttcacactcattaccccatgctggaagaccacatggctcggaccggactggcaaccgtcccaaattactgggataatcctatggtcgtgtgcagagagaactctgacacaagagtgttccagctgctgcctccttgtgagttctacgttttcatcatcccctttgaaatggaaggagatactacagaaattccaggcggactgccaagtgtttaccaaaaagcgcttggacagcgagagcagaagatccagatctggcaaaaaacagtcaaggaggcccacctgaccaaagaccagagaaaacaattccaggtactagtagaaaacaagttttatgagtggttaataaacaccggacacaggcagcaacttgacagtctggtgcctccggccgctgggtctaaacaggccgccggatag

SEQ ID NO: 25553 - DNA, 462 bp, Artificial Sequence
  Description of Artificial Sequence: Synthetic coding sequence
atggccgagcaggagcagcggaagatccccctggtgcccgagaacctgctcaaaaaaaggaaggcttatcaggctctgaaagccacacaggccaagcaagcgttattagccaagaaagaacagaaaaaaggcaagggactgcgcttcaagcggctggagagcttcctgcatgattcatggaggcagaaaagggataaagtccgcctgcggagactggaagtcaaaccgcacgctctggaattgccggacaagcattccttggcttttgtggtccggattgaacggatagatggagtgtccctactggtccagcggaccatcgcccggctgcgcctgaagaaaattttttccggagtcttcgtgaaagttaccccacagaatttgaaaatgcttaggattgtggaaccctatgtgacctggggtgaggtgtggcggcaccttcttggacgccctcattcttag

SEQ ID NO: 25554 - DNA, 2070 bp, Artificial Sequence
  Description of Artificial Sequence: Synthetic coding sequence
atgatcgacagcgtgaagctgcggcgggacagcgccgccgacttctttagccattatgagtatctgtgcgcccttcagaactctgtaccactcccggctgtgagggcgtgtctgagagaaggtgtcctggactttaacgctgatcggctcagaggagtggactgggccccattactctcaacgttgaaaattaataaagacctccccctcgtgagcataaagtccttttttcaaccatggttaggcgatacagggagcgacatgaataagttttgtcggagcagggtccctgctatccggtacaaagacgtgacatttcagttgtgcaaggcactgaaagggtgcttaagtatctcttcagtacttaaaaatctggaacttaacggtctgattctcagagagcgggacctgactattttggcaaaaggccttaacaaatctgccagcctggtgcatctgtccctcgcaaactgcccaataggcgacggcgggttagagatcatctgtcagggaatcaagtcttctataacactgaagacggttaacttcactggctgtaacctgacctggcaaggcgccgatcatatggctaagattcttaagtaccaaaccatgagaagacacgaggaaacatgggcggagtccctccggtaccgccggcctgacctggactgtatggctggcctacgccgcattacacttaattgcaatacgctcatcggggacttgggcgcatgtgcctttgccgatagcctgtccgaggacctgtggttgcgcgctctggatcttcagcagtgcgggctcacgaatgaaggcgccaaagcactcctcgaggctcttgagactaacacgacccttgtggtgcttgacatccgtaagaacccgctcattgaccactccatgatgaaagcagttatcaaaaaagtcctgcaaaacggacggtccgctaaatccgaataccaatggatcacttcaccctccgtcaaagaaccatctaagaccgccaagcagaaacgtcggaccatcattctgggatctggtcacaagggcaaagctaccattcggattgggctcgcgaccaaaaagcctgtatcctcagggcgcaaacattccctgggcaaagagtattacgccccagcccccttacctcccggggtgtccgggttcctgccttggcgcacagcggaacgggctaagaggcacagaggcttcccgctcatcaagacccgcgatatttgcaaccagcttcagcagccggggttcccggtgaccgtcacggtggaaagcccctcgagctctgaggtggaggaggtggacgactctagtgagtctgtgcacgaggtgccagagaaaaccagcatcgagcaagaggctcttcaagaaaaactggaggagtgtcttaagcagcttaaggaagagcgcgttattcgtttgaaggtggacaaaagagtgagcgagctggaacatgagaatgctcagttgagaaatattaacttctctctcagcgaggctttacacgcacaatcacttaccaatatgattttggacgacgaaggcgtcctgggctcaatcgagaacagttttcaaaagttccatgcctttctggacctcctcaaggacgccggcctaggacaattggcaacaatggccgggattgaccagtctgactttcagttgttgggacatccacaaatgacttcaaccgttagcaatcctcccaaggaggagaaaaaagctctcgaggacgagaagccggagccaaaacagaacgccctcgggcagatgcagaatatccagttccaaaagatcacaggcgacgcccgaatccctttgccactggactccttcccggtgccagtttcaacgcctgagggtttgggcacctcgagcaacaacctcggcgttcctgctacagagcagagacaggaaagtttcgaaggcttcatcgcccgtatgtgtagtcctagcccagacgcaacgtccgggaccggatcacagcgcaaggaggaggagctgagcagaaactctcggtcatcttccgaaaaaaagacaaaaaccgagtcacattag

SEQ ID NO: 25555 - DNA, 915 bp, Artificial Sequence
  Description of Artificial Sequence: Synthetic coding sequence
atgaacttcagcgaggtgttcaagctgagcagcctgctgtgcaagttttcccctgacgggaagtacctggcttcatgcgtgcagtaccgactcgtggtgcgcgatgtgaacaccctccagatcctgcagctctacacttgtcttgaccagattcagcacattgaatggagtgcggacagtctgttcatattgtgtgctatgtataagagggggttggttcaggtgtggtcattagaacaacccgaatggcattgcaaaatcgacgagggttctgccggactggtggcctcatgctggtcacccgacgggcgccatatcttaaacactacagaatttcacctgcggataacagtatggtccctctgcacaaagtccgtgtcatatatcaaatatcctaaagcatgccttcagggaatcacctttacaagagacggaaggtatatggcgctggcagagagacgggactgtaaagactacgtttcaatctttgtatgttccgattggcagctcttacgtcatttcgatactgacactcaagacctcaccgggatcgagtgggctccgaatggctgcgttttggctgtgtgggacacctgcttggaggttaggattctgaatcacgtcacttggaagatgataacagagttcggtcaccccgctgcgatcaacgatccaaagattgtcgtctataaggaagccgagaagtccccgcaactaggcttagggtgcctttccttcccgcccccccgcgctggcgccgggcctcttccatcctccgagagtaagtatgagatagcgtcagtgccagtgtcccttcagacgctgaagccagtgactgaccgtgctaatcccaaaattggtatcggaatgctggctttctcacccgactcctacttcctggcaacacgtaattag

SEQ ID NO: 25556 - DNA, 483 bp, Artificial Sequence
  Description of Artificial Sequence: Synthetic coding sequence
atgaaggaggtgggccggccccgggaggtgcggggccggcccggcaaatctagaattcaaaaagaactcgctgacattaccctagacccccccccaaattgttcagccggccctaaaggggataatatctacgaatggagaagtacaattctgggcccaccaggatctgtttacgaaggaggcgtgttcttcttagatattactttcacaccagaatacccctttaagccccccaaggtcacctttcgcaccaggatctatcattgcaacatcaatagccagggagtcatctgcttggatatcctcaaagacaactggtctccagcattaacaattagtaaggtacttcttagcatttgctccctcctgacagactgcaacccggctgatcctctggtgggctctattgccactcagtatatgaccaatcgtgccgaacacgacagaatggctaggcagtggacaaagagatacgctacttag

SEQ ID NO: 25557 - DNA, 516 bp, Artificial Sequence
  Description of Artificial Sequence: Synthetic coding sequence
atgagcagcggcaacgccaagatcggccaccccgcccccaacttcaaagctactgccgtgatgccagatggccagttcaaagacatttctctctcggactataagggtaagtatgtggtgtttttcttttaccctcttgacttcacatttgtctgcccaacagagatcatagccttcagtgacagggctgaggagtttaagaaactcaactgtcaggttatcggagcttccgtggactcacatttctgccacctagcctgggtcaacactcccaagaaacaaggcgggttaggaccaatgaacattcccctcgttagcgaccctaaacggacaattgcccaggattatggggttctgaaagctgacgaggggatcagctttagggggctttttattatagacgataagggtattcttcggcagattactgtgaacgatctgcccgtagggcggagtgtagatgagacgctgcggctggtccaggcctttcagtttacagacaaacatggagagtag

SEQ ID NO: 25558 - DNA, 603 bp, Artificial Sequence
  Description of Artificial Sequence: Synthetic coding sequence
gtgctgatcttcgcctgcctggtgcccggcttccccgccgtgatgagctcccgcggcccatgtactctggagaccctaattaatccttcaccgtctgtggccgatgttaaaatatatccggaagaaatcaccccactcctaccagctatctccggggagaagattgccgaggaccaaacttgcttttttctgcagattctcctgaagtacatggtgattcaggcagcttccctggaatggaagaataaggaaaaccaggacactgggttcaaattcttgtttacgctgtttcggaagtactacctcccccatctatttccctcttttaccaagctgacgaatatttacaaacctgtgctcgatattccccacctgagaccgaaaccagtctatatcacaaccacgagagacaatgagaatatctattccacaaaaatcccctacatggccgccagagtcgtgttcattaaatggatcgtgacgttcttcctcgagaagaaatacctgaccgccacccagaacacaaagaatggcgtggacgttctgcctaaaataatccaagtttgccacccctcatcattctatttattgatgctggtatag

SEQ ID NO: 25559 - DNA, 576 bp, Artificial Sequence
  Description of Artificial Sequence: Synthetic coding sequence
atgagcagcaccctgggcaagctgagcaaccaggtggaggagaccctcccactcctgaaaaaaccattgaagcgagcaatcactacactcatggccggcattctacggctcgtggtgcaatggcctcccggtaggttgcaaaccgtgaccaaaggagtcgagtccctgatctgtacggattggattaggcacaaatttactcgaagcagaattcccgaaaaggtgtttcaggccagccctgaggaccatgagaagtacggcggcgaccctcaaaaccctcataaactgcatatcgtgaccaggattaaaagcactagaagacgaccatactgggagaaagatatcatcaagatgttaggtctcgagaaagcccacactccccaggtgcacaagaacattcctagtgtgaatgctaaactcaaagtcgtaaaacatcttatccggataaaacccctgaaacttccccagggcctccctgcggaagagaatatgtccaacacatgcctcaagtcaaccggagagctggttgttcagtggcatttgaagcccgtggagcaaaaagcacatgagagctag

SEQ ID NO: 25560 - DNA, 483 bp, Artificial Sequence
  Description of Artificial Sequence: Synthetic coding sequence
atggaggccgagcggccccaggaggaggaggacggcgagcagggccccccccaggatgaagagggctggcctccaccaaatagcaccaccaggccctggcggtcagccccaccttcccctccacctcctggaacccgccacactgctttgggaccacggagcgcctctctcctgtcactgcaaactgaactcctcctagatttagttgccgaagcccagagccgccgcttggaggaacagcgtgccacattctacacaccccaaaacccaagctctctagccccagctcctcttaggcctctggaggatcgagagcaactgtacagtaccatactgagtcaccaatgtcagcgtatggaggcccaaagatctgagccaccactcccacctgggggacaggaactgctagagctcctcttgcgcgtgcagggcggaggtcggatggaagagcagagatcaagaccccccacacacacatgttag

SEQ ID NO: 25561 - DNA, 321 bp, Artificial Sequence
  Description of Artificial Sequence: Synthetic coding sequence
accttcctggagcagagcaagacccggttcaacaagaactacaagggtatgagtctgtcgaaaataacaacaacagtgggactgaacatcggcacggtggacgtgggcaaagcacgcctgatgttttgggatctcggtgggcaggaggagctgcaatcactttgggataaagacaagactaagtgcggcgacctggggactttgcatagctctaaggtctccgccagcttcaggttgcgcgatctcgccgctgaccatcaccggacgcagaagtggcagagacctgatgtcggtacagccggatggctgccacttccttag

SEQ ID NO: 25562 - DNA, 1524 bp, Artificial Sequence
  Description of Artificial Sequence: Synthetic coding sequence
atggccgagctgcagatgctgctggaggaggagatccccggcggccgccgagcgctcttcgattcttacactaatctcgaaagagtagcagattactgtgagaataactatattcagtctgccgacaagcagagggctttagaagaaacaaaagcatacacgacacagtccctggcgtctgtcgcctatttaatcaatacactggctaacaacgtactgcagatgctcgatatccaggcttcccagctcaggcgaatggagtcaagcattaatcacattagccagactgttgatatccacaaagaaaaggtggcccgcagggaaatcggcatactgactaccaacaaaaacacctctagaacacacaagattatcgctccagctaacctcgagagaccagtgagatacattcgcaagcccattgactataccatcctagacgacattgggcacggggtcaaagtgagtacccaaaatatgaagatggggggactgccacggactacacctcccacccagaagcctccgagccctccaatgagtgggaagggaactctgggaaggcactcaccatataggacactcgagccggtgcggcctcctgtggtgccgaatgactacgttcccagccccactaggaacatggcaccatcccagcagagccctgtgagaacagcaagtgttaatcagagaaaccgaacctattctagttcaggatcttccggaggctcacaccctagcagcaggtcttcatcccgcgagaactcagggtctggctcagtaggagtgccaattgctgtgccaactccctcacctccgagcgtgtttcccgcaccagccgggtcagccggcacacctccacttccggctacaagcgctagtgccccagcacccctggtccccgctaccgtgcctagttcaaccgcccctgacgctgccgcagggggagcccagactcttgcggatggcttcacaagccctactcctcctgtcgtgagctccaccccgcctacaggtcaccccgttcaattctactccatgaataggcctgcgtcacgtcacacccctccaacaattggagggtccttgccatacaggcggcccccctcaataacatcccagacctcactccagaaccagatgaacggaggcccattttattctcaaaacccagtaagcgataccccccctccacctccccccgtggaagaacccgtgttcgacgaaagtccaccccctccacccccgcctgaagattacgaggaggaggaggccgctgtggtggaatatagcgatccttacgccgaggaggaccctccttgggccccgcggtcatatttggaaaaggtggttgcaatatacgattatacgaaagacaaggaagatgagttgtccttccaggagggtgctatcatttatgtgattaagaagaacgatgatggctggtacgaaggcgttatgaacggcgtaaccggactgtttcccgggaattacgtcgagagcatcatgcattactcggagtag

SEQ ID NO: 25563 - DNA, 303 bp, Artificial Sequence
  Description of Artificial Sequence: Synthetic coding sequence
atggccagcgccggcacccagcactacagcatcggcctgcggcagaagaattccttcaagcagtccggtcccagcggcaccgtgcccgctacaccaccagagaagccgtccgagggtcgggtatggcctcaagcccaccagcaggtgaagcctatttggaagctcgagaaaaagcaggtcgaaacactctctgcggggctggggccaggtctattgggagtgcctccacagcccgcttacttcttttgccccagcaccctgtgtagctctggtacgacagccgtaattgccggccacagctag

SEQ ID NO: 25564 - DNA, 1212 bp, Artificial Sequence
  Description of Artificial Sequence: Synthetic coding sequence
atggccagcgccctgcggcccccccgggtgcccaagcccaagggcgtgctgccaagccactattatgaatcattcttggaaaaaaaggggccttgcgaccgggactacaagaaattttgggccggactgcagggcttgacaatctatttctacaactctaatagagacttccagcacgtcgagaagcttaatctcggagccttcgaaaagctcactgatgaaataccttggggatcgagcagggatcccggcacccacttttctctgattctgagagaccaagaaatcaaatttaaggttgagacattagaatgtcgtgaaatgtggaaaggtttcattttgacagtggtggagctgcgggtccctaccgatctgacactgctgccagggcatctatatatgatgtcagaggtcctcgccaaggaagaagcccgtcgtgctcttgagaccccctcctgctttttaaaggtctcaaggctggaggcacagctgctgctggagagataccccgagtgtggaaatcttctcttgaggccgagcggtgacggcgctgatggcgtctccgtcactacccggcagatgcacaatggcacccatgtcgtgcggcactacaaagtgaaaagagaggggccaaagtatgtcattgacgtcgaacagccattctcttgcacatcacttgacgctgtagtgaattatttcgtgagccataccaaaaaagctctcgtcccctttttgctggatgaggattatgagaaggtgcttggctatgtggaggccgataaagagaacggtgagaatgtgtgggtagccccaagtgcgccgggccctgggcccgctccttgcaccgggggaccaaaaccgctatcccccgcgtctagccaggataagctgccacccctgccaccgctacccaaccaggaagagaactatgttacacctatcggggatggccctgctgtcgactatgaaaatcaggacgtggcctctagcagctggccggtgatactgaaaccaaagaaattaccgaagccacctgcaaagctgcctaaacccccggtaggacccaaacccgagccaaaggtttttaatggtggactgggcagaaaactgcccgtatcctctgcacagcccctatttccgacggccggactagccgatatgaccgcagagctgcagaagaagctagagaaacgcagggctctggaacattag

SEQ ID NO: 25565 - DNA, 1551 bp, Artificial Sequence
  Description of Artificial Sequence: Synthetic coding sequence
atgctgcggcggggcagccaggccctgcggcggttcagcaccggcagggtgtacttcaagaataagctgaaactggcactgattggacagtctctttttggccaggaagtttacagccacctgcggaaggagggacatcgcgtcgttggggtgttcaccgtcccggataaggatggtaaggccgaccctctagcattagccgcagagaaggacggcaccccagtctttaaactgccaaaatggcgggtgaagggtaagaccatcaaggaagtggccgaggcctatcggtctgtgggggccgagctaaacgtgctccccttttgcactcagttcatcccgatggacattattgacagcccaaagcatgggtctatcatctatcatccttctattctgcctaggcaccgcggagcgagtgcaattaattggaccctgatcatgggagataaaaaggctggtttttctgtgttttgggccgatgatgggttggatactggcccaatcctgctccagcgatcatgcgacgtcgagcctaacgacacagtagacgcactgtacaacaggtttttattccctgagggtattaaagcaatggtagaggccgtgcaactgattgccgacggtaaggccccacggatcccacagccagaagaaggagctacatatgaagggatccaaaagaaagaaaacgccgaaatttcgtgggatcagtcagcagaagtgctgcataattggattcgcggccatgacaaggtcccgggcgcttggaccgagatcaacggccagatggttaccttttacggcagcacattattgaatagttccgtcccccccggcgagcctctggaaatcaaaggggccaagaaacctgggctggtcaccaagaacggcttggtcctattcggaaatgacggaaaagctctgacagtgcgaaacctgcagttcgaagacggaaagatgattcctgcatcccaatatttttctactggagagacgagcgtggtggagttgactgccgaggaggtgaaggtggcagagacgatcaaagtcatctgggccggcatcctgtctaacgtccccataatcgaagactctaccgacttcttcaagtcaggggctagcagcatggatgtggccagacttgtggaggaaatccgccagaagtgtggcggtctgcagctccagaacgaagacgtgtatatggccaccaagtttgagggctttatccagaaagtcgtgcggaagctcagaggggaagaccaggaagttgagcttgtcgttgattacataagcaaagaagtgaatgagatcatggtcaaaatgccctaccagtgtttcataaacggccaattcacagacgccgatgacgggaaaacctatgacacaatcaatcccaccgatggcagtacgatctgtaaagtatcatatgcttccctcgcggacgttgacaaagcggtcgcagccgctaaggatgcttttgagaatggcgaatgggggaggatgaatgcccgggagaggggcagacttatgtactctatgcgcatgaattag

SEQ ID NO: 25566 - DNA, 1581 bp, Artificial Sequence
  Description of Artificial Sequence: Synthetic coding sequence
atggaggagatccccgcccaggaggccgccggcagcccccgggtgcagtttcagagtctagagacccagtcagagtgcctgtctcctgagccacagtttgtgcaagatacagatatggagcagggtcttactggcggcttccccatctcgaaaccggatgggatcagccagctcgaacaggacctgcaggtattcgacctcgagaccaagacacgagaagtgctcagggatgattgtagcgacggcgagacgagagaagagaacaaactgcttatccctaagcagaaaataagtgaggaggtgcactcctacaaggtgcgcgtcggtaggttaaagcacgacatcacccaggttcctgagacccgtgaggtttataagtcggaagataggctggagaggttacaggagatcctaaggaagttcctttatctcgagagagagtttaggcagattaccatttcaaaggaaacgttcacaagtgagaaaaataacgaatgtcacgagcccgagaagagttttagcttagattctaccattgatgccgaccagagagtgcttcgaattcagaataccgacgataatgacaagtacgacatgtcttttaatcaaaactctgcctcaggaaagcacgaacatctgaatctaaccgaagattttcagtcttccgagtgcaaagaatcccttatggacctatcacacctgaataagtgggaatctattccaaataccgagaagtcttataaatgtgacgtgtgtgggaagatattccatcagtcttccgccttaacgcgacaccagcgcatacatactcgcgaaaaaccctacaaatgcaaagagtgcgaaaaatcgttctcacagagcagtagcttgtctaggcacaaacgtatccacactcgggagaagccctacaagtgcgaagcaagcgacaaaagctgcgaggcatccgacaagtcatgctcgcctagctccgggataattcagcataaaaagattcatacccgtgctaaatcatacaaatgttcgtcttgtgagcgggtgtttagccggagtgtgcacctcacacagcatcagaaaatccataaagagatgccatgtaagtgcacagtttgtggaagtgacttttgtcacacatcatatctcctggaacatcagagagtgcaccatgaggagaaggcctatgagtatgacgagtacgggctggcctacatcaaacagcaggggattcacttccgggagaagccttatacatgcagcgagtgcgggaaggattttaggctcaatagccacttaatccagcatcagcggatacacacgggtgaaaaggcccatgagtgtaatgaatgtggaaaggccttctcacagacatcgtgcttgattcagcaccataagatgcatcgaaaagagaagtcatatgaatgtaacgaatatgagggtagtttttcccacagctctgatctcattctgcagcaggaggtcttgacaaggcaaaaggcctttgattgtgatgtgtgggaaaaaaactcctctcagcgggcccacctcgttcagcaccagagcattcacactaaggagaatagttag

SEQ ID NO: 25567 - DNA, 603 bp, Artificial Sequence
  Description of Artificial Sequence: Synthetic coding sequence
gtgctgatcttcgcctgcctggtgcccggcttccccgccgtgatgtcctctcgcgggccttgtactcttgagactcttatcaatcccagtccaagcgtcgccgacgttaagatttatcccgaggaaattacccccctgttgccagccatcagcggtgaaaagatagccgaagaccaaacctgtttcttcctacagattttgctgaagtatatggtgattcaggccgcctccctcgaatggaagaataaagaaaaccaggatactggtttcaagtttttgttcacacttttccgaaagtattaccttccccatttgttcccttcattcacaaagctcacaaatatctataagccggttttggacatccctcacctgcgccccaagcctgtgtacattacaactactcgcgacaatgaaaacatctactcaacaaagattccatacatggccgctcgtgttgtatttattaaatggatcgtcacgttttttttagagaagaagtaccttaccgccacacaaaacaccaagaacggcgtcgacgtgctgccaaagataatccaagtgtgccacccttcttctttctacttgttaatgcttgtgtag

SEQ ID NO: 25568 - DNA, 540 bp, Artificial Sequence
  Description of Artificial Sequence: Synthetic coding sequence
aacatcaagcccggcgagggcctgggcatgtacatcaagagcacctatgacggcctgcatgtgatcacagggacgaccgagaatgtgggctggcaactgaagaacctggtaaagaagctacgtgagaatccaactggagttgttttgctgctgaagaaacggcctactgggtccttcaacttcacccccgctcctctgaagaaccttaggtggaaaccccccctggtgcagacgagcccaccccctgctacaacccagtctcctgaaagtacaatggacacttccttaaagaaagagaagtcggccatcctggacctttacatccctcccccgcctgcagttccttactcaccccgcgacgagaacgggtcatttgtgtatggggggagctccaaatgcaagcagccactacctgggccgaaaggaagcgagagccccaatagcttcctggatcaagagtcacgcagaaggcgtttcacaatagctgattctgatcagctgcccggctatagtgttgagactaacatactgccaacctag

SEQ ID NO: 25569 - DNA, 1368 bp, Artificial Sequence
  Description of Artificial Sequence: Synthetic coding sequence
atgatgggcgcccccaacctgatcgccgacagcatggagtacggcttaagctattcggtgatttcttatttgaagaaactgagccagcaagccaaaattgaaagcgatcgcgtcattgggagcgttggcaagaaggtagtgcaggagaccgggattaaggtgcgttcaaggtcccacggcctgtctatggcctatcggaaggacttccagcagttactgcaggggatctcagaggacgtgccacatcggcttctggacctgaacatgaaagaatataccggattccaggtagcactactgaacaaggacctgaagccccagacgtttagaaatgcgtatgatataccacggcggaatctgctcgatcacctgacaaggatgaggtcaaatctcctgaagtctacaaggagatttctgaaggggcaagacgaggaccaggttcatagcgtgccaatcgcccaaatgggcaattatcaagagtatctgaagcaggttccttcgccactccgcgaactagacccagatcagccaagacgactacacacattcggcaaccccttcaaactagataaaaaaggcatgatgatagacgaagccgatgaatttgtcgcggggcctcagaataagcacaaaagacccggggagccaaacatgcagggaattccgaagaggcggagatgtatgtcaccactcctgcgaggacgacagcaaaacccggtggtaaataatcatattggtggcaagggaccacccgcaccgaccacacaagcccagcctgatctgattaaacctctccctctgcataagatttccgagaccacgaacgactcgatcatacacgacgtggtcgagaatcacgtcgccgaccagcttagctcagacatcacgccaaacgccatggatacggaattctccgccagcagccctgccagtcttttagaaaggcccactaatcacatggaagctcttggacatgatcacctcggcacaaatgatcttaccgtgggtggcttcttggaaaatcatgaggagccgcgcgataaagagcaatgtgccgaagaaaatattcccgcctcttctctgaataaaggcaagaagctgatgcattgcagaagccacgaagaggtgaacacggaactcaaggcccaaatcatgaaagagatcaggaaaccaggacgcaagtatgagagaattttcactctcctcaagcacgttcagggaagcttacagactcggttaattttcctgcagaatgtcatcaaggaggcttccaggttcaagaaacggatgctcatagagcagctggaaaatttccttgatgagatacatagaagggctaatcagattaaccacattaattccaactag

SEQ ID NO: 25570 - DNA, 1467 bp, Artificial Sequence
  Description of Artificial Sequence: Synthetic coding sequence
ctggactgcggcccccggctgcccgtggaggtgggccccagcctgagctcaccttcatctggatgcggcgaagggtcgattagtgtcggcgagaatgtgagcgatgtcgctcctactcagccctggtggcctaatactccaggcgactcggtcagtgaagaattgggacccggaaggtccggcgacaccgaagacctttcccctaattggccattgaactcacaggaagataccgcagcccaaagctcccctggacggggcgaggaagcagaggcatctgcagctgaagcacagggtggcgaacaggcctatctggcaggcctggcggggcagtaccatttggagcgatacccggactcttatgagtctatgtcagaaccaccaatcgcacacttgctccgtccggtcctccctcgagcttttgccttcccggtggatccccaagtgcagagcgctgctgatgagaccgcagtgcaactctctgaacttctcaccttaccagtgctgatgaagcggtccataaccgcccctctcgcagcccatatttctttggtgaacaaagcagcggtcgactatttttttgtggagctgcacctggaggcacactacgaggcactgcgacattttcttctgatggaggacggcgagtttgcgcaatccctgtctgatcttctctttgagaaactgggggctggtcagactcctggcgaattgctcaaccctctggtacttaactccgtgctgtccaaggctctacagtgttcgttgcacggcgacactcctcacgccagcaatctgagcctcgccctgaagtatcttccggaggtgttcgcgccaaacgcccctgacgtactgtcttgcctggagctcagatacaaggtcgactggccgctgaatattgtgatcaccgagggttgcgtgagcaaatatagcggggtctttagtttcctactccagctcaaactaatgatgtgggcgttgaaggacgtctgttttcacctgaaaaggactgtcccctcggccgcggccgtgcaggctcgcgacgccgccttcagggaagggcaccctggtctccacagacagccggatcctgccaggcacttggtaagggtccagggccaggtgggacataggggaaggccagggggcgatccagcatgcgctaggcgggtcccagcccaaggccggcttcaggcagccccagtgatgaacgtgattcattccatatttagtttggtgctgaaattccggtctcagttgatctcgcaggcctggggccctcctggtgggcctcggggggctgagcaccccaattttgccctgatgcagcagtcttataacacgtttaaatactatagtcactttctgttcaaggtcgttactaagttggttaacaggggatatcagccgcatctggaagattttctgctgcgcatcaacttcaacaattactaccaggatgcctag

SEQ ID NO: 25571 - DNA, 3819 bp, Artificial Sequence
  Description of Artificial Sequence: Synthetic coding sequence
atggccaacgacagccccgccaagagcctggtggacatcgacctgtcaagcttacgagaccctgctggaatctttgagcttgtagaagtggtgggtaatggcacatacggccaggtctataaggggcgacatgtgaaaacagggcagttagctgccattaaggtgatggacgtgacagaggatgaggaggaagaaatcaaacttgagatcaacatgcttaagaagtactctcatcatcggaatatcgccacctattacggtgcgttcataaagaagagtccaccaggtcatgatgatcagctctggttggtcatggaattttgcggtgccggctcaatcaccgacctggtcaagaatactaagggcaacaccctaaaggaggattggattgcctatatatcacgggaaattctcaggggcttggcccatcttcatatccatcacgtaattcatagggacattaagggccagaacgtgctgttgaccgagaacgcagaggtgaagctcgtggattttggggttagcgcacagctcgacagaacggtgggtagacgtaacacatttatcggtactccatactggatggccccagaagtgatcgcatgtgatgagaacccagacgccacatacgattacagatcagacctgtggagttgcgggatcactgccatcgaaatggcagaaggtgcgccacccctttgcgacatgcaccccatgagagctctcttcctcatcccacggaatccgccacctaggctcaaatcaaaaaagtggtccaagaagtttttctcattcattgaaggttgtctggttaagaactacatgcaaagacctagtacagaacaactcctcaagcacccatttattagagaccaacctaacgaaagacaggtcaggatccaacttaaagaccacattgaccgcaccaggaagaagagaggggagaaggatgagacagagtacgagtattctggatcagaagaagaggaggaggaggttccagaacaggagggggagccctccagtatagtgaatgtgcctggggagagtacacttcgtcgcgacttccttcggctgcagcaggaaaacaaggagaggagcgaggccttacgacggcagcagctgctgcaggaacagcagttgcgcgagcaggaggagtacaaacggcagctgctggccgagagacagaagagaatagagcaacagaaggagcagagaagacgactcgaagaacaacagaggagggagagagaggcacgccgacaacaggaacgggagcagcgtaggcgggagcaggaagagaaaagaagactggaggaactggaacgcagacgaaaggaagaggaggagaggcggagagccgaggaagagaaaaggagagtagaacgggaacaggagtacatccggcgccaattggaggaagaacaacgtcatctggaggttttgcagcagcagttgctacaggaacaggctatgctgctacatgatcacagacggcctcatccgcagcattcacagcagccacccccacctcaacaagagagaagcaaaccatcttttcacgcccctgaacctaaggctcactatgaacctgctgatcgcgctcgggaagttgaagatcggtttaggaaaaccaaccatagttcgccagaggctcagtcaaagcagactggcagggtgctcgagcccccagtgccctcccgatctgagagtttctctaacggcaacagcgagtcggtgcaccctgcactgcagcggccggctgaaccacaggttcccgtccgtacaactagcaggtcccccgtccttagcagacgggattctcctttacagggctcaggacagcagaattctcaggcaggccagcgcaatagcacctccatcgaaccccggctactgtgggagcgagttgaaaaactggtgcccagaccaggaagcggctcatctagcgggtcctccaattctggatctcagcccgggtcgcatcctgggtctcagtcgggctccggcgagcgatttcgagtaagatccagcagtaaatcagaagggagccccagtcagaggctggagaatgcagtcaaaaaacctgaagacaagaaagaggtattcaggccgttgaagcctgcagacctgacagcactggcaaaggaactccgggcagtggaagacgtgcggcctccacacaaagtaacagattactcctcatcgtcagaggaatccggcactactgatgaggaagacgacgacgtcgaacaggagggagctgatgagagtacaagtggccctgaggatactagagcggcatcttctctcaacttgtccaacggcgaaactgagagcgtgaagacgatgatcgttcacgacgacgttgagagtgagccagccatgacaccaagcaaagaaggtacgcttattgtgaggcagtctacggtcgaccagaaacgggcgtcccaccacgagagtaacggattcgccggcaggatccatctgctgccagatctgctccagcagtcgcactctagcagtacatcatcaaccagtagtagtcctagctcttcccagccaactccaaccatgagcccacagacaccacaggataagcttacagcaaatgagacccaaagcgcctccagcaccttacagaagcataagtcctcgtcttcctttactcctttcattgacccacgcttgctgcagatctcaccaagcagtggaacgaccgtcacaagcgtggtcggtttttcctgcgacggcatgcggcctgaggcaatacggcaggacccaacccggaaagggagtgttgtgaacgtgaatccaacaaacaccagaccccagtccgatactccagaaatccgaaagtacaagaagcggtttaattcagagattctgtgcgccgccctgtggggcgtcaatttgctcgtgggaactgagagtggcctcatgctccttgataggagcgggcagggaaaggtgtaccccctcatcaatcgacgccggtttcaacaaatggacgtgctggaaggactgaatgtccttgttactatatcagggaagaaggataaattgagggtgtattacctatcctggttgagaaataagatccttcataatgaccctgaagtcgagaaaaaacagggatggacaactgtgggagaccttgaaggttgcgtccattataaagtggtgaagtacgaacgcatcaaattccttgtgattgcccttaaaagcagcgtggaggtttacgcatgggcaccaaagccctatcataaattcatggcattcaagtcttttggtgaattggtccacaaaccactgctggtggaccttacagtggaagagggacagagattgaaggtgatttatggcagctgcgctggttttcatgctgtggatgtagattctggttcggtgtacgatatttatttgcccacccacatacagtgctccattaaacctcatgctattataatactccctaataccgatggcatggaactactagtatgttatgaggacgagggcgtgtacgtgaacacttacggcaggattaccaaggatgtcgtactccaatggggggagatgccgacctctgtagcttacatcaggtccaatcagaccatgggctggggggaaaaggcaattgaaatccgcagtgtggagacaggtcacctcgatggagtgttcatgcataagagggcacagagacttaagttcctgtgtgagcggaacgataaagtttttttcgccagcgttcgtagtggagggtcttcccaggtttactttatgaccctgggacgaactagcctgttatcctggtag

SEQ ID NO: 25572 - DNA, 363 bp, Artificial Sequence
  Description of Artificial Sequence: Synthetic coding sequence
gccctgcagatcagcgagaacctgttcagcaacaaggtgctgaacgctctgaaacccgagaaggatgtggacggagtgaccgacatcaatctgggcaaactggtcaggggagatgcccacgaatgctttgtgtcacccgtggccaaagctgttattgaactcctggaaaagtccgtgggggtgaacttggacgggaaaaaaatcctggtggtcggcgcccacggctctctggaggctgccctgcagtgcctcttccagcgcaaaggctctatgacaatgtccatccaatggaagacccgacagcttcagagcaagacagaatccagatctgtgacacgtctcgaatgcagacgagtgatttag

SEQ ID NO: 25573 - DNA, 1866 bp, Artificial Sequence
  Description of Artificial Sequence: Synthetic coding sequence
atggtgagcatcctgagcagcttcgagagccggctgatgaagctggagaactcgatcattccggtccacaagcagaccgaaaacctgcaacggttgcaggagaatgtggaaaaaaccctatcatgcctcgatcatgtgatttcttattatcatgtggctagcgatacagaaaagattatccgagagggccccactggacgtctggaggagtatctgggtagcatggccaaaatccaaaaggccgtggagtatttccaagataatagccccgactcacctgagctgaacaaagtcaaactgctgttcgagagagggaaggaggccctggagagtgagtttcgaagtctaatgactcgccacagcaaggtcgtgtctcccgtgctgatcctggacctgatctccggcgacgatgacctggaggcccaggaggacgtgactcttgagcacctccctgaatctgtgttgcaagatgtgattcgtattagtagatggctggtggaatatggaagaaatcaagatttcatgaatgtgtactaccagatccgcagttctcagctcgatcggagcattaagggcctcaaagagcattttcacaaatcatccagctctagtggcgtgccatactccccagcaatcccgaacaagcgcaaggatacgccaacgaagaagccggtaaaacggcccggcacaatccggaaagcgcaaaatcttctgaaacagtattcacagcacggcctggatgggaaaaaaggcggttccaacctgataccgctggaaggacgcgatgatatgctagatgtggagaccgacgcctatatacactgcgtctctgcctttgtgaagctggcgcagagcgagtaccaattgctggcagatattatccctgaacatcaccagaaaaaaacatttgattctttaatccaagacgcactggacggtctgatgttggagggagagaatatcgtctctgccgcccggaaagctattgtgcggcacgacttcagcaccgtcctcaccgttttcccgatcctccgacacctcaagcagactaagccggaatttgatcaggtgttacagggaactgcagcatcaacaaaaaataagctgcccggcctgattacatcaatggagaccattggagcgaaggccctggaggacttcgccgataacataaagaacgatcctgataaggaatataatatgccaaaggacgggacagtgcacgagttgacgagtaatgctatactgtttttgcagcaacttttagacttccaggagaccgctggcgcaatgctggcatctcaaggcaaggtgctgggtaacctccaactcaatttgctgtccaaatcgaaggtctatgaagaccccgctctgagcgcaattttcctccacaataattacaattacattctgaaatcactggagaagtccgagctaatacagctcgtggccgtgacacagaagaccgccgagcggtcttatagggaacatattgaacagcagattcagacatatcagagaagctggttgaaagttactgactacatcgccgaaaaaaatctgcccgtttttcaacctggcgtgaaactgagagataaagaacgacaaataataaaggagcgctttaaaggctttaatgatggcctcgaagaactgtgtaagattcaaaaggcttgggcaatcccagacacagagcaacgggatagaattcgccaagcccagaaaacaattgttaaggaaacatacggagccttcctgcagaagttcggctctgtccccttcaccaagaatccagagaagtacatcaagtacggtgtggagcaggtgggcgatatgattgatcgactgtttgacacctcagcctag

SEQ ID NO: 25574 - DNA, 1344 bp, Artificial Sequence
  Description of Artificial Sequence: Synthetic coding sequence
atggacttcctgctgggcaaccccttcagcagccccgtgggccagcggatcgaaaaagccaccgacggctccttgcagtccgaggactgggcgttgaatatggaaatctgcgacatcatcaacgagacagaagagggccccaaagatgctctgcgagccgtgaaaaagaggattgtgggaaataaaaatttccatgaagtaatgcttgctctaacagtgctcgaaacttgtgtcaaaaactgtggacatcgcttccacgttctcgtggccagtcaggactttgtggagagtgtgctggtgaggaccattctgcctaagaacaaccccccaactattgtgcatgacaaggtgctgaatctgatccaaactgtgttcaattccgaaacccagtccggtcaggactcagttgggactgactcctctcagcaagaagactccgggcagcatgctgcccccctacctgccccacccattctgtctggcgatacacctattgcccctacacctgagcaaatcgggaaacttcgctccgagctcgagatggtctctgggaacgtgagggtgatgtccgagatgctcaccgagctggtgcccacccaggctgagccagccgacttggagctactgcaagagcttaatcggacgtgtcgcgccatgcagcagcgtgttcttgaactgattccacaaatagctaacgagcagttaaccgaagagctccttattgtgaatgataacttaaacaatgtatttctcaggcacgagcggttcgagaggtttcgcactggccagacgaccaaagcgcccagcgaagccgaacccgccgcagacctgattgatatgggccctgacccagccgctaccggcaatctgagctcccagctcgctggcatgaacttaggcagctccagcgtgcgagccggcctgcaatcgctcgaggcctcaggccgcctggaggacgaattcgatatgttcgcgctgacccgtggatcgtctttggccgatcagagaaaggaggtgaagtatgaggcccctcaggctacggacggcttggctggtgctctggacgccagacagcagtccaccggcgccattcccgtcactcaagcctgccttatggaggacatagagcagtggctgagtacagatgtgggcaatgatgccgaagagccaaagggcgttacgagcgaggaattcgacaagttcctggaggagagggcaaaggcagctgaccgattgccaaacctcagctctccatcagccgaagggccccccggacccccatcagggcctgcacccagaaaaaagacacaagagaaggacgacgatatgctctttgccttatag

SEQ ID NO: 25575 - DNA, 2103 bp, Artificial Sequence
  Description of Artificial Sequence: Synthetic coding sequence
atggccaccatgatcccccccgtgaagctgaagtggctggagcacctgaacagtagctggatcaccgaggattcggagtctatcgctacaagagaaggggtcgcagtgctctactctaagttagtatcaaacaaagaggttgtgcccctgccccagcaggtgctgtgcctgaagggacctcagttgcccgactttgaaagagaaagcctgtcaagtgacgagcaggaccactatctcgacgcactgttgtctagccagttggccttggccaaaatggtctgctccgatagtccttttgcaggagcgctgaggaaacgactgctcgtgttgcagcgcgtgttctacgccctgagcaacaagtatcacgataagggtaaggtgaaacagcagcagcattcacccgagtcctcctccggttccgcagatgtgcacagcgtgtcggagcggccacggtcatctaccgatgcgctgatagaaatgggcgtgaggaccggtctgtctttactttttgcccttttacggcagtcttggatgatgcctgtatcaggtcccgggttgtcactctgcaatgatgtaattcatactgcgattgaagtggtcagcagtcttccgcctctgtccctagccaacgagtccaaaatcccgccgatggggctggactgccttagtcaagtaaccacttttctgaagggtgtcaccatcccaaacagtggcgcagataccctggggcgcagactggcaagcgagttgctacttgggctggccgcacagcggggatctctccgctacttgctcgagtggatcgaaatggcgctcggggcctctgctgtggtccacaccatggagaaaggcaaattactttcatctcaggaaggcatgattagtttcgactgcttcatgactatcctcatgcaaatgcggagaagtctcattagcgagaaccaggactccgcggatgttgacccccaggaacactcattcacaaggactattgatgaagaagccgagatggaggagcaggcggagagagaccgcgaagaaggccacccagaaccagaggacgaggaagaagaacgggaacatgaagttatgaccgctgggaagattttccagtgtttcctctccgccagagaagtcgcaaggagccgagatagagaccgcatgaactccggagctggcagcggagccagagcggacgatccacccccccagagccagcaagagcgaagggtgtctacagatcttccagagggccaggatgtgtataccgccgcctgtaatagtgtgatacatcgatgcgctctcttaatactcggagtgtcgccagttatcgacgagctgcaaaaacgtcgcgaagaggggcagctccagcagccgtctacgtccgcttcagagggcggaggcctgatgacccggtccgaaagcctgacagcagagagtcggttggtacatactagtcctaattacagactgatcaaatcaaggtccgaatctgacttgagtcagcccgaatccgatgaagaggggtatgccctgagcggaaggcggaatgtggatctcgacctggccgcctcacacaggaagcggggccccatgcacagtcaactagaaagtttatcagacagttgggcgcgccttaagcatagcagggactggctttgtaattcatcatatagcttcgagtccgacttcgatctaacgaagtctttaggcgtccatactcttattgaaaacgtcgtctctttcgtgtctggtgatgtgggtaacgcacctggctttaaggaaccagaggagtcaatgagtacatccccccaggccagcatcatcgctatggaacagcagcagctccgggccgagctcaggctcgaggccctgcaccagatcctggtgctgttaagcgggatggaagaaaaagggtcaatcagtctggccggatccagattatcctcaggcttccagtcctctacacttctgaccagtgtcagactgcagttccttgctgggtgcttcggcctgggcacagttggtcatacaggggggaaaggagagtccgggcggctacaccattatcaagacggcattcgcgccgctagggggtactag

SEQ ID NO: 25576 - DNA, 537 bp, Artificial Sequence
  Description of Artificial Sequence: Synthetic coding sequence
atggccgaccgggccgccgccgagcgggcctgcaaggaccccaacccaatcatcgatggacgcaaagccaatgtcaatctggcatacttaggagcgaagccgagaatcatgcagccagggttcgcctttggggttcagcagctccaccctgccctgatccaacgcccattcggtatcccggctcactatgtctaccctcaggcttttgttcagcccggtgttgtgattcctcacgtgcagccaaccgctgccgccgccagcacaaccccctacatagattatacaggtgccgcctatgctcagtattcagctgctgcagccgctgcagctgctgccgccgcctacgaccagtatccatatgcagcatcgccggcagctgccgggtacgtaaccgcagggggctacgggtatgccgtccagcagccaattacagccgccgcaccggggacggccgctgccgcagctgctgccgcagcagccgccgccgcattcgggcaatatcagcctcagcaactgcagactgaccgcatgcagtag

SEQ ID NO: 25577 - DNA, 579 bp, Artificial Sequence
  Description of Artificial Sequence: Synthetic coding sequence
atgggcaagggctgcaaggtggtggtgtgcggcctgctgagcgtgggcaagacagccattttagagcagctgctttatggtaatcatacgatcggcatggaagattgtgagacaatggaagacgtgtatatggccagtgtcgagacagatcgcggcgttaaggagcagctccatttgtatgatacaagagggctgcaggagggcgtggagctacctaaacattattttagcttcgcagatggattcgttctcgtgtactctgtgaataatctggagagctttcagcgggtcgagctgctaaagaaagagatcgataagtttaaagacaagaaagaagtagccattgtggtgctgggtaataagattgatcttagcgaacaaagacaggttgatgcagaggtagctcaacagtgggccaaatcggaaaaggtaagactttgggaggtgacagttacagacaggaagacactgattgaaccctttacactcctagcctctaaactgtctcaaccacagtcaaaatctagttttccactgcctgggagaaagaacaagggaaattccaactctgagaactag

SEQ ID NO: 25578 - DNA, 555 bp, Artificial Sequence
  Description of Artificial Sequence: Synthetic coding sequence
atgaaccggagccagcccggcctgctgcggaccgaccccgtgcccgaggagggcgaggatgtagccgcaacaattagtgccaccgaaacgctgtctgaggaggaacaggaagagctgcgtagggaactggccaaagtggaagaggaaatccagactcttagccaggtgctagcagccaaggaaaagcatctggccgaaattaagcgtaagctggggataaactccctgcaggagctgaagcagaacatcgctaagggatggcaggacgtcacagcaacaagcgcctataaaaagacatcagagacattatctcaggctggccagaaagcatcagccgcttttagctctgtggggtccgtgatcactaagaagctggaagatgtgaagaacagccccacttttaaaagttttgaagaaaaggttgagaacctcaagtctaaagtgggtggcactaaaccagccgggggagatttcggcgaagtattgaattccgccgcaaatgccagcgctactacaacagaacccctgcctgagaagacacaagagtcactatag

SEQ ID NO: 25579 - DNA, 1620 bp, Artificial Sequence
  Description of Artificial Sequence: Synthetic coding sequence
atggccaccagcgcccccctgcggagcctggaggaggaggtgacctgttctatctgcctagactacttgagggaccctgttactatcgattgcgggcatgtgttttgccggagttgcaccacagacgtgcggcctataagcgggtctcgaccagtttgccccctgtgcaagaaaccatttaagaaggagaacatacgccccgtgtggcagctggcctctctcgtagagaacatcgaacgtttaaaagtggacaaaggccggcagcccggcgaggttacgcgtgaacaacaggatgccaagctgtgcgagagacatagggaaaaattgcactactactgtgaggacgatgggaaacttctgtgtgtgatgtgccgggagtcccgcgagcatcgcccgcataccgcagtcctcatggagaaagcagcccagcctcaccgcgagaaaatcctaaaccacctgtctacactccggcgtgatcgggacaagatacagggtttccaggcaaaaggggaggctgacattctggccgccttaaagaagttgcaagaccagaggcaatacatcgtggccgagtttgaacaggggcatcagtttctgagagaacgtgaagaacatctgctcgagcaactagctaagttggaacaggaattgactgagggcagggagaaatttaaatccagaggcgtgggagagctggcgagacttgctctggtgatcagcgaactagaaggaaaagcacagcagccagctgccgagcttatgcaggatacccgagactttcttaaccgatatcctcggaagaaattctgggtgggcaaacctattgccagagtggtcaagaagaaaacaggggagtttagtgacaagcttctcagcctgcagcgcgggctgagggaatttcagggaaagctgctacgagatttagaatataagaccgtcagcgttacactggacccacaatctgcctccggctatctgcagctcagtgaggactggaaatgtgtaacgtacaccagtctgtataagtctgcatatctgcacccccaacagtttgactgcgagcccggtgtccttgggtcgaaggggtttacctggggtaaagtttattgggaggtcgaggtcgaaagggagggatggagcgaagatgaagaagagggtgacgaagaggaggagggtgaggaagaggaagaggaagaggaagcgggctacggcgatggttacgatgactgggagacggatgaagacgaagaatctttgggagacgaagaggaagaagaagaggaggaggaggaggaagtgctggagtcctgtatggtcggcgtcgcacgagacagcgttaagagaaagggcgacctgagtctgagacccgaggacggcgtgtgggccctgcgccttagctctagcgggatctgggctaatacctcgcccgaggcggagctgttccctgctttgcgaccacgccgagtggggatcgccttggactacgagggaggcaccgtgacctttacgaacgcggagtcccaggagctgatctatacgtttactgctacctttacacggcgactggtgccgttcctctggctcaagtggccaggcactcggctgcttcttagaccttag

SEQ ID NO: 25580 - DNA, 612 bp, Artificial Sequence
  Description of Artificial Sequence: Synthetic coding sequence
atggagccccccatggagcccagcggcggcgagcaggagcccggcgctgtgcgatttcttgatttgccttgggaggacgtactgttgcctcacgtattgaacagagtgcctttacggcaattgctgagactgcagcgagttagccgtgcctttagatcactagtgcagctgcaccttgctggcttacgccgcttcgatgcagcacaggtgggcccccagattccaagggccgcacttgcccggctgctgagagatgctgaggggcttcaggagctcgccttggctccctgtcatgaatggctatcagatgaggacttggtgccagtgttagccaggaatcctcaattaaggtcagttgctctcggtgggtgcggacagttgagcagaagggcattgggggccctcgctgaggggtgtcctagactccagagactgagtctcgcacactgtgattgggtcgacggcttggccttaagaggtctggctgacaggtgtccggctctggaggagctcgacctgactgcatgtaggcagctgaaagatgaagcgattgtgtaccttgcccaacggcgcggcgctggactcagaagtttaagcctggctgttaactag

SEQ ID NO: 25581 - DNA, 1824 bp, Artificial Sequence
  Description of Artificial Sequence: Synthetic coding sequence
atggcccggggcctgggcaaggccagcggcttccccgccggcccctccggcgccgaactccctgccagtggacgcagaagaggtccacttatctccctctttccagccgtcctggcctccgaggccgccatgtcttaccctgccgacgattatgagtcagaagccgcatacgacccctatgcttaccctagcgactatgacatgcatactggcgaccccaaacaggacctcgcttacgagaggcaatacgaacagcaaacttaccaggtgatcccagaagtcattaaaaattttatccagtacttccataaaacggtttctgatctaattgatcagaaggtgtacgagctgcaggcaagcagagttagttcagacgttatcgaccagaaggtgtacgaaatccaggatatctacgagaatagttggacaaagctgaccgaaaggttctttaagaacaccccgtggcccgaggccgaagccatagccccacaggtgggtaatgacgcagtttttctgatcttatataaggaactctattacagacacatctatgccaaagtgtcagggggccccagtttggaacaacgcttcgaaagctattacaattactgtaacctgtttaactacatactaaatgccgacggacctgcacccctggagctgccaaaccagtggctgtgggacatcatcgatgagttcatctatcagtttcagtcgttctcccaatatagatgcaaaacggccaaaaagagcgaagaggagatcgactttctcagatctaaccccaaaatctggaacgtgcactcagtactcaatgtgttacacagtctggtcgataagtctaacattaaccgacaactggaagtgtatacaagcggcggcgatccggagagcgtggctggggagtatggacgacacagcctgtacaaaatgctgggatacttctctctggtcgggttgctccgactgcacagcttactaggtgattattaccaggccataaaagtgctggagaacatagagctaaacaagaaatctatgtattcccgcgtgccagaatgccaggtaacaacttattattatgtcggctttgcgtatctgatgatgcgtagatatcaggacgccattagagtttttgcgaatatcctgttatatatccaaagaaccaagtctatgttccagagaacaacatacaagtacgaaatgattaacaaacagaacgagcaaatgcacgctctgctcgcaatcgctttgacgatgtaccctatgcggattgatgaaagcattcacctccagctgcgggagaaatatggggataaaatgctacgcatgcagaaaggcgatcctcaagtgtatgaagagctctttagctatagttgtcccaaatttctctcacccgttgttcccaactacgacaacgtccaccccaattatcataaagaaccattcctgcagcagctgaaggtattttctgacgaggtccagcaacaggcgcagttgagcacaattcggagctttctgaaactttacacaactatgcctgtggccaaacttgccgggttcctggatctgacggaacaggaattcagaattcagctcctggtgtttaaacacaagatgaaaaatctggtctggacctcaggcatctccgcgttggatggcgaatttcagtccgcaagcgaggtggacttttatatcgacaaagatatgatccatattgccgatactaaggtggcacgccgctatggggacttttttatccgccagattcacaagtttgaagaacttaatcggactctgaaaaagatgggccagcggccttag

SEQ ID NO: 25582 - DNA, 1308 bp, Artificial Sequence
  Description of Artificial Sequence: Synthetic coding sequence
atggccgccagcagcctggagcagaagctgagccggctggaggccaaactcaaacaggagaatagggaggctaggcgtaggatcgacttaaatctggatatttccccccagcgccctagacctattatcgtaatcacactgagccccgcccctgccccctcccagagggctgctctgcagctgcccctcgctaacgacgggggaagtcgaagcccctctagcgagagcagtccacagcatcctactcccccagcccggcctaggcacatgttagggcttccatcaactctgttcactcccagatcaatggaatccattgagatcgatcagaagcttcaagagataatgaagcagaccggctacctgaccattggaggacagaggtaccaggcagaaattaacgatctggagaacctgggcgaaatgggctccggtacctgcggacaggtgtggaaaatgagatttcgaaaaaccggtcacgtcattgccgtgaaacagatgcggcgctccggtaacaaggaagaaaataaacgaatcctgatggacctggatgttgtccttaaaagtcatgactgtccatacatcgtgcagtgtttcggaacctttataactaataccgatgtgtttattgccatggagcttatggggacgtgtgctgagaagctgaaaaagcgtatgcaagggcccattccagagcgtatattagggaagatgacagtggccatcgtcaaggctctctattacttgaaggaaaagcacggggtcattcatagggacgtcaagcccagcaatatcttgctcgatgaacgtggacagatcaaactttgcgattttggaatcagtggccggttggtagattccaaggccaaaactcgcagcgcaggttgcgccgcttacatggcgccggaaagaattgaccccccagatcccactaagccggactacgatatccgggccgacgtctggagcctcggtattagcctcgttgagctggccaccgggcagttcccctataaaaattgtaagaccgacttcgaagtgctcacaaaggttctgcaggaagagcctcccctgctgcccggccacatgggctttagtggcgattttcagagcttcgtcaaggattgcctcacgaaagaccaccgtaagagacccaagtataataagctcctcgaacactcatttattaaacggtatgaaactctggaggtcgatgtcgcatcctggttcaaggacgttatggctaagacagagtccccccgaacatccggcgtcctatcccaaccacatctgcctttctttagatag

SEQ ID NO: 25583 - DNA, 3006 bp, Artificial Sequence
  Description of Artificial Sequence: Synthetic coding sequence
atggccagcagccccctgcccggccccaacgacatcctgctggccagtccctctagcgccttccagcccgacacgctgtctcagccccgtcccggtcacgctaacctgaaacccaatcaggtggggcaagttattctttacgggattcctattgtgtctctggtaattgatgggcaggaaagactgtgcctggcccagatttctaatacgctattgaagaacttcagctacaatgagatccacaatagacgagttgcactaggcattacatgtgtgcaatgcaccccggtgcagctggaaattctgcgacgagccggggccatgcctattagctcccgtcgctgtggcatgatcacaaaaagggaagcagaacgactgtgcaaatcttttttaggcgaaaatcgccctccaaaactgcccgataacttcgcattcgatgtctctcatgaatgtgcgtggggttgtcgggggtcttttatccccgcccggtataatagctctcgcgccaagtgtataaagtgcagctactgcaacatgtatttctctccaaataagttcatctttcacagccacaggactcctgatgcgaagtacactcagccagacgctgccaactttaactcttggcggaggcatctgaaactgaccgataagtccccacaggatgaacttgtctttgcttgggaggacgttaaggctatgttcaacggaggatccagaaagcgcgcccttcctcagcccggcgcccatcccgcttgtcatcccttgagtagcgttaaagctgccgcggtggctgctgcggcagccgttgccgggggagggggcctcttagggccacatctgcttggcgcccctcctccaccccctccgccacctcctcccctcgccgagctggctggtgcacctcacgcccatcataagcggccacgctttgacgacgacgatgattcactccaggaggcagccgtcgtagctgcagccagtttgtcagctgctgccgctagtctcagtgttgcagccgcgtctggcggtgcaggtaccggcgggggcggggccggtggtgggtgtgtggccggagtcggcgttggagcaggcgctggagccggcgccggggcaggagcgaaggggcctaggagctatccagtgattcccgtgccaagcaaagggagcttcgggggcgtcctacagaaattccctggctgcggaggtctattccctcatccatatacattccccgccgcagcagcagcctttagtctgtgtcataagaaggaagatgcaggggccgcagcggaggctttgggaggcgctggtgccgggggtgcaggagctgcgcctaaagctggactgtccggcctgttctggccggccggccgcaaggacgctttctaccctccgttttgtatgttttggccccctcgcactccaggcggcctaccggtcccaacctatctccaaccaccaccacaaccaccatctgcactgggatgcgcacttggggaatcccccgcccttctacgacaagccttcttggacctggctgaaccaggaggcgccgccggcagtgctgaagcagccccacctcctggacagcctccacaagtggtggctaatggtcctggctccggaccaccccctccggcaggtggggctggttctagagatgctttgttcgagtctcctccaggcgggtccgggggagattgcagcgccgggtccacgcctcctgctgattctgtggcggccgctggcgctggcgcagccgctgcgggtagtggcccggcggggtcacgcgtgcctgcaccccatcacccacaccttttagaagggcgtaaggccggcggcggaagctatcatcattctagcgcatttaggcccgtgggcgggaaagatgacgcagaaagtcttgccaaactccatggcgcgtcagctggagcaccccactcagctcagactcacccccaccatcatcaccatcctcaccaccatcatcaccaccatcacccaccacagcctccctctcccttgcttctgctgccacctcagcccgacgagcctggctcagagaggcatcaccctgctcctccacctccacccccaccaccaccgccccccccactggcccagcacccccaccacagggggctgctgagcccaggcgggacctcatgctgttaccctagcgaggattcctctgaagacgaagatgatgaagaggaggagcaggaggtcgatgtggaaggacacaagccccctgaaggagaggaggaggaggaagggagggaccccgacgatgacgaggaggaagacgaggagaccgaagtcctgcttggcgacccactggtaggaggaggaagatttctgcagggccgtggaccctctgaaaaagggtcttctcgggacagggctcctgccgttgccggtgcctttcccctcggcctgaatagtagccgcctgctgcaggaagacggcaagcttggggatcctgggtctgaccttccgcccccacctccacctcctttggcgccgcagaaagcaagcggtggaggctcgtcttccccgggaagccccgtgcatcatccttcgctagaagagcagccctcctacaaggacagccagaaaacaaaagagaataaccaggttatcgtgtctacaaaggacgataactcattctcagacaaaaacaaagagcattcattcttcattactgattctgacgcaagcggtggagacttttggcgcgaacggtctggcgaacacacacaggagactaacagtcctcactcacttaagaaggatgtggaaaatatgggcaaggaggaactccagaaggttctgtttgagcagattgatctgcgaagaaggttggaacaggaattccaggtgctgaagggaaacacatccttccccgtgtttaataacttccaggaccagatgaaacgtgagctcgcgtatcgcgaagagatggtgcagcagctgcaaatcgtgagttgcatcagtacttag

SEQ ID NO: 25584 - DNA, 198 bp, Artificial Sequence
  Description of Artificial Sequence: Synthetic coding sequence
atggccatggcccccagccccagcctggtgcaggtgtacaccagcccagctgcagtggccgtgtgggaatggcaggacggcttgggcacctggcacccctactctgctacggtctgcagcttcatagagcagcagttcgttcagcaaaagggccagagattcgggttgggatcccttgcacactcgattccactgtag

SEQ ID NO: 25585 - DNA, 1041 bp, Artificial Sequence
  Description of Artificial Sequence: Synthetic coding sequence
atgatcagccggcccgcctggctgtggggcgccgagatgggcgccaacgaacatggcgtgtgcatagccaacgaagcaatcaataccagggagcctgccgccgaaatcgaagcccttctgggcatggatctagtccgcttgggactagaacgtggagagacagcaaaagaagcccttgacgtcatcgtctccttactggaagagcacgggcagggtggcaattatttcgaagatgccaactcttgtcacagtttccagtctgcatatttaatcgtggatcgtgatgaagcgtgggttctggaaacaatcggcaagtactgggccgcagagaaagtaacagagggtgtgcgatgtatctgctcccagctgtctctcacaactaaaatggatgccgagcaccctgagctgcggtcttacgcccagtcgcaggggtggtggaccggcgaaggagaatttaacttctccgaagtatttagccctgtcgaggaccatctggattgtggtgccggcaaagattccctggaaaagcaggaagaaagcatcactgtgcagactatgatgaacacgcttcgggacaaagcttctggggtgtgcattgactcagagttttttcttactaccgctagtggcgtgagtgtgctgcctcagaacaggtcttcgccctgcatccattacttcacgggcacccctgacccttcaagatcgatctttaagccctttatctttgttgacgatgtgaaactggtacctaaaactcagtctccatgcttcggagatgacgatccggccaagaaggagccacggtttcaagaaaagcccgaccgaaggcatgaattatacaaagcccatgaatgggcacgggctatcattgaatccgaccaggaacagggacgtaaactgcggtcaaccatgcttgagctcgagaagcaagggctggaggccatggaagagatcctaactagttccgaaccactcgatcctgcagaggttggggacctcttttacgattgcgtagatactgagattaaattctttaagtag

SEQ ID NO: 25586 - DNA, 1620 bp, Artificial Sequence
  Description of Artificial Sequence: Synthetic coding sequence
atggccaccagcgcccccctgcggagcctggaggaggaggtgacctgctccatctgcttggactacctgcgggatccagtgactatcgattgtggtcacgtcttctgtcgcagttgtacaaccgacgttagacccatctccggctctcgcccggtttgtcccctctgcaagaaaccttttaaaaaggagaatatcaggcccgtctggcagttagcctccctagtcgaaaatatcgaaagactgaaggtcgataaaggtaggcaacctggagaagtaacacgcgaacaacaggatgctaagctttgtgagagacatagagagaaactgcactactactgcgaggacgatgggaaattactttgtgtcatgtgcagggagtccagagagcaccgtccacatactgccgtcctaatggaaaaggccgcacaaccccaccgggagaagatcctgaaccacttgtctactttgcgaagagaccgtgacaagatacagggttttcaagccaaaggtgaagcggatatcctcgcagccctaaaaaagcttcaggaccagcggcaatacatcgttgcagaatttgagcagggacatcaatttctccgcgagcgagaggagcacctcctggaacagttagcaaagcttgagcaagagttgaccgagggccgcgagaagtttaagtcaagaggggttggcgaactcgccagattggcattggtgatctcggagctcgaaggaaaggcacagcagcctgcagccgaactcatgcaggacacccgtgatttcctcaataggtatccaagaaaaaaattctgggtggggaagccaatcgccagagtagtgaagaaaaagaccggcgaattttcggataagttgctttcactccaaagaggactgagagaattccagggcaagctgctgcgggacctggagtataagaccgtgtcagtgacgctggaccctcagtcggctagtggctatctgcagctgagcgaagactggaagtgtgttacttacaccagcctctacaagtccgcctatctacatccacagcaatttgattgcgaacccggcgttctcggctccaagggatttacatggggcaaggtgtactgggaggtggaagtcgaacgagagggctggagtgaggacgaggaggaaggagacgaggaagaagaaggggaagaggaggaggaggaggaggaggcaggatatggtgatgggtacgacgattgggagactgacgaagatgaagagtctctgggagacgaggaagaagaggaagaggaagaagaggaagaggtgcttgaatcctgcatggttggtgttgctagagatagcgtgaagaggaagggagatctgagcctcagacccgaagacggcgtctgggccctgaggttgtcatcaagtggaatctgggcgaataccagccccgaagctgagttgttccctgccttgcggccaagaagggtgggcattgctttagactatgagggtggaaccgtgacgttcactaacgctgaatcacaggaactaatctacacctttacggccaccttcacacggcgcctggtgccttttctctggctcaagtggccgggcacacggttgctgctgcgcccgtag

SEQ ID NO: 25587 - DNA, 390 bp, Artificial Sequence
  Description of Artificial Sequence: Synthetic coding sequence
atggccgagctgatccagaagaagctgcagggcgaggtggagaagtatcagcagttacagaaggacttgagtaagtctatgagcggcaggcaaaaactggaggcccagctgactgagaataacatcgtcaaagaagaactggcgctcctcgatggtagcaacgtcgtgttcaaactgctcggccctgtgctcgtaaaacaggagctcggggaggcccgagcaactgttggcaaaagactcgattacattacggctgaaattaagaggtacgaatcacagctccgcgacttggagcgccaatcggagcagcagagagagacattggcacaactgcagcaggaatttcagcgagcccaggccgctaaggccggcgctccagggaaagcttag

SEQ ID NO: 25588 - DNA, 1740 bp, Artificial Sequence
  Description of Artificial Sequence: Synthetic coding sequence
atgagcgccgccaaccccgagacccccaacagcaccatcagccgggaagcttcaacgcaatccagctcagctgcagctagtcaagggtgggtcctgccagaaggcaaaattgtgccaaacactgtatttgtgggaggaattgatgctcgcatggatgaaacagagatcggttcgtgtttcggacgctatggcagtgtaaaagaggtgaagatcatcacaaatagaaccggcgtaagcaaaggttacgggtttgtgtctttcgtgaatgacgttgatgttcaaaagatagtcggcagccagattcattttcacggcaagaagttgaaactcggcccggctattcgcaagcagaagctgtgtgcgcgccacgtgcagccccgtcctctggttgtgaatcccccccctcccccccaatttcagaacgtctggaggaaccctaacacagagacataccttcaaccacagatcacccccaatcccgtgacacaacatgtacaaagtgccgccaatcccgaaacaccgaactctaccattagtagagaagcgtcgactcagagttcatccgccgcggcatcccaaggttgggtcttgcccgagggtaaaatcgttcccaatacagtgtttgtagggggaatcgacgcaagaatggatgaaacagagatcggatcttgtttcggccgttacgggtctgtcaaagaagtaaagatcattacgaataggacaggggtaagcaaggggtacggatttgtgtcttttgtgaatgatgttgatgtgcagaaaatcgttggctcgcagattcatttccacggcaaaaagctaaagttgggccccgcaatccgaaagcagaagttgtgtgcccggcatgtgcaacctagacccctcgtagtaaatcctcccccacctccacagtttcagaatgtgtggaggaatcccaacacagagacttacctgcaaccgcagattacgccgaatcccgtgacacaacacgtgcaggcatattctgcatacccccactctccaggccaggtcattaccgggtgccagcttcttgtgtacaattaccaggaatacccaacttacccagattcagcattccaggttacgaccggatatcagctgcccgtgtataattaccagcctttccccgcttaccctaggtccccctttcaagtgaccgccggatatcaattacccgtatacaattaccaggctttccccgcatatcctaactctccattccaggttgccaccgggtatcaattcccagtgtataactaccagcctttccccgcctacccttctagtccatttcaggtgacagctggctaccagcttccagtctataattatcaagctttccccgcgtatcccaactctcctttccaagttgccactggctaccagtttccagtgtataactatcaggcattccccgcttacccaaactctcctgtgcaggtaactacaggataccagctgccggtgtataactaccaggcctttcctgcttatccctccagcccctttcaggttaccacagggtatcaattgcccgtgtacaattaccaggccttcccagcttaccccaacagtgccgtgcaggtgacaacaggatatcagttccacgtgtacaactatcagatgccacctcagtgtcccgtgggggagcaacggagaaatctgtggactgaagcctataaatggtggtacctcgtgtgtcttatacagcgccgcgactag

SEQ ID NO: 25589 - DNA, 831 bp, Artificial Sequence
  Description of Artificial Sequence: Synthetic coding sequence
atgtacgccagctggaccaaggcctgccggggcctggaggagctgattaacctgacacgcttgaatgtcagctacaaccacattgatgacctcagcgggttaatcccattgcatggcattaaacacaagctgcggtacatagatctgcactccaataggattgatagcatccaccatttgcttcagtgcatggttggacttcacttcctcacgaacctgatcctcgaaaaggacggagatgacaatcctgtatgccgtctgccgggatatcgagctgtaattttacaaactttaccccaacttcggatccttgactgcaaaaacatctttggtgaacccgtgaacctcaccgagataaacagttcacaactccagtgtttagaaggcctactagataatctagtgtctagtgattccccgttaaatattagtgaagacgagatcattgaccgtatgccagtgatcactgcgcctatcgacgagcttgttccactcgagcagttcgcctcaacaccaagtgatgcggtcttgacaagcttcatgagtgtatgccagtcttctgagccagaaaaaaacaaccacgagaatgaccttcagaacgagatcaaactacagaagctggatgaccagatcctccagctcctgaatgagaccagcaacagcatagataacgtgctagaaaaggaccctcgacccaaaagagatacagacatcacttctgagtcagactatggtaactctcgcaaaaatggcgaaacgaaaaaggcagccgcggggtctacagataagaccgatccacgtggtggcactcagtctttctcttgcaggtag

SEQ ID NO: 25590 - DNA, 1995 bp, Artificial Sequence
  Description of Artificial Sequence: Synthetic coding sequence
atgggcgacgacggcagcccccccgccaagaagatgatcaccgacatacatgccaatggcaaaaccataaacaaggtcccaactgtgaaaaaagaacacctggacgactacggcgaggcccctgtcgagacagatggtgagcacgttaagaggacttgtacttccgtaccggaaacactacatcttaatccatcactgaaacatacactggctcaatttcatcttagttcacaatcaagtctgggcggtccggcggcctttagtgccaggcacagccaggagtccatgagcccaaccgtcttccttccccttccatcccctcaggtgctgcctggccccctactcatcccctctgattctagtaccgaactaacacagactgtgttagaaggggaaagcatttcatgcttccaggtggggggcgagaaaaggctgtgtctgccccaagtcctgaatagcgtgctgcgagagtttactctacagcagatcaacactgtttgcgacgagttgtacatatattgctcaagatgtactagcgaccagctgcatattctgaaggtgctgggaatcttaccatttaatgctccatcttgtgggttgattaccctcacagatgctcagcgactatgcaatgctctgcttagaccacgcacattcccacaaaacggaagcgtgctgcctgccaagtcctctttggcacagttgaaagagaccggctcagcatttgaggtggaacacgaatgtctcggtaagtgtcaaggtttatttgccccccaattttacgttcagccagatgccccctgtatccagtgcttggaatgctgtggcatgttcgcaccccaaaccttcgtgatgcatagccaccgttcacccgacaagaggacttgccattggggatttgagtccgctaagtggcattgctatcttcatgttaatcaaaagtacctaggaaccccagaggagaaaaagctcaagatcatactggaagaaatgaaggaaaaattctctatgagatcgggtaaacgtaaccagagcaagacagatgcgccttccggaatggagttgcagagctggtaccctgtcataaaacaggaaggcgaccatgtgtcccagacacactcattcctccatcccagctattatctgtatatgtgtgacaaggtggtggcgcccaacgttagtttgacatccgctgtgagccagtcaaaagagcttacgaagacggaggccagcaagtccatctcgcgccaatcggagaaggctcactcctctggcaaacttcagaaaacagtgtcctacccagatgtcagcttggaagagcaggaaaagatggatttgaagacatcaagggagctttgcagcagactagatgctagcatttctaataacagcactagtaagcgcaaaagcgagagtgcaacatgtaatttggtccgagacatcaacaaagtcggaattgggctggtggccgcagcctcttctccactcttggttaaagacgttatatgcgaagatgataaaggtaaaattatggaagaggtgatgaggacatatctcaaacagcaggagaaactcaatctcatcctacagaaaaagcaacaattgcagatggaagttaagatgctgtcttcttcaaaatcaatgaaggagcttacagaggagcaacagaacctacagaaggagctcgagagtctccagaatgaacacgcccagaggatggaggaattctatgtagagcagaaggatcttgagaaaaagctcgagcagatcatgaagcagaagtgcacctgtgattcaaacctggagaaagacaaagaagcagagtatgccggccaactggcagaactcagacaacggttagatcacgccgaagctgaccgtcaggaactgcaagatgagctgaggcaggagagggaagcccgacaaaaactggaaatgatgatcaaggagctaaagctccagatcctcaagtctagtaagactgcgaaagaatag

SEQ ID NO: 25591 - DNA, 1068 bp, Artificial Sequence
  Description of Artificial Sequence: Synthetic coding sequence
atgggccggcgggacctggtgagcggcggcagcaacgagggcaacggtaaggaagactgggccatgaaaaccgtcagtctcaggtggactaagctgccccccgtgaagagcgctatcagaggacaagccccagtcgtgccttacatgaggtacgggcactccacagtccttatcgatgatacagtcctactgtggggcggcagaaacgatacggagggtgcctgtaacgttctttacgccttcgatgtgaacacccacaagtggttcacccccagggtgagcgggactgtgcccggcgcaagagatgggcactctgcctgtgtactcggaaagattatgtacatcttcggtggctacgaacagcaagccgactgtttttctaatgacattcacaagcttgacacttctactatgacatggactttgatctgtaccaagggctctcccgctcgctggagggatttccatagcgccaccatgctgggatcccacatgtatgtctttgggggccgcgccgacagatttggacctttccactctaataatgaaatctactgtaatcggattagagtgttcgacacacgcaccgaggcgtggcttgactgcccaccaacccctgtgctccccgaaggacggagatcccactctgcctttggctataatggcgagctctatattttcggtggctacaacgcccgcctgaatagacatttccacgacctttggaaatttaatcctgtgagttttacatggaaaaagatcgagccaaaaggcaaaggcccatgtccgagacggagacagtgttgctgtatcgttggcgataaaatagtcttgtttggcggtacctctccgagccccgaagaggggcttggcgatgaatttgatctcatcgatcatagcgacttgcatatactggacttttctccatccctgaaaaccctctgtaaactagccgtaatccagtataatctggatcagtcttgtctgcctcatgacattcgatgggagctcaacgcaatgacaacgaactctaatataagccggcctatagtgagctctcacggttag

SEQ ID NO: 25592 - DNA, 1245 bp, Artificial Sequence
  Description of Artificial Sequence: Synthetic coding sequence
atggccgccgccccccccagctactgcttcgtggccttcccccccagagccaaggacgggctggtggtcttcgggaagaattccgcccggccccgcgacgaggtccaggaagtagtttacttttcagccgctgatcatgagcccgagtcgaaagtcgaatgtacctatatcagtatcgatcaagtgccccggacctacgccatcatgatatcacggcccgcctggctgtggggtgctgaaatgggagcaaatgagcacggggtgtgcatcgcaaatgaggctattaacactagagagccggctgcagagattgaggctctgctcggcatggacctggtgaggctcgggcttgagcggggtgagactgccaaagaggctcttgacgttattgtgtcacttttagaagagcacggtcaggggggcaactattttgaggacgctaattcctgccatagtttccagtcagcatacctgatcgtggaccgggatgaagcttgggttctggagaccataggtaagtactgggcggcagagaaggttactgagggagtcaggtgcatatgcagtcagttgagcctgactaccaaaatggacgccgaacaccctgagcttagatcctacgcccaaagtcagggatggtggacgggtgagggagagttcaacttctcagaggtgttctcccctgtcgaggaccacctcgactgtggagctggtaaagatagcctcgaaaagcaagaagaatccatcactgtacaaacaatgatgaacacccttcgggataaagctagcggggtatgcatagactccgaattctttctaacaactgcttcaggcgtgagtgttctgccccagaataggagtagtccttgcatccactatttcacaggaactcccgatcctagtcgatctatcttcaagcctttcattttcgtggacgatgttaaactcgtccccaaaacgcaaagcccctgctttggagacgacgaccctgctaagaaggagcctaggttccaggagaagccagatagacgacatgaactttataaggctcatgaatgggcgcgggccatcattgaatccgaccaggagcaaggacgtaaactgagatctactatgcttgaactagagaaacaaggcctcgaggccatggaggaaattctgacttcaagtgaacctctcgatcccgcggaggttggggacctgttctacgactgtgtcgacacagaaattaaattcttcaaatag

SEQ ID NO: 25593 - DNA, 1200 bp, Artificial Sequence
  Description of Artificial Sequence: Synthetic coding sequence
atggccaccggcgacctgaagcggagcctgcggaacctggagcaggttttgcggttacttaattatccagaggaggtcgattgcgtaggtttgatcaaaggcgatcctgccgcctccctgccgatcattagctattcttttacttcatactctccatatgtgaccgagctgattatggagtccaatgtggaacttatcgcgaagaacgacctgcgctttatcgacgccgtgtacaagctgctgcgtgatcagtttaattacaagccaatcttaacgaagaagcaatttattcagtgcggatttgctgagtggaagattcagattgtatgtgatatactcaactgcgtgatgaaaaagcacaaggagttaagttccctacagaagattccttcccagcaaagaaaaaaaatatcctccggaaagtcagagcccccactgggcaacgagaaaatctcggcagaggcagtgggtgttgacattagcggcaggttcatgacctccggtaagaaaaaggcagtggtgataaggcacctctacaatgaagacaatgtggacatctccgaagacacgctgagtcctattacagacgtgaacgaagctgtggacgttagcgatcttaatgccacagaaatcaaaatgcccgaggttaaggtgcccgagataaaggcggagcagcaagacgtcaacgtcaatccagagataactgctctgcaaaccatgttagctgagtgccaggaaaacttaaaaaaactcacatccattgagaagcgcctcgattgtctcgagcagaaaatgaagggcaaagtcatggttgatgagaacacctggacgaacctgctgtccagggtgacactgctggaaacagagatgctcctgtccaaaaaaaacgatgaatttatcgagttcaacgaggtaagtgaggactacgcgtcctgctccgatatggatctgctgaacccgcacagaaagagcgaagtggaacgccctgcctctattcctttgtcaagtggatattccactgcgagcagcgactctacgccgcgtgctagtacagttaactactgtgggctaaatgagatctcagagaatttccctgcatggagcgccaccagctcatgctccagcctgtcatggttgctcagaggtcatacttcatacctcagctcgcaaagttttgcatggccattgtcatgcgtgtag

SEQ ID NO: 25594 - DNA, 1317 bp, Artificial Sequence
  Description of Artificial Sequence: Synthetic coding sequence
tgatgcgccggcgccgagcggccccggcggcggggccggctgtgggattccagtggcgtgcctcagcgtcagaaaaggcctggaccctggaggactcagacgcaagagcaaatgtcaagagacgtatgcattcatacctggccctgcacatactaccttgagcctaaacgccgctgggtgacaggacaactcagtctcacctccctatcactcaggtttatgacagatagtacaggcgagatcctggtctcctttcccctgagcagcattgttgaaataaaaaaggaagcaagccactttattttttcatccattactattttggagaagggacacgccaaacattggttctcatcgttacgaccatcaagaaacgtcgtattttcaattatcgagcacttctggcgggaactcctcctgtcacagccaggcgctgtggccgacgcatcggtgcctagaacgcgtggtgaggagctcaccgggctgatggcgggatctcagaagcggttggaggataccgccagggtcctgcaccaccagggacaacaattggatagcgtgatgcggggcctggacaagatggagagcgacctggaggtggccgacagactcctgacggagctggagagcccggcatggtggccattcagctcgaaactctggaagacaccaccggagacaaagcctagagaagatgtgtccatgaccagctgcgagccttttggaaaagagggtatccttatcaagatccctgcggtaattagtcaccgtacagaatcgcacgtgaagcctggcaggctgactgtcctggtctctgggctggagatacacgacagctcttcgcttttaatgcacagatttgaaagagaggatgtggacgacattaaagtgcactccccgtacgagatcagtattcggcagaggttcatcggcaaacccgacatggcctataggctgattagcgcaaaaatgccggaggtaattccaattctagaagtacagttttctaaaaagatggaactgttggaggatgcgttggttctaagaagtgcgcgaaccagcagtcctgctgagaagagttgctcagtttggcatgctgcgtccggactgatgggaagaaccctgcacagagaaccacccgctggggaccaagagggcaccgcactgcatctgcagacatctctacccgccctgagcgaagcggacacgcaggaattaacacagggcttccgacctatgtcactcagcacacagacagtccttgtaatgctgtgcagcgagtcggccggtgccctctggcggcagcggttgtcctag

SEQ ID NO: 25595 - DNA, 711 bp, Artificial Sequence
  Description of Artificial Sequence: Synthetic coding sequence
atgaccggctacgaggcccggctgatcaccttcggcacctggatgtacagtgtaaataaggaacagctggcacgcgcaggattttatgccattggccaagaagataaggtgcagtgctttcattgtggtggggggttggcgaactggaagcctaaggaagacccatgggagcagcacgcgaagtggtaccccggttgtaagtaccttcttgaagagaaagggcacgagtatattaacaatattcacttgactagaagtctggaaggagctctcgtacagacaacgaaaaaaaccccctctctgaccaaaaggatcagtgacaccatcttccccaatcctatgctgcaggaggctatccgcatgggattcgacttcaaagacgtgaagaagataatggaggagcgtattcagacatctggctccaattataagacgctggaagttttggtggcagatctagtttcggcgcaaaaggataccacagagaacgagctgaatcagacaagtcttcagagagagatatcacctgaagaacctctacgtcggttacaggaagaaaaactgtgtaagatatgcatggaccgtcacatcgccgtggtatttattccttgtgggcacttagtcacctgcaagcagtgcgccgaggcggtggaccgatgcccaatgtgttctgccgtcattgatttcaagcagagggtgttcatgagctag

SEQ ID NO: 25596 - DNA, 285 bp, Artificial Sequence
  Description of Artificial Sequence: Synthetic coding sequence
atgaaccccaccaaccccttcagcggccagcagcccagcgccttctcggctagctctagcaatgtcggtaccctgccatctaagccacccttcagatttggacagccgtccttattcggtcagaattccaccctgtcagggaaatcctctggcttctctcaggtgagcagcttccctgctagcagcggcgtttcgcatagcagctctgtccagactctgggctttactcagactagctcggtggggcctttcagtggcctggagcatacatctactttcgtgtag

SEQ ID NO: 25597 - DNA, 723 bp, Artificial Sequence
  Description of Artificial Sequence: Synthetic coding sequence
atggccatcgtgcagaccctgcccgtgcccctggagcccgcccccgaagccgccactgccccacaagctcccgtcatggggtccgtcagctcgctgatctctggccggccctgcccaggcggccctgcaccaccgcgacatcacggacctcctggacccactttttttagacagcaagatggcctgctccgggggggatatgaggcgcaggagccactgtgtcccgctgtcccacccagaaaggccgttcctgtaacaagtttcacttatatcaatgaggactttcgtactgagagtcccccgagcccctctagtgacgttgaagacgctcgagagcagagggcacataatgcacatttgagggggccacccccaaaactgatacccgtgtccggtaagcttgaaaaaaatatggagaagatcctcatcagacctacagctttcaagccagtgctgcctaaacccagaggagcaccttccttgccttcgtttatgggaccacgagccactgggctgagtggctcacaggggtcactcactcaactgtttggtggaccggcctcctcaagcagctcaagttcgtccagctcggccgcggacaaacccttggcattctcagggtgggccagcggctgtcctagcggaacactcagcgatagcggccgcaattccctgtcctcactgcctacatactctactggaggagcagagccgaccacgtag

SEQ ID NO: 25598 - DNA, 1317 bp, Artificial Sequence
  Description of Artificial Sequence: Synthetic coding sequence
atgtgccccaagaacgccagctactacggcaaccgggccgccaccttgatgatgctcggacgattcagagaggcactgggagatgcccagcaatcagtccgactcgatgatagttttgtcaggggccaccttagagaggggaagtgccacctgtccttaggcaacgccatggccgcttgtagaagcttccagagggccctggagctggaccacaagaacgcacaggcacagcaagagtttaaaaacgctaacgcggtgatggagtacgaaaagatcgctgagacagatttcgaaaagcgggattttcgcaaagttgtgttctgcatggacagagcattagaattcgccccagcctgccacagatttaaaattctcaaagccgaatgcttagccatgcttggccgctacccggaggctcaatcagtagcatcagatattcttaggatggattctacaaatgcagacgccctgtacgttcggggcttgtgcctttactatgaggattgcatcgagaaagccgttcagtttttcgtgcaggccctgcggatggcacccgatcacgagaaggcatgtatcgcctgccgaaacgctaaagctcttaaggctaagaaagaggatggtaacaaagccttcaaggaaggcaactataagctggcttacgaactctacacagaagccctgggcattgaccccaacaacatcaagactaacgcaaagctgtattgtaaccgtgggactgttaatagcaagcttaggaaattggacgacgcaatagaggactgcactaatgccgtgaaactcgacgatacctacatcaaagcatatttgcgacgcgctcagtgctacatggatactgaacagtacgaagaagcagtacgcgactatgagaaagtttaccaaaccgagaagactaaggaacataaacaactccttaagaatgcccaattggagctgaaaaagtctaagcggaaggactattataagatcctaggggtcgataaaaatgccagcgaggatgaaatcaagaaagcatatagaaaacgggcgttaatgcaccatcccgacagacatagcggcgctagcgccgaggtgcagaaggaagaggagaagaagtttaaggaagtaggggaggcgtttacgattttatccgacccgaagaagaagacccgttatgactctggccaagaccttgatgaggagggtatgaatatgggagattttgatccgaacaacatattcaaagcctttttcggaggtcccggagggttcagctttgaagcatctggccctggtaatttcttctttcagtttgggtag

SEQ ID NO: 25599 - DNA, 678 bp, Artificial Sequence
  Description of Artificial Sequence: Synthetic coding sequence
atggaggaggaggagatgaacgacggcagccagatggtgcggagccaggaaagtctgacttttcaggatgtagccgtcgatttcacgcgtgaagagtgggatcagttgtaccctgctcagaaaaacctctatcgtgacgtcatgttagagaactatcgaaacctcgtcgcgctgggctaccagctgtgcaagcctgaagtaattgcccagctcgaactcgaggaggaatgggttatcgaacgcgactcactcctggacacccatcctggagaccagagccacgtaatgtctgttgtcaggtctagtgtccacgcccggtggatcgtgggtaaagtcatcggcactaagatgcagaaaaccgcaaaggtaagagtgaccagacttgtgctggatccctatttattgaaatactttaataagcggaagacatatttcgcccatgacgctctgcagcagtgtaccgtgggggacattgtgctcctacgggcattgcctgtgccccgggcaaagcacgtgaaacacgagttggccgaaattgtgttcaaagtgggtaaagtcattgatccggtgacaggcaagccatgcgctggcactacatacctggaaagcccactttcctcagagactacccagttgtcaaagaatctagaagagctcaacatttcttccgcacagtag

SEQ ID NO: 25600 - DNA, 753 bp, Artificial Sequence
  Description of Artificial Sequence: Synthetic coding sequence
atgaccaccaagaacctggagaccaaggtgaccgtgaccagcagcccgatccgcggggccggcgacgggatggagaccgaggaaccccctaaatctgttgaggttacctctggcgtacagagccgaaagcaccactcgttacaatccccgtggaagaaggcagtcccctccgagagccctggagtcttgcaactcggcaaaatgcttaccgaaaaggccatggaagtcaaggctgtccgcattttggttcccaaggcggccatcacccatgatattcctaacaagaacacgaaggtgaagtccctaggacaccacaaaggagagtttctcggccagtccgaaggggttatcgaaccgaacaaagaactatctgaggtgaagaacgtgctagaaaaacttaagaacagcgaacggagacttctgcaagataaagaggggctgtccaaccagctgcgtgtccagacagaagtgaaccgagagctgaagaaactgctagtggcctccgtgggtgacgatctgcagtatcactttgagagactcgcccgagagaaaaatcagctgatactggaaaacgaggctctggggaggaatactgcccagctctctgagcaactggagaggatgtctatacagtgcgacgtttggaggtccaagttcttggctagccgagtgatggcggacgagcttacgaatagtcgggccgctctgcagagacagaatcgcgacgcccacggagcaatacaggatttatag

SEQ ID NO: 25601 - DNA, 387 bp, Artificial Sequence
  Description of Artificial Sequence: Synthetic coding sequence
atgctgtgctggggctactggagcctgggccagcccggcatcagcaccaacctgcagggaatcgtcgcagagccccaggtctgtggctttattagcgacaggtccgtgaaagaggtcgcttgtggcggaaatcacagtgtcttcctcctcgaagacggagaagtgtatacatgtgggctgaacacaaagggccagctcggccatgaaagggaaggtaataagcctgagcagattggcgcgcttgccgatcagcacattattcacgtagcttgtggtgagagccactctctggctctctctgatcgtggccagctgtttagctggggagccggcagtgatggccagctcggtctgatgactacggaggactccgtggccgtgccatag

SEQ ID NO: 25602 - DNA, 1617 bp, Artificial Sequence
  Description of Artificial Sequence: Synthetic coding sequence
atggacgtggacaaggagctgggcatggagagcgtgaaggccggcgcgtctgggaagccagaaatgcgactgggcacccaggaagaaacctccgagggcgatgctaacgagtcttcattgttagttctgagctcaaacgtgcccctcctggctttggagtttcttgagattgcgcaggccaaggagaaagccttccttcctatggtgagccatacatttcacatgcggaccgaagagagcgatgcgtctcaggagggcgacgacctgcctaagtcaagcgccaatacttcccacccaaagcaggacgactctccaaagtctagtgaggagaccattcagcctaaggaaggagatattcccaaggcacctgaggagacgatccaatctaagaaagaagacctaccaaagtccagcgaaaaggccatacaacctaaggaatccaacatccccaagtcctctgccaaacctatacagcccaaactcggcaatatccctaaagcatctgtgaaaccctcacagcccaaagaaggggacattccaaaggcgcccgaggagaccatccaaagtaagaaggaagacctgcctaaatcatcagaagaagctattcagccgaaagaaggcgacatccctaagtcgtcagcaaaacctatacaacccaagctgggtaatatcgccaagacttcagttaagccctctcagccaaaggagtctgatattcccaagagtcctgaagaaacgatccagcccaaggagggcgatatccccaagagttcagctaaaccaattcagcccaaactaggaaatattcctaaagcatccgtgaagccttctcagcccaaggagggcgatatctccaaatcacctgaggaggctatccagccaaaagaaggcgacctacctaagagcttagaagaagctattcagcctaaagaaggtgacattccaaaatctctggaagaagccatccagcctaaagagggtgacatacctaagagccctgaggagactatccagcccaaaaagggagacattcccaagagtcctgaggaagcaattcaacctaaggaaggcgacattcccaagtctcccaagcaagcgatccagcctaaggagggtgacatcccaaagagtttggaagaggccattccccccaaggagatcgacatccctaagagcccagaagagaccattcagccgaaggaggatgatagccctaaaagtctggaggaagcaactcccagtaaagagggcgatattctgaagccagaagaggagaccatggagttcccagaaggcgacaaggtcaaggtgattctctccaaagaagacttcgaggctagtctaaaagaagctggtgaaaggctggtagcggtggacttcagcgctacgtggtgcgggccatgccgtactatacgaccctttttccacgctctgtcggtgaagcacgaggacgtcgtcttcctggaggtcgacgcggataattgcgaggaggttgtgagggagtgtgccattatgtgtgtgcctacctttcagttctataagaaggaagaaaaagtggatgaactgtgcggcgctctgaaggagaaactggaggccgtcatcgctgaattgaaatag

SEQ ID NO: 25603 - DNA, 153 bp, Artificial Sequence
  Description of Artificial Sequence: Synthetic coding sequence
atggccagcgaggagctgcagaaggacctggaggaggtgaaggtgctcctggagaaggcgacgagaaaacgtgtgagagatgccctgactgcagaaaaatctaagatcgaaactgagattaagaataagatgcaacagaaatctcagaaatag

SEQ ID NO: 25604 - DNA, 1527 bp, Artificial Sequence
  Description of Artificial Sequence: Synthetic coding sequence
atggccaccgactggctgggcagcatcgtgagcatcaactgcggcgattccctgggcgtttaccaaggcagggtctcagctgtggaccaggttagccaaactatctctctgactaggccctttcataatggcgtcaagtgtctggtacctgaagtgacatttagggcaggcgacataactgagttgaaaatcctagagatcccgggacctggggataaccagcacttcggtgacctgcatcagacggagctggggccttccggagcgggatgccaggttgggatcaaccaaaacggcacaggtaaattcgtcaagaaaccggccagcagctctagtgcaccccaaaacataccgaagagaacagatgtaaagtcacaggacgttgccgtgtctccgcaacagcagcagtgttccaaatcttacgtcgatcggcatatggaatcgttaagtcaatccaagtcctttaggagaagacacaactcatggagtagctcgagtagacaccccaaccaagcaaccccaaagaagtccggtctcaagaacgggcagatgaagaataaagatgatgaatgttttggagacgacatcgaggaaattcctgacactgacttcgattttgaaggcaacctggccctgttcgacaaagcagcagtgttcgaggagatagatacatatgagcgacggtccgggactaggagcaggggcatccctaacgagagacccacaagataccgacatgacgagaatattctggagtccgagcccatcgtctaccggagaatcattgtgccccacaatgtctccaaagagttttgtacagacagcggtttggttgtgccctctatatcatatgagcttcacaaaaaactcctgtcagttgccgagaaacatgggcttactcttgagcggcgcctggaaatgactggcgtgtgcgcatcccaaatggcattgaccctgctgggcgggccaaatagacttaaccccaaaaatgtccaccagaggccgaccgtggccctgctctgcggcccccacgtgaagggagcacagggcatttcgtgtggccggcatctcgcgaaccatgacgtgcaagtaatactgttcttaccgaatttcgtgaaaatgctagagtcgatcactaacgaactctccctgttttctaaaactcaaggacagcaagtgtcaagtctgaaggacctgccaacctctcctgttgacttagttatcaattgtctagactgtcccgagaatgtcttcctgcgtgaccagccatggtacaaggccgcagtagcctgggcaaatcaaaatcgggcccctgtgctaagtatcgaccctcctgtgcatgaggtggagcagggaatcgacgcaaagtggagccttgccctaggcttgccattacctctgggtgagcacgccgggcgcatctacctctgtgacatcggcatcccgcagcaggtgttccaggaggtcggaatcaattatcattcaccctttggctgtaagtttgtgatacccctgcattccgcatag

SEQ ID NO: 25605 - DNA, 3846 bp, Artificial Sequence
  Description of Artificial Sequence: Synthetic coding sequence
atgaccttctacagctggatcccctaccaccggcaggcccccctgaatcacaggcgggtttgttctgctgaaggagccggttcccctgggccagccctcgatcctaggtggctgccaacggaggctcacctgctggaggctcaccgcttattgctccagagcgtgctctgcgatagacccagagaaagcatccaacttcattttcggctgtcaatggcttctcaactccaggtgtttagccctccatcagtttctagttcagctttctgtagcgcaaaaaagctaaagattgaaccgtcaggatgggacgtgagcggacagtcttctaacgacaaatactacacacactctaagactcttccagcaacacagggacaggcaaacagctcccaccaggtggccaactttaacatccccgcctacgatcaaggactgctgttgccagcacccgcggtggagcacatcgtagttaccgccgctgatagctccggctctgctgccacctccactttccaaagctcacagaccctcacacacagatccaacgtgagtcttcttgaaccctatcaaaaatgcgggctaaagcgaaagtccgaggaggtggattccaatgggtccgtgcagataattgaagaacaccctccacttatgctccagaaccggactgtggtcggtgcagccgctacaaccacaacagtcacaactaagagttctagcagctccggcgagggagattatcaacttgtgcaacacgagattctgtgcagcatgaccaattcatacgaagtgctggaattcctcggccgaggcacattcggccaggtcgccaagtgctggaagcgtagcacaaaggaaatcgttgctattaagatcttgaaaaatcatccctcttatgcccgacagggacagatcgaagtgagcattctgtcccgcctgagctccgagaatgcagacgaatataactttgtgagatcctacgagtgtttccagcacaagaaccatacatgtcttgtgttcgagatgctagaacagaacctctatgattttttgaagcagaataagttctcccccctgccactgaagtatatcagacccatcctccaacaggtggcgacggccctgatgaagctgaagtctttagggctaattcatgcagacctgaagccagagaatataatgttagtggaccctgtccggcagccttatcgcgtgaaggtgattgattttgggtcagcctcgcatgtgagcaaagccgtgtgttcaacttacttgcagagccggtattatcgggcccctgaaataatcctcggcttgcctttttgcgaagccatagacatgtggtctctcggatgtgttattgctgaattgtttctgggttggcctctataccccggggcctctgaatatgaccaaatcagatacatctcccaaactcaaggcctgcccgccgaatatcttttgtccgcaggtaccaagacaacaaggtttttcaatcgagaccccaacctagggtatcctctgtggcgcttgaaaaccccagaggagcatgagttagagaccggcattaagtccaaagaggcccgaaagtatatcttcaattgcttggatgatatggcacaagtgaatatgtctacagatctcgagggaaccgatatgcttgctgaaaaggcagaccgcagagaatatatagatttgctaaagaagatgctgacaattgatgctgacaagcgcataactccgttgaagacgctcaaccatcagtttgtgacgatgacacacctcctggactttccacacagtaaccacgtgaaaagttgtttccaaaatatggaaatttgcaagcgaagagttcacatgtacgacacggtctcccagataaagagcccgtttactacccacgtggcccctaacacttctaccaatctgaccatgagtttctccaatcaactgaacacggtgcacaaccaggccagcgtgctggcatccagcagtacagccgccgcggctactctgagtctggctaacagcgatgtgtcccttcttaactatcagagcgccttataccctagctccgcagccccagttccaggcgtagcacagcagggggtcagcctccagcccggcacaactcagatctgtacacagacggacccgttccagcagacctttatcgtgtgccctcccgccttccaaaccggcttgcaggccaccacgaaacattctggcttccctgttaggatggacaacgctgtgccaatcgtccctcaggcccccgctgcccagcccctacagatccagagcggcgtgctgacccagggtagttgtacacccctaatggtagccactctgcatccacaggttgccacaatcacgcctcagtatgccgtgcctttcactctctcgtgcgcagcaggccgtccagctctcgtcgaacagaccgccgcagtgcttcaggcctggcccggcggcacgcagcagatattactgcccagcacatggcaacagcttcctggcgtggctctgcataatagcgtgcagccgacagctatgataccagaggccatgggctccggtcagcagttggcagattggaggaatgcacactctcacgggaaccaatattctactattatgcagcagcccagtctgctgacaaaccatgtgaccttggctaccgcccagcctctgaacgtgggcgtggctcacgttgtgcggcaacagcagtccagtagcctgcccagcaagaagaataagcagtctgccccagtctcgagtaagtctagcctagacgtgctcccctcccaagtctatagcctggtgggtagctcacctttgcgaactacatctagctacaatagcctagtccctgtgcaggaccagcaccagcccataataatccccgacacacctagcccaccagtgtctgttatcactatcagaagtgatacggacgaggaggaagacaataagtacaagccttccagcagtggactgaagcccagaagtaacgtgatctcatatgtcacagttaacgatagccctgattcagattcttctctgagtagcccctactctactgacacgctgagtgccctcagaggcaactccggctccgtcctggaaggtccgggaagagtggtggccgatggtactggcacgcggaccatcatcgtaccgcccttgaagacccaactcggagactgcactgtcgccacccaggcttcaggcctccttagcaacaaaacaaagcccgttgcgagcgtgtccggccagtccagtggatgttgcatcacacccacggggtacagggctcagaggggcggaacgtctgccgcacagcctcttaatctttcacagaaccagcaatctagcgcagccccgacgtcacaggagagaagctctaaccccgccccacgccgtcaacaggcgttcgtcgctcccttaagtcaggctccatatacattccagcatggcagcccattacattctacaggtcatcctcacctggcccctgctcccgctcacctcccctcgcaggcgcacctgtacacatacgctgccccaacgtcggcagcggcactgggctcaacatcttccatcgcccaccttttttctccgcagggcagctctcgacatgcagctgcatatacgacacacccttcaaccctagtccaccaagttcctgtttccgttgggcccagtctgctgacctctgctagtgtcgccccagctcagtaccagcatcagttcgccactcagagctatattggatcttcaagaggctcgactatctacacgggttaccctctgtctccaacgaagatatctcagtattcttacctgtag

SEQ ID NO: 25606 - DNA, 1071 bp, Artificial Sequence
  Description of Artificial Sequence: Synthetic coding sequence
atgaccagcgtgacccggagcgagatcatcgacgagaagggccccgtgatgtccaaaactcacgaccaccagctggagagtagccttagtccagtggaggtgttcgccaagacttcagcctccctagagatgaaccagggtgtctcggaagaaaggattcatctgggcagcagcccaaaaaaggggggtaactgcgacctatcccaccaggaacgcttgcaaagtaagtcgctccacctgagcccacaagagcagagtgctagctatcaggatagaaggcaatcttggcggcgagcctccatgaaagagactaataggaggaaaagtctgcatcccatccaccagggaatcactgagctgtctcgaagcatttccgtcgacctggctgagtctaaaagactcggttgtctactgctgagctcattccaattctctattcaaaaactggagcctttcctgcgggacacaaagggattcagtttggaatcgtttcgcgcaaaggccagctccctcagcgaggagctgaagcactttgccgatgggctggagacggacggcacattgcagaagtgttttgaggactccaacggtaaggcttcagactttagcctggaagcctctgtggctgaaatgaaggagtatatcacaaagttcagtctcgaacgccagacatgggaccagctgctactgcattaccagcaggaggctaaagaaatcctttcgaggggttccacggaagctaagatcacagaagttaaggtcgaaccaatgacctacctcggctcatcgcagaatgaggtgctgaataccaaacccgactaccagaagatcttgcagaaccagtctaaggtctttgactgcatggagctcgtgatggacgaactgcagggttcggtcaaacaacttcaggctttcatggacgagtctacacagtgtttccagaaagtctcagtgcagcttggaaagcggtccatgcaacagctggatccgagcccagcccggaaactactaaagctgcagcttcaaaacccgcctgccattcacggaagcgggtcgggttcttgccaatag

SEQ ID NO: 25607 - DNA, 2748 bp, Artificial Sequence
  Description of Artificial Sequence: Synthetic coding sequence
atgcagggccccgacgcccccctgctgctgagcgcccgggagctgggtcccggtagacgagggtccgcctcctggtatagacaagaggggggcgccgtgtgtaactggcttcggaagccgcagcccctggagccccgaacgagctttccctctgctcgccggagcgaattccgtccaccccgccgactgccctgggcggggcccgcaagcgcacaatctgaagaagggcatgcaggtggcagatgtcaggccggaagtcctgcccccgccagacgcctatcaggggccttcaaaactctcgttccgggaactcacgcgcagggggctagtgacacccacccactggggccccctcacacccctgtgctcgatcctagccctcaagacggctttccagtcctttggcgcgggtcaagcaaagcttcccatatgaatcgactcaggaacgcaaaaatctatgtggagcgggccgtgaaacagaagaaaatctttactattcagggttgttatccggtgatcagatgcctgctccgaagaaggggatgggtggaaaagaagatggtgcatcggtcaggccctacactgctgccacctcagaaagaccttgattcctccgcaatgggcgactcagacaccacagaagacgaagacgaagacgaggacgaagagttccagccaagccagttgttcgatttcgatgacttgctgaaatttgatgaccttgatggcactcatgcgctaatggttgggctgtgcctaaacttgcgcaatctgccatggttcgacgaagtcgacgcaaattctttttttccccggtgttactgcttgggagcggaggatgataagaaggctttcatcgaagatttctggcttaccgcagcgcgaaatgtgctcaagctagtcgtgaagtctgagtggaaaagctaccctatccaggcagttgaggaggaggccagtggagacaagcagcccaaaaaacaggagaaaaaccccgtccttgtgagtccggagtttgtagatgaggccctctgcgcatgtgaagaatatttaagcaatctggcacatatggatatcgataaagatctcgaagctcccctttacctcactcctgaaggctggtcactcttcttgcagcgatattaccaggtggttcatgaaggtgctgagctgcgccatttggacacccaggttcagaggtgcgaagacatcctgcagcagctgcaggccgtggtaccacagattgatatggagggcgatcgaaatatctggattgtgaaacctggggccaagtcccgcgggaggggtatcatgtgcatggaccacctggaagaaatgctgaagctggtcaacggtaacccagtagttatgaaggacgggaagtgggtggtccagaaatacattgagcggcccttgctcattttcggtactaagtttgacctgcggcagtggtttctggtcaccgactggaacccccttactgtatggttctatcgggattcctatatccgcttcagtacacaacctttcagtcttaagaacctggacaattccgtacacctctgtaacaattctatacagaaacaccttgagaattcctgccatcgacatccgttattaccacccgacaatatgtggagcagtcagcgcttccaggcccacctgcaggagatgggagcccctaacgcctggtccaccattattgtacctggcatgaaagacgcagtcatccatgccctacaaactagtcaggatacggtccaatgtaggaaagcttcctttgaactgtatggcgccgattttgtttttggagaagattttcagccatggctcatcgaaataaacgcttcccctacgatggctcctagtacagctgtgacggctcgtctgtgcgcgggtgtgcaggccgacactttgcgagtggtgattgatcggatgctggatcggaattgcgatactggcgcttttgaactcatttacaagcagcccgccgttgaagtaccacaatatgtggggatacgcctgttagtggaaggcttcaccattaaaaaacccatggcaatgtgtcacaggcgcatgggcgtgcgccccgcagtgcccctacttactcagaggggctccggggaagctcgccaccattttccaagtctccataccaaggcacagttaccctcaccccatgtgctgaggcatcaaggccaggtacttcgcagacagcatagcaagctggtcgggaccaaggctttgtccacaacgggaaaggcgttacgcacactgccaacagccaaagtatttatttcgctcccccccaatctggactttaaagtagctccatctatcctcaagcctaggaaagccccggccttgctgtgtttgcgcgggccacagttggaagtgccttgctgcctctgccctctgaaaagcgaacagttcctggcccctgtgggccgctcgaggcccaaagccaactcccggcctgattgtgataagcctcgcgccgaggcttgcccaatgaaaagactgagtcccctgaaacctctgccgctcgttggaacatttcagcgtcgccgtggactaggagacatgaaattggggaaaccactcttgcggttcccaactgcactggtgttagaccctacccccaataaaaaaaagcaggtcaagtacctgggacttgattcaatcgccgtgggcggaagccgtgtggacggcgcacgaccatgcaccccgggtagcaccgctcgggcatag

SEQ ID NO: 25608 - DNA, 2463 bp, Artificial Sequence
  Description of Artificial Sequence: Synthetic coding sequence
atgcggatcagcagctgcagcgacgagagcagcaacagcaacagctcccggaagtccgataaccattcccccgcggttgtgaccaccaccgtgtcgagcaagaagcagccgagtgtgttggtcacttttccaaaagaagaacgtaagtctgtgtctggaaaagcctcgatcaagctgtccgaaacgatttccgagggcacctccaacagcctgtcaacatgcacaaaatcaggaccctcaccactgagtagccccaacggtaagctgactgttgccagccccaaacgcggccagaagagggaagaggggtggaaggaggtggtgcgacggagcaaaaaggtgtcagttcccagtaccgtgattagcagagtcatcggccgaggaggctgcaacattaatgccatccgggaatttactggggcccacatagatattgacaagcagaaggacaaaaccggtgaccgtattatcaccataagaggagggaccgaatctacacgccaggctacccagcttatcaatgctctgattaaggaccccgataaggagatcgacgagcttatccctaagaatcggcttaagagctcatctgccaacagtaaaatcgggagctcggctcctaccacaacggccgccaacactagcctaatgggaataaaaatgactaccgtcgcactatcctctacttctcaaacagctacagccctgacagtgcctgcgatttcttcggcatcaacacacaagacgatcaaaaatcctgtgaacaacgtacgcccaggctttcccgtgagcctgccattggcttatcctccaccgcaattcgctcatgctctactggctgcccagaccttccagcagataaggcccccacggctgcccatgacccatttcggaggcacatttccgcctgcacaaagtacttggggcccattccctgtgcgtccactgagccctgcccgagcaacaaactccccgaaaccccatatggtccccaggcacagtaaccagaattcatctggttcacaagtgaacagtgcgggatcgctgacgagctcgcctactaccacaacctcatcctctgcttctactgtgcctggcacctcaacaaatggctccccttcaagccccagcgtgaggagacagctctttgtgactgtcgttaaaacctccaacgctaccactaccaccgttaccactactgctagtaacaataataccgcccccaccaacgctacctatcctatgcctaccgccaaggagcactatcccgtatcatcccccagctcccccagccccccggcccagcccggaggagtgtctcgaaatagtccgctcgactgtggcagcgcctctcccaacaaagtggcttccagtagcgagcaggaggccggaagtccgccagtcgtggagaccaccaacaccagaccccccaactcttcgtcttcttctggaagttcaagtgctcactctaatcaacaacagccgccaggatccgtctcccaggagcctcggcccccactgcaacagagccaggttcccccacccgaggtccgcatgaccgttccacctctggccactagctcggcccccgttgcagttccatctacagcgcctgtcacttacccgatgcctcagacccccatgggctgcccgcagccaacacccaagatggagactccggcgatccgccccccaccccatggaaccactgccccccataagaactctgccagcgtacagaatagtagcgtcgccgttttatccgtgaaccacattaagagaccacactccgtacctagcagtgttcagttgccttcgaccctgtccacccagtccgcctgccaaaattcagtgcatcctgcaaataaacctatcgcgcctaacttctctgcccctttgccattcgggccattctccacattgttcgagaactcccctacttccgcccatgccttttggggtggctctgtcgtgagttcccagagcacacccgagtccatgctgtctggaaagtcaagttacctgccgaattctgaccctctgcaccagtctgatactagtaaggcaccaggcttcaggccacctcttcagaggcctgccccatccccctctggcatcgttaacatggactcgccatacggctcagtcacaccctcctcaactcatctgggaaatttcgcctcaaacataagcggagggcaaatgtatggaccaggggcaccgttgggcggtgcacccgcggccgccaacttcaatcgccagcatttttccccactctcacttcttacaccgtgctccagcgcctccaacgactcctccgcccagagtgtgtctagtggcgtgagagctcctagcccagcacccagctccgttccacttgggtcagaaaaaccttcgaacgtgtcccaggacattgtggcaagtggcccactgaaaggactggtggccatcaagaccaagtag

SEQ ID NO: 25609 - DNA, 6033 bp, Artificial Sequence
  Description of Artificial Sequence: Synthetic coding sequence
atggagaaggccaccgtgcccgtggccgccgccaccgccgccgagggagagggcagtccaccggctgtggctgccgtagccggccctcccgccgccgccgaggtcggaggaggtgtgggagggtctagccgagccaggtctgcgagctccccccgcgggatggtgcgcgtgtgcgatctccttctaaagaagaagccccctcaacagcagcaccataaggccaaaaggaacaggacctgtcggcccccctcctcgagcgagtcttcctccgactcagacaactccggagggggagggggcggcggcggcggaggaggggggggaggtggaacgtcttccaacaatagcgaggaagaggaggacgacgatgacgaagaagaggaggtcagtgaagtggagtcttttatactggaccaggatgacctggagaaccccatgctggaaaccgcctcaaagctccttctctctggtacagccgacggtgctgaccttagaaccgtggatcctgagacccaggcacgtttagaagcccttctggaggcagcggggattggcaagttaagcacagctgacggtaaagcgttcgcagaccccgaggtgctgagaagactgaccagcagcgtgtcttgtgccctggatgaagcggccgccgccctgacccgcatgcgggcagagtctacagcaaacgctggacagtccgacaaccgatccctggccgaggcatgttcggagggcgacgtgaatgccgtccgaaagcttcttattgagggaagaagcgtgaacgaacataccgaggagggagagtctttgctgtgtctggcatgcagtgccgggtactacgagcttgcacaggtcctactcgctatgcacgcaaacgttgaagatagaggcattaagggggacattaccccactaatggctgcagctaacgggggacatgtaaaaatcgtgaaattgctgctggcccacaaagctgacgtgaacgctcagtccagtactggcaatacagctctgacatatgcttgtgccgggggctacgtggatgttgtgaaggtgctcctggagagcggcgcatccatagaagaccataatgagaatggtcatacgcctcttatggaggctggcagcgccggacacgtagaggtggctcgtcttcttctggagaacggggctgggattaacacacactccaacgagtttaaagaatcagccctgacactggcttgttacaaaggacaccttgaaatggtgcggtttctgttggaggctggagccgaccaagagcacaaaacagatgagatgcatactgcattaatggaggcatgtatggacggccacgttgaggtggccaggctactgttggatagtggtgcacaggtcaacatgcctgccgattccttcgagagcccactgaccttggcagcatgcggtggtcatgtagaactggccgccttacttattgagcgaggcgcgagcctggaggaggttaacgatgagggatatacaccactgatggaagccgctcgagaggggcacgaggaaatggtggcgcttctgctcggccagggcgctaacattaatgctcagacggaagagacccaggaaacagccctaaccttggcctgttgcggtgggtttttagaggtagctgattttctgatcaaagcaggtgccgatatcgagctggggtgcagtacccctcttatggaagccgctcaggagggtcatttagagctggttaagtatctgctggcagcgggagcaaatgttcatgcaacaacggccacgggcgacactgccttaacttatgcctgcgagaacgggcatacagatgtggccgatgtgttgctgcaagcaggggcagacttggagcacgaaagcgaggggggcaggacccctctgatgaaagcggcgagggccggtcacgtctgtaccgtgcagtttttgattagcaagggagcaaatgtcaaccggaccaccgctaacaacgaccacacagtcttgtctctggcctgcgcgggagggcatctcgcggtagtcgagctcctactagcccacggagcagacccgacccacagactgaaagacggttctactatgctgattgaggcagccaagggaggacatactagcgttgtgtgctacctgctcgattaccccaacaatctcttgtctgcacctcccccagatgttacacagctcactccaccgtcccacgaccttaatcgcgctccgcgagtgccagtgcaagcccttcctatggtggttcccccacaggaaccagacaagcctcctgcgaacgtggcgactaccctgcctattagaaataaagcagcgtccaaacagaagtcctcctcccacttgcctgcaaattcacaggacgtgcaaggttatattaccaatcagtctcctgaatctattgtggaggaagcccaggggaagctgacagaactcgagcagcgaatcaaagaagccatcgagaagaatgctcagttacagtcgctggaactggctcatgcagatcagctgaccaaagaaaagatcgaggagctaaataagacccgggaagagcaaatccaaaaaaagcagaagatcctggaagagctccaaaaagtggagagagaactgcagctgaaaactcagcagcagctgaaaaaacagtatctggaggttaaagctcagcgcatccagctccagcagcagcagcagcagagctgtcagcatctcggattgctgaccccagtgggcgttggtgagcagctgagcgagggagactacgctcggcttcaacaagttgatcctgtccttctgaaagatgaacctcagcaaaccgcggctcagatgggatttgctcctatccagcctttggctatgccacaggcccttccattggctgctggacctttaccccctggatcaatcgctaatcttactgagctgcaggtgctgagttcactcttgcagccttgtttcctgtccacgttaccgttaatactgatgcatagactgcgggttattatgacacgccctaagtccagtagtaccagcgaatctggcgatagtgataacatgcggatttcctcctgttccgacgagtccagtaatagtaactccagccgcaaaagcgacaaccactcccctgccgttgtgactactacagtgtcttctaaaaagcagcctagcgtgttagtgacattccccaaggaagagcgcaagtcagtgtcaggcaaggcatccattaaactgtcagagaccatcagtgaaggaacttccaacagcctgtcaacctgtactaagtccggcccttctcctctcagtagtccaaatggtaagttgacagtggcgtcccctaaacgagggcagaagagggaggagggatggaaggaagttgtccgtcggtctaagaaggtgtccgtcccaagtacagtgatctcacgcgtgatcggcagaggggggtgcaacattaatgcaatcagggaatttacgggggcccatatagatatagacaaacagaaagataaaacgggggacagaatcataactatcagggggggaacagagagcactcgccaggccacacaactcattaatgctttgatcaaagacccagacaaggaaattgatgagctcattccaaagaatcgattgaaatctagctcggccaacagtaagattggctcctccgccccgactacaacagctgccaacacaagcctgatgggcatcaagatgaccacagtggctcttagctcaacttctcagactgctacggctctgacagtgccagcaattagcagcgctagcacccacaagacgatcaaaaacccggtaaataacgtgagacccggcttcccagtgtcactgcctctggcttatcccccaccccagttcgctcatgcgctcctagcagcacagaccttccagcaaatacggccaccgagactgcccatgacgcacttcggcggcacatttcctcccgctcagtcaacatgggggccattcccagtcaggccactgagcccagcccgcgctactaattcgcccaaacctcatatggtgcccagacatagcaaccagaattctagcggaagtcaagtaaacagcgcgggtagcctgacctcttcaccaaccaccaccacctcatctagtgcatccactgtacccggcacaagcacaaatggttctccaagctccccctccgttcggagacagctcttcgtaactgtggttaagacatccaatgccaccaccaccacggtgacaacaacagcaagcaacaataatacggcgcccacgaacgccacctatccaatgcctacagccaaggagcattacccagtttcctcccctagttccccaagtccacccgcacaacccggcggggtttctcgaaatagtcccctggactgcggcagtgcatcaccgaacaaagtcgccagttcttcagaacaggaggccgggagtcctccagtagttgaaactacaaacaccagacctccgaacagcagttcctctagcggaagttcttcagcgcattccaatcagcagcagcctccagggagtgtctcccaggagcctagacctcctttacaacagtctcaggtacccccacctgaggttcgcatgacagtgccccctctagctacttcgtccgcccccgtggctgtaccctccaccgcccctgtgacatacccaatgccacagacccccatgggttgcccccagcccactcctaagatggaaaccccggcaatccgcccacctccccacgggacaaccgctccccacaaaaactcagcttccgtgcaaaactcttcagtagctgtgctctctgtgaatcacattaagagacctcattctgtgccctcctcagtccaattacctagtacacttagtacccaatccgcctgtcaaaatagtgttcaccctgccaataaacctatcgccccaaactttagcgcgcccctgccattcggcccgtttagcacgttgtttgagaactcaccaacgtctgctcacgcattctggggaggcagtgttgtgtcgtcgcagagtacacccgagagtatgcttagtggaaaatcttcttatctgcctaactccgatccgctacaccagagcgacacgtcaaaggctccaggcttccgccccccgcttcagcgccccgccccaagcccttcagggatagtgaatatggattccccatatgggtcggtgacccctagctctacccaccttggcaattttgccagcaacatatccggagggcaaatgtacgggcccggcgccccactcggcggcgcccccgctgcagccaattttaataggcagcatttttctcctctgtctcttctcaccccttgctccagcgcttcaaatgacagcagtgcccagtccgtatccagcggagtaagggctccttccccagcaccctcaagtgtccccctgggatcggaaaagcccagtaacgtgtcccaagatcggaaagtgccagtgccgattggtaccgaacggtctgcccggattagacaaaccgggacttctgccccaagtgtgatcggctctaacctgtctacctcggtcggccactctggtatctggtccttcgagggaatagggggtaatcaggacaaagtggattggtgtaaccctgggatgggcaacccaatgattcaccgccccatgtccgatcctggggtcttttcacagcatcaagctatggaaagagacagcacaggaattgtgactccttctggaacatttcatcaacacgtgcctgccggatatatggattttccaaaggtgggaggcatgccattcagtgtgtatggtaatgccatgatccctcctgtagctcccatcccggacggtgcaggtgggcccatctttaacgggccccacgccgcggacccctcctggaatagcctgattaagatggtgtcatctagcacggaaaacaacggcccacagaccgtttggaccggcccctgggcgccacacatgaactctgtccacatgaatcagctgggatag

SEQ ID NO: 25610 - DNA, 1446 bp, Artificial Sequence
  Description of Artificial Sequence: Synthetic coding sequence
atggccagcgccgccagcgtgaccagcctggccgacgaggtgaactgtcctatttgccagggaacactccgagaaccagtgactatcgattgtggccataacttttgtcgagcatgcctgacccgttactgtgagattccagggcctgacctcgaagaatcacctacctgccccctttgcaaagagccgttcagacctgggtcatttcgccccaactggcagcttgccaatgtagtagagaacattgaaaggctacagctggtttccactctgggtctgggcgaggaagatgtatgccaggagcatggcgagaagatttattttttttgcgaagacgatgagatgcaactttgcgtcgtctgtcgtgaggcaggggaacacgccacccacacaatgaggtttttagaggacgccgccgcaccatacagggagcagatccacaaatgcttgaagtgtctacggaaggagagagaggagattcaagagattcagtcgcgcgaaaataaacgcatgcaggtgctcctgacacaggtgagtactaagaggcagcaggttatttctgagttcgcacacctccggaaattcctggaggagcagcaatccatactgcttgcccagttagaatctcaagatggcgatatcttgcgccagcgtgatgagttcgacctcctagtggctggtgagatatgccgcttttctgccctgatcgaggagttggaggaaaagaacgaaaggcctgcgcgcgagcttttaaccgatatccgcagtactttgattcgttgcgagacccgtaagtgccggaagccagttgccgtgtcccccgagttgggacagcggattcgcgatttcccgcaacaggctctgcctttgcaacgggaaatgaagatgttcctggaaaaactgtgctttgagcttgattacgagcctgcccacatttccctcgacccacaaacctcccatcccaagttacttctctccgaagaccaccaaagagcgcagttcagttacaagtggcagaattcgcccgataatcctcagcggttcgatagggcaacctgtgtacttgcacatactggcattaccggcggccggcacacgtgggtggtgtcgatagacctggcacacgggggctcttgtaccgtgggagtcgtttctgaggacgtccaacggaagggcgaactgagacttaggcccgaagaaggggtttgggctgtcagattggcctggggattcgtttcggcactggggtctttcccgactagactgaccctgaaggagcaacccagacaagtgagagtgagccttgactatgaggtgggctgggtcacgtttacaaacgccgtaacgcgagaaccaatctacacattcaccgcctctttcactaggaaagtcatcccattttttgggctttggggtcgcgggtcaagtttttctctcagttcatag

SEQ ID NO: 25611 - DNA, 1566 bp, Artificial Sequence
  Description of Artificial Sequence: Synthetic coding sequence
atgcccagcccccagctgctggtgctgttcggcagccagaccggcacagcccaggacgtatcggaacgcctcggacgggaagcccgtcgtcggagactcggctgccgcgtacaagcactggatagttaccctgttgtgaacctaattaatgaacctttagttattttcgtgtgcgccaccactgggcagggcgaccctcccgacaacatgaaaaacttttggagatttattttcaggaaaaacttgccatctaccgcactctgccaaatggatttcgctgtccttgggctcggcgattcttcctatgctaagtttaattttgtcgcgaagaaactgcaccgccggctcctccagctgggcggatcagcgctgttaccagtttgtctgggcgacgatcaacacgaactgggattgccgtcaaagttcacacttctcttcctgcaggaggccccctccacggggagtgaaggacaaagagtcgcacatcccggatctcaagaaccaccctcagagtcaaagcccttcctcgcacccatgattagcaatcaacgcgtgacaggcccctcccatttccaggacgtgcggctgattgagtttgatatacttggctccgggatttccttcgcagctggtgatgtcgtgctgattcagccttctaactccgcagcccacgtccagaggttctgtcaggtgctgggccttgaccccgaccagctgttcatgctccaacctcgggaaccagacgtgtcatccccaacgagacttcctcagccctgcagcatgagacatcttgtgagtcattacttagacattgcttcagtccccaggcgctcattttttgaactgctggcatgtctgtcattgcatgagttagagagggagaagttgctggagttttcatctgcacagggacaggaggaactttttgagtactgcaatagaccgagacgcacaattctagaggtactctgtgactttcctcataccgctgcggcaatccccccagattatttattggacctcatccctgtaattaggcctagggcattctctatcgcttcttcattgctgactcatccctcaagactccagatcttggtcgccgtggttcagtttcagactaggctgaaggaacctaggaggggactgtgtagctcctggcttgcttctctcgaccctggacaggggcccgtgcgggtgccactgtgggtccgccccggctcgctcgcctttccggagacacctgacaccccggtcatcatggttgggccaggcaccggtgtggccccctttagagcagcgatccaggagcgcgtagcccaaggtcagaccggtaacttccttttttttggatgtcgatggagagaccaagacttttattgggaggccgagtggcaggagttggagaaaagggactgtctcactctcatcccggcattttcaagagaacaggagcaaaaggtgtacgttcaacaccggcttcgggaactggggagccttgtgtgggagctgctggaccgccaggccactccatctccatgccagcgcacctcaagaaagccctag

SEQ ID NO: 25612 - DNA, 753 bp, Artificial Sequence
  Description of Artificial Sequence: Synthetic coding sequence
tgacagcccagccccgtggagccccggggccccttctacttctgcagactcctcctcgacgatttaggtatgaactcttgggacagacgaaagaatttccacctcctgaaaaagaactccaaattactcagggaattgaaaaacctggacagtagacagtgcagggagactcacaagattgccgtcttctatattgcggagggtcaggaggacaagtgttccatcctatctaacgaacgtggctcccaagcctacgaagacttcgtggccggtctcggatgggaagtggatctctcaacacactgcggctttatgggggggttgcaacgcaatgggagcaccggccagacggcgccttactacgccacctctactgttgaagttatcttccatgtatcgaccagaatgcctagcgactcagacgattcgcttacgaaaaaacttcggcatctcggcaacgacgaggtgcatatagtgtggtccgagcactctcgggactacaggcgtgggattatccccactgcgttcggggatgtttcgatcatcatctatcccatgaagaaccatatgtttttcatcgcaattacaaaaaagcctgaggtccctttctttgggcctctgtttgatggagctatcgtctctggaaagcttctgccctcactggtgtgtgcgacatgcatcaacgctagccgagcagttaagtgcctgattccactttatcagagcctgtacctcttcgctctgaacgtgtag

SEQ ID NO: 25613 - DNA, 345 bp, Artificial Sequence
  Description of Artificial Sequence: Synthetic coding sequence
atggtgctgatcctgggccggcggctgaaccgggaggacctgggcgttagagactctcctgctaccaaacggaaggtgtttgagatggaccctaagtcactcactgggcacgagttttttgactttagttccggatcatctcatgccgaaaatatccttcagattttcaacgagtttagggactcccggttgttcactgacgtcatcatatgtgtggagggcaaggagttcccttgtcaccgtgccgttctgagcgcttgtagttcctatttccgggcgatgttctgcaatgatcacagagaatctcgtgaaatgcttgtcgagatcaacggaatactggcctag

SEQ ID NO: 25614 - DNA, 1830 bp, Artificial Sequence
  Description of Artificial Sequence: Synthetic coding sequence
atggccagcctgagccgggccctgcgggtggccgccgcccaccccaggcagagtccgacaagaggcatgggcccatgtaacctcagctcagccgctggcccaacagctgagaaaagtgttccctatcagcgcacactcaaagagggtcagggcacaagcgtagtagcccagggcccaagtaggcccctgccctcaaccgctaacgtcgttgtcataggagggggctctttgggctgccagacactgtaccaccttgctaaactgggcatgagcggcgcagttcttctggagcgcgagaggttaacatctggcacgacttggcacacagctggcttgttatggcagctgcgtccttctgacgtagaagtcgagcttctagcccacacgagaagggttgtgagcagagaactggaggaggaaaccggccttcatacaggctggatccagaacgggggcttgttcatagcaagcaataggcagagactcgatgagtataaacgcctcatgtcattaggcaaggcgtatggcgtcgagagccacgtgctgtctcctgctgaaacgaaaaccctgtaccccctgatgaatgtcgacgacctatatggcaccctgtatgtaccacacgacggaaccatggatcctgctggaacttgtactactcttgctagggccgcttccgcccgcggcgcgcaggttatcgagaactgccccgtaacagggatccgcgtatggacagatgattttggagtcaggagagtggccggcgtagaaacacagcacggctctatccagaccccttgcgtggtcaattgcgccggagtatgggccagcgctgtcggccgcatggctggggtgaaagttcccttagtggcgatgcaccatgcttatgtggtgacggagcgtatcgagggaatccagaatatgcctaatgtaagagaccacgacgcttcagtctatcttagactccagggcgatgccctgagtgtcgggggttacgaggccaatcctattttttgggaggaggtgagtgataaatttgccttcgggctgtttgatttggactgggaagtgtttacccagcatatcgaaggcgctatcaaccgcgttcctgtgcttgaaaaaactgggatcaagtctactgtatgtggccccgagtccttcactcccgaccacaagccacttatgggcgaagctcccgagctgcggggattctttttgggctgcggattcaacagcgccggaatgatgctgggcggcggatgcgggcaggaactggcacactggattatccacgggcgccccgagaaggatatgcatggctacgatatccggcgattccaccactcactgaccgatcacccccgatggatccgagaaagatcccacgagagttatgcaaaaaactacagtgtcgtcttccctcacgatgagccccttgcaggacggaacatgagacgtgacccattacatgaagagctcctgggccagggctgtgtgttccaggaaagacatggttgggagaggccaggttggtttcatccacgaggtcctgcccccgtgctggagtacgattactatggggcttatggttctcgagcgcacgaggactacgcatatagacgtttgctggctgatgagtacactttcgcctttcctccccaccacgacaccataaagaaggagtgtctggcctgtcgcggggctgcggcggtcttcgatatgtcatacttcggcaagttctatctcgtcgggctggacgctaggaaggcagccgattggctcttctcagctgatgtgtcccgaccccccggcctgcatcgggttcacgtttag

SEQ ID NO: 25615 - DNA, 129 bp, Artificial Sequence
  Description of Artificial Sequence: Synthetic coding sequence
atggacaacatgagcccccggctgcgggccttcctgagcgagcccatcggagaaaaagatgtgtgttgggttgacggcatcagtcacgagcttgccattaacctggtgaccaaaggcatcaataaatag

SEQ ID NO: 25616 - DNA, 3120 bp, Artificial Sequence
  Description of Artificial Sequence: Synthetic coding sequence
atggtgagcagcgcccagatgggcttcaacctgcaggccctgctggaacagctgtcccaggacgagcttagcaaatttaaatatctaatcactactttctcactagcccatgaactacagaagattcctcacaaagagatggcctctctgcaagtttttgaaaagatgcatcgcatggacctttctgagcgtgcaaaagatgaggtccgggaagccgccctgaagagttttaacaagcgaaagcctctgtctcttggcataactcggaaggaaaggcctccactggacgtggatgagatgttagaaaggttcaaaacggaagcacaggcgttcacagaaactaaaggtaatgtcatctgtttaggaaaggaagtatttaaaggtaaaaagccagataaagacaacagatgtcggtacatcctaaaaactaaattccgggaaatgtggaagtcttggccaggagattccaaggaggtccaggtaatggccgaacggtacaaaatgctaatcccattttccaacccaagggtgctgcccgggccattttcctatactgtggtgctgtatggccctgccggactcggtaagaccaccctggcccagaagctgatgttggattgggccgaagataaccttatccataagttcaaatacgccttctatctgtcctgccgtgaactctcccgccttggaccatgcagttttgcagagcttgtgttccgagactggccggaacttcaggatgatatccctcacatcctggctcaggctcgtaagatactattcgtcatcgacgggttcgatgagttgggcgccgcgcccggggctctgattgaggatatttgtggcgattgggagaaaaaaaaacccgttcctgttctattgggctcgctgctgaatcgcgtgatgctaccaaaggctgcacttctggttacaaccaggccacgggccctgcgcgacctgcggatactagcggaagagccgatctacattcgagtggagggtttcctggaggaagatagaagagcatactttctgcgacacttcggagatgaagaccaagcaatgagggcattcgagcttatgagatccaacgcagccctgtttcaattggggtccgcgccggcagtgtgttggatcgtttgcacaaccctcaagctgcagatggaaaagggggaggaccccgttcccacctgcctcacccgcaccggcctgttcctgagattcctatgttctagattccctcagggagcccagcttcgcggtgctttgcggaccctatctttattggccgcgcaggggctctgggcccagactagtgtcttacatagggaagaccttgagcggctgggagtgcaggaaagcgatcttagactgtttctggacggcgatatcctgaggcaagatcgagtaagtaaggggtgttatagctttatccatctttccttccagcagtttctcacagccctgttttatactcttgaaaaagaggaagaggaggacagggatgggcacacatgggatatcggtgacgtgcagaagctcctatcgggagttgaacgcctgaggaacccagatctgattcaggccggatactacagcttcggactggcgaacgaaaagcgcgcaaaggagctagaagccacctttggatgcagaatgtctcctgatatcaaacaagagctgctccggtgtgacatcagctgcaagggtggccattcaaccgtgacagacttgcaggagctgcttggatgcctgtatgagtctcaggaggaggagctcgtgaaggaggtcatggcacaatttaaagaaatcagcctgcacctgaatgcagtagacgtagtcccctcatctttttgcgttaaacattgtcggaatttgcaaaaaatgtccctgcaagtgatcaaggagaacttaccagagaacgtgacggccagtgagagcgacgctgaggtcgaaagaagccaggacgatcagcacatgcttcccttttggaccgatttgtgctctatctttggctcaaataaagacttgatgggattggcaataaatgacagctttctgagcgcctccctcgtgcgtatcctgtgtgagcaaatcgcttccgatacgtgccatctgcagcgggttgttttcaaaaatatctctcctgccgacgcacacaggaatctctgtctcgcactccgcggtcataagacagtgacttatctgaccctgcaggggaacgatcaggatgatatgtttccggctctgtgcgaggtgctgcggcatccagaatgcaatctgcggtatctgggactggtgtcatgctcggcgacgactcaacagtgggctgacctcagtttggccctggaagtcaaccagtctctcacgtgtgttaacctgagtgataatgaacttctggatgagggagccaagctgctatacacaaccctgcggcaccctaagtgctttttgcagagactcagcctggaaaactgccatcttaccgaggccaattgcaaggatctggccgcggttctcgtcgtgtctagggagttgacacacctgtgtctggccaagaacccaatcggaaatacaggagtcaaattcctgtgcgagggacttcgatatcctgagtgcaagctccagacacttgtcctgtggaattgtgacatcactagtgacggctgttgcgatcttactaagctattgcaggagaaaagctcacttctttgcctagacctggggctaaatcacatcggcgttaaaggaatgaagtttctctgtgaagctctccggaagccattgtgcaatctccggtgtttgtggctgtgggggtgcagcattccacctttctcctgcgaggatctgtgcagcgctctgagctgtaatcagtccctagtgacgctggacctcggacagaaccccctggggagctccggagttaagatgcttttcgaaaccctcacatgtagttcagggacattgcggaccctgagactcaaaattgacgattttaacgatgaactcaataagttgctggaggaaatagaggaaaaaaacccacagttaatcattgacaccgagaaacatcatccctgggctgaacgaccgtcttctcacgactttatgatctag

SEQ ID NO: 25617 - DNA, 1899 bp, Artificial Sequence
  Description of Artificial Sequence: Synthetic coding sequence
atggacaccatgatgctgaacgtgcggaacctgttcgagcagctggtgcgcagggtggagatcctgagtgaaggtaacgaagtgcagttcatacagctggctaaggacttcgaagacttccgaaagaaatggcagagaacggaccacgagttaggaaaatacaaggatttactaatgaaagcagaaacggaacggagcgcgctcgatgtgaaactcaaacacgcccggaatcaggtggacgtggagatcaagcggcgccagcgggctgaggctgactgcgagaaactcgaaaggcagatccaattgattcgcgagatgctgatgtgtgacacttcgggcagtatccagctcagcgaggaacaaaagagtgctctggctttcttaaaccgtggacagccctcgtcttccaatgcaggcaataagcggctctctacaattgatgagtccggcagcattttgtctgatatcagcttcgataagactgatgaatcactggattgggacagcagcctggtgaagactttcaagctcaagaagagggaaaagcggaggagcacttcccggcaattcgtggacgggccacccggtcccgtcaagaaaaccagatccattggctccgccgtggaccaaggaaatgaaagcattgtcgcaaaaactacagtcactgtgcctaatgatggtgggcccatcgaggcagtatccaccatagagacagtaccctattggaccaggtctcgacgaaaaactgggacattgcaaccatggaactccgactcaactctgaactccaggcagctcgaaccacgtaccgaaacggacagcgtgggcacccctcagtccaacggcggtatgaggcttcacgatttcgttagcaaaacagtgatcaaacccgagtcctgtgtgccatgcggtaagcgaatcaagttcgggaaactgagtcttaagtgccgagactgtagagtggtgagccaccctgagtgccgagatcgctgcccgttaccctgcatccctacattgatcgggactccagtgaagatcggcgaaggaatgctcgccgacttcgttagtcagacatccccgatgatcccatccattgtagtacattgcgtgaacgagatagaacagcgtggactcactgagaccggcctgtacaggatttccggctgcgatcgaacagtcaaggaactcaaggagaagttcctgcgggtcaaaactgtaccactgttatccaaagtggacgatatccacgccatttgctctttgctaaaggattttctccggaacctgaaagaacctctcctgacctttcgcctgaacagagcctttatggaggctgcagaaatcaccgacgaagacaattcaattgctgcgatgtatcaggcggtgggagagctgccacaggcaaatcgagatacgcttgcattcttgatgatccatttgcaacgcgtagctcagtccccacatacaaagatggatgtggcgaatctggcgaaggtttttgggccaacaatcgttgctcatgctgttccaaacccagaccccgtgaccatgctccaggacatcaagcgccaaccaaaggtcgttgagcgccttttaagcttgcccttagagtattggagtcaattcatgatggtcgagcaggaaaacatcgacccgcttcacgtaatcgaaaactccaatgccttttctactccccagactcctgatattaaagtgagtttgctcgggccagtgacaacacccgagcatcagctcctgaagaccccctccagctctagcttgagtcaacgcgtgcgatcgaccctgaccaagaacacgcctaggttcggtagcaaatcaaagagcgctacgaatctcgggcgacaggggaatttctttgcctctccgatgctaaaatag

SEQ ID NO: 25618 - DNA, 189 bp, Artificial Sequence
  Description of Artificial Sequence: Synthetic coding sequence
atgagcatcagcagcgacgaggtgaacttcctggtgtaccggtacttgcaagagtctggctttagccatagcgcattcacctttggtatcgagtcccatataagtcagtctaatattaatggagcgctcgtgccccctgctgcactgatttccatcatacaaaagggcctccaatacgtggaggcctag

SEQ ID NO: 25619 - DNA, 417 bp, Artificial Sequence
  Description of Artificial Sequence: Synthetic coding sequence
atggagcccagcgcccagcagctgcagctggccgccagcctgcccgcaaatctgtcaaatttctgtcagggctcagagatgcctaccacctctcgccctgcactggatgtaaagggcggcacatccccggctaaagaggatgctaaccaagagatgtcctccgtggcttatagcaacttggccgtaaaggacaggaaggccgtggctattctgcattaccccggagtggcctccaatggaactaaagcgtctggagcccccacttcaagtagcggctcgcctattgggagtccgacaacgaccccccctacaaaaccaccttcattcaatctgcacccagccccccatctcctagcgtcgatgcacctgcagaagctgaactctcagtatcaggggatggccgcagccacaccgtag

SEQ ID NO: 25620 - DNA, 1473 bp, Artificial Sequence
  Description of Artificial Sequence: Synthetic coding sequence
atgaacggcgccctggaccacagcgaccagcccgaccccgacgccatcaaaatgttcgtgggccagattccccgctcttggtccgagaaagagcttaaggagctgttcgagccctatggcgccgtctaccaaataaatgtgctgcgggataggagccagaaccctcctcaaagtaaaggatgttgttttgtaacgttctataccaggaaagccgctcttgaggcgcagaacgcgttgcacaacattaagacccttccagggatgcaccatcctatccagatgaagcctgccgactccgagaaatcaaacgccgtggaagaccgaaaactttttatcggcatggtctcaaaaaaatgtaatgagaacgatatcagggtgatgttctcaccatttggacaaatagaggaatgtagaattttgaggggccctgacggccttagccgcgggtgtgctttcgtgactttctctacccgggctatggcacaaaacgctatcaaggcaatgcaccaatctcagactatggaaggctgctcctcgcctatagtcgtgaaattcgccgacacacagaaagacaaagaacaaaggcgcctacagcaacaactggcccagcaaatgcaacagctcaacacagcaacctgggggaacctcacgggactcggcgggttgactccccagtatctggctcttctgcaacaggctacgagcagcagcaacctcggggctttcagtggcatccagcagatggccggaatgaatgctctgcaactccagaacctggctactctggcggctgctgccgccgccgcccagaccagtgcaacaagcaccaatgccaatcctctctccaccactagctccgcattgggggctttgacaagtcccgtagcagcctctacaccaaacagcactgccggcgccgctatgaactctctcacatccctgggaactcttcagggtcttgccggagcaacagtaggcttaaataatatcaacgctctcgccgtggcacaaatgctgagcggcatggccgctctgaacggtgggctcggagcgacaggcctgacaaacggcacagcgggcacaatggatgcacttacacaggcttattccggcatccagcagtatgcagctgccgccctccccacactgtactcccagagcctgctccagcaacagagcgctgccggaagccaaaaagagggaccagagggcgccaatctatttatataccaccttccacaggaatttggcgaccaagacatcctgcagatgtttatgccttttggcaatgttatatctgccaaagtatttatcgataaacagactaatctctccaagtgctttggtttcgtcagttacgataatccggtgtccgcccaggccgctatccaggccatgaacggttttcaaatcggcatgaagcgtctaaaagttcagctgaagcggtctaaaaatgattcgaaaccgtactag

SEQ ID NO: 25621 - DNA, 357 bp, Artificial Sequence
  Description of Artificial Sequence: Synthetic coding sequence
atggccagcagcgcccgggagcacctgctgttcgtgcggcggcggaatccacagatgagatacacgctctccccggaaaacttgcagagcctggcagcgcaaagctcaatgcctgaaaatatgactttgcaaagagccaactcagacacagacctggtgacatccgagtctcggtcttccctcaccgccagtatgtacgaatacaccctcgggcaggcgcagaatctgatcatcttttgggatatcaaagaggaggtagatccatctgattggatcggtctttatcatatcgacgagaatagtccagccaacttctgggactccaagaatagaggcgtaaccggaacacaaaagtag

SEQ ID NO: 25622 - DNA, 1620 bp, Artificial Sequence
  Description of Artificial Sequence: Synthetic coding sequence
atggccaccagcgcccccctgcggagcctggaggaggaggtgacctgctccatctgtttggattacttgcgggaccctgtcaccatagactgcggccacgttttttgccgatcctgcacgactgacgtgagacccatctctggctcacgacccgtttgccccctgtgcaaaaaaccatttaaaaaagaaaacattcgacctgtgtggcagttagccagtctcgtggaaaatatcgagcgcctcaaggtcgataaaggtcgccagcctggggaagtcacccgcgaacagcaggacgccaaactgtgcgagcggcaccgagagaaactgcattactattgcgaagatgacggcaaactgctttgcgttatgtgtcgcgaatctcgagagcatcgcccccacacggctgtactgatggaaaaagccgcccaaccccatcgagaaaaaatcctgaaccacctgtccacactgcgccgcgacagagacaagatacaagggttccaagccaagggcgaggccgacatcctcgctgcattgaaaaagctgcaggaccagaggcagtacatcgtagctgagtttgagcagggacatcagttccttagagagagggaggaacatctcctggaacagttagcaaaattggagcaggagctcacggaaggcagagaaaagttcaagtctcggggagttggagaacttgccagactagccctggtgatttccgagttggaggggaaggcccagcagcccgctgcagagctcatgcaggatacacgcgactttctgaatcgataccctaggaagaaattctgggtggggaaacctatcgccagagttgtgaagaagaagaccggggagttcagtgataaattgttaagcctccagcgggggttgcgggagttccagggtaagctcctgagagatctagaatataaaactgtctcggttactctggacccacagtctgcttccggctacttgcaactatccgaggactggaaatgcgtgacctacacatccctgtacaaaagcgcttacttgcacccccagcagtttgactgtgagcccggggtgctaggatcaaagggattcacgtggggaaaggtgtattgggaagtcgaagtggagcgagaggggtggagcgaggatgaggaggagggtgacgaagaggaggaaggcgaggaagaggaggaggaggaggaagcaggatacggggacggatacgatgattgggaaactgacgaggatgaggagtccctgggggacgaggaggaggaggaagaagaggaagaggaggaggtccttgagagctgcatggtcggagtggcacgcgacagcgtgaagcgcaagggagatctctcacttaggcccgaagatggagtctgggcactcaggctgagcagtagtgggatttgggctaacacctcacctgaagccgaactgttccccgcactaagacccaggcgtgtaggcatcgctctggattatgaaggaggcaccgtgacatttacgaacgctgagagccaggagttgatatatacttttaccgccacttttacgagaagactcgtaccattcctgtggctgaaatggccaggtacgcggcttttactgagaccctag

SEQ ID NO: 25623 - DNA, 270 bp, Artificial Sequence
  Description of Artificial Sequence: Synthetic coding sequence
atgagcgagcagggcgacctgaaccaggccatcgccgaggagggcggcaccgaacaggagaccgcaaccccagagaacggcatcgtgaagtccgagagtctggatgaggaggagaagctggagctgcaacgcagactggaggcccaaaatcaggagaggcgcaagtctaaatccggggccggaaaggggaagcttacgcgcagcttagccgtatgcgaagagtcttcagccaggcccggaggggaatctcttcaagatcagacactctag

SEQ ID NO: 25624 - DNA, 909 bp, Artificial Sequence
  Description of Artificial Sequence: Synthetic coding sequence
atggtgaccgagcaggaggtggacgccatcggccagaccctggtggatcccaagcagccactacaggctaggtttcgggcactgttcactctgagaggattaggtggccctggcgctatcgcatggatcagccaggccttcgacgatgactcagccctgcttaagcacgagctcgcctattgtctaggccaaatgcaggatgcacgggctatacctatgctggtagatgtacttcaggacacacgccaggaaccaatggtcaggcatgaagcaggcgaggcccttggcgccattggcgatcccgaggttctagagattttgaagcagtattcatcagatcccgtcatcgaagtggccgagacctgccagctggccgtcagacgattggaatggcttcagcaacacggcggcgaaccagccgctggtccgtacctgtcagtcgatccagcccccccagcggaagagagagacgttggccgtctgcgtgaagcgctcctggacgaaagccggcctctgttcgagaggtatcgtgccatgtttgctctgcgaaacgccggtggcgaggaagccgccctggccctggctgagggattacactgtggcagcgctttatttcggcatgaggttggctacgtgttaggccagttgcaacacgaggccgccgtcccacagcttgctgccgcgctggcccgctgcaccgagaatcctatggtgagacacgagtgtgctgaggcactcggcgccattgcacgcccggcttgtttggctgccctccaagctcacgccgatgatccagaacgggtcgtaagagaatcttgcgaggttgctcttgatatgtatgagcatgaaactggacgggcttttcaatatgccgacggattggagcaactgcggggggctcccagctag

SEQ ID NO: 25625 - DNA, 1521 bp, Artificial Sequence
  Description of Artificial Sequence: Synthetic coding sequence
atgagcgtgctgagccccggcgacctgaagcccaagcggggcagccctcaccgcgggtccctggataggactgatgcatccacagatttggcgatgcggtcctggccaagcgagctcgggtcccgtacatgtagtacaagcgctacaacaaccgccccatctaactctacgcccattgcacggcaccctggacgtacgaaaggctacaacagcgatgataacctctgcgaaccttcgttagagtttgaagtccctaaccatcggcagtatgtttccagacctagctctttggaatcttcccggaacactagcagcaatagcagcccattgaacttgaagggttccagcgaacaactgcatgggcggtctgagtctttctcgtcagaagatttgatcccgagccgcgacctggcaacacttccgcgagaggcatcgactcctgggcgaaatgcactagggaggcatgagtaccccctgccgagaaacggaccactccctcaggagggagcgcaaaagcgcgggaccgccccaccctacgtcggtgtgcgcccttgctctgcctcaccatcatctgagatggttactcttgaggagttcctggaagaatcaaacagatctagcccgacccacgacacaccttcctgtagagatgatctgctgagcgattactttagaaaggcgtccgatcccccagcgattggcggacaacccggcccccctgctaaaaaggagggtgccaaaatgccaaccaactttgtggctcctaccgtcaagatggctgcgccaacctccgaagggcgcccattgaagccggggcaatatgttaaacccaacttcagattgaccgaggcagaggcccctccatcggtcgccccacggcaggcgcagccaccgcaaagcctcagtttaggcagacctcgccaggcaccagaggcactgggcggaagagaaaccgggtcacacacactgcaatcacccgctcctcccagctcccattcattagccagagagcgaaccccactagtcggcaaggccggatcatcctgtcaagggccagggccaaggtccagacccctggatacgcgcagattctccctggcccctccaaaagaagaaaggctcgcacccctgcatcagtccgcaacagcgccagccattgctacagctggcgccggagctgctgctgcgggatctggtagtaactcccagttgctccatttctctcccgctgccgcacctgccgctcggaccaaacccaaggcccctcccaggagcggggaggtggcaacaatcacccccgtcagagcgggactgtcactttctgagggagacggcgtgccaggacagggttgttctgaaggactccctgccaagagtccaggccggtccccagacttggcgccacacctggggagggcactcgaagattgctctcgggggtcggtcagcaagagcagtcccgcatccccagaacctgggggcgacccccagaccgtttggtacgagtacggttgtgtatag

SEQ ID NO: 25626 - DNA, 678 bp, Artificial Sequence
  Description of Artificial Sequence: Synthetic coding sequence
atggcccagaccgtgcccccctgcgagctgccctgcaaggagtacgacgtcgcccgtaacacgggtgcatacacatcgtctggactggctacggcttcatttaggacatctaaatacctcttggaggaatggttccagaattgttatgcaaggtatcaccaggcttttgctgaccgggaccagtccgagcggcaaaggcatgagagtcaacagctcgccaccgaaacccaggcgctggcccagagaactcagcaggactctacacggactgttggagaacgcctgcaagatactcacagttggaagagcgaattacaaagggagatggaggctttggcagctgagactaatctgttattagctcaaaaacagaggctggagcgcgccctggacgccacggaagtcccctttagcataacaaccgacaacctacagtgtcgggagcggagagagcatcctaatctggtccgggatcatgtggagactgaactcctgaaggccctccccccagcactgtctcagtgtttaaagaactcgtgtagcagcagaaaattaagcgccagaaacaaaggcacatgccagctcatggaaaccctaaccgttcacggcgaggccaatccaggcatagaaggacgtcgcacccgggccttggcccataaggaagtgccatctggctag

SEQ ID NO: 25627 - DNA, 309 bp, Artificial Sequence
  Description of Artificial Sequence: Synthetic coding sequence
atggccaacgacagccccgccaagagcctggtggacatcgacctgtcctccctcagagatcccgctgggattttcgagctggtagaagttgtggggaatgggacctacgggcaggtgtataaagggagacatgtgaagacaggccagcttgcagcgatcaaagtgatggacgtgacggaggatgaggaggaggagatcaaactggagatcaatatgctgaaaaagtacagtcaccacaggaatatcgccacatactacggggccttcatcaaaaagtcccctcctggacacgacgatcagctatggtag

SEQ ID NO: 25628 - DNA, 369 bp, Artificial Sequence
  Description of Artificial Sequence: Synthetic coding sequence
atggccaccagcgcccccctgcggagcctggaggaggaggtgacctgttctatttgtctagattacctgcgcgatccagttacaatagactgtgggcatgtcttttgccggtcttgcaccacagatgtaagaccgatctctggctcgagacctgtctgtcccttgtgtaagaaaccttttaagaaggagaacattagacccgtatggcagctggcgagcttagtggaaaacatcgagaggctgaaggtggataagggtcgccaaccgggcgaagtaacccgggaacagcaggatgccaagctgtgcgaacggcaccgcgaaaagttacattactattgtgaggatgacggtaaacttctgtgtgtttag

SEQ ID NO: 25629 - DNA, 312 bp, Artificial Sequence
  Description of Artificial Sequence: Synthetic coding sequence
atgagcggcggcctgctgaaggccctgcggagcgacagctacgtggaactatcccagtaccgagaccagcacttccgcggggataacgaggaacaggagaagctgctgaaaaaatcatacgccgagaatgctatgcgctacatcaatggaaccagactggatgacaggattatccgcaccgattgggacgccggttttaaggaaggacgacaatatgggcgcgggagatccggcgggcaagttagagacgagtacaggcaggattatgacgccggccgggggggctatggaaagctcgctcagaatcagtag

SEQ ID NO: 25630 - DNA, 894 bp, Artificial Sequence
  Description of Artificial Sequence: Synthetic coding sequence
atgtggcccttccccagccggagcctgttccccccccccacccaggcatggctccagaccgtttctagtgatcctgaagctcagggctggggcgcgtggaacgaaactaaggaaattctgggtcctgagggtggcgagggcaaggaggagaaggaagaggaggaggatgcagaagaagaccaggacggagacgcaggtttcctgctcagtctgcttgagcaggagaacctagctgagtgcccgctaccggatcaggaactggaagcaattaagatgaaggtttgtgcaatggagcaggctgaggggactcctcgccctcccggcgtgcagcagcaagcagaggaggaagaaggcaccgctgccggacaactgctctctccagagacggtgggctgtcctctttcaggtactcctgaagaaaaggttgaagccgaccaccggtcagtatacgtgggcaatctatgcctgcatcgcgtttgccatcaggggctgcgtgctggacgccggggcgctgggccggagcctctccctggtccaggccaccagggagccgctgagaaaaaccagttgccatgggaccagctgcatagaccaagaggccctagtaggactccccgtctgcaaggcgggacactgcccccgcagcggccccccgggcaagcgcccgcgcagacgactagagccgagcctggaccttggaaaatcctgactatggtattcaccgttctcaagggtcggccagactttgaacgaggggctggagcctggattagaagcaagcctcttgtcctgcatcccggagctggggcgggttcaggagcaggcgcccgtccggaggagaggggagtgcagagctcacactggccacctctgggaggcgggatggctcagtag

SEQ ID NO: 25631 - DNA, 1059 bp, Artificial Sequence
  Description of Artificial Sequence: Synthetic coding sequence
atggacatcgacaaggacctggaggcccccctgtacctgacccccgaaggatggagcctgtttcttcagcgatattatcaagtggtgcacgagggcgccgagttgcgacacctggacacccaggttcagcggtgcgaggacattctgcaacaactgcaggccgtagttccccaaattgacatggagggggatcgcaatatctggatagtaaaacccggggctaagtccaggggcagaggcattatgtgtatggatcacctagaggagatgcttaagttggttaacggaaatcccgtggtgatgaaagacgggaaatgggtggtgcagaaatatatcgaaagacctctgctaattttcgggactaaatttgacctcagacaatggttcctggtgacagattggaacccgctgaccgtgtggttctacagggacagttacatacgtttttcgacccaacccttctctctcaagaatcttgacaactccgttcatctctgcaacaactccatccagaaacacttggagaacagctgccacaggcatccgctgctcccacccgacaacatgtggtctagtcagagatttcaggctcatctacaagaaatgggagcaccaaacgcgtggagcaccattattgttccgggcatgaaagatgccgttattcatgccctgcagacaagccaggacacagtgcaatgtcgcaaggcttccttcgagctatatggagctgatttcgtgttcggcgaagactttcagccatggctgattgaaattaacgcctcccccaccatggcaccaagtaccgcagtcaccgcacgactgtgcgcaggggtacaagcagacaccctccgcgtcgtcattgataggatgctagacagaaattgtgatacgggcgccttcgagctcatttataagcagccagttacaactagcccagcaagcacaccacgcccgagttgtctcctacctatgtacagcgacacacgcgcccgcagttctgatgattctacagcttcttggtgggccctgcggccgtgtcgaccccaggcacgtccctag

SEQ ID NO: 25632 - DNA, 363 bp, Artificial Sequence
  Description of Artificial Sequence: Synthetic coding sequence
atggagctggacctgttcctgggcctggacgacgtgttcccccggctgcttcatgggctgctgcatcgtgctttttccgtgtttctcttcaataccgagaataagctcctgttgcagcagcgaagtgacgcgaagattaccttccctggttgctttacaaacacttgctgcagccaccctctgtcaaatcccgcggaacttgaggaatcagatgctctgggagtgcgacgtgcggcccagcggagactgaaggccgagctcggtatcccactagaggaggtgacctccagccctactcagccttacaagctgaagcccaagcataccataaaaagattcctgatcaagttcctgaacagctag

SEQ ID NO: 25633 - DNA, 339 bp, Artificial Sequence
  Description of Artificial Sequence: Synthetic coding sequence
atggaggagatccccgcccaggaggccgccggcagcccccgggtgcagttccagtcactggagacacaaagtgagtgtctcagccccgagcctcaatttgtccaggacaccgacatggaacagggactgacgggcggctttcctatctctaaaccagacggcatctcacagttggaacaagacctccaagtgttcgacctcgaaacaaagactagggaggtcctgcgggacgattgtagcgacggcgaaactcgcgaggaaaacaaactgctgatcccgaaacagaaaatctccgaagaggtccacagctacaaggtgagggtgggtcggcttaaatag

SEQ ID NO: 25634 - DNA, 1818 bp, Artificial Sequence
  Description of Artificial Sequence: Synthetic coding sequence
atgagcgagatcctgaagcagaaggacaccgagcccaccaacttcaaggtcgctgccggaacgcttgacgcctctaccaagatttacgccgttcgtgttgacgcagtgcacgcagacgtgtaccgcgtcctcgggggcctcggtaaggacgccccaagtctggaagaagtcgaggggcatgtagcagatggctcggcaaccgagatgggtacaacaaaaaaggccgtgaagcccaagaaaaagcacctacaccgcacaatcgagcagaatataaataacctcaatgtgtcggaggccgacagaaagtgcgaaattgatccaatgtttcagaaaaccgccgcgtctttcgatgagtgttcaaccgccggtgtgttcctgtctaccctccattgtcaggattaccgcagcgagctgttgtttccatcggatgtgcagactctttctactggtgagcctctcgaactgccagaactggggtgcgtcgagatgactgatctcaaggctcccttgcagcagtgcgccgaagacagacaaatctgtccttccctcgcaggatttcaatttacccagtgggactccgagactcataacgagtcagtgtcagcgctcgtggataagtttaagaaaaacgatcaggtgtttgatataaatgccgaagtcgatgagtcagattgtggggatttccccgacggctcactcggtgatgactttgacgccaacgacgagccagatcacacggcagtgggcgatcacgaagagttccgtagctggaaagaaccatgtcaggtacaatcatgtcaggaagagatgatctcgctcggtgatggagacatccgcacaatgtgcccgctactgtccatgaaaccaggggaatatagctactttagtcctaggacaatgtccatgtgggcgggacccgatcattggcggttcagaccacgtaggaaacaggacgccccatctcaatcagagaacaagaaaaagtcaaccaagaaagatttcgaaattgatttcgaggatgatatcgattttgatgtgtatttccgtaagactaaagcggccactatccttacaaagtctacgctcgaaaatcagaattggagagccactactctgcccacagatttcaattacaatgtggacactctcgtgcagctccacctcaagccagggacccgtctacttaaaatggctcaagggcatagggtagaaaccgagcactacgaggaaatcgaggactatgactataacaatcccaacgacacctccaatttttgtcccggcctgcaggctgcagacagtgatgacgaagacctagacgacctattcgtgggccccgtgggtaactccgatttgagtccctacccatgtcacccccccaaaacagcccagcagaacggcgatacaccagaagcccagggattggacatcaccacctacggggaaagtaatctggtggccgagccacagaaggtgaacaagatcgaaatccattatgcaaagacagctaaaaaaatggacatgaaaaagctgaagcaatcgatgtggtctctgttgacggctctctcagggaaagaagccgatgctgaagccaatcacagagaagccggcaaagaggcggctctcgccgaggtcgccgacgagaaaatgctcagtggactcacaaaagacctgcagcgaagcctgccaccagtgatggcccagaacctgtccattccattagcctttgcatgtctcctgcatctcgctaacgagaagaaccttaagcttgagggaaccgaagacctgagtgacgtgttagtcagacagggcgactag

SEQ ID NO: 25635 - DNA, 2253 bp, Artificial Sequence
  Description of Artificial Sequence: Synthetic coding sequence
atgagcagcagccccgtgaacgtgaagaagctgaaggtgagcgagctgaaggaagaactgaagaaacgcagactctccgataaggggctgaaggccgagcttatggaaaggctgcaggctgctctggacgatgaggaggcgggaggacgccctgcaatggagccggggaatggggacgaccagggatttcaagagggagaggatgaactgggcgacgaggaggaaggggcaggcgacgaaaatgggcacggcgagcagcagcctcagcctcctgccacccagcagcagcagccccagcagcagcgcggggccgccaaagaagctgccggcaagagcagcggcccgacatcgctgttcgccgttaccgtcgcccccccaggggcccgccagggccagcagcaagctgggggaaagaagaaagccgaaggcggcggcggcgggggaagaccgggcgctcctgccgccggggatggcaagaccgagcagaagggtggagataaaaaacggggggtaaagcgccccagagaagaccatggtcgcgggtatttcgagtacatcgaagaaaacaagtactcccgagcaaaaagcccacagcctcctgtggaggaggaggacgaacatttcgacgacactgtcgtgtgccttgatacttataattgcgacttgcactttaaaatcagtcgcgacagactgagtgcgtcctcgctgacaatggagagcttcgccttcctgtgggcggggggcagggccagctacggtgtgagtaaaggcaaggtttgtttcgaaatgaaagtcacagagaagattcccgttcgccatttgtacaccaaagacattgatatccacgaagtacgtataggctggtccttgaccaccagcggtatgcttcttggtgaggaagaattcagttacgggtactctcttaagggcattaaaacatgtaattgcgagaccgaagattatggggagaaattcgacgaaaacgacgttattacctgctttgctaacttcgagagtgatgaggttgagctttcatatgctaagaatggccaagatctcggtgtggcattcaaaataagcaaagaggtcctggccggtaggccgctgttcccccacgtcttgtgccacaactgcgccgtggagtttaattttggccaaaaagagaaaccatacttcccgatacctgaagaatataccttcattcagaacgttcctctcgaagaccgcgtccggggcccaaagggaccggaggagaagaaggattgcgaagtcgtgatgatgattggtctgccgggcgcagggaagactacatgggtaaccaaacacgccgcggagaacccgggcaaatataatatcctggggacaaatacaatcatggacaaaatgatggtggctggttttaagaagcaaatggcagacacggggaagctgaatacattgctgcagcgagctcctcaatgtctcggtaagtttattgaaattgctgcacggaagaagaggaatttcattctggaccagactaatgtgtctgctgccgcccagcggagaaagatgtgcctgttcgccgggtttcaacggaaagctgtggtcgtctgcccaaaagacgaagattataaacagcggactcagaagaaggctgaagtcgaaggcaaggacttaccagaacacgccgtgctcaagatgaagggaaacttcacgcttcctgaagtggccgagtgtttcgatgaaattacgtacgtcgagctgcagaaagaagaagctcagaaactgctggaacagtacaaagaggaatcaaagaaagcactccccccagaaaaaaaacagaacacagggtctaagaagtccaataagaataagtccggcaagaatcaatttaacagaggcgggggccataggggccgcggggggtttaatatgcggggtggaaatttccggggtggcgcacctggtaatagaggagggtataacaggagaggcaatatgccccagcggggtggtgggggcggaggcagcggcggaataggttatccctacccgcgggcacccgtgttccccggtcgtggctcgtactccaataggggcaactacaatcgtggagggatgccgaacagggggaactacaaccaaaatttcaggggacggggcaacaaccgcgggtacaagaatcaaagtcaggggtataaccagtggcagcagggtcagttttggggacagaagccttggtcccagcactatcaccaaggctattactag

SEQ ID NO: 25636 - DNA, 804 bp, Artificial Sequence
  Description of Artificial Sequence: Synthetic coding sequence
atgtgggaccagcggctggtgaagctggccctgctgcagcacctgcgggcattttatggtatcaaggtgaagggcgtgaggggacagtgcgatcggcgcaggcatgagaccgcagccacagaaattgggggcaagatcttcggtgtgccattcaatgccttgccccacagcgctgtccctgagtatggccacatcccttcctttttagtcgatgcttgcacaagcttggaagagcacatccacactgaaggtctgttcagaaagagcgggagcgttatcaggttgaaagccctcaagaataaggtcgaccatggcgaggggtgccttagctcagcaccaccctgtgatatcgctggactgctgaagcaattttttcgcgagttgccagagcctatcctgcctgcagacctgcatgaagcactacttaaggcccagcagctgggaacagaagaaaagaataaggccattttgctgctctcctgcctcctggccgaccacaccgtccacgtgttgagatacttttttaatttcctccggaatgtgtccttgaggagtagtgaaaataagatggactctagcaatctggctgtgatctttgctcctaacttactccaaaccagcgaaggccatgaaaagatgagtagtaatgccgagaaaaagggtgtgtaccagaccctatcttggaagagatatcagccatgttgggtcctgatggtgagtgtgttgttgcaccattggaaagccctgaagaaggtgaatatgaagctcttggtgaacatcagagagcgcgaagataatgtgtag

SEQ ID NO: 25637 - DNA, 600 bp, Artificial Sequence
  Description of Artificial Sequence: Synthetic coding sequence
atgccccacaagatcggcttcgtggtggtgagcagcagcggccacgaagacgggttttcggctagggaactgatgatccacgccccaacggtatccggctggcgctcaccttcatacgtttcactatgcgataacgaaaaaactggctgcaaggctagagagctgaaatctgtttacgtggacgcagtcgggcagttcctgaagcttatatttcatcagaatcacgtaaataaatacaatatttataaccaggtcgccttagtggcaattaacattattggcgaccctgctgacttctccgacgaatccaacacggcatctcgcgaaaagctcatcgatcattatctaggtcataattcagaagatccagccctggaaggaacctatgcgagaaagtctgattacataagtccactggacgacctggcctttgatatgtaccaggatccagaagtggcccagatcataaggaagctcgacgaaagaaaacgtgaggctgtgcagaaggagcggtatgactacgccaagaaattgaagcaagccattgccgatttgcagaaggtgggcgaacgcctggggagatacgaggtagagaagtag

SEQ ID NO: 25638 - DNA, 471 bp, Artificial Sequence
  Description of Artificial Sequence: Synthetic coding sequence
atgaccgaggacagccagcggaacttccggagcgtgtactacgagaaggtaggcttccgcggcgtggaagaaaaaaagagtcttgagatcctgttaaaggacgaccggttagataccgagaagctttgcaccttttcccagaggttcccccttcccagcatgtaccgcgctctggtgtggaaagtgctgttgggcattctacctcctcatcacgagtctcacgcaaaggtcatgatgtatagaaaggagcaatatttggacgtccttcatgctctgaaggtggtgagatttgtgagcgacgctactcctcaggctgaagtctaccttcgaatgtaccagctggaaagcgggaaactgcctcggtccccctccttccccctcgagcccgacgacgaggtgtttttggcaatcgctaaagctatggaagagatggtggaagactccgtcgattgctactggatcacacgttag

SEQ ID NO: 25639 - DNA, 2730 bp, Artificial Sequence
  Description of Artificial Sequence: Synthetic coding sequence
atgatccggcacgccggcgcccccgcccggggcgaccccaccggcccagtgcccgtagtggggaaaggggaagaggaggaggaagaagatggtatgcgtctgtgcctgcctgctaaccctaagaactgcctgccccacagacggggcatcagcatactggaaaaacttatcaaaacctgcccagtgtggctgcagttgtccctgggtcaagccgaggttgcccgtatcctgcaccgggttgtggcggggatgttcctcgtgcggagggattcctctagcaaacagctggtgctgtgcgtgcactttcctagcctgaatgagtcttctgcagaggtgctcgagtatactattaaagaagagaagagcatcctatatctggagggctccgccctcgtcttcgaagacatcttcaggctgatcgcattctactgcgtgagtcgggatctcctgccattcacactgcggctaccccaggccattctggaagccagcagcttcactgatctggaaacaatcgctaaccttggattgggattctgggatagtagcctcaaccccccacaagaaagaggcaaacccgctgaacctcctagagaccgcgctcccggattccctctcgtgtcgagtctgaggcccactgcccacgacgctaattgtgcatgcgagatagagctatctgtgggtaatgatagactctggttcgtgaatccgatcttcattgaagactgttccagcgcactgccaacagaccaaccccccctgggaaattgccctgccagacccctcccgcctacgtccgatgctacaagccccacctctaggtgggcccctagacgacctcccccaccaccgccagtgctaccattgcagccctgtagcccagcacagccacctccgcttcctgctaaaaagaatctacccaccgctccgcccaggcgacgcgtatctgaacgggtttcacttgaggaccagtccccagggatggcagcagagggggaccaattatcacttcccccccagggaacatctgacggcccagaggatacgcccagagaatctaccgaacagggccaggatactgaggtcaaggctagcgatcctcactctatgcccgagctgccccgtacagctaagcagcccccagttcctcccccccgcaaaaagaggatttctcgccagttagcttctacactccccgccccacttgagaatgctgaactctgtacacaggccatggcgctagagacccccacacctggccctcctagggaaggtcaatctccggccagccaggccggcacccaacatcctcctgcacaagccacagctcatagtcagtccagtccagagttcaagggtagtctggcctccctatccgactctctgggagtctcagtcatggcgaccgatcaggattcctacagtaccagtagtacagaagaggagctggaacagtttagttcaccttctgtaaagaagaaaccttccatgatcctgggtaaggccagacatcgcctgagctttgccagcttttcgtccatgttccacgccttcctatccaacaaccgcaaactttacaagaaggtcgtcgaactcgcccaggataaggggagctatttcggatctctggtgcaggactacaaagtatatagcctggagatgatggcccgtcagaccagctccaccgagatgctccaagaaatacgtaccatgatgacacagctaaaatcttatttgctccaatcgactgaactcaaagctcttgtggatccagccctgcatagcgaggaggagctcgaggcgattgtggagtccgcactctataagtgcgttctcaagccattaaaggaagcaatcaactcttgcctccatcagatccattcgaaagatggttccctgcaacagctaaaagaaaaccaactagttattctggccactacaactacagatctgggagtgactacctctgtgcccgaggtgccaatgatggagaaaatacttcaaaaattcactagcatgcataaagcttactcccctgaaaaaaagattagcattctgttaaaaacgtgtaaattgatatacgactccatggcgctgggcaatcctggcaagccgtacggcgcagatgatttcctgccggtgctgatgtatgtgctggcccgctccaacttaacagaaatgctcctgaatgtggaatacatgatggaactaatggaccccgccctgcagctgggagaagggtcttattatcttactactacatacggcgcactggaacacatcaagagttatgacaagatcaccgtgactagacaattatccgtggaggttcaggactcaattcaccgctgggagaggagaagaaccctgaataaggctcgggcgagccgctccagtgtccaggattttatctgcgtgagttacttggagcctgaacagcaggccaggacgctagccagccgcgctgacactcaggctcaagcgttgtgtgcccagtgcgccgagaagtttgctgtggagcgcccccaggcccatagactgtttgtccttgtggacgggaggtgctttcaactcgctgacgatgctctgccgcactgcattaaaggctatctgctcaggtccgagccgaaaagagacttccacttcgtttataggcccttggatggtggaggaggagggggcggagggagccccccatgcctcgtggttagggagcccaatttcctctag

SEQ ID NO: 25640 - DNA, 1728 bp, Artificial Sequence
  Description of Artificial Sequence: Synthetic coding sequence
atgagcagcgacgaggagaagtacagcctgcccgtggtgcagaacgattcgtcccgagggtcgtcagtgtcctcaaacttgcaggaggagtatgaagagttgttgcattatgcaatcgtcaccccgaacatcgaaccatgtgccagccagtcaagtcaccccaaaggagaactggtgccagacgtgcgaatctcgacaattcatgacattcttcatagccagggtaataatagcgaggttcgcgagaccgcaatcgaggtaggcaaggggtgcgacttccacatttccagccactccaaaacagacgagtcctccccggtactttctccgcgtaagccctcacatcccgtgatggacttcttcagctcccacctattggccgattcctcctcccctgctaccaatagttcacacacagacgcgcatgaaattctggtgagcgactttctcgtttcagatgagaatctgcagaagatggagaacgtgcttgacctgtggtcctccggtcttaaaacgaatatcatttcagagctgagcaagtggagattgaatttcatcgactggcataggatggaaatgaggaaggaaaaagaaaagcacgccgcccatcttaagcagctgtgtaaccagattaatgaactgaaggaacttcagaaaacattcgagatcagcatcggcagaaaagacgaggttatctcttcattatctcatgctattggtaaacagaaagagaagattgagctgatgcgaaccttcttccactggcgcatcgggcacgtccgggcccgccaagatgtttatgaggggaagctggccgaccaatactatcagcggaccctgctgaagaaggtgtggaaagtttggagaagcgtggtccagaagcagtggaaggacgttgtcgagcgggcgtgccaagcgcgtgctgaagaagtgtgcatccagatcagcaacgactacgaggcgaaagtggcaatgctgagcggagctctggaaaatgccaaggctgagatacagcgcatgcagcacgagaaggagcatttcgaagactccatgaaaaaggcattcatgagaggggtgtgcgccttaaacctggaagctatgactatattccaaaacaggaatgatgccggaattgatagcactaataacaagaaggaggaatacgggccaggagttcaaggcaaggaacattctgctcatcttgatccatccgccccccccatgcctctgcccgtgacatcccccctgctccctagccctccagccgctgtagggggcgcctctgccacagccgtacctagtgccgcaagtatgacgagcaccagagcagcctctgcgtcttccgtgcacgtgccagtaagcgccctgggagcgggctcagcggccacagccgctagtgaagagatgtatgtccctcgagtggtgacatccgcccagcagaaggccggaagaacaataactgcaagaatcacagggagatgtgacttcgcttcaaagaacaggataagctcctccctcgccatcatgggagtgtcaccccccatgagctcagtggttgtagaaaaacatcaccccgtcaccgtacagactattccccaggccacagcagccaaatacccgaggacaatacatcccgaatcaagcacctctgcctctcggtccctcggaacccgatcagcgcatacccagtcgctcaccagtgttcactcaatcaaggttgtagactag

SEQ ID NO: 25641 - DNA, 2091 bp, Artificial Sequence
  Description of Artificial Sequence: Synthetic coding sequence
atggccaactaccggaacaccagcgagatccccctggtgctggtgggcacccaagatgccatcagtagcgcaaaccccagagtgatcgacgatgcccgagctcgaaagctctccaatgatcttaagcgctgcacctattacgaaacgtgcgccacctatggtctcaatgtcgagcgcgtgttccaagatgtggctcagaaaatcgtggcaacccgtaaaaagcagcaactgtccatcggcccctgtaagtctcttccaaatagtccttctcacagctccgtctgtagcgcacaggtatccgccgtacatatttcccagacatcaaatggaggcggcagcttaagcgattacagctcttcggtcccgagcacaccctccacttcgcagaaagaacttagaatcgatgtgccccccacagccaacaccccaacacctgttaggaagcagagtaagagaaggtcaaatctcttcacgagccgcaaaggctcggatcctgacaaagagaaaaaaggccttgagagtcgggcagatagcattgggtccggcagagctattccgatcaagcaggggatgctactgaaaaggtctgggaagagcttgaataaggagtggaagaaaaaatatgtgaccctctgtgacaacggggtcctgacctaccatccatcacttcatgattacatgcaaaacgtgcacgggaaggagattgatttgctgcgaaccacagtgaaagtgccaggcaagaggccaccccgtgctacatcagcctgcgcccccattagctcaccaaagactaacggacttagtaaggatatgagtagtctccacatttctcctaattcgggcaacgtaacaagcgcatctgggtcacaaatggcatcggggataagcctggtctcttttaacagtcgcccagatggcatgcatcagcgatcttattctgtttcatctgccgatcagtggtctgaagccaccgttattgccaacagtgctatctctagtgacacaggcttaggtgactcagtttgttcaagtccatccatttcaagcacaaccagtcccaagctcgaccccccaccttccccccatgcaaatcgcaagaagcacaggcggaagaagagcaccagcaacttcaaagccgatggattgagtggcacggctgaagagcaggaggagaactttgagttcattattgtatcgctcacaggccagacctggcacttcgaggcaacaacctatgaagagcgtgatgcctgggtgcaggcgatcgaaagccagatcttggcatcgcttcaatcttgcgaatcaagcaagaacaaatcgcgcctcacttcccaaagtgaagccatggccttgcagtctataaggaacatgcgagggaatagccactgcgtggattgcgaaacacagaatccaaactgggcctcactcaacttaggcgcactaatgtgcatcgagtgcagcggcattcatcgaaacctcggaacccatttgagccgggtgaggtctctggatctggacgattggccagttgagctgattaaggtgatgagctctatcggcaatgagctggcaaatagcgtctgggaagagtcatcacaaggcagaacgaagccctccgttgattctactagggaagaaaaggagagatggatcagggcaaagtatgaacagaaactgtttctcgccccactgccttgcactgagctgtcccttggtcaacacctgctgagagccactgctgacgaagatcttagaaccgctatactgttgctggcccacgggtcgagggacgaggtgaacgaaacctgcggtgagggggacggtcggaccgccctgcatttggcctgcaggaagggaaacgtggttctagctcagctcctcatttggtatggggtagatgtgacagcacgcgacgcacatggaaacactgccctggcctacgcaagacaggccagcagccaggaatgcattgacgtactgttgcagtacggctgccccgacgaacggttcgtgcttatggcaaccccaaatctgtccagacggaacaataaccgcaataacagctctggtcgggtgcctacgatcatctag

SEQ ID NO: 25642 - DNA, 270 bp, Artificial Sequence
  Description of Artificial Sequence: Synthetic coding sequence
atgagcgagcagggcgacctgaaccaggccatcgccgaggagggcggcaccgaacaggagactgcaactccggagaacgggattgtgaagtctgagagtctggatgaggaggagaagctcgaactgcagaggcggcttgaggcccaaaatcaggagcgccgcaaatctaaaagcggagccggaaaagggaaacttacgcgctctctcgccgtgtgcgaggaatcctcagctcgccctggcggagaatccttgcaggatcagacactatag

SEQ ID NO: 25643 - DNA, 1785 bp, Artificial Sequence
  Description of Artificial Sequence: Synthetic coding sequence
atgaccgacacccggcggcgggtgaaggtgtacaccctgaacgaggataggcagtgggatgatcggggtaccggccacgtgagtagtggatatgtcgagaggctcaagggcatgtctctgctggtccgggccgagagtgatggttctcttctgttagagagcaaaattaaccctaatacagcataccagaagcagcaggaagatgagaaattcctgacggatttgttcgcccagctgacagatgaagcaaccgacgaagagaaaagacaggaactcgtcaacttcttgaaggagttctgtgcattctcacagacactccagccccagaatcgcgacgcctttttcaagacattgtctaatatgggaatattgcccgctctggaagtgatcttaggaatggacgatacgcaggtcagatctgctgctacagacatcttttcttacctggtcgagtacaacccatctatggtgagggaatttgtgatgcaagaggcccagcagaatgacgacgtgtcgaagaaacttaccgagcagaagatcaccagcaaagacattttgctaataaatttgattatcgaacacatgatctgcgacactgatcctgaacttgggggcgcagttcagctcatgggccttctgcggaccctcgtggacccggagaacatgctggctactgcgaataagacagaaaaaactgagttcctaggcttcttctacaaacactgcatgcatgtcctcacagctccactcctggcgaatactaccgaggacaagccgtctaaggatgactttcagactgcccagctgctggctctggtcttggaactgttgactttttgcgtggaacaccacacttaccatatcaagaactatattattaacaaagacatattgcggcgggtgctggtcctcatggcctccaagcacgcctttctggctctgtgtgcgctccggttcaaacggaaaatcattgggctgaaagatgaattttataatcggtatattatgaaaagttttctttttgaaccggttgttaaagctttcctcaacaacggatcccgatataatctgatgaactctgctattatagaaatgttcgagtttatcagggtagaagacatcaagtctctcaccgcacacgtcatcgaaaactactggaaggcgctggaggatgttgattatgttcagacatttaaaggactaaagctccgttttgagcagcagagagagcgccaggataacccaaagctggactccatgagatctatcctgcggaatcatcggtataggcgggatgctcgtacactggaagatgaggaggagatgtggttcaacaccgacgaggacgatatggaggacggcgaggccgtggtaagtccaagtgacaagacaaagaatgatgacgatatcatggatcccatcagtaaattcatggagcgcaagaaattaaaagaatcagaggaaaaggaggttctcctgaaaacaaatttgtctggaaggcagagtcccagcttcaagttgtctctgtctagcggcacaaagaccaatctcacctcacagagttcgactacgaatctacctggatcccctggctccccaggtagtccggggagtcctggttcaccgggatcagtgcccaaaaacacaagtcagactgctgccatcacaactaagggtggtctcgtgggtctggtggattaccctgatgatgacgaggacgatgatgaggatgaggataaagaggacacgcttcctctgtcgaaaaaggctaaatttgattcttag

SEQ ID NO: 25644 - DNA, 522 bp, Artificial Sequence
  Description of Artificial Sequence: Synthetic coding sequence
atgttcaccgagggcgaggagatgtacctgcagggcagcaccgtgtggcatcctgattgcaagcagagtacaaagaccgaggaaaagcttagacccaccagaacatctagtgagtctatctacagccgtccagggtctagcatacccggctcccctggccatacgatctacgccaaggttgacaatgaaatcctggattataaggacctggccgcaataccgaaagtcaaggctatatacgatattgagcggccagatctgattacctacgagcctttttacaccagcggctatgatgataaacaggaaagacaatcgctgggggaatctcccagaaccctgtcaccaaccccgagcgccgaagggtaccaagacgtgagagacagaatgattcatcgcagtacaagtcagggcagtatcaacagtccggtctactcaaggcacagttacacacccacaacaagtcgttctcctcaacattttcatcgtccggatcagggtattaatatttacagaaaatag

SEQ ID NO: 25645 - DNA, 1620 bp, Artificial Sequence
  Description of Artificial Sequence: Synthetic coding sequence
atggccaccagcgcccccctgcggagcctggaggaggaggtgacctgttcaatctgcctagattatctccgggacccagtcacgattgactgcggtcacgtgttctgtcgttcctgtactaccgatgtgcgtcccataagcggatcgagacccgtgtgtccgctatgcaaaaaacctttcaagaaagaaaatatcaggcccgtgtggcagcttgcatcactggtagagaacatagaacgccttaaggttgacaagggacggcaacccggagaagtgacacgcgagcagcaggacgcaaaactctgcgagcgccatagagagaagctgcattattattgtgaggatgacggcaaactgctgtgcgtaatgtgcagggagagccgggagcatcgcccccatactgccgtgcttatggagaaggctgctcaaccgcaccgggagaagattttaaaccacctgtccacgctaagaagagaccgggacaagatccaaggttttcaggccaaaggagaggctgacatcctggctgccctcaaaaagctccaggaccagcggcagtatatcgtagcggagttcgaacagggccatcagttcctcagggaaagggaggagcatttgttggaacaattagctaagttggaacaggagctcacagaggggcgcgagaagttcaagagccgtggagtgggcgaattagcccgccttgccctggtgattagcgagctcgagggaaaggcgcaacaaccagcagccgagctgatgcaggacactagggattttctgaacagatacccaaggaaaaaattttgggttggtaagccaatagcgcgggtggtcaagaaaaagaccggtgaattctccgataaactgttatctttacagagagggcttcgggaattccaaggaaaactccttagagacttggagtacaaaacggtgagcgtcactctcgacccacaatcagccagtgggtatctgcagctcagcgaggactggaagtgtgtgacctataccagcctctataagagtgcttatctgcacccccagcagttcgactgtgagcccggggtcttaggtagtaagggtttcacatggggcaaggtgtactgggaggtggaggtggaaagagaggggtggagtgaagatgaagaagagggggacgaggaggaggaaggcgaagaagaggaggaggaggaagaggccgggtatggggacggctatgacgattgggagaccgacgaagacgaagagagcctcggcgacgaggaggaggaagaagaggaagaggaggaggaagtcctggagtcatgtatggttggcgttgcgcgcgacagcgtgaagaggaagggagatctgagcctcaggcctgaggatggcgtttgggctcttagactgtcctccagtgggatttgggcaaatactagcccagaggccgagctcttcccggccctgagaccacgaagagttgggatcgcacttgactatgaaggaggaaccgtcacttttactaatgccgaatcccaggagctgatttatacttttaccgctacattcactaggcggctggtacccttcctgtggctgaaatggcccggcactaggttactgttgcgaccttag

SEQ ID NO: 25646 - DNA, 2112 bp, Artificial Sequence
  Description of Artificial Sequence: Synthetic coding sequence
atgttccggtacgagagcctggaggactgccccctggacgaggacgaggacgcttttcaagggcttggcgaagaagacgaggagatagaccagttcaatgacgacaccttcggttctggggctgtagatgacgactggcaggaggctcatgagagactggccgagctggaagagaagctcccagtagcggtcaacgaacaaaccgggaatggggaaagagacgaaatggacttgctcggagatcacgaggaaaacctcgccgagagactttcaaagatggtgatagaaaatgaactcgaagatcctgcaatcatgcgggcggttcaaactcgacctgtgctgcagccacaaccaggtagcctgaattcaagtatctgggatggatccgaggttcttcgacggattaggggccctctactggcacaggaaatgccgacagtgtccgtgctggaatatgctctgcctcagaggcctccccagggacctgaggacgacagagatctgagcgagcgagctctgccccgacgaagcacctctccaataatcgggtcgccaccggtgcgggcagtacccattgggactccacctaaacagatggccgttccttcatttactcagcagatcttatgcccgaagcccgttcacgtccgaccacccatgcctccaagataccctgcaccgtacggagagcggatgtcaccaaatcagctgtgtagcgtgcccctgcagccaggacggatgtccccgtcacaatttgcgcgcgtccctgggtttgtggggagtccgctcgccgcaatgaacccaaaactgctgcagggaagagtaggacaaatgctgccccctgcccccggcttccgcgcattcttttccgcaccgccatcagctacaccccctcctcaacagcaccccccaggccctggcccacacctgcagaacctgagatcccaggcccccatgttccgccccgataccacccacctgcatccacagcaccgaaggctcctccaccagaggcagcagcagaataggtcacaacaccggaacctgaacggggcgggtgatcgtggaagccaccggtcatcgcatcaggaccacctgcgaaaagacccctacgccaacctcatgctgcagagggaaaaggattgggtctccaaaattcagatgatgcaactccagagcaccgatccttatctggatgacttttactatcagaactatttcgaaaaactggagaaactgtccgcggctgaggaaatccaaggcgatggaccaaaaaaagaacgcaccaaacttatcaccccccaggtggccaaattagaacatgcgtacaaaccagtacagttcgaaggatctctgggcaagctgactgtctctagcgttaataatccaagaaagatgattgacgctgttgtgacatcgcgatcggaggacgacgagactaaggagaaacaggttcgtgacaagcgccgaaagaccctcgtcattattgagaagacatatagtctgctactggacgttgaagattatgagaggcgctacctgctgagcttggaggaggagagacctgccttgatggatgatcggaaacataaaatttgcagtatgtacgataaccttagaggcaagctccccgggcaagaaagaccctccgacgaccactttgtccaaataatgtgtatcaggaaggggaaaaggatggttgccaggattctgccatttctctccactgagcaggccgctgacatactcatgaccacggccaggaatctgccattcctgatcaagaaagacgcacaggacgaagtgctcccttgtctcctttcaccttttagtttgctcctgtatcacctaccatctgtgagtatcacctcactgctcagacagcttatgaacctgcccagctccgatcccgcaaccgaaagtacacagaacaatcagtggaccgaagtgatgttcatggctacaagggaactgctgaggatcccccaagctgctctggctaaacctatatcaattcctacaaacttggtatctctcttcagccgctatgttgacaggcagaagctcaatctgcttgaaacgaagttgcagctggtgcaaggcatccggtag

SEQ ID NO: 25647 - DNA, 957 bp, Artificial Sequence
  Description of Artificial Sequence: Synthetic coding sequence
atgagcgcccacaaccggggcaccgagctggacctgagctggatctcgaaaatccaggttaaccatcccgccgtccttagacgggctgagcagattcaagcacgtcgcaccgtgaaaaaggaatggcaagccgcatggctcttgaaagccgttactttcatcgacctaaccacgctgtcaggcgatgacacaagttctaatatccagagactatgttacaaagccaagtaccctatccgggaagaccttttaaaggctcttaacatgcacgataagggtatcaccaccgctgccgtttgcgtctatcctgcaagagtgtgtgatgctgttaaagcccttaaagcagccggatgtaatataccagtggcttcagtcgctgctggcttccctgctggacagactcacctgaagactcgtttagaggaaatccgactcgccgtagaggatggagctactgagatcgacgttgtcatcaaccgctcactggtgctgacagggcagtgggaggccttgtacgatgagatcaggcaattcaggaaagcatgtggggaggcccacctcaagacaattctggctaccggggagcttgggacgttgactaacgtgtataaggctagcatgatcgcaatgatggccggctcagattttataaagacgagcaccggcaaggaaacggtgaatgcaacttttcctgttgctatcgtgatgttgcgtgccattcgtgattttttctggaagactggaaataagatcggctttaaacctgcgggaggcattaggagcgctaaagattctttggcctggttatccttagtgaaagaagagctgggagacgagtggttgaaaccagaactcttcagaattggggcgtccaccctgctgagcgacatagagcgtcagatttaccatcatgtgaccgggcgatacgccgcttaccacgatctccccatgtcgtag

SEQ ID NO: 25648 - DNA, 1188 bp, Artificial Sequence
  Description of Artificial Sequence: Synthetic coding sequence
atggccagcgccgccagcgtgaccagcctggccgacgaggtgaactgtcctatttgccagggcacattgagggagcccgttaccatcgactgtggacacaacttctgtagagcctgtcttacacggtactgtgaaatcccaggtcctgacctggaggagtctcctacctgtcctctctgtaaagagccattcagaccggggtcatttaggcctaattggcaattggccaacgttgtcgagaacattgaaagacttcagctggtgtcaacccttgggctcggggaagaagatgtttgccaggagcacggggaaaagatttacttcttttgcgaggacgacgagatgcagctatgtgtggtgtgtagagaagctggggaacacgctactcatacgatgagattcctggaagacgctgccgccccttaccgtgagcagattcataaatgtttaaagtgccttcgcaaagaacgtgaagagattcaggagatacaaagtagagaaaacaagaggatgcaggtcctcctgacacaggtatccacgaaacgccaacaggtcatctccgagtttgcccatttgagaaaattcctggaagaacagcagtcaatccttcttgcccagctggaaagtcaggacggagatatactccgtcaacgagatgagtttgacttgctggtggccggggaaatttgtcgtttcagcgcgttaatcgaggagctggaggagaagaatgagcggcccgccagagagctgttgaccgacataagatcaacactaatccgttgcgaaactaggaagtgccgcaaacctgtggccgtctcaccggaactgggtcaaaggataagagatttcccccaacaggctctcccactccagagggaaatgaagatgttcctcgagaaactgtgtttcgagctggattatgagccagcacacatatctctcgacccccagacctctcatcctaaacttttgctcagcgaagatcaccagcgtgcccagtttagttacaaatggcagaatagtccggacaatccgcagcggtttgatcgggcaacttgtgtcctggcccataccggcattactgggggtcgccacacttgggtctggatggcgagggtgccaggcgactcggggtgctgccagttctgcagtcctccatctgtcctcggaactgaggtggcagcgtag

SEQ ID NO: 25649 - DNA, 3288 bp, Artificial Sequence
  Description of Artificial Sequence: Synthetic coding sequence
atggccgagggcgccgccggccgggaggaccccgccccccccgacgcagctggtggagaggacgaccctagagttggacccgacgcggcgggagactgtgtcaccgccgctagtggcggtcgtatgcgggacaggcggtcaggtgttgctcttcccggtgccgcgggaacccctgccgattcagaggctggtctcctcgaggctgccagagctacccccaggcggagctctatcatcaaggatccatcgaaccagaaatgtggaggcagaaaaaaaacggtgagtttttcatcaatgccatctgagaagaagatctcttccgccaatgactgcatttctttcatgcaggctggttgcgaattaaaaaaggtccgacccaactctcgtatttataacaggttcttcacactggacacagatttacaggcactgcggtgggagccgagcaagaaagatttagagaaggccaaattagacatttcagcaattaaagaaattcggctagggaaaaataccgaaacctttcgcaataatggattggctgatcaaatctgtgaagattgcgctttctctatccttcatggcgaaaattacgaaagcctagatcttgtcgccaactccgcagacgtggccaatatttgggtctctggtctgagatatctagtgagcaggtctaaacagcccctcgatttcatggaaggaaatcagaacactccccggttcatgtggctaaagaccgttttcgaggctgctgatgtggacggaaatggcatcatgttggaggatacgtcagtcgaacttatcaaacaactgaatcctacactgaaggaagccaaaatcaggttaaaattcaaggagatacaaaaaagtaaagagaagctgacaacacgggtgactgaagaagaattttgtgaggctttttgtgaactctgcactcggcccgaagtctatttcctgttagtgcagatcagcaaaaacaaagagtacctggatgctaatgatttgatgttgttcctcgaagcggagcagggagtcactcatataacagaggatatttgccttgacatcattcgaaggtatgagctgtccgaggagggtcgacagaagggattcttggcaatagatggtttcacgcagtacctgttgtcatctgaatgcgatatcttcgaccccgagcagaagaaagtggcccaggacatgacacagcccctgtcccactactacatcaatgcatcccacaatacgtatctcattgaggaccagttcagaggacccgccgacatcaatggctatatacgggctctcaagatgggctgtcggagcgtggagcttgacgtgagcgacgggtctgacaatgagccaatcctgtgtaaccggaacaatatgaccacacacgtctctttccgatcggtcattgaggtcatcaacaagtttgcttttgtcgcctcggagtaccccttgatcctctgcctgggaaaccactgcagcctccctcaacagaaagtgatggctcagcagatgaagaaagtgtttggcaacaagctgtacaccgaagccccactgccttctgaaagttacctgccaagtcctgaaaagctgaagcggatgattatcgttaaaggcaagaaactaccaagtgaccccgatgtcctggagggcgaagtcaccgacgaagacgaggaagcagaaatgtcacgtagaatgtcagtggactataacggcgaacagaaacagatccgtctctgccgggagctaagtgatttggtatccatttgcaaaagtgtccagtatcgtgacttcgaactgtccatgaaatcacagaattattgggagatgtgttccttctctgagaccgaagcctcacgcatagcaaacgaataccccgaagattttgtcaattataacaagaagttcctctctcggatatacccttctgccatgcgtattgattcttccaacctgaacccccaagatttctggaattgcgggtgccaaatcgtggccatgaattttcaaaccccaggccctatgatggacctgcatacaggatggtttttacaaaacggcggatgcggttacgtgctgagacccagtataatgagagacgaggtcagttacttttccgctaataccaagggcatactgcccggagtaagcccgttagcactacacataaaaattatctccggccagaatttccccaaaccaaagggagcttgtgcaaagggggatgtcatcgatccttatgtgtgtatcgaaattcatggcatacccgccgactgttcagagcagcggactaagacagtccagcaaaacagtgataaccctatttttgatgaaaccttcgagtttcaagttaatctcccagagctggccatgatcagatttgtcgtgctggatgatgattacatcggcgatgagtttataggccagtatacaatcccgttcgagtgtcttcagcccggctaccgccacgtgcctctccgatctttcgtgggagacattatggaacacgttaccctgttcgtacacattgctattacaaacagatctggcggcggcaaggctcaaaaaaggtctctcagcgttagaatgggcaagaaagtgagggagtacacaatgctgcgcaatattgggctgaagactatcgacgatatttttaaaatcgctgtccacccgcttcgcgaagcgatagatatgcgggagaacatgcagaatgccattgtgtctattaaggaactctgtggattgcctcctatagcctctttaaagcagtgtcttctaacccttagttcacgcctcattacttcagacaacactccgagcgtgagcctggtgatgaaggactctttcccctacctggagccactcggcgctatccccgacgtgcagaagaagatgctgaccgcatatgatttgatgattcaggagagcagattcctcatcgaaatggctgacaccgtgcaggagaaaatagtccaatgtcagaaggccggaatggaatttcacgaagagctgcacaacctgggcgcaaaagaaggcctgaaggggcgcaagctgaacaaagccacagaaagttttgcttggaacattactgtcctcaagggccagggagacctcctgaagaatgcgaagaacgaggcgattgagaacatgaagcaaattcagctcgcttgccttagttgcgggcttagcaaagccccatcgtcatccgctgaagcgaagagcaaaagaagcctggaagcaatcgaggagaaagaatctagcgaagaaaatggtaagctgtag

SEQ ID NO: 25650 - DNA, 543 bp, Artificial Sequence
  Description of Artificial Sequence: Synthetic coding sequence
atggagcagcccaagggcgtggactggaccgtgatcatcctgacctgtcaatataaggatagcgtgcaggtgtttcagcgagagcttgaagtgagacaaaaaagagagcaaatccccgcggggacgcttttgctggccgtggaagatcctgagaagcgggtgggcagtggcggcgctaccctgaatgcattgttagtcgccgccgagcacctctccgctcgcgccggctttaccggtcgcgatttcccctttgatgattgcggtagggccttcacatgtttgcccgtggaaaatcccgaagccccggtcgaggcacttgtgtgtaatctggactgcctgctcgatatcatgacctacagactgggtccgggatccccacctggagtttgggtttgttccacagacatgctgctgtcagtcccggccaatccaggcgaaccggagacaacttgggactgtttgccttcctctcagcctcagcaggaagcgagctccgccctgttagcgcatccagcaagtgggccagcaccactaccctactag

SEQ ID NO: 25651 - DNA, 429 bp, Artificial Sequence
  Description of Artificial Sequence: Synthetic coding sequence
atgaacgaggtggtgcacaccagccccaccatcggcagcaacgtggaagaaatagttattaacaatacccggttcctgatgtgggacattggcgggcaggaatcgctgcggtcaagctggaacacttactacacgaacacggagtttgtgattgtggtggtggatagcaccgaccgggagcggataagcgtcacacgcgaagagctgtacaaaatgctcgctcacgaggacctgcggaaggcagggttgctcatattcgccaacaaacaggacgtcaaggagtgcatgactgtcgcagagatctcacaatttctgaaactcacttccattaaggatcaccagtggcatattcaggcatgctgcgcactcacgggagagggactgtgccagggactcgaatggatgatgagtagactgaaaatccggtag

SEQ ID NO: 25652 - DNA, 342 bp, Artificial Sequence
  Description of Artificial Sequence: Synthetic coding sequence
atggagggcgtgctgtacaagtggaccaactacctgagcggctggcagcctcgatggttcctactctgtggaggcatcttatcatactatgacagccctgaagacgcctggaaaggatgcaaggggagtattcagatggcagtgtgtgaaatccaggtgcattcagtggataataccagaatggatctcattatccctggggaacagtatttttacctcaaggcaaggagtgtggcagagcggcagcgttggctggtcgctctgggatcagctaaggcatgtcttactgatagtcgcactcagaaggagaagggtaatctgctgaagacactgaagacatag

SEQ ID NO: 25653 - DNA, 1119 bp, Artificial Sequence
  Description of Artificial Sequence: Synthetic coding sequence
atggccagcaaccacaagagcagcgccgcccggcccgtgagccggggtggagtgggtctgaccggacggccaccaagtggaatccgtccactgtcagggaacatcagggttgccaccgcaatgccccctggtacagcgcgccccggatcgagagggtgtcccatcggcaccggtggagtgctgagctcgcagattaaggtggcgcacaggccagtgactcagcagggcttgactggcatgaaaacgggcacaaagggaccacagagacagattcttgacaaaagctattatctgggcctactgcgatctaagatctccgagctgacaacagaagtgaacaaactccagaaaggcattgaaatgtacaaccaggagaactccgtgtacctgtcgtatgagaagagagcagaaactctagccgtcgaaattaaggagctgcaggggcagctggctgactataacatgttagttgataagttaaacacgaatacggagatggaggaggtaatgaatgactacaacatgctaaaagctcaaaacgatcgcgagacccaatctctggatgtcatcttcacggaaaggcaggccaaggaaaaacagatccgcagcgttgaggaagaaatcgaacaggagaaacaggccaccgatgatataatcaaaaacatgagtttcgagaaccaggtcaagtatctggagatgaagacaacgaacgaaaagctgctgcaagaactggataccctgcagcaacagctcgacagccagaatatgaaaaaagaaagtctggaagcagagatcgcccacagtcaggtgaagcaggaggcagtgcttctgcatgagaagctttacgagctcgagtcacacagggaccaaatgatcgcggaagacaagagcatcggctcaccaatggaagaaagagaaaagttactcaagcaaataaaggatgacaaccaggagatcgcctctatggaacgccagcttacagatactaaggagaagattaatcagttcatcgaggagattcgacagctggatatggatctcgaggaacaccaagaccctacaaactacggatggaaaatcctcgagaagaacacggggagtttcaaaaagcaggtttag

SEQ ID NO: 25654 - DNA, 345 bp, Artificial Sequence
  Description of Artificial Sequence: Synthetic coding sequence
atgtggagcctgaccgccagcgagggcgagagcaccaccgcccacttttttttaggagctggtgatgaagggcttgggacgaggggaattggaatgcgaccagaggagtctgactctgaactcctggaggatgaggaagatgaggtcccccctgaacctcagattatcgtcggtatctgtgcgatgaccaaaaaaagcaaatcaaagccgatgacccagatactggagagactgtgcagattcgattacctcacagtggtgatattgggggaggacgtgatcttaaatgagccagtggaaaactggccaagctgtcactgcttaataagctttcattcaaaatag

SEQ ID NO: 25655 - DNA, 327 bp, Artificial Sequence
  Description of Artificial Sequence: Synthetic coding sequence
atggccatggcccccagccccagcctggtgcaggtgtacaccagcccggcggcggtagccgtttgggaatggcaggatggtctcgggacctggcacccctacagtgcaacagtgtgctctttcatcgaacagcagttcgtgcagcagaaaggtcaaagattcggactgggctctctggcccacagtatacccctcggccaggcagacccttctctggctccctacattattgatcttccatcctggacacaattcaggcaggatactgggactatgcgggcggtccggagacacctgttcccacagcacagtgcccctgggcgatag

SEQ ID NO: 25656 - DNA, 549 bp, Artificial Sequence
  Description of Artificial Sequence: Synthetic coding sequence
atgcgggagtgcatcagcatccacgtgggccaggccggcgtgcagatagggaatgcttgctgggagctatactgcttagagcatggaatacagcctgacgggcaaatgccctcagacaagaccattggtggcggggatgattctttcaacacctttttctccgaaactggagctggtaaacatgttccgagggcagtctttgttgacctcgaacctactgtcatagactggtgcccaactgggttcaaagtggggatcaactaccaacctccaacagtcgtcccgggcggagatctggctaaggtgcaacgggcagtctgtatgttgtccaacacaaccgccatcgccgaagcctgggccagactagaccataagtttgatctgatgtacgccaaaagggcctttgtacattggtatgtcggcgaaggcatggaggaaggagaatttagcgaggctcgggaagacatggctgctcttgaaaaagactacgaggaggtgggggtcgactctgtggagggggaaggcgaagaggaaggcgaggagtactag

SEQ ID NO: 25657 - DNA, 483 bp, Artificial Sequence
  Description of Artificial Sequence: Synthetic coding sequence
atggaggccgagcggccccaggaggaggaggacggcgagcagggccctccccaggacgaggagggctggccaccaccgaacagcacgacccggccctggagaagtgcaccccctagcccacccccacccggtacccgtcacactgccctggggcctagatctgcatccctactgagcctccagaccgaactgctgttggacttggtggcggaggcccagagtcgccgtctggaggaacagagagctaccttttacactccacagaatccttcctctctagctccagcccctcttagaccgctcgaagaccgcgagcagctttattccactatcctgtcccatcaatgccagcgcatggaagcacagcgaagcgaacccccattgccacctggcggacaggaactgctggaactgctgctgagggttcaaggtggaggccgtatggaggagcaacggtctcgacctcctacacacacctgttag

SEQ ID NO: 25658 - DNA, 3483 bp, Artificial Sequence
  Description of Artificial Sequence: Synthetic coding sequence
atggcctgccggcggcggtacttcgtggagggcgaggcccccagcagtgagacaggcacctctctggactcaccctccgcctacccccagggccccctggtgcctgggagctcactgagccccgaccactatgagcacacatctgtcggagcctacggcctctacagcggaccaccaggccagcagcagaggactcggcgtcccaagcttcagcatagtactagtatcctccggaaacaggccgaagaggaagccattaagaggtccaggagcctatcagaatcttacgaactctcaagtgatctgcaggacaaacaggtggagatgctggaacgcaagtacggggggaggctggtgaccaggcacgccgcgagaacaatccagaccgctttccgccagtatcagatgaacaagaactttgaacgtctccgctcttccatgtcagagaaccgcatgtcccggcgcatcgtactaagtaacatgcggatgcaattctccttcgagggaccggagaaagtccatagtagctatttcgagggcaagcaagtatcagtgacgaatgatggctcccagttgggcgctcttgtgtcccctgagtgcggagacctttccgaacctaccactttgaaaagcccagcgccaagttccgactttgcagacgccattacggaattagaagacgccttctcaaggcaggtcaaatcccttgccgaatccattgacgatgccttgaactgtcgctctctacacacagaagaggctcctgctctggacgcagcccgagcccgtgatactgagcctcagaccgcgctgcatggtatggatcatcgtaagctcgatgaaatgactgcctcctatagtgacgtaactctgtacatcgacgaggaggagctcagccccccacttcctctatcccaggccggtgaccggccaagttcaaccgaaagcgacctgcgactgagggctggcggcgcagccccagactattgggcactagcacacaaagaagacaaggccgacacagatacatcttgccgatcaactccttccctcgaaaggcaggagcaacggcttagagtcgagcaccttcctctcctgacaatagaaccaccttcagattcaagtgtggacctcagtgacagaagcgaaaggggttcgctcaagcgccagagcgcgtacgaaagatctctgggaggccagcagggttctcctaaacatggccctcactctggtgccccaaagtcccttccacgcgaagaaccagagctgagacctcggccaccacggcccctggattctcatctggctatcaatggttctgccaatcgacagagtaaatccgaaagcgattacagtgacggtgataacgattccattaatagcaccagcaatagcaatgacactatcaactgctcttccgagtccagctcaagagactctctgagagaacaaactttgagcaagcaaacctaccataaggaggctagaaacagttgggacagtcccgccttttctaacgatgtgatccgtaaacggcattaccgcatcgggctgaacttgttcaataaaaaaccagaaaaaggagttcagtatctcattgagaggggctttgtgccagacacaccagttggcgtcgctcactttcttctccagcgaaaaggcctctcaagacaaatgattggagaattcttaggcaataggcagaaacaatttaatcgggacgtactggactgcgtggtggacgaaatggatttctccacaatggagctcgacgaagcactgcggaagtttcaggcccatattcgcgtccagggtgaggctcagaaagtcgagaggctgatcgaagcctttagccaacgttattgcatttgcaaccccggagtagtcagacagttcagaaaccctgatactatcttcatcctggcctttgctatcatcctgctaaacactgatatgtatagccccaatgtcaaacccgagagaaaaatgaagctcgaagacttcattaagaatcttagaggcgtcgatgatggcgaggacatcccccgagaaatgcttatggggatatatgagagaatacggaagagggagcttaaaactaacgaggaccacgtgtctcaggtgcagaaggtcgagaagctcatcgtcggaaaaaaacctataggctctctgcacccagggctcggttgcgtgctgtctcttccccacaggaggcttgtatgttactgtagactgttcgaggtgcctgatccgaataaaccgcagaagctcggcttgcaccagcgggaaatcttcctattcaatgatctcctggtagtgaccaaaatctttcagaagaaaaagaatagtgttacctatagtttccgacaatcctttagcctttatggtatgcaggttctccttttcgagaaccagtactatccaaatggcatccggcttactagttccgtacccggcgccgatatcaaagttctgattaatttcaacgcccccaacccacaggacagaaaaaagtttaccgacgacctgcgcgagtctatcgcggaagttcaggaaatggaaaaacaccggatagaaagcgagctggagaaacagaagggggtggtgcggccatcgatgtcccaatgcagctctttaaagaaagagtccggaaacggaactctgtcacgggcatgtcttgatgactcatacgcttccggcgaaggcttaaaaaggagcgctctatccagctctcttcgtgatttgtcagaggccggcaaacgtggccggcgctcaagcgccggctctctcgaatcgaacgtggagggctcgattatatcctctccccacatgcgaaggcgcgcaacctcaaccagggaatgcccttctcgccctcatcaaacaatgcctaacagcagctcattgctcgggagtctgtttggctccaagaggggcaagcccccaccacaggcgcatctgccatccgctcctgctttagcaacaccgccaccaacaggtggtccggccagccttgctgccctgtgcggctggcctccgcccggagcccctcggggagccgccgccggcaggcacgcgcgggcatcacacccagtcctgccccacgcagaaccctcacccgttcccccatcaccacctccaccgcccactcctgctcatcccgctagaacacctgtgccccctagaccgccctggggtcctccctctttgcggggcccctgtccacgccctccagctgcggcactggggccccggggagcacattcagcccctccatgggcagccccgtgcccagcagccccccaccaacagcagggtcagacacagagacatcagcataactgcgtcgattcactgggcaggggacctcgtctgccggaaacccccgctcatcatactggacacgcccgaggaagtcctgctgcgcatcaaacccggggaacatcagtggccatcagtccgctgtgtccttcgaggccaaactag

SEQ ID NO: 25659 - DNA, 378 bp, Artificial Sequence
  Description of Artificial Sequence: Synthetic coding sequence
atgaagaaggagcacgtgctgcactgccagttcagcgcctggtacccgttcttccgcggcgttacaatcaagtctgtaattctgcccctaccccagaacgtaaaagactatctgctagatgatggaacactggttgtgagtggccgagatgaccctcccacccactcacaacccgactcagacgatgaagccgaggaaatccagtggagtgatgacgaaaacactgccactttgaccgacgcttattggatcgcaatgaattcaagtcttaagtgtaagactctatcggacatctttttgttattcaagagctctgattttattaccagggattttacacaaccctttattcattgcactgatgatagcccagattag

SEQ ID NO: 25660 - DNA, 414 bp, Artificial Sequence
  Description of Artificial Sequence: Synthetic coding sequence
atgagcctgttcggcaccaccagcggcttcggcaccagcggcacctccatgttcggttctgctaccacggataaccataacccaatgaaggacattgaagtaacctccagccccgacgattctatcgggtgcctgagtttctctcctcctacccttcctgggaactttctcatcgcggggtcatgggctaacgacgtgagatgttgggaggtgcaggatagcgggcagacaattccaaaagcccagcagatgcataccggaccagtccttgacgtgtgttggagtgacgatggctctaaagtcttcaccgcttcctgcgataagacagccaagatgtgggacctgtcttccaaccaggcaatccaaatcgcacaacatgacgcccccgttaaaaccattcattggatcaagtag

SEQ ID NO: 25661 - DNA, 3222 bp, Artificial Sequence
  Description of Artificial Sequence: Synthetic coding sequence
atggaggagcggaagcacgagaccatgaaccccgcccacgtgctgttcgaccggttcgtgcaagctacaacatgcaaggggacgctgaaagcctttcaggagctatgcgatcaccttgaacttaagcccaaggactacagatctttttaccacaagttaaaaagcaagttgaactattggaaggcaaaagcactgtgggccaagctggacaagagaggttcccacaaagactacaaaaaggggaaagcgtgcactaataccaaatgtctgataattggcgcaggaccttgcggcctgcggaccgccatcgacctttccctgctgggggcaaaggtggtggtgatagaaaagagagacgccttctcgcgaaacaatgtgcttcacttatggccattcaccatccacgacctgcgcggcctgggtgctaagaaattctacggcaagttttgcgccggggctatcgatcacataagtattcggcagctgcaactgatcttgctgaaagtggcattaatattggggatcgagattcacgtgaatgtggaattccagggccttatacagcctcctgaagaccaagaaaatgaacggattgggtggagagccttggtgcaccccaagactcatccagtttcagagtacgagtttgaggtgattataggaggagacggcaggcgcaacaccctggagggatttcgccggaaagagtttagaggcaagctggctatcgccataacggccaacttcatcaatcggaataccacggccgaagcaaaagtagaagagatcagtggcgtcgcttttatctttaatcagaaattttttcaggagctgagggaggcgaccggaatagaccttgagaatatcgtgtactataaggacgacacacactacttcgttatgaccgcaaaaaaacagtcactgcttgataagggggtgatcctgcatgattacgcagacaccgagctgctgttatcgagagaaaacgtcgatcaggaagcattgctgtcttatgcaagagaggccgccgatttttctacccaacagcagttgccctcactggacttcgccataaaccactacggtcagccggacgtggctatgttcgattttacatgcatgtacgccagcgaaaacgctgcactcgtgcgcgaacagaacggtcaccaattgttggtcgccctggtgggcgatagcctgctggagccattctggccaatgggtaccgggattgcgagagggtttttagctgctatggactctgcatggatggttcggagttggtccttaggcaccagccccctggaagtgctggctgagcgtgaaagcatctaccgtttgttgccccagactactcctgagaatgttagcaaaaatttcagtcagtattctatcgaccctgtgacccggtatcccaacattaatgttaactttctgcgcccaagtcaagtcagacatttatacgacaccggggaaaccaaagatatccacctggagatggagtctttagtcaattcgagaaccaccccgaagctgactcgaaacgaatctgtggctcgaagttcaaaactgttgggctggtgccaacgtcaaaccgatggttacgcaggcgtgaacgtgactgacttgacgatgtcttggaagagcggtctggcgctgtgcgctatcatccatagatatagaccggatctcatcgactttgactccctggatgagcagaacgtggaaaaaaacaatcagctggctttcgatattgccgaaaaagaattagggatttcccctataatgactggcaaggagatggcctcagtgggagagcctgacaagcttagcatggttatgtatctgactcaattctatgagatgtttaaggacagccttccctcctccgatacgcttgacctcaatgccgaagaaaaagccgtcctcattgcgagcactcggtcccccatttctttcctgtccaagctgggccagactatttctcgcaaacggtcccctaaggacaaaaaggaaaaagacctggacggcgcggggaaaaggcgaaaaacatcccagtctgaagaagaggaggctccccgggggcacagaggggaaagaccaaccctggtctccactctcaccgataggagaatggacgtcgcagtggggaaccaaaacaaagtcaagtatatggccacgcagttgctcgctaaattcgaagagaatgctcctgcgcagtccattggcatccggcgacaacagcgggaaaaggagtgtagcagaacttgtcccaaaaaagtgattactctgagtcctccccctacgccccccccttgccgggcccatggaggtcaacagacttatcgtgacctggatgccgacaatcgtgggaagcaatcccctcaccacgagcgccccgaaccagaaccccccagacgctttttcgtcgaccagtgggagctttccctctctttgcggtcaagtgccaggccagcctctccctcgagcgattctctcagacaaaagtatatcaaaatgtatacggggggcgtgagttcactggcggaacagattgctaatcaactgcagagaaaggaacagccaaaagctttgctggataagaaagaactgggaagtatgaaaaaggagttcccacaaaatctgggtggatctgacacttgctatttttgtcaaaagcgagtctatgtgatggaaaggctctccgccgaaggtaagttctttcacaggtcctgctttaaatgcgagtactgcgctaccaccctgcgattgtctgcctacgcgtatgatattgaggatgggaagttctattgcaagccccactactgttaccgcttgtctggatatgcacagcggaagagacccgccgttgctcctctgtctggaaaagaagctaagggcccacttcaggacggagctacaaccgacgccaatgggagagcgaatgccgtggcatcatcaactgaaagaacacctggctccctgactagcctttttggatgggttgctagacatagccttggtctctgtgataaagccaaggggatgtctcagcatctgcagtctaacatttcctcttttgggcagcaagtagctcagaaccccttagatagtttctttatgtgtcagcttctggccttcggcgtcccatttctttatgggttatctgaagtgctcgtgcaaattagaggcgaatttcattggcaggccgttgcccagtag

SEQ ID NO: 25662 - DNA, 543 bp, Artificial Sequence
  Description of Artificial Sequence: Synthetic coding sequence
atgttcctgagctgcggcagcctgcaccagcggggccccgagaccgacggtacagtcttccgaatccacaccaaggctgaaggatttatggacgtggatatcccattagagcttgtgtttcacctgccagtaaactaccccagctgcctgccgggcatcagtatcaactccgaacagctgacccgcgcgcagtgcgtgaccgtgaaggagaacctgctggagcaggcggaatccctgctgtctgagcccatggtgcacgaactcgttctatggatccaacagaacctaagacatatcttgagtcagcccgaaaccggcagcggtagtgaaaagtgtacgttttcgacctcaactaccatggatgacggcctgtggattactctgctgcatttggaccatatgagagccaagaccaagtatgtaaagatcgtggagaagtgggccagcgacctgaggctcacaggccgtctgatgtttatgggaaagatcattctcatactgctacagggtgacagaaataacctgaaagtccccaagtcctag

SEQ ID NO: 25663 - DNA, 1521 bp, Artificial Sequence
  Description of Artificial Sequence: Synthetic coding sequence
atgaagcggcggagcgtgaccatgaccgacggcctgaccgccgacaaagtgacacgctcggacgggtgccctacttccacctcactgcccaggcctcgcgatagcattagatcatgtgcactatccatggaccagattcccgacctccacagtcccatgtcacctatctcggagtcaccctcctctcccgcttattctacggtcaccagagttcacgccgcccctgccgctccatcagccacagcgctccccgcatctcccgtagcccgacggtctagcgagccccagctgtgtccaggttcggctcctaaaacacatggcgagagtgacaagggcccacacaccagtccgtctcatacactggggaaggcctccccatcacctagcttatcgagctacagtgatccggactccggccactactgccaactgcagccacctgtgaggggctctagggagtgggccgcgaccgaaacttctagtcagcaggcccggtcctacggagagcgtctcaaggaactgtctgagaatggcgcccctgagggcgattgggggaaaacctttacagtacccattgtcgaagtcaccagcagttttaacccagctactttccagagcctgctaatacctcgcgataaccgccccctcgaagtagggcttttacgtaaggtgaaagagctgcttgctgaggtggacgctaggacactggccagacatgtcacgaaggtggactgcctggtggctagaatcctgggagtcactaaggagatgcagactctaatgggggtgagatggggtatggaactgctaactctgcctcacggtcgccaattacgactggatcttctggaacggtttcacactatgagcatcatgctcgcggtggacattctgggctgcacaggttctgccgaagagcgagctgcattactccacaaaaccatccagctggcagcagagcttagagggactatggggaatatgtttagtttcgccgccgtcatgggcgccctggacatggcccagataagtcggcttgaacagacatgggtgaccctgcgacagcgacataccgaaggcgcaatcctgtacgagaagaaattgaaaccctttctgaaatctttaaatgaagggaaggagggacctcccttgagtaacacaacattcccccatgtgctaccacttattaccttgctggaatgtgatagcgctcctccggaaggtcctgagccgtggggctctaccgaacatggagtggaagttgtgttggcccatctcgaagctgcccgaacagtcgcccaccatgggggcttgtatcacaccaatgctgaggtgaagctgcaaggctttcaagcccgtcctgagctgttggaggtattcagcaccgaatttcagatgcgcctgctttggggcagccagggagcttctagttctcaggctcgacgctacgaaaaatttgacaaggtgctaactgccctctcccataagctggaacccgctgttcgtagcagcgaattatag

SEQ ID NO: 25664 - DNA, 369 bp, Artificial Sequence
  Description of Artificial Sequence: Synthetic coding sequence
atggccaccagcgcccccctgcggagcctggaggaggaggtgacctgctcaatttgcctggactatcttcgggatcccgtgaccatcgactgtgggcacgtgttctgccggtcctgcaccaccgacgttaggcccatctccggcagccgaccggtctgtccgctgtgcaaaaagcccttcaaaaaggaaaacatcagacccgtgtggcagctcgccagtctcgtcgagaacatagaacgcttaaaagtagacaagggacggcagcccggcgaagtcactcgcgagcaacaggatgccaagctgtgcgagcggcatcgcgagaagctgcactattattgcgaagatgatggaaaactgttatgtgtgtag

SEQ ID NO: 25665 - DNA, 369 bp, Artificial Sequence
  Description of Artificial Sequence: Synthetic coding sequence
atgcccgagatcaacaccaaccacctggacaagcagcaggtgcagttattggccgagatgtgcatcttgattgacgagaatgacaataagatcggcgccgaaactaagaaaaactgccacttgaatgagaacatagagaaaggcctgttgcatcgagccttctcggtgttcctgtttaatacagagaataaactgctgctccagcagagatccgatgccaaaattacctttcctggctgtttcacaaatacatgctgctctcaccctctgagtaatcccgcagagttagaggaatcagacgcactcggtgtacgacgggccgctcagcgcagactcaaagcggaactgggcatccctctggaggagtag

SEQ ID NO: 25666 - DNA, 408 bp, Artificial Sequence
  Description of Artificial Sequence: Synthetic coding sequence
atggccgccctgcggcccctggtgaagcccaagatcgtgaagaagagaacaaagaaatttatccgccaccaatccgatcggtacgtgaaaatcaaacgtaattggcggaagccgcgcgggattgacaatcgtgtgaggcgaaggttcaaagggcaaatcctgatgcctaacatcggctacggtagcaacaaaaaaaccaagcacatgctccccagtggcttcagaaagttcctggtgcataatgtgaaagagttggaggtcctgcttatgtgtaacaaaagctattgcgcggagattgcacacaacgtgtcttccaaaaataggaaggccattgtggaacgagctgcgcagttggccattagggtcaccaatcctaacgctcgcctgcgatccgaggaaaatgagtag

SEQ ID NO: 25667 - DNA, 3282 bp, Artificial Sequence
  Description of Artificial Sequence: Synthetic coding sequence
atgggcaccggcgacttcatctgcatcagcatgaccggcggcgccccatggggatttcggctccaggggggaaaggaacagaagcagccattgcaggtggctaaaatccgaaaccagtccaaagctagtggctcaggcctatgcgagggcgacgaagtggtgtcgatcaacggcaatccatgtgctgatctgacctatccagaggtcataaaactaatggagtccattacagatagcctacagatgttaataaaacgccctagctcagggatcagcgaagccctgatttcggaaaacgagaataagaacctggagcatctcacccacggcggctatgtcgagtctaccactctgcagatcaggccggccaccaaaacacagtgcactgaattcttcctggccccagtaaaaacagaagtgccactggctgagaaccagcgaagtgggcctgattgcgctgggtcgttgaaggaggaaacaggaccttcataccagcgcgcaccccagatgcccgacagccagcgcggccgcgttgctgaggagctgattttacgagagaaggtagaggctgtgcaacctgggcctgtggttgagctacaactgagtttgtcccaggaacgtcataagggcgccagcggcccattagtggcgctgccgggcgccgaaaagagtaagtctccagatcctgaccccaacctaagccatgatcgcatagtgcacattaattcgataccaactaatgaaaaggcggacccattcctgcggtcctcaaagatcatccagatctccagcgggcgcgaacttcgcgtgattcaggagtctgaggccggagacgccggattaccgagagttgaagtaatcctggattgttctgaccgccagaagacggagggctgtaggctgcaagccggtaaggaatgcgtcgattccccagtggaagggggacagtctgaggcccccccgtctctcgtcagcttcgccgtgtcaagcgaggggaccgagcaaggcgaggacccccgatcagagaaagaccactccaggccccacaagcatagggcaagacacgcgcgtcttagacgctctgagtctctgtctgagaagcaggttaaagaagcaaaaagtaaatgcaagtcgatcgcgctcctgttaaccgacgcgccaaaccccaactcaaagggcgttctgatgtttaaaaagagacggagacgcgccagaaaatatactttggtgagctacggtaccggcgagctggagcgggaagcagatgaggaggaggagggcgacaaagaggacacatgtgaagttgccttcctaggagccagcgaatccgaagttgatgaggagctgctcagcgacgttgatgacaacacacaagttgtgaatttcgattgggacagcggcctcgtggacatcgagaagaagttgaaccgcggagataagatggaaatgttgcccgataccacaggaaagggcgcgctcatgttcgctaagagaagagagcgaatggaccaaatcaccgctcagaaggaagaggacaaggtgggaggcacgccgtccagggagcaggacgccgcccaaactgacggtctgagaaccaccacgagttaccagcgcaaggaagaggagtccgtgagaacacagagttctgtgtcaaaatcctacatagaagtttctcacggattggggcacgttccacaacagaacggattcagcggcaccagcgaaacagccaacatccagaggatggtgcccatgaaccggacggccaaaccatttccaggctccgtcaatcaaccagcgacacctttcagccctacaaggaacatgacatcccccatcgcagactttccggcccccccaccttactcggccgtcacccctccgcctgacgccttctctagaggcgtgtcatcccctattgcagggccagcgcagccaccgccatggccacagccagccccttggtctcaaccagctttttatgattccagcgaacgtattgcttccagggatgaaagaatttccgtaccggccaagaggaccggaatcctacaggaagctaagcggcggagcaccacgaagcctatgtttactttcaaggagccgaaggtgtctccgaacccagagttactttctctgttgcagaattcggaggggaagcggggcactggcgcaggtggagactctggacctgaggaggactatttgagcctgggcgctgaggcttgcaatttcatgcaatcatccagcgcgaagcaaaaaacaccccctcctgttgctcccaaaccagctgtcaaatccagcagctcccagcccgtgaccccagtcagcccggtctggagtccgggcgtcgccccaacacaaccccctgccttcccaacaagcaatccaagtaaggggacagtggtgtcttccatcaagatcgcacaaccatcttatcccccggcgcgccctgcgtccacgctgaacgtagccgggcccttcaaaggccctcaagctgccgtcgctagtcagaattacactccaaagccgaccgtttctacccctaccgtgaatgctgtgcagcctggagccgtgggacctagcaatgagctgccaggcatgtccgggaggggggctcagctgttcgccaaaaggcagtcccggatggagaaatatgtcgttgacagtgacaccgtccaagctcacgcagccagagcccaatcacctaccccttctctgcctgcatcttggaaatactcaagcaatgtgcgggccccaccacctgtggcttacaatcccatccatagtccctcttatcccctagccgcccttaagagccaaccatcggctgcgcagccatccaagatggggaaaaagaaaggcaaaaaacccttgaacgcattggatgtaatgaaacatcaaccatatcaactgaatgcctctttgttcactttccaaccccctgacgccaaggatggactgcctcaaaaatcttccgtgaaggtcaattccgcgctggcaatgaagcaagctctgccgccccgtcccgtcaatgccgcaagtcccacgaacgttcaggcatcaagcgtgtattcggtgccggcgtacactagtcccccatcattctttgccgaggcctcatcccctgtctcagcgagccctgtcccggtaggcattcccacctcgcctaagcaggagagcgctagtagctcctacttcgttgctccgcggcccaaatttagcgctaagaagtcaggcgtgacaatacaagtgtggaagccatcggtagtggaagagtag

SEQ ID NO: 25668 - DNA, 600 bp, Artificial Sequence
  Description of Artificial Sequence: Synthetic coding sequence
atggccatcgtgcagaccctgcccgtgcccctggagcccgcccccgaagctgccacagctccacaagcgccagtaatggggtccgtgagcagtctgatatctggccgcccctgtccaggaggccctgctcccccccgccaccacggaccgcccggccctacattcttcaggcagcaggatgggctgctgaggggtggatatgaagcccaggagcctctgtgtccagccgttcctccaaggaaagcagtgccagttacctcctttacgtacatcaacgaagattttcggactgagtctcccccctcgccaagtagcgatgtcgaagatgcccgtgagcagagggcgcacaacgcccatctccgggggccgcctcccaaactcataccggtctctggaaagcttgagaagaacatggaaaagatccttattcggccaaccgctttcaagcctgtgcttcccaagccgaggggcgccccttccctgcccagttttatgggcccacgcgctaccgggctgtctggctcacaaggatctttgacacagttattcgggggtccagcgtcaagcagttccagcagctcgtcttcgtctgcagcctag

SEQ ID NO: 25669 - DNA, 612 bp, Artificial Sequence
  Description of Artificial Sequence: Synthetic coding sequence
atgcccagcacccccgccagcaccatcagcgcccgggaggagctggtgcaacgcatcccagaggctagtctcaatttccagaaagttcctcctggcagcctaaacagtagagactttgatcaaaacatgaacgactcttgtgaggatgccctagctaataaaactcgcccccggaacagagaagaggtcatatttgataatttgatgcttaaccccgtcagccaactaagccaagcaattagagaaaatactgagcatctagcagagaaaatgaagattctcttccagaacactggccgagcctgggaggatctggaggctcgaataaacgctgagaacgaagtgcccattttgaagacctccaacaaggagatctctagcatcctgaaggaactcaggcgggtccaaaagcagcttgaggtcattaatgctattgtggacccttcgggctcactagaccttctgttgcctacattgagctcttttgtccctccaccacctgctttcgcttgggaactggtgttggtgtgccgcgcaagtcgcagagtgcattgtacattcgttcttcggtggtcatgcggttgtctctccgagaatggatattttatttag

SEQ ID NO: 25670 - DNA, 321 bp, Artificial Sequence
  Description of Artificial Sequence: Synthetic coding sequence
tgacccaccaccagccggcccgccctggacgtgaagggcggcacctctccagctaaggaagacgcaaaccaggagatgtcttctgtcgcttattctaatctggcagttaaggatcggaaggccgtggcaatcttacattaccctggcgtggcctcaaatgggacaaagagccctgcaatcatagattccgatcctgtggacgaggaagtgctgatgtctttggttgtcgagcttggactggaccgagccaatgagcttcccgagctctggttaggacagaatgagtttgatttcacggcagattttccatcttcctgctag

SEQ ID NO: 25671 - DNA, 456 bp, Artificial Sequence
  Description of Artificial Sequence: Synthetic coding sequence
atggccgccttccgggacatcgaggaggtgagccagggcctgctgtctctgttgggcgccaatcgtgcagaagcgcagcagagaaggttgttgggccggcacgagcaggtggtggagcggcttctcgaaactcaggatggggccgagaaacagctgcgggaaatcctcacaatggaaaaagaggttgctcaaagcttgcttaacgcaaaagagcaggagaggcaggaaaaggaggttgatgaggataccactgttacaatcccctccgcagtgtatgtggctcagctgtatcaccaagtgtctaagatcgagtgggattacgagtgcgaacctggcatggtgaagggtatccaccacggtccaagcgtcgcccagccaatccacctcgatagtacgcaacttagccgaaaattcatctccgactacctgtggtcgctcgtggatacagagtggtag

SEQ ID NO: 25672 - DNA, 444 bp, Artificial Sequence
  Description of Artificial Sequence: Synthetic coding sequence
atgctgcggtgcggccagatgatcttcgcccaggccctggtgtgcaggcatttaggtcgagactggagatggacccagcgaaagcgacagcccgatagttacttcagtgtgctgaacgccttcattgatcggaaagattcctactattccattcaccaaatcgcccaaatgggcgtgggtgagggcaagtcaattggacaatggtacggacccaacaccgtggcccaggtgcttaagaagctggcggtgtttgacacgtggtcttccctggcagtgcacatcgcgatggacaatacagttgtgatggaggagatcaggcgtctgtgtaggactagcgtcccttgcgccggagcaaccgcattccccgctgactcggataggcattgtaatgggtttcctgccggcgctgaggttaccaacaggcctagtccctggcgcccttag

SEQ ID NO: 25673 - DNA, 1482 bp, Artificial Sequence
  Description of Artificial Sequence: Synthetic coding sequence
atggagaagtacgagaacctgggcctggtgggcgagggcagctacggcatggtgatgaagtgtaggaacaaggacacaggacgcatcgtggccattaaaaagttcctggagagtgacgacgataagatggtgaaaaagatcgccatgcgggaaataaagctgctgaaacagctacgtcatgaaaaccttgtcaatctcctcgaggtgtgtaagaagaaaaagaggtggtatctggtattcgaatttgtcgaccatacaatcctcgacgatcttgagctctttcccaacggactggactaccaggtggtccagaagtatctttttcagatcataaacggcataggcttctgccacagccataatattatccatcgcgatattaagccagagaacatactggtctcccagagcggcgtggtcaagctctgcgacttcggtttcgcaaggacattggccgctcccggggaagtctacaccgattacgtggccacacggtggtatagagccccagagttgctggtcggggatgtgaagtacggaaaagccgttgacgtgtgggccattggctgtttggtgactgaaatgtttatgggtgagccgctgtttccgggtgactcagatatcgatcagctctaccacataatgatgtgcctcggcaatctcatccccaggcaccaagaactgttcaacaaaaatcccgtttttgcaggcgtgagacttccggaaattaaagagcgggagccacttgagcgaaggtatccgaagttgtcagaggtagtcattgatctcgcaaagaagtgcctgcacattgacccggacaagcggccattttgcgctgagctcctacaccacgactttttccagatggacggattcgcagagaggttttcacaagagctccaactgaaagtgcaaaaagatgcccgcaatgtgagcctttccaagaagtcccaaaatcgtaagaaggagaaagaaaaagatgatagtctggtggaagagcgtaagaccctggttgtgcaggacacgaacgctgaccccaagatcaaggactacaaactgtttaaaatcaaaggctccaagattgacggtgaaaaggccgagaaaggcaaccgggccagtaacgcgtcatgtctgcatgacagtcggacctcccataataagatcgtcccctccacaagtcttaaagattgctctaatgtgtctgttgaccacacccgtaatccatcggttgcaattcctcctctcactcacaatctgagcgcagttgctcccagtattaatagtggcatgggaactgaaaccatccctatccaaggatatagggtggacgagaaaaccaagaagtgttccattcctttcgtgaaaccaaaccgccattcgccctcagggatatataacataaacgtgacaactctggtgagcggtccccccttgtccgatgacagcggagcagatttgccccagatggaacaccagcattag

SEQ ID NO: 25674 - DNA, 6189 bp, Artificial Sequence
  Description of Artificial Sequence: Synthetic coding sequence
atggacggctgcctggacaccgagacccccaccgtgagcatccaggagaacgtcgatgtagctagcctgaaacctatttccgattcaggcataaacttcacagatgccatttggtctcccacttgcgaacggaggacatgtgagtgccatgagagcatcgagaagaacaaggataagactgacctccctcaatcagtggtctaccaaaacgaggagggccggtgggtaactgacctggcgtactatactagcttcaactctaagcagaatctgaatgtttcgctgtctgacgaaatgaatgaggactttagaagcggttcggaggccttcgacctgatcgcgcaggacgaggaagaatttaacaaggaacaccaattcattcagcctagtttcggatactttattcggtctccagaaaaaagggagcccatcgcgttgatccggaagagcgacgtttccagaggcaacctcgagaaagagatggcacacctgaatcatgacctgtattccggggatctgaatgagcagtcccaggctcagctcagtgaggggtccatcacactgcaggtggaagctgttgaatccaccagccaggtcgacgagaacgatgtgactctgaccgccgataaaggaaagacggaggataccttcttcatgtccaacaagcctcagcgttacaaggataagctacccgacagtggtgacagcatgttgaggattagcacaattgcatccgcgattgctgaggcctccgtgaatactgatccatcacagctggccgccatgataaaggccctgagcaacaagacacgggataagacatttcaggaagacgaaaaacaaaaagattacagtcacgtgcgccactttctccctaatgacctggagaagtccaatggctctaatgccctagacatggagaaataccttaagaagacagaggtcagccggtatgagtcagctctagagaacttttctagggctagtatgtctgatacatgggacttgtcccttccaaaggagcagaccacgcaggatatccaccccgttgacctctctgccacttcagtctccgtccgagctcccgaagaaaataccgccgcgatcgtatatgttgagaacggagaaagtgaaaaccaagaatcatttcgcacaatcaattctagtaatagcgtgaccaaccgcgagaataatagtgccgtggttgatgtcaaaacctgtagcattgataacaaactccaggatgtgggcaacgacgagaaggccacttctatcagcactcctagcgactcctactcatccgtccggaatcccaggattacatcattatgcttgctcaaagattgcgaagaaatccgggacaaccgcgagaaccagagacagaacgagtgtgtctcagaaatttccaactcggagaaacacgtcacattcgagaaccaccgcatagtcagtccgaagaacagcgacctgaagaacacaagccccgagcacggtggccgggggtctgaggacgagcaagagagtttccgtccatccacctcgccactgtcgcacagcagccctagcgaaatctccgggacatcatcttctgggtgcgccctggagtcttttggttcagcagctcagcagcagcagcctccatgtgagcaggaattgtcccccttagtgtgctcaccagctggtgtgtcacgcctgacttatgtctccgaacccgaatcttcctatccaactacggccactgacgatgccctggaggatagaaagtctgatataacctccgaactgtccactacaataatacagggctcccccgctgcgcttgaggagagagccatggagaaactgagagagaaagtccccttccagaaccgcggcaagggaacactgtcgtcaatcatccagaataatagcgataccagaaaagcaaccgagaccacatcactctcctccaagcccgagtacgtgaaacccgattttagatggagtaaagacccttcatcgaagtcaggcaatctgttagagacttccgaagtcgggtggaccagcaatccagaagaactggaccctatccggctggccctgctggggaagagcgggctcagctgtcaagtgggctccgcaacttctcacccagtaagctgccaggaacccatcgacgaggaccaaaggatttcgccaaaagacaaaagcacagccggcagggagttttctggccaagtgtctcatcagaccactagcgaaaatcagtgtactccaattccttcaagtaccgtgcactcctccgtggctgatatgcagaatatgcctgcagccgtgcatgctttactcacacagccctctctcagtgcagctccgtttgctcagagatacctggggacattgccgtccacagggtccaccaccctcccccaatgtcacgcaggcaatgcgacggtctgtggctttagcggtggcctgccgtaccccgccgtggccggcgaaccggtgcagaacagcgtcgcagtcggcatatgcttgggaagcaatatcggcagcggttggatgggaacctccagcctgtgtaatccctattctaatactctaaaccagaatcttctgtccacaaccaagccgttccctgtccctagcgtcggaaccaactgtggcattgaaccctgggattccggcgtgacgtcggggctgggaagcgtacgagtccccgaggaattaaagctgccgcacgcctgctgcgtgggaattgcaagtcaaacactcttgtcagtcctgaaccctaccgacaggtggctgcaagtgagtatcggggtcctgagcatctccgtgaacggtgaaaaagtggacctaagcacctaccgctgccttgtatttaaaaataaggcaattattcggccacatgccaccgaggagattaaggtattgtttatcccctcttctcccggggtgttccgctgtactttttctgtggcaagttggccctgtagcaccgacgctgagaccatcgtgcaggctgaggctctggcaagcaccgtgacgctcactgctatcgcagagtctcccgtgattgaagtggagacagagaagaaagatgttctagatttcggtgacctgacatacggtggatggaaggccctccctcttaagttaataaatagaacacacgccaccgtgcccatacggctcatcatcaacgcgaatgcagtcgcttggcggtgcttcacttttagcaaagaaagtgtccgggccccggttgaagttgcaccttgtgccgacgtcgtgacaagactggcaggacccagcgttgtgaaccacatgatgccagcctcatatgatggccaggatccggaattcctcatgatatgggtactgtttcatagccctaagaagcagatctcctcgtccgatattctggattcggctgaggaatttagtgccaaggtcgatatcgaggttgacagcccaaaccctaccccagtactgagaagcgtttccctgcgggcacgagccggtatcgccagaatccacgccccaagggaccttcaaaccatgcacttcctagccaaagtggcctcttctcgaaaacagcatctgcccctcaagaatgccggcaacatcgaggtttacctggatatcaaggtgccagaacagggaagccatttcagcgtggacccaaagaacctgctgttgaagcccggagaggagcatgaagtcatcgtttccttcacacccaaagatcctgaggcctgtgaggaacgaattctaaagatttttgtgcaaccttttgggccccagtacgaggtggtactgaagggcgaagtgatttcaagcggtagcaagccgttatccccaggcccttgtttggacataccaagtatcctttccaataagcagtttttggcctggggcggcgtgcccctgggcagaacccagctccagaagctcgctctccgaaacaactccgcttctaccacacagcacctgcgccttctgattcgcggccaagatcaggattgtttccagctccagaacacttttgggtctgaacagaggctgacatctaactgtgaaatcagaattcaccccaaagaagacatttttatcagtgtactcttcgcccctacccgcttgtcttgcatgctggcaagactggaaatcaagcagctgggaaatcggtcccaacctggaattaaattcactattcccttgagtgggtatggcggaaccagtaacctgattctagagggcgtcaaaaaattatctgactcatacatggtgaccgttaatggtcttgtgccagggaaagaatcaaagatcgtgttctctgtaagaaacactggctctagagctgcctttgtgaaagcagttggttttaaagactcacagaagaaggtccttctggacccgaaagtgcttcggatctttcccgacaagttcgtgttgaaagaacggacacaggagaacgtgactctcatttacaatccatctgaccggggtattaacaacaaaacggcaacggagctttccaccgtctacctgttcggcggcgatgagatctctcgccagcagtacagaagagctcttctgcacaaacctgagatgatcaagcagattttgccagaacatagcgtccttcagaatatcaatttcgtcgaggccttccaggatgagttgctggtcaccgaagtatatgacctgcctcagcggccaaatgatgttcagctcttctatgggagtatgtgcaagatcattctttccgtgattggggaatttagggattgcatttcaagcagagagttcctccagccgtcctcaaaggccagtctggaaagcactagcgatctgggggcttcaggcaagcatggtgggaatgtgtcattggatgtgttacctgtcaaaggtccccaggggtctcccttactatccagggcagcccgtccgccacttgatcagctggcatcggaggagccatggaccgtgctgccagagcacctgatccttgtggctccttctccctgcgatatggcaaagactggacgattccagatagtgaataattccgtgcggctgctgagatttgagctgtgttggccggcacactgtctcactgtgacccctcagcacggttgcgtagcccccgagtccaagttgcaaattcttgtttcacctaacagcagcctgtctaccaaacagagtatgtttccatggtccggtctcatttacattcactgcgacgatgggcagaaaaagattgtaaaggtgcaaatccgagaagatcttacacaggtggagctgttaacaaggctcacatccaagccattcggtattctgagcccagtgtcagaacccagtgttagccatctggtcaagcccatgactaaaccaccctcaaccaaggttgagattaggaacaagtccataacctttccgaccactgaacctggcgagacgtccgaatcctgcctcgagctggaaaaccacggtacaaccgacgtgaaatggcatctctcttctctggccccaccttacgtgaagggggtcgatgaatcgggggatgtctttcgcgctacttatgcagcatttagatgttctccaatctctggccttctagaaagccatggaattcaaaaggtttcaattactttcttacccagagggagaggtgattatgctcagttctgggacgtagaatgccaccctttgaaagaaccccatatgaagcataccctgcgttttcagctgtctggtcaatccatagaagccgagaacgaaccggaaaacgcctgtctttctacagattcactaataaaaatagaccacttggttaaaccaaggagacaggccgtctctgaagcatcagctagaatcccagaacagctcgatgtaacagcgaggggggtttacgcccctgaggacgtttatagattccgacccaccagcgtgggtgagtctagaactctgaaagtgaatctccgaaataactcctttatcacacatagtttgaaattcttgtcgccacgggagccattttatgtgaagcactccaagtatagcctgcgcgcgcagcactacatcaatatgccagttcaattcaagcctaaaagtgcagggaaattcgaggccttgctggttatccagactgatgagggtaagtcaattgctattaggcttataggcgaggcgctcggcaagaactag

SEQ ID NO: 25675 - DNA, 1545 bp, Artificial Sequence
  Description of Artificial Sequence: Synthetic coding sequence
atgagcatcagcagcgacgaggtgaacttcctggtgtaccggtacttacaggagtcagggttctcccacagcgccttcaccttcggcattgaaagccatattagccagtcaaacatcaacggtgccttggtccctccggctgccctcatatccatcatccaaaaagggttacagtatgtcgaagcagaggtgagcatcaacgaagacggcactttgtttgacggtcgtcctatcgaatcattgagtttgattgacgccgtgatgcccgacgtcgtgcagaccagacagcaggcataccgcgataaacttgctcagcaacaggccgccgccgccgccgcagccgcagctgcagccagtcagcagggctccgccaagaacggggagaacacagctaacggtgaggagaatggggctcatacgatcgcaaataatcacaccgacatgatggaagtggacggagatgtggaaattccaccaaataaggctgtcgtgctccgggggcatgaatccgaggtgtttatttgcgcctggaacccagtgagcgatctgctcgcatccgggagtggcgactccactgcccggatctggaacttgagcgaaaattctacctccgggagcacacaactcgtcctccgccactgtatcagggagggcggacaggatgtgccctctaataaagacgttacaagccttgattggaattctgaggggactttgctcgcaaccgggagctacgatggtttcgctaggatttggacaaaggacgggaatctggcatccacccttggccagcataagggacctatcttcgctcttaaatggaacaaaaaagggaacttcattctgtctgctggcgtggataagaccactatcatatgggatgcacacactggagaggcgaagcaacagtttccatttcacagcgcccctgccctggatgtggactggcagtctaacaatacattcgcttcatgtagtacagacatgtgtattcatgtgtgcaaacttgggcaggacaggcctattaagacatttcaaggccacaccaatgaggttaacgcaattaagtgggaccccaccggcaacctgttggcctcttgctccgatgatatgaccctgaaaatatggagcatgaaacaggataattgcgtgcacgatctgcaggctcacaacaaagagatttacaccattaagtggtctcccacaggaccaggtaccaataacccaaatgcaaacctcatgttggcatctgcctcatttgattccacggtccggttgtgggacgttgatcggggtatttgcattcacacactcacaaagcatcaggagcccgtttactccgtggcctttagtccagacggtcggtacctggcaagcggctctttcgataaatgcgttcacatttggaatacacagactggtgcccttgtgcacagttacaggggaaccggaggcatttttgaggtgtgctggaatgccgctggggataaggtgggcgcctccgcctcggacggatcagtctgtgtgctggatctgcgaaagtag

SEQ ID NO: 25676 - DNA, 2034 bp, Artificial Sequence
  Description of Artificial Sequence: Synthetic coding sequence
atggaggagaccatgaagctggccaccatggaggacaccgtggagtattgcctgttcctcataccagacgagagtcgcgattccgacaagcacaaagaaatacttcaaaagtacatagagaggataatcacccgattcgctccaatgttggttccgtatatttggcagaaccagccatttaatttgaagtataaacctggcaaaggcggcgtaccagcacacatgttcggagttactaagtttggtgacaacatagaagacgagtggttcatcgtgtatgtaatcaagcagattacaaaagagtttccagaacttgtcgcaagaatcgaggataatgacggcgagttcctgctcatcgaggcagcagactttcttccaaagtggctcgatccagaaaactccaccaaccgggttttcttttgtcacggcgaactgtgtatcatacctgcaccacggaaatctggggcagagagctggttgcctacaacacctcctacaatccctcaagccctgaacattatcaccgcacactccgagaagatcctggcatccgagtccatccgagccgccgtcaaccgcagaattcggggataccccgagaaaatccaggcctcgcttcatcgtgcacattgtttcttgcctgcaggtatcgtggccgttttgaagcagagacctcgtctggtagcagccgcggtccaagccttctaccttcgtgatcctatcgacttacgagcttgccgggttttcaagacattcctccctgaaacaagaatcatgacatcagtcacctttaccaaatgcctgtacgctcagttggtccagcagcggttcgttcccgatagacgctccggttatagattacctccaccatccgaccctcagtatcgcgctcatgaactgggcatgaaactagctcacggtttcgagatactctgcagcaagtgttcacctcatttctctgattgcaaaaagtccctcgtgacggcctcacctctgtgggccagctttctcgagtcactcaaaaaaaacgattacttcaagggtctcatcgagggctccgcacagtatcgggaacgcctcgagatggcagagaattactttcagttgagtgttgattggccagaacggctcgaggttcagtggcgtgacccgggcctgttgcaggccccccccccaggctttacaccgttcatttgcctgtccctcctgtctacttgggacaactcatccctggccatgtcgccaggcgaggagatcttgaccctattgcagacaatcccattcgacatagaagatctgaaaaaggaggcggccaatcttcctccagaagacgatgatcaatggctagacctaagccccgatcagctggaccagttactgcaggaagcggtcgggaaaaaggagtcagagtctgtgtcaaaggaggaaaaggagcaaaactatgacttgacggaggtatctgagtcaatgaaagcatttatttctaaagtgagtactcacaagggcgcggaactcccccgggagccaagcgaggcccccatcacattcgatgcggattccttcctcaactacttcgacaagatcctcggaccacgacctaacgagagcgattccgatgacctagacgatgaggattttgaatgcctagactcagatgacgacctcgactttgagacccacgagcccggcgaagaggcctctctcaaggggacactggacaacctcaagagttatatggcccagatggaccaggagctggcacacacttgcatctctaagtccttcacaactagaaaccaagtcgagccggttagccaaaccactgataataattcagacgaagaagactctggaaccggggaatccgtgatggctcccgtggatgttgacctgaatctggtgagtaacatacttgaaagctactccagccaggctggcttggccggtcccgcttctaatcttctccaatcaatgggcgtccaattgccagacaataccgaccacaggcccacctctaaacctacaaagaattag

SEQ ID NO: 25677 - DNA, 1821 bp, Artificial Sequence
  Description of Artificial Sequence: Synthetic coding sequence
atggaggagagccccctgagccgggcccccagccggggcggcgtgaatttcctgaacgtggcgcggacatatatacctaatacaaaagtggagtgtcattatacactgcctcccggtaccatgccctcagcttcggattggattggaatcttcaaagtggaagcagcttgcgttcgagattatcacacctttgtttggtctagtgtccctgagtctactaccgatggcagtcccattcacaccagcgtccagtttcaagaacctcgccccatggatgaactggtcactctggaagaggctgacggcggctccgatattctgctggtagtgcctaaagccactgtactgcagaatcagctagacgagtcgcagcaggaacgtaacgacttaatgcaactgaagctgcagctggaaggccaggtgactgaactgagatcccgagttcaagagttggaacgagcattggctactgctagacaggaacatacagagctgatggagcagtacaagggaattagtcggagccacggcgagatcacagaggagagggacattctgtctcgccagcagggagatcatgtcgcaaggatattagaactggaagacgacatccagaccattagtgagaaagtactcacaaaggaggtcgagcttgacaggctaagggacactgtcaaggccctcactcgagagcaggagaagctgcttgggcagctaaaggaagtgcaagccgacaaggagcagagcgaggctgagctggagcccctcaaggaacagctgcgtggcgcacaggagttggccgcatcttcccagcagaaggctacgttgctaggtgaagagctggccagtgctgctgccgctcgagacaggactatcgccgagctgcaccggtcccgcctggaggtggcagaggttaacgggagactggccgagctcgggctgcaccttaaggaggaaaagtgtcagtggagtaaggaacgagcgggcctgctgcagtcagtggaagctgagaaagacaaaatcctcaagctttctgcagagattttacgcctggaaaaggccgtgcaagaggagagaacccagaaccaggtattcaaaactgagttggcccgcgagaaggacagtagcctggtccaactgtcggagtcaaagcgggaattaacggagctgagaagtgctctccgggtgctgcagaaagaaaaggagcaactccaagaggaaaaacaagaacttttggaatacatgcgcaagttggaggctcgcctggagaaagtggctgacgaaaaatggaacgaagacgcgactaccgaggacgaagaggctgctgttgggcttagctgtccagccgcactcaccgattcagaagacgagagcccagaagacatgcgtttgccaccgtatgggctgtgcgagcgcggggaccctggaagtagccccgcagggcccagggaggcatcccccctggtcgtgatcagccaacccgccccaatcagtccccacttatccggccccgccgaagactcgtcctcagactccgaagctgaagatgagaaatctgtattaatggcggctgtacagagcgggggcgaggaggcaaatctactcctgcctgagctggggtctgcattctacgacatggcatccggctttacggtcggaacgctgtccgagacatcaacagggggacccgcgactccaacctggaaagaatgtccaatctgtaaggagaggtttccagccgaatctgataaggacgccctcgaagaccatatggatgggcacttcttctttagtactcaggacccgtttacctttgagtag

SEQ ID NO: 25678 - DNA, 2997 bp, Artificial Sequence
  Description of Artificial Sequence: Synthetic coding sequence
atgaaccggcggcggaagttcctgctggccagcgtgctggccctgcagaacagtagtttcatttacccttcatgccaaaagtgtttcagccggattatcctagtgagcaagcgttctaactgtccaaagtgtggctccaccggggagagtgggaatgcgaattaccgctacaagcttagtcttaaggtggctgagtccaacaaactgttcgttataactgtgtttgggagctgtctggatactttcttcgggctgacagccactggcctacacaggtacattcaggatcccaataaaattccagagaccctggacaatgacaccacccagaacctgcttacgaaggcggtcgaaacatgcttcgtggggcagtccttcatctttggggttactaacttcgaaaaccagcccggtcaagggtcagatgcatccaacttccttcaacagtgcagcgatcataaaaggaaggctaaggctcttgtggcttgtcagatcgtcctccccgaccctggaattgctgggtttactgtgatcgattacttccaccagctcctgcagacattcaactttagaaaactacagtgtgatagccaggcccctaataaccatctgttggctctggaccactccaacagtgatctgagctctatatatacctccgattcaacctcagatttttttaaatcctgttcaaaagatacattctctaaattttggcagcccagtctagaatttacatgcatagtttcgcaactcaccgacaacgatgacttcagcgccagtgagcagtcaaaggcttttggtaccctccagcagaacagaaaatctatctcgatcgctgaggcaaccggatccagcagttgtcacgatccaatccaagactcttggagtctagtgtcttacatggacaaaaaatcaacagctgaaaaactggggaaggaactgggtctgcaggccaaggagctcagtgcagtccatagttcacaccatgagataggagtcaacgacagcaacctattctcacttgaaatgagggagcctctggagtccagcaatactaagtcttttcattcagcagtagaaataaagaaccggtctcagcacgagttgccttgttttcagcaccacgggattgacacgcccacttccctgcagaaaagatctgcgtgctgccctccttcccttttgcgactggaagaaaccgcaagttctagccaggacggcgatccccagatttgggatgaccttcctttcagtgagtctcttaataagtttttagctgttttggagtccgagatagccgttacccaggctgacgtgtcttctcgtaagcatcacgtggataatgatatagacaaattccatgcagatcattccaggctctctgtcaccccacaaagaactaccggggcactgcacactccgccaatcgctctcagatcctcacaggtgatcgtgaaggccaattgttctaaggatgactttctgtttaattgcaagggcaacctttctcccagtgtcgaaaaggaatcccagcctgataataaagtggaggcggtatctgtgaaccacaatggtcgggacatgagtgagtacttcctcccaaatccttacctctctgccctgtcatcttcgagtaaagatctggagactattgtgacccttaagaagacaattagaataagcccccacagagagagtgaccattccagcctaaataacaaatacctgaacggctgtggcgaaataagcgttagcgagatgaacgagaaactaacgacgttgtgttatcggaaatacaacgacgtcagcgacttgtgcaagctcgaaaataagcagtactgtcggtggtctaaaaatcaagacgattcttttacaatttgccgcaagctgacttaccccttggagaccttgtgtaattcacctaatcgaagcaccaacacgctgaaggaaatgccttgggggcacatcaacaacaatgtgactcagtcatatagcatcggctatgaagggagttatgatgcttctgctgacttattcgatgatattgctaaagagatggacattgccactgagattactaagaagtcacaggacatcctgctgaaatggggtactagcctcgctgagtcacacccatctgagtctgacttcagtcttcgctccctgtccgaggattttatccagccttcccagaaattgtcccttcagagcctgagcgatagcagacatagcaggacctgttcccctacaccccactttcagtcagacagcgagtacaatttcgaaaactcccaagacttcgtgccttgctcccaatccacccctataagtgggttccaccaaacacgaatacatggcatcaatagagcattcaagaagcccgtcttctattctgatctagatggaaactacgaaaagattaggattttccccgaaaatgataagcagcaggcttcgccatcttgtcccaaaaatatcaagacccctagccaaaagattcgtagcccgatagtttctggggtgtcccagcctgatgtttttaatcattacccttttgcagagtgccatgaaactgatagcgacgagtgggtgccccccaccactcagaagatctttccttccgatatgttagggtttcagggcattgggcttggcaagtgcctggctgcttaccactttcccgatcaacaggaactcccccgcaagaaactcaaacatatcagacagggaaccaacaagggtctgatcaaaaagaagctaaagaatatgctggcggccgttgtaaccaaaaaaaagacccataaatacaattgcaaatcctcaggttggatctcgaaatgccctgatattcaggttctggcagcgccacagctacacccaatcctcgggccggattcatgctcggaagtaaagtgttgccttcctttctccgaaaagggaccacctagcgtgtgtgagacacgtagtgcatggtcccccgagctttttagttag

SEQ ID NO: 25679 - DNA, 471 bp, Artificial Sequence
  Description of Artificial Sequence: Synthetic coding sequence
atggccgacagccccggcggctacaaggagtgcggcaccaacgagggtccccaggaggacgaaaacggcagcagtgcgagcggctcttccaaggtgcggcagctgtggtctgaagactcctgcgagtctgggaagctacctgctacccggaccgtttattgtatgaatgaagctgagatagtagacgtggccctcgggattttaatagaatctcgcaagcaggaaaaggcctgtgagcagccagcgcttgctggcgctgacaacccagagcatagtccaccatgttctgtgtctccccatacttcgagcggaagtagtagtgaagaggaagatagcgggaaacaggctctcgccccaggtctcagcccatctcagaggccaggcggaagctcctccgcctgttcacgcagtccagaggaggaggaagaggaagatgtgctcaaatatgtacgggagatcttcttttcgtag

SEQ ID NO: 25680 - DNA, 1377 bp, Artificial Sequence
  Description of Artificial Sequence: Synthetic coding sequence
atggccgagctgcagatgctgctggaggaggagatccccggcggccgcagggccctgttcgacagttataccaatctggagagggtcgcggactactgcgaaaacaattatatccagtctgcggataagcagcgagcactggaggagactaaagcctacactacccagtctctggcttccgtggcttacttaataaacacgcttgccaataacgtgcttcaaatgcttgacattcaggccagtcagctcaggagaatggagtcaagcataaaccacatttctcagaccgtcgatattcataaggagaaagtagctagaagggaaatcggaatactgacaaccaacaagaataccagccggacacataagatcatcgctccagcaaatctggaaaggccagtgcgatacatccgaaaacccattgactacacaatcttggatgatataggtcacggagttaaagtaagcacacagaatatgaagatgggcggtctcccacgtacaacccccccgacccagaaacctccatcgccccctatgtccggtaagggcacactgggctcgtctggaagcagcggagggtcacacccctccagcaggagttcttctcgagagaattctggcagtggatcggttggggtgccaatagcggtacctacacccagccctccttctgtgtttcccgccccagcagggagcgccggaactccgcccctccccgccacctccgctagtgcccccgcgcctcttgtcccagctactgtaccatcctccacagctcctgacgctgccgcggggggggcacagacgttagccgatggatttacttcccccactcccccagtcgtctcgtcgactcctccgacggggcatcctgtgcagttttactcgatgaataggccggcctcaagacacacacctcctacaattggcggctccctgccatatagaagaccaccttccataacaagtcagacatccctccagaaccagatgaatggaggaccattttattcccagaaccccgtgtccgacactccacccccccctccgcctgttgaagaaccagtttttgacgagagcccgccgcccccccctccacccgaggactacgaggaagaggaggctgcagtggtggagtatagcgacccttacgccgaagaagatccgccttgggcgcctcgctcctacctggagaaagttgttgctatttacgactacaccaaagacaaggaggatgagctgtcatttcaggaaggcgcgatcatctacgtcatcaagaagaacgacgacggctggtacgagggcgtaatgaacggggtcacaggtctgtttcctgggaactatgttgagagtatcatgcattatagcgagtag

SEQ ID NO: 25681 - DNA, 5223 bp, Artificial Sequence
  Description of Artificial Sequence: Synthetic coding sequence
tgaaagatctaccccgaggagatcacccccctgctgcccgccatcagcggggagaagattgctgaagaccaaacgtgtttcttcctgcaaatcctgctcaagtatatggtaattcaggcagcctccctcgagtggaagaataaagagaaccaggataccggtttcaagtttctcttcaccctgtttcgcaagtattatctaccccacctgttccctagtttcacaaaactgaccaacatctacaaaccagtgctggacatccctcatttgcgccccaagccggtatacattaccactacaagagacaatgagaatatttattcgacgaagatcccgtacatggctgccagggtcgtgtttatcaaatggattgtgacatttttcctcgaaaagaagtacttgacagccacccagaacacaaagaacggcgtggacgttcttccaaaaatcatacagaccgtgggcggcggggcagttcaggagagagcccccgagctggacgggggcggacccacagagcaggataaatcccacagcaattctagtaccctctccgaccggaggttgtctaattcctctttatgtagtatagaggaagagcaccgtatggtgtatgagatggttcagcgcatattgctctccacacgaggatacgttaattttgttaatgaggttttccaccaggcttttttgctgccgtcctgcgagatagcggtgacccgtaaagtggtgcaggtgtatcggaaatggatcctgcaggacaaaccagtcttcatggaggagccggatcgtaaggacgttgcccaagaggatgccgaaaagcttgggttttctgaaaccgatagcaaggaggcctcctctgagtcctcagggcacaaacggtcctcatcttgggggaggacgtattcatttacttccgccatgtcccgtggttgcgtcaccgaagaggaaaatactaatgttaaagctggtgtccaggcactcttgcaagtgtttctgacaaacagcgctaacatttttttactggagccgtgtgctgaagttccggtgctgttgaaggagcaggtcgatgcatgcaaggcggtgcttataattttccggcggatgattatggagctgaccatgaataaaaagacatgggaacagatgctgcagatactgcttagaattaccgaggctgtcatgcagaagccaaaagataaacagataaaagacttattcgcgcaatcactggccggcttgcttttcaggaccctgatggtggcctggatcagggccaacttgtgcgtttatattagtagagagctctgggacgactttttaggagttctcagcagcttgacagagtgggaagagctaattaatgagtgggccaatatcatggacagcctcactgcagtgctggccaggaccgtttatggggtggagatgacaaatttaccccttgataagttgagcgagcaaaaggaaaagaagcaaagaggcaaaggctgtgtgctggatcctcagaaaggaactactgtcggaagatcttttagtctgtcatggcgttcgcacccggatgttaccgaacctatgaggtttcgctccgcaacgaccagcggcgcccctggcgtagaaaaagctagaaatattgttaggcagaaagccacagaggtggaggaatgtcagcaatccgagaacgccccagccgccggttccgggcatcttacagtcggacagcaacagcaggtgcttcggtcctccagcacctctgatatccctgagccattatgcagtgacagcagccaggggcaaaaggccgagaatacccaaaacagtagctcctcggaacctcaaccaattcaggagaataagggccacgtcaaaagagagcacgaaggtattaccattctggttagacgctcctcatctcctgccgaactcgatctcaaagacgacctgcaacagacccagggcaaatgcagagaacggcagaaaagtgagtcaaccaattcagacactacattaggatgcaccaatgaggccgagctgtcaatggggccatggcaaacatgtgaagaggatcctgagctgaatacacctacagatgttgtggctgatgcagacgcgcgccattggttgcagctttctcccactgatgctagcaatctgacagatagtagtgaatgcctaaccgacgactgcagcatcatcgccgggggcagtttgacgggatggcaccctgacagcgccgccgtgttatggcggagagtcctgggcatcctaggggacgtcaataacatccagtctcccaagatccacgcgcgtgtgttttgctacctttatgaactgtggtataagctcgcaaaaatccgtgataaccttgctatctcacttgacaatcagtcctctccgagtcctcctgtgctgatcccaccccttcgtatgtttgcgtcttggctgttcaaggccgcaaccctcccaaacgagtacaaagagggaaaattgcaagcataccggctcatctgtgcaatgatgactcggcgccaagacgtgctacccaattccgactttctggttcacttctacctcgtcatgcacctaggcctgacgtccgaggatcaggatatccttaacactattattaggcactgtccgccacgctttttctcactcgggtttcctgggttttccatgctggtgggcgattttatcacagctgccgcccgggtcctgtcaactgatattctgacggcccccagatccgaggcagtgacagttctgggtagcctggtctgttttcccaatacctatcaagagatacctctgctgcagagcgtcccggaggtaaatgaagcaatcactggcacggaagatgtgaaacattacctcatcaacatcctgctaaagaacgccacagaagaaccaaacgaatatgcccggtgcatcgctgtctgcagccttggtgtgtggatttgtgaggaattggcacagtgtactagtcacccccaagtgaaggaagccatcaacgtcatcggagtcacactgaaattcccaaataaaattgtggcccaggtggcttgtgacgtcctgcaactgctggtatcatactgggagaaactgcaaatgttcgagacgagtcttcccagaaagatggcagagatcctggtggccactgttgccttcctattgccaagtgccgagtattctagcgtggagaccgataagaaattcatcgtcagcctgcttctgtgcttactagactggtgtatggccctgcctgtctccgtgctcctgcaccctgtgagtaccgctgttcttgaggagcagcactctgcaagggccccgctactagattatatctaccgggtactgcactgctgtgtctgcggaagttccacctatacccagcagagccactatatccttacacttgcagatctaagctccactgattatgatccgtttctcccacttgctaatgttaaatcctcagagccagtgcagtaccattcatccgccgagctcggcaacctgctgacagtagaagaagagaagaagcgaaggagcctggagctcatccccctcaccgcccgaatggtgatggctcatctggttaaccatcttggtcactacccgctgtcaggcgggcccgccatcttgcacagcctggttagcgagaatcacgataatgcacatgtggaaggaagcgagctaagctttgaagtcttccggtctcccaaccttcagctattcgtattcaacgatagtacgttaatctcttatttgcagaccccaactgaggggccagtgggtggctctccagtaggaagcttgtccgacgtacgggtaatagtgagggatataagtgggaagtattcatgggatggcaaagtgctttacggccctcttgagggctgcctggcacctaacgggcggaacccttcatttctcatttcgtcttggcatcgcgatacatttgggccgcagaaagatagctcccaagttgaggagggcgacgacgtgctggacaaattgttggagaacataggccacacgtccccagaatgcctgcttccatcacagctcaatttgaatgagccttcccttacgccttgcggtatgaattatgaccaggagaaagagatcatcgaggttattctacgccaaaatgcacaagaggacgagtatattcagtcccacaactttgatagcgctatgaaggtgacctcacagggacagcctagtcctgtcgagcctcggggcccattctacttttgcaggctgctcctcgacgatctggggatgaactcctgggaccggagaaagaatttccaccttttgaaaaaaaacagcaaactcctgcgagagctgaaaaatctcgactcacgacaatgcagagagacccacaaaatagccgtgttttacatcgccgaaggccaggaagacaagtgttcgatcctctctaacgaaagagggtcccaggcttatgaagattttgtcgccggcttggggtgggaagttgatctgtctacacattgcgggttcatgggtggtctgcagcggaatggctcaacaggacaaaccgccccgtactatgccacgtcaaccgtggaagtgatttttcacgtgtctacgcgcatgccttcagactctgatgattcattgactaaaaagttgagacacctaggaaatgatgaagttcacatagtctggtctgaacattccagagattataggcgaggaatcattcccacggccttcggggacgtgagcatcatcatataccccatgaagaaccatatgttcttcatcgccatcacaaaaaaacccgaagtccccttcttcggacctctgtttgacggagccatcgtcagcggcaaattgctgccgtccctggtgtgtgctacctgtatcaacgcaagccgggcagtcaaatgtttgatacccctttaccaaagcttttacgaggagagggctctgtacctggaagcgataatccaaaatcatcgggaagtcatgacatttgaagattttgctgcacaggtttttagtcccagtccgagctattcactcagtggcacgggggccctcgccagcagcctgagtgctgaccttgaggagcccctcagcgaggaggaaacagagcatcctctgcttccactcccccgagccactaaaccaaggatcagcagaaaattcaggtgctgtacttccgccctgagccggtccagccactag

SEQ ID NO: 25682 - DNA, 1836 bp, Artificial Sequence
  Description of Artificial Sequence: Synthetic coding sequence
atgccccacctggacatgaagacccacgtgtgccccagcgtggagggccccaaaaagaaaggcggaataacctgtttttgctgtggaggacccttccgagcagccgatcgctcaaagacccgcagcccaaagctcagccactccccacaacctccatctctcggggacccagtcgagcacctgagtgagaccagtgcggacagccttgaggctatgtccgagggtgacgcgcctacacctttctcgcgtggttctaggacgagagcctcactccccgtggtgcgttctacaaaccagaccaaagagagaagcctgggggtgctctatctgcagtacggggacgagactaagcagctcagaatgcctaatgaaatcacctctgccgatacgatccgggcactctttgttagcgctttcccgcaacagctgacgatgaaaatgctcgagagtccttctgtcgcaatctatattaaggatgagtcgcgcaatgtatactacgagttaaatgacgtgcgcaatattcaagatcgctcccttctgaaggtctacaacaaagacccggcccacgcctttaatcacactcccaaaacaatgaatggtgatatgcgcatgcagcgcgaactcgtctatgcccggggcgatggcccgggcgctccgcgccccgggtccaccgcccacccgcctcacgctattccaaacagcccaccttctacccctgtgcctcactcaatgcccccctccccctctcggatcccgtatggtggcactagatctatggtggtccctggcaacgccactatccccagggaccgaatctccagcctgcccgtgtcaaggcccatctcccctagtccaagcgccattctagaacgccgcgatgtgaagccagacgaggatatgtccggtaaaaatattgctatgtataggaacgagggcttttacgcggatccatatctttatcatgaggggcgtatgtctatcgcaagctcacacggtggccatcctcttgacgttcctgaccacatcatcgcgtatcaccgaacggctatcagatcagcgtcagcgtactgtaaccccagtatgcaagccgagatgcacatggagcaatcactctacagacaaaaatcccgaaaataccccgatagccaccttcccaccctcggctcaaagacacccccagcttctccgcatcgggtaagcgacttgaggatgatcgatatgcacgcccactataatgctcatggaccaccccacactatgcagccggatagggcatcacctagccgacaagcatttaagaaagagccaggcacccttgtgtacatagaaaaacctaggtccgccgccggcctatctagcctggtagatcttggaccccccttaatggagaaacaagtttttgcgtattcgacggccaccatccccaaggacagagaaacctctgaaaaaatgatgaagactacagccaacagaaatcacaccgactccgcgggcaccccccatgttagcggaggcaaaatgctttccgccttggagtccactgtgccccccagccaaccaccccccgttggtacttcagcgatacatatgtccctcctcgagatgcgcagatccgtcgccgagcttcgcctgcagttgcagcaaatgagacaactgcaacttcagaaccaggaactcctccgcgccatgatgaagaaagccgagctggagatctcgggtaaagtcatggaaactatgaagcgcctcgaagatcctgtccaacgacagagagttctggtagagcaggagcgccagaagtatcttcacgaagaggaaaagatcgttaagaagctttag

SEQ ID NO: 25683 - DNA, 189 bp, Artificial Sequence
  Description of Artificial Sequence: Synthetic coding sequence
tgagagaaccccctggtgtactgcgacggccacggctgcagcgtggccgttcatcaggcctgttacggcattgtccaggtccccactggaccctggttctgcaggaaatgcgagagccaggagcgcgcggctagggtggtgggcccaatgtggtttgtcccttgtatattccagcggtacaacctctag

SEQ ID NO: 25684 - DNA, 1869 bp, Artificial Sequence
  Description of Artificial Sequence: Synthetic coding sequence
atggccatggcccccagccccagcctggtgcaggtgtacaccagccctgcagccgtggcagtgtgggaatggcaagatgggcttgggacctggcatccttattcagcgacagtatgctccttcatcgagcagcaattcgttcaacaaaaaggccaacgctttggacttggctccctcgctcatagtattcctctggggcaggcagatccctcactggccccttatatcattgatttaccgtcgtggacgcagttcagacaggatacggggaccatgcgcgcggttagaaggcacctatttcctcagcacagcgcccccgggcggggcgtcgtatgggagtggctgtcggacgacgggtcttggacggcatatgaggcatccgtgtgtgattacctcgaacagcaagtcgctagggggaatcagctggtcgaccttgcccccctggggtacaactataccgtgaactacaccacgcacactcagactaataaaacctctagcttttgccgctcggtgagacgccaggccggccctccataccccgtcaccaccattatcgctccaccgggccatactggcgtggcctgcagttgtcatcagtgcctctccggatctagaactggaccagtgtccggacggtatcggcatagcatgacaaatctccctgcatatcctgttccccaacatccccctcatcgaaccgcatccgtcttcggtacacatcaggcgtttgctccctataacaagccctcactgagcggcgcccgaagcgcccctcggctgaacacgacaaatgcctggggcgcggcacctcccagcttgggttcccaaccgctgtatagatcaagcctatcccacctcggacctcagcatctgccgcctgggagtagtacttcaggcgcggtgagcgcctctttgccctccggtccctcatcctcccccggcagcgtgccagcgaccgttccaatgcagatgcctaaacccagccgcgtccagcaggcacttgcagggatgacatcagtgctcatgagtgccatcggtttaccagtgtgcctgagtcgggccccacagcccactagtcctcctgcaagcagactcgcttccaagtctcatggctccgtgaaacgccttaggaaaatgtctgtcaaaggtgctaccccaaaaccagagccggagcccgagcaggtcataaagaactatacagaggaactgaaagtgccgcccgatgaagattgtataatttgcatggaaaaactgtccactgcttctggatactctgatgtaaccgattccaaggcaattgggtcactggcggtcgggcatctaactaagtgcagccacgcttttcacttgctatgtctgctggccatgtattgtaacggaaataaggacggatcgcttcagtgtcctagctgcaagacaatatatggagagaagactggaacccagccccagggcaaaatggaggtgctgagattccaaatgtcacttcctggccacgaggactgcggcacaattctgatcgtgtactctattcctcacggcatacaaggccctgaacacccaaatccaggcaagcccttcactgcacgagggtttcctcgtcagtgctacctgccagacaacgcacagggtaggaaggtgctcgaactgctcaaagttgcatggaagcggaggctgatcttcactgtggggaccagctctactaccggggaaaccgacacggtcgtgtggaacgaaatccatcataagactgagatggaccgaaacattacaggtcacgggtatccagatccgaactacctacagaacgtcctggccgaactggcagcccagggcgtgactgaggactgtttggagcaacagtag

SEQ ID NO: 25685 - DNA, 546 bp, Artificial Sequence
  Description of Artificial Sequence: Synthetic coding sequence
atgggcggccggagcgcccaggccggcctgggcacccggatcaccccaatgatggaactgaaaccaaatgccgggagcgaccgcgcctgggtgtggaacacccatgctgatttcgccgacgaatgccctaagccggagttactggccatcaggtttttgaacgctgaaaacgcccaaaaattcaagaccaagtttgaagaatgccgcaaagaaatcgaagagcgagagaagaagggtgatgtggtcccttgggtaggtggcctgctctgccggctgaccctgcacctaactatattacccggtggttgttttttttgtctccctgacaaacatagccgtgttctgtggcctccgcatgtttcgagagtaatgcaactccctggtgataccggggcctcctggggggccctgtccacttgccaatgctgctggccacagtcaaactgggccggcattggcgtgagggccctgcctggagcacaccagaaagtgctttacgatggacccagattcgtttcccaacgtgcttggtctcccttgccgtag

SEQ ID NO: 25686 - DNA, 378 bp, Artificial Sequence
  Description of Artificial Sequence: Synthetic coding sequence
atgagcagcagcggctacccccccaaccagggcgccttcagcaccgagcagagtcgctacccccctcattctgtgcagtacacattccctaatacacgtcaccagcaggaattcgccgtgcccgattatcggagcagccatctggaagtgtcccaggcttcccagctcctccaacaacaacaacagcagcagctgaggcgccgaccatctctcctctccgaattccatcccggctccgacaggccacaggagaggaggacttcttatgagccgttccatcccgggccaagccctgtcgaccacgactctctagaatccaagagaccccgccttgagcaggtgagtgacagtcatttccagcgagtcagtgcagcgtag

SEQ ID NO: 25687 - DNA, 318 bp, Artificial Sequence
  Description of Artificial Sequence: Synthetic coding sequence
atgctgcggtgcggccagatgatcttcgcccaggccctggtgtgcagacacctgggtcgggattggagatggacccagagaaagagacagcctgattcatacttctcagtactaaacgccttcatagatcgtaaagattcctactatagtattcatcagatcgcccagatgggtgtcggtgaaggcaaatccataggtcaatggtacggcccaaatactgtggcccaggtcctcaagaaacttgccgtgtttgacacatggagctccctggctgttcacatagctatggataatacagttgtcatggaggagatatag

SEQ ID NO: 25688 - DNA, 1305 bp, Artificial Sequence
  Description of Artificial Sequence: Synthetic coding sequence
atggacatcgacaaggacctggaggcccccctgtacctgacccccgaaggctggtccttgtttttacagaggtattaccaggttgtgcacgagggtgctgagctgcgccacctggatacacaggtccaaagatgtgaggatatcttacagcagctccaggcagtcgtgccacagatcgacatggagggagacaggaatatctggatagtcaaaccaggcgcgaagagcagaggtcgcggaataatgtgcatggatcaccttgaagaaatgctgaaactagtcaatggcaatccagtggtgatgaaggatggcaaatgggttgtgcaaaaatatatcgaacggcctctgctcatctttggaactaagtttgacctacggcagtggtttctggtaacggactggaacccccttactgtttggttctatagggactcttatataagattctcaacccagccattttccttaaaaaacctcgataattcggtgcacctgtgtaacaactcaattcagaaacacttggaaaattcatgtcacaggcaccccttgctacctcccgacaatatgtggtcttcccagcgatttcaggctcacctccaggaaatgggcgcgccaaacgcctggagcaccataatcgttccaggaatgaaagatgccgttatacatgccctgcagacaagtcaggacactgttcagtgtaggaaggctagctttgagctgtacggcgctgactttgtatttggggaagacttccagccctggcttattgagattaacgcgagcccaactatggcgcccagtactgccgttaccgctaggttgtgcgccggcgtgcaagctgacactctgcgggtggtcatcgacagaatgttggatcgcaactgtgatactggtgccttcgaattaatctataagcagcctgctgttgaagtcccccaatatgtaggcatccgacttctcgtcgaaggatttacaatcaagaagcctatggcaatgtgccatcgaaggatgggcgtacggcctgcagtccccttactgacacagagagggagtggtgaagccagacatcattttccctctctccatactaaggcccaactgccctctcctcacgtgctccgccaccagggacaggtcttacgacggcagcactctaaattagtggggactaaagcactatccactaccgggaaggccctgcggacattgccgacggctaaggtgttcatctctctgcccccaaatctcgactttaaagtggccccaagcatcctaaaaccgagaaaggtgggcctcgacctttag

SEQ ID NO: 25689 - DNA, 576 bp, Artificial Sequence
  Description of Artificial Sequence: Synthetic coding sequence
atggccatcggcaagcggctggccaccctgcccaccaaggagcagaagactcagaggctgatatctgaactctccctgctcaaccataagctgccagccagggtgtggcttccaactgccggattcgatcaccacgtggtgcgggtgccccatacacaggccgtggtcctaaattctaaagacaaagcaccctatttaatttacgtggaggtccttgagtgcgaaaattttgacaccacgagcgtgccggctcggatcccagaaaacagaatccgcagcacacggagtgtcgaaaacctgcccgagtgtggaataacacatgagcagcgggcaggcagcttctctactgttcccaattatgataatgatgacgaggcctggtccgtcgacgacattggcgaattgcaggtagaactgcccgaggtccataccaatagctgcgacaatatttcccaattcagtgtggactccatcacatcacaggagagtaaagagcctgtctttatcgccgctggggacattagaagaaggctgtctgagcagctggcacatactccaacagcctttaaaaggtag

SEQ ID NO: 25690 - DNA, 903 bp, Artificial Sequence
  Description of Artificial Sequence: Synthetic coding sequence
atggccaagtggggccagggcaacccccactggatcgtggaggagcgtgaggacggcaccaatgtcaataactggcggtggaggacagaaagagatgcaacatccctgtctaaggggaagtttcaagagcttttagtcggcattgtggtggagaatgacgccggtcggggcgaaatcaacgagcttaagcaggtagagggcgaggcgagctgctcctctcgcaaagggaagctcatattcttttacgagtggaatatcaagctaggatggaaaggaattgttaaagagagcggtgtgaagcacaaaggactaattgaaatccccaacctgtccgaggagaacgaggtagacgatacggaggtatccctgtctaagaagaagggcgatggggtgatcttgaaagacctgatgaagaccgccggcaccgccaaggtcagagaggccctgggcgactatctcaaggcactgaaaacggaatttacaaccgggatgatcctgcccaccaaggcgatggccacccaggagctgacagttaagcgtaagctgagcggaaacacgttacaggtgcaggcttctagccccgtggctctgggtgtgcggattccaaccgtggctttacatatgatggaactttttgacacaacagttgagcagctgtacagcatctttacggttaaagaactgaccaacaaaaagatcattatgaaatggcggtgcggaaattggcccgaagaacattacgccatggtcgccttaaacttcgtgcccacattgggccagactgagttgcaactgaaggaatttttatctatttgtaaggaggagaacatgaagttctgctggcaaaagcaacactttgaagaaattaaggggtccctgcagctgacccctctcaatggctag

SEQ ID NO: 25691 - DNA, 1137 bp, Artificial Sequence
  Description of Artificial Sequence: Synthetic coding sequence
atgaaggacgtgcccggcttcctgcagcagagccagaacagcggcccgggccagccggcagtatggcatcgcctggaggagctttataccaaaaactttatgaagacgctgtctgtcaacctgaatactggtaagtctctgagctctgtcttccactttgagaacgaatgcatcgatgcaaggaggtgctctaaggctggtggattctacttcagggttaaccccctttccttggtggaaatcattttacacgtggtcaggcagatgactgaccccaatgtcgcactgacttttttagaaaaaacccgcgaaaaagtgaagagctccgacgaagcagtaatcctctgcaagacggccataggagccttgaagctcaatatcggggatttacaagtaacaaaggaaacgattgaggacgttgaagaaatgctgaataacctacccggagttacttccgttcacagcaggttctatgacttatcaagtaaatattaccagaccattgggaatcacgcaagctattacaaagacgccctgcgatttctaggttgcgtagatattaaagaccttcctgtaagtgaacagcaagagcgggctttcaccctgggtcttgctggcctcctgggggaaggggtgtttaattttggagagcttttgatgcacccggtgcttgaatccttgcgaaacacagatagacagtggctgattgatacactgtacgcttttaattctggaaacgtggagaggttccaaactcttaagaccgcatggggacagcagcccgatcttgccgccaacgaggcccagcttctgcggaaaatccaactactgtgcctgatggaaatgactttcacaaggcctgccaaccacagacagcttaccttcgaggagatcgctaagtccgccaagattactgtcaacgaagtggaactactggtgatgaaggccctgtcggttgggcttgtaaaggggtcaattgatgaggtagacaagcgggttcacatgacttgggtccagcctcgtgtgctcgacttacagcagatcaagggcatgaaagaccgcctcgaattctggtgcaccgacgttaaatccatggagatgctcgttgagcaccaagcacacgatatattgacttag

SEQ ID NO: 25692 - DNA, 603 bp, Artificial Sequence
  Description of Artificial Sequence: Synthetic coding sequence
atgctgctggagcagaacctgatcaccgtggacatgcagaagcactccctgacattctggtggctggtggagtgctggccgcaggttttcaataaactgataagacggtacaaatatctcgaaaaggggttcgaggatgaagtgaagaagctccttctgttcttgaaaggctttagcgagtccgaacgcaataagctggctatgctgacaggcgtgttactcgctaacggtacactgaatgcctctatcctgaactccctgtataacgaaaatctggtaaaggagggcgtttctgcggccttcgcggtaaaactgttcaagagttggatcaacgaaaaggacatcaacgccgtggcagctagtctgcgaaaggtgagcatggataacagactcatggaacttttcccggcgaacaagcagtcagttgaacacttcacaaagtattttacagaggccggactcaaagagttatcggagtacgtgaggaaccagcaaacaataggtgcccgaaaggagctgcagaaagagctacaggaacaaatgtcccgcggcgatccctttaaggatatcatcctgtatgtgaaggaggagatgaagaaatag

SEQ ID NO: 25693 - DNA, 1446 bp, Artificial Sequence
  Description of Artificial Sequence: Synthetic coding sequence
atggccagcgccgccagcgtgaccagcctggccgacgaggtgaactgcccaatatgccaaggtacgcttagagagcctgtgacaattgattgtggccacaatttctgcagagcctgcctgacacgctactgcgaaattcctgggccggatcttgaagagagccccacctgccctttgtgcaaggagccattccggcctggcagttttagacccaactggcagctcgcgaacgtcgtcgagaatattgagcgtctccagctggtcagcacactcggcctgggcgaggaagatgtgtgccaggaacacggggaaaagatttacttcttttgcgaggacgacgagatgcagttgtgcgtcgtctgcagagaagctggtgaacatgcgacgcacactatgcgttttctggaggacgctgctgccccctaccgagagcaaattcataagtgcctgaagtgccttcggaaggagcgagaggaaatccaggagatccaaagccgggagaataagaggatgcaggtcctgctgacacaggtcagcactaagagacagcaggtgatctccgaatttgctcatcttaggaagtttctggaggagcagcagtctattttgctggcccagctagagtcacaggacggagatattctgcgacagcgggatgagtttgatctcctggttgccggcgagatatgccgattttctgccctgatcgaggagctggaagaaaaaaatgaacgacccgcgagagaactactcaccgatataagatcgacactgattagatgcgaaacccgcaaatgtcgcaaaccagttgccgtgtcccctgaattgggacagaggattagggacttcccccagcaggctctgcccttacaacgtgaaatgaaaatgttcctggagaagctctgtttcgaactcgattacgagcccgcccacatctcacttgacccacagacgtcacatcccaagttactactctccgaagatcatcagcgcgcccagttttcgtataaatggcagaatagtccagacaatccacaacgattcgatagagccacgtgcgttctcgcccatacgggtattaccggagggcgccacacatgggtggtgtctattgatttagcccacggcggtagttgtaccgtgggcgttgtgtccgaagatgtgcagagaaagggggaactgaggcttcgtcctgaagaaggggtgtgggcagtgcggctggcctggggctttgtgagtgccctgggctcatttcccacacggctgacactcaaggagcaacccagacaggtccgagttagcctcgattatgaggtggggtgggtcacttttaccaacgcagtgacacgggagcccatatacacattcactgccagcttcacccgcaaagtgatccccttttttgggctttggggacgcggcagtagcttttcgctcagcagctag

SEQ ID NO: 25694 - DNA, 261 bp, Artificial Sequence
  Description of Artificial Sequence: Synthetic coding sequence
atgggcaagatggtgagcgtgatcaacaccgtggacaccagccacgaggacatgatacacgacgctcaaatggattactacgggactcgcctggctacatgttcctctgatcggagcgtgaagatctttgatgttcgtaatggcgggcagattctgatcgcagacttaaggggtcacgagggccccgtttggcaggtcgcatgggctcaccctatgtatggtaacattctcgctagctgctcctacgaccgaaaagtgtag

SEQ ID NO: 25695 - DNA, 660 bp, Artificial Sequence
  Description of Artificial Sequence: Synthetic coding sequence
atggagcccagcgcccagcagctgcagctggccgccagcctgcccgctaatctgagtaatttttgccaggggtctgagatgcctactaccagtagacccgctcttgacgtgaaaggagggacttctccagccaaggaggacgctaaccaggagatgtcttcagttgcatactctaatctggcagtaaaggaccggaaagctgtcgctatcttgcactacccaggagttgctagcaacggcacaaaggcttctggagccccgacatcctcttccggctcacccattggctcacccacaacaacacctcctaccaagccaccttcatttaacctgcaccctgccccccaccttctggctagtatgcacctacagaaactgaattcccagtaccaaggcatggccgctgctacacctggccagcccggagaggcaggccctttacagaactgggacttcggcgcacaggccggcggtgccgagtctttatctccttcagccggcgctcagagtccagctatcattgatagcgacccagtcgatgaggaggttctgatgtcattggtcgttgagctgggactggatcgtgccaatgaactgccagagctgtggctgggtcagaatgagtttgactttaccgccgacttcccctcctcgtgctag

SEQ ID NO: 25696 - DNA, 396 bp, Artificial Sequence
  Description of Artificial Sequence: Synthetic coding sequence
atgctgtgctggggctactggagcctgggccagcccggcatcagcacaaatttacagggcatcgtcgcagagcctcaagtctgtgggttcatttcagatcggtcggtgaaagaggttgcctgcggcggcaatcattctgtgtttctgctcgaggacggggaggtctatacttgtggcctgaacactaagggtcaactcgggcacgagcgagaaggcaacaaacctgaacagatcggcgctcttgcagatcagcacattatccacgtggcctgtggggaatcccatagcctcgctctgtccgacagagggcagctgttctcttggggagccgggtcggacggtcagctcggtctgatgacaactgaggatagtgtagcagtgccccggctgatctag

SEQ ID NO: 25697 - DNA, 3099 bp, Artificial Sequence
  Description of Artificial Sequence: Synthetic coding sequence
atggagggcgccctgaccgcccgggacaaggtgggcgtgcaggacttcgttttgttggatgcgtatacaagcgagtctgcttttgtagataacctgcgcaaacggttttcagagaacctgatttacacttatatcgggactcttctggtctccgttaacccttaccaggagttaggaatttacaccgtcagccagatggaactgtaccagggggtgaacttctttgagctcccccctcacgtgtacgcgattgccgataatgcatataggatgatgtgcgcagagctgaataaccactttatcctgatctccggcgaatctggtgctgggaagacagaggcatctaaaaaaattctggagtacttcgccgtgacgtgtcccatgacgcaaagcttgcagattgcgcgggaccgactattattttctaatccggtcctggaagctttcggcaatgcacggacactcagaaacgacaactcaagccgttttggcaagtacatggatattcagtttgattttcagggaatccccgttgggggacatataatttcttacctaattgaaaaatcccgtgtagtttaccaaaatgagggcgaaagaaactttcacatcttctaccaactcctcgcaggcggtgaggaggaacgcctttcatatttgggattagagcgggacccccagctatacaagtatctgagtcagggccactgcgccaaggagtcctctatatctgataagaacgactggaaaactgtctctaatgcattttccgtcatcgatttcactgaggctgaccttgagaatcttttcggcattattgcttctgtgttacatttaggtaacatcggatttgaggaagacgaccagggatgtgctaccattccggatacacacgagatcaaatggatcgcaaagctgctgggagtgcacccgtccgtactactagaggccctgacacaccggaagattgaagctaagacagaagaagtgatctgtcccttaactctagagctctctgtctacgctcgggacgctatggctaaagccgtctacggcagaacatttacgtggctggtcaacaaaatcaacagttccctcgttaacaaggtggggcagcggattcttgatcccctgcttctcctgacatggaagacagtgatcggcctactggacatttatggcttcgaggtcttcgataagaacgggtttgagcagttctgcatcaactactgcaacgaaaagctgcagcagttgttgatcgagcgtacactgaaagccgagcaagctgagtatgagatggaggggatcgagtgggagcccatcaaatactttaacaataagattatatgtgatcttgttgaagaacgacataaaggcatcattagtatcctagatgaggagtgcattcggccaggccctgctacggatctgagcttcttggaaaagctggaggaaaaggtgggaaaacacgcacatttcgagactcggaagctcgctggacccaagggtcgcaagcggatcggctggatggaattccgcctcctacattatgccggcgaggtcacctactgtactaaggggttcctcgagaagaataatgacttgttgtaccggcacctcaaggaagtgttgtgcaaatcaaagaacattattctgcgcgagtgctttctgctggctgaattagagaacagacgccgaccacccaccgttgggacacagtttaaaaacagtcttagctccctgcttgaaaccctgattagtaaagaacctagctacatacggtgtatcaagcctaatgatcgtaaagaaccatccaagtttgatgactttctgattcgacatcagattaaatatctggggcttatggagcatctgcgcgtgaggcgcgccggttttgcatataggcgtaagtacgaacactttttacagagatacaagtcactgtgtcctgacacgtggccacattggcacggccccccagctgagggcgtggagagactgatcaaatacattgggtacaaaccggaagagtacaaactcggcaaaactaaaatctttatccggttcccccgaaccctgtttgccacagaagatgcttttgaattctccaagcatcaactggtggctcgaatccaggcaacctacaagcgctgccttgggcgcagggagtacgttaaaaaaagacaggcagctattaaattagaagcgcattggagaggagcacttgccaggaaagccatacagcgaagaaagtgggccgtgaggatcatacgcaagtttatcaagggtttcattagccgtaacaaacccctgtgccctgacaatgaagaatttattgtcttcgtacgcaaaaactacatcctgaacctgcggtaccaccttccgaagactgtgctggataagagctggttacgtcctcccggaattctcgagaacgcgtccgatttgctaaggaagatgtgcgtgagaaacctggtgcagaagtattgtcggggtatcaccgctgagaggaaagctatgatgcagcagaaggtggtcacttcagaaatctttagaggcaggaaagatggatacactgaatctcttaatcagccctttgtgaactcacgaattgatgagggggacatcaacccaaaggtgctgcagctgatatcacacgaaaaaattcagtacggggtgccggtcattaagtacgataggaaaggttttaaggcgaggcagagacagttgattctaacacaaaaggccgcatatgtggttgagcttgccaagatcaagcaaaagatcgaatactcagccctgaaaggcgttagcacctccaacctaagtgatgggattctcgtaattcacgtgtctccagaggattccaagcaaaaaggcgacgcagtgctgcagtgtgggcacgtattcgaagctgttacgaagctggtcatgctcgtgaagaaggagaacatcgtgaacgtcgtccaaggctcgctgcagttcttcattagccccggaaaagagggcacaatagtgtttgataccggcttggaagaacaggtctacaaaaataaaaatgggcagctgaccgtcgtatcagtgcgccgcaagtcgtag

SEQ ID NO: 25698 - DNA, 1176 bp, Artificial Sequence
  Description of Artificial Sequence: Synthetic coding sequence
atgtgcagccagctgtggttcctgaccgaccggcggatccgggaggactacccacaagtgcaaatcctgcgcgcactgaggcagcgctgctccgaacaggatgtgcgcttccgtgccgtgctaatggaccaaattgcggtgactatcgtcggaggtcatctgggattgcagctgaaccagaaggcacttacaacgtttccagatgtcgtactagttcgagtgccaacaccatccgttcagtccgattccgatattacagttctccgccaccttgaaaagctgggctgtagactagtcaatcgccctcagtccatcctgaactgcataaacaaattctggacatttcaggagttggcggggcacggggtccccatgcccgacaccttctcttatggagggcacgaagacttttctaagatgatcgatgaggctgagcctttggggtaccccgtggtggtgaagagcacacgtggtcacagaggcaaagccgtgttcttggcgcgggacaagcaccatctgagcgatatctgccatttgattcggcacgacgtgccctatctcttccaaaagtacgtgaaggaatcccacggcaaagacatcagggtggttgttgtcggtgggcaggtcattgggtcaatgctaagatgtagcaccgacggcagaatgcagtcaaattgcagcttggggggtgtgggcgtcaaatgcccccttaccgagcagggcaagcagctggccatccaggtttctaacattctggggatggacttttgtggaatcgatctgctgatcatggacgacggcagctttgtggtttgcgaagctaacgccaacgttggctttctggcatttgaccaggcatgcaatcttgatgtcggaggcattatcgccgactacactatgtccctgcttcccaatcggcagaccggaaagatggctgttctgcccggcctcagctcccctagagagaaaaatgaacccgacggttgtgcttctgcgcagggcgttgcggagagcgtctacaccatcaatagcggatcgaccagcagcgagtctgaacctgaactgggcgaaatcagggacagttcggcctcaacaatgggagctcctccttccatgctgccggaacctggatataacataaataatcggatcgcctcagagttgaagctgaagtag

SEQ ID NO: 25699 - DNA, 1065 bp, Artificial Sequence
  Description of Artificial Sequence: Synthetic coding sequence
atggacatggaccacatcatgacctgggccaccgacgtggccaagggtatgcattacctgcacatggaggctcctgtaaaagtgatccatagggatctgaagagccgcaacgttgtcatcgcagcagacggcgtgctcaagatatgcgactttggtgccagtcggtttcataaccacacaacgcacatgtccctagttggaaccttcccatggatggcaccagaggttatacagagcctgcctgtcagtgagacatgcgatacgtactcttatggcgtagtgttgtgggaaatgttaacaagagaagtgccttttaagggactcgagggcctgcaggtcgcctggctggtggtcgagaaaaatgaacgccttaccatcccgtcttcttgcccgcgatcctttgccgagttgctgcaccagtgctgggaagctgacgcaaagaaaaggccatcattcaaacaaatcatcagcatcctggagagcatgtcaaatgacacttctctccctgataagtgtaattcatttctccacaataaggcggagtggaggtgcgaaatcgaagccaccctggagagacttaagaagctggagagagatctgagtttcaaggagcaggagctgaaagaacgtgagagaaggctgaaaatgtgggagcagaagcttaccgaacagtccaacacaccacttctgctgccattggccgctaggatgtcagaggaatcttactttgaatccaagactgaagagtctaacagtgcagagatgtcctgccagattaccgccacttctaacggggagggccatggtatgaatccctctctgcaggccatgatgttgatgggctttggggacatcttctcaatgaataaggccggagctgtgatgcacagtggcatgcagatcaacatgcaggccaaacagaacagttccaagactacatctaagagaagaggcaaaaaagtcaacatggctctcggattctccgattttgacttatcagagggtgacgatgacgacgacgacgatggggaagaggaagacaatgacatggataactcagaatag

SEQ ID NO: 25700 - DNA, 1707 bp, Artificial Sequence
  Description of Artificial Sequence: Synthetic coding sequence
atgctggagcggccccccgccctggccatgcccatgcccaccgagggcactcccccccccctgtccggtacccctatccccgttccagcctattttcgtcatgcggagcccggtttttcactgaaaaggcctcgtgggttgtctcggagtctccctccacctcccccagcgaagggaagtatacccatcagccggctctttccgccccgtacacccggttggcaccagctgcagcctcgaagggtgagctttcggggagaagcttcagagaccctgcagtcgcccggctatgaccctagtcggcccgagagcttcttccaacagagcttccaacggctgtcacgccttggacacgggtcttatggtgaggtgttcaaagtgcggagcaaagaagacggacgcctctatgcggtgaagagaagtatgtccccttttagaggtcctaaggatcgggcccgaaaactggccgaggttgggtctcacgagaaagttggtcaacacccctgctgcgtgagactcgaacaggcctgggaggaaggtgggatcctctatctgcagacagaactctgcggcccctctttgcagcagcactgcgaagcctggggggcctctctcccagaagctcaagtgtggggttatcttagggatacgcttcttgcactcgcccacctgcactcacagggtctggtacacctcgacgtgaagcccgcaaacatttttttgggtcccaggggacgctgtaaactaggggactttgggctcctggttgagctgggtacggccggcgctggagaggttcaggagggtgatcctcgctatatggcacccgagctgctgcaaggtagttatgggacagccgcagacgtgttctcactggggctgacaatcctcgaggtggcctgcaatatggagctgccccacggtggtgaaggatggcagcagttacgccagggatatctcccgccagaattcaccgctggcttatcatctgaactacggtctgtgctggtgatgatgcttgagcccgaccccaagctgagggccactgcagaagccttacttgctctcccagtgctgcgccagcctcgagcatggggggtgttgtggtgtatggccgcggaggcactgtcccgcggatgggccctgtggcaggcactccttgccctgctgtgctggctgtggcatggtctggctcaccccgcaagctggcttcagccgctcggacctccggccactccacctggatctcctccatgctcacttctattggactcgtctctgtctagcaactgggacgacgacagcctcggcccctccctgtcccccgaagcggtcctcgctcgcacggtgggatcgacttccaccccaagaagcagatgtactcccagagtgctcacccccttgagactttcgcctgcagcggagccgtcggccccagggctggggcccgcagccgaggcgccttgctgcgtggagcagaggggcttcctgtccagacacatacctcggagcttcagtgcctttcaggccgccccgccgaaatccgcttgcaatgcattgcacctgcatggccacacccaaccatctgccttcgtctggtctctaacctgtagctcacaccacgggagaaccttcgaggcccggaccaaagtggatccattgtttaaaatctgcggcgggtttctgacagtgtttgccgacctgtag

SEQ ID NO: 25701 - DNA, 642 bp, Artificial Sequence
  Description of Artificial Sequence: Synthetic coding sequence
atggccgagaccgaggagcggagcctggacaacttcttcgccaagcgggataaaaaaaagaaaaaggaacggtccaatcgagccgctagcgccgctggtgccgcaggaagtgctggaggctcctccggggccgctggcgctgctggtggaggtgccggtgcgggtacccggcccggcgatggtggaacagcctctgcaggggccgccgggccaggggccgctacaaaagccgttaccaaggacgaagatgagtggaaagaacttgagcaaaaagaagtggattattcaggcctgagggtgcaggcaatgcaaatttccagtgagaaagaggaggacgacaacgagaagaggcaggacccaggggataactgggaagaaggaggagggggcggaggggggatggaaaaatcatccggaccttggaacaaaaccgctcctgtgcaggcccctcccgcccctgttatcgtaactgagacacctgaaccagcaatgacgtccggtgtatatagaccccctggcgcccgtcttacaaccacacggaagacacctcaggggcctcctgagatatacagcgatacacagttcccaagtttacaatctaccgcgaaacacgtggaatccagaaaccggtacttaaaatag

SEQ ID NO: 25702 - DNA, 4140 bp, Artificial Sequence
  Description of Artificial Sequence: Synthetic coding sequence
atggccagcagccccaccaagggcctgaccatgagcgtgcccgtggctcctaaaaaaagctgctacacccaactgcgagacaatcgcaatgcggctcgaaacaacaacgagtcgatactaagtcttggcgatacaaacgcaaatcagataatgctagaggtgtctagctcccatgatgagtccaaaacttgtgatctaggcgacgaaatcggcaacaccaactccagtgagcccgaaaacaggacccactttcacaaggagtttcatcaactccaaggattcgggaaggggagccaagcaggttccgcctctctaaaggattttaggctgagttccacgatccagcgggagctgaacgaagagcataccgtcgagaggggcacagattctctccagacgaccagatctatccagggacctagcttaagcagttggaggaatgtgatgagcgaagcttccttggatgtactggcaaaacgcgacgccgaaataccacgccacgtccccaaagacaaactggccaagacactggataatgaggagctccgcagacacagtttggagagggcctcgtctagcgtggctgcagtaggcagtctgaccccacaacatccccagcccctcagcctggattctcgagaggctcgagggcaaattcctggcgggggcgagggccctcagaaaacactgcccgatcatgctgtgcccgctgccttcccggccactgactcaaccagtgaaggcaagagtgtccggcatcccaaaccaagcactagcgaaagtaagcaatccacacctagtgaaactcagacagtgggtgcccacgtcctccaagtgtgctctgaacacactagccattctgcccaccctgagccagccttaaatctgacactggccagcaaggagatcccttccaaattggaagcacaactaggccaaggaaagggggaggcaaaactggacctcaaatatgttccccccagacgtgtggaacaggagggcaaagccgcccaagaaggatatctcggttgtcataaagaagagaacctgtcagctttggaaggccgcgacccttgcggtgaggcacaccctgaagcaacagacgcgctgggacacctcctcaactccgatctacaccacttgggcgtcggaaggggaaattgtgaagagaagcgcggggtaaaccctggagagcaggatagtctccacactacccccaagcaggggagtgcatcattgggcggcgcagataaccagcccaccggtaaaatcagcccatgcgccggcgagaaactgggagagagaaccagctctagtttctctccgggcgacagtcacgtcgctttcattccgaacaatctcacggacagcaagcctctcgacgtcatcgaagaagaacgtagactgggaagcgggaataaagattccgtaatggtgctggtctttaacccatctgtcggtgaaaacaaaactgaggtacccgaacccctggacccacaatcggggcgcagtgaggctagagagtctaaggaggtgaccaccagcgtggctgagaacaggaatcttctcgagaatgcagacaagatcgaatccacaagtgccagagccgattcagtactgaatatccctgcgccactgcaccctgagaccaccgtaaatatgacatatcagcctaccaccccatcatcttccttccaggatgtgtccgtcttcggcatggacgcaggtagcccactggtggtcccaccccccacagattcagcccgactattgaatacgagcccaaaggttcccgataaaaacacctgtccctccggtattccgaaacctgtgtttacacactccaaagacaccccctctagccaggaaggcatggagaattatcaggtggagaaaactgaagagagaactgagacaaagccaatcatcatgcctaagcctaaacatgtacgacccaaaataattacttatataagacgaaacccacaggcccttggccaggtggatgcctcgcttgtgcctgttgggctgccttatgcgcccccaacatgcaccatgcctcttccgcatgaggagaaagcggccggcggggatctgaagcccagtgccaatctttacgaaaagttcaagcccgacttgcaaaagccgagggtgttctccagcggtctcatggtgagcgggattaaacccccaggtcatccttttagtcagatgagcgaaaaattcctgcaggaagtcaccgatcatccgggaaaagaggaattctgctcgcccccatatgcacattatgaagtacctccaactttttatcggtccgctatgctgctaaaaccccagctgggcttgggggccatgagtaggctcccatccgcaaagtcccgcattcttatcgccagtcagcgcagctctgcctcagctatacatcctcctggtcctataacgacagcaactagtctgtactcatcggatccgtctgccgacttgaaaaaagcgtcttcatccaatgcggcaaagagcaatctgccaaagtcaggactcaggcctccaggatatagcaggctacccgcagcaaaactcgccgcgttcggctttgtgagatcttcctcagtttctagcgtttcgtcaacacaaagcggggactccgcacaaccggagcaaggacgaccagccacccgctccacttttggaaacgaggaacagcccgtcctgaaggcctcgctgcccagcaaggacacacctaagggcgctggacgcgttgctcccccagcctcctcaagtgttactgcaccccgcagatcactactgcctgcgccgaagtctacaagcacacccgccgggacaaagaaagatgcacaaaaagatcaagacacaaataagcctgcggtgagctccccaaaacgggtagctgcctcaacaactaagctgcacagccccgggtatccaaagcagcgaacggctgccgcaaggaatggcttcccccccaaaccggatcctcaggcccgggaagctgagcgtcagctggtcctcagactgaaggagcgatgcgaacagcagacaaggcagctaggtgtggcacagggcgagctcaagcgagccatctgcggctttgacgcgttggctgttgctacccagcacttttttcggaaaaatgagtccgcattggtgaaagaaaaggaactgtccatcgaactggcaaatattagagacgaggtggccttccacacagctaagtgcgaaaagttgcagaaagaaaaggaggaattggagagacggttcgaggacgaggtgaaacgcctgggttggcaacaacaagccgaactgcaagaattggaagagcgcctgcaattgcaattcgaggcagagatggcgaggctgcaggaggaacatggagaccaacttctgtctatccggtgccaacaccaggagcaagtggaggacctgactgcttcacatgatgctgcgttgctggaaatggaaaacaaccacaccgtggcaatcactatactgcaggatgaccacgatcataaggtgcaggaactgatgtcaacacacgagctcgaaaagaaagagttggaagagaacttcgagaagctccgactgtccctgcaagaccaagtcgatacactgacgtttcagagccagtctttgagggaccgagctcggcgcttcgaagaggcacttcgaaaaaacaccgaagagcagttggagatcgctctcgcgccttaccagcatctggaggaagacatgaagtcactcaagcaggtgcttgagatgaaaaaccaacagatccatgagcaggagaagaaaatcctggagttggagaagcttgctgagaagaacatcattttggaagaaaagatccaagtgctccagcaacaaaacgaagatctcaaggcgaggattgatcagaacactgtcgtgacaaggcagctgagcgaggagaacgccaatctccaggagtacgtcgagaaagagacacaggagaagaagaggttatcccggacaaacgaagaactactatggaaactgcagaccggcgatcccactagtccgatcaagctctctccaacttcccccgtgtatcgaggaagttcaagcgggccatcctctcctgcacgcgtgtcaaccaccccccgctag

SEQ ID NO: 25703 - DNA, 1041 bp, Artificial Sequence
  Description of Artificial Sequence: Synthetic coding sequence
atgcagcacctgaagagcaagaagcgggaggagcggtggatgcgggcctctaaacgacagagtgagaaggagatggaagagctgcaccacaacatcgacgatctgcttcaggagaaaaagtccttggaatgcgaggtcgaggaactgcatcggaccgtgcagaaacgtcaacagcagaaagactttatagatggcaacgtggagagcctaatgacagaacttgagattgagaagtctcttaaacatcacgaggatatcgttgatgaaattgagtgcattgagaagacactgctgaaacgacgtagtgaactccgggaagctgaccgactcttggcagaggcagaatccgaactgtcctgcactaaggaaaaaacaaaaaacgccgtggaaaagttcaccgacgccaagaggagcctgctgcagaccgaaagcgacgccgaagagttggagcggagagctcaggaaactgcagtcaatctggtgaaggccgatcagcagttgcgatccctgcaagccgatgctaaggatctagagcagcacaaaattaagcaagaagaaatcctcaaagagattaacaaaatagtggcagccaaggatagtgatttccagtgcctcagtaagaaaaaagagaagctgacagaagagctgcagaagctccaaaaagacattgagatggcagagaggaatgaggatcaccacctgcaggtgctaaaggagagtgaggtactactgcaggccaaacgggccgaactggagaagctcaaaagccaggtcacatcgcaacagcaggagatggctgtgctggatagacagctcggccacaaaaaggaggaactgcacctcctgcaagggagcatggttcaggccaaagccgacctgcaggaggcactgcgtctgggtgaaaccgaggtaaccgaaaaatgcaaccatatccgcgaagttaagagcctccttgaggagctgtcattccagaagggggagttgaatgtgcagataagcgagcgtaagacccaactcacgctaatcaagcaggaaatctag

SEQ ID NO: 25704 - DNA, 369 bp, Artificial Sequence
  Description of Artificial Sequence: Synthetic coding sequence
atggccaccagcgcccccctgcggagcctggaggaggaggtgacctgttctatttgtctcgactatctgcgggaccctgttaccatagactgcgggcacgtcttctgccgctcatgtacaacagatgtgagaccaatttccggctcaaggcccgtgtgtcccctgtgtaaaaagcccttcaaaaaagaaaacatcaggccggtgtggcaattggcttcactcgtcgaaaatattgagcggcttaaggtggataaaggacgacagccaggagaagttacccgcgaacagcaggacgcgaagctctgtgaaaggcaccgcgagaaattgcattactactgcgaagatgacgggaaactgctctgtgtttag

SEQ ID NO: 25705 - DNA, 291 bp, Artificial Sequence
  Description of Artificial Sequence: Synthetic coding sequence
atgagcatcagcagcgacgaggtgaacttcctggtgtaccggtacctgcaggagtccggattttctcactccgcgtttacttttggcatcgagagccacatctcacaaagcaatatcaatggtgccttagttccacctgcagcccttatctccattatccaaaagggactgcagtacgttgaggccgaggttagcatcaacgaagatggaactctgttcgacggacgcccaatagagagtctgtctctgatcgacgctgtcatgcccgatgtcgtccaaactcggcaatag

SEQ ID NO: 25706 - DNA, 2913 bp, Artificial Sequence
  Description of Artificial Sequence: Synthetic coding sequence
atgctgcagcaggtgaacggccacaaccccggcagcgacggccaggcgagagaatacctgagagaggacctccaagagtttctagggggtgaggtactgctgtacaaattggatgacctgacacgagtaaatccggtaacccttgagacagtgctgaggtgtctgcaggcccgatacatggccgacaccttctataccaatgccgggtgcactctggtggctctcaacccatttaaaccggtgcctcaattgtatagtccagaactaatgagggagtaccacgctgcaccgcagcctcaaaagctgaagccacatgtgttcaccgtcggcgagcagacatatcgcaacgtcaagtctctgatcgagcccgttaatcagtctattgtggtgagcggcgagagtggcgccgggaagacctggacgagtaggtgcctgatgaaattttacgccgtggtggcaacctcgcctgcctcatgggagagtcataaaatcgccgagaggattgaacagcggattctgaactccaacccggtgatggaagccttcggaaacgcatgcacactcagaaataacaattcatcgcgcttcggcaagtttatccagcttcaactcaaccgagcccagcagatgacaggcgccgcagtgcagacttacctcctggagaaaacccgagtggcttgccaggcctccagcgagagaaattttcacattttttaccagatctgcaaaggggctagcgaggatgaaagactgcagtggcatctgccagagggcgctgcattcagctggttgcctaatcctgagagatcgctggaagaagattgtttcgaggtgacgagggaagcaatgttacatctgggtatcgataccccaacccaaaacaatatcttcaaggtgttggcgggcctactccatctagggaacatccaattcgccgcatcagaagatgaggcgcaaccctgtcagccaatggacgatgccaagtacagtgtcaggaccgcagctagcctgcttggactccccgaagacgttctgctggaaatggtccagattcgtacaattagggccgggcgacagcaacaagtgttcagaaagccttgcgcccgggcggagtgtgacacaaggagggactgcctggctaaacttatctatgccagactctttgactggctggtgtcggtaattaattctagtatctgcgcggacacagattcctggaccaccttcattgggctgttggacgtctacggatttgaaagctttccagacaacagccttgaacagctgtgtataaactacgccaacgaaaaactccagcagcacttcgtggcacattaccttagagcgcagcaggaagaatatgccgtagagggcctagaatggtcctttattaattaccaggataaccagccatgtctcgatctgattgagggaagccccatctcgatctgctctctaatcaacgaggaatgccggctaaatagaccctcaagcgccgctcagttacagacgcgcattgagaccgccctggccggtagcccctgcctgggccataataaattgtctcgtgagcccagttttattgtggtgcattatgccggacctgttagataccacactgccggcctggtggagaagaacaaagaccccatccccccagagcttacccgactgctacagcagtcacaggatcctctcctaatgggactcttcccaactaatccgaaggaaaagacccaggaagagccacctggacaatcgcgcgcacctgtcttgacagtggtcagcaaatttaaagctagccttgaacaacttctccaggttctgcacagtacaactcctcattatatcagatgtataaagcccaattctcagggacaggctcagactttcttgcaggaggaggtgttgtctcagctggaagcttgtggactggttgagactattcatatctctgccgctgggttcccaatccgagtttcccacagaaatttcgtggagaggtacaagctgctgaggaggctccatccctgcaccagctccggacccgatagtccataccccgcaaagggcttacctgagtggtgccctcactccgaggaggccactctcgaaccccttatccaggacatcctgcatacgcttcctgttctcacccaggctgcggccatcaccggtgacagcgccgaagccatgcccgcgccaatgcattgtggccgtactaaggtgtttatgacagactccatgctggagctcctggaatgtggccgcgccagggttctcgaacagtgtgcacgatgcatacagggcggctggaggcggcatcggcatagggagcaggaaagacagtggcgggctgtgatgcttatacaggcagctataagatcgtggctcacgcgaaagcatatacagcgcttacatgccgcggctactgtgatcaagagggcttggcagaaatggcgcattagaatggcttgcctggcagccaaagaactggacggagtggaagagaagcactttagtcaggccccttgctctctgagtacgagccctctccagactaggttgctcgaggcaattatccgactatggcctctgggacttgtactggccaatactgctatgggagtgggctcttttcagaggaaactggtagtctgggcatgtcttcagcttccacgcggaagccctagctcctataccgtgcagacagctcaagatcaggccggggttacctctatccgcgctctgcctcagggatctatcaagtttcattgtagaaagtctccactgagatatgccgacatctgtccagagccctctccctatagcattactggctttaatcagattttgctcgaaagacacagactgattcacgtgacgtccagcgcttttacagggctgggatag

SEQ ID NO: 25707 - DNA, 3303 bp, Artificial Sequence
  Description of Artificial Sequence: Synthetic coding sequence
atgagctactaccagcggcccttcagccccagcgcctacagcctgcctgcttctttaaattccagtatagtgatgcagcatgggacttctctcgatagcaccgacacttatccccaacacgcgcagtctcttgacggcacaacttctagttcaataccactttacagatcttcagaagaggagaagcgcgtcactgtcattaaggcccctcactatccaggtataggcccagtggatgagtctggcattccaaccgccatacggactaccgtagatagacctaaggactggtacaaaacaatgttcaagcaaattcacatggtgcacaagccggatgatgatacggatatgtataacactccctacacttacaatgctggactctacaaccctccttattctgcccaatcccaccccgccgctaagacccaaacatacagaccgctgtccaagtctcactccgataatagcccgaacgcctttaaagacgctagctcacctgtccccccccctcacgtccctcctcccgtccctcctctgcgtccaagagataggtcctccactgagaaacatgattgggacccccccgatcgcaaggtggataccagaaaatttaggtccgaaccccggagtattttcgagtacgagcctggtaagtcaagcatcctccaacacgagagacccgccagcctgtatcagagcagcatcgatcggtccctagagcggccaatgtcttccgccagcatggcctcagattttagaaagaggcgcaagagtgaacccgccgttggaccacctcggggattgggagatcaatccgcatctagaaccagtcccggacgcgtggatttacctggttcaagcacgaccttaaccaagtccttcactagcagtagcccatcttcaccatcaagggctaagggcggagacgattctaaaatttgcccttcgttatgttcctattccggccttaatggcaaccccagtagcgagctggactattgttctacctaccgccagcatctagatgtgcctcgggatagtccccgcgccataagttttaagaatggatggcagatggcccggcagaatgcggaaatctggagctcgaccgaggagactgtcagcccaaagatcaaatccagaagttgcgacgaccttctgaatgacgactgcgacagtttccctgacccaaaagtgaaatctgagtcgatgggaagcctcttgtgcgaggaagactctaaggagagctgtcccatggcttgggggagtccttacgtacccgaagtccgaagtaacggcagatcccggattcgccaccggtccgcgaggaacgctcccggatttcttaaaatgtataaaaagatgcataggatcaacagaaaggatctgatgaattccgaggtgatctgcagcgtaaagtctcgcatcctgcagtacgagagtgagcagcagcacaaggacctgttgcgagcctggtcgcaatgcagcaccgaagaggttcctagggatatggtgccaactaggatctccgagttcgaaaagctcatccaaaagagtaagagtatgcctaacctgggggatgacatgctcagccctgtgactctggaacctccacagaatggactttgtccaaaaaggcggttcagtatagaatacctgctggaggaagagaatcagtccggaccgcctgcgcgcggcaggcgtggatgccaatccaatgccctggtgcctatccacatcgaagtgaccagcgacgagcaaccaagggcgcacgtcgagttctccgatagcgaccaagatggcgtcgtgtctgaccactcagactacatacatctcgagggtagctcattttgcagcgaatccgatttcgaccatttcagctttacatcgtctgagtcattttacggttccagtcatcaccaccaccatcaccaccaccaccatcatagacacctgatcagctcttgtaaaggcaggtgtccagcttcctatacaagattcacgaccatgctcaagcatgaacgggcccgacacgaaaataccgaagagccacggcgtcaggaaatggaccccggactgtctaaactggccttccttgttagccccgtgccctttcggcgcaagaaaaatagcgccccgaaaaagcagaccgaaaaagcaaagtgcaaggcttcagtgttcgaggccctcgattcggctttgaaggatatttgtgaccagataaaggccgagaagaaacggggatctcttcccgacaactccatcctacacagactaatatctgagttgctgcctgacgttcctgaacggaatagctctcttagagccctaagacggtcccccctgcaccagcctctgcacccgctgcctccagatggggccattcactgccccccataccagaatgactgtggccgaatgccacgatccgcctccttccaagacgtggacaccgccaactcatcctgtcaccaccaagatagggggggggcgcttcaagaccgagagtcacctcggtcgtacagctctaccttgacggatatgggaagatccgcccctagggagcggcgggggactccggaaaaggagaaactgcccgcaaaggctgtgtacgacttcaaggctcaaacatcaaaggaattatcctttaaaaagggtgacacagtgtacatcctccggaaaatcgatcaaaattggtacgagggggagcatcacggccgcgttggaatcttccctatcagctacgttgaaaagctgacaccgcctgaaaaagctcagccagcgcggccacctccacccgctcaaccaggggagatcggtgaggcgatcgctaagtataatttcaacgctgatactaatgtagagcttagcctaaggaaaggggatcgtgtaatccttctgaaacgagtcgaccagaactggtatgaagggaagatccccggcaccaatcggcaaggaatctttcccgtgtcttacgtcgaggttgtgaagaagaataccaaaggcgccgaagattatccagatcccccaatcccgcattcttatagttccgatagaattcacagtttgtcatccaacaagccacagaggccagtcttcactcatgaaaacattcaaggtgggggtgagcctttccaggcgctgtacaactacacaccccgaaatgaagatgaattggaactgcgcgaatctgacgtgatagatgtcatggaaaagtgtgatgatgggtggttcgtgggcacctcacgtcggacaaagttcttcggcacctttcctggaaactacgtcaagaggctgtag

SEQ ID NO: 25708 - DNA, 390 bp, Artificial Sequence
  Description of Artificial Sequence: Synthetic coding sequence
atggccgagctgatccagaagaagctgcagggcgaggtggagaagtatcagcagctgcagaaggatctaagtaaatctatgagcggccgccagaaattggaggcacagctcaccgaaaataatattgtgaaagaagagcttgctctactcgacggatctaacgtcgtttttaaattgttgggccctgtgctcgtgaagcaggagcttggggaagcgagggctaccgtcggcaagcggttggactacataaccgcagagatcaaacgctacgagagccagctccgagatctggagagacagtcagaacagcagagagagaccctggctcagttgcaacaagagttccagcgcgcccaggccgcaaaggccggcgctcctggcaaagcttag

SEQ ID NO: 25709 - DNA, 498 bp, Artificial Sequence
  Description of Artificial Sequence: Synthetic coding sequence
atgagcctgcacggcaagcggaaggagatctacaagtacgaggccccttggacggtgtatgccatgaattggtctgtgcgacccgataagcgctttcgccttgccctcggctctttcgtcgaagagtacaacaataaggtacagctggttggcttagatgaagagtcatccgagttcatctgcaggaacactttcgaccacccatatcccactactaaactgatgtggatcccagatactaagggtgtttatcctgacttgttggcgacaagcggcgattatctgcgtgtttggcgggtgggagagaccgagacccgcctggagtgtctactgaacaacaacaagaattccgatttctgtgcccccttaacatcttttgactggaacgaggtggatccctacctgttggggaccagctccatagacactacatgctgttttcagtggcctgtctgcctgagtctcctttgcacacattgttaccagaagctgctctag

SEQ ID NO: 25710 - DNA, 1044 bp, Artificial Sequence
  Description of Artificial Sequence: Synthetic coding sequence
atgagcctggcccagagccccggcatctggggcgaggaccccgtgaagctgacacttgccttaaagatgaccagacaggatttgactagaacacagatggagctgaataatatgaaggctaacttcggggacgtcgtgcctcgccgagatttcgaaatgcaggagaagaccaataaggacttgcaggagcagctggataccttgcgcgcgagctacgaagaagtgagaaaggagcatgagatattgatgcaacttcacatgtccacacttaaggagagggatcagtttttctctgagctgcaggaaattcaaagaacttccacccccagacccgactggacgaagtgtaaagatgtggtggccggcggccccgaaagatggcagatgctggccgagggaaaaaactcagatcaactggtggatgtgctgctggaagagatagggtctgggcttcttcgcgagaaggactttttccccggcctcggttacggggaggcaatccctgctttcctcaggtttgacggcttagtggagaacaagaaaccttccaaaaaagacgtcgtaaacctgctgaaggatgcctggaaagagcggctcgccgaggaacagaaggaaacattcccggacttcttcttcaactttctggaacatcgttttggtccgtccgacgcaatggcatgggcctacaccatctttgaaaacataaagatatttcacagcaacgaagtgatgtcacagttttacgctgtgttgatggggaagagatctgaaaacgtgtatgttacccagaaagaaaccgtggcccagcttctgaaggaaatgacaaatgctgatagccagaatgaaggcctcctgaccatggagcaatttaacaccgtgttgaaaagcacatttcccctcaaaactgaggaacaaatacaggaactgatggaagccggcggttggcacccctcatcctctaatgcggatctcctgaactaccgctcactgtttatggaggacgaggagggtcagtctgagcccttcgttcagaagctgtggtag

SEQ ID NO: 25711 - DNA, 219 bp, Artificial Sequence
  Description of Artificial Sequence: Synthetic coding sequence
atgtggagcctgaccgccagcgagggcgagagcaccaccgcccacttttttctcggcgccggtgatgaaggcctggggactagaggaattggtatgcgccctgaagaatccgactctgagctgctcgaggacgaggaagacgaggtacccccagagccccaaattattgtgggaatttgcgcgatgacaaagaaatctaaaagtaaaccaatgacatag

SEQ ID NO: 25712 - DNA, 1149 bp, Artificial Sequence
  Description of Artificial Sequence: Synthetic coding sequence
atgctgcggtggaccgtgcacctggagggcggcccccggcgggtgaatcacgctgctgtcgctgttggccacagggtgtattccttcggcggttactgcagtggcgaagactatgaaacactgcgacagatcgacgtgcacatttttaacgccgtgtctctgagatggacaaagctcccccctgtgaaatccgcaatccgtggacaggccccggtggtgccctatatgagatacggacactcaaccgttctgatcgacgatactgtgttgctctggggaggacggaatgatacagaaggcgcctgtaatgttctttacgcttttgacgtcaacacgcataaatggttcacgcccagggtgagtggcacagtgcctggtgcccgcgatggacattctgcctgcgtcctaggaaaaataatgtacattttcggcgggtacgaacagcaagccgactgcttcagcaacgatattcataagcttgacacttccactatgacctggaccctaatctgtactaagggcagccctgctaggtggagagatttccacagtgccaccatgctcggctctcacatgtacgttttcggggggcgcgcagataggtttggaccctttcattcaaacaatgagatttactgtaatcggatcagagtgttcgacacacgaaccgaggcttggctggactgccctcctacccctgtcctgcctgagggcaggcgctcccacagcgctttcgggtacaacggcgaactctatatttttggcggctacaatgcccgactgaatagacactttcacgacctgtggaagtttaatcccgttagctttacttggaaaaagattgaaccaaaggggaaagggccctgtccccgcaggaggcaatgttgttgcattgtgggggataagatcgtactctttggtggaacttctccatcgcctgaagagggcctgggcgatgagtttgacctgattgatcacagcgatcttcacattctggatttctccccatccttgaagaccttatgcaaattggctgtgatccagtataacctcgatcagtcctgcctgccacacgacatcaggtgggagctgaatgccatgaccaccaacagcaacatttctcggccgattgtgagctcacatggatag

SEQ ID NO: 25713 - DNA, 1620 bp, Artificial Sequence
  Description of Artificial Sequence: Synthetic coding sequence
atggccaccagcgcccccctgcggagcctggaggaggaggtgacctgctcaatctgtctggactatctccgtgatcccgtgactatcgattgtgggcacgtattttgccgcagctgtacaacagacgtaaggcccattagcggctctagacccgtctgcccactgtgcaagaagccttttaagaaagaaaacattcggcccgtgtggcagttggcctcgctcgtggaaaacatagaaagactcaaagtcgacaaggggcggcagccaggggaggtcactcgcgagcagcaggatgccaaactctgcgaacgccatcgagaaaagctccactactactgcgaggacgatgggaaactgctttgtgttatgtgccgcgagtctcgggagcacagacctcataccgctgttctgatggaaaaggccgctcagcctcatagggagaagatcctgaaccacctgtccacccttcggagagacagggataagatccaagggttccaggccaaaggggaggcggacattctagcagcactgaaaaagctgcaagatcagcggcaatacattgtggcagagtttgaacagggccaccagtttttaagggagcgagaggaacatcttctggagcaactggcaaaattggagcaggaactcactgaaggacgcgagaagtttaaaagtcgtggagttggtgaactggctaggctagctctcgtaatcagtgaactggaaggcaaagcacaacaacccgccgcagagttgatgcaggatacccgggattttcttaaccgctatcccagaaaaaagttctgggtgggaaaacctatcgccagagtcgtgaagaaaaagacgggggagttttctgataagttactgtccctgcaacgaggcctgagggagttccaggggaagctgttaagagatctggagtataaaactgtctctgtcactttggaccctcaaagcgcttctggttacctgcagctcagtgaagattggaaatgcgtgacttacaccagcctgtacaaatctgcgtatcttcatccacaacaatttgattgcgagcccggagtgctcggctctaagggatttacctggggcaaggtttactgggaggttgaggttgagagagaaggctggtcagaagacgaagaagaaggagacgaagaggaagagggagaggaggaagaggaggaggaggaagccggctatggagacggatatgacgactgggagacagacgaagatgaagaatctctgggagatgaagaggaagaagaagaagaggaggaagaagaggtgcttgaaagctgcatggtgggagtggcaagagattctgtcaaacgtaaaggagatttgagtcttcggccagaagacggggtttgggccctgaggctgtcgtcttcaggcatatgggccaatacaagtcccgaggccgaactgtttcccgccctgcgaccgaggcgcgtggggatagccctcgattacgaaggagggactgtgacatttactaacgccgaaagtcaagaactaatttacaccttcacagcaacatttacgcggcggctcgtccctttcctttggttgaagtggcccggcacaagattactgcttcgcccctag

SEQ ID NO: 25714 - DNA, 390 bp, Artificial Sequence
  Description of Artificial Sequence: Synthetic coding sequence
atggccgagctgatccagaagaagctgcagggcgaggtggagaagtatcagcagttacagaaagatctgtccaaaagtatgtccggacggcaaaaactagaggctcaactgaccgaaaataatatcgtcaaggaggaattggctcttctcgacgggtccaatgttgttttcaaactgctggggcccgtactggtgaagcaggagctaggtgaggcgcgggctactgtagggaagagattggactatatcactgcagaaatcaagagatatgagagtcagctcagagatctggaacgacagtctgagcagcagagagaaactttggcccagttgcagcaagaattccagagagcccaggctgctaaggctggggcccccggaaaagcatag

SEQ ID NO: 25715 - DNA, 1089 bp, Artificial Sequence
  Description of Artificial Sequence: Synthetic coding sequence
atgctgaagaacaagggccacagcagcaagaaggacaacctggccgtcaacgccgtcgccctgcaggaccatatcctccacgatttacagctgcggaacctgtcggtagctgaccactccaaaactcaggtgcagaaaaaggaaaacaaatctcttaaacgcgatacaaaggcaatcatcgataccgggttaaagaaaacgacacagtgccccaaacttgaggactctgagaaggagtatgtcctcgatcccaaaccacccccactgactctggcacagaagctcggtctgattgggcctccaccccctcctctgagctctgatgaatgggagaaggtaaagcagcgcagcctcttgcaaggagatagcgtacagccctgcccgatttgtaaggaagaattcgaactgcgtcctcaggtcctgctgagttgtagtcacgtcttccacaaagcttgcctacaggcctttgagaaatttaccaacaaaaaaacctgtccgctgtgtagaaagaatcagtaccaaacacgggtcatccacgatggggcccggctgtttcggattaaatgcgtcacccgcatacaggcttactggaggggctgtgtcgttcgcaagtggtaccggaatctgcggaagaccgtcccacctaccgacgccaagcttcgtaaaaagttctttgagaaaaagttcactgagatcagtcacaggatactctgttcctataacactaacatcgaggagctctttgctgaaatcgaccagtgcctcgctataaataggagcgttttgcaacagctggaggagaagtgcggccacgaaattactgaagaagagtgggaaaaaattcaagtgcaagctctccgccgggagacccacgaatgttccatttgcttggctccactcagcgcagctggcggacaaagagtgggcgccgggcgtagatctcgggaaatggctcttttatcgtgcagccacgtctttcaccacgcgtgccttctggctcttgaggagtttagcgtgggtgataggcccccattccatgcttgccctctgtgcagaagttgctatcagaagaagattctggaatgttag

SEQ ID NO: 25716 - DNA, 1266 bp, Artificial Sequence
  Description of Artificial Sequence: Synthetic coding sequence
atgagcgccctgcggcggagcggctacggccccagcgacggcccctcatacggtcggtactatggacccgggggaggcgatgtgccggtccatcctccaccacccctgtatcctctgagacctgagccaccacagcccccaatctcttggcgcgtgaggggaggcggtcccgctgagacaacatggctcggagagggggggggcggtgatggctactatccaagcggcggggcctggcccgagccgggtagagctgggggatctcatcagagcctgaacagttacaccaatggcgcatatggtccgacatatccccctggacctggcgctaacacagccagttactcgggagcttattatgcgcccgggtacacccagacttcctattccacagaagtgccctccacttacagatcatctggaaactcccctacgcctgtgtccagatggatctatccccagcaggattgccaaaccgaagcccccccactgcgggggcaggtacccggataccccccctctcagaaccctggtatgacactaccccattatccgtacggcgatggaaaccggtcagttccacagtccggtcctactgttagacctcaagaggatgcttgggcttctcccggagcttatggcatgggcggaaggtacccctggccctcatccgcgccatccgctccaccaggcaacctgtacatgacagaatcaacatctccctggccctccagtggaagtccgcagagtccaccatctccccctgtgcaacagccaaaagattctagctacccatactctcaaagtgatcagtcaatgaatagacataatttcccttgctcggtccatcagtatgagtcaagcgggactgtgaataatgatgactcagacctactcgattcacaggttcagtatagcgctgagccccagttatatggcaatgccacatctgaccaccccaataatcaggaccagagctcctcattgccagaggagtgtgtcccatccgacgagagtactccgcccagcattaagaagatcatccacgtattggaaaaagtgcaatatttggagcaggaggtcgaggagtttgtcggtaaaaagactgacaaggcctactggttactagaggaaatgcttaccaaagaactgctggaactggattctgttgaaaccggaggccaagactccgttcggcaggcccgtaaggaagcggtgtgtaaaattcaagccatcctggagaagctggagaagaagggactgtag

SEQ ID NO: 25717 - DNA, 321 bp, Artificial Sequence
  Description of Artificial Sequence: Synthetic coding sequence
tgaaacctgcgggagggcgccgagcagaaggtggtgttcatcaccggtcgggtgcatccaggcgaaaccccaagttcatttgtgtgtcagggcattatcgatttcttggtgagccaacatccaatagcttgtgtgctaagggaatatctagttttcaagatagcaccgatgctaaatccagatggtgtgtaccttggaaattatcgctgtctgtctttgatgcggaatggatccaggggaagaccttttttcccatcctcgtccgctcgcatgttgagaaccagtccaattcccgcccaccctttaaccgggacgttgtag

SEQ ID NO: 25718 - DNA, 684 bp, Artificial Sequence
  Description of Artificial Sequence: Synthetic coding sequence
tgactgatcttcgcctgcctggtgcccggcttccccgccgtgatgtcctcccgcgggccttgtactctagagacccttatcaacccttccccatcagtggccgacgtgaagatctaccccgaggaaataacgccactcctcccggcgataagcggcgaaaagatcgcagaggaccagacatgtttcttcctacagattctgctgaaatacatggtgatccaggctgccagccttgagtggaagaacaaagaaaatcaggacactggctttaaatttctgtttactctgtttcgcaagtactacttgccgcatcttttcccctcctttactaaactaacgaatatctacaagccagtgctagatataccccatctaagaccaaagcccgtttacattacaacaactcgggacaatgagaacatttatagtacaaagatcccatatatggccgcgcgcgtggtgtttatcaagtggattgtcaccttttttcttgagaaaaagtaccttacagcaacccaaaacactaaaaatggcgtagacgtgctaccgaaaatcatacaaaccgtagggggaggcgcggtgcaggaacgcgcccctgagctggacggtggtggccccaccgaacaggacaagtcccactctaactctagtacactgagcgatcgccgtctcagcaattcctag

SEQ ID NO: 25719 - DNA, 573 bp, Artificial Sequence
  Description of Artificial Sequence: Synthetic coding sequence
atggagccccccatggagcccagcggcggcgagcaggagcccggcgctgtgcgcttcctggatctcccgtgggaggatgtactgttgccgcatgtgctcaatagggtaccccttagacagttgctgagactgcaacgggtgtcccgagcgtttcgtagtttggttcaattgcatctggccggcttgcgcaggtttgatgcagcacaggtaggaccacagattccacgtgcagccctggcacgcctgctcagagatgcagagggcctgcaagaattggcccttgcaccgtgccacgaatggcttagcgacgaagacctcgtgccagtcctggcacggaacccgcagctgcgctccgttgccctggggggttgcgggcagctgtcaaggcgcgctcttggggctctggcggaggggtgtcccaggctacaaaggctctccctggcccattgcgactgggtggacggtctcgccctgagagggctggctgaccggtgccctgcacttgaagaacttgaccttacggcatgccggcagttaaaagacgaggcaatagtgtacctggctcagaggtag

SEQ ID NO: 25720 - DNA, 270 bp, Artificial Sequence
  Description of Artificial Sequence: Synthetic coding sequence
atgagcgagcagggcgacctgaaccaggccatcgccgaggagggcgggacagagcaggagacagcaacgccagagaacgggattgttaagagcgaaagcctggatgaggaggaaaagcttgagctgcagagacgcctagaggcacagaatcaggagcggagaaagagcaagtccggggccggcaagggcaagcttaccagatccctggccgtgtgtgaagagtcctcagccaggcccggaggtgagagcctgcaggaccagactttgtag

SEQ ID NO: 25721 - DNA, 381 bp, Artificial Sequence
  Description of Artificial Sequence: Synthetic coding sequence
atgaccacccggagcgtgctggacgtggagaccttcgtggccgacattttaaaaggcgagaatctcagcaagaaggctaaggaaaagcgcgaatccctgatcaaaaagattaaagacgtgaaatccatctacttgcaagaattccaggacaaaggcgatgctgaggacggggaggaatacgatgacccttttgctggaccccctgacaccattagcctggcaagcgagagatatgataaggacgatgaggcgccctcagacggggcccagttcccacccatcgctgctcaggatctgccttttgttctgaaggccggatatctagagaagcgtcgtaaagaccactctttcctgggatttgagtggcaaaagaggtggtag

SEQ ID NO: 25722 - DNA, 678 bp, Artificial Sequence
  Description of Artificial Sequence: Synthetic coding sequence
atgctgagcgccgtggcccggggctaccagggctggttccacccctgtgcgagactgtctgtaaggatgagctctaccggcattgatcgtaaaggggtgctggccaacagagttgctgtggtgactggctccaccagcgggatcgggttcgcaattgctcggcgcctcgcccgggatggagctcacgtagtgatctcctctagaaagcagcagaatgtggatagagcaatggccaaattgcagggtgaaggtctcagtgtcgcgggaatcgtgtgccacgtcgggaaagctgaggatcgagagcaattggtggcgaaggccttagagcattgtgggggcgtcgatttcctggtgtgttccgcaggtgtgaatccactggtcggtagtactctggggacgagtgagcagatatgggataaaatcctgagcgttaatgtgaaatcccccgccttgctgctctcacagttactcccttatatggaaaaccggcgcggggccgtgatcctggtttcatccattgccgcctataatccagtggtagccctgggtgtatacaatgtgtcaaagaccgctcttctggggctgacaagaacgctcgcgctcgagctggccccgaaagacatccgggtgaattgcgttgtgcctggaattatcaagactgacttcagtaaagtgtag

SEQ ID NO: 25723 - DNA, 1080 bp, Artificial Sequence
  Description of Artificial Sequence: Synthetic coding sequence
tgagccaccgccatgaccagcgcctggctggcccagggcaccggcgagggtgttaatgatgtgcgaaagggtgcttgcgcaagtcacgtatctacaatggcgtcttttctcaaaggggcacatgtgaccatcaatgcccgggcagaagaggatgttgaaccagagtgcatcatggagaaggtggccaaggcctcaggcgctaactactctttccacaaggagtctgggcgtttccaagacgtgggcccacaagctcccgttggatccgtgtatcagaagacaaatgcggttagcgaaattaagagagtgggaaaggattccttttgggccaaagccgagaaggaggaagaaaatcgacgactggaagaaaaacggagagcagaggaggcacagcggcagctggaacaggaacgcagagagcgggaattgagagaggccgccaggcgtgagcagcgttaccaggagcaggggggagaggcttccccacagcgcacatgggaacagcagcaggaagtggtgtcccgcaacaggaatgagcaggagagcgccgtgcatccccgggaaattttcaagcaaaaggagcgggccatgtccaccacttcaatctcttctccacagcctgggaagctgcgttcacctttcctccagaagcagctgacccagcctgaaacccatttcggcagagagcctgctgccgcgatctcaagaccacgcgccgaccttcctgctgaggagccagcaccgagcactcctccatgcctggttcaagcagaagaggaggcggtgtacgaggagcccccagagcaggagaccttttacgaacagccgcctctggtccaacaacagggtgcgggctcagagcacatcgaccaccacatccagggacagggcttgagcggacagggcctatgtgccagggctttatatgactatcaggccgccgacgacaccgagatttctttcgatcctgagaatctgatcaccggcatcgaggtaatcgacgaagggtggtggagggggtatggtccagatggacactttggcatgttccctgcgaactatgtcgaattgatcgagtag

SEQ ID NO: 25724 - DNA, 483 bp, Artificial Sequence
  Description of Artificial Sequence: Synthetic coding sequence
atggaggccgagcggccccaggaggaggaggacggcgagcagggcccccctcaggatgaggaaggatggcctcctcccaattcgacaacgaggccttggcgctctgcgcctcctagccccccacccccagggacccggcatacagccctggggcctaggtctgcctctctgcttagtctacagacagaactgttactagacctggtcgccgaggctcagtccagaagactggaagaacaacgggcgaccttctacacgccccagaatcccagttctctggcccctgctccgctgcggccccttgaggaccgcgaacagttatattcaactattttaagtcaccagtgtcagaggatggaggctcaaaggagcgagccacctctacctcccgggggccaggaattactggagctgctccttcgagttcagggcgggggcagaatggaggaacaaagatcacgcccaccgacccacacctgctag

SEQ ID NO: 25725 - DNA, 2616 bp, Artificial Sequence
  Description of Artificial Sequence: Synthetic coding sequence
atgggcgacagcgacgacgagtacgaccggcggcggcgggacaagttcaggagggaaaggagcgactatgatcggagcagagagagagacgagaggcgaaggggggatgactggaatgaccgggagtgggacaggggccgggaacgccgctccaggggtgagtatcgcgattatgataggaacagacgggagagattctcccccccccgccacgaactgagccccccacagaaacgaatgaggagagattgggacgaacatagttccgatccttaccacagcggatatgagatgccttacgctggcggggggggaggccccacctacggccctcctcagccatggggtcaccccgacgtgcatatcatgcaacaccacgtccttcccatccaggcgagactgggaagcatcgccgagattgatttgggggtgccgcctcctgtcatgaaaacctttaaggaattccttctgagtctcgacgacagcgtggatgagaccgaagcagtgaagaggtacaatgactacaagttagatttcagacggcagcagatgcaggatttttttctagcacataaagacgaggagtggttccgttctaaatatcaccccgatgaagtgggtaagcggcgtcaagaagcgagaggcgcactgcagaacaggcttagagtgttccttagtctcatggagacaggctggtttgacaatctgctgctggatatagataaagccgacgccatcgtaaagatgttggatgcagctgtgataaagatggaaggaggaacagagaacgatcttaggattttggagcaggaagaagaggaggagcaggcgggtaagccaggggagccctctaaaaaggaagagggaagagccggcgctggactgggggacggtgagaggaagaccaatgataaggatgaaaaaaaggaggacggaaagcaggccgagaacgactcgtcgaatgacgacaagacaaagaagtctgagggtgatggtgataaagaggagaagaaagaagattctgagaaggaggccaaaaagtccagcaagaagagaaaccgcaagcactctggcgacgattcattcgatgaaggatccgtcagtgagtccgagtccgaatctgaaagtgggcaggcagaagaagaaaaagaggaagcagaggctctgaaggagaaagagaagcccaaggaggaggagtgggaaaaaccaaaggacgcagcaggactagagtgcaaaccgagacctctgcacaagacatgcagtctgttcatgcggaatattgccccaaacattagcagggccgaaatcatatctctctgcaagcggtaccctggcttcatgcgcgtggcactatctgaacctcagcccgaacggcgtttttttcgccgcggttgggtcacattcgaccgctccgtcaacattaaagaaatctgctggaatctacaaaatatccgactgcgagaatgtgagctttctccaggcgtaaacagggatctgacccgtcgtgtgagaaatattaatgggattacccagcataagcagatcgtgcggaatgatataaagttagccgccaagctgatccataccctcgatgaccgcactcagctttgggcctcagagcccggcaccccccccttgcccacgtccctgccaagccagaatccaatactgaagaacattacggactacctgatagaggaggtatcagcagaggaagaagaactgctgggctcttctggaggggcacctcccgaggagccaccaaaggagggaaaccccgccgaaattaacgttgaacgcgacgagaaactcatcaaagtgttggacaaactccttttgtacttgcgcatcgtccacagcctagactattacaacacctgcgagtaccctaatgaggacgagatgcctaataggtgcggcatcatacatgtaagggggcccatgccaccgaataggatttctcatggagaagtgctggagtggcaaaaaacctttgaggagaagctgaccccactcttgagcgtccgcgagtctctgagtgaagaggaggctcagaagatgggccgtaaagaccctgaacaggaggttgaaaagtttgttacgtctaatactcaggaactgggtaaggacaagtggttgtgtcccctctccggaaaaaaatttaaagggcccgagttcgtcaggaaacatatcttcaacaagcacgccgaaaagatcgaagaagttaagaaagaggtagcctttttcaacaactttctgacggatgcgaagcgccctgctctcccagaaattaaacccgctcagcccccaggccctgctcaaagcttaacacctggcttgccttacccacaccagactccgcaaggactgatgccgtatggccaacctagaccccccatcctgggctacggggcgggcgcagtaagacccgcagtgcccaccggcggcccgccgtaccctcacgcaccttatggggccgggcgcgggaactatgatgctttccgcgggcagggcggatatcctgggaagccccgcaatcggatggtcagaggtgaccctagggctatcgttgaatatcgggatctcgatgcaccagacgatgtggattttttttag

SEQ ID NO: 25726 - DNA, 2025 bp, Artificial Sequence
  Description of Artificial Sequence: Synthetic coding sequence
atgcagaccagcagcagccggagcgtgcacctgagcgagtggcagaagaactacttcgccatcacgagcggtatttgcacaggcccaaaagctgatgcataccgcgcacagattttgcgaatccagtacgcatgggcgaattccgaaattagccaagtgtgtgcaaccaagctgttcaaaaaatatgctgagaagtattcagctatcatcgacagcgataacgtagaatctggactgaataattatgcagagaatattttaaccctggccgggtcacagcagactgattccgataaatggcagagtggcctgtctattaataacgtcttcaagatgtcctccgttcagaaaatgatgcaggctgggaagaaattcaaagactctctacttgaaccggccctcgcatcagtggtgatccacaaggaggcaaccgtgtttgacctgcccaagttttccgtgtgcggatcctcccaggagtccgattctcttcctaattctgcccatgatcgagatcgaacgcaggattttcctgaatccaatcggctgaaattattacaaaatgcacaaccacctatggtcaccaataccgcccgcacgtgccccaccttcagtgccccagtgggcgaaagtgcgactgctaagttccatgtaacgcccctcttcgggaacgtcaagaaggagaatcattcatccgccaaggagaatatcggcctgaatgtgtttttgtctaatcaaagctgcttcccagccgcctgcgagaatccccaaagaaagtctttctatggctcaggcactatcgatgctctttcaaatccaattttaaataaagcatgtagcaaaaccgaggacaacggaccaaaagaggattcctcccttcctacctttaaaactgcaaaggagcagctctgggtggaccagcagaaaaagtatcaccagccgcaaagagcatctggctccagttacggcggcgtcaagaagagtctgggagccagcagaagcagaggtattctaggtaagttcgtcccgcccatcccgaagcaggatggcggagaacagaacgggggcatgcagtgcaaaccatacggcgccggtcccaccgagccagcgcatcccgtcgacgagagactcaagaatctcgaaccaaagatgatcgaactgattatgaacgagattatggatcacggtccgccagtcaattgggaggacattgccggcgtggagttcgctaaggcgactatcaaagagattgttgtgtggccgatgctgaggcccgacatctttacgggcctgagaggcccccctaaagggatcctcctcttcggtccgccagggacaggcaagaccttgatcggcaagtgtattgccagccaaagtggcgcaacgttttttagcatttcagcgtccagcttaaccagcaagtgggtaggcgagggggagaagatggtgcgcgctctattcgcagtggcacgctgtcagcagccggccgtgatctttatcgatgaaattgatagcttgttaagtcagagaggggatggcgagcacgagtcgtcccgccgtatcaaaactgaatttcttgtgcaattggatggcgctactactagctctgaggaccgaatactggtagttggggccaccaaccggccacaggagatcgacgaagccgcaagaaggcgactggtgaagcgtttatatattccattgcccgaggcttctgcccgcaagcaaatagtgatcaacctaatgtcgaaagagcaatgttgcttatccgaggaggaaatcgaacagatcgtccagcaaagtgatgcgtttagtggcgccgatatgacccagctctgcagagaggcaagccttggaccaatacgtagcctgcagactgcagatatcgccactatcacccccgaccaggtaaggccgatcgcttatattgactttgagaacgcattcaggacagtgcgtccatctgtctctccaaaggacctagagctgtacgaaaactggaacaaaactttcggttgtggcaagtag

SEQ ID NO: 25727 - DNA, 1467 bp, Artificial Sequence
  Description of Artificial Sequence: Synthetic coding sequence
atgagcgacgaggtgttcagcaccaccctggcctacaccaagagcccaaaggtcacaaaacgcaccacttttcaagatgaacttatcagagcaatcactgcccggtctgcccggcagaggtctagcgaatactccgacgactttgactccgacgaaattgtcagccttggcgattttagcgatacaagcgctgatgaaaacagtgtaaacaaaaagatgaacgatttccatatctcagacgatgaggaaaagaatcccagtaagctactgtttttgaaaactaacaaatccaacggcaacattacaaaggacgaacctgtttgcgcaattaaaaatgaagaggagatggcgcccgatgggtgcgaggatattgtcgttaaatctttttcagagtcccagaataaggacgaagagttcgagaaagacaaaatcaaaatgaagcccaagccgcgaatcctcagtatcaagtcaacaagtagtgagaataattccctagacacagacgatcacttcaaaccatccccccggcctcggtcgatgctgaaaaaaaaatcacacatggaagaaaaggacggactggaggacaaagagaccgctttgtctgaagagttggaattgcattctgcccccagctctctccccacccctaatgggatccaactggaagcagagaaaaaagcctttagtgagaaccttgatccggaagacagctgcttgacaagccttgcatccagcagcctcaaacagatcctgggagactcattctcgcccggctcagagggcaacgcttctggcaaggaccccaacgaagaaatcaccgagaaccataattccttgaaaagcgacgagaataaagagaatagcttcagtgcagaccatgtaaccacagcagtggagaagtcaaaggagtctcaggtaacagccgacgatctagaagaggagaaggcgaaagccgagttgatcatggatgacgacagaaccgtggaccctctgcttagtaagagccagagcattctcatctcgacctccgcaaccgctagctctaagaaaaccatcgaggaccgcaacattaaaaacaagaagtccacaaacaaccgggcaagcagcgcgagcgcccgccttatgacgtcggaatttttgaaaaagtctagttccaaaaggagaaccccctccacaactacttccagccattatttaggaaccttgaaggtgctcgaccagaagccttcacaaaagcagagcatagagcccgaccgcgcagacaatatccgggccgcagtataccaggaatggctcgagaagaaaaatgtctacctgcacgagatgcaccgaatcaaacggatagaatccgagaatctccgcatacagaatgagcaaaaaaaagcggcaaagagggaggaggctctagcctcctttgaggcatggaaggctatgaaagagaaggaggcgaaaaaaatagctgcatag

SEQ ID NO: 25728 - DNA, 564 bp, Artificial Sequence
  Description of Artificial Sequence: Synthetic coding sequence
atggtgcgggagcccggcccccggcccggcacccccggctgcagcgcatccggccaatggaccgccacattgcgcccatatctctcagctgtgcgggctaccctgcaggccgcactgtgcttagagaacttcagtagccaggtggtggaaaggcacaacaagcccgaggtggaggtgcgcagttcaaaagagctgctcctacagccagtcaccatttcccgtaatgagaaagagaaggttctgattgaaggatctatcaacagcgttcgagtgtctattgctgttaagcaagccgatgagatcgagaagatcttgtgccacaagtttatgagatttatgatgatgagagctgagaactttttcattttaagaaggaagcccgttgaaggctacgatatctccttcttgattaccaacttccacaccgagcagatgtataagcataaactggtggactttgtgattcatttcatggaagagatcgataaggagatctctgagatgaaactttcagtcaacgcacgagcgcggatcgtagccgaagagtttttgaagaacttctag

SEQ ID NO: 25729 - DNA, 1068 bp, Artificial Sequence
  Description of Artificial Sequence: Synthetic coding sequence
tgaagcctggccagcagcctgcggaacaaggagggcaccctgggcagcaaggtgggttaccttgatgtggaggcacgcggtcctggggagggaaggggtggcggaggagaaagcccccccctccaacccccaccccccgcccccgtcctgctatacgaccaggggggtggcaggagaaggcggggggaggcggaggcagaggccgaggaatgggaggcagagtccgttctgggcacattactgcagaaattgagagaagagggctaccttgcttactatctgcaagggggcttttccaggttccaagctgagtgccctcacctgtgtgagacaagcctggctgggagagcaggcagtagcatggcacccgttccaggccccgttcctgtcgtaggcctgggatcactttgcctgggctctgactgctccgatgccgagtctgaggctgacagggactccatgagttgcggactcgattcggagggggcgacacccccaccagtgggcctcagagcctccttccccgtgcaaatccttccgaacttgtatctgggaagcgcaagggatagcgcgaacctggaatccctcgccaagctggggatccggtacattctgaatgtaaccccgaacctgccgaatttcttcgagaagaacggagacttccactataagcaaatacctatttccgatcactggtcccagaatctgtcccggtttttccccgaagctattgaattcattgacgaggcactgtctcagaactgtggggtgctcgtacactgtcttgccggggtcagtcggtctgtaaccgtaacagtcgcctacctgatgcaaaagctacacttgtccctgaatgatgcatatgatctggtcaaacgcaaaaagtcaaacatcagccccaactttaacttcatgggacagttgctggatttcgagagaagtctcaggctcgaagagagacattcccaagagcaagggtctggaggtcaggcttctgctgcatctaacccaccaagtttttttacgactcccacttccgatggggcttttgagcttgcaccaacctag

SEQ ID NO: 25730 - DNA, 51 bp, Artificial Sequence
  Description of Artificial Sequence: Synthetic coding sequence
atgtgcaccagcgagaccttccaggccctggacaccttcgaggcccgttag

SEQ ID NO: 25731 - DNA, 1620 bp, Artificial Sequence
  Description of Artificial Sequence: Synthetic coding sequence
atggccaccagcgcccccctgcggagcctggaggaggaggtgacctgctccatctgtctcgactatctcagggaccccgttaccatagactgtggacacgtgttctgtaggtcatgtacgactgacgtgcgccccatatccgggtctcggccagtctgccccctgtgcaagaagccgttcaagaaagagaacatcaggcctgtgtggcagctcgcctcccttgtggagaatatcgagcgactgaaggtcgacaaggggagacagcccggagaggtgacacgtgaacaacaggacgctaagctctgtgagcgccatcgggagaagctgcactattactgcgaggatgacggcaaactgctctgcgtgatgtgtcgtgaatctagagagcaccgtccacacacggccgtgctcatggagaaggccgcccagccacacagggaaaagatcttgaatcacctgtccactctgaggagggaccgagataaaatacagggatttcaggctaagggagaggcagacattctcgccgcactgaagaagctgcaggatcagcggcagtacattgttgcggagtttgagcagggccatcagttccttagggaacgcgaggagcatctcctcgaacagctggccaagctggagcaggagctaactgaaggacgcgagaagtttaaatcacggggggttggcgaactggcacgcctggcgctggtgatatccgagctggagggaaaggcccagcagccagccgcagaattgatgcaggacactcgggatttcctgaacaggtatccaagaaaaaaattctgggtcgggaaaccaatcgccagggttgtgaaaaaaaaaacaggcgaattcagtgacaaattgctgagcctgcaaagagggctgagagagtttcaaggtaagttactgagagatctagagtataaaaccgtgtctgtgacgctcgacccacaaagtgcctccggctacttacagttgtctgaagactggaaatgtgtcacatacacttccctttataaaagcgcctatctacatcctcagcagtttgattgtgaaccgggcgtgctgggatcaaagggtttcacttggggtaaagtgtactgggaagtggaagtggaacgcgagggatggagcgaggacgaagaagaaggcgacgaggaagaagaaggggaggaagaagaggaagaggaagaagcgggatacggagatggctacgatgattgggagactgacgaggacgaggagtccctgggggatgaggaggaggaggaagaggaagaggaggaggaggttctggagtcctgcatggttggagtggccagggattctgtgaaacgcaagggagacctgtcccttcggccagaagacggcgtttgggcgcttaggctgtccagctcggggatctgggcaaatacgtctcctgaggctgagctgtttccagcccttcggcctagaagagtaggaattgccctggattatgagggaggtacggtgaccttcaccaacgcagagtcccaagagcttatttacacctttacggctactttcacccgacgcctggtcccttttctctggctgaagtggccaggcacgcgtttgctgctcagaccctag

SEQ ID NO: 25732 - DNA, 474 bp, Artificial Sequence
  Description of Artificial Sequence: Synthetic coding sequence
atggccaccagcgcccccctgcggagcctggaggaggaggtgacctgcagtatatgtttggactatctgagggacccggtgactatcgattgcggccatgtattctgcagatcctgcaccacagatgtgcgcccaatctctggctcccgccctgtgtgcccactctgtaagaaacccttcaaaaaagagaatataagacctgtgtggcagttagcttccttagttgagaacatcgaacgcctaaaagtcgacaaagggcggcagcccggcgaggtgactagggagcagcaggatgctaagctgtgtgaacggcacagggagaaactgcactactactgtgaagacgacgggaagttgctctgcgtaatgtgccgcgagtcccgcgagcatcgaccacacaccgccgtacttatggaaaaggcggctcagccccaccgtgaaaagattttgaaccatctttcaaccctccgatag

SEQ ID NO: 25733 - DNA, 2553 bp, Artificial Sequence
  Description of Artificial Sequence: Synthetic coding sequence
atggagcccgagcggaagggcctgagcctggccagcagcagcgacggagatggtcgagaagagaacaagttgaaacagggaatttcacaggacctggcatctagctcaagactggatcgatataagatcgctcgtcagctgactgaaaaggctattaaagagaagaaaatattctctatttacgggcattatcccgtagtcagggctgctctgcgccgaaaggggtgggtggagaaaaagttccatttcctccctaaggtgatccccgatgtggaggatgaaggcgcccgcgtcaatgacgacacatgtgccaaggtcaaagagaaccaggagatggctttagagaagacagacaatatacatgacgtgatgagtcgcctcgtgaagaatgaaatgccatatctactttggacgattaaacgcgatatcatcgattatcattcacttacatatgaccagatgctcaaccattatgcaaagacggcctcatttaccaccaagatcggactgtgcgtgaacatgcgcagtttgccctggtatgtgccagccaacccagattctttttttccacgttgctattcactctgtactgagagtgagcagcaggagttcctcgaagactttcgaaggacaatggcctcatccatactgaagtgggtcgtgtctcaccagtcttgctctaggagctcccgcagcaagccgcgcgatcagcgggaggaagcaggatcgagtgatttaagttctagacaggatgccgagaacgccgaagctaaactgcggggactgccaggccagctcgtggacatcgcttgtaaggtttgccaggcatacttgggtcagctggagcacgaggatatcgacaccagcgctgatgcagtggaggatttgaccgaagcagaatgggaggaccttactcagcagtattacagcctcgtacatggcgatgccttcatctccaattcccgaaactacttcagtcagtgtcaagcactgctgaacagaattacctccgtcaacccccagacagatattgacggcctgaggaatatttggatcatcaagcccgccgctaagtccaggggcagagacatcgtttgcatggacagggttgaggagatcttagaattggcggctgcagaccatcccctgtccagagataataagtgggtagtgcaaaagtatattgagacacccctgctgatctgcgatacgaagttcgacatccgacagtggttcctggtcaccgactggaacccacttactatctggttttataaagagagctatctgagattcagcacacagcggttcagcctggacaagttagattcggccatccacctttgcaacaatgcagttcagaaatacctgaagaatgatgttggcaggagcccattgttacccgcccacaatatgtggacttccacacgattccaagaataccttcagcgccaaggtcgcggcgccgtctgggggtctgttatttatccctcaatgaaaaaggctatcgcccacgccatgaaggtggcacaagaccatgtggagccacggaagaactcgtttgaattgtacggggccgatttcgttctgggtagggatttccggccttggctgattgagattaatagctctccaacaatgcacccatcaacacctgttacggcccagttatgcgcccaggttcaagaggatacgatcaaagtggcagtggacaggtcttgtgatatcggcaatttcgaacttctatggcggcaacccgttgtggaacccccaccattttcaggctccgatctttgtgttgccggggtttccgtcagacgggccaggcgccaggtgctgccagtgtgcaacctcaaggcttcagcctccctactggatgctcagcctctgaaggccagaggtccatccgctatgccggatcccgctcagggacctccaagccccgctctgcagcgtgacctcggcttgaaagaagagaaggggcttccactcgcgctcctcgcgccccttagaggcgcagcagagagtgggggcgctgctcagccaacacgcacaaaggctgccggaaaagtcgaactcccggcttgcccgtgccgccatgtggatagccaggcccccaacacgggcgtacccgtcgcccagcccgccaaaagctgggacccgaaccaattaaatgcacaccctctggagccggtgctgcgggggctgaaaacagcggagggcgccctgcggccgcctccaggtggaaaaggggaaggaacagtgtgctcacggctccctcatcatggacatcatgtggcagcctgtcagacgaccggtacaacctgggatggtggcccaggagtttgttttcttcgccagctcctggcaagtgagctccccatggggcccgggctcccaagagatcccagggctcctccatgtctggtttgtcgcggactattgccccccgctggcccttgcaagcgatgccggtccttttgcgccgccgtgttacagggcgccagctttgtcagactgggggggcggtcctgtagccctaggactccttag

SEQ ID NO: 25734 - DNA, 2739 bp, Artificial Sequence
  Description of Artificial Sequence: Synthetic coding sequence
atgaagcggggcatccggcgggaccccttccggaagcggaagctggggggcagagctaagaaagtcagagagccaacagcagttaatagcttctatagagaggcaagtctcccttctgtctgggcttcactgcgacggcgggagatggtgcgttccggtgctcgacccggacaggtcctgagctctggcaggcacacgggaccagctaaactgacgaatggaaagaaggcaacctatcttcgtaaaattccacggttcaacgcagactccggctacagcattcattctgattcggagtcccaggcagaaacagttcacggcctcgacgggtgcgctagcctcctccgcgacattctccgaaacgaggactccgcctcctctgataataagaagcagatccctaatgaagcttccgcaagaagtgagagagatacctcggatctggagcagaactggagtttgcaagatcactataggatgtattcccccataatttaccaggcactgtgtgagcatgttcagacccagatgagtctgatgaacgatctgacctcgaaaaatataccaaatggtattccggcagttccctgccacgcccctagtcacagcgagtcacaggcgaccccccactcatcctacgggctctgcacaagtacccctgtgtggagcctgcagagaccgccatgcccccctaaggtgcactccgaggtgcaaaccgacggcaactcccagttcgccagtcagggtaagactgtaagtgctacctgcacggacgtgttacggaactctttcaataccagtcctggggtcccgtgttctctccctaaaacagacataagtgctattccaacactgcagcagctgggcctggtcaatggcatactgccacaacagggcattcataaggaaacggacttgctgaaatgtattcagacttatctgtccttatttcggagtcacggcaaagagacccacttggactcacagacccataggagtcctacacaaagccagcctgcctttcttgcgaccaacgaggaaaagtgtgcaagagaacagatccgggaagcaacatcagaaagaaaggatcttaatatccacgtgcgggatactaagacagttaaggatgttcagaaggccaagaacgtgaacaaaaccgcggaaaaggtgagaatcattaagtatctgctgggtgagctgaaggctctcgtcgctgagcaggaggattcggagatacagcggttgatcacagagatggaagcctgtataagcgtccttcccaccgtgagtgggaatactgatatccaggtggagatcgccctggcaatgcagcccctgaggagcgagaatgctcagcttcgaaggcaactgcgaatcctcaaccagcaactgcgggagcagcagaagacccagaaaccctccggcgcagttgactgtaaccttgagttgttttcccttcagtctctcaacatgtcacttcagaatcaattggaagaaagcctgaagtctcaagagctgctccaaagcaagaatgaggagcttctcaaggttattgagaatcagaaggatgaaaacaaaaaattcagcagcatttttaaggataaggaccagaccattctggagaacaaacagcaatacgacatcgagataactcgaataaaaattgagctggaggaggccttggtcaacgtgaagagtagtcagttcaaactcgaaaccgcagagaaggagaaccaaatactggggattactctgcgccagcgcgacgccgaagtcacacgcctacgcgagttaacgcgcactctgcagactagcatggccaaacttctgagcgacctgagcgtggattccgctaggtgtaagccagggaacaacctcaccaaatctctcttgaatatccacgataagcagctccaacacgaccccgccccagcccataccagcatcatgagttacctgaataagcttgagaccaactattccttcacacattccgaacccctgagcacaattaagaacgaggagacaatcgaaccagacaagacatacgagaacgtcctctcctcgcgaggaccgcagaattctaataccaggggtatggaggaagctagcgcgccagggattatcagtgccctcagcaaacaggattctgacgagggttccgaaacaatggctttaatagaggatgaacataatctggataacacgatctatatacccttcgccagatccacacccgagaaaaaaagtcctctgtcaaagcgcttgagcccccagccacagattagggctgcgacaactcagctagtgtccaatagtggcctggctgtgtcagggaaggaaaacaagctgtgcacccccgtgatttgtagcagctctacgaaagaagccgaagacgctcctgagaaactgagcagagcctcagatatgaaagatactcaattgctcaaaaaaattaaggaggcaattggcaagattcccgcagccacgaaagagcccgaagagcaaaccgcttgtcacggtccaagcggatgcctctcaaattccctgcaggtgaaaggtaatacggtctgcgatggatctgtgtttacatccgatctgatgagcgattggtccatttcttcattctctacctttacaagtcgcgatgagcaggattttcggaatggattggccgcactcgacgctaatatcgcacggctccagaagagcctgagaacgggccttttggaaaaatag

SEQ ID NO: 25735 - DNA, 528 bp, Artificial Sequence
  Description of Artificial Sequence: Synthetic coding sequence
atggagctgaccatcttcatcctgcggctggccatctacatcctgacatttcccctgtacctcctgaattttcttggattgtggtcatggatctgtaagaagtggtttccttacttcctcgtgcgctttacagtgatctataacgaacagatggccagtaagaagagagaactgttttccaacctgcaggagtttgccggacccagcggcaagctgagtctgctggaggttgggtgcgggaccggggcaaatttcaaattttatcctcccggatgcagagtgctgcggccgggaggcgccttctactttatggagcacgttgccgccgagtgctctacttggaactacttttggcagcaggtcttagaccccgcttggcaccttcttttcgacggctgtaacctgacaagagagtcctggaaagccctggaacgagcgtccttctccaagctgaaattacagcatattcaggccccgctcagttgggaattggtacggcctcacatttatggctatgcagtgaagtag

SEQ ID NO: 25736 - DNA, 1392 bp, Artificial Sequence
  Description of Artificial Sequence: Synthetic coding sequence
atgagcggcggcaccccctacatcggcagcaagatcagcctgatcagtaaagcagaaatccgttatgaagggattctatatacaatagacaccgaaaactcgaccgtggcactggccaaggtgaggtccttcgggacggaggaccgtccgacagaccggcccattcctcctagagacgaggtgtttgagtatatcatcttccgggggagtgatatcaaggacttgactgtgtgcgagcctcccaaacctcagtgctctctgccacaggatccggccatcgtgcagtcttctctgggatcaagcacttcaagcttccaaagcatggggtcttatggcccatttggtcggatgcctacctatagccagttcagtccgagctccctggtggggcagcagttcggggcagtgggggtggctggttcatctttgacatcctttgggaccgagacatcaaattccggtaccctgccgcagagcagcgccgtcggctcagcctttacccaagacacccgaagcctcaagacacaactatctcagggaagatcgagtccccagcttgaccctctaaggaaatcccctactatggaacaggctgtccagactgcttccgcccacctcccagctcctgccgctgtgggccgaagatccccggtgtccacaagacctttgccttcagccagccagaaggctggcgaaaaccaggaacaccgcagagcagaggttcataaggtgagccggccagagaacgagcagttgcggaacgacaataaacggcaggtggcacctggagcaccctccgccccgagaaggggcaggggagggcacaggggaggcagggggcgcttcggtatccgcagagacggcccaatgaaatttgaaaaggatttcgacttcgagagcgccaatgcccaatttaacaaagaagaaatagaccgggagttccacaataaattgaagttaaaagaggataagctcgagaagcaggagaagccagtcaatggcgaagataagggggacagcggtgtggacacacaaaatagcgaggggaacgccgacgaagaagacccgctggggcccaattgttattacgacaaaaccaaatcattcttcgacaatatttcctgcgacgacaatcgggagcggcgtcctacgtgggccgaggaaaggcggctcaatgcagaaaccttcggtatccctctgagaccaaatagaggccgtggtggctatcgggggagaggcggccttgggttccggggaggcagaggacgcgggggtggacgtggtggaacctttactgccccaagaggtttcaggggcggtttcagaggcggtcgcggaggcagagagtttgcagacttcgagtatagaaagaccactgcttttggaccctag

SEQ ID NO: 25737 - DNA, 2790 bp, Artificial Sequence
  Description of Artificial Sequence: Synthetic coding sequence
atggccgaggtggaggccgtgcagctgaaggaggagggcaaccggcattttcagttgcaggattataaggccgctactaactcatacagtcaggctttgaagttgaccaaagataaggctctgctcgcaacactctacaggaatcgtgccgcttgcggtctaaagacggagtcatatgttcaggctgcctccgatgccagtcgggccatcgatattaattcctccgatatcaaagccctgtacaggcgctgccaggctctggaacatctcggaaagcttgaccaagcgtttaaggacgtgcagagatgtgccacgctggagccaaggaaccagaactttcaggagatgctgcgccggcttaatacctcaatccaagagaaactccgtgtccaatttagtactgactccagagtgcagaagatgttcgagatacttctcgatgagaattccgaggcggataaacgcgaaaaggccgcaaacaacctgatcgtactggggcgcgaggaggcgggcgccgagaaaattttccaaaataatggcgtggctttgctcctccaactgttagacactaagaagcccgagttggtgttagccgctgtgcggaccttaagcggaatgtgtagtggtcaccaggcaagagccacagtgatattacacgctgtgaggatcgaccgcatttgctccctcatggctgtggaaaacgaagagatgtcacttgcggtgtgcaatctgctgcaggccatcattgattccctgagcggagaggataagcgggaacatcgaggaaaggaagaagccctggtcctggacaccaaaaaagatctgaaacaaataacctcccacctcctggatatgctggtctccaagaaggtcagtggccagggccgggatcaggctctcaatctcctgaataagaatgtgccgcgcaaggacctcgctattcatgacaattcaagaactatttatgtggtcgacaatggccttcgaaagattttaaaggtggtggggcaggtgcccgacctgccatcttgtttgcccctaaccgataacacgcggatgcttgctagcattctgattaacaaactttacgatgatttgaggtgtgacccagagcgggatcactttcgcaagatctgtgaagagtatattacgggaaagttcgatccacaggatatggataagaacctcaacgccattcagactgtgtccgggatcctgcagggcccctttgatctgggcaaccagctgctgggattaaagggggtcatggaaatgatggttgccctttgcggctcagaacgagagaccgaccaacttgtggccgtcgaggcactaatccacgcaagcacaaagctgtcgagagcgacgtttataattactaatggagtatccctgctgaagcagatctacaaaacaacaaaaaacgaaaaaatcaagatccggacactcgttgggctttgcaaactgggatccgccggggggaccgattacgggctccggcaattcgcagaggggtccactgagaagctggctaagcagtgcagaaaatggttatgcaacatgagcattgatacccgcactagacgctgggcggtcgagggacttgcatacctcacactggatgctgacgtgaaagacgactttgtgcaggacgtgcctgcgttacaagctatgttcgaactggccaagactagtgataagaccatactgtatagtgttgctacaaccctggtgaattgcacaaatagttacgatgtcaaagaggttatccccgagttagtgcagctggccaaatttagtaaacagcatgtgcccgaagagcatcccaaggataagaaggatttcattgatatgcgggttaagcggctgctgaaggctggggtgatctcagccttagcctgtatggtgaaagccgatagcgctattctgacggaccagacaaaagagttactggcccgggtgttccttgccctctgtgacaaccccaaggaccggggtacaatagtcgcccagggggggggcaaggccctgatccctcttgccctggaggggacagacgtaggaaaagtaaaagccgcacacgcactggccaagatcgctgccgtctcaaacccggacattgctttcccgggcgagcgagtttacgaagtcgttcgtccgctggtgaggcttctggacactcagagggacggtctccagaattatgaagccttgcttgggctcactaatctcagtgggcggagtgataagttacgccagaagatctttaaggaaagggcccttcccgatattgagaattacatgttcgagaatcatgaccaacttcgtcaggcagctaccgaatgtatgtgtaatatggtcctgcacaaggaagttcaggagagattccttgcagatggcaacgatcgtttgaagctggtggtgttattatgtggcgaggatgatgacaaggtgcagaatgccgccgccggggcactggccatgctaacagcagcccacaagaagctgtgtttgaaaatgacacaggtgacgacccagtggctggagatactacaaagactatgtctgcatgaccagctctcagtgcaacaccgggggctggttattgcctacaacctgctggccgccgatgctgagctcgcaaagaagctcgttgaaagcgagcttctggaaatactgacagtggtaggtaaacaagaaccagatgaaaagaaagcagaagtcgttcagacagccagggaatgccttataaagtgcatggactacggattcatcaagccggtaagttag

SEQ ID NO: 25738 - DNA, 246 bp, Artificial Sequence
  Description of Artificial Sequence: Synthetic coding sequence
atgagccactacggcagctactacggcggcctgggctacagctgcggtggattcgggggactgggttatggttacggctgcggctgcgggtccttctgccgccggggatcaggctgtggatatggaggctatggctacgggtcaggattcgggggttatggatacggcagcggttttggtggctatgggtacgggtgctgccgaccatcctataacggcggatatggcttctccggattttactag

SEQ ID NO: 25739 - DNA, 150 bp, Artificial Sequence
  Description of Artificial Sequence: Synthetic coding sequence
atggaggtgccccggctggaccacgccctgaacagccccaccagcccttgtgaagaggtcatcaagaatctgtccttagaggctatacagctgtgcgacagggatgtggttttcgaggagctgacttcaaaacagactcggaaagggtag

SEQ ID NO: 25740 - DNA, 498 bp, Artificial Sequence
  Description of Artificial Sequence: Synthetic coding sequence
atgagccggtacctgcggccccccaacaccagcctgttcgtgcggaatgtcgccgatgacacccggtctgaagacctgagaagagaattcggacgctacggccccattgtcgacgtgtacgtccctttggacttctataccagacgaccccggggctttgcttatgtgcagttcgaagacgtgcgtgacgcagaagacgccctacataatcttgataggaaatggatttgtggccgccagatcgaaatacaatttgcccagggagatcggaagacacctaaccagatgaaggccaaggagggaagaaacgtgtattctagcagcaggtatgacgattatgaccgctatcggaggagtaggagcaggtcctacgagaggcgccggtcgcggtcgcgctcttttgactataactatcggaggtcttacagccctcgtaagccaaactgctcatggaacacccagtattcctctgcttactacactagccgaaagatctag

SEQ ID NO: 25741 - DNA, 1803 bp, Artificial Sequence
  Description of Artificial Sequence: Synthetic coding sequence
atggccagcaaccacaagagcagcgccgcccggcccgtgagccggggcggcgtgggactcacgggccgcccaccatctggtatcaggcctctgagtggcaacatacgcgtggccacagctatgccccccgggaccgctcgaccaggctcacgtggctgtcctatcggcaccggtggcgttctaagtagccagattaaggtcgcccacagacctgtgacccagcaaggcctcacgggaatgaaaacggggaccaagggcccccaacgtcagatattagataagtcctattacctggggctcctgcgatcgaaaatttcagaactgacgaccgaagtcaacaagctgcagaagggaatcgagatgtacaaccaggagaattcagtttacctgtcgtacgagaaacgagccgagaccctggcggtggagatcaaagagctgcagggccaactcgcagattacaatatgctggtggacaagctgaacactaacacggagatggaggaggtgatgaatgactacaacatgctgaaagcccagaatgaccgcgagacacagagtctggatgtgatcttcaccgaaaggcaggccaaagaaaagcaaatccgttcagtagaagaagagatcgaacaggagaaacaagcaacagacgatatcataaaaaatatgagcttcgagaatcaggtcaagtacctggagatgaaaactactaatgaaaagcttctccaggaattagacaccttgcaacagcagctcgactctcagaacatgaagaaagaatctcttgaagctgagatcgcacactcgcaggtgaagcaggaagcagtgctactacacgaaaagctctacgagctcgaaagccatcgggatcagatgatcgcagaggataagtccattgggtcccctatggaggaacgggagaagcttttgaagcaaataaaggatgataatcaggaaatcgcatccatggagaggcagctcactgacaccaaagagaagatcaatcagtttatagaggagattagacagttggacatggaccttgaggaacaccaaggcgaaatgaaccagaagtacaaagagctgaagaagcgagaggagcatatggatacattcatcgagactttcgaggagaccaaaaatcaggaactcaagaggaaggctcagattgaggctaatatcgtcgccctgctcgagcattgtagccgtaatattaacaggattgagcagatatcttcaattaccaaccaagagttgaagatgatgcaagatgacctgaactttaagtccaccgaggtccagaagagccagagcaccgcccagaacttgacaagcgatattcaaaggttgcagcttgaccttcagaagatggaacttctcgagtccaaaatgactgaagagcagcattcattgaagtcaaagattaagcaaatgaccaccgacctggagatttataacgatctcccagccttaaagagcagcggagaggaaaagattaagaaactgcaccaggaacgaatgatcctatctacccataggaacgcctttaaaaagatcatggaaaagcagaacatcgagtatgaggccctgaagactcaattacaagagaacgaaacccattctcagctcaccaacctggaaaggaagtggcaacatcttgagcagaataattttgccatgaaggagttcattgccaccaaaagccaagaaagcgattaccagccaatcaaaaaaaacgtgaccaagcagatcgccgaatacaacaaaacaatcgtcgacgccctccattctacgtcaggcaactag

SEQ ID NO: 25742 - DNA, 465 bp, Artificial Sequence
  Description of Artificial Sequence: Synthetic coding sequence
atggtgagcagcgcccagatgggcttcaacctgcaggccctgctggagcagttatctcaggatgaattatcaaagttcaagtatctcatcacaactttcagcctggcccacgaattacagaagattcctcataaggaggtcgacaaggccgatggcaagcagctcgtcgagattctgaccacccactgtgactcttactgggtggagatggccagcctgcaagtttttgagaagatgcacaggatggatctgtctgaacgggccaaggacgaggtgcgggaagcagccctgaaatcattcaataaaaggaaaccattaagcctgggaattacaaggaaagaacgacccccgttggatgtggatgagatgctagaaaggttcaaaacagaggcacaggcttttactgagactaaaggaaatgtcatttgtctgggcaaagaagtttttaagggcaagaaaccctag

SEQ ID NO: 25743 - DNA, 474 bp, Artificial Sequence
  Description of Artificial Sequence: Synthetic coding sequence
atggccaccagcgcccccctgcggagcctggaggaggaggtgacctgttccatctgcttagattatctccgtgaccctgtgaccatcgattgcgggcatgtgttctgtcggagttgcacaaccgacgttcgcccgatttctggaagtcgcccagtctgtcccctatgcaagaagccattcaagaaggaaaatattagaccggtctggcagttagcttctctcgttgagaatatcgaaagactgaaagttgacaaggggagacaacccggcgaagtcacaagagaacagcaggacgcgaagctgtgtgagaggcacagagaaaagctgcattactactgtgaggacgacggcaaactgctgtgtgtgatgtgcagggagtcgcgtgaacacaggcctcatactgcagtacttatggaaaaagccgcccagccccaccgggaaaagattcttaaccacttatctactctgcgttag

SEQ ID NO: 25744 - DNA, 348 bp, Artificial Sequence
  Description of Artificial Sequence: Synthetic coding sequence
atgccccacctgcccctggccagcttccggccccccttctggggcctccgtcatagccgggggttgcctcgattccattctgttagtactcaatccgaaccccacgggagccctatttccaggagaaaccgcgaggcaaagcagaagagattgcgggagaagcaggccacgttggaggccgagattgcgggagagtcaaaatctccagctgaaagtataaaggcttggcggcccaaggagctcgtgctttacgaaataccaaccaagcctggagagaaaaaagatgtctccggtccccttccgcccgcctattcccctcgatatgtggaggccgcatggtatccttag

SEQ ID NO: 25745 - DNA, 432 bp, Artificial Sequence
  Description of Artificial Sequence: Synthetic coding sequence
gtgcgggagctggaggccgagctggacgccgagcagaagaagcacgccgaggccctcaagggagttcgcaagcacgagagacgagtgaaggaattagcataccaggtgggtgatagagtgagcctcggaagcggtcccggcgccggccccgctcaagcgtcaccggaaagcccacttcccgcccaggccgaagaggacagaaagaatctcgctagaatgcaggacttagtggataaattgcagtcaaaagtaaaaagctataagaggcagttcgaggaagccgagcagcaggcaaacacaaatcttgcgaagtataggaaagcccaacatgagctggatgacgcagaagaacgggcagatatggccgagactcaggcgaataaactccgggctaggaccagggacgccctgggccctaagcataaagagtag

SEQ ID NO: 25746 - DNA, 828 bp, Artificial Sequence
  Description of Artificial Sequence: Synthetic coding sequence
atgagcaccatcggcagcttcgagggcttccaggccgtgagcctgaagcaggaaggtgatgatcagccctcagaaaccgatcaccttagcatggaagaggaagacccaatgcctcgtcagatatctcggcagtcctccgtgaccgagtctactctgtaccccaatccctatcaccagccttatatttctagaaagtactttgctaccaggccaggtgccattgaaaccgcaatggaggacctgaaagggcacgttgctgaaaccagtggcgagaccatacaaggattttggctcctgactaagattgatcactggaataacgagaaagagcggatcctgctcgtaaccgataaaacactgctgatctgtaaatatgacttcatcatgctgtcctgtgtccaacttcagcgcatccccctcagcgccgtctataggatctgcctcggtaagtttacatttccaggaatgtccttggataaaaggcagggcgagggcctgcgcatctactggggctcacccgaggagcagagcctcttaagccgatggaacccttggtccactgaggtcccctatgctacttttactgaacatcctatgaaatatacctcagaaaagtttctcgagatctgtaagctgagcggcttcatgtcaaagctggttcccgctattcagaatgcccacaaaaacagtactggctcaggacggggcaagaaactcatggtgctgaccgaacctatcctcattgaaacgtacacaggcctcatgagtttcattggaaacaggaataagttgggctactcccttgcccgcggttctataggattctag

SEQ ID NO: 25747 - DNA, 339 bp, Artificial Sequence
  Description of Artificial Sequence: Synthetic coding sequence
tgatgcgcccggaccgccggcggctgcctgggctgcctgagcggccagtgctgttgccgcctgtgtcccctgacactccccgccaccagaagcctttgccccggccgggtggtgtgggcgcggcgaaggtggtggccttcctggcttgcctggcgatgtctgtggtgtaccaccagacctcccgcctgtatggagaatacagacgctttcctgtttctgttctcattcactgacagggcatccttcgaagacttgcctgggcagctggcccgtatcgccggggaggcgcctggcgtagttaggatggtgatagggagtaagttcgaccagtatatgtag

SEQ ID NO: 25748 - DNA, 3330 bp, Artificial Sequence
  Description of Artificial Sequence: Synthetic coding sequence
atgggcaccggcgacttcatctgcatcagcatgaccggcggcgccccctggggctttcgattacaaggaggaaaggaacagaagcagcccctacaggttgctaagatccgaaaccagagtaaggcatctggaagcggactgtgtgagggggacgaggtcgtgagcatcaatggcaacccctgtgctgaccttacttacccagaagtgattaagctaatggaaagtatcacagacagcctgcagatgctgataaagcgcccctcatccggcatctcggaagctctcattagcgagaatgaaaacaaaaacttggagcatctcactcatggtgggtatgttgagagcacaactctgcagatccgcccagccacaaagacacagtgtactgagttctttttggcaccagttaagaccgaagttcccctggccgaaaatcaacggtctgggccagattgcgctggcagcctcaaggaagaaaccggccccagctaccagcgagcaccacaaatgccagacagtcaacgggggcgcgtggcagaggaattaattctgcgggagaaagtggaggctgtgcaacctggaccagtagttgaattgcagctgtcactctctcaagagagacacaagggggcatccggccctctcgttgctttgcccggcgctgaaaaaagcaagagtccagaccctgaccccaacttgtcacatgatcgcatcgtccacatcaatagtatacccaccaacgagaaagctgatcccttccttcgcagctctaagatcatccagattagttccggacgcgagctccgagtcattcaggaatctgaggccggcgacgccggtctccccagggttgaggtgatcctggactgctccgatcgccagaaaacggaagggtgtcgtctgcaagccggaaaagagtgtgtcgactcccccgtcgagggtggccaatctgaagctcccccatcactggtgagtttcgctgtgagcagtgaaggcaccgagcagggggaagacccccgctcagaaaaggatcatagcagaccgcacaagcatagagctaggcatgctaggctgagacgatcagaatccttaagcgaaaaacaggtgaaggaggccaagtccaaatgcaaaagcatcgctttgctgctgacagatgcacccaatcccaacagcaaaggggtgctgatgttcaaaaaacgacgcaggagggctcggaaatataccctggtgtcttacgggactggggagttggagagagaggctgacgaagaggaagagggtgataaggaggatacttgtgaagtcgcctttcttggcgctagcgaaagtgaggtagacgaagaactgctctcagacgtggacgacaacacacaggtcgtcaattttgattgggattctggcctagttgatattgagaaaaagctgaatcggggggacaagatggaaatgctgccggacaccaccgggaagggcgcgttgatgtttgccaaacggcgcgagcggatggaccagattactgcacagaaggaagaagataaggttggcgggacaccctcccgagagcaggacgctgcacaaactgatggtctgcggaccacaacgagctaccagagaaaagaggaagagtccgtgcgtacccagtccagcgtgtcaaaatcatatatcgaagtgtcccacggcctgggacacgtgccgcagcaaaatggattttctgggacctctgagactgctaacatccagcgaatggtccccatgaataggacggctaagccatttcctgggtctgtaaaccagccagccacaccgttctctcctacccgtaacatgacatcacccatcgctgatttcccggccccccccccttatagcgcagttacccccccgccagatgcgttcagccgtggcgttagttcccccatcgctggcccagcacagccccccccatggccacagcccgcaccctggtcccagccagctttctatgatagtagtgagcgcatagcttcacgcgatgaacgcatcagcgtacccgctaagaggaccggaattctgcaggaggctaagaggcgaagcacaacaaagccaatgtttacattcaaagagccgaaggtttcacctaatccagaacttctaagtctgctgcaaaactcagaagggaagagaggcacaggcgccggcggcgacagtggaccagaggaagattacttatctctgggagcggaggcctgcaattttatgcagagctcttctgcaaagcaaaagacacccccgccagtggccccaaaaccggctgttaagagcagctcatcccagcccgtcactcccgtgtctccagtgtggtctccaggtgtggcccccacgcagcccccagcctttcctacatcaaacccttctaaagggacagtagtttctagcatcaagatcgcccagcccagctatcctccagccagaccagccagtactctgaatgttgcaggacctttcaaggggccccaagcagctgtggcaagtcaaaactacacaccaaaaccaaccgtgtcaacgccaactgtgaacgccgtgcagcctggagccgtggggccctcaaatgagttaccaggaatgtctgggagaggagcacagctgttcgccaagagacaatctagaatggagaaatacgttgttgattcagacaccgtccaggcgcatgccgctcgggctcagtcccctaccccttccctgccagcatcctggaagtactctagcaacgtcagggcaccaccgccagtggcttataatcccatccactcaccttcctaccccctggctgctctaaagagccagccttccgctgcccagccctccaagatgggcaaaaaaaagggcaagaagcccctgaacgccttggacgtgatgaagcaccagccctaccagctcaatgcctctctcttcacctttcaaccaccagacgctaaggacgggctgccccagaaatcctctgtgaaagtgaattcggctctcgcgatgaaacaggccctgcctccaaggcccgtcaacgcggcttcccctacaaatgtacaggcatcgtccgtatacagcgttccagcctatacttccccaccctcatttttcgctgaagcttcgtcccctgtttcagcttcaccagttccggtcggtatcccgacctcacccaagcaggagtccgctagcagttcatatttcgtcgcacccaggcccaagttttctgccaagaaatctggcgtgactatccaggtgaagtgcaagtcaggcattcactctcaggacattatcagaacatacttcccggcttacttaagctcatccacatag

SEQ ID NO: 25749 - DNA, 1554 bp, Artificial Sequence
  Description of Artificial Sequence: Synthetic coding sequence
atggagaccgacctgaacagccaggaccggaaggacctggacaagttcattaagttctttgccctgaagactgtgcaggtcatcgtgcaggctcggctgggagagaaaatctgcactagatcctcttctagccctacgggctcagactggtttaatctagctatcaaagacatccctgaggttactcatgaggctaagaaagccctagcaggccagctacctgccgtgggccgaagtatgtgtgttgaaatatcccttaaaacgtccgaaggcgactcaatggagttggagatctggtgtctcgaaatgaacgagaaatgcgataaagaaatcaaagtgtcatacactgtgtacaacagactgagcttgttgctaaaatcattgctcgcgatcaccagagtcactccagcctaccgtctgtcacggaaacagggccatgaatacgtgatcctctacagaatttacttcggcgaagtgcagctctctggacttggcgaaggctttcagacagtaagagtcggaaccgtggggacccccgtcggcaccatcacattgagctgcgcctaccgcattaacctggcatttatgtcaacccggcagttcgaacggacccccccgatcatgggtatcataattgatcatttcgtagaccggccctatcccagctccagcccgatgcatccatgtaattacagaacggctggcgaggacactggggtcatttacccatcagtggaggatagccaggaggtatgcacaacgagcttttccacatccccaccctcacagctcagtagctcaaggttatcttatcagcctgcagcactgggagtgggctccgctgacctcgcctacccggtagttttcgccgccggactgaacgccactcatccacatcaattgatggtgcctggcaaagagggcggcgttccgttggctcccaaccagcctgtccatggcacgcaagccgatcaggagcgcctagctacctgtactccgagcgacagaacccactgcgccgcaaccccctcctcctcagaagacaccgagaccgtgtctaactcttcagagggccgggcttctccccatgatgttctagaaaccatcttcgtgcgcaaggtcggagcattcgtcaataagccaatcaatcaggtcactttgacgagtttggatatcccttttgcgatgttcgcaccaaagaatcttgaactggaagataccgaccccatggtgaacccaccggactctccagaaaccgaatctcccctccaaggatccctccactccgatggatcttctggcgggtcgtctggtaacacacacgatgattttgtcatgatcgactttaaacctgccttttctaaagacgatatactccctatggaccttgggacattctatcgtgagttccagaaccctccacagctctcaagtttgtcaatcgatattggcgcgcagagcatggcagaagatcttgattccctacccgaaaaactagctgtacatgagaaaaatgtgagggagtttgatgcgtttgtcgagacactgcagtag

SEQ ID NO: 25750 - DNA, 348 bp, Artificial Sequence
  Description of Artificial Sequence: Synthetic coding sequence
atgccccacctgcccctggccagcttccggccccccttctggggcctccgacacagcagggggttgcctcgcttccatagtgtgagtacacagtctgaacctcacggaagccccatcagtagaaggaatcgggaagctaaacaaaagcgtctgcgcgaaaaacaggcgacactggaggcagagatcgccggtgagagtaaaagccctgcagagtctattaaggcctggcgccccaaggagctggtgctatacgagatccctacaaagcctggtgagaaaaaagatgttagcggccccctgcccccggcatactcccctagatatgtcgaagctgcatggtacccatag

SEQ ID NO: 25751 - DNA, 1014 bp, Artificial Sequence
  Description of Artificial Sequence: Synthetic coding sequence
atggagctgaagaccctgtgggagaacaagctgatgcagagccgggctgttgatggattccattctgaggaacagcagctgcttctgcaggtgcagcagcagcatcagccacagcaacagcagcatcaccaccaccaccaccaccagcaggcgcagccccagcagacagtaccacaacaggcacaaacacagcaagtcctcattcccgccagtcaacaagccacggcaccccaggttattgtgcctgactctaagttgatccaacatatgaacgcaagtaatatgtccgcagccgctaccgccgctaccctggccctgccagccggggtgactcccgtgcagcagattctgaccaactccgggcagttgctccaggtggtgcgggccgctaatggtgcccagtatatcttccagccacagcaatccgtggttctgcagcagcaggtgattccccagatgcagccaggcggggtgcaggcgccagtaattcagcaagtcctcgcccccttaccaggcggcatttccccccagaccggcgtgataattcagcctcagcagatcttattcaccggcaacaaaacacaggtgattccgactactgtcgcagcaccaactcctgcccaggcccagataactgccactgggcagcagcagccccaggctcaacctgcccagacacaagctccactagtactccaagtcgatggaaccggggatacaagctccgaggaggacgaggacgaggaggaagactacgatgatgatgaggaggaggataaggagaaggacggtgcagaggatggccaagtcgaggaggaacccttgaactctgaagacgatgtttccgatgaggagggccaggaactgttcgataccgagaatgtagtagtgtgccagtatgataaaatccataggtccaagaacaaatggaaatttcacctgaaggacggaattatgaacctcaatggccgcgactatatatttagtaaggcaataggagatgccgagtggtag

SEQ ID NO: 25752 - DNA, 3012 bp, Artificial Sequence
  Description of Artificial Sequence: Synthetic coding sequence
atgagccagtggacccccgagtacaacgagctgtacaccctgaaggtcgacatgaaaagtgagatcccctcagacgcacccaaaacacaggaatctctgaaaggcatcctgcttcacccagagcctatcggcgctgctaaaagttttccggccggggtcgaaatgatcaattctaaggtcggcaacgagttcagccatctttgcgacgacagccagaaacaagaaaaagaaatgaatgggaatcagcaggagcaggagaagtcattagtggtgcggaagaaaaggaaaagtcagcaggcggggcctagctacgtccaaaactgtgtaaaggagaaccagggcatactgggcctgagacagcacttgggcacaccttccgacgaggataacgattcctccttcagcgactgccttagttccccgtcaagcagtctccatttcggagattccgataccgtgacttccgacgaggacaaagaggtgtccgtacggcattcccagaccattctcaacgccaagtcaaggtctcacagcgctaggtcacataaatggccccggaccgaaaccgagtccgtgtccggtctgcttatgaagagaccttgcctgcacggatcgtcgctgaggcggttgccatgccgcaagcggtttgtcaaaaataatagttcccagaggactcagaaacagaaagagcgcatcctaatgcagagaaagaagcgagaagtgctggctagaagaaaatacgctctgttgccctccagctcctcctcaagtgagaacgacctgtccagcgagagctcgtcctcatcctcgacagagggagaagaggacttgtttgtctcggcatccgagaaccaccagaataatccagcagtcccttctgggagtatagacgaggacgtggtggtcatcgaggcctcttcaactccacaggtaacagcgaacgaggaaatcaatgtgacgagcaccgatagtgaggttgaaatcgtgacggtcggggaatcgtaccggtctcgatctacactggggcactctcgttcccattggagccagggctcgagtagccatgcctctcggccccaggaaccccgcaacagaagccgaatatcgactgtcattcagcctttacgacagaacgcggccgaggtcgttgatctgaccgttgacgaagacgagcctacggttgtccctactacgtcagcccggatggaatcacaagccacgagcgcctccattaacaatagtaatccctccaccagtgagcaagcttccgataccgcgagcgccgtgacaagctcccaaccaagtactgtgagtgagacgtccgcaacccttacctccaatagcactaccggtacctccattggggatgactctcgacggacaaccagtagtgcggttaccgaaacagggcctccagctatgccaaggctccccagttgttgtcctcagcacagtccttgtggcgggtccagtcagaatcatcatgctctcggccacccccacacctcttgtttccagcagcatggccaccacttccagcatcatcaccatcatcaccacacaccacaccctgccgttccagtctctcccagtttttctgacccggcatgccccgtggagcgccccccacaggtccaggcgccatgcggtgctaatagctcgtctggcacctcctaccacgaacagcaggctctgcccgtggacttatccaattctggcatacgttcccatggttcaggcagcttccacggggccagcgcattcgatccctgttgtcccgtcagcagtagccgcgcagccatctttgggcaccaggctgctgcggctgcccccagtcagcccttgagcagcattgacgggtacggcagttccatggtggcgcagccccagccacagcccccaccacagccaagcctgtctagctgtcgacattacatgccccctccctacgcaagtttgacccgcccactgcatcaccaggcctccgcctgccctcactcacatgggaacccgccccctcagacccagcctcctccccaggtggactacgtgatcccccatcccgtgcatgccttccactctcagatctcgtcacatgccacgtctcatccagttgcccccccacctcctactcacctcgcctccacagcagcaccaatccctcagcacctgccgcccacccaccaaccaatttcccaccacattcccgctaccgccccacctgcacagcgacttcacccccacgaagttatgcagaggatggaggtccaaagaagacggatgatgcagcaccctacaggtctcttcgtgttttgtgtgagcagacgggcacacgaaagaccccctccacacccgcaccggatgcaccctaattatggacacggacatcacattcacgtgcctcagacaatgtcaagccacccccgccaagcacccgagagatccgcatgggaactgggtatagaggccggagtgacagccgcaacatatacccccggggcccttcacccgcatctggctcattatcatgcgccccccagactgcaccatctgcagctgggggccctccccctgatggtgccggatatggctggttacccccacattaggtacatttcctctggtctcgatggtacctcgttcagaggtcccttccgcggaaacttcgaggaactcatacacttagaggagcgactgggcaacgtaaacaggggggcgtctcaggggacaattgaaaggtgcacctacccacacaaatataagaaggtgactactgactggtttagtcaacgaaaactgcactgtaaacaagacggcgaggaggggaccgaggaggatacagaggaaaaatgcacaatctgtctgtcaattctggaagaaggtgaggacgtgaggcggcttccttgtatgcatctgttccaccaggtctgtgtcgaccagtggctaatcacgaataaaaagtgtccaatatgccgcgttgacatcgaggcccagttgccatctgagtcttag

SEQ ID NO: 25753 - DNA, 3309 bp, Artificial Sequence
  Description of Artificial Sequence: Synthetic coding sequence
atggccgagaaggaggcccggcggaagttcaagcagatcgtgaccgccgtgtacttttgtcattgtcgcaacattgttcatcgtgatctgaaggcagaaaatctactgctggacgcgaacctcaatataaagatcgcggactttggctttagtaatctctttacaccaggtcagttactcaagacatggtgtggcagccccccgtatgcagcccctgaattgtttgaaggtaaagaatatgacggcccgaaagtggacatctggtcactgggggtcgtgctgtacgtgctggtgtgcggagccctgcccttcgatgggagcactttacagaacctgcgcgcccgggttttaagtgggaagttccggattccgttcttcatgtccactgagtgcgagcaccttatccgccacatgctggtgctggaccctaacaaacgcctgtctatggaacaaatttgcaagcacaagtggatgaaactgggggacgccgatcctaactttgatcgccttattgcagagtgtcaacagctcaaagaggaacggcaagtggatccactgaacgaggatgttctgctggctatggaagacatgggactcgacaaggagcagacactccagtcgctccgcagtgatgcctatgatcattactcggccatctattcattactctgtgaccggcataaaagacacaagaccctacgcctcggagccctgccttccatgcctcgcgcccttgcttttcaagcgccagtgaacattcaagccgagcaggctgggactgccatgaatatttctgtgccacaggtccaactgataaaccccgaaaaccagatcgtcgagcccgacggcactctgaatctggactctgacgaaggcgaagagccctctcccgaggccctcgtccgctatctgtcaatgcgcagacacaccgtcggggttgccgatccccggacagaagtcatggaggacctccaaaaactgctccccggattccccggggtaaaccctcaggctccattccttcaggtcgcaccaaacgtgaatttcatgcataatcttctacccatgcaaaacttacagccaacgggtcagctcgaatacaaggaacagagtctgttgcagccacccaccctccagctgttgaacggcatggggccactcgggagacgggcctccgatggtggcgcaaacattcaactgcatgcacagcagttgctgaagcggccacgtgggccaagccctttggtgaccatgaccccagcagtcccagccgtgacgccagtcgacgaagaaagctccgatggagagcccgaccaagaagcagtgcagtcttccacatacaaggattcgaacacgctgcatctcccaactgaaaggttctccccagtccggcgcttctctgatggtgcagcatccatccaggcatttaaagcccaccttgagaaaatgggtaataatagtagtatcaagcaacttcaacaggaatgtgagcagctgcagaaaatgtacggaggccagatcgacgagcgcaccctggagaagacccaacagcaacatatgctgtatcagcaagaacagcaccatcagatccttcagcagcaaatccaggattccatctgtcctcctcagcctagcccaccgctgcaggctgcctgtgaaaaccagcccgcgctcctgacccaccagttacagcggttacgaatacaaccatctagccccccgccaaaccatccgaataaccacctgtttcgccagccttccaattctcctccacctatgtcatcagccatgattcaaccccacggagcggcatcatcctcccaatttcaggggctgccatctcgatccgcaatctttcagcagcaaccagaaaactgtagctccccaccaaatgtggcgttgacgtgccttgggatgcagcaacccgcacagtcccaacaggtgaccattcaggttcaggaaccagttgacatgttatccaacatgcctggcaccgccgcagggtccagtggacggggtatttccatctcgccctctgcaggccagatgcagatgcaacatcgcacgaatcttatggctaccctttcatatggacacaggccactgtctaaacaactatcagccgatagtgccgaagctcatagtgctcaccaacagcctccccactacactactagcgcactccaacaagcattgctttctcccaccccaccagactacactcggcatcagcaggtcccacatatattgcaaggcctactgagcccacgccacagtctgactggccactcagatattcgtttgcctcccaccgaatttgcacagcttatcaagagacaacagcagcagcgccagcagcaacagcagcagcagcagcagcaggaataccaagagctgtttaggcacatgaaccaaggtgacgccgggtcactagcaccatccctcgggggccagagcatgaccgaaagacaggcactgtcatatcagaatgctgattcctaccaccaccacactagtccccagcatctgctgcagatccgggcacaggagtgtgtgagccaggcatcttcgcctacccccccccacgggtacgcacatcagcccgccctgatgcactctgaatctatggaagaagactgcagttgcgaaggggccaaagacggattccaggattctaaatcctcgtctactctgacgaaaggctgtcacgattcacccttactcctgtcaacaggggggccaggcgacccagagagtttactgggaaccgtcagccacgcacaagagctcggcatccacccctacgggcatcaacccacagcagcgttttccaagaacaaagtacccagccgcgaacccgtcatcggtaattgcatggataggagttctcctgggcaagccgttgaactgcctgatcataatgggctgggataccccgcacgcccgagtgtgcacgaacatcacaggccacgcgccctccaacggcatcacaccatccagaactccgacgacgcctacgtgcagctggacaatctgcccgggatgtcactggtggctggtaaagccctgtcttccgcccgtatgtccgacgccgtgctgtcacagtcatcgttgatgggatcacagcagttccaggatggagagaatgaggagtgcggcgctagcctcggagggcacgagcaccctgatctgtctgatggatctcagcatcttaactcatcctgttacccctctacctgcattacagacattctgctgtcctacaaacacccagaggtttccttctccatggagcaggcaggagtctag

SEQ ID NO: 25754 - DNA, 1461 bp, Artificial Sequence
  Description of Artificial Sequence: Synthetic coding sequence
atgaccctgatggtgctgaccttcagcagctacatcctggacttcatcaatgtgctgtcttatgacctgcacggcagctgggaaagatttaccggtcacaactcaccactgttttccctgccggaagatcctaaatcatcagcgtatgccatgaattattggagaaagctcggtgcgcctagtgaaaagctgattatgggcatcccgacttatggacgcacctttcggcttctgaaggctagtaaaaatggcctacaagcgcgcgccataggtcccgcttccccggggaagtacactaaacaggagggatttctagcatatttcgagatctgctcttttgtctggggcgccaagaaacactggattgattaccaatatgtgccatacgcgaacaaaggaaaagaatgggtaggctacgacaatgctatttccttctcctacaaggcttggtttattcggcgcgagcattttggtggcgcaatggtatggacgcttgacatggatgatgtccgcgggacattttgtgggaccggcccttttccgttagtctacgtcctgaatgacatcctggttcgcgctgagttcagcagcacgtcactgccgcagttctggctttcctctgccgtcaatagttccagcactgacccagaacggctggctgtcaccacggcctggacaaccgattcaaaaatcctcccgccaggaggggaggcaggcgtgactgaaatccatggcaagtgtgagaacatgactatcacaccccggggaacgactgttacacccaccaaggaaaccgtgtccctgggcaagcataccgtggccctgggggagaagactgaaatcaccggtgcaatgaccatgacttctgtgggtcaccaatctatgacccccggagagaaggctctgacaccagtgggacaccagagcgtaacaaccggtcagaaaactctgacctctgtgggttatcaatcagtaacgcctggtgaaaaaacactgacccccgtgggccaccagtcagtgacgcctgtgtcccatcagagcgtgtctcccggtggcacaacaatgacccctgtgcactttcagacagagacattacggcagaatacagtggccccacggcggaaagccgtggcgagagagaaagttaccgttcctagtcgcaacatctcggttactcccgaggggcagaccatgccacttagaggcgagaatctgaccagcgaagtggggacgcacccccgcatgggcaatctcggcctccagatggaggctgagaacaggatgatgttgagctctagtccagtgatccagctgccggaacagaccccgctggccttcgataaccgcttcgttcccatttatggtaaccattcgagcgtgaacagcgttactccacagacttcccctctgtccttaaagaaagagatccccgaaaacagcgccgtggatgaggaagcctag

SEQ ID NO: 25755 - DNA, 1017 bp, Artificial Sequence
  Description of Artificial Sequence: Synthetic coding sequence
atggagctgtggggccggatgctgtgggccctgctgagcggccccggcagaaggggcagcaccagaggctgggcttttagtagctggcagccccaaccacccctggccggcttgagctccgccatcgagttggtgagtcattggacgggcgttttcgaaaaaagaggtattccggaggctcgcgagtcttccgagtatattgttgcacacgtcctgggagccaagacttttcagtccctccggcccgcattgtggactcagcctctgacatcacagcagcttcaatgtatccgagagctctcgtccaggcgactgcaacggatgcctgttcagtacatcctcggggagtgggacttccagggcctgtctctccggatggtgcccccagtattcatcccacggccggagaccgaagaactcgtcgaatgggtgctcgaggaggtcgcgcagcgtagccatgctgtgggcagcccagggtcacctcttattctggaggtgggatgcggatctggggccatttccctctctcttctctcccagctcccccaatccagagtgattgctgtagataaacgggaggccgccattagccttacccatgagaacgcacagcgacttcggctgcaggaccgaatttggatcatccacctggacatgacaagcgagaggtcttggacccatttgccatggggccctatggacctaatcgttagcaatcctccatatgtgttccatcaggacatggaacagctggcacccgaaatccggtcatatgaggaccccgctgcattagacggcggtgaagagggtatggatatcatcacacacatcctggccttagcacccaggttgctgaaagactcaggttccatatttcttgaggtcgatcctcgccaccctgaactcgtgagcagctggctgcaatctcgtcccgacctatatctgaacttagttgcagtgcgacgcgacttttgcggtagaccccggtttctccatatccgccgatcaggcccctag

SEQ ID NO: 25756 - DNA, 1899 bp, Artificial Sequence
  Description of Artificial Sequence: Synthetic coding sequence
atggacaccatgatgctgaacgtgcggaacctgttcgagcagctggtcaggagggttgagattctctccgagggcaatgaagttcaatttatccagctggctaaagattttgaggatttccggaaaaaatggcagagaaccgaccacgagctaggtaaatacaaagatctactgatgaaggctgagacagaacgctcggcgttagatgtgaagttgaaacacgcccggaaccaagtggatgtggagattaagcgccggcaacgcgcagaggccgattgtgaaaaattggaaaggcagatccagctgattagggagatgcttatgtgcgatacctctgggagtattcagctctcggaagagcagaaatcggcactggcctttctgaatcggggtcagccatcttcttcaaacgcaggcaacaaaagactctctactatagatgagagtgggagtatcttgtcagatatatccttcgataagaccgatgaatcattggactgggactcttccctggtgaagacgttcaagctcaagaagcgggagaagcggcgtagtacgtctcggcagtttgttgacggaccacctgggcccgtcaaaaagacccggtccattggctcagcagtggatcagggaaatgagagcattgttgctaaaacgaccgtgacagtccctaatgatggaggaccaatcgaggcggtgtctacgatcgagactgtgccgtattggacacgctccagacgcaagacaggaactctccaaccctggaatagcgattccacgcttaacagcagacagctggaacccagaaccgaaaccgactctgtgggaactccacagtcaaatggggggatgagactccatgatttcgtctccaaaacagtgattaaaccagagtcctgcgttccgtgcgggaagcggattaaatttggcaagctgtctctcaagtgccgcgactgcagggttgtctcccacccagagtgtcgagacagatgccccctcccctgtattcctactctcatcggcacacctgtgaaaatcggggagggtatgttggctgactttgtttcccagacttcaccaatgatcccttcaatcgtggttcactgtgtaaatgagatcgagcagaggggtttgaccgaaacgggtctctataggatatccggatgtgatcgcaccgtgaaggaactgaaggagaaattcctgcgagtgaaaactgtgcccctgctgagcaaggttgatgacatacacgccatctgtagcctgctcaaagactttctgcgaaacttaaaagagcccctactcacattccgcctgaaccgcgcttttatggaggccgccgaaattacggacgaggataacagcatagcggctatgtaccaggctgtgggcgaactccctcaggctaatagagacacccttgcctttctgatgattcacctgcaaagggtcgcacaatcgccacacacaaaaatggatgttgccaacctggctaaagtgttcggccctactatcgttgcccacgctgtgcctaaccccgaccccgtaacaatgttgcaagacattaaaaggcagccaaaggttgttgagcggttgctctctctgcctctggagtactggtctcagttcatgatggtggagcaggagaacattgatcctcttcacgtaatcgaaaacagcaacgctttttcgacaccacagactccagatatcaaagtgtcgctactgggaccagtaaccactcccgagcaccaactgctcaagacccccagttcgagttccctctcacaacgggttagatcgaccctaactaaaaatacacccagattcggaagtaagtccaagtcagccacaaatcttgggcgccaaggcaacttttttgcttctcccatgctgaaatag

SEQ ID NO: 25757 - DNA, 1791 bp, Artificial Sequence
  Description of Artificial Sequence: Synthetic coding sequence
atgagcaaccagcaggagaagtacgaggcccagaacatcgtgaactcaaccgaagagtccgacgacgcattcgataccgtgacaatacccgtgccctcggaggaacctcaagaaagcgatcaaaccgaggagcacgaaagcggcatcgaacaattttccgagtcacacgcgatccacgttgaggagcagtcagatcagagtttcagtagcctggagccggataatgagcagttgatggaggaggtgatctccccacggcaagttagctataccccacagcaccatgaaaaacagtatgccatgcagagacccaacgatgacagtctggcctttttggacaaaataaagtcagtgaaagagtctctgcaggagtctgtggaagatagtttagcaactgtcaaggtggtgctgatccctgtaggccaggagatcgtgattccattcaaggtggacactattttgaagtacctcaaggatcacttctcccacctcctcggaatccctcactcagttctccaaatccgatattctggtaagatcctgaagaacaacgaaaccctggtgcagcatggggttaagccccaggaaatcgttcaggtcgagattttctcgactaacccagatctgtatccagtgcgcagaattgatggtctgacagacgttagtcagattatcacagttacagtgcagactgggctcgatcagtaccagcaagtccccgttgaaatagtaaaaagtgacttccataaaccttttctgggcgggttcagacacaaggtgaccggggtcgagtatcataacgccggaacacaaaccgtcccaaaaaggataccggaacgacttagcattttctgtcgggacacacaaaccgtgtttcagaagaagaacctgcagcagaccacgaatactacgtctactcaaatgacgaatatcggagtgtatgtgtctaatatgactgataagcttgtaaccccgggaaagtacttttcggctgcagaataccatgcccagagactgaaggctgtgatagttatccaaacctattatcgacaatggcacgctaaaattttcgtcgagaatctccggagacagaaatcacttcgcttggagtgggaaacacagcaagaactgcgcaaaatccgggagaaggaggaatggattaagctggactatcaccgccggcacaatccaaaaaccaacgaggatttcgagtttctatacaacgccttggagttttggcgtcaagaagaactgacccggattaatcagtcctttacaggggccgaaagaaaggctgccctgtgcgagttgctggaaaaggaaactcagattattgcctcaattggccgtcatcgctatatcgcctacatggccaaccaagaagctgctattcaagccttcttagataagtgctcagcccccaaaatctggcgaacccctaacggcaaaacaatcgagatggatacccagttcactatccgagctcgtgaactccagaacatttataaatgcatcatgctgaagaatataagtcaggatgaaaggctcgatgtcttgctcacactgaaacatacagtcaaggagcatgagtgcaaactaacgcaagagatcctggagctcatcgacagagaggtggacttgatgatgcgaggcgttaaacaccacaacctggaaggcctgcgaaagcgtattgcaaccttgtttttccactatattaaaactcctctttttaaccctgaggtcgccaaatatttgaaaatgggaggcgaataccttagcatggccctgtag

SEQ ID NO: 25758 - DNA, 1305 bp, Artificial Sequence
  Description of Artificial Sequence: Synthetic coding sequence
atggtgcaggacggcaccttcaagacccgggacagcacctggacctgcgagtccacacgcatggcagccgccccaccatcctactgtttcgtggcattccctccacgcgccaaagacggattagtcgttttcggaaaaaacagcgctaggccacgggacgaggttcaagaggtggtgtactttagcgcagcagatcacgagcctgaatccaaggtggagtgtacctacatttcaatcgaccaggtgcctcgtacatacgcaattatgatctctcggccagcctggctgtggggagcggaaatgggggccaacgagcatggcgtatgcattgcaaacgaggccataaacacacgagagcctgctgctgagattgaggccctcctggggatggatctggtacgtctgggcttggaacgaggggaaacagctaaggaggctctggatgtgattgtcagtctgctggaagagcatggtcagggaggtaactatttcgaggacgctaattcctgccactcttttcagagcgcctacctgatagtggacagggacgaggcctgggtgctcgagaccattggcaaatactgggcagccgaaaaagtcacagagggcgtgcgctgtatctgtagccagctttcactgaccaccaagatggacgctgagcaccccgagctgagatcctatgcacaaagccagggatggtggacaggggagggggaatttaatttttcagaggtgttcagtccggtcgaagaccatttagattgtggggccggcaaagactcactggaaaagcaagaggagtcaatcaccgtgcaaactatgatgaatactctacgagataaggcttcaggagtttgcatagacagcgagtttttcctaacgacggctagtggcgtctccgtcctcccccaaaatcgatcctctccatgtatccactattttaccgggacacctgatccaagcaggagcatctttaagcctttcatcttcgtggatgacgtgaaactagtgccaaagacacaaagcccttgcttcggtgatgatgatcctgcgaaaaaggagcctcgcttccaagagaaacctgatcgccgccatgagctgtacaaggctcacgaatgggctagagccattattgagagcgaccaggagcagggacgcaagttgaggagtaccatgctggagttggagaagcaagggctcgaagccatggaagaaatcctgacgagttcagaaccgctcgaccctgcggaagttggagatttgttttatgattgtgtggacacagagattaaatttttcaagtag

SEQ ID NO: 25759 - DNA, 1320 bp, Artificial Sequence
  Description of Artificial Sequence: Synthetic coding sequence
atggcctggccctgcatcacccgggcctgctgcatcgcccggttctggaatcagctggacaaggccgacatcgccgttcccctggtgtttacaaaatattctgaggctaccgagcacccgggcgcaccaccacaacccccccctcctcaacaacaagcccagccagcgttagctcctccttcagctagagcggtagcaattgagacacagcccgcccagggagaactcgacgcagtcgctcgggctactggccccgcacccggtccaaccggtgagcgcgaacccgcggccggacccgggaggagtggccccggtcccggactcgggagtggatcgacttccgggccggctgacagcgtgatgcggcaagattaccgagcatggaaggtccagcgcccagagccatcttgcagaccgcgcagcgaataccagccgtctgatgcacccttcgagagagaaacccagtatcagaaggacttcagggcctggcccctccctcggcgtggggatcacccatggatccccaagccagtgcagatctccgctgcttctcaggccagtgctcccatactgggggcacccaagcgaaggcctcagagtcaggagaggtggccagttcaggccgcagctgaagcccgagaacaggaggcggcgcccggcggcgcggggggcttggccgctggaaaggccagtggtgctgatgaaagggatactcgaaggaaagcaggtccagcgtggatcgtgaggcgggcagaagggctcggacacgaacagacgccactccctgccgcacaggcccaggtgcaggctacaggcccagaagcaggacgcgggcgcgccgctgctgacgcgttaaaccgtcaaattagggaggaagttgcttcagctgtctccagcagttatcgaaacgagtttagggcctggacagacatcaaaccagtgaaaccgataaaggcaaagccccagtacaaaccgcccgacgacaagatggtgcacgaaacgtcctactcagcccaattcaaaggcgaggcttctaaacctaccacagccgacaataaagtaatagacagaagaagaatacggagcctgtacagtgaacctttcaaagaacctcccaaggtagaaaagcctagtgtccagtcatcgaagcccaaaaaaacatcagcttctcacaaacccacccggaaagccaaagacaaacaagcagtttcaggccaagccgccaaaaaaaaaagcgctgagggaccctcaaccactaagccggatgataaagaacagtcaaaggaaatgaataataaattggcggaggcaaaggagtag

SEQ ID NO: 25760 - DNA, 813 bp, Artificial Sequence
  Description of Artificial Sequence: Synthetic coding sequence
atgggcggctgcttcagcaagcccaagcccgtggagctgaagatcgaggtggtgctgcctgaaaaggaaagagggaaggaggaacttagcgcttcaggaaaaggctcgcccagggcctatcaagggaacggcacagcaagacacttccatacagaggaacggttgagcactcctcacccctatcctagccctcaggactgcgttgaagccgccgtttgccacgtgaaagatctcgagaacggccagatgagggaagtggagctaggttgggggaaggtgttattggtaaaagacaacggagaattccatgcccttgggcacaagtgccctcactatggcgcaccattggtcaagggagtgctctctcgcggccgagtaagatgcccctggcacggtgcttgcttcaatatctccacgggcgacctggaagatttccctggactggattccctgcacaagtttcaagttaaaattgaaaaagaaaaagtctacgtgcgtgccagcaagcaggccctgcagctccagagacggaccaaagtcatggcaaagtgcatctcaccttcagcagggtactccagttcaaccaacgttctgattgtcggagccggagccgccggcctggtgtgtgccgagactctgcggcaggagggcttttccgaccgaatcgtgctgtgtacactggaccggcacctgccctatgatcgaccaaaactcagcaaaagtctcgacactcagcccgaacagctggcactccgtccgaaggaatttttccgagcatatggcatcgaagtgctgactgaggcacaggtatag

SEQ ID NO: 25761 - DNA, 369 bp, Artificial Sequence
  Description of Artificial Sequence: Synthetic coding sequence
atggccaccagcgcccccctgcggagcctggaggaggaggtgacctgctccatttgcctagattacctgagagacccggtgactattgactgtggccatgtcttttgccggtcctgcactaccgatgtacgccccatttcagggtccaggccagtctgcccattgtgcaaaaaacctttcaaaaaagagaacataaggccagtgtggcagttggcctccctcgtcgaaaacatcgaaaggctgaaagtagataagggccgtcagcccggggaagtaaccagagagcagcaggacgcgaagctttgtgagagacaccgggagaaacttcactactactgcgaggacgatggcaagctcttgtgcgtatag

SEQ ID NO: 25762 - DNA, 1269 bp, Artificial Sequence
  Description of Artificial Sequence: Synthetic coding sequence
atgacccccagcatccccagcatccggcggctgggcagcggctacttctcctctaacgggaagctggaggaggtcaaaactccaaagaacccagtaaagagaaaagacctgcttagacacgatcccgacctgcacatgcaccagggatatgataagtacgacgttagtgagttttgttcctacattaagtcctcatctagccttggcaacgccacatccgatgaggatccaaacacaaatatcatgaatatcaatgagaacaagaatatccccaaggctaaaaataagtcagagagcgaaaacgagccgaaggccggcacagactctcctgtgtcatgtgcaagcgttacagaagagagagtggctagtgactccccgaagccggctctgaccctccaacagggacaagagttctctgcaggtggacagaatgccgaaaacctgtgtcagttctttaagatctcccccgacttgaacataaagtgcgagagaaaggacgattttctaggcgccgctgaaggtaagctgcagtgcaatcgcctaatgccgaattctcagaaggactgccactgcttgggagatgtacttatcgaaaacacaaaggagagcaagtctcagtcagaggaccttggcaggaaaccaatggagtctagttcagtggtctcatgccgagataggaaagacaggcgacgatctatgtgctactccgatggacgaagcctccacctcgaaaagaatggcaatcatactccaagtagcagcgttggaagttctgtggagataagtctcgaaaattcagaattgtttaaggacctcagcgacgctatcgagcagacttttcagagaaggaactctgagactaaggtccgcaggtctaccaggcttcagaaggatctcgagaacgagggtttggtctggatctcattacccctgccttccacaagtcagaaggccaaaagacgcaccatctgtacctttgactcatctggattcgagtccatgagccctattaaggagaccgtgtcctccaggcagaagccacagatggcgcccccagtctcagatcctgagaatagtcagggtcctgcagctggatcttctgacgaacccggaaagcgtaggaagagcttctgtatatccacacttgcgaatactaaagcaaccagtcagtttaaagggtaccggcgcagatccagtctcaacggcaagggggaaagctcacttactgccttagagcgaatcgagcacaatggcgagcgtaaacagtag

SEQ ID NO: 25763 - DNA, 3336 bp, Artificial Sequence
  Description of Artificial Sequence: Synthetic coding sequence
atggtgcgggagcggaagtgcatcctgtgccacatcgtgtacagctcaaagaaagagatggatgaacacatgcggagcatgctacaccaccgcgaactggagaacctgaaggggagattcggaattgaaatggtgcccctcgtgcagaacgagcaagaggcattagacttggatggagagccagacttgagctctctagaaggtttccagtgggaaggggtgagcattagttctagcccggggctcgcgcggaagcgctctctctccgaatcctctgtcattatggatagagccccaagtgtctacagcttcttttcagaagaaggcacagggaaggagaatgagcctcagcagatggttagcccctccaacagcttacgagccggccagtctcaaaaagcaacaatgcacctgaagcaggaagtgacccctcgagcagcgagcctgagaaccggggagagagcagagaacgtagccactcagagacgacacagcgcccaactctcatccgatcacattatccccctgatgcatttggcaaaagatctgaacagccaggaacgttccatacccccgtctgagaaccagaacagccaagagagtaacggggagggcaattgtctctcaagcagtgccagtagcgctctggctatctccagcttagccgacgccgccacggatagctcctgcacctcgggtgcagaacagaatgacggacagtccatccggaaaaaaagaagagcaacaggcgacgggagctcccctgagctgccaagtctggagagaaagaacaagagacgtaagataaaaggaaagaaagaaagatctcaagtcgatcaactcttgaacatttcccttagggaggaggaactgagtaagagcctacagtgtatggataacaatctcttgcaggccagggccgccctgcagacggcatacgtcgaggtacagcgccttctcatgctgaagcagcaaattacaatggagatgagtgcactgcgcacacaccgcatccagatcttgcagggacttcaggagacctacgagccatccgagcacccagatcaagttccctgctccttaacgcgtgaaaggaggaactcccgttcacagaccagtatcgacgctgcattgctccctaccccctttttccccttgttcttggagccacccagctctcatgtaagtcccagcccgaccggcgccagtctgcagataacaacatcgccgacctttcaaacacacggatccgttccagctcccgattcttccgtacaaatcaaacaggaaccaatgagccccgaacaggatgaaaatgttaacgccgttcctccatcttctgcatgcaatgtgtcaaaggaactcctcgaggccaacagagaaatctcggactcctgtcccgtatacccggtaattaccgccaggctttctctcccagagtccactgaaagtttccatgagcctagtcaggagctcaagtttagcgtggagcagagaaatacccgcaatcgtgaaaattcacccagctctcagtccgccggtctgtcttccattaataaggaaggagaggaacctaccaaaggcaatagcggctcagaggcctgcaccagctcctttttgcgattgtccttcgcatctgaaactcccctggagaaggaaccgcactccccggctgaccaaccggagcagcaggccgagagtaccctgactagtgccgagacgagaggttcaaagaagaagaagaagctgcgcaaaaaaaagtccctgcgcgctgctcacgttccggaaaactcagacaccgaacaggatgtattaacggttaaaccagtaaggaaggtaaaagcaggcaagctcatcaagggaggcaaggtgacaacttcaacatgggaagactcccggacaggcagagaacaagaatccgttcgcgacgagcctgattcggatagcagtctcgaggtgcttgagattccaaatccacaacttgaagttgtggcgatagattcaagcgagagtggcgaggagaagcccgattctccttcaaagaaggatatctggaattccactgaacaaaatccactggaaacgtccagaagtgggtgtgacgaggtgagcagcactagtgagatcgggacgcgctacaaggacggaatccctgtgagcgttgcagaaacccagacagttataagcagcatcaagggctccaagaactcttccgagatctcatctgaacctggcgacgacgacgagccgaccgaggggtcttttgagggacaccaggctgctgtgaacgccatccagatattcggcaatctgctgtacacctgctctgctgacaagactgttagggtctacaacctagtgagtagaaagtgtataggagtgttcgagggccacacttcaaaggttaattgcctcctagtgactcagacatccggtaaaaacgcggcgctttataccgggtcctctgaccacactattagatgttacaacgtcaagagcagagagtgcgtcgagcagctgcagctagaggatagggtgctgtgtctgcattccaggtggcgcattttatacgccggactggccaatggaaccgtggtcacatttaacatcaaaaataacaagaggctggagatttttgagtgtcacggacctagggccgttagttgtctggcgactgctcaggaaggtgccaggaaactccttgtcgttggctcatatgattgcaccatttcggtcagggacgctagaaacgggctcctgctccgaaccctcgaagggcactccaagaccatcctgtgtatgaaggtggttaatgacctcgtattttctggcagcagtgaccaatccgtccatgcacataacatacacaccggggaactggttcggatttataaaggccataaccatgcagtgacggtagtcaacattttaggcaaagtgatggtgacagcctgcctggacaagtttgtgcgcgtgtacgagctgcagtctcatgaccgcctgcaggtctatggcggccataaagacatgattatgtgcatgactattcacaaatctatgatttacacaggttgttacgacgggtccatccaggctgtgaggctgaacctcatgcagaactaccgatgttggtggcacggctgcagcctcatctttggtgtggtggaccacctgaagcagcacctgttgactgaccatacgaatccaaatttccagacactgaagtgtagatggaagaattgcgatgcattcttcaccgctcgcaagggcagtaagcaggatgcagcagggcatatcgagcggcatgcagaagatgattcaaagattgatagttag

SEQ ID NO: 25764 - DNA, 354 bp, Artificial Sequence
  Description of Artificial Sequence: Synthetic coding sequence
atgtacagccccatcatctaccaggccctgtgcgagcacgtgcagacccagatgagcttaatgaatgatctgactagtaagaatattccgaatggaatacctgcagttccctgtcacgccccctctcactccgaatcccaagccactccgcactcatcctacggattgtgcacttcgacaccagtttggagcttacagcgccccccttgcccaccaaaagttcattccgaggtgcagaccgatgggaactcccagtttgcttcccagggtaagacggtgagcgccacctgcaccgatgtacttagaaactcatttaacacatccccaggtgtcccttgctcgctgccaaagtag

SEQ ID NO: 25765 - DNA, 189 bp, Artificial Sequence
  Description of Artificial Sequence: Synthetic coding sequence
atggccgccctgcggcccctggtgaagcccaagatcgtgaagaagaggaccaagaagtttattagacaccagtccgatcggtacgtgaagattaaacggaactggcggaaaccccggggaatagataatagggtgaggcgaagatttaagggacagattctaatgcctaacatcggatacggctcctag

SEQ ID NO: 25766 - DNA, 411 bp, Artificial Sequence
  Description of Artificial Sequence: Synthetic coding sequence
atgagcgccagctgcgacggctgcgtgggcagccggccccccgtgcatcttgcaagcgggtatagcctcgccgatctactggtgttggagatgggtatgggaacccagtgttggacggaggaccagcgacgctggagctcactgtggccatggagccacctctcctccgtactcctagctgacaaagaggggggcccccccgctgttgacgaagtgctggacgaagctgtgcccgagtaccgggcacccggccggaagagtctgctcgagatcagacaactcgaccctgatgaccgatcccttgcaaagtacaaacgcgtgttactagggcccctacctcccgcagtggacccctccctgcccaacgtgcaggtaactaggttgactctgcttagcgaacaggcgccatag

SEQ ID NO: 25767 - DNA, 1803 bp, Artificial Sequence
  Description of Artificial Sequence: Synthetic coding sequence
atgcccgagatccgggtgacccccctgggcgccggccaggacgtgggacgcagttgtattctcgtcagcatcgccggaaagaacgttatgttagactgcggaatgcacatggggttcaatgatgataggagattccctgacttttcctatatcactcagaacgggcggttgactgactttttggactgcgtcatcatcagccacttccacctggaccactgtggggctttaccctacttcagtgagatggttggttatgacggcccaatatacatgacgcatcctactcaggccatatgccccattcttctggaggactatcgcaaaattgccgtggataagaaaggggaagccaatttttttactagccagatgattaaggactgcatgaaaaaagttgtggctgtgcaccttcaccagaccgtgcaggtcgacgatgaactggagataaaagcctactacgcaggccatgtattgggggccgcgatgttccagattaaagttggaagcgagtccgtggtgtacaccggcgattataacatgacccctgatcggcacctgggggccgcctggatcgacaaatgccggccaaacttgctgattaccgagagcacctatgctaccactatccgcgatagtaagagatgccgtgagagggacttcttgaaaaaggttcacgagacagtggagagaggtgggaaggtcctcatacccgtgttcgccttgggacgcgctcaggaactgtgtattcttttggagacattctgggaacgcatgaatcttaaggtgcccatatacttcagcacgggattaacggagaaggcaaaccattactacaagctctttatcccctggaccaatcagaagatccgaaaaacctttgtccaacggaacatgtttgagttcaaacacatcaaagccttcgatcgcgcctttgctgacaaccctggtcctatggtagtcttcgctacaccgggaatgctgcacgccggacagtcgctgcaaatctttcggaagtgggccggcaatgagaaaaatatggtgattatgccagggtattgcgtccaaggtaccgtgggtcacaaaatcctcagcgggcaaaggaaactggaaatggaaggcagacaggtcctagaagtgaaaatgcaggtggagtacatgagcttctctgcacatgcagatgccaaagggatcatgcagcttgtgggccaggcggagccagagagcgtgttgctggtacacggggaggctaaaaagatggagttcctcaaacaaaaaatcgagcaggagctccgcgttaactgttacatgccagcaaacggcgaaacagtgaccctccccaccagcccaagcatccctgtgggcatttctctcgggcttttgaagcgggaaatggcccagggactcctaccagaggcaaaaaaaccgcggctcctccacggcacactcatcatgaaagactcaaattttcgattagtgagctcagagcaagctctaaaggaactagggctagctgaacaccaactccgcttcacctgccgggtccacttacacgacactaggaaagaacaagagactgccctgagggtctacagtcacctcaagtccgtgctgaaggaccattgcgttcagcatctgccggatggctctgttactgttgaatcagtcttacttcaggccgccgctccatccgaagaccccggcaccaaagtccttttggtgagctggacatatcaagacgaagagctcgggagtttccttacatctcttttgaaaaagggccttccacaggcacctagctag

SEQ ID NO: 25768 - DNA, 774 bp, Artificial Sequence
  Description of Artificial Sequence: Synthetic coding sequence
atgctggagtacgccctgaagcaggagcgggccaagtaccacaagcttaaatttggcaccgacctcaatcagggggagaagaaggctgatgtctctgaacaagtctctaatggccccgtcgaatccgtgaccttggagaatagcccgcttgtgtggaaggaagggagacagcttctacggcagtacctcgaggaagttggctacaccgacaccatactcgacatgagatctaaacgcgtgcgtagtctcctcggcaggagtctggagctgaacggtgctgttgaaccctcagagggtgccccacgtgcccccccaggacccgcaggcctgtccgggggtgagtctctcctggtgaagcagatcgaggaacaaatcaagcgcaacgcagccggaaaggacggaaaggaaagactcggaggctcagtcctgggccagatccctttcttgcagaattgcgaagacgaggactcggacgaggatgacgagttagactctgtgcagcacaagaagcagcgagttaaattaccgtctaaggccctggtaccggaaatggaagatgaggatgaggaagatgattcagaagacgccataaatgagtttgatttcctggggagtggagaggacggggagggggcccctgaccctaggcgctgtaccgtggacggtagcccacacgaactgggccccgagctgcacagccccacagaatggcagggtgcactctctgtaggaaaggcctcccccatgcccgattgggtcggaactgcaggatag

SEQ ID NO: 25769 - DNA, 381 bp, Artificial Sequence
  Description of Artificial Sequence: Synthetic coding sequence
atgcccggcgtgaagctgaccacccaggcctactgcaagatggtgctgcatggagccaagtatccacattgcgcagtaaatggattgctggtggccgaaaaacagaaaccacggaaggaacatctgcctctgggcggacccggagcacaccacaccctcttcgtggactgtatccccctgtttcacggcactctcgctctcgcacccatgctcgaagttgccctcaccctgatcgacagctggtgtaaggaccattcctatgtcatcgccggatactatcaagcgaacgaacgagtgaaggacgcgtcccccaaccaagtcgcagaaaaggttgcgtctcgtatcgctgagggctttagcgacacagcactgattatgtag

SEQ ID NO: 25770 - DNA, 450 bp, Artificial Sequence
  Description of Artificial Sequence: Synthetic coding sequence
gtgcgggagctggaggccgagctggacgccgagcagaagaagcacgcggaagcgctgaagggggtgcgcaaacatgaaaggagggtgaaggagctggcctatcaggtgggcgatagggtgtccttaggctccggccccggagctggccctgcccaagcatctcctgagtcaccactgccggcacaggccgaagaggatcggaagaatctagcacgcatgcaggatcttgtcgataaactgcagagcaaggttaaaagctacaagagacagttcgaggaggcagagcaacaggctaataccaatctggctaagtaccgtaaagcccagcacgagctagacgacgccgaggagagagccgacatggcagagacacaggcaaataagctgcgggcccggacaagagacgcactgggaccaaaactgagtctatccccgcagcacaaagaatag

SEQ ID NO: 25771 - DNA, 2349 bp, Artificial Sequence
  Description of Artificial Sequence: Synthetic coding sequence
atggacagcagcatccacctgagcagcctgatcagccggcacgacgacgaggcaacacgaacatcgacatccgaaggactcgaagagggagaggtggaaggagagacactgcttatagttgagagtgaggaccaagcctccgtggatttatcacatgaccagtccggtgactctctcaactccgatgagggcgatgtgagctggatggaggaacagctgagctacttctgtgataaatgccagaaatggatccccgcctctcagctgcgagaacaactgtcttacctcaagggagacaacttcttcaggtttacatgttctgattgcagcgccgacggtaaagagcagtacgaaaggctaaagttgacatggcagcaggtcgtaatgttggctatgtataatctgtcactggaaggctcaggccggcagggctacttccgctggaaggaggacatttgtgcctttattgagaagcactggacgttcctcctgggcaataggaaaaagacctcaacctggtggtcgactgtagctggctgccttagcgtggggagcccgatgtatttccggtccggagcacaagagtttggggagcctggatggtggaagctggtccataacaagcctccgaccatgaagcctgagggcgagaagttgtctgcttcaacgttgaaaataaaggccgccagtaaacctactctcgacccaatcatcaccgtcgaaggactcaggaaacgagcttcgcgcaaccccgtggaatctgccatggagctgaaagaaaaaagaagtagaacgcaagaggctaaggacatcaggagggcccaaaaagaagctgccggatttctggataggtcaacgtccagtacccccgtgaagttcatttcaagagggcggcgtccagacgttattctggaaaagggggaagtcatcgatttcagctccctaagctcaagcgataggaccccactgacgtccccaagtccgagcccgtctctggacttctccgcacctggtactccagcctctcattccgccaccccgtcacttttatcagaggctgatctgatcccggatgtgatgcctccacaggcgctgttccatgacgacgacgagatggaaggagacggcgtgatcgaccccggcatggagtatgtgcccccccctgcgggctccgttgcaagcgggccagttgttggggtgaggaaaaaggtgcgcggcccagagcagattaagcaggaggtagagagcgaagaggaaaaaccagacaggatggatattgacagtgaggacaccgatagcaacacaagcttgcagaccagggcccgtgaaaagaggaagccacagttagaaaaggacacgaagcccaaggaaccacgatatactcccgttagcatctatgaggagaaactactgctgaagagactcgaggcgtgcccgggcgctgtggcaatgacccccgaggccagacgccttaaaagaaagctgattgtgcggcaggctaagcgcgatcggggactcccactgtttgacctggaccaggtggtaaacgctgcactgctgttggtggacggcatttacggggccaaggagggcgggatctcaagattgcctgcaggccaggccacatatcgaacaacctgtcaggactttcgcatcctagaccgctaccagacttccttaccatcccgaaaaggcttccggcatcagacgacaaagttcctgtataggcttgtcggctccgaggacatggccgtggatcagtccatcgtgtctccatatacgtctcgcatccttaagccctacattcgccgcgattacgagaccaaaccccccaaactccagctgctcagtcaaatcagatcacacctccacaggtccgatcctcactggacaccagagccggatgctcctctagactactgttacgtgaggccaaaccacatccctactatcaatagtatgtgccaagagtttttctggccaggcatcgacctgagtgagtgccttcagtaccctgactttagtgtggtagtgctgtacaagaaggtgataattgccttcggtttcatggtacccgatgtaaagtacaacgaagcctatatctctttcctttttgtgcatcctgaatggagaagggccggaatcgctacatttatgatctatcacctaatccagacatgtatgggcaaggacgtcacactgcatgtgtcggccagtaaccccgctatgctcctataccagaagttcggcttcaaaacagaagagtacgtgctcgatttctacgacaagtactaccccctggagagcaccgagtgcaagcatgccttcttcctgaggctcagacggtag

SEQ ID NO: 25772 - DNA, 495 bp, Artificial Sequence
  Description of Artificial Sequence: Synthetic coding sequence
atgatgagcgaggtggaggaggccatgcagtgcgtggaggagctgaacgcccagggattgctgcatgtatttgtgagggtcggcgtggagtccactcttgaacgcagtcagatcacacgtgaccacatggggcagctactgtatcagctggtccagtcagaaaagctgagcaaacaagacttcttcaagggcttcagtgagaccttagaactagctgacgatatggccatcgacattccacacatttggctttacttagccgagctggtcacacctatgctgaaggaaggtgggatctccatgcgggaattaaccatcgagttctcaaaaccccttctcccagtcggcagggccggtgtgttactaagcgagatcctccatttgttgtgcaaacaaatgagtcataagaaggtgggtgcactatggagggaggcggatctgtcctggaaagatttccttccagaaggtgaggacgttcacaacttcctgctttag

SEQ ID NO: 25773 - DNA, 369 bp, Artificial Sequence
  Description of Artificial Sequence: Synthetic coding sequence
atggccaccagcgcccccctgcggagcctggaggaggaggtgacctgtagcatttgtctggactacctgcgagacccagtgaccatcgattgtggacatgtgttttgccggtcttgtacgacagacgtacgacctataagcggtagtcgtcccgtttgtccactttgcaaaaaaccttttaagaaggagaacatcaggcctgtgtggcagctcgcctccctcgtggagaatatagaacgcctcaaagtggacaaaggtaggcagcccggcgaggttaccagagagcagcaggacgccaagctgtgcgaacgccaccgagaaaagttgcactactattgcgaggacgatggcaagcttttgtgcgtgtag
